United States Patent 8,877,916 (PROMOTER, PROMOTER CONTROL ELEMENTS, AND COMBINATIONS, AND USES THEREOF) - sequence listing, part 25

SEQ ID NO: 119836 - DNA, 9 bp, Unknown
  misc_feature (1)..( 9): Result.002 file - promoters60/1557730
atcaaatta

SEQ ID NO: 119837 - DNA, 9 bp, Unknown
  misc_feature (1)..( 9): Result.002 file - promoters60/1557730
atcatatta

SEQ ID NO: 119838 - DNA, 8 bp, Unknown
  misc_feature (1)..( 8): Result.002 file - promoters60/1557730
taaaaaaa

SEQ ID NO: 119839 - DNA, 8 bp, Unknown
  misc_feature (1)..( 8): Result.002 file - promoters60/1557730
taagaaaa

SEQ ID NO: 119840 - DNA, 7 bp, Unknown
  misc_feature (1)..( 7): Result.002 file - promoters60/1557730
acagaaa

SEQ ID NO: 119841 - DNA, 7 bp, Unknown
  misc_feature (1)..( 7): Result.002 file - promoters60/1557730
acaaaaa

SEQ ID NO: 119842 - DNA, 6 bp, Unknown
  misc_feature (1)..( 6): Result.002 file - promoters60/1557730
cacctt

SEQ ID NO: 119843 - DNA, 6 bp, Unknown
  misc_feature (1)..( 6): Result.002 file - promoters60/1557730
cacctt

SEQ ID NO: 119844 - DNA, 8 bp, Unknown
  misc_feature (1)..( 8): Result.002 file - promoters60/1557730
caccatca

SEQ ID NO: 119845 - DNA, 8 bp, Unknown
  misc_feature (1)..( 8): Result.002 file - promoters60/1557730
caccttca

SEQ ID NO: 119846 - DNA, 7 bp, Unknown
  misc_feature (1)..( 7): Result.002 file - promoters60/1557730
atgaaaa

SEQ ID NO: 119847 - DNA, 7 bp, Unknown
  misc_feature (1)..( 7): Result.002 file - promoters60/1557730
atgaaaa

SEQ ID NO: 119848 - DNA, 6 bp, Unknown
  misc_feature (1)..( 6): Result.002 file - promoters60/1557730
ccatcc

SEQ ID NO: 119849 - DNA, 6 bp, Unknown
  misc_feature (1)..( 6): Result.002 file - promoters60/1557730
ccatcc

SEQ ID NO: 119850 - DNA, 7 bp, Unknown
  misc_feature (1)..( 7): Result.002 file - promoters60/1557775
tttgttc

SEQ ID NO: 119851 - DNA, 7 bp, Unknown
  misc_feature (1)..( 7): Result.002 file - promoters60/1557775
ttttttc

SEQ ID NO: 119852 - DNA, 7 bp, Unknown
  misc_feature (1)..( 7): Result.002 file - promoters60/1557775
attatat

SEQ ID NO: 119853 - DNA, 7 bp, Unknown
  misc_feature (1)..( 7): Result.002 file - promoters60/1557775
attctat

SEQ ID NO: 119854 - DNA, 6 bp, Unknown
  misc_feature (1)..( 6): Result.002 file - promoters60/1557775
aaaaga

SEQ ID NO: 119855 - DNA, 6 bp, Unknown
  misc_feature (1)..( 6): Result.002 file - promoters60/1557775
aaaaga

SEQ ID NO: 119856 - DNA, 6 bp, Unknown
  misc_feature (1)..( 6): Result.002 file - promoters60/1557775
ttcggt

SEQ ID NO: 119857 - DNA, 6 bp, Unknown
  misc_feature (1)..( 6): Result.002 file - promoters60/1557775
ttcggt

SEQ ID NO: 119858 - DNA, 8 bp, Unknown
  misc_feature (1)..( 8): Result.002 file - promoters60/1557775
cactcaaa

SEQ ID NO: 119859 - DNA, 8 bp, Unknown
  misc_feature (1)..( 8): Result.002 file - promoters60/1557775
cacacaaa

SEQ ID NO: 119860 - DNA, 7 bp, Unknown
  misc_feature (1)..( 7): Result.002 file - promoters60/1557775
ggattcg

SEQ ID NO: 119861 - DNA, 7 bp, Unknown
  misc_feature (1)..( 7): Result.002 file - promoters60/1557775
ggattcg

SEQ ID NO: 119862 - DNA, 6 bp, Unknown
  misc_feature (1)..( 6): Result.002 file - promoters60/1557775
gaaacg

SEQ ID NO: 119863 - DNA, 6 bp, Unknown
  misc_feature (1)..( 6): Result.002 file - promoters60/1557775
gaaacg

SEQ ID NO: 119864 - DNA, 7 bp, Unknown
  misc_feature (1)..( 7): Result.002 file - promoters60/1557775
agtttct

SEQ ID NO: 119865 - DNA, 7 bp, Unknown
  misc_feature (1)..( 7): Result.002 file - promoters60/1557775
agtttct

SEQ ID NO: 119866 - DNA, 10 bp, Unknown
  misc_feature (1)..( 10): Result.002 file - promoters60/1557775
aacaacaagt

SEQ ID NO: 119867 - DNA, 10 bp, Unknown
  misc_feature (1)..( 10): Result.002 file - promoters60/1557775
aacaacgagt

SEQ ID NO: 119868 - DNA, 6 bp, Unknown
  misc_feature (1)..( 6): Result.002 file - promoters60/1557775
ttgact

SEQ ID NO: 119869 - DNA, 6 bp, Unknown
  misc_feature (1)..( 6): Result.002 file - promoters60/1557775
ttgact

SEQ ID NO: 119870 - DNA, 6 bp, Unknown
  misc_feature (1)..( 6): Result.002 file - promoters60/1557775
tataaa

SEQ ID NO: 119871 - DNA, 6 bp, Unknown
  misc_feature (1)..( 6): Result.002 file - promoters60/1557775
tataaa

SEQ ID NO: 119872 - DNA, 8 bp, Unknown
  misc_feature (1)..( 8): Result.002 file - promoters60/1557775
ggccaagt

SEQ ID NO: 119873 - DNA, 8 bp, Unknown
  misc_feature (1)..( 8): Result.002 file - promoters60/1557775
ggcgaagt

SEQ ID NO: 119874 - DNA, 6 bp, Unknown
  misc_feature (1)..( 6): Result.002 file - promoters60/1557775
aagaaa

SEQ ID NO: 119875 - DNA, 6 bp, Unknown
  misc_feature (1)..( 6): Result.002 file - promoters60/1557775
aagaaa

SEQ ID NO: 119876 - DNA, 6 bp, Unknown
  misc_feature (1)..( 6): Result.002 file - promoters60/1557775
gaatca

SEQ ID NO: 119877 - DNA, 6 bp, Unknown
  misc_feature (1)..( 6): Result.002 file - promoters60/1557775
gaatca

SEQ ID NO: 119878 - DNA, 7 bp, Unknown
  misc_feature (1)..( 7): Result.002 file - promoters60/1557775
tccggtt

SEQ ID NO: 119879 - DNA, 7 bp, Unknown
  misc_feature (1)..( 7): Result.002 file - promoters60/1557775
tccagtt

SEQ ID NO: 119880 - DNA, 6 bp, Unknown
  misc_feature (1)..( 6): Result.002 file - promoters60/1557775
tttccg

SEQ ID NO: 119881 - DNA, 6 bp, Unknown
  misc_feature (1)..( 6): Result.002 file - promoters60/1557775
tttccg

SEQ ID NO: 119882 - DNA, 6 bp, Unknown
  misc_feature (1)..( 6): Result.002 file - promoters60/1557775
ataaat

SEQ ID NO: 119883 - DNA, 6 bp, Unknown
  misc_feature (1)..( 6): Result.002 file - promoters60/1557775
ataaat

SEQ ID NO: 119884 - DNA, 6 bp, Unknown
  misc_feature (1)..( 6): Result.002 file - promoters60/1557775
aaccct

SEQ ID NO: 119885 - DNA, 6 bp, Unknown
  misc_feature (1)..( 6): Result.002 file - promoters60/1557775
aaccct

SEQ ID NO: 119886 - DNA, 11 bp, Unknown
  misc_feature (1)..( 11): Result.002 file - promoters60/1557783
aagtgtagatt

SEQ ID NO: 119887 - DNA, 11 bp, Unknown
  misc_feature (1)..( 11): Result.002 file - promoters60/1557783
aagtgttggtt

SEQ ID NO: 119888 - DNA, 11 bp, Unknown
  misc_feature (1)..( 11): Result.002 file - promoters60/1557783
tagtattgaga

SEQ ID NO: 119889 - DNA, 11 bp, Unknown
  misc_feature (1)..( 11): Result.002 file - promoters60/1557783
ccctatattat

SEQ ID NO: 119890 - DNA, 11 bp, Unknown
  misc_feature (1)..( 11): Result.002 file - promoters60/1557783
gattgtaatct

SEQ ID NO: 119891 - DNA, 13 bp, Unknown
  misc_feature (1)..( 13): Result.002 file - promoters60/1557783
aacgcaaatattt

SEQ ID NO: 119892 - DNA, 13 bp, Unknown
  misc_feature (1)..( 13): Result.002 file - promoters60/1557783
aaaacaaatatta

SEQ ID NO: 119893 - DNA, 13 bp, Unknown
  misc_feature (1)..( 13): Result.002 file - promoters60/1557783
agtcctaatttta

SEQ ID NO: 119894 - DNA, 13 bp, Unknown
  misc_feature (1)..( 13): Result.002 file - promoters60/1557783
aaaacaaatttaa

SEQ ID NO: 119895 - DNA, 13 bp, Unknown
  misc_feature (1)..( 13): Result.002 file - promoters60/1557783
gaaccgaaactat

SEQ ID NO: 119896 - DNA, 11 bp, Unknown
  misc_feature (1)..( 11): Result.002 file - promoters60/1557783
ttatgtttctc

SEQ ID NO: 119897 - DNA, 11 bp, Unknown
  misc_feature (1)..( 11): Result.002 file - promoters60/1557783
atgtgtttctc

SEQ ID NO: 119898 - DNA, 11 bp, Unknown
  misc_feature (1)..( 11): Result.002 file - promoters60/1557783
atgggtttgaa

SEQ ID NO: 119899 - DNA, 11 bp, Unknown
  misc_feature (1)..( 11): Result.002 file - promoters60/1557783
tagtgattcca

SEQ ID NO: 119900 - DNA, 10 bp, Unknown
  misc_feature (1)..( 10): Result.002 file - promoters60/1557783
agttataaat

SEQ ID NO: 119901 - DNA, 10 bp, Unknown
  misc_feature (1)..( 10): Result.002 file - promoters60/1557783
gtatatgaat

SEQ ID NO: 119902 - DNA, 10 bp, Unknown
  misc_feature (1)..( 10): Result.002 file - promoters60/1557783
gtttatgaat

SEQ ID NO: 119903 - DNA, 10 bp, Unknown
  misc_feature (1)..( 10): Result.002 file - promoters60/1557783
tgtaataaat

SEQ ID NO: 119904 - DNA, 10 bp, Unknown
  misc_feature (1)..( 10): Result.002 file - promoters60/1557783
gtagatgaga

SEQ ID NO: 119905 - DNA, 12 bp, Unknown
  misc_feature (1)..( 12): Result.002 file - promoters60/1557783
cgacgaagattc

SEQ ID NO: 119906 - DNA, 12 bp, Unknown
  misc_feature (1)..( 12): Result.002 file - promoters60/1557783
acacgtagatga

SEQ ID NO: 119907 - DNA, 12 bp, Unknown
  misc_feature (1)..( 12): Result.002 file - promoters60/1557783
aaaagtatatga

SEQ ID NO: 119908 - DNA, 12 bp, Unknown
  misc_feature (1)..( 12): Result.002 file - promoters60/1557783
acaagtagaaga

SEQ ID NO: 119909 - DNA, 8 bp, Unknown
  misc_feature (1)..( 8): Result.002 file - promoters60/1557783
tttgtaaa

SEQ ID NO: 119910 - DNA, 8 bp, Unknown
  misc_feature (1)..( 8): Result.002 file - promoters60/1557783
attgtaat

SEQ ID NO: 119911 - DNA, 8 bp, Unknown
  misc_feature (1)..( 8): Result.002 file - promoters60/1557783
aatgtaaa

SEQ ID NO: 119912 - DNA, 8 bp, Unknown
  misc_feature (1)..( 8): Result.002 file - promoters60/1557783
tttgtaat

SEQ ID NO: 119913 - DNA, 7 bp, Unknown
  misc_feature (1)..( 7): Result.002 file - promoters60/1557806
ggatgaa

SEQ ID NO: 119914 - DNA, 7 bp, Unknown
  misc_feature (1)..( 7): Result.002 file - promoters60/1557806
ggaagaa

SEQ ID NO: 119915 - DNA, 6 bp, Unknown
  misc_feature (1)..( 6): Result.002 file - promoters60/1557806
agaaga

SEQ ID NO: 119916 - DNA, 6 bp, Unknown
  misc_feature (1)..( 6): Result.002 file - promoters60/1557806
agaaga

SEQ ID NO: 119917 - DNA, 6 bp, Unknown
  misc_feature (1)..( 6): Result.002 file - promoters60/1557806
gaagaa

SEQ ID NO: 119918 - DNA, 6 bp, Unknown
  misc_feature (1)..( 6): Result.002 file - promoters60/1557806
gaagaa

SEQ ID NO: 119919 - DNA, 9 bp, Unknown
  misc_feature (1)..( 9): Result.002 file - promoters60/1557806
tcttagcaa

SEQ ID NO: 119920 - DNA, 9 bp, Unknown
  misc_feature (1)..( 9): Result.002 file - promoters60/1557806
tcttatcaa

SEQ ID NO: 119921 - DNA, 10 bp, Unknown
  misc_feature (1)..( 10): Result.002 file - promoters60/1557806
aagaatctgt

SEQ ID NO: 119922 - DNA, 10 bp, Unknown
  misc_feature (1)..( 10): Result.002 file - promoters60/1557806
gataatttgt

SEQ ID NO: 119923 - DNA, 10 bp, Unknown
  misc_feature (1)..( 10): Result.002 file - promoters60/1557806
gatgatttga

SEQ ID NO: 119924 - DNA, 8 bp, Unknown
  misc_feature (1)..( 8): Result.002 file - promoters60/1557806
tataaatt

SEQ ID NO: 119925 - DNA, 8 bp, Unknown
  misc_feature (1)..( 8): Result.002 file - promoters60/1557806
tataaatt

SEQ ID NO: 119926 - DNA, 8 bp, Unknown
  misc_feature (1)..( 8): Result.002 file - promoters60/1557806
tttcattt

SEQ ID NO: 119927 - DNA, 8 bp, Unknown
  misc_feature (1)..( 8): Result.002 file - promoters60/1557806
tttaattt

SEQ ID NO: 119928 - DNA, 7 bp, Unknown
  misc_feature (1)..( 7): Result.002 file - promoters60/1557806
aaaccaa

SEQ ID NO: 119929 - DNA, 7 bp, Unknown
  misc_feature (1)..( 7): Result.002 file - promoters60/1557806
aaatcaa

SEQ ID NO: 119930 - DNA, 6 bp, Unknown
  misc_feature (1)..( 6): Result.002 file - promoters60/1557806
aaccga

SEQ ID NO: 119931 - DNA, 6 bp, Unknown
  misc_feature (1)..( 6): Result.002 file - promoters60/1557806
aaccga

SEQ ID NO: 119932 - DNA, 6 bp, Unknown
  misc_feature (1)..( 6): Result.002 file - promoters60/1557806
caagtt

SEQ ID NO: 119933 - DNA, 6 bp, Unknown
  misc_feature (1)..( 6): Result.002 file - promoters60/1557806
caagtt

SEQ ID NO: 119934 - DNA, 6 bp, Unknown
  misc_feature (1)..( 6): Result.002 file - promoters60/1557806
acagtg

SEQ ID NO: 119935 - DNA, 6 bp, Unknown
  misc_feature (1)..( 6): Result.002 file - promoters60/1557806
acagtg

SEQ ID NO: 119936 - DNA, 6 bp, Unknown
  misc_feature (1)..( 6): Result.002 file - promoters60/1557806
gaactt

SEQ ID NO: 119937 - DNA, 6 bp, Unknown
  misc_feature (1)..( 6): Result.002 file - promoters60/1557806
gaactt

SEQ ID NO: 119938 - DNA, 8 bp, Unknown
  misc_feature (1)..( 8): Result.002 file - promoters60/1557806
aatttatt

SEQ ID NO: 119939 - DNA, 8 bp, Unknown
  misc_feature (1)..( 8): Result.002 file - promoters60/1557806
aattgatt

SEQ ID NO: 119940 - DNA, 6 bp, Unknown
  misc_feature (1)..( 6): Result.002 file - promoters60/1557806
aaaatt

SEQ ID NO: 119941 - DNA, 6 bp, Unknown
  misc_feature (1)..( 6): Result.002 file - promoters60/1557806
aaaatt

SEQ ID NO: 119942 - DNA, 10 bp, Unknown
  misc_feature (1)..( 10): Result.002 file - promoters60/1557806
tatgttttgg

SEQ ID NO: 119943 - DNA, 10 bp, Unknown
  misc_feature (1)..( 10): Result.002 file - promoters60/1557806
tatgctttgg

SEQ ID NO: 119944 - DNA, 8 bp, Unknown
  misc_feature (1)..( 8): Result.002 file - promoters60/1557806
ttcacaga

SEQ ID NO: 119945 - DNA, 8 bp, Unknown
  misc_feature (1)..( 8): Result.002 file - promoters60/1557806
ttcacaga

SEQ ID NO: 119946 - DNA, 6 bp, Unknown
  misc_feature (1)..( 6): Result.002 file - promoters60/1557806
tcttgt

SEQ ID NO: 119947 - DNA, 6 bp, Unknown
  misc_feature (1)..( 6): Result.002 file - promoters60/1557806
tcttgt

SEQ ID NO: 119948 - DNA, 6 bp, Unknown
  misc_feature (1)..( 6): Result.002 file - promoters60/1557806
gtgtgc

SEQ ID NO: 119949 - DNA, 6 bp, Unknown
  misc_feature (1)..( 6): Result.002 file - promoters60/1557806
gtgtgc

SEQ ID NO: 119950 - DNA, 12 bp, Unknown
  misc_feature (1)..( 12): Result.002 file - promoters60/1565965
gtaccattggga

SEQ ID NO: 119951 - DNA, 12 bp, Unknown
  misc_feature (1)..( 12): Result.002 file - promoters60/1565965
agaacattggat

SEQ ID NO: 119952 - DNA, 12 bp, Unknown
  misc_feature (1)..( 12): Result.002 file - promoters60/1565965
agaaaatttgat

SEQ ID NO: 119953 - DNA, 12 bp, Unknown
  misc_feature (1)..( 12): Result.002 file - promoters60/1565965
cgaaaatcgcgt

SEQ ID NO: 119954 - DNA, 9 bp, Unknown
  misc_feature (1)..( 9): Result.002 file - promoters60/1565965
ttttatagt

SEQ ID NO: 119955 - DNA, 9 bp, Unknown
  misc_feature (1)..( 9): Result.002 file - promoters60/1565965
gtttataaa

SEQ ID NO: 119956 - DNA, 9 bp, Unknown
  misc_feature (1)..( 9): Result.002 file - promoters60/1565965
ttttatagt

SEQ ID NO: 119957 - DNA, 9 bp, Unknown
  misc_feature (1)..( 9): Result.002 file - promoters60/1565965
cattatagt

SEQ ID NO: 119958 - DNA, 8 bp, Unknown
  misc_feature (1)..( 8): Result.002 file - promoters60/1565965
attgatcg

SEQ ID NO: 119959 - DNA, 8 bp, Unknown
  misc_feature (1)..( 8): Result.002 file - promoters60/1565965
tttgttcg

SEQ ID NO: 119960 - DNA, 8 bp, Unknown
  misc_feature (1)..( 8): Result.002 file - promoters60/1565965
attaatcg

SEQ ID NO: 119961 - DNA, 8 bp, Unknown
  misc_feature (1)..( 8): Result.002 file - promoters60/1565965
cttgttct

SEQ ID NO: 119962 - DNA, 8 bp, Unknown
  misc_feature (1)..( 8): Result.002 file - promoters60/1565965
attgttct

SEQ ID NO: 119963 - DNA, 15 bp, Unknown
  misc_feature (1)..( 15): Result.002 file - promoters60/1565965
taaagagtaaagacc

SEQ ID NO: 119964 - DNA, 15 bp, Unknown
  misc_feature (1)..( 15): Result.002 file - promoters60/1565965
taaatagtaacggga

SEQ ID NO: 119965 - DNA, 15 bp, Unknown
  misc_feature (1)..( 15): Result.002 file - promoters60/1565965
tttatagtaaccgga

SEQ ID NO: 119966 - DNA, 15 bp, Unknown
  misc_feature (1)..( 15): Result.002 file - promoters60/1565965
attatagtcccttaa

SEQ ID NO: 119967 - DNA, 8 bp, Unknown
  misc_feature (1)..( 8): Result.002 file - promoters60/1565965
ccgtactt

SEQ ID NO: 119968 - DNA, 8 bp, Unknown
  misc_feature (1)..( 8): Result.002 file - promoters60/1565965
atgtactt

SEQ ID NO: 119969 - DNA, 8 bp, Unknown
  misc_feature (1)..( 8): Result.002 file - promoters60/1565965
ttgttctt

SEQ ID NO: 119970 - DNA, 8 bp, Unknown
  misc_feature (1)..( 8): Result.002 file - promoters60/1565965
ttgttctc

SEQ ID NO: 119971 - DNA, 7 bp, Unknown
  misc_feature (1)..( 7): Result.002 file - promoters60/1566253
tgggttt

SEQ ID NO: 119972 - DNA, 7 bp, Unknown
  misc_feature (1)..( 7): Result.002 file - promoters60/1566253
tggtttt

SEQ ID NO: 119973 - DNA, 6 bp, Unknown
  misc_feature (1)..( 6): Result.002 file - promoters60/1566253
ttgttg

SEQ ID NO: 119974 - DNA, 6 bp, Unknown
  misc_feature (1)..( 6): Result.002 file - promoters60/1566253
ttgttg

SEQ ID NO: 119975 - DNA, 6 bp, Unknown
  misc_feature (1)..( 6): Result.002 file - promoters60/1566253
agtaaa

SEQ ID NO: 119976 - DNA, 6 bp, Unknown
  misc_feature (1)..( 6): Result.002 file - promoters60/1566253
agtaaa

SEQ ID NO: 119977 - DNA, 7 bp, Unknown
  misc_feature (1)..( 7): Result.002 file - promoters60/1566253
aagaaaa

SEQ ID NO: 119978 - DNA, 7 bp, Unknown
  misc_feature (1)..( 7): Result.002 file - promoters60/1566253
aagtaaa

SEQ ID NO: 119979 - DNA, 9 bp, Unknown
  misc_feature (1)..( 9): Result.002 file - promoters60/1566253
gagcctgat

SEQ ID NO: 119980 - DNA, 9 bp, Unknown
  misc_feature (1)..( 9): Result.002 file - promoters60/1566253
gagtctgat

SEQ ID NO: 119981 - DNA, 6 bp, Unknown
  misc_feature (1)..( 6): Result.002 file - promoters60/1566253
aattgc

SEQ ID NO: 119982 - DNA, 6 bp, Unknown
  misc_feature (1)..( 6): Result.002 file - promoters60/1566253
aattgc

SEQ ID NO: 119983 - DNA, 6 bp, Unknown
  misc_feature (1)..( 6): Result.002 file - promoters60/1566253
tccaaa

SEQ ID NO: 119984 - DNA, 6 bp, Unknown
  misc_feature (1)..( 6): Result.002 file - promoters60/1566253
tccaaa

SEQ ID NO: 119985 - DNA, 6 bp, Unknown
  misc_feature (1)..( 6): Result.002 file - promoters60/1566253
aaacga

SEQ ID NO: 119986 - DNA, 6 bp, Unknown
  misc_feature (1)..( 6): Result.002 file - promoters60/1566253
aaacga

SEQ ID NO: 119987 - DNA, 6 bp, Unknown
  misc_feature (1)..( 6): Result.002 file - promoters60/1566253
tctaaa

SEQ ID NO: 119988 - DNA, 6 bp, Unknown
  misc_feature (1)..( 6): Result.002 file - promoters60/1566253
tctaaa

SEQ ID NO: 119989 - DNA, 8 bp, Unknown
  misc_feature (1)..( 8): Result.002 file - promoters60/1566253
aacacaaa

SEQ ID NO: 119990 - DNA, 8 bp, Unknown
  misc_feature (1)..( 8): Result.002 file - promoters60/1566253
aacaaaaa

SEQ ID NO: 119991 - DNA, 6 bp, Unknown
  misc_feature (1)..( 6): Result.002 file - promoters60/1566253
ttgact

SEQ ID NO: 119992 - DNA, 6 bp, Unknown
  misc_feature (1)..( 6): Result.002 file - promoters60/1566253
ttgact

SEQ ID NO: 119993 - DNA, 8 bp, Unknown
  misc_feature (1)..( 8): Result.002 file - promoters60/1566253
ccaagacg

SEQ ID NO: 119994 - DNA, 8 bp, Unknown
  misc_feature (1)..( 8): Result.002 file - promoters60/1566253
ccaagacg

SEQ ID NO: 119995 - DNA, 7 bp, Unknown
  misc_feature (1)..( 7): Result.002 file - promoters60/1566253
aggccca

SEQ ID NO: 119996 - DNA, 7 bp, Unknown
  misc_feature (1)..( 7): Result.002 file - promoters60/1566253
aggccca

SEQ ID NO: 119997 - DNA, 6 bp, Unknown
  misc_feature (1)..( 6): Result.002 file - promoters60/1566423
tcaaaa

SEQ ID NO: 119998 - DNA, 6 bp, Unknown
  misc_feature (1)..( 6): Result.002 file - promoters60/1566423
tcaaaa

SEQ ID NO: 119999 - DNA, 8 bp, Unknown
  misc_feature (1)..( 8): Result.002 file - promoters60/1566423
aaatcata

SEQ ID NO: 120000 - DNA, 8 bp, Unknown
  misc_feature (1)..( 8): Result.002 file - promoters60/1566423
aaataata

SEQ ID NO: 120001 - DNA, 7 bp, Unknown
  misc_feature (1)..( 7): Result.002 file - promoters60/1566423
taggtaa

SEQ ID NO: 120002 - DNA, 7 bp, Unknown
  misc_feature (1)..( 7): Result.002 file - promoters60/1566423
tagataa

SEQ ID NO: 120003 - DNA, 12 bp, Unknown
  misc_feature (1)..( 12): Result.002 file - promoters60/1566423
ctgaaatatatt

SEQ ID NO: 120004 - DNA, 12 bp, Unknown
  misc_feature (1)..( 12): Result.002 file - promoters60/1566423
ctgaaataaatt

SEQ ID NO: 120005 - DNA, 6 bp, Unknown
  misc_feature (1)..( 6): Result.002 file - promoters60/1566423
ttatgt

SEQ ID NO: 120006 - DNA, 6 bp, Unknown
  misc_feature (1)..( 6): Result.002 file - promoters60/1566423
ttatgt

SEQ ID NO: 120007 - DNA, 11 bp, Unknown
  misc_feature (1)..( 11): Result.002 file - promoters60/1566423
tttgtaaacaa

SEQ ID NO: 120008 - DNA, 11 bp, Unknown
  misc_feature (1)..( 11): Result.002 file - promoters60/1566423
tttgtatacaa

SEQ ID NO: 120009 - DNA, 9 bp, Unknown
  misc_feature (1)..( 9): Result.002 file - promoters60/1566423
tatattatt

SEQ ID NO: 120010 - DNA, 9 bp, Unknown
  misc_feature (1)..( 9): Result.002 file - promoters60/1566423
tattttatt

SEQ ID NO: 120011 - DNA, 9 bp, Unknown
  misc_feature (1)..( 9): Result.002 file - promoters60/1566423
attaaaatt

SEQ ID NO: 120012 - DNA, 9 bp, Unknown
  misc_feature (1)..( 9): Result.002 file - promoters60/1566423
attaatatt

SEQ ID NO: 120013 - DNA, 7 bp, Unknown
  misc_feature (1)..( 7): Result.002 file - promoters60/1566423
gaccaaa

SEQ ID NO: 120014 - DNA, 7 bp, Unknown
  misc_feature (1)..( 7): Result.002 file - promoters60/1566423
gacaaaa

SEQ ID NO: 120015 - DNA, 7 bp, Unknown
  misc_feature (1)..( 7): Result.002 file - promoters60/1566423
ttcaata

SEQ ID NO: 120016 - DNA, 7 bp, Unknown
  misc_feature (1)..( 7): Result.002 file - promoters60/1566423
ttccata

SEQ ID NO: 120017 - DNA, 8 bp, Unknown
  misc_feature (1)..( 8): Result.002 file - promoters60/1566423
atttcaca

SEQ ID NO: 120018 - DNA, 8 bp, Unknown
  misc_feature (1)..( 8): Result.002 file - promoters60/1566423
attttaca

SEQ ID NO: 120019 - DNA, 6 bp, Unknown
  misc_feature (1)..( 6): Result.002 file - promoters60/1566423
tattta

SEQ ID NO: 120020 - DNA, 6 bp, Unknown
  misc_feature (1)..( 6): Result.002 file - promoters60/1566423
tattta

SEQ ID NO: 120021 - DNA, 6 bp, Unknown
  misc_feature (1)..( 6): Result.002 file - promoters60/1566423
taaaac

SEQ ID NO: 120022 - DNA, 6 bp, Unknown
  misc_feature (1)..( 6): Result.002 file - promoters60/1566423
taaaac

SEQ ID NO: 120023 - DNA, 6 bp, Unknown
  misc_feature (1)..( 6): Result.002 file - promoters60/1566423
cccaat

SEQ ID NO: 120024 - DNA, 6 bp, Unknown
  misc_feature (1)..( 6): Result.002 file - promoters60/1566423
cccaat

SEQ ID NO: 120025 - DNA, 11 bp, Unknown
  misc_feature (1)..( 11): Result.002 file - promoters60/1566423
aagcaaagagg

SEQ ID NO: 120026 - DNA, 11 bp, Unknown
  misc_feature (1)..( 11): Result.002 file - promoters60/1566423
aaggaaacagg

SEQ ID NO: 120027 - DNA, 6 bp, Unknown
  misc_feature (1)..( 6): Result.002 file - promoters60/1566715
tcaaaa

SEQ ID NO: 120028 - DNA, 6 bp, Unknown
  misc_feature (1)..( 6): Result.002 file - promoters60/1566715
tcaaaa

SEQ ID NO: 120029 - DNA, 8 bp, Unknown
  misc_feature (1)..( 8): Result.002 file - promoters60/1566715
aaatcata

SEQ ID NO: 120030 - DNA, 8 bp, Unknown
  misc_feature (1)..( 8): Result.002 file - promoters60/1566715
aaataata

SEQ ID NO: 120031 - DNA, 7 bp, Unknown
  misc_feature (1)..( 7): Result.002 file - promoters60/1566715
taggtaa

SEQ ID NO: 120032 - DNA, 7 bp, Unknown
  misc_feature (1)..( 7): Result.002 file - promoters60/1566715
tagataa

SEQ ID NO: 120033 - DNA, 12 bp, Unknown
  misc_feature (1)..( 12): Result.002 file - promoters60/1566715
ctgaaatatatt

SEQ ID NO: 120034 - DNA, 12 bp, Unknown
  misc_feature (1)..( 12): Result.002 file - promoters60/1566715
ctgaaataaatt

SEQ ID NO: 120035 - DNA, 6 bp, Unknown
  misc_feature (1)..( 6): Result.002 file - promoters60/1566715
ttatgt

SEQ ID NO: 120036 - DNA, 6 bp, Unknown
  misc_feature (1)..( 6): Result.002 file - promoters60/1566715
ttatgt

SEQ ID NO: 120037 - DNA, 11 bp, Unknown
  misc_feature (1)..( 11): Result.002 file - promoters60/1566715
tttgtaaacaa

SEQ ID NO: 120038 - DNA, 11 bp, Unknown
  misc_feature (1)..( 11): Result.002 file - promoters60/1566715
tttgtatacaa

SEQ ID NO: 120039 - DNA, 9 bp, Unknown
  misc_feature (1)..( 9): Result.002 file - promoters60/1566715
tatattatt

SEQ ID NO: 120040 - DNA, 9 bp, Unknown
  misc_feature (1)..( 9): Result.002 file - promoters60/1566715
tattttatt

SEQ ID NO: 120041 - DNA, 9 bp, Unknown
  misc_feature (1)..( 9): Result.002 file - promoters60/1566715
attaaaatt

SEQ ID NO: 120042 - DNA, 9 bp, Unknown
  misc_feature (1)..( 9): Result.002 file - promoters60/1566715
attaatatt

SEQ ID NO: 120043 - DNA, 7 bp, Unknown
  misc_feature (1)..( 7): Result.002 file - promoters60/1566715
gaccaaa

SEQ ID NO: 120044 - DNA, 7 bp, Unknown
  misc_feature (1)..( 7): Result.002 file - promoters60/1566715
gacaaaa

SEQ ID NO: 120045 - DNA, 7 bp, Unknown
  misc_feature (1)..( 7): Result.002 file - promoters60/1566715
ttcaata

SEQ ID NO: 120046 - DNA, 7 bp, Unknown
  misc_feature (1)..( 7): Result.002 file - promoters60/1566715
ttccata

SEQ ID NO: 120047 - DNA, 8 bp, Unknown
  misc_feature (1)..( 8): Result.002 file - promoters60/1566715
atttcaca

SEQ ID NO: 120048 - DNA, 8 bp, Unknown
  misc_feature (1)..( 8): Result.002 file - promoters60/1566715
attttaca

SEQ ID NO: 120049 - DNA, 6 bp, Unknown
  misc_feature (1)..( 6): Result.002 file - promoters60/1566715
tattta

SEQ ID NO: 120050 - DNA, 6 bp, Unknown
  misc_feature (1)..( 6): Result.002 file - promoters60/1566715
tattta

SEQ ID NO: 120051 - DNA, 6 bp, Unknown
  misc_feature (1)..( 6): Result.002 file - promoters60/1566715
taaaac

SEQ ID NO: 120052 - DNA, 6 bp, Unknown
  misc_feature (1)..( 6): Result.002 file - promoters60/1566715
taaaac

SEQ ID NO: 120053 - DNA, 6 bp, Unknown
  misc_feature (1)..( 6): Result.002 file - promoters60/1566715
cccaat

SEQ ID NO: 120054 - DNA, 6 bp, Unknown
  misc_feature (1)..( 6): Result.002 file - promoters60/1566715
cccaat

SEQ ID NO: 120055 - DNA, 11 bp, Unknown
  misc_feature (1)..( 11): Result.002 file - promoters60/1566715
aagcaaagagg

SEQ ID NO: 120056 - DNA, 11 bp, Unknown
  misc_feature (1)..( 11): Result.002 file - promoters60/1566715
aaggaaacagg

SEQ ID NO: 120057 - DNA, 6 bp, Unknown
  misc_feature (1)..( 6): Result.002 file - promoters60/1566797
aaaaac

SEQ ID NO: 120058 - DNA, 6 bp, Unknown
  misc_feature (1)..( 6): Result.002 file - promoters60/1566797
aaaaac

SEQ ID NO: 120059 - DNA, 6 bp, Unknown
  misc_feature (1)..( 6): Result.002 file - promoters60/1566797
ttaaat

SEQ ID NO: 120060 - DNA, 6 bp, Unknown
  misc_feature (1)..( 6): Result.002 file - promoters60/1566797
ttaaat

SEQ ID NO: 120061 - DNA, 6 bp, Unknown
  misc_feature (1)..( 6): Result.002 file - promoters60/1566797
taaaat

SEQ ID NO: 120062 - DNA, 6 bp, Unknown
  misc_feature (1)..( 6): Result.002 file - promoters60/1566797
taaaat

SEQ ID NO: 120063 - DNA, 10 bp, Unknown
  misc_feature (1)..( 10): Result.002 file - promoters60/1566797
ttcgtttctt

SEQ ID NO: 120064 - DNA, 10 bp, Unknown
  misc_feature (1)..( 10): Result.002 file - promoters60/1566797
ttcttttctt

SEQ ID NO: 120065 - DNA, 6 bp, Unknown
  misc_feature (1)..( 6): Result.002 file - promoters60/1566797
aatgct

SEQ ID NO: 120066 - DNA, 6 bp, Unknown
  misc_feature (1)..( 6): Result.002 file - promoters60/1566797
aatgct

SEQ ID NO: 120067 - DNA, 8 bp, Unknown
  misc_feature (1)..( 8): Result.002 file - promoters60/1566797
tttggtta

SEQ ID NO: 120068 - DNA, 8 bp, Unknown
  misc_feature (1)..( 8): Result.002 file - promoters60/1566797
tttgttta

SEQ ID NO: 120069 - DNA, 7 bp, Unknown
  misc_feature (1)..( 7): Result.002 file - promoters60/1566797
aaagata

SEQ ID NO: 120070 - DNA, 7 bp, Unknown
  misc_feature (1)..( 7): Result.002 file - promoters60/1566797
aaagata

SEQ ID NO: 120071 - DNA, 6 bp, Unknown
  misc_feature (1)..( 6): Result.002 file - promoters60/1566797
cacata

SEQ ID NO: 120072 - DNA, 6 bp, Unknown
  misc_feature (1)..( 6): Result.002 file - promoters60/1566797
cacata

SEQ ID NO: 120073 - DNA, 7 bp, Unknown
  misc_feature (1)..( 7): Result.002 file - promoters60/1566797
aacgttt

SEQ ID NO: 120074 - DNA, 7 bp, Unknown
  misc_feature (1)..( 7): Result.002 file - promoters60/1566797
aaccttt

SEQ ID NO: 120075 - DNA, 6 bp, Unknown
  misc_feature (1)..( 6): Result.002 file - promoters60/1566797
ttaaac

SEQ ID NO: 120076 - DNA, 6 bp, Unknown
  misc_feature (1)..( 6): Result.002 file - promoters60/1566797
ttaaac

SEQ ID NO: 120077 - DNA, 7 bp, Unknown
  misc_feature (1)..( 7): Result.002 file - promoters60/1566797
aattaat

SEQ ID NO: 120078 - DNA, 7 bp, Unknown
  misc_feature (1)..( 7): Result.002 file - promoters60/1566797
aatgaat

SEQ ID NO: 120079 - DNA, 8 bp, Unknown
  misc_feature (1)..( 8): Result.002 file - promoters60/1566797
acatgacg

SEQ ID NO: 120080 - DNA, 8 bp, Unknown
  misc_feature (1)..( 8): Result.002 file - promoters60/1566797
acataacg

SEQ ID NO: 120081 - DNA, 7 bp, Unknown
  misc_feature (1)..( 7): Result.002 file - promoters60/1566797
cattttt

SEQ ID NO: 120082 - DNA, 7 bp, Unknown
  misc_feature (1)..( 7): Result.002 file - promoters60/1566797
cattttt

SEQ ID NO: 120083 - DNA, 13 bp, Unknown
  misc_feature (1)..( 13): Result.002 file - promoters60/1566948
ttggatcaacaat

SEQ ID NO: 120084 - DNA, 13 bp, Unknown
  misc_feature (1)..( 13): Result.002 file - promoters60/1566948
ttgaatcaatatt

SEQ ID NO: 120085 - DNA, 13 bp, Unknown
  misc_feature (1)..( 13): Result.002 file - promoters60/1566948
ttgattcaaaatt

SEQ ID NO: 120086 - DNA, 6 bp, Unknown
  misc_feature (1)..( 6): Result.002 file - promoters60/1566948
tggatt

SEQ ID NO: 120087 - DNA, 6 bp, Unknown
  misc_feature (1)..( 6): Result.002 file - promoters60/1566948
tggatt

SEQ ID NO: 120088 - DNA, 6 bp, Unknown
  misc_feature (1)..( 6): Result.002 file - promoters60/1566948
tggatt

SEQ ID NO: 120089 - DNA, 13 bp, Unknown
  misc_feature (1)..( 13): Result.002 file - promoters60/1566948
tttaggaaaaatt

SEQ ID NO: 120090 - DNA, 13 bp, Unknown
  misc_feature (1)..( 13): Result.002 file - promoters60/1566948
ttgattcaaaatt

SEQ ID NO: 120091 - DNA, 13 bp, Unknown
  misc_feature (1)..( 13): Result.002 file - promoters60/1566948
ttgaatcaatatt

SEQ ID NO: 120092 - DNA, 7 bp, Unknown
  misc_feature (1)..( 7): Result.002 file - promoters60/1567007
aaaagaa

SEQ ID NO: 120093 - DNA, 7 bp, Unknown
  misc_feature (1)..( 7): Result.002 file - promoters60/1567007
aaaagaa

SEQ ID NO: 120094 - DNA, 7 bp, Unknown
  misc_feature (1)..( 7): Result.002 file - promoters60/1567007
aaaagat

SEQ ID NO: 120095 - DNA, 9 bp, Unknown
  misc_feature (1)..( 9): Result.002 file - promoters60/1567007
aaatattaa

SEQ ID NO: 120096 - DNA, 9 bp, Unknown
  misc_feature (1)..( 9): Result.002 file - promoters60/1567007
aaatatctt

SEQ ID NO: 120097 - DNA, 9 bp, Unknown
  misc_feature (1)..( 9): Result.002 file - promoters60/1567007
gaattttaa

SEQ ID NO: 120098 - DNA, 8 bp, Unknown
  misc_feature (1)..( 8): Result.002 file - promoters60/1567007
taaaatct

SEQ ID NO: 120099 - DNA, 8 bp, Unknown
  misc_feature (1)..( 8): Result.002 file - promoters60/1567007
caaaatca

SEQ ID NO: 120100 - DNA, 8 bp, Unknown
  misc_feature (1)..( 8): Result.002 file - promoters60/1567007
caaattca

SEQ ID NO: 120101 - DNA, 8 bp, Unknown
  misc_feature (1)..( 8): Result.002 file - promoters60/1567007
ttaaaatc

SEQ ID NO: 120102 - DNA, 8 bp, Unknown
  misc_feature (1)..( 8): Result.002 file - promoters60/1567007
ttaaaaaa

SEQ ID NO: 120103 - DNA, 8 bp, Unknown
  misc_feature (1)..( 8): Result.002 file - promoters60/1567007
ctaaaaaa

SEQ ID NO: 120104 - DNA, 8 bp, Unknown
  misc_feature (1)..( 8): Result.002 file - promoters60/1567007
ctaaaaga

SEQ ID NO: 120105 - DNA, 8 bp, Unknown
  misc_feature (1)..( 8): Result.002 file - promoters60/1567007
ctaaaaaa

SEQ ID NO: 120106 - DNA, 8 bp, Unknown
  misc_feature (1)..( 8): Result.002 file - promoters60/1567007
ttaaaaaa

SEQ ID NO: 120107 - DNA, 8 bp, Unknown
  misc_feature (1)..( 8): Result.002 file - promoters60/1567007
aaaagaac

SEQ ID NO: 120108 - DNA, 8 bp, Unknown
  misc_feature (1)..( 8): Result.002 file - promoters60/1567007
taaaaaac

SEQ ID NO: 120109 - DNA, 8 bp, Unknown
  misc_feature (1)..( 8): Result.002 file - promoters60/1567007
taaaaaaa

SEQ ID NO: 120110 - DNA, 10 bp, Unknown
  misc_feature (1)..( 10): Result.002 file - promoters60/1567092
tttgcttaca

SEQ ID NO: 120111 - DNA, 10 bp, Unknown
  misc_feature (1)..( 10): Result.002 file - promoters60/1567092
ttttcttttc

SEQ ID NO: 120112 - DNA, 10 bp, Unknown
  misc_feature (1)..( 10): Result.002 file - promoters60/1567092
gttgtttata

SEQ ID NO: 120113 - DNA, 10 bp, Unknown
  misc_feature (1)..( 10): Result.002 file - promoters60/1567092
catgtttaat

SEQ ID NO: 120114 - DNA, 10 bp, Unknown
  misc_feature (1)..( 10): Result.002 file - promoters60/1567092
aaagttaaat

SEQ ID NO: 120115 - DNA, 10 bp, Unknown
  misc_feature (1)..( 10): Result.002 file - promoters60/1567092
catatttagc

SEQ ID NO: 120116 - DNA, 10 bp, Unknown
  misc_feature (1)..( 10): Result.002 file - promoters60/1567092
tgagttcata

SEQ ID NO: 120117 - DNA, 10 bp, Unknown
  misc_feature (1)..( 10): Result.002 file - promoters60/1567092
caagtaaaag

SEQ ID NO: 120118 - DNA, 13 bp, Unknown
  misc_feature (1)..( 13): Result.002 file - promoters60/1567092
cgcaactattttg

SEQ ID NO: 120119 - DNA, 13 bp, Unknown
  misc_feature (1)..( 13): Result.002 file - promoters60/1567092
cctgcatatttta

SEQ ID NO: 120120 - DNA, 13 bp, Unknown
  misc_feature (1)..( 13): Result.002 file - promoters60/1567092
agtcataatttta

SEQ ID NO: 120121 - DNA, 13 bp, Unknown
  misc_feature (1)..( 13): Result.002 file - promoters60/1567092
tcataatattagt

SEQ ID NO: 120122 - DNA, 13 bp, Unknown
  misc_feature (1)..( 13): Result.002 file - promoters60/1567092
gtatcataaagca

SEQ ID NO: 120123 - DNA, 13 bp, Unknown
  misc_feature (1)..( 13): Result.002 file - promoters60/1567092
aactagaattttc

SEQ ID NO: 120124 - DNA, 13 bp, Unknown
  misc_feature (1)..( 13): Result.002 file - promoters60/1567092
caacaatgtacaa

SEQ ID NO: 120125 - DNA, 13 bp, Unknown
  misc_feature (1)..( 13): Result.002 file - promoters60/1567092
caataatttacat

SEQ ID NO: 120126 - DNA, 13 bp, Unknown
  misc_feature (1)..( 13): Result.002 file - promoters60/1567092
ttacaatttacaa

SEQ ID NO: 120127 - DNA, 13 bp, Unknown
  misc_feature (1)..( 13): Result.002 file - promoters60/1567092
gaataataaaatg

SEQ ID NO: 120128 - DNA, 13 bp, Unknown
  misc_feature (1)..( 13): Result.002 file - promoters60/1567092
atataacttatcc

SEQ ID NO: 120129 - DNA, 13 bp, Unknown
  misc_feature (1)..( 13): Result.002 file - promoters60/1567092
tgaaaatttatac

SEQ ID NO: 120130 - DNA, 11 bp, Unknown
  misc_feature (1)..( 11): Result.002 file - promoters60/1567949
ataatcaatga

SEQ ID NO: 120131 - DNA, 11 bp, Unknown
  misc_feature (1)..( 11): Result.002 file - promoters60/1567949
aagatcattga

SEQ ID NO: 120132 - DNA, 11 bp, Unknown
  misc_feature (1)..( 11): Result.002 file - promoters60/1567949
ccaatcaaatg

SEQ ID NO: 120133 - DNA, 11 bp, Unknown
  misc_feature (1)..( 11): Result.002 file - promoters60/1567949
gtaataaattc

SEQ ID NO: 120134 - DNA, 11 bp, Unknown
  misc_feature (1)..( 11): Result.002 file - promoters60/1567949
gagatcatttg

SEQ ID NO: 120135 - DNA, 11 bp, Unknown
  misc_feature (1)..( 11): Result.002 file - promoters60/1567949
aagatcatgta

SEQ ID NO: 120136 - DNA, 10 bp, Unknown
  misc_feature (1)..( 10): Result.002 file - promoters60/1567957
ccagaattaa

SEQ ID NO: 120137 - DNA, 10 bp, Unknown
  misc_feature (1)..( 10): Result.002 file - promoters60/1567957
ccataattag

SEQ ID NO: 120138 - DNA, 10 bp, Unknown
  misc_feature (1)..( 10): Result.002 file - promoters60/1567957
aaatacttaa

SEQ ID NO: 120139 - DNA, 10 bp, Unknown
  misc_feature (1)..( 10): Result.002 file - promoters60/1567957
tcatcaatat

SEQ ID NO: 120140 - DNA, 10 bp, Unknown
  misc_feature (1)..( 10): Result.002 file - promoters60/1567957
ttatccatat

SEQ ID NO: 120141 - DNA, 11 bp, Unknown
  misc_feature (1)..( 11): Result.002 file - promoters60/1567957
atggtttatta

SEQ ID NO: 120142 - DNA, 11 bp, Unknown
  misc_feature (1)..( 11): Result.002 file - promoters60/1567957
cttttttttta

SEQ ID NO: 120143 - DNA, 11 bp, Unknown
  misc_feature (1)..( 11): Result.002 file - promoters60/1567957
atactttattt

SEQ ID NO: 120144 - DNA, 11 bp, Unknown
  misc_feature (1)..( 11): Result.002 file - promoters60/1567957
aacattttttt

SEQ ID NO: 120145 - DNA, 13 bp, Unknown
  misc_feature (1)..( 13): Result.002 file - promoters60/1567957
acaactttaaaca

SEQ ID NO: 120146 - DNA, 13 bp, Unknown
  misc_feature (1)..( 13): Result.002 file - promoters60/1567957
atttttttaaaaa

SEQ ID NO: 120147 - DNA, 13 bp, Unknown
  misc_feature (1)..( 13): Result.002 file - promoters60/1567957
gctggtttcaaca

SEQ ID NO: 120148 - DNA, 13 bp, Unknown
  misc_feature (1)..( 13): Result.002 file - promoters60/1567957
attattttaattt

SEQ ID NO: 120149 - DNA, 11 bp, Unknown
  misc_feature (1)..( 11): Result.002 file - promoters60/1567957
gcccaaatacg

SEQ ID NO: 120150 - DNA, 11 bp, Unknown
  misc_feature (1)..( 11): Result.002 file - promoters60/1567957
atccatatata

SEQ ID NO: 120151 - DNA, 11 bp, Unknown
  misc_feature (1)..( 11): Result.002 file - promoters60/1567957
ttacataaata

SEQ ID NO: 120152 - DNA, 11 bp, Unknown
  misc_feature (1)..( 11): Result.002 file - promoters60/1567957
atcaatattct

SEQ ID NO: 120153 - DNA, 6 bp, Unknown
  misc_feature (1)..( 6): Result.002 file - promoters60/1568230
gattga

SEQ ID NO: 120154 - DNA, 6 bp, Unknown
  misc_feature (1)..( 6): Result.002 file - promoters60/1568230
gattga

SEQ ID NO: 120155 - DNA, 8 bp, Unknown
  misc_feature (1)..( 8): Result.002 file - promoters60/1568230
tcggtttt

SEQ ID NO: 120156 - DNA, 8 bp, Unknown
  misc_feature (1)..( 8): Result.002 file - promoters60/1568230
tcgatttt

SEQ ID NO: 120157 - DNA, 6 bp, Unknown
  misc_feature (1)..( 6): Result.002 file - promoters60/1568230
atttta

SEQ ID NO: 120158 - DNA, 6 bp, Unknown
  misc_feature (1)..( 6): Result.002 file - promoters60/1568230
atttta

SEQ ID NO: 120159 - DNA, 10 bp, Unknown
  misc_feature (1)..( 10): Result.002 file - promoters60/1568230
ttaatataaa

SEQ ID NO: 120160 - DNA, 10 bp, Unknown
  misc_feature (1)..( 10): Result.002 file - promoters60/1568230
acaatttaaa

SEQ ID NO: 120161 - DNA, 10 bp, Unknown
  misc_feature (1)..( 10): Result.002 file - promoters60/1568230
ttattataaa

SEQ ID NO: 120162 - DNA, 6 bp, Unknown
  misc_feature (1)..( 6): Result.002 file - promoters60/1568230
aaccgt

SEQ ID NO: 120163 - DNA, 6 bp, Unknown
  misc_feature (1)..( 6): Result.002 file - promoters60/1568230
aaccgt

SEQ ID NO: 120164 - DNA, 7 bp, Unknown
  misc_feature (1)..( 7): Result.002 file - promoters60/1568230
taatcta

SEQ ID NO: 120165 - DNA, 7 bp, Unknown
  misc_feature (1)..( 7): Result.002 file - promoters60/1568230
taaacta

SEQ ID NO: 120166 - DNA, 6 bp, Unknown
  misc_feature (1)..( 6): Result.002 file - promoters60/1568230
aatatt

SEQ ID NO: 120167 - DNA, 6 bp, Unknown
  misc_feature (1)..( 6): Result.002 file - promoters60/1568230
aatatt

SEQ ID NO: 120168 - DNA, 7 bp, Unknown
  misc_feature (1)..( 7): Result.002 file - promoters60/1568230
attctaa

SEQ ID NO: 120169 - DNA, 7 bp, Unknown
  misc_feature (1)..( 7): Result.002 file - promoters60/1568230
attataa

SEQ ID NO: 120170 - DNA, 8 bp, Unknown
  misc_feature (1)..( 8): Result.002 file - promoters60/1568230
tattttaa

SEQ ID NO: 120171 - DNA, 8 bp, Unknown
  misc_feature (1)..( 8): Result.002 file - promoters60/1568230
tattataa

SEQ ID NO: 120172 - DNA, 8 bp, Unknown
  misc_feature (1)..( 8): Result.002 file - promoters60/1568230
tttatggt

SEQ ID NO: 120173 - DNA, 8 bp, Unknown
  misc_feature (1)..( 8): Result.002 file - promoters60/1568230
tttctggt

SEQ ID NO: 120174 - DNA, 7 bp, Unknown
  misc_feature (1)..( 7): Result.002 file - promoters60/1568230
aatgaaa

SEQ ID NO: 120175 - DNA, 7 bp, Unknown
  misc_feature (1)..( 7): Result.002 file - promoters60/1568230
aataaaa

SEQ ID NO: 120176 - DNA, 7 bp, Unknown
  misc_feature (1)..( 7): Result.002 file - promoters60/1568230
acaaatt

SEQ ID NO: 120177 - DNA, 7 bp, Unknown
  misc_feature (1)..( 7): Result.002 file - promoters60/1568230
acacatt

SEQ ID NO: 120178 - DNA, 6 bp, Unknown
  misc_feature (1)..( 6): Result.002 file - promoters60/1568230
agaaaa

SEQ ID NO: 120179 - DNA, 6 bp, Unknown
  misc_feature (1)..( 6): Result.002 file - promoters60/1568230
agaaaa

SEQ ID NO: 120180 - DNA, 6 bp, Unknown
  misc_feature (1)..( 6): Result.002 file - promoters60/1568230
taataa

SEQ ID NO: 120181 - DNA, 6 bp, Unknown
  misc_feature (1)..( 6): Result.002 file - promoters60/1568230
taataa

SEQ ID NO: 120182 - DNA, 7 bp, Unknown
  misc_feature (1)..( 7): Result.002 file - promoters60/1568230
tgtttga

SEQ ID NO: 120183 - DNA, 7 bp, Unknown
  misc_feature (1)..( 7): Result.002 file - promoters60/1568230
tgtgtga

SEQ ID NO: 120184 - DNA, 6 bp, Unknown
  misc_feature (1)..( 6): Result.002 file - promoters60/1568230
taaaca

SEQ ID NO: 120185 - DNA, 6 bp, Unknown
  misc_feature (1)..( 6): Result.002 file - promoters60/1568230
taaaca

SEQ ID NO: 120186 - DNA, 7 bp, Unknown
  misc_feature (1)..( 7): Result.002 file - promoters60/1568230
acaaaat

SEQ ID NO: 120187 - DNA, 7 bp, Unknown
  misc_feature (1)..( 7): Result.002 file - promoters60/1568230
acaaaat

SEQ ID NO: 120188 - DNA, 8 bp, Unknown
  misc_feature (1)..( 8): Result.002 file - promoters60/1568230
gttaaata

SEQ ID NO: 120189 - DNA, 8 bp, Unknown
  misc_feature (1)..( 8): Result.002 file - promoters60/1568230
gttatata

SEQ ID NO: 120190 - DNA, 6 bp, Unknown
  misc_feature (1)..( 6): Result.002 file - promoters60/1568230
aaacct

SEQ ID NO: 120191 - DNA, 6 bp, Unknown
  misc_feature (1)..( 6): Result.002 file - promoters60/1568230
aaacct

SEQ ID NO: 120192 - DNA, 15 bp, Unknown
  misc_feature (1)..( 15): Result.002 file - promoters60/1568386
tttaaattttaatct

SEQ ID NO: 120193 - DNA, 15 bp, Unknown
  misc_feature (1)..( 15): Result.002 file - promoters60/1568386
tgtaaattgtaatta

SEQ ID NO: 120194 - DNA, 15 bp, Unknown
  misc_feature (1)..( 15): Result.002 file - promoters60/1568386
tttaactttttcaat

SEQ ID NO: 120195 - DNA, 15 bp, Unknown
  misc_feature (1)..( 15): Result.002 file - promoters60/1568386
cacaaatttgttgta

SEQ ID NO: 120196 - DNA, 15 bp, Unknown
  misc_feature (1)..( 15): Result.002 file - promoters60/1568386
cttcatttttattct

SEQ ID NO: 120197 - DNA, 15 bp, Unknown
  misc_feature (1)..( 15): Result.002 file - promoters60/1568386
attaaatatgttaac

SEQ ID NO: 120198 - DNA, 15 bp, Unknown
  misc_feature (1)..( 15): Result.002 file - promoters60/1568386
gtataattttgtttc

SEQ ID NO: 120199 - DNA, 15 bp, Unknown
  misc_feature (1)..( 15): Result.002 file - promoters60/1568386
ttcaaaatgtaaata

SEQ ID NO: 120200 - DNA, 10 bp, Unknown
  misc_feature (1)..( 10): Result.002 file - promoters60/1568386
ttttgacaaa

SEQ ID NO: 120201 - DNA, 10 bp, Unknown
  misc_feature (1)..( 10): Result.002 file - promoters60/1568386
cttttacata

SEQ ID NO: 120202 - DNA, 10 bp, Unknown
  misc_feature (1)..( 10): Result.002 file - promoters60/1568386
tttttacaca

SEQ ID NO: 120203 - DNA, 10 bp, Unknown
  misc_feature (1)..( 10): Result.002 file - promoters60/1568386
tgattaaata

SEQ ID NO: 120204 - DNA, 10 bp, Unknown
  misc_feature (1)..( 10): Result.002 file - promoters60/1568386
gattcaatca

SEQ ID NO: 120205 - DNA, 10 bp, Unknown
  misc_feature (1)..( 10): Result.002 file - promoters60/1568386
taaataaata

SEQ ID NO: 120206 - DNA, 13 bp, Unknown
  misc_feature (1)..( 13): Result.002 file - promoters60/1568386
tttaattttgaca

SEQ ID NO: 120207 - DNA, 13 bp, Unknown
  misc_feature (1)..( 13): Result.002 file - promoters60/1568386
cataatttttacc

SEQ ID NO: 120208 - DNA, 13 bp, Unknown
  misc_feature (1)..( 13): Result.002 file - promoters60/1568386
ttcatttttattc

SEQ ID NO: 120209 - DNA, 13 bp, Unknown
  misc_feature (1)..( 13): Result.002 file - promoters60/1568386
gttggttttattt

SEQ ID NO: 120210 - DNA, 13 bp, Unknown
  misc_feature (1)..( 13): Result.002 file - promoters60/1568386
ttcaattttatgc

SEQ ID NO: 120211 - DNA, 13 bp, Unknown
  misc_feature (1)..( 13): Result.002 file - promoters60/1568386
atttgttgtattc

SEQ ID NO: 120212 - DNA, 13 bp, Unknown
  misc_feature (1)..( 13): Result.002 file - promoters60/1568386
aaaaaatgtagta

SEQ ID NO: 120213 - DNA, 13 bp, Unknown
  misc_feature (1)..( 13): Result.002 file - promoters60/1568386
aaactttttacgg

SEQ ID NO: 120214 - DNA, 11 bp, Unknown
  misc_feature (1)..( 11): Result.002 file - promoters60/1568386
agtaatttaat

SEQ ID NO: 120215 - DNA, 11 bp, Unknown
  misc_feature (1)..( 11): Result.002 file - promoters60/1568386
cacaatttacc

SEQ ID NO: 120216 - DNA, 11 bp, Unknown
  misc_feature (1)..( 11): Result.002 file - promoters60/1568386
agtagtttcca

SEQ ID NO: 120217 - DNA, 11 bp, Unknown
  misc_feature (1)..( 11): Result.002 file - promoters60/1568386
tcaaattaaat

SEQ ID NO: 120218 - DNA, 11 bp, Unknown
  misc_feature (1)..( 11): Result.002 file - promoters60/1568386
caaaattgacc

SEQ ID NO: 120219 - DNA, 11 bp, Unknown
  misc_feature (1)..( 11): Result.002 file - promoters60/1568386
acaaatttatt

SEQ ID NO: 120220 - DNA, 11 bp, Unknown
  misc_feature (1)..( 11): Result.002 file - promoters60/1568386
atgtatttaat

SEQ ID NO: 120221 - DNA, 14 bp, Unknown
  misc_feature (1)..( 14): Result.002 file - promoters60/1568386
tcaattgtacttat

SEQ ID NO: 120222 - DNA, 14 bp, Unknown
  misc_feature (1)..( 14): Result.002 file - promoters60/1568386
caacttgtacacgc

SEQ ID NO: 120223 - DNA, 14 bp, Unknown
  misc_feature (1)..( 14): Result.002 file - promoters60/1568386
ttaattgtataatt

SEQ ID NO: 120224 - DNA, 14 bp, Unknown
  misc_feature (1)..( 14): Result.002 file - promoters60/1568386
ttctttgaacttat

SEQ ID NO: 120225 - DNA, 14 bp, Unknown
  misc_feature (1)..( 14): Result.002 file - promoters60/1568386
taaattgtaattag

SEQ ID NO: 120226 - DNA, 14 bp, Unknown
  misc_feature (1)..( 14): Result.002 file - promoters60/1568386
ttatttgagttatg

SEQ ID NO: 120227 - DNA, 10 bp, Unknown
  misc_feature (1)..( 10): Result.002 file - promoters60/1568386
atatatctta

SEQ ID NO: 120228 - DNA, 10 bp, Unknown
  misc_feature (1)..( 10): Result.002 file - promoters60/1568386
ataaatcttt

SEQ ID NO: 120229 - DNA, 11 bp, Unknown
  misc_feature (1)..( 11): Result.002 file - promoters60/1568386
ttatcatatta

SEQ ID NO: 120230 - DNA, 11 bp, Unknown
  misc_feature (1)..( 11): Result.002 file - promoters60/1568386
acatcatttta

SEQ ID NO: 120231 - DNA, 11 bp, Unknown
  misc_feature (1)..( 11): Result.002 file - promoters60/1568386
ataaaacttga

SEQ ID NO: 120232 - DNA, 11 bp, Unknown
  misc_feature (1)..( 11): Result.002 file - promoters60/1568386
ttgaaatttga

SEQ ID NO: 120233 - DNA, 9 bp, Unknown
  misc_feature (1)..( 9): Result.002 file - promoters60/1568386
gttatttaa

SEQ ID NO: 120234 - DNA, 9 bp, Unknown
  misc_feature (1)..( 9): Result.002 file - promoters60/1568386
attattttc

SEQ ID NO: 120235 - DNA, 9 bp, Unknown
  misc_feature (1)..( 9): Result.002 file - promoters60/1568386
tttatttac

SEQ ID NO: 120236 - DNA, 9 bp, Unknown
  misc_feature (1)..( 9): Result.002 file - promoters60/1568386
tatattcta

SEQ ID NO: 120237 - DNA, 9 bp, Unknown
  misc_feature (1)..( 9): Result.002 file - promoters60/1568386
tttatttat

SEQ ID NO: 120238 - DNA, 9 bp, Unknown
  misc_feature (1)..( 9): Result.002 file - promoters60/1568386
catatatat

SEQ ID NO: 120239 - DNA, 11 bp, Unknown
  misc_feature (1)..( 11): Result.002 file - promoters60/1568386
aaattttgtaa

SEQ ID NO: 120240 - DNA, 11 bp, Unknown
  misc_feature (1)..( 11): Result.002 file - promoters60/1568386
aaatttattgt

SEQ ID NO: 120241 - DNA, 11 bp, Unknown
  misc_feature (1)..( 11): Result.002 file - promoters60/1568386
taattttgttt

SEQ ID NO: 120242 - DNA, 11 bp, Unknown
  misc_feature (1)..( 11): Result.002 file - promoters60/1568386
caatttaccaa

SEQ ID NO: 120243 - DNA, 11 bp, Unknown
  misc_feature (1)..( 11): Result.002 file - promoters60/1568386
ctatttatttc

SEQ ID NO: 120244 - DNA, 11 bp, Unknown
  misc_feature (1)..( 11): Result.002 file - promoters60/1568386
taatttcaaaa

SEQ ID NO: 120245 - DNA, 8 bp, Unknown
  misc_feature (1)..( 8): Result.002 file - promoters60/1568405
attaatac

SEQ ID NO: 120246 - DNA, 8 bp, Unknown
  misc_feature (1)..( 8): Result.002 file - promoters60/1568405
tttaataa

SEQ ID NO: 120247 - DNA, 8 bp, Unknown
  misc_feature (1)..( 8): Result.002 file - promoters60/1568405
ttttataa

SEQ ID NO: 120248 - DNA, 7 bp, Unknown
  misc_feature (1)..( 7): Result.002 file - promoters60/1568405
atagaaa

SEQ ID NO: 120249 - DNA, 7 bp, Unknown
  misc_feature (1)..( 7): Result.002 file - promoters60/1568405
ataaaaa

SEQ ID NO: 120250 - DNA, 7 bp, Unknown
  misc_feature (1)..( 7): Result.002 file - promoters60/1568405
ataaaat

SEQ ID NO: 120251 - DNA, 7 bp, Unknown
  misc_feature (1)..( 7): Result.002 file - promoters60/1568405
tttctga

SEQ ID NO: 120252 - DNA, 7 bp, Unknown
  misc_feature (1)..( 7): Result.002 file - promoters60/1568405
tttgtga

SEQ ID NO: 120253 - DNA, 7 bp, Unknown
  misc_feature (1)..( 7): Result.002 file - promoters60/1568405
aacaaaa

SEQ ID NO: 120254 - DNA, 7 bp, Unknown
  misc_feature (1)..( 7): Result.002 file - promoters60/1568405
aacaaaa

SEQ ID NO: 120255 - DNA, 8 bp, Unknown
  misc_feature (1)..( 8): Result.002 file - promoters60/1568405
aaagttat

SEQ ID NO: 120256 - DNA, 8 bp, Unknown
  misc_feature (1)..( 8): Result.002 file - promoters60/1568405
aaaattat

SEQ ID NO: 120257 - DNA, 6 bp, Unknown
  misc_feature (1)..( 6): Result.002 file - promoters60/1568405
aggaag

SEQ ID NO: 120258 - DNA, 6 bp, Unknown
  misc_feature (1)..( 6): Result.002 file - promoters60/1568405
aggaag

SEQ ID NO: 120259 - DNA, 10 bp, Unknown
  misc_feature (1)..( 10): Result.002 file - promoters60/1568405
acttttgctt

SEQ ID NO: 120260 - DNA, 10 bp, Unknown
  misc_feature (1)..( 10): Result.002 file - promoters60/1568405
acttttcctt

SEQ ID NO: 120261 - DNA, 8 bp, Unknown
  misc_feature (1)..( 8): Result.002 file - promoters60/1568405
tcccataa

SEQ ID NO: 120262 - DNA, 8 bp, Unknown
  misc_feature (1)..( 8): Result.002 file - promoters60/1568405
tccaataa

SEQ ID NO: 120263 - DNA, 11 bp, Unknown
  misc_feature (1)..( 11): Result.002 file - promoters60/1568405
gaaatcagtgt

SEQ ID NO: 120264 - DNA, 11 bp, Unknown
  misc_feature (1)..( 11): Result.002 file - promoters60/1568405
tttatcattgt

SEQ ID NO: 120265 - DNA, 11 bp, Unknown
  misc_feature (1)..( 11): Result.002 file - promoters60/1568405
tttatcatatt

SEQ ID NO: 120266 - DNA, 7 bp, Unknown
  misc_feature (1)..( 7): Result.002 file - promoters60/1568405
aaataag

SEQ ID NO: 120267 - DNA, 7 bp, Unknown
  misc_feature (1)..( 7): Result.002 file - promoters60/1568405
aaaaaag

SEQ ID NO: 120268 - DNA, 6 bp, Unknown
  misc_feature (1)..( 6): Result.002 file - promoters60/1568405
gaaact

SEQ ID NO: 120269 - DNA, 6 bp, Unknown
  misc_feature (1)..( 6): Result.002 file - promoters60/1568405
gaaact

SEQ ID NO: 120270 - DNA, 6 bp, Unknown
  misc_feature (1)..( 6): Result.002 file - promoters60/1568405
tgagag

SEQ ID NO: 120271 - DNA, 6 bp, Unknown
  misc_feature (1)..( 6): Result.002 file - promoters60/1568405
tgagag

SEQ ID NO: 120272 - DNA, 7 bp, Unknown
  misc_feature (1)..( 7): Result.002 file - promoters60/1568405
tttgatt

SEQ ID NO: 120273 - DNA, 7 bp, Unknown
  misc_feature (1)..( 7): Result.002 file - promoters60/1568405
ttttatt

SEQ ID NO: 120274 - DNA, 7 bp, Unknown
  misc_feature (1)..( 7): Result.002 file - promoters60/1568405
ttactct

SEQ ID NO: 120275 - DNA, 7 bp, Unknown
  misc_feature (1)..( 7): Result.002 file - promoters60/1568405
ttagtct

SEQ ID NO: 120276 - DNA, 6 bp, Unknown
  misc_feature (1)..( 6): Result.002 file - promoters60/1568405
gaatct

SEQ ID NO: 120277 - DNA, 6 bp, Unknown
  misc_feature (1)..( 6): Result.002 file - promoters60/1568405
gaatct

SEQ ID NO: 120278 - DNA, 6 bp, Unknown
  misc_feature (1)..( 6): Result.002 file - promoters60/1568405
tttgta

SEQ ID NO: 120279 - DNA, 6 bp, Unknown
  misc_feature (1)..( 6): Result.002 file - promoters60/1568405
tttgta

SEQ ID NO: 120280 - DNA, 8 bp, Unknown
  misc_feature (1)..( 8): Result.002 file - promoters60/1568405
ccaatggg

SEQ ID NO: 120281 - DNA, 8 bp, Unknown
  misc_feature (1)..( 8): Result.002 file - promoters60/1568405
ccaatggg

SEQ ID NO: 120282 - DNA, 7 bp, Unknown
  misc_feature (1)..( 7): Result.002 file - promoters60/1568409
attatat

SEQ ID NO: 120283 - DNA, 7 bp, Unknown
  misc_feature (1)..( 7): Result.002 file - promoters60/1568409
attgtat

SEQ ID NO: 120284 - DNA, 9 bp, Unknown
  misc_feature (1)..( 9): Result.002 file - promoters60/1568409
tgtgaatct

SEQ ID NO: 120285 - DNA, 9 bp, Unknown
  misc_feature (1)..( 9): Result.002 file - promoters60/1568409
tgtcaatct

SEQ ID NO: 120286 - DNA, 7 bp, Unknown
  misc_feature (1)..( 7): Result.002 file - promoters60/1568409
acgttta

SEQ ID NO: 120287 - DNA, 7 bp, Unknown
  misc_feature (1)..( 7): Result.002 file - promoters60/1568409
acgatta

SEQ ID NO: 120288 - DNA, 9 bp, Unknown
  misc_feature (1)..( 9): Result.002 file - promoters60/1568409
atatcattc

SEQ ID NO: 120289 - DNA, 9 bp, Unknown
  misc_feature (1)..( 9): Result.002 file - promoters60/1568409
caatctttc

SEQ ID NO: 120290 - DNA, 9 bp, Unknown
  misc_feature (1)..( 9): Result.002 file - promoters60/1568409
caatttttg

SEQ ID NO: 120291 - DNA, 8 bp, Unknown
  misc_feature (1)..( 8): Result.002 file - promoters60/1568409
aaagtctt

SEQ ID NO: 120292 - DNA, 8 bp, Unknown
  misc_feature (1)..( 8): Result.002 file - promoters60/1568409
aaagtcga

SEQ ID NO: 120293 - DNA, 8 bp, Unknown
  misc_feature (1)..( 8): Result.002 file - promoters60/1568409
aaaggctt

SEQ ID NO: 120294 - DNA, 6 bp, Unknown
  misc_feature (1)..( 6): Result.002 file - promoters60/1568409
catatt

SEQ ID NO: 120295 - DNA, 6 bp, Unknown
  misc_feature (1)..( 6): Result.002 file - promoters60/1568409
catatt

SEQ ID NO: 120296 - DNA, 7 bp, Unknown
  misc_feature (1)..( 7): Result.002 file - promoters60/1568409
atttgat

SEQ ID NO: 120297 - DNA, 7 bp, Unknown
  misc_feature (1)..( 7): Result.002 file - promoters60/1568409
atttgat

SEQ ID NO: 120298 - DNA, 11 bp, Unknown
  misc_feature (1)..( 11): Result.002 file - promoters60/1568409
tgtattcgatt

SEQ ID NO: 120299 - DNA, 11 bp, Unknown
  misc_feature (1)..( 11): Result.002 file - promoters60/1568409
tgtcttcgatt

SEQ ID NO: 120300 - DNA, 7 bp, Unknown
  misc_feature (1)..( 7): Result.002 file - promoters60/1568409
ttctttt

SEQ ID NO: 120301 - DNA, 7 bp, Unknown
  misc_feature (1)..( 7): Result.002 file - promoters60/1568409
ttcgttt

SEQ ID NO: 120302 - DNA, 6 bp, Unknown
  misc_feature (1)..( 6): Result.002 file - promoters60/1568409
gtttgg

SEQ ID NO: 120303 - DNA, 6 bp, Unknown
  misc_feature (1)..( 6): Result.002 file - promoters60/1568409
gtttgg

SEQ ID NO: 120304 - DNA, 6 bp, Unknown
  misc_feature (1)..( 6): Result.002 file - promoters60/1568409
cttttt

SEQ ID NO: 120305 - DNA, 6 bp, Unknown
  misc_feature (1)..( 6): Result.002 file - promoters60/1568409
cttttt

SEQ ID NO: 120306 - DNA, 7 bp, Unknown
  misc_feature (1)..( 7): Result.002 file - promoters60/1568409
ctttatt

SEQ ID NO: 120307 - DNA, 7 bp, Unknown
  misc_feature (1)..( 7): Result.002 file - promoters60/1568409
cttgatt

SEQ ID NO: 120308 - DNA, 7 bp, Unknown
  misc_feature (1)..( 7): Result.002 file - promoters60/1568409
tacattt

SEQ ID NO: 120309 - DNA, 7 bp, Unknown
  misc_feature (1)..( 7): Result.002 file - promoters60/1568409
tacgttt

SEQ ID NO: 120310 - DNA, 14 bp, Unknown
  misc_feature (1)..( 14): Result.002 file - promoters60/1568409
ttattatcttccta

SEQ ID NO: 120311 - DNA, 14 bp, Unknown
  misc_feature (1)..( 14): Result.002 file - promoters60/1568409
ttattaactttcta

SEQ ID NO: 120312 - DNA, 7 bp, Unknown
  misc_feature (1)..( 7): Result.002 file - promoters60/1568409
agagaag

SEQ ID NO: 120313 - DNA, 7 bp, Unknown
  misc_feature (1)..( 7): Result.002 file - promoters60/1568409
agagaag

SEQ ID NO: 120314 - DNA, 7 bp, Unknown
  misc_feature (1)..( 7): Result.002 file - promoters60/1568409
gagcaaa

SEQ ID NO: 120315 - DNA, 7 bp, Unknown
  misc_feature (1)..( 7): Result.002 file - promoters60/1568409
gaggaaa

SEQ ID NO: 120316 - DNA, 6 bp, Unknown
  misc_feature (1)..( 6): Result.002 file - promoters60/1568409
ttattg

SEQ ID NO: 120317 - DNA, 6 bp, Unknown
  misc_feature (1)..( 6): Result.002 file - promoters60/1568409
ttattg

SEQ ID NO: 120318 - DNA, 7 bp, Unknown
  misc_feature (1)..( 7): Result.002 file - promoters60/1568409
tgataaa

SEQ ID NO: 120319 - DNA, 7 bp, Unknown
  misc_feature (1)..( 7): Result.002 file - promoters60/1568409
tgacaaa

SEQ ID NO: 120320 - DNA, 8 bp, Unknown
  misc_feature (1)..( 8): Result.002 file - promoters60/1568409
tgtgactc

SEQ ID NO: 120321 - DNA, 8 bp, Unknown
  misc_feature (1)..( 8): Result.002 file - promoters60/1568409
tgtcactc

SEQ ID NO: 120322 - DNA, 7 bp, Unknown
  misc_feature (1)..( 7): Result.002 file - promoters60/1568409
tattaaa

SEQ ID NO: 120323 - DNA, 7 bp, Unknown
  misc_feature (1)..( 7): Result.002 file - promoters60/1568409
tataaaa

SEQ ID NO: 120324 - DNA, 9 bp, Unknown
  misc_feature (1)..( 9): Result.002 file - promoters60/1568508
aattacaat

SEQ ID NO: 120325 - DNA, 9 bp, Unknown
  misc_feature (1)..( 9): Result.002 file - promoters60/1568508
tcttataat

SEQ ID NO: 120326 - DNA, 9 bp, Unknown
  misc_feature (1)..( 9): Result.002 file - promoters60/1568508
tcttataaa

SEQ ID NO: 120327 - DNA, 7 bp, Unknown
  misc_feature (1)..( 7): Result.002 file - promoters60/1568508
acatcaa

SEQ ID NO: 120328 - DNA, 7 bp, Unknown
  misc_feature (1)..( 7): Result.002 file - promoters60/1568508
acaccaa

SEQ ID NO: 120329 - DNA, 8 bp, Unknown
  misc_feature (1)..( 8): Result.002 file - promoters60/1568508
acttatat

SEQ ID NO: 120330 - DNA, 8 bp, Unknown
  misc_feature (1)..( 8): Result.002 file - promoters60/1568508
tcttataa

SEQ ID NO: 120331 - DNA, 8 bp, Unknown
  misc_feature (1)..( 8): Result.002 file - promoters60/1568508
tcttataa

SEQ ID NO: 120332 - DNA, 8 bp, Unknown
  misc_feature (1)..( 8): Result.002 file - promoters60/1568508
aaaacaca

SEQ ID NO: 120333 - DNA, 8 bp, Unknown
  misc_feature (1)..( 8): Result.002 file - promoters60/1568508
aaaacaca

SEQ ID NO: 120334 - DNA, 8 bp, Unknown
  misc_feature (1)..( 8): Result.002 file - promoters60/1568508
caagcttt

SEQ ID NO: 120335 - DNA, 8 bp, Unknown
  misc_feature (1)..( 8): Result.002 file - promoters60/1568508
caaacttt

SEQ ID NO: 120336 - DNA, 6 bp, Unknown
  misc_feature (1)..( 6): Result.002 file - promoters60/1568508
aatatt

SEQ ID NO: 120337 - DNA, 6 bp, Unknown
  misc_feature (1)..( 6): Result.002 file - promoters60/1568508
aatatt

SEQ ID NO: 120338 - DNA, 6 bp, Unknown
  misc_feature (1)..( 6): Result.002 file - promoters60/1568508
atcaaa

SEQ ID NO: 120339 - DNA, 6 bp, Unknown
  misc_feature (1)..( 6): Result.002 file - promoters60/1568508
atcaaa

SEQ ID NO: 120340 - DNA, 7 bp, Unknown
  misc_feature (1)..( 7): Result.002 file - promoters60/1568508
caaatcc

SEQ ID NO: 120341 - DNA, 7 bp, Unknown
  misc_feature (1)..( 7): Result.002 file - promoters60/1568508
caagtcc

SEQ ID NO: 120342 - DNA, 7 bp, Unknown
  misc_feature (1)..( 7): Result.002 file - promoters60/1568508
cacaaga

SEQ ID NO: 120343 - DNA, 7 bp, Unknown
  misc_feature (1)..( 7): Result.002 file - promoters60/1568508
cacgaga

SEQ ID NO: 120344 - DNA, 8 bp, Unknown
  misc_feature (1)..( 8): Result.002 file - promoters60/1568508
ctcgcttc

SEQ ID NO: 120345 - DNA, 8 bp, Unknown
  misc_feature (1)..( 8): Result.002 file - promoters60/1568508
ctcgcttc

SEQ ID NO: 120346 - DNA, 8 bp, Unknown
  misc_feature (1)..( 8): Result.002 file - promoters60/1568508
cttctcga

SEQ ID NO: 120347 - DNA, 8 bp, Unknown
  misc_feature (1)..( 8): Result.002 file - promoters60/1568508
cttctcga

SEQ ID NO: 120348 - DNA, 8 bp, Unknown
  misc_feature (1)..( 8): Result.002 file - promoters60/1569568
caaataaa

SEQ ID NO: 120349 - DNA, 8 bp, Unknown
  misc_feature (1)..( 8): Result.002 file - promoters60/1569568
aaaataaa

SEQ ID NO: 120350 - DNA, 8 bp, Unknown
  misc_feature (1)..( 8): Result.002 file - promoters60/1569568
aaaataaa

SEQ ID NO: 120351 - DNA, 8 bp, Unknown
  misc_feature (1)..( 8): Result.002 file - promoters60/1569568
caaagaaa

SEQ ID NO: 120352 - DNA, 8 bp, Unknown
  misc_feature (1)..( 8): Result.002 file - promoters60/1569568
aaaataat

SEQ ID NO: 120353 - DNA, 8 bp, Unknown
  misc_feature (1)..( 8): Result.002 file - promoters60/1569568
taaaattt

SEQ ID NO: 120354 - DNA, 8 bp, Unknown
  misc_feature (1)..( 8): Result.002 file - promoters60/1569568
taaaataa

SEQ ID NO: 120355 - DNA, 8 bp, Unknown
  misc_feature (1)..( 8): Result.002 file - promoters60/1569568
gaaacttt

SEQ ID NO: 120356 - DNA, 8 bp, Unknown
  misc_feature (1)..( 8): Result.002 file - promoters60/1569568
aaaaataa

SEQ ID NO: 120357 - DNA, 7 bp, Unknown
  misc_feature (1)..( 7): Result.002 file - promoters60/1569568
aaataaa

SEQ ID NO: 120358 - DNA, 7 bp, Unknown
  misc_feature (1)..( 7): Result.002 file - promoters60/1569568
aaataac

SEQ ID NO: 120359 - DNA, 7 bp, Unknown
  misc_feature (1)..( 7): Result.002 file - promoters60/1569568
aaagaaa

SEQ ID NO: 120360 - DNA, 7 bp, Unknown
  misc_feature (1)..( 7): Result.002 file - promoters60/1569568
aaataat

SEQ ID NO: 120361 - DNA, 10 bp, Unknown
  misc_feature (1)..( 10): Result.002 file - promoters60/1569568
tttatttact

SEQ ID NO: 120362 - DNA, 10 bp, Unknown
  misc_feature (1)..( 10): Result.002 file - promoters60/1569568
ggtatttact

SEQ ID NO: 120363 - DNA, 10 bp, Unknown
  misc_feature (1)..( 10): Result.002 file - promoters60/1569568
tttatttcat

SEQ ID NO: 120364 - DNA, 10 bp, Unknown
  misc_feature (1)..( 10): Result.002 file - promoters60/1569568
aatatctcat

SEQ ID NO: 120365 - DNA, 9 bp, Unknown
  misc_feature (1)..( 9): Result.002 file - promoters60/1569568
aaaattaaa

SEQ ID NO: 120366 - DNA, 9 bp, Unknown
  misc_feature (1)..( 9): Result.002 file - promoters60/1569568
aaacttaat

SEQ ID NO: 120367 - DNA, 9 bp, Unknown
  misc_feature (1)..( 9): Result.002 file - promoters60/1569568
tagattaaa

SEQ ID NO: 120368 - DNA, 9 bp, Unknown
  misc_feature (1)..( 9): Result.002 file - promoters60/1569568
tgccttaat

SEQ ID NO: 120369 - DNA, 9 bp, Unknown
  misc_feature (1)..( 9): Result.002 file - promoters60/1569568
cagcttaat

SEQ ID NO: 120370 - DNA, 15 bp, Unknown
  misc_feature (1)..( 15): Result.002 file - promoters60/1569568
ttttactaaaaaaga

SEQ ID NO: 120371 - DNA, 15 bp, Unknown
  misc_feature (1)..( 15): Result.002 file - promoters60/1569568
ctttaataagaaata

SEQ ID NO: 120372 - DNA, 15 bp, Unknown
  misc_feature (1)..( 15): Result.002 file - promoters60/1569568
ttttacttgatctaa

SEQ ID NO: 120373 - DNA, 15 bp, Unknown
  misc_feature (1)..( 15): Result.002 file - promoters60/1569568
accaaaaaagaaata

SEQ ID NO: 120374 - DNA, 11 bp, Unknown
  misc_feature (1)..( 11): Result.002 file - promoters60/1569568
taatgtctcgt

SEQ ID NO: 120375 - DNA, 11 bp, Unknown
  misc_feature (1)..( 11): Result.002 file - promoters60/1569568
ctttgtctcca

SEQ ID NO: 120376 - DNA, 11 bp, Unknown
  misc_feature (1)..( 11): Result.002 file - promoters60/1569568
taatatctcat

SEQ ID NO: 120377 - DNA, 11 bp, Unknown
  misc_feature (1)..( 11): Result.002 file - promoters60/1569568
tgatggctcgg

SEQ ID NO: 120378 - DNA, 11 bp, Unknown
  misc_feature (1)..( 11): Result.002 file - promoters60/1569568
ttttatttcat

SEQ ID NO: 120379 - DNA, 14 bp, Unknown
  misc_feature (1)..( 14): Result.002 file - promoters60/1569568
ctcttttatttatt

SEQ ID NO: 120380 - DNA, 14 bp, Unknown
  misc_feature (1)..( 14): Result.002 file - promoters60/1569568
aaattttataatca

SEQ ID NO: 120381 - DNA, 14 bp, Unknown
  misc_feature (1)..( 14): Result.002 file - promoters60/1569568
tctctttatttatt

SEQ ID NO: 120382 - DNA, 14 bp, Unknown
  misc_feature (1)..( 14): Result.002 file - promoters60/1569568
aaaatttacctaac

SEQ ID NO: 120383 - DNA, 11 bp, Unknown
  misc_feature (1)..( 11): Result.002 file - promoters60/1569568
tttaaccaaaa

SEQ ID NO: 120384 - DNA, 11 bp, Unknown
  misc_feature (1)..( 11): Result.002 file - promoters60/1569568
tttcaccaagg

SEQ ID NO: 120385 - DNA, 11 bp, Unknown
  misc_feature (1)..( 11): Result.002 file - promoters60/1569568
tataaccaaaa

SEQ ID NO: 120386 - DNA, 11 bp, Unknown
  misc_feature (1)..( 11): Result.002 file - promoters60/1569568
ataaactaaac

SEQ ID NO: 120387 - DNA, 10 bp, Unknown
  misc_feature (1)..( 10): Result.002 file - promoters60/1569721
atattattag

SEQ ID NO: 120388 - DNA, 10 bp, Unknown
  misc_feature (1)..( 10): Result.002 file - promoters60/1569721
atattaataa

SEQ ID NO: 120389 - DNA, 10 bp, Unknown
  misc_feature (1)..( 10): Result.002 file - promoters60/1569721
atattattag

SEQ ID NO: 120390 - DNA, 10 bp, Unknown
  misc_feature (1)..( 10): Result.002 file - promoters60/1569721
atataattat

SEQ ID NO: 120391 - DNA, 10 bp, Unknown
  misc_feature (1)..( 10): Result.002 file - promoters60/1569721
atataaagct

SEQ ID NO: 120392 - DNA, 10 bp, Unknown
  misc_feature (1)..( 10): Result.002 file - promoters60/1569721
atacaatgaa

SEQ ID NO: 120393 - DNA, 10 bp, Unknown
  misc_feature (1)..( 10): Result.002 file - promoters60/1569721
tgtttgttta

SEQ ID NO: 120394 - DNA, 10 bp, Unknown
  misc_feature (1)..( 10): Result.002 file - promoters60/1569721
tatttattta

SEQ ID NO: 120395 - DNA, 10 bp, Unknown
  misc_feature (1)..( 10): Result.002 file - promoters60/1569721
tttttatttc

SEQ ID NO: 120396 - DNA, 10 bp, Unknown
  misc_feature (1)..( 10): Result.002 file - promoters60/1569721
cttttgtttc

SEQ ID NO: 120397 - DNA, 10 bp, Unknown
  misc_feature (1)..( 10): Result.002 file - promoters60/1569721
actttttttg

SEQ ID NO: 120398 - DNA, 10 bp, Unknown
  misc_feature (1)..( 10): Result.002 file - promoters60/1569721
aattcattag

SEQ ID NO: 120399 - DNA, 10 bp, Unknown
  misc_feature (1)..( 10): Result.002 file - promoters60/1569721
aatgcatgaa

SEQ ID NO: 120400 - DNA, 9 bp, Unknown
  misc_feature (1)..( 9): Result.002 file - promoters60/1569721
aattaaaat

SEQ ID NO: 120401 - DNA, 9 bp, Unknown
  misc_feature (1)..( 9): Result.002 file - promoters60/1569721
aatgaaaaa

SEQ ID NO: 120402 - DNA, 9 bp, Unknown
  misc_feature (1)..( 9): Result.002 file - promoters60/1569721
aataaaaaa

SEQ ID NO: 120403 - DNA, 9 bp, Unknown
  misc_feature (1)..( 9): Result.002 file - promoters60/1569721
gatgaaacc

SEQ ID NO: 120404 - DNA, 9 bp, Unknown
  misc_feature (1)..( 9): Result.002 file - promoters60/1569721
cagaaaaaa

SEQ ID NO: 120405 - DNA, 9 bp, Unknown
  misc_feature (1)..( 9): Result.002 file - promoters60/1569721
aaaaaaaaa

SEQ ID NO: 120406 - DNA, 10 bp, Unknown
  misc_feature (1)..( 10): Result.002 file - promoters60/1569721
aaaatattaa

SEQ ID NO: 120407 - DNA, 10 bp, Unknown
  misc_feature (1)..( 10): Result.002 file - promoters60/1569721
taaaaattaa

SEQ ID NO: 120408 - DNA, 10 bp, Unknown
  misc_feature (1)..( 10): Result.002 file - promoters60/1569721
aaaagattca

SEQ ID NO: 120409 - DNA, 10 bp, Unknown
  misc_feature (1)..( 10): Result.002 file - promoters60/1569721
gtaaaattcc

SEQ ID NO: 120410 - DNA, 10 bp, Unknown
  misc_feature (1)..( 10): Result.002 file - promoters60/1569721
taacaattct

SEQ ID NO: 120411 - DNA, 10 bp, Unknown
  misc_feature (1)..( 10): Result.002 file - promoters60/1569721
ataaacttaa

SEQ ID NO: 120412 - DNA, 12 bp, Unknown
  misc_feature (1)..( 12): Result.002 file - promoters60/1569721
tgaaaaacaaac

SEQ ID NO: 120413 - DNA, 12 bp, Unknown
  misc_feature (1)..( 12): Result.002 file - promoters60/1569721
ctataaataaat

SEQ ID NO: 120414 - DNA, 12 bp, Unknown
  misc_feature (1)..( 12): Result.002 file - promoters60/1569721
ttttaaaaaaag

SEQ ID NO: 120415 - DNA, 12 bp, Unknown
  misc_feature (1)..( 12): Result.002 file - promoters60/1569721
atgtatatatta

SEQ ID NO: 120416 - DNA, 12 bp, Unknown
  misc_feature (1)..( 12): Result.002 file - promoters60/1569721
ctggtcataaat

SEQ ID NO: 120417 - DNA, 12 bp, Unknown
  misc_feature (1)..( 12): Result.002 file - promoters60/1569721
ttagaaacagac

SEQ ID NO: 120418 - DNA, 8 bp, Unknown
  misc_feature (1)..( 8): Result.002 file - promoters60/1569763
agaagaac

SEQ ID NO: 120419 - DNA, 8 bp, Unknown
  misc_feature (1)..( 8): Result.002 file - promoters60/1569763
agaggaac

SEQ ID NO: 120420 - DNA, 8 bp, Unknown
  misc_feature (1)..( 8): Result.002 file - promoters60/1569763
tcaagaac

SEQ ID NO: 120421 - DNA, 8 bp, Unknown
  misc_feature (1)..( 8): Result.002 file - promoters60/1569763
tcaggaaa

SEQ ID NO: 120422 - DNA, 6 bp, Unknown
  misc_feature (1)..( 6): Result.002 file - promoters60/1570085
tattat

SEQ ID NO: 120423 - DNA, 6 bp, Unknown
  misc_feature (1)..( 6): Result.002 file - promoters60/1570085
tattat

SEQ ID NO: 120424 - DNA, 7 bp, Unknown
  misc_feature (1)..( 7): Result.002 file - promoters60/1570085
tttattt

SEQ ID NO: 120425 - DNA, 7 bp, Unknown
  misc_feature (1)..( 7): Result.002 file - promoters60/1570085
tttgttt

SEQ ID NO: 120426 - DNA, 7 bp, Unknown
  misc_feature (1)..( 7): Result.002 file - promoters60/1570085
cttattt

SEQ ID NO: 120427 - DNA, 8 bp, Unknown
  misc_feature (1)..( 8): Result.002 file - promoters60/1570085
tttgtaat

SEQ ID NO: 120428 - DNA, 8 bp, Unknown
  misc_feature (1)..( 8): Result.002 file - promoters60/1570085
tttggaat

SEQ ID NO: 120429 - DNA, 8 bp, Unknown
  misc_feature (1)..( 8): Result.002 file - promoters60/1570085
tagtccaa

SEQ ID NO: 120430 - DNA, 8 bp, Unknown
  misc_feature (1)..( 8): Result.002 file - promoters60/1570085
taggccaa

SEQ ID NO: 120431 - DNA, 9 bp, Unknown
  misc_feature (1)..( 9): Result.002 file - promoters60/1570085
aaagctata

SEQ ID NO: 120432 - DNA, 9 bp, Unknown
  misc_feature (1)..( 9): Result.002 file - promoters60/1570085
aaagctata

SEQ ID NO: 120433 - DNA, 7 bp, Unknown
  misc_feature (1)..( 7): Result.002 file - promoters60/1570085
tctcata

SEQ ID NO: 120434 - DNA, 7 bp, Unknown
  misc_feature (1)..( 7): Result.002 file - promoters60/1570085
tcttata

SEQ ID NO: 120435 - DNA, 8 bp, Unknown
  misc_feature (1)..( 8): Result.002 file - promoters60/1570085
ttgctaac

SEQ ID NO: 120436 - DNA, 8 bp, Unknown
  misc_feature (1)..( 8): Result.002 file - promoters60/1570085
ttgttaac

SEQ ID NO: 120437 - DNA, 6 bp, Unknown
  misc_feature (1)..( 6): Result.002 file - promoters60/1570085
tatcat

SEQ ID NO: 120438 - DNA, 6 bp, Unknown
  misc_feature (1)..( 6): Result.002 file - promoters60/1570085
tatcat

SEQ ID NO: 120439 - DNA, 10 bp, Unknown
  misc_feature (1)..( 10): Result.002 file - promoters60/1570085
tctatatata

SEQ ID NO: 120440 - DNA, 10 bp, Unknown
  misc_feature (1)..( 10): Result.002 file - promoters60/1570085
tctatatata

SEQ ID NO: 120441 - DNA, 6 bp, Unknown
  misc_feature (1)..( 6): Result.002 file - promoters60/1570085
catttt

SEQ ID NO: 120442 - DNA, 6 bp, Unknown
  misc_feature (1)..( 6): Result.002 file - promoters60/1570085
catttt

SEQ ID NO: 120443 - DNA, 6 bp, Unknown
  misc_feature (1)..( 6): Result.002 file - promoters60/1570085
ttttat

SEQ ID NO: 120444 - DNA, 6 bp, Unknown
  misc_feature (1)..( 6): Result.002 file - promoters60/1570085
ttttat

SEQ ID NO: 120445 - DNA, 6 bp, Unknown
  misc_feature (1)..( 6): Result.002 file - promoters60/1570085
ttattt

SEQ ID NO: 120446 - DNA, 6 bp, Unknown
  misc_feature (1)..( 6): Result.002 file - promoters60/1570085
ttattt

SEQ ID NO: 120447 - DNA, 6 bp, Unknown
  misc_feature (1)..( 6): Result.002 file - promoters60/1570085
cattta

SEQ ID NO: 120448 - DNA, 6 bp, Unknown
  misc_feature (1)..( 6): Result.002 file - promoters60/1570085
cattta

SEQ ID NO: 120449 - DNA, 6 bp, Unknown
  misc_feature (1)..( 6): Result.002 file - promoters60/1570085
gttgca

SEQ ID NO: 120450 - DNA, 6 bp, Unknown
  misc_feature (1)..( 6): Result.002 file - promoters60/1570085
gttgca

SEQ ID NO: 120451 - DNA, 8 bp, Unknown
  misc_feature (1)..( 8): Result.002 file - promoters60/1570085
aatagtta

SEQ ID NO: 120452 - DNA, 8 bp, Unknown
  misc_feature (1)..( 8): Result.002 file - promoters60/1570085
aataatta

SEQ ID NO: 120453 - DNA, 8 bp, Unknown
  misc_feature (1)..( 8): Result.002 file - promoters60/1570085
atatttac

SEQ ID NO: 120454 - DNA, 8 bp, Unknown
  misc_feature (1)..( 8): Result.002 file - promoters60/1570085
atatatac

SEQ ID NO: 120455 - DNA, 8 bp, Unknown
  misc_feature (1)..( 8): Result.002 file - promoters60/1570085
ttatataa

SEQ ID NO: 120456 - DNA, 7 bp, Unknown
  misc_feature (1)..( 7): Result.002 file - promoters60/1570085
ttagaaa

SEQ ID NO: 120457 - DNA, 7 bp, Unknown
  misc_feature (1)..( 7): Result.002 file - promoters60/1570085
ttagaaa

SEQ ID NO: 120458 - DNA, 7 bp, Unknown
  misc_feature (1)..( 7): Result.002 file - promoters60/1570085
tcatata

SEQ ID NO: 120459 - DNA, 7 bp, Unknown
  misc_feature (1)..( 7): Result.002 file - promoters60/1570085
tcaaata

SEQ ID NO: 120460 - DNA, 7 bp, Unknown
  misc_feature (1)..( 7): Result.002 file - promoters60/1570085
aaaaaag

SEQ ID NO: 120461 - DNA, 7 bp, Unknown
  misc_feature (1)..( 7): Result.002 file - promoters60/1570085
aaaaaag

SEQ ID NO: 120462 - DNA, 7 bp, Unknown
  misc_feature (1)..( 7): Result.002 file - promoters60/1570085
agaatta

SEQ ID NO: 120463 - DNA, 7 bp, Unknown
  misc_feature (1)..( 7): Result.002 file - promoters60/1570085
agactta

SEQ ID NO: 120464 - DNA, 7 bp, Unknown
  misc_feature (1)..( 7): Result.002 file - promoters60/1570085
ataattt

SEQ ID NO: 120465 - DNA, 7 bp, Unknown
  misc_feature (1)..( 7): Result.002 file - promoters60/1570085
ataattt

SEQ ID NO: 120466 - DNA, 7 bp, Unknown
  misc_feature (1)..( 7): Result.002 file - promoters60/1570085
aactatt

SEQ ID NO: 120467 - DNA, 7 bp, Unknown
  misc_feature (1)..( 7): Result.002 file - promoters60/1570085
aacaatt

SEQ ID NO: 120468 - DNA, 9 bp, Unknown
  misc_feature (1)..( 9): Result.002 file - promoters60/1570085
atcacatga

SEQ ID NO: 120469 - DNA, 9 bp, Unknown
  misc_feature (1)..( 9): Result.002 file - promoters60/1570085
atcacatga

SEQ ID NO: 120470 - DNA, 8 bp, Unknown
  misc_feature (1)..( 8): Result.002 file - promoters60/1570085
aacctttc

SEQ ID NO: 120471 - DNA, 8 bp, Unknown
  misc_feature (1)..( 8): Result.002 file - promoters60/1570085
aaccattc

SEQ ID NO: 120472 - DNA, 8 bp, Unknown
  misc_feature (1)..( 8): Result.002 file - promoters60/1570107
tcaataac

SEQ ID NO: 120473 - DNA, 8 bp, Unknown
  misc_feature (1)..( 8): Result.002 file - promoters60/1570107
tcaacaac

SEQ ID NO: 120474 - DNA, 7 bp, Unknown
  misc_feature (1)..( 7): Result.002 file - promoters60/1570107
attaaaa

SEQ ID NO: 120475 - DNA, 7 bp, Unknown
  misc_feature (1)..( 7): Result.002 file - promoters60/1570107
tttaaaa

SEQ ID NO: 120476 - DNA, 8 bp, Unknown
  misc_feature (1)..( 8): Result.002 file - promoters60/1570107
tttcaaaa

SEQ ID NO: 120477 - DNA, 7 bp, Unknown
  misc_feature (1)..( 7): Result.002 file - promoters60/1570107
aattaag

SEQ ID NO: 120478 - DNA, 7 bp, Unknown
  misc_feature (1)..( 7): Result.002 file - promoters60/1570107
aattaag

SEQ ID NO: 120479 - DNA, 8 bp, Unknown
  misc_feature (1)..( 8): Result.002 file - promoters60/1570107
atgttgtg

SEQ ID NO: 120480 - DNA, 8 bp, Unknown
  misc_feature (1)..( 8): Result.002 file - promoters60/1570107
atgtagtg

SEQ ID NO: 120481 - DNA, 8 bp, Unknown
  misc_feature (1)..( 8): Result.002 file - promoters60/1570107
agaaaaaa

SEQ ID NO: 120482 - DNA, 8 bp, Unknown
  misc_feature (1)..( 8): Result.002 file - promoters60/1570107
tcaaaaaa

SEQ ID NO: 120483 - DNA, 8 bp, Unknown
  misc_feature (1)..( 8): Result.002 file - promoters60/1570107
agacaaac

SEQ ID NO: 120484 - DNA, 8 bp, Unknown
  misc_feature (1)..( 8): Result.002 file - promoters60/1570107
aaaagatc

SEQ ID NO: 120485 - DNA, 8 bp, Unknown
  misc_feature (1)..( 8): Result.002 file - promoters60/1570107
aaaaaatc

SEQ ID NO: 120486 - DNA, 16 bp, Unknown
  misc_feature (1)..( 16): Result.002 file - promoters60/1570107
acggtcacataataaa

SEQ ID NO: 120487 - DNA, 16 bp, Unknown
  misc_feature (1)..( 16): Result.002 file - promoters60/1570107
caataaccataataaa

SEQ ID NO: 120488 - DNA, 16 bp, Unknown
  misc_feature (1)..( 16): Result.002 file - promoters60/1570107
caattaccttaattat

SEQ ID NO: 120489 - DNA, 7 bp, Unknown
  misc_feature (1)..( 7): Result.002 file - promoters60/1570107
aaataga

SEQ ID NO: 120490 - DNA, 7 bp, Unknown
  misc_feature (1)..( 7): Result.002 file - promoters60/1570107
aaaaaga

SEQ ID NO: 120491 - DNA, 6 bp, Unknown
  misc_feature (1)..( 6): Result.002 file - promoters60/1570107
accaaa

SEQ ID NO: 120492 - DNA, 6 bp, Unknown
  misc_feature (1)..( 6): Result.002 file - promoters60/1570107
accaaa

SEQ ID NO: 120493 - DNA, 8 bp, Unknown
  misc_feature (1)..( 8): Result.002 file - promoters60/1570107
tataattt

SEQ ID NO: 120494 - DNA, 8 bp, Unknown
  misc_feature (1)..( 8): Result.002 file - promoters60/1570107
tatcattt

SEQ ID NO: 120495 - DNA, 7 bp, Unknown
  misc_feature (1)..( 7): Result.002 file - promoters60/1570107
ttcaaac

SEQ ID NO: 120496 - DNA, 7 bp, Unknown
  misc_feature (1)..( 7): Result.002 file - promoters60/1570107
ttcaaac

SEQ ID NO: 120497 - DNA, 6 bp, Unknown
  misc_feature (1)..( 6): Result.002 file - promoters60/1570107
gaaatg

SEQ ID NO: 120498 - DNA, 6 bp, Unknown
  misc_feature (1)..( 6): Result.002 file - promoters60/1570107
gaaatg

SEQ ID NO: 120499 - DNA, 6 bp, Unknown
  misc_feature (1)..( 6): Result.002 file - promoters60/1570107
aagcag

SEQ ID NO: 120500 - DNA, 6 bp, Unknown
  misc_feature (1)..( 6): Result.002 file - promoters60/1570107
aagcag

SEQ ID NO: 120501 - DNA, 6 bp, Unknown
  misc_feature (1)..( 6): Result.002 file - promoters60/1570107
gccgac

SEQ ID NO: 120502 - DNA, 6 bp, Unknown
  misc_feature (1)..( 6): Result.002 file - promoters60/1570107
gccgac

SEQ ID NO: 120503 - DNA, 9 bp, Unknown
  misc_feature (1)..( 9): Result.002 file - promoters60/1570107
aaaataaaa

SEQ ID NO: 120504 - DNA, 9 bp, Unknown
  misc_feature (1)..( 9): Result.002 file - promoters60/1570107
caaaaaaaa

SEQ ID NO: 120505 - DNA, 9 bp, Unknown
  misc_feature (1)..( 9): Result.002 file - promoters60/1570107
caaaaaagc

SEQ ID NO: 120506 - DNA, 6 bp, Unknown
  misc_feature (1)..( 6): Result.002 file - promoters60/1570107
tctctc

SEQ ID NO: 120507 - DNA, 6 bp, Unknown
  misc_feature (1)..( 6): Result.002 file - promoters60/1570107
tctctc

SEQ ID NO: 120508 - DNA, 11 bp, Unknown
  misc_feature (1)..( 11): Result.002 file - promoters60/1570107
agagagtcggc

SEQ ID NO: 120509 - DNA, 11 bp, Unknown
  misc_feature (1)..( 11): Result.002 file - promoters60/1570107
agagattcgta

SEQ ID NO: 120510 - DNA, 11 bp, Unknown
  misc_feature (1)..( 11): Result.002 file - promoters60/1570107
taagatacgta

SEQ ID NO: 120511 - DNA, 6 bp, Unknown
  misc_feature (1)..( 6): Result.002 file - promoters60/1570107
tatttt

SEQ ID NO: 120512 - DNA, 6 bp, Unknown
  misc_feature (1)..( 6): Result.002 file - promoters60/1570107
tatttt

SEQ ID NO: 120513 - DNA, 6 bp, Unknown
  misc_feature (1)..( 6): Result.002 file - promoters60/1570107
tattat

SEQ ID NO: 120514 - DNA, 6 bp, Unknown
  misc_feature (1)..( 6): Result.002 file - promoters60/1570107
tattat

SEQ ID NO: 120515 - DNA, 8 bp, Unknown
  misc_feature (1)..( 8): Result.002 file - promoters60/1570107
aattcttc

SEQ ID NO: 120516 - DNA, 8 bp, Unknown
  misc_feature (1)..( 8): Result.002 file - promoters60/1570107
aattgttc

SEQ ID NO: 120517 - DNA, 8 bp, Unknown
  misc_feature (1)..( 8): Result.002 file - promoters60/1570107
tttacaaa

SEQ ID NO: 120518 - DNA, 8 bp, Unknown
  misc_feature (1)..( 8): Result.002 file - promoters60/1570107
ttttcaaa

SEQ ID NO: 120519 - DNA, 8 bp, Unknown
  misc_feature (1)..( 8): Result.002 file - promoters60/1570107
taataaaa

SEQ ID NO: 120520 - DNA, 8 bp, Unknown
  misc_feature (1)..( 8): Result.002 file - promoters60/1570107
taaaaaaa

SEQ ID NO: 120521 - DNA, 6 bp, Unknown
  misc_feature (1)..( 6): Result.002 file - promoters60/1570107
aaaaat

SEQ ID NO: 120522 - DNA, 6 bp, Unknown
  misc_feature (1)..( 6): Result.002 file - promoters60/1570107
aaaaat

SEQ ID NO: 120523 - DNA, 7 bp, Unknown
  misc_feature (1)..( 7): Result.002 file - promoters60/1570107
ctttttt

SEQ ID NO: 120524 - DNA, 7 bp, Unknown
  misc_feature (1)..( 7): Result.002 file - promoters60/1570107
ctttttt

SEQ ID NO: 120525 - DNA, 9 bp, Unknown
  misc_feature (1)..( 9): Result.002 file - promoters60/1570116
aataaatta

SEQ ID NO: 120526 - DNA, 9 bp, Unknown
  misc_feature (1)..( 9): Result.002 file - promoters60/1570116
aataaacgc

SEQ ID NO: 120527 - DNA, 9 bp, Unknown
  misc_feature (1)..( 9): Result.002 file - promoters60/1570116
aaaaaaagt

SEQ ID NO: 120528 - DNA, 9 bp, Unknown
  misc_feature (1)..( 9): Result.002 file - promoters60/1570116
aatacattt

SEQ ID NO: 120529 - DNA, 9 bp, Unknown
  misc_feature (1)..( 9): Result.002 file - promoters60/1570116
aatacatac

SEQ ID NO: 120530 - DNA, 9 bp, Unknown
  misc_feature (1)..( 9): Result.002 file - promoters60/1570116
taaacattt

SEQ ID NO: 120531 - DNA, 6 bp, Unknown
  misc_feature (1)..( 6): Result.002 file - promoters60/1570293
cttttt

SEQ ID NO: 120532 - DNA, 6 bp, Unknown
  misc_feature (1)..( 6): Result.002 file - promoters60/1570293
cttttt

SEQ ID NO: 120533 - DNA, 6 bp, Unknown
  misc_feature (1)..( 6): Result.002 file - promoters60/1570293
ttttaa

SEQ ID NO: 120534 - DNA, 6 bp, Unknown
  misc_feature (1)..( 6): Result.002 file - promoters60/1570293
ttttaa

SEQ ID NO: 120535 - DNA, 6 bp, Unknown
  misc_feature (1)..( 6): Result.002 file - promoters60/1570293
aacaga

SEQ ID NO: 120536 - DNA, 6 bp, Unknown
  misc_feature (1)..( 6): Result.002 file - promoters60/1570293
aacaga

SEQ ID NO: 120537 - DNA, 7 bp, Unknown
  misc_feature (1)..( 7): Result.002 file - promoters60/1570293
cacaaca

SEQ ID NO: 120538 - DNA, 7 bp, Unknown
  misc_feature (1)..( 7): Result.002 file - promoters60/1570293
caccaca

SEQ ID NO: 120539 - DNA, 6 bp, Unknown
  misc_feature (1)..( 6): Result.002 file - promoters60/1570293
acaaaa

SEQ ID NO: 120540 - DNA, 6 bp, Unknown
  misc_feature (1)..( 6): Result.002 file - promoters60/1570293
acaaaa

SEQ ID NO: 120541 - DNA, 8 bp, Unknown
  misc_feature (1)..( 8): Result.002 file - promoters60/1570293
aaagtttt

SEQ ID NO: 120542 - DNA, 8 bp, Unknown
  misc_feature (1)..( 8): Result.002 file - promoters60/1570293
aaaatttt

SEQ ID NO: 120543 - DNA, 8 bp, Unknown
  misc_feature (1)..( 8): Result.002 file - promoters60/1570293
cgaatttt

SEQ ID NO: 120544 - DNA, 6 bp, Unknown
  misc_feature (1)..( 6): Result.002 file - promoters60/1570293
gaataa

SEQ ID NO: 120545 - DNA, 6 bp, Unknown
  misc_feature (1)..( 6): Result.002 file - promoters60/1570293
gaataa

SEQ ID NO: 120546 - DNA, 8 bp, Unknown
  misc_feature (1)..( 8): Result.002 file - promoters60/1570293
ttttcttc

SEQ ID NO: 120547 - DNA, 8 bp, Unknown
  misc_feature (1)..( 8): Result.002 file - promoters60/1570293
ttttattc

SEQ ID NO: 120548 - DNA, 8 bp, Unknown
  misc_feature (1)..( 8): Result.002 file - promoters60/1570293
aaaattgc

SEQ ID NO: 120549 - DNA, 8 bp, Unknown
  misc_feature (1)..( 8): Result.002 file - promoters60/1570293
gaaattgt

SEQ ID NO: 120550 - DNA, 8 bp, Unknown
  misc_feature (1)..( 8): Result.002 file - promoters60/1570293
gaatttgt

SEQ ID NO: 120551 - DNA, 8 bp, Unknown
  misc_feature (1)..( 8): Result.002 file - promoters60/1570293
ggatagtg

SEQ ID NO: 120552 - DNA, 8 bp, Unknown
  misc_feature (1)..( 8): Result.002 file - promoters60/1570293
ggaaagtg

SEQ ID NO: 120553 - DNA, 6 bp, Unknown
  misc_feature (1)..( 6): Result.002 file - promoters60/1570293
cacaca

SEQ ID NO: 120554 - DNA, 6 bp, Unknown
  misc_feature (1)..( 6): Result.002 file - promoters60/1570293
cacaca

SEQ ID NO: 120555 - DNA, 6 bp, Unknown
  misc_feature (1)..( 6): Result.002 file - promoters60/1570293
aaggta

SEQ ID NO: 120556 - DNA, 6 bp, Unknown
  misc_feature (1)..( 6): Result.002 file - promoters60/1570293
aaggta

SEQ ID NO: 120557 - DNA, 7 bp, Unknown
  misc_feature (1)..( 7): Result.002 file - promoters60/1570293
tataatt

SEQ ID NO: 120558 - DNA, 7 bp, Unknown
  misc_feature (1)..( 7): Result.002 file - promoters60/1570293
tatgatt

SEQ ID NO: 120559 - DNA, 6 bp, Unknown
  misc_feature (1)..( 6): Result.002 file - promoters60/1570293
tcgtta

SEQ ID NO: 120560 - DNA, 6 bp, Unknown
  misc_feature (1)..( 6): Result.002 file - promoters60/1570293
tcgtta

SEQ ID NO: 120561 - DNA, 7 bp, Unknown
  misc_feature (1)..( 7): Result.002 file - promoters60/1570293
aaaatga

SEQ ID NO: 120562 - DNA, 7 bp, Unknown
  misc_feature (1)..( 7): Result.002 file - promoters60/1570293
aaactga

SEQ ID NO: 120563 - DNA, 8 bp, Unknown
  misc_feature (1)..( 8): Result.002 file - promoters60/1570293
cgggaaaa

SEQ ID NO: 120564 - DNA, 8 bp, Unknown
  misc_feature (1)..( 8): Result.002 file - promoters60/1570293
cgggaaaa

SEQ ID NO: 120565 - DNA, 7 bp, Unknown
  misc_feature (1)..( 7): Result.002 file - promoters60/1570293
ggaatat

SEQ ID NO: 120566 - DNA, 7 bp, Unknown
  misc_feature (1)..( 7): Result.002 file - promoters60/1570293
ggaatat

SEQ ID NO: 120567 - DNA, 7 bp, Unknown
  misc_feature (1)..( 7): Result.002 file - promoters60/1570293
gaataaa

SEQ ID NO: 120568 - DNA, 7 bp, Unknown
  misc_feature (1)..( 7): Result.002 file - promoters60/1570293
gaaaaaa

SEQ ID NO: 120569 - DNA, 7 bp, Unknown
  misc_feature (1)..( 7): Result.002 file - promoters60/1570293
aaaaaaa

SEQ ID NO: 120570 - DNA, 7 bp, Unknown
  misc_feature (1)..( 7): Result.002 file - promoters60/1570293
aaaaaaa

SEQ ID NO: 120571 - DNA, 7 bp, Unknown
  misc_feature (1)..( 7): Result.002 file - promoters60/1570293
acaaaat

SEQ ID NO: 120572 - DNA, 7 bp, Unknown
  misc_feature (1)..( 7): Result.002 file - promoters60/1570293
acagaat

SEQ ID NO: 120573 - DNA, 7 bp, Unknown
  misc_feature (1)..( 7): Result.002 file - promoters60/1570293
ggtttgg

SEQ ID NO: 120574 - DNA, 7 bp, Unknown
  misc_feature (1)..( 7): Result.002 file - promoters60/1570293
ggtttgg

SEQ ID NO: 120575 - DNA, 10 bp, Unknown
  misc_feature (1)..( 10): Result.002 file - promoters60/1570474
attataaaac

SEQ ID NO: 120576 - DNA, 10 bp, Unknown
  misc_feature (1)..( 10): Result.002 file - promoters60/1570474
tttataatgt

SEQ ID NO: 120577 - DNA, 11 bp, Unknown
  misc_feature (1)..( 11): Result.002 file - promoters60/1570474
tttcatatgta

SEQ ID NO: 120578 - DNA, 11 bp, Unknown
  misc_feature (1)..( 11): Result.002 file - promoters60/1570474
acttagattca

SEQ ID NO: 120579 - DNA, 11 bp, Unknown
  misc_feature (1)..( 11): Result.002 file - promoters60/1570474
atttttaaatt

SEQ ID NO: 120580 - DNA, 11 bp, Unknown
  misc_feature (1)..( 11): Result.002 file - promoters60/1570474
ctttttaaccg

SEQ ID NO: 120581 - DNA, 11 bp, Unknown
  misc_feature (1)..( 11): Result.002 file - promoters60/1570474
agtaagattct

SEQ ID NO: 120582 - DNA, 11 bp, Unknown
  misc_feature (1)..( 11): Result.002 file - promoters60/1570474
ttgtttaacaa

SEQ ID NO: 120583 - DNA, 9 bp, Unknown
  misc_feature (1)..( 9): Result.002 file - promoters60/1570474
ataatttga

SEQ ID NO: 120584 - DNA, 9 bp, Unknown
  misc_feature (1)..( 9): Result.002 file - promoters60/1570474
ctaattttg

SEQ ID NO: 120585 - DNA, 9 bp, Unknown
  misc_feature (1)..( 9): Result.002 file - promoters60/1570474
atattttta

SEQ ID NO: 120586 - DNA, 10 bp, Unknown
  misc_feature (1)..( 10): Result.002 file - promoters60/1570474
ataagtttgt

SEQ ID NO: 120587 - DNA, 10 bp, Unknown
  misc_feature (1)..( 10): Result.002 file - promoters60/1570474
tgatatttat

SEQ ID NO: 120588 - DNA, 10 bp, Unknown
  misc_feature (1)..( 10): Result.002 file - promoters60/1570474
attgattttt

SEQ ID NO: 120589 - DNA, 12 bp, Unknown
  misc_feature (1)..( 12): Result.002 file - promoters60/1570474
taataaattcat

SEQ ID NO: 120590 - DNA, 12 bp, Unknown
  misc_feature (1)..( 12): Result.002 file - promoters60/1570474
ttatatattttt

SEQ ID NO: 120591 - DNA, 12 bp, Unknown
  misc_feature (1)..( 12): Result.002 file - promoters60/1570474
taacaaatacca

SEQ ID NO: 120592 - DNA, 12 bp, Unknown
  misc_feature (1)..( 12): Result.002 file - promoters60/1570474
atatttatgtgt

SEQ ID NO: 120593 - DNA, 12 bp, Unknown
  misc_feature (1)..( 12): Result.002 file - promoters60/1570474
tgattcatgcta

SEQ ID NO: 120594 - DNA, 12 bp, Unknown
  misc_feature (1)..( 12): Result.002 file - promoters60/1570474
cgattgattttt

SEQ ID NO: 120595 - DNA, 11 bp, Unknown
  misc_feature (1)..( 11): Result.002 file - promoters60/1570622
ccatctccaca

SEQ ID NO: 120596 - DNA, 11 bp, Unknown
  misc_feature (1)..( 11): Result.002 file - promoters60/1570622
aaatctccaac

SEQ ID NO: 120597 - DNA, 11 bp, Unknown
  misc_feature (1)..( 11): Result.002 file - promoters60/1570622
acatctcgttg

SEQ ID NO: 120598 - DNA, 11 bp, Unknown
  misc_feature (1)..( 11): Result.002 file - promoters60/1570622
ttctctgcaat

SEQ ID NO: 120599 - DNA, 11 bp, Unknown
  misc_feature (1)..( 11): Result.002 file - promoters60/1570622
aaaactctatt

SEQ ID NO: 120600 - DNA, 11 bp, Unknown
  misc_feature (1)..( 11): Result.002 file - promoters60/1570622
taagctgcaat

SEQ ID NO: 120601 - DNA, 11 bp, Unknown
  misc_feature (1)..( 11): Result.002 file - promoters60/1570622
taaactctgat

SEQ ID NO: 120602 - DNA, 9 bp, Unknown
  misc_feature (1)..( 9): Result.002 file - promoters60/1570860
gattagaaa

SEQ ID NO: 120603 - DNA, 9 bp, Unknown
  misc_feature (1)..( 9): Result.002 file - promoters60/1570860
gatgagaac

SEQ ID NO: 120604 - DNA, 9 bp, Unknown
  misc_feature (1)..( 9): Result.002 file - promoters60/1570860
cattcgaaa

SEQ ID NO: 120605 - DNA, 9 bp, Unknown
  misc_feature (1)..( 9): Result.002 file - promoters60/1570860
aattcgaat

SEQ ID NO: 120606 - DNA, 10 bp, Unknown
  misc_feature (1)..( 10): Result.002 file - promoters60/1570860
tttgctgaat

SEQ ID NO: 120607 - DNA, 10 bp, Unknown
  misc_feature (1)..( 10): Result.002 file - promoters60/1570860
aatgcagaaa

SEQ ID NO: 120608 - DNA, 12 bp, Unknown
  misc_feature (1)..( 12): Result.002 file - promoters60/1570860
agagaaagaaag

SEQ ID NO: 120609 - DNA, 12 bp, Unknown
  misc_feature (1)..( 12): Result.002 file - promoters60/1570860
agaaaaaattca

SEQ ID NO: 120610 - DNA, 12 bp, Unknown
  misc_feature (1)..( 12): Result.002 file - promoters60/1570860
taaaaaaatctt

SEQ ID NO: 120611 - DNA, 12 bp, Unknown
  misc_feature (1)..( 12): Result.002 file - promoters60/1570860
aaataaaacatt

SEQ ID NO: 120612 - DNA, 12 bp, Unknown
  misc_feature (1)..( 12): Result.002 file - promoters60/1570860
ttctaaaatctt

SEQ ID NO: 120613 - DNA, 12 bp, Unknown
  misc_feature (1)..( 12): Result.002 file - promoters60/1570860
atcatcaatctt

SEQ ID NO: 120614 - DNA, 16 bp, Unknown
  misc_feature (1)..( 16): Result.002 file - promoters60/1570860
aaactaattagatata

SEQ ID NO: 120615 - DNA, 16 bp, Unknown
  misc_feature (1)..( 16): Result.002 file - promoters60/1570860
ttcccacttaaatatc

SEQ ID NO: 120616 - DNA, 16 bp, Unknown
  misc_feature (1)..( 16): Result.002 file - promoters60/1570860
aaactaattaaatagt

SEQ ID NO: 120617 - DNA, 16 bp, Unknown
  misc_feature (1)..( 16): Result.002 file - promoters60/1570860
cgataactgaaaagtc

SEQ ID NO: 120618 - DNA, 16 bp, Unknown
  misc_feature (1)..( 16): Result.002 file - promoters60/1570860
ttcaaactcaaaatca

SEQ ID NO: 120619 - DNA, 16 bp, Unknown
  misc_feature (1)..( 16): Result.002 file - promoters60/1570860
cgaaattgcaaaaagt

SEQ ID NO: 120620 - DNA, 14 bp, Unknown
  misc_feature (1)..( 14): Result.002 file - promoters60/1570869
tgcattagttcttc

SEQ ID NO: 120621 - DNA, 14 bp, Unknown
  misc_feature (1)..( 14): Result.002 file - promoters60/1570869
taaatttgttatgt

SEQ ID NO: 120622 - DNA, 14 bp, Unknown
  misc_feature (1)..( 14): Result.002 file - promoters60/1570869
gttattagttaacc

SEQ ID NO: 120623 - DNA, 14 bp, Unknown
  misc_feature (1)..( 14): Result.002 file - promoters60/1570869
taaattttttaaaa

SEQ ID NO: 120624 - DNA, 14 bp, Unknown
  misc_feature (1)..( 14): Result.002 file - promoters60/1570869
tatacgttttaaaa

SEQ ID NO: 120625 - DNA, 14 bp, Unknown
  misc_feature (1)..( 14): Result.002 file - promoters60/1570869
gaaatttcctcgct

SEQ ID NO: 120626 - DNA, 16 bp, Unknown
  misc_feature (1)..( 16): Result.002 file - promoters60/1570869
attcgaatttttcaat

SEQ ID NO: 120627 - DNA, 16 bp, Unknown
  misc_feature (1)..( 16): Result.002 file - promoters60/1570869
tttagtctattttaat

SEQ ID NO: 120628 - DNA, 16 bp, Unknown
  misc_feature (1)..( 16): Result.002 file - promoters60/1570869
atttgaaattttcata

SEQ ID NO: 120629 - DNA, 16 bp, Unknown
  misc_feature (1)..( 16): Result.002 file - promoters60/1570869
caatcccaattctaac

SEQ ID NO: 120630 - DNA, 16 bp, Unknown
  misc_feature (1)..( 16): Result.002 file - promoters60/1570869
gaacggagattttaac

SEQ ID NO: 120631 - DNA, 16 bp, Unknown
  misc_feature (1)..( 16): Result.002 file - promoters60/1570869
tagaaaagaatgaaat

SEQ ID NO: 120632 - DNA, 11 bp, Unknown
  misc_feature (1)..( 11): Result.002 file - promoters60/1570869
ttttgaagaat

SEQ ID NO: 120633 - DNA, 11 bp, Unknown
  misc_feature (1)..( 11): Result.002 file - promoters60/1570869
ttttgatgaat

SEQ ID NO: 120634 - DNA, 11 bp, Unknown
  misc_feature (1)..( 11): Result.002 file - promoters60/1570869
gtttgaatcgt

SEQ ID NO: 120635 - DNA, 11 bp, Unknown
  misc_feature (1)..( 11): Result.002 file - promoters60/1570869
atttgctgaat

SEQ ID NO: 120636 - DNA, 11 bp, Unknown
  misc_feature (1)..( 11): Result.002 file - promoters60/1570869
aaaagatgaag

SEQ ID NO: 120637 - DNA, 11 bp, Unknown
  misc_feature (1)..( 11): Result.002 file - promoters60/1570869
tttcgatgtat

SEQ ID NO: 120638 - DNA, 11 bp, Unknown
  misc_feature (1)..( 11): Result.002 file - promoters60/1570869
ttttaaatcag

SEQ ID NO: 120639 - DNA, 19 bp, Unknown
  misc_feature (1)..( 19): Result.002 file - promoters60/1570869
ataaaaatgttagatagga

SEQ ID NO: 120640 - DNA, 19 bp, Unknown
  misc_feature (1)..( 19): Result.002 file - promoters60/1570869
tcataaattttaaaattat

SEQ ID NO: 120641 - DNA, 19 bp, Unknown
  misc_feature (1)..( 19): Result.002 file - promoters60/1570869
tgttaaatatgaatattac

SEQ ID NO: 120642 - DNA, 20 bp, Unknown
  misc_feature (1)..( 20): Result.002 file - promoters60/1570869
tgttaaactgttagtgcaag

SEQ ID NO: 120643 - DNA, 20 bp, Unknown
  misc_feature (1)..( 20): Result.002 file - promoters60/1570869
atgtaaattttgaaataatt

SEQ ID NO: 120644 - DNA, 20 bp, Unknown
  misc_feature (1)..( 20): Result.002 file - promoters60/1570869
ctgagaaatagatttgaaaa

SEQ ID NO: 120645 - DNA, 20 bp, Unknown
  misc_feature (1)..( 20): Result.002 file - promoters60/1570869
ttttaaattttttaaaatat

SEQ ID NO: 120646 - DNA, 11 bp, Unknown
  misc_feature (1)..( 11): Result.002 file - promoters60/1570869
cttatataaac

SEQ ID NO: 120647 - DNA, 11 bp, Unknown
  misc_feature (1)..( 11): Result.002 file - promoters60/1570869
tatatataata

SEQ ID NO: 120648 - DNA, 11 bp, Unknown
  misc_feature (1)..( 11): Result.002 file - promoters60/1570869
agtatataaac

SEQ ID NO: 120649 - DNA, 11 bp, Unknown
  misc_feature (1)..( 11): Result.002 file - promoters60/1570869
tataaataaaa

SEQ ID NO: 120650 - DNA, 11 bp, Unknown
  misc_feature (1)..( 11): Result.002 file - promoters60/1570869
tgtatataaat

SEQ ID NO: 120651 - DNA, 11 bp, Unknown
  misc_feature (1)..( 11): Result.002 file - promoters60/1570869
ctactataaaa

SEQ ID NO: 120652 - DNA, 11 bp, Unknown
  misc_feature (1)..( 11): Result.002 file - promoters60/1570869
tccccataaaa

SEQ ID NO: 120653 - DNA, 11 bp, Unknown
  misc_feature (1)..( 11): Result.002 file - promoters60/1570869
gataaatatcc

SEQ ID NO: 120654 - DNA, 12 bp, Unknown
  misc_feature (1)..( 12): Result.002 file - promoters60/1570869
tatataaacaaa

SEQ ID NO: 120655 - DNA, 12 bp, Unknown
  misc_feature (1)..( 12): Result.002 file - promoters60/1570869
ataataaccaaa

SEQ ID NO: 120656 - DNA, 12 bp, Unknown
  misc_feature (1)..( 12): Result.002 file - promoters60/1570869
tatataaactct

SEQ ID NO: 120657 - DNA, 12 bp, Unknown
  misc_feature (1)..( 12): Result.002 file - promoters60/1570869
tttataaataaa

SEQ ID NO: 120658 - DNA, 12 bp, Unknown
  misc_feature (1)..( 12): Result.002 file - promoters60/1570869
tatataaatgac

SEQ ID NO: 120659 - DNA, 12 bp, Unknown
  misc_feature (1)..( 12): Result.002 file - promoters60/1570869
actataaaatca

SEQ ID NO: 120660 - DNA, 12 bp, Unknown
  misc_feature (1)..( 12): Result.002 file - promoters60/1570869
cccataaaagca

SEQ ID NO: 120661 - DNA, 10 bp, Unknown
  misc_feature (1)..( 10): Result.002 file - promoters60/1570869
caaaatttgt

SEQ ID NO: 120662 - DNA, 10 bp, Unknown
  misc_feature (1)..( 10): Result.002 file - promoters60/1570869
caatatttta

SEQ ID NO: 120663 - DNA, 10 bp, Unknown
  misc_feature (1)..( 10): Result.002 file - promoters60/1570869
gaatatgttt

SEQ ID NO: 120664 - DNA, 10 bp, Unknown
  misc_feature (1)..( 10): Result.002 file - promoters60/1570869
aattatttta

SEQ ID NO: 120665 - DNA, 11 bp, Unknown
  misc_feature (1)..( 11): Result.002 file - promoters60/1570869
atttagtttga

SEQ ID NO: 120666 - DNA, 11 bp, Unknown
  misc_feature (1)..( 11): Result.002 file - promoters60/1570869
agatagtatat

SEQ ID NO: 120667 - DNA, 11 bp, Unknown
  misc_feature (1)..( 11): Result.002 file - promoters60/1570869
tcatattatta

SEQ ID NO: 120668 - DNA, 11 bp, Unknown
  misc_feature (1)..( 11): Result.002 file - promoters60/1570869
tggttattttt

SEQ ID NO: 120669 - DNA, 11 bp, Unknown
  misc_feature (1)..( 11): Result.002 file - promoters60/1570869
gatttagtttg

SEQ ID NO: 120670 - DNA, 11 bp, Unknown
  misc_feature (1)..( 11): Result.002 file - promoters60/1570869
atgtttttttt

SEQ ID NO: 120671 - DNA, 11 bp, Unknown
  misc_feature (1)..( 11): Result.002 file - promoters60/1570869
aaattatttta

SEQ ID NO: 120672 - DNA, 11 bp, Unknown
  misc_feature (1)..( 11): Result.002 file - promoters60/1570869
atattattagt

SEQ ID NO: 120673 - DNA, 11 bp, Unknown
  misc_feature (1)..( 11): Result.002 file - promoters60/1570869
atactatgata

SEQ ID NO: 120674 - DNA, 11 bp, Unknown
  misc_feature (1)..( 11): Result.002 file - promoters60/1570869
atagtatatac

SEQ ID NO: 120675 - DNA, 10 bp, Unknown
  misc_feature (1)..( 10): Result.002 file - promoters60/1570966
gaaatatagg

SEQ ID NO: 120676 - DNA, 10 bp, Unknown
  misc_feature (1)..( 10): Result.002 file - promoters60/1570966
aaaatattaa

SEQ ID NO: 120677 - DNA, 10 bp, Unknown
  misc_feature (1)..( 10): Result.002 file - promoters60/1570966
tagatatatt

SEQ ID NO: 120678 - DNA, 10 bp, Unknown
  misc_feature (1)..( 10): Result.002 file - promoters60/1570966
taaaaattaa

SEQ ID NO: 120679 - DNA, 10 bp, Unknown
  misc_feature (1)..( 10): Result.002 file - promoters60/1570966
caaatattgc

SEQ ID NO: 120680 - DNA, 10 bp, Unknown
  misc_feature (1)..( 10): Result.002 file - promoters60/1570966
aagatatttc

SEQ ID NO: 120681 - DNA, 10 bp, Unknown
  misc_feature (1)..( 10): Result.002 file - promoters60/1570966
gtaaaatttc

SEQ ID NO: 120682 - DNA, 10 bp, Unknown
  misc_feature (1)..( 10): Result.002 file - promoters60/1570966
taacaattct

SEQ ID NO: 120683 - DNA, 9 bp, Unknown
  misc_feature (1)..( 9): Result.002 file - promoters60/1570966
caacaaagt

SEQ ID NO: 120684 - DNA, 9 bp, Unknown
  misc_feature (1)..( 9): Result.002 file - promoters60/1570966
aaacaaacg

SEQ ID NO: 120685 - DNA, 9 bp, Unknown
  misc_feature (1)..( 9): Result.002 file - promoters60/1570966
gaacaaaac

SEQ ID NO: 120686 - DNA, 9 bp, Unknown
  misc_feature (1)..( 9): Result.002 file - promoters60/1570966
aaataaatt

SEQ ID NO: 120687 - DNA, 9 bp, Unknown
  misc_feature (1)..( 9): Result.002 file - promoters60/1570966
aaacaaatg

SEQ ID NO: 120688 - DNA, 9 bp, Unknown
  misc_feature (1)..( 9): Result.002 file - promoters60/1570966
aaaaaaaga

SEQ ID NO: 120689 - DNA, 9 bp, Unknown
  misc_feature (1)..( 9): Result.002 file - promoters60/1570966
gtatatatt

SEQ ID NO: 120690 - DNA, 13 bp, Unknown
  misc_feature (1)..( 13): Result.002 file - promoters60/1570966
ccactatataaga

SEQ ID NO: 120691 - DNA, 13 bp, Unknown
  misc_feature (1)..( 13): Result.002 file - promoters60/1570966
ccattatatatag

SEQ ID NO: 120692 - DNA, 13 bp, Unknown
  misc_feature (1)..( 13): Result.002 file - promoters60/1570966
caaccatataaat

SEQ ID NO: 120693 - DNA, 13 bp, Unknown
  misc_feature (1)..( 13): Result.002 file - promoters60/1570966
cgcctatatataa

SEQ ID NO: 120694 - DNA, 13 bp, Unknown
  misc_feature (1)..( 13): Result.002 file - promoters60/1570966
cttttatatataa

SEQ ID NO: 120695 - DNA, 13 bp, Unknown
  misc_feature (1)..( 13): Result.002 file - promoters60/1570966
tatttatacaaat

SEQ ID NO: 120696 - DNA, 13 bp, Unknown
  misc_feature (1)..( 13): Result.002 file - promoters60/1570966
tgtttgattgaat

SEQ ID NO: 120697 - DNA, 13 bp, Unknown
  misc_feature (1)..( 13): Result.002 file - promoters60/1570966
tgtttaattaaac

SEQ ID NO: 120698 - DNA, 13 bp, Unknown
  misc_feature (1)..( 13): Result.002 file - promoters60/1570966
tatttcatttcca

SEQ ID NO: 120699 - DNA, 13 bp, Unknown
  misc_feature (1)..( 13): Result.002 file - promoters60/1570966
aaataaataaaag

SEQ ID NO: 120700 - DNA, 13 bp, Unknown
  misc_feature (1)..( 13): Result.002 file - promoters60/1570966
aataaaattaata

SEQ ID NO: 120701 - DNA, 13 bp, Unknown
  misc_feature (1)..( 13): Result.002 file - promoters60/1570966
gacattataaaat

SEQ ID NO: 120702 - DNA, 13 bp, Unknown
  misc_feature (1)..( 13): Result.002 file - promoters60/1570966
tctaacataggca

SEQ ID NO: 120703 - DNA, 15 bp, Unknown
  misc_feature (1)..( 15): Result.002 file - promoters60/1570966
cgaattctttaaact

SEQ ID NO: 120704 - DNA, 15 bp, Unknown
  misc_feature (1)..( 15): Result.002 file - promoters60/1570966
aaaatccttaattac

SEQ ID NO: 120705 - DNA, 15 bp, Unknown
  misc_feature (1)..( 15): Result.002 file - promoters60/1570966
ttatttctttaaact

SEQ ID NO: 120706 - DNA, 15 bp, Unknown
  misc_feature (1)..( 15): Result.002 file - promoters60/1570966
ataattattttgcag

SEQ ID NO: 120707 - DNA, 15 bp, Unknown
  misc_feature (1)..( 15): Result.002 file - promoters60/1570966
atgtttgtttaacaa

SEQ ID NO: 120708 - DNA, 15 bp, Unknown
  misc_feature (1)..( 15): Result.002 file - promoters60/1570966
ttatttatttactaa

SEQ ID NO: 120709 - DNA, 15 bp, Unknown
  misc_feature (1)..( 15): Result.002 file - promoters60/1570966
tttacccttaaaagt

SEQ ID NO: 120710 - DNA, 11 bp, Unknown
  misc_feature (1)..( 11): Result.002 file - promoters60/1570966
ttttaaaaatt

SEQ ID NO: 120711 - DNA, 11 bp, Unknown
  misc_feature (1)..( 11): Result.002 file - promoters60/1570966
ggctaaaaatg

SEQ ID NO: 120712 - DNA, 11 bp, Unknown
  misc_feature (1)..( 11): Result.002 file - promoters60/1570966
gtttcaaatac

SEQ ID NO: 120713 - DNA, 11 bp, Unknown
  misc_feature (1)..( 11): Result.002 file - promoters60/1570966
gtttccaatat

SEQ ID NO: 120714 - DNA, 11 bp, Unknown
  misc_feature (1)..( 11): Result.002 file - promoters60/1570966
agatcaaatag

SEQ ID NO: 120715 - DNA, 11 bp, Unknown
  misc_feature (1)..( 11): Result.002 file - promoters60/1570966
cctggaaatag

SEQ ID NO: 120716 - DNA, 12 bp, Unknown
  misc_feature (1)..( 12): Result.002 file - promoters60/1570966
ttgagtttaggc

SEQ ID NO: 120717 - DNA, 12 bp, Unknown
  misc_feature (1)..( 12): Result.002 file - promoters60/1570966
ttaagtctagta

SEQ ID NO: 120718 - DNA, 12 bp, Unknown
  misc_feature (1)..( 12): Result.002 file - promoters60/1570966
ttgacttttgac

SEQ ID NO: 120719 - DNA, 12 bp, Unknown
  misc_feature (1)..( 12): Result.002 file - promoters60/1570966
gatagtttaaaa

SEQ ID NO: 120720 - DNA, 12 bp, Unknown
  misc_feature (1)..( 12): Result.002 file - promoters60/1570966
ttggcttctatt

SEQ ID NO: 120721 - DNA, 12 bp, Unknown
  misc_feature (1)..( 12): Result.002 file - promoters60/1570966
ataagtttcaaa

SEQ ID NO: 120722 - DNA, 12 bp, Unknown
  misc_feature (1)..( 12): Result.002 file - promoters60/1570966
acaattctaatt

SEQ ID NO: 120723 - DNA, 9 bp, Unknown
  misc_feature (1)..( 9): Result.002 file - promoters60/1570966
aaaaataaa

SEQ ID NO: 120724 - DNA, 9 bp, Unknown
  misc_feature (1)..( 9): Result.002 file - promoters60/1570966
aaacatata

SEQ ID NO: 120725 - DNA, 9 bp, Unknown
  misc_feature (1)..( 9): Result.002 file - promoters60/1570966
aaaattaat

SEQ ID NO: 120726 - DNA, 9 bp, Unknown
  misc_feature (1)..( 9): Result.002 file - promoters60/1570966
taaaataca

SEQ ID NO: 120727 - DNA, 9 bp, Unknown
  misc_feature (1)..( 9): Result.002 file - promoters60/1570966
taacatagg

SEQ ID NO: 120728 - DNA, 9 bp, Unknown
  misc_feature (1)..( 9): Result.002 file - promoters60/1570966
gataatatt

SEQ ID NO: 120729 - DNA, 10 bp, Unknown
  misc_feature (1)..( 10): Result.002 file - promoters60/1570966
atattattag

SEQ ID NO: 120730 - DNA, 10 bp, Unknown
  misc_feature (1)..( 10): Result.002 file - promoters60/1570966
atattaataa

SEQ ID NO: 120731 - DNA, 10 bp, Unknown
  misc_feature (1)..( 10): Result.002 file - promoters60/1570966
atattattag

SEQ ID NO: 120732 - DNA, 10 bp, Unknown
  misc_feature (1)..( 10): Result.002 file - promoters60/1570966
ttattatatt

SEQ ID NO: 120733 - DNA, 10 bp, Unknown
  misc_feature (1)..( 10): Result.002 file - promoters60/1570966
atataattat

SEQ ID NO: 120734 - DNA, 10 bp, Unknown
  misc_feature (1)..( 10): Result.002 file - promoters60/1570966
ccttaattac

SEQ ID NO: 120735 - DNA, 10 bp, Unknown
  misc_feature (1)..( 10): Result.002 file - promoters60/1570966
atataactaa

SEQ ID NO: 120736 - DNA, 11 bp, Unknown
  misc_feature (1)..( 11): Result.002 file - promoters60/1571014
caaaatgttat

SEQ ID NO: 120737 - DNA, 11 bp, Unknown
  misc_feature (1)..( 11): Result.002 file - promoters60/1571014
tccaatgtttt

SEQ ID NO: 120738 - DNA, 11 bp, Unknown
  misc_feature (1)..( 11): Result.002 file - promoters60/1571014
caaaatttttt

SEQ ID NO: 120739 - DNA, 11 bp, Unknown
  misc_feature (1)..( 11): Result.002 file - promoters60/1571014
cttcattcttt

SEQ ID NO: 120740 - DNA, 11 bp, Unknown
  misc_feature (1)..( 11): Result.002 file - promoters60/1571014
gcaaatgttaa

SEQ ID NO: 120741 - DNA, 11 bp, Unknown
  misc_feature (1)..( 11): Result.002 file - promoters60/1571014
ttcaatcttct

SEQ ID NO: 120742 - DNA, 11 bp, Unknown
  misc_feature (1)..( 11): Result.002 file - promoters60/1571422
actaattaata

SEQ ID NO: 120743 - DNA, 11 bp, Unknown
  misc_feature (1)..( 11): Result.002 file - promoters60/1571422
actaatttgta

SEQ ID NO: 120744 - DNA, 11 bp, Unknown
  misc_feature (1)..( 11): Result.002 file - promoters60/1571422
aataattagta

SEQ ID NO: 120745 - DNA, 11 bp, Unknown
  misc_feature (1)..( 11): Result.002 file - promoters60/1571422
ataaattaatg

SEQ ID NO: 120746 - DNA, 11 bp, Unknown
  misc_feature (1)..( 11): Result.002 file - promoters60/1571422
gtaaattatat

SEQ ID NO: 120747 - DNA, 11 bp, Unknown
  misc_feature (1)..( 11): Result.002 file - promoters60/1571422
atatattaatg

SEQ ID NO: 120748 - DNA, 11 bp, Unknown
  misc_feature (1)..( 11): Result.002 file - promoters60/1571422
gtaaataatta

SEQ ID NO: 120749 - DNA, 7 bp, Unknown
  misc_feature (1)..( 7): Result.002 file - promoters60/1571422
aaaaaaa

SEQ ID NO: 120750 - DNA, 7 bp, Unknown
  misc_feature (1)..( 7): Result.002 file - promoters60/1571422
aaaaaaa

SEQ ID NO: 120751 - DNA, 7 bp, Unknown
  misc_feature (1)..( 7): Result.002 file - promoters60/1571422
aaaaaac

SEQ ID NO: 120752 - DNA, 9 bp, Unknown
  misc_feature (1)..( 9): Result.002 file - promoters60/1571422
ttattttat

SEQ ID NO: 120753 - DNA, 9 bp, Unknown
  misc_feature (1)..( 9): Result.002 file - promoters60/1571422
ttaatttat

SEQ ID NO: 120754 - DNA, 9 bp, Unknown
  misc_feature (1)..( 9): Result.002 file - promoters60/1571422
tttttttga

SEQ ID NO: 120755 - DNA, 8 bp, Unknown
  misc_feature (1)..( 8): Result.002 file - promoters60/1571422
taataaag

SEQ ID NO: 120756 - DNA, 8 bp, Unknown
  misc_feature (1)..( 8): Result.002 file - promoters60/1571422
atataaag

SEQ ID NO: 120757 - DNA, 8 bp, Unknown
  misc_feature (1)..( 8): Result.002 file - promoters60/1571422
taacaaaa

SEQ ID NO: 120758 - DNA, 8 bp, Unknown
  misc_feature (1)..( 8): Result.002 file - promoters60/1571422
atataaat

SEQ ID NO: 120759 - DNA, 9 bp, Unknown
  misc_feature (1)..( 9): Result.002 file - promoters60/1571422
actatcata

SEQ ID NO: 120760 - DNA, 9 bp, Unknown
  misc_feature (1)..( 9): Result.002 file - promoters60/1571422
tcaatcata

SEQ ID NO: 120761 - DNA, 9 bp, Unknown
  misc_feature (1)..( 9): Result.002 file - promoters60/1571422
actatcatt

SEQ ID NO: 120762 - DNA, 8 bp, Unknown
  misc_feature (1)..( 8): Result.002 file - promoters60/1571422
aatttcat

SEQ ID NO: 120763 - DNA, 8 bp, Unknown
  misc_feature (1)..( 8): Result.002 file - promoters60/1571422
aatttcat

SEQ ID NO: 120764 - DNA, 8 bp, Unknown
  misc_feature (1)..( 8): Result.002 file - promoters60/1571422
tatttcag

SEQ ID NO: 120765 - DNA, 9 bp, Unknown
  misc_feature (1)..( 9): Result.002 file - promoters60/1571422
cataatttt

SEQ ID NO: 120766 - DNA, 9 bp, Unknown
  misc_feature (1)..( 9): Result.002 file - promoters60/1571422
cataataaa

SEQ ID NO: 120767 - DNA, 9 bp, Unknown
  misc_feature (1)..( 9): Result.002 file - promoters60/1571422
aataataaa

SEQ ID NO: 120768 - DNA, 8 bp, Unknown
  misc_feature (1)..( 8): Result.002 file - promoters60/1571422
ttttcaaa

SEQ ID NO: 120769 - DNA, 8 bp, Unknown
  misc_feature (1)..( 8): Result.002 file - promoters60/1571422
gttttaaa

SEQ ID NO: 120770 - DNA, 8 bp, Unknown
  misc_feature (1)..( 8): Result.002 file - promoters60/1571422
gttataag

SEQ ID NO: 120771 - DNA, 8 bp, Unknown
  misc_feature (1)..( 8): Result.002 file - promoters60/1572151
tttactaa

SEQ ID NO: 120772 - DNA, 8 bp, Unknown
  misc_feature (1)..( 8): Result.002 file - promoters60/1572151
attattaa

SEQ ID NO: 120773 - DNA, 8 bp, Unknown
  misc_feature (1)..( 8): Result.002 file - promoters60/1572151
attattat

SEQ ID NO: 120774 - DNA, 11 bp, Unknown
  misc_feature (1)..( 11): Result.002 file - promoters60/1572151
taattttagag

SEQ ID NO: 120775 - DNA, 11 bp, Unknown
  misc_feature (1)..( 11): Result.002 file - promoters60/1572151
taattttaatt

SEQ ID NO: 120776 - DNA, 11 bp, Unknown
  misc_feature (1)..( 11): Result.002 file - promoters60/1572151
tagtttgagag

SEQ ID NO: 120777 - DNA, 11 bp, Unknown
  misc_feature (1)..( 11): Result.002 file - promoters60/1572151
tcgttttaatt

SEQ ID NO: 120778 - DNA, 13 bp, Unknown
  misc_feature (1)..( 13): Result.002 file - promoters60/1572151
ccactatatatat

SEQ ID NO: 120779 - DNA, 13 bp, Unknown
  misc_feature (1)..( 13): Result.002 file - promoters60/1572151
catttatttatat

SEQ ID NO: 120780 - DNA, 13 bp, Unknown
  misc_feature (1)..( 13): Result.002 file - promoters60/1572151
agtgtatatatat

SEQ ID NO: 120781 - DNA, 13 bp, Unknown
  misc_feature (1)..( 13): Result.002 file - promoters60/1572151
catctatttttat

SEQ ID NO: 120782 - DNA, 9 bp, Unknown
  misc_feature (1)..( 9): Result.002 file - promoters60/1572151
taaacaaca

SEQ ID NO: 120783 - DNA, 9 bp, Unknown
  misc_feature (1)..( 9): Result.002 file - promoters60/1572151
taatcaaat

SEQ ID NO: 120784 - DNA, 9 bp, Unknown
  misc_feature (1)..( 9): Result.002 file - promoters60/1572151
caatcaaat

SEQ ID NO: 120785 - DNA, 11 bp, Unknown
  misc_feature (1)..( 11): Result.002 file - promoters60/1572151
gtaaacataat

SEQ ID NO: 120786 - DNA, 11 bp, Unknown
  misc_feature (1)..( 11): Result.002 file - promoters60/1572151
aaaaacattaa

SEQ ID NO: 120787 - DNA, 11 bp, Unknown
  misc_feature (1)..( 11): Result.002 file - promoters60/1572151
aaaaaaattaa

SEQ ID NO: 120788 - DNA, 9 bp, Unknown
  misc_feature (1)..( 9): Result.002 file - promoters60/1572151
atttctttg

SEQ ID NO: 120789 - DNA, 9 bp, Unknown
  misc_feature (1)..( 9): Result.002 file - promoters60/1572151
attactttt

SEQ ID NO: 120790 - DNA, 9 bp, Unknown
  misc_feature (1)..( 9): Result.002 file - promoters60/1572151
tttaatttt

SEQ ID NO: 120791 - DNA, 9 bp, Unknown
  misc_feature (1)..( 9): Result.002 file - promoters60/1572151
attttagtc

SEQ ID NO: 120792 - DNA, 9 bp, Unknown
  misc_feature (1)..( 9): Result.002 file - promoters60/1572151
attttggtc

SEQ ID NO: 120793 - DNA, 9 bp, Unknown
  misc_feature (1)..( 9): Result.002 file - promoters60/1572151
tctttggtt

SEQ ID NO: 120794 - DNA, 8 bp, Unknown
  misc_feature (1)..( 8): Result.002 file - promoters60/1572151
tatttcta

SEQ ID NO: 120795 - DNA, 8 bp, Unknown
  misc_feature (1)..( 8): Result.002 file - promoters60/1572151
tatttcaa

SEQ ID NO: 120796 - DNA, 8 bp, Unknown
  misc_feature (1)..( 8): Result.002 file - promoters60/1572151
gatttcaa

SEQ ID NO: 120797 - DNA, 8 bp, Unknown
  misc_feature (1)..( 8): Result.002 file - promoters60/1572151
aacaaata

SEQ ID NO: 120798 - DNA, 8 bp, Unknown
  misc_feature (1)..( 8): Result.002 file - promoters60/1572151
ttcaaata

SEQ ID NO: 120799 - DNA, 8 bp, Unknown
  misc_feature (1)..( 8): Result.002 file - promoters60/1572151
ttcgaatt

SEQ ID NO: 120800 - DNA, 8 bp, Unknown
  misc_feature (1)..( 8): Result.002 file - promoters60/1572151
atagaaga

SEQ ID NO: 120801 - DNA, 8 bp, Unknown
  misc_feature (1)..( 8): Result.002 file - promoters60/1572151
ataaaagt

SEQ ID NO: 120802 - DNA, 8 bp, Unknown
  misc_feature (1)..( 8): Result.002 file - promoters60/1572151
ttaaaaaa

SEQ ID NO: 120803 - DNA, 8 bp, Unknown
  misc_feature (1)..( 8): Result.002 file - promoters60/1572151
ttaatttt

SEQ ID NO: 120804 - DNA, 8 bp, Unknown
  misc_feature (1)..( 8): Result.002 file - promoters60/1572151
ttagtttg

SEQ ID NO: 120805 - DNA, 8 bp, Unknown
  misc_feature (1)..( 8): Result.002 file - promoters60/1572151
aaagtttg

SEQ ID NO: 120806 - DNA, 8 bp, Unknown
  misc_feature (1)..( 8): Result.002 file - promoters60/1572151
aattcaaa

SEQ ID NO: 120807 - DNA, 8 bp, Unknown
  misc_feature (1)..( 8): Result.002 file - promoters60/1572151
atttcaaa

SEQ ID NO: 120808 - DNA, 8 bp, Unknown
  misc_feature (1)..( 8): Result.002 file - promoters60/1572151
atttcaat

SEQ ID NO: 120809 - DNA, 8 bp, Unknown
  misc_feature (1)..( 8): Result.002 file - promoters60/1572151
tgtaacat

SEQ ID NO: 120810 - DNA, 8 bp, Unknown
  misc_feature (1)..( 8): Result.002 file - promoters60/1572151
tgtaaccc

SEQ ID NO: 120811 - DNA, 8 bp, Unknown
  misc_feature (1)..( 8): Result.002 file - promoters60/1572151
tgtcaccc

SEQ ID NO: 120812 - DNA, 8 bp, Unknown
  misc_feature (1)..( 8): Result.002 file - promoters60/1572404
gttaagct

SEQ ID NO: 120813 - DNA, 8 bp, Unknown
  misc_feature (1)..( 8): Result.002 file - promoters60/1572404
gttgagct

SEQ ID NO: 120814 - DNA, 8 bp, Unknown
  misc_feature (1)..( 8): Result.002 file - promoters60/1572404
gaaaaaaa

SEQ ID NO: 120815 - DNA, 8 bp, Unknown
  misc_feature (1)..( 8): Result.002 file - promoters60/1572404
gaagaaaa

SEQ ID NO: 120816 - DNA, 7 bp, Unknown
  misc_feature (1)..( 7): Result.002 file - promoters60/1572404
gtcaaaa

SEQ ID NO: 120817 - DNA, 7 bp, Unknown
  misc_feature (1)..( 7): Result.002 file - promoters60/1572404
gtcgaaa

SEQ ID NO: 120818 - DNA, 7 bp, Unknown
  misc_feature (1)..( 7): Result.002 file - promoters60/1572404
agaaaat

SEQ ID NO: 120819 - DNA, 7 bp, Unknown
  misc_feature (1)..( 7): Result.002 file - promoters60/1572404
agagaat

SEQ ID NO: 120820 - DNA, 8 bp, Unknown
  misc_feature (1)..( 8): Result.002 file - promoters60/1572404
aattgttt

SEQ ID NO: 120821 - DNA, 8 bp, Unknown
  misc_feature (1)..( 8): Result.002 file - promoters60/1572404
aatttttt

SEQ ID NO: 120822 - DNA, 8 bp, Unknown
  misc_feature (1)..( 8): Result.002 file - promoters60/1572404
ttttttta

SEQ ID NO: 120823 - DNA, 8 bp, Unknown
  misc_feature (1)..( 8): Result.002 file - promoters60/1572404
ttttttta

SEQ ID NO: 120824 - DNA, 6 bp, Unknown
  misc_feature (1)..( 6): Result.002 file - promoters60/1572404
attata

SEQ ID NO: 120825 - DNA, 6 bp, Unknown
  misc_feature (1)..( 6): Result.002 file - promoters60/1572404
attata

SEQ ID NO: 120826 - DNA, 7 bp, Unknown
  misc_feature (1)..( 7): Result.002 file - promoters60/1572404
aaatatc

SEQ ID NO: 120827 - DNA, 7 bp, Unknown
  misc_feature (1)..( 7): Result.002 file - promoters60/1572404
aaacatc

SEQ ID NO: 120828 - DNA, 8 bp, Unknown
  misc_feature (1)..( 8): Result.002 file - promoters60/1572404
tagtcctc

SEQ ID NO: 120829 - DNA, 8 bp, Unknown
  misc_feature (1)..( 8): Result.002 file - promoters60/1572404
tagacctc

SEQ ID NO: 120830 - DNA, 6 bp, Unknown
  misc_feature (1)..( 6): Result.002 file - promoters60/1572404
acttat

SEQ ID NO: 120831 - DNA, 6 bp, Unknown
  misc_feature (1)..( 6): Result.002 file - promoters60/1572404
acttat

SEQ ID NO: 120832 - DNA, 9 bp, Unknown
  misc_feature (1)..( 9): Result.002 file - promoters60/1572796
tccagtagg

SEQ ID NO: 120833 - DNA, 9 bp, Unknown
  misc_feature (1)..( 9): Result.002 file - promoters60/1572796
tccagaagg

SEQ ID NO: 120834 - DNA, 6 bp, Unknown
  misc_feature (1)..( 6): Result.002 file - promoters60/1572796
agtaca

SEQ ID NO: 120835 - DNA, 6 bp, Unknown
  misc_feature (1)..( 6): Result.002 file - promoters60/1572796
agtaca

SEQ ID NO: 120836 - DNA, 6 bp, Unknown
  misc_feature (1)..( 6): Result.002 file - promoters60/1572796
agctca

SEQ ID NO: 120837 - DNA, 6 bp, Unknown
  misc_feature (1)..( 6): Result.002 file - promoters60/1572796
agctca

SEQ ID NO: 120838 - DNA, 8 bp, Unknown
  misc_feature (1)..( 8): Result.002 file - promoters60/1572796
aacataaa

SEQ ID NO: 120839 - DNA, 8 bp, Unknown
  misc_feature (1)..( 8): Result.002 file - promoters60/1572796
aacacaaa

SEQ ID NO: 120840 - DNA, 8 bp, Unknown
  misc_feature (1)..( 8): Result.002 file - promoters60/1572796
acaaaacg

SEQ ID NO: 120841 - DNA, 8 bp, Unknown
  misc_feature (1)..( 8): Result.002 file - promoters60/1572796
acaagacg

SEQ ID NO: 120842 - DNA, 6 bp, Unknown
  misc_feature (1)..( 6): Result.002 file - promoters60/1572796
gtagag

SEQ ID NO: 120843 - DNA, 6 bp, Unknown
  misc_feature (1)..( 6): Result.002 file - promoters60/1572796
gtagag

SEQ ID NO: 120844 - DNA, 6 bp, Unknown
  misc_feature (1)..( 6): Result.002 file - promoters60/1572796
aacctg

SEQ ID NO: 120845 - DNA, 6 bp, Unknown
  misc_feature (1)..( 6): Result.002 file - promoters60/1572796
aacctg

SEQ ID NO: 120846 - DNA, 7 bp, Unknown
  misc_feature (1)..( 7): Result.002 file - promoters60/1572796
aatttca

SEQ ID NO: 120847 - DNA, 7 bp, Unknown
  misc_feature (1)..( 7): Result.002 file - promoters60/1572796
gatttca

SEQ ID NO: 120848 - DNA, 7 bp, Unknown
  misc_feature (1)..( 7): Result.002 file - promoters60/1572796
aatttcg

SEQ ID NO: 120849 - DNA, 8 bp, Unknown
  misc_feature (1)..( 8): Result.002 file - promoters60/1572796
ttaattaa

SEQ ID NO: 120850 - DNA, 8 bp, Unknown
  misc_feature (1)..( 8): Result.002 file - promoters60/1572796
ttatttaa

SEQ ID NO: 120851 - DNA, 6 bp, Unknown
  misc_feature (1)..( 6): Result.002 file - promoters60/1572796
attgta

SEQ ID NO: 120852 - DNA, 6 bp, Unknown
  misc_feature (1)..( 6): Result.002 file - promoters60/1572796
attgta

SEQ ID NO: 120853 - DNA, 6 bp, Unknown
  misc_feature (1)..( 6): Result.002 file - promoters60/1572796
gtgaat

SEQ ID NO: 120854 - DNA, 6 bp, Unknown
  misc_feature (1)..( 6): Result.002 file - promoters60/1572796
gtgaat

SEQ ID NO: 120855 - DNA, 7 bp, Unknown
  misc_feature (1)..( 7): Result.002 file - promoters60/1572796
tacagta

SEQ ID NO: 120856 - DNA, 7 bp, Unknown
  misc_feature (1)..( 7): Result.002 file - promoters60/1572796
tactgta

SEQ ID NO: 120857 - DNA, 6 bp, Unknown
  misc_feature (1)..( 6): Result.002 file - promoters60/1572796
caatat

SEQ ID NO: 120858 - DNA, 6 bp, Unknown
  misc_feature (1)..( 6): Result.002 file - promoters60/1572796
caatat

SEQ ID NO: 120859 - DNA, 8 bp, Unknown
  misc_feature (1)..( 8): Result.002 file - promoters60/1572796
aaaaaaat

SEQ ID NO: 120860 - DNA, 8 bp, Unknown
  misc_feature (1)..( 8): Result.002 file - promoters60/1572796
aaaataat

SEQ ID NO: 120861 - DNA, 13 bp, Unknown
  misc_feature (1)..( 13): Result.002 file - promoters60/1573594
caacaatgtacaa

SEQ ID NO: 120862 - DNA, 13 bp, Unknown
  misc_feature (1)..( 13): Result.002 file - promoters60/1573594
caataatttacat

SEQ ID NO: 120863 - DNA, 13 bp, Unknown
  misc_feature (1)..( 13): Result.002 file - promoters60/1573594
ttacaatttacaa

SEQ ID NO: 120864 - DNA, 13 bp, Unknown
  misc_feature (1)..( 13): Result.002 file - promoters60/1573594
aaattttctacaa

SEQ ID NO: 120865 - DNA, 13 bp, Unknown
  misc_feature (1)..( 13): Result.002 file - promoters60/1573594
tgacaattttctt

SEQ ID NO: 120866 - DNA, 6 bp, Unknown
  misc_feature (1)..( 6): Result.002 file - promoters60/1573651
aatcgt

SEQ ID NO: 120867 - DNA, 6 bp, Unknown
  misc_feature (1)..( 6): Result.002 file - promoters60/1573651
aatcgt

SEQ ID NO: 120868 - DNA, 6 bp, Unknown
  misc_feature (1)..( 6): Result.002 file - promoters60/1573651
aatcgt

SEQ ID NO: 120869 - DNA, 9 bp, Unknown
  misc_feature (1)..( 9): Result.002 file - promoters60/1573651
taagattgg

SEQ ID NO: 120870 - DNA, 9 bp, Unknown
  misc_feature (1)..( 9): Result.002 file - promoters60/1573651
taatattgg

SEQ ID NO: 120871 - DNA, 7 bp, Unknown
  misc_feature (1)..( 7): Result.002 file - promoters60/1573651
ataaaaa

SEQ ID NO: 120872 - DNA, 7 bp, Unknown
  misc_feature (1)..( 7): Result.002 file - promoters60/1573651
ataaaaa

SEQ ID NO: 120873 - DNA, 7 bp, Unknown
  misc_feature (1)..( 7): Result.002 file - promoters60/1573651
agaagct

SEQ ID NO: 120874 - DNA, 7 bp, Unknown
  misc_feature (1)..( 7): Result.002 file - promoters60/1573651
agaagct

SEQ ID NO: 120875 - DNA, 15 bp, Unknown
  misc_feature (1)..( 15): Result.002 file - promoters60/1573651
ttaatatatattact

SEQ ID NO: 120876 - DNA, 15 bp, Unknown
  misc_feature (1)..( 15): Result.002 file - promoters60/1573651
ttaatatatattact

SEQ ID NO: 120877 - DNA, 6 bp, Unknown
  misc_feature (1)..( 6): Result.002 file - promoters60/1573651
ttttaa

SEQ ID NO: 120878 - DNA, 6 bp, Unknown
  misc_feature (1)..( 6): Result.002 file - promoters60/1573651
ttttaa

SEQ ID NO: 120879 - DNA, 7 bp, Unknown
  misc_feature (1)..( 7): Result.002 file - promoters60/1573651
actcaaa

SEQ ID NO: 120880 - DNA, 7 bp, Unknown
  misc_feature (1)..( 7): Result.002 file - promoters60/1573651
actcaaa

SEQ ID NO: 120881 - DNA, 7 bp, Unknown
  misc_feature (1)..( 7): Result.002 file - promoters60/1573651
tttggtt

SEQ ID NO: 120882 - DNA, 7 bp, Unknown
  misc_feature (1)..( 7): Result.002 file - promoters60/1573651
tttagtt

SEQ ID NO: 120883 - DNA, 9 bp, Unknown
  misc_feature (1)..( 9): Result.002 file - promoters60/1573651
agcccaata

SEQ ID NO: 120884 - DNA, 9 bp, Unknown
  misc_feature (1)..( 9): Result.002 file - promoters60/1573651
agcccaata

SEQ ID NO: 120885 - DNA, 6 bp, Unknown
  misc_feature (1)..( 6): Result.002 file - promoters60/1573651
agccca

SEQ ID NO: 120886 - DNA, 6 bp, Unknown
  misc_feature (1)..( 6): Result.002 file - promoters60/1573651
agccca

SEQ ID NO: 120887 - DNA, 8 bp, Unknown
  misc_feature (1)..( 8): Result.002 file - promoters60/1573651
tcatcatc

SEQ ID NO: 120888 - DNA, 8 bp, Unknown
  misc_feature (1)..( 8): Result.002 file - promoters60/1573651
tcatcatc

SEQ ID NO: 120889 - DNA, 8 bp, Unknown
  misc_feature (1)..( 8): Result.002 file - promoters60/1573651
aagtggta

SEQ ID NO: 120890 - DNA, 8 bp, Unknown
  misc_feature (1)..( 8): Result.002 file - promoters60/1573651
aagttgta

SEQ ID NO: 120891 - DNA, 7 bp, Unknown
  misc_feature (1)..( 7): Result.002 file - promoters60/1573651
gctcatt

SEQ ID NO: 120892 - DNA, 7 bp, Unknown
  misc_feature (1)..( 7): Result.002 file - promoters60/1573651
gctgatt

SEQ ID NO: 120893 - DNA, 7 bp, Unknown
  misc_feature (1)..( 7): Result.002 file - promoters60/1573713
aaatata

SEQ ID NO: 120894 - DNA, 7 bp, Unknown
  misc_feature (1)..( 7): Result.002 file - promoters60/1573713
aaacata

SEQ ID NO: 120895 - DNA, 7 bp, Unknown
  misc_feature (1)..( 7): Result.002 file - promoters60/1573713
atatata

SEQ ID NO: 120896 - DNA, 10 bp, Unknown
  misc_feature (1)..( 10): Result.002 file - promoters60/1573713
ataagcgaca

SEQ ID NO: 120897 - DNA, 10 bp, Unknown
  misc_feature (1)..( 10): Result.002 file - promoters60/1573713
ataaacgaca

SEQ ID NO: 120898 - DNA, 7 bp, Unknown
  misc_feature (1)..( 7): Result.002 file - promoters60/1573713
aatcgaa

SEQ ID NO: 120899 - DNA, 7 bp, Unknown
  misc_feature (1)..( 7): Result.002 file - promoters60/1573713
aatcgaa

SEQ ID NO: 120900 - DNA, 10 bp, Unknown
  misc_feature (1)..( 10): Result.002 file - promoters60/1573713
atttatttga

SEQ ID NO: 120901 - DNA, 10 bp, Unknown
  misc_feature (1)..( 10): Result.002 file - promoters60/1573713
ctttatatga

SEQ ID NO: 120902 - DNA, 10 bp, Unknown
  misc_feature (1)..( 10): Result.002 file - promoters60/1573713
attaattgta

SEQ ID NO: 120903 - DNA, 6 bp, Unknown
  misc_feature (1)..( 6): Result.002 file - promoters60/1573713
atttgt

SEQ ID NO: 120904 - DNA, 6 bp, Unknown
  misc_feature (1)..( 6): Result.002 file - promoters60/1573713
atttgt

SEQ ID NO: 120905 - DNA, 6 bp, Unknown
  misc_feature (1)..( 6): Result.002 file - promoters60/1573713
gctctg

SEQ ID NO: 120906 - DNA, 6 bp, Unknown
  misc_feature (1)..( 6): Result.002 file - promoters60/1573713
gctctg

SEQ ID NO: 120907 - DNA, 6 bp, Unknown
  misc_feature (1)..( 6): Result.002 file - promoters60/1573713
taataa

SEQ ID NO: 120908 - DNA, 6 bp, Unknown
  misc_feature (1)..( 6): Result.002 file - promoters60/1573713
taataa

SEQ ID NO: 120909 - DNA, 7 bp, Unknown
  misc_feature (1)..( 7): Result.002 file - promoters60/1573713
taagtta

SEQ ID NO: 120910 - DNA, 7 bp, Unknown
  misc_feature (1)..( 7): Result.002 file - promoters60/1573713
taattta

SEQ ID NO: 120911 - DNA, 7 bp, Unknown
  misc_feature (1)..( 7): Result.002 file - promoters60/1573713
atttatt

SEQ ID NO: 120912 - DNA, 7 bp, Unknown
  misc_feature (1)..( 7): Result.002 file - promoters60/1573713
attaatt

SEQ ID NO: 120913 - DNA, 10 bp, Unknown
  misc_feature (1)..( 10): Result.002 file - promoters60/1573713
tagagttatt

SEQ ID NO: 120914 - DNA, 10 bp, Unknown
  misc_feature (1)..( 10): Result.002 file - promoters60/1573713
attagtaatt

SEQ ID NO: 120915 - DNA, 10 bp, Unknown
  misc_feature (1)..( 10): Result.002 file - promoters60/1573713
attaataatt

SEQ ID NO: 120916 - DNA, 7 bp, Unknown
  misc_feature (1)..( 7): Result.002 file - promoters60/1573713
tgataaa

SEQ ID NO: 120917 - DNA, 7 bp, Unknown
  misc_feature (1)..( 7): Result.002 file - promoters60/1573713
tgaaaaa

SEQ ID NO: 120918 - DNA, 6 bp, Unknown
  misc_feature (1)..( 6): Result.002 file - promoters60/1573713
tatcaa

SEQ ID NO: 120919 - DNA, 6 bp, Unknown
  misc_feature (1)..( 6): Result.002 file - promoters60/1573713
tatcaa

SEQ ID NO: 120920 - DNA, 7 bp, Unknown
  misc_feature (1)..( 7): Result.002 file - promoters60/1573713
taatttt

SEQ ID NO: 120921 - DNA, 7 bp, Unknown
  misc_feature (1)..( 7): Result.002 file - promoters60/1573713
taatttt

SEQ ID NO: 120922 - DNA, 6 bp, Unknown
  misc_feature (1)..( 6): Result.002 file - promoters60/1573713
ttagaa

SEQ ID NO: 120923 - DNA, 6 bp, Unknown
  misc_feature (1)..( 6): Result.002 file - promoters60/1573713
ttagaa

SEQ ID NO: 120924 - DNA, 6 bp, Unknown
  misc_feature (1)..( 6): Result.002 file - promoters60/1573713
atattt

SEQ ID NO: 120925 - DNA, 6 bp, Unknown
  misc_feature (1)..( 6): Result.002 file - promoters60/1573713
atattt

SEQ ID NO: 120926 - DNA, 8 bp, Unknown
  misc_feature (1)..( 8): Result.002 file - promoters60/1573713
tagtagta

SEQ ID NO: 120927 - DNA, 8 bp, Unknown
  misc_feature (1)..( 8): Result.002 file - promoters60/1573713
tagaagta

SEQ ID NO: 120928 - DNA, 6 bp, Unknown
  misc_feature (1)..( 6): Result.002 file - promoters60/1573713
taatct

SEQ ID NO: 120929 - DNA, 6 bp, Unknown
  misc_feature (1)..( 6): Result.002 file - promoters60/1573713
taatct

SEQ ID NO: 120930 - DNA, 10 bp, Unknown
  misc_feature (1)..( 10): Result.002 file - promoters60/1573713
gaaatatata

SEQ ID NO: 120931 - DNA, 10 bp, Unknown
  misc_feature (1)..( 10): Result.002 file - promoters60/1573713
gaaatatata

SEQ ID NO: 120932 - DNA, 6 bp, Unknown
  misc_feature (1)..( 6): Result.002 file - promoters60/1573713
aaacat

SEQ ID NO: 120933 - DNA, 6 bp, Unknown
  misc_feature (1)..( 6): Result.002 file - promoters60/1573713
aaacat

SEQ ID NO: 120934 - DNA, 7 bp, Unknown
  misc_feature (1)..( 7): Result.002 file - promoters60/1573713
atatttt

SEQ ID NO: 120935 - DNA, 7 bp, Unknown
  misc_feature (1)..( 7): Result.002 file - promoters60/1573713
ataattt

SEQ ID NO: 120936 - DNA, 10 bp, Unknown
  misc_feature (1)..( 10): Result.002 file - promoters60/1573713
agatatattt

SEQ ID NO: 120937 - DNA, 10 bp, Unknown
  misc_feature (1)..( 10): Result.002 file - promoters60/1573713
agatattttt

SEQ ID NO: 120938 - DNA, 8 bp, Unknown
  misc_feature (1)..( 8): Result.002 file - promoters60/1573941
ctggcaat

SEQ ID NO: 120939 - DNA, 8 bp, Unknown
  misc_feature (1)..( 8): Result.002 file - promoters60/1573941
ctggtaat

SEQ ID NO: 120940 - DNA, 8 bp, Unknown
  misc_feature (1)..( 8): Result.002 file - promoters60/1573941
aaaagtag

SEQ ID NO: 120941 - DNA, 8 bp, Unknown
  misc_feature (1)..( 8): Result.002 file - promoters60/1573941
aaaaatag

SEQ ID NO: 120942 - DNA, 6 bp, Unknown
  misc_feature (1)..( 6): Result.002 file - promoters60/1573941
aaaaag

SEQ ID NO: 120943 - DNA, 6 bp, Unknown
  misc_feature (1)..( 6): Result.002 file - promoters60/1573941
aaaaag

SEQ ID NO: 120944 - DNA, 6 bp, Unknown
  misc_feature (1)..( 6): Result.002 file - promoters60/1573941
tgcatt

SEQ ID NO: 120945 - DNA, 6 bp, Unknown
  misc_feature (1)..( 6): Result.002 file - promoters60/1573941
tgcatt

SEQ ID NO: 120946 - DNA, 7 bp, Unknown
  misc_feature (1)..( 7): Result.002 file - promoters60/1573941
agcgttg

SEQ ID NO: 120947 - DNA, 7 bp, Unknown
  misc_feature (1)..( 7): Result.002 file - promoters60/1573941
agcgttg

SEQ ID NO: 120948 - DNA, 6 bp, Unknown
  misc_feature (1)..( 6): Result.002 file - promoters60/1573941
gaggat

SEQ ID NO: 120949 - DNA, 6 bp, Unknown
  misc_feature (1)..( 6): Result.002 file - promoters60/1573941
gaggat

SEQ ID NO: 120950 - DNA, 8 bp, Unknown
  misc_feature (1)..( 8): Result.002 file - promoters60/1573941
aaaagtgc

SEQ ID NO: 120951 - DNA, 8 bp, Unknown
  misc_feature (1)..( 8): Result.002 file - promoters60/1573941
aaaactgc

SEQ ID NO: 120952 - DNA, 6 bp, Unknown
  misc_feature (1)..( 6): Result.002 file - promoters60/1573941
aaacca

SEQ ID NO: 120953 - DNA, 6 bp, Unknown
  misc_feature (1)..( 6): Result.002 file - promoters60/1573941
aaacca

SEQ ID NO: 120954 - DNA, 7 bp, Unknown
  misc_feature (1)..( 7): Result.002 file - promoters60/1573945
cagaagt

SEQ ID NO: 120955 - DNA, 7 bp, Unknown
  misc_feature (1)..( 7): Result.002 file - promoters60/1573945
cagaaga

SEQ ID NO: 120956 - DNA, 7 bp, Unknown
  misc_feature (1)..( 7): Result.002 file - promoters60/1573945
gagaaga

SEQ ID NO: 120957 - DNA, 7 bp, Unknown
  misc_feature (1)..( 7): Result.002 file - promoters60/1573945
aatctct

SEQ ID NO: 120958 - DNA, 7 bp, Unknown
  misc_feature (1)..( 7): Result.002 file - promoters60/1573945
aatctct

SEQ ID NO: 120959 - DNA, 10 bp, Unknown
  misc_feature (1)..( 10): Result.002 file - promoters60/1573945
aaagatttct

SEQ ID NO: 120960 - DNA, 10 bp, Unknown
  misc_feature (1)..( 10): Result.002 file - promoters60/1573945
aaaggtttct

SEQ ID NO: 120961 - DNA, 6 bp, Unknown
  misc_feature (1)..( 6): Result.002 file - promoters60/1573945
actttg

SEQ ID NO: 120962 - DNA, 6 bp, Unknown
  misc_feature (1)..( 6): Result.002 file - promoters60/1573945
actttg

SEQ ID NO: 120963 - DNA, 6 bp, Unknown
  misc_feature (1)..( 6): Result.002 file - promoters60/1573945
tttatt

SEQ ID NO: 120964 - DNA, 6 bp, Unknown
  misc_feature (1)..( 6): Result.002 file - promoters60/1573945
tttatt

SEQ ID NO: 120965 - DNA, 8 bp, Unknown
  misc_feature (1)..( 8): Result.002 file - promoters60/1573945
tattgtaa

SEQ ID NO: 120966 - DNA, 8 bp, Unknown
  misc_feature (1)..( 8): Result.002 file - promoters60/1573945
tattgtaa

SEQ ID NO: 120967 - DNA, 10 bp, Unknown
  misc_feature (1)..( 10): Result.002 file - promoters60/1573945
tttaaagttt

SEQ ID NO: 120968 - DNA, 10 bp, Unknown
  misc_feature (1)..( 10): Result.002 file - promoters60/1573945
tgtaaaattt

SEQ ID NO: 120969 - DNA, 10 bp, Unknown
  misc_feature (1)..( 10): Result.002 file - promoters60/1573945
tttaaaagag

SEQ ID NO: 120970 - DNA, 6 bp, Unknown
  misc_feature (1)..( 6): Result.002 file - promoters60/1573945
gtatca

SEQ ID NO: 120971 - DNA, 6 bp, Unknown
  misc_feature (1)..( 6): Result.002 file - promoters60/1573945
gtatca

SEQ ID NO: 120972 - DNA, 6 bp, Unknown
  misc_feature (1)..( 6): Result.002 file - promoters60/1573945
tgagag

SEQ ID NO: 120973 - DNA, 6 bp, Unknown
  misc_feature (1)..( 6): Result.002 file - promoters60/1573945
tgagag

SEQ ID NO: 120974 - DNA, 6 bp, Unknown
  misc_feature (1)..( 6): Result.002 file - promoters60/1573945
tttatt

SEQ ID NO: 120975 - DNA, 6 bp, Unknown
  misc_feature (1)..( 6): Result.002 file - promoters60/1573945
tttatt

SEQ ID NO: 120976 - DNA, 7 bp, Unknown
  misc_feature (1)..( 7): Result.002 file - promoters60/1573945
cgaggag

SEQ ID NO: 120977 - DNA, 7 bp, Unknown
  misc_feature (1)..( 7): Result.002 file - promoters60/1573945
cgacgag

SEQ ID NO: 120978 - DNA, 6 bp, Unknown
  misc_feature (1)..( 6): Result.002 file - promoters60/1573945
tctagg

SEQ ID NO: 120979 - DNA, 6 bp, Unknown
  misc_feature (1)..( 6): Result.002 file - promoters60/1573945
tctagg

SEQ ID NO: 120980 - DNA, 7 bp, Unknown
  misc_feature (1)..( 7): Result.002 file - promoters60/1573945
aaagtta

SEQ ID NO: 120981 - DNA, 7 bp, Unknown
  misc_feature (1)..( 7): Result.002 file - promoters60/1573945
aaaatta

SEQ ID NO: 120982 - DNA, 7 bp, Unknown
  misc_feature (1)..( 7): Result.002 file - promoters60/1573945
taacccg

SEQ ID NO: 120983 - DNA, 7 bp, Unknown
  misc_feature (1)..( 7): Result.002 file - promoters60/1573945
taaaccg

SEQ ID NO: 120984 - DNA, 7 bp, Unknown
  misc_feature (1)..( 7): Result.002 file - promoters60/1574029
ttagcct

SEQ ID NO: 120985 - DNA, 7 bp, Unknown
  misc_feature (1)..( 7): Result.002 file - promoters60/1574029
ttaccct

SEQ ID NO: 120986 - DNA, 6 bp, Unknown
  misc_feature (1)..( 6): Result.002 file - promoters60/1574029
taaccg

SEQ ID NO: 120987 - DNA, 6 bp, Unknown
  misc_feature (1)..( 6): Result.002 file - promoters60/1574029
taaccg

SEQ ID NO: 120988 - DNA, 6 bp, Unknown
  misc_feature (1)..( 6): Result.002 file - promoters60/1574029
gttaaa

SEQ ID NO: 120989 - DNA, 6 bp, Unknown
  misc_feature (1)..( 6): Result.002 file - promoters60/1574029
gttaaa

SEQ ID NO: 120990 - DNA, 7 bp, Unknown
  misc_feature (1)..( 7): Result.002 file - promoters60/1574029
caaagtc

SEQ ID NO: 120991 - DNA, 7 bp, Unknown
  misc_feature (1)..( 7): Result.002 file - promoters60/1574029
caatgtc

SEQ ID NO: 120992 - DNA, 8 bp, Unknown
  misc_feature (1)..( 8): Result.002 file - promoters60/1574029
atattttc

SEQ ID NO: 120993 - DNA, 8 bp, Unknown
  misc_feature (1)..( 8): Result.002 file - promoters60/1574029
atatcttc

SEQ ID NO: 120994 - DNA, 6 bp, Unknown
  misc_feature (1)..( 6): Result.002 file - promoters60/1574029
gagata

SEQ ID NO: 120995 - DNA, 6 bp, Unknown
  misc_feature (1)..( 6): Result.002 file - promoters60/1574029
gagata

SEQ ID NO: 120996 - DNA, 7 bp, Unknown
  misc_feature (1)..( 7): Result.002 file - promoters60/1574029
atgtggt

SEQ ID NO: 120997 - DNA, 7 bp, Unknown
  misc_feature (1)..( 7): Result.002 file - promoters60/1574029
atgtgga

SEQ ID NO: 120998 - DNA, 7 bp, Unknown
  misc_feature (1)..( 7): Result.002 file - promoters60/1574029
atgagga

SEQ ID NO: 120999 - DNA, 7 bp, Unknown
  misc_feature (1)..( 7): Result.002 file - promoters60/1574029
agctaat

SEQ ID NO: 121000 - DNA, 7 bp, Unknown
  misc_feature (1)..( 7): Result.002 file - promoters60/1574029
agcaaat

SEQ ID NO: 121001 - DNA, 6 bp, Unknown
  misc_feature (1)..( 6): Result.002 file - promoters60/1574029
aatgct

SEQ ID NO: 121002 - DNA, 6 bp, Unknown
  misc_feature (1)..( 6): Result.002 file - promoters60/1574029
aatgct

SEQ ID NO: 121003 - DNA, 7 bp, Unknown
  misc_feature (1)..( 7): Result.002 file - promoters60/1574029
caatcta

SEQ ID NO: 121004 - DNA, 7 bp, Unknown
  misc_feature (1)..( 7): Result.002 file - promoters60/1574029
caatcta

SEQ ID NO: 121005 - DNA, 8 bp, Unknown
  misc_feature (1)..( 8): Result.002 file - promoters60/1574029
atttcaaa

SEQ ID NO: 121006 - DNA, 8 bp, Unknown
  misc_feature (1)..( 8): Result.002 file - promoters60/1574029
atttcaaa

SEQ ID NO: 121007 - DNA, 8 bp, Unknown
  misc_feature (1)..( 8): Result.002 file - promoters60/1574029
tttgggaa

SEQ ID NO: 121008 - DNA, 8 bp, Unknown
  misc_feature (1)..( 8): Result.002 file - promoters60/1574029
tttgcgaa

SEQ ID NO: 121009 - DNA, 10 bp, Unknown
  misc_feature (1)..( 10): Result.002 file - promoters60/1574029
ttcaagaaga

SEQ ID NO: 121010 - DNA, 10 bp, Unknown
  misc_feature (1)..( 10): Result.002 file - promoters60/1574029
ttcaagaaga

SEQ ID NO: 121011 - DNA, 6 bp, Unknown
  misc_feature (1)..( 6): Result.002 file - promoters60/1574029
cgttga

SEQ ID NO: 121012 - DNA, 6 bp, Unknown
  misc_feature (1)..( 6): Result.002 file - promoters60/1574029
cgttga

SEQ ID NO: 121013 - DNA, 9 bp, Unknown
  misc_feature (1)..( 9): Result.002 file - promoters60/1574029
aatcaagat

SEQ ID NO: 121014 - DNA, 9 bp, Unknown
  misc_feature (1)..( 9): Result.002 file - promoters60/1574029
aataaagat

SEQ ID NO: 121015 - DNA, 6 bp, Unknown
  misc_feature (1)..( 6): Result.002 file - promoters60/1574059
caagga

SEQ ID NO: 121016 - DNA, 6 bp, Unknown
  misc_feature (1)..( 6): Result.002 file - promoters60/1574059
caagga

SEQ ID NO: 121017 - DNA, 6 bp, Unknown
  misc_feature (1)..( 6): Result.002 file - promoters60/1574059
gtttca

SEQ ID NO: 121018 - DNA, 6 bp, Unknown
  misc_feature (1)..( 6): Result.002 file - promoters60/1574059
gtttca

SEQ ID NO: 121019 - DNA, 7 bp, Unknown
  misc_feature (1)..( 7): Result.002 file - promoters60/1574059
ttcatca

SEQ ID NO: 121020 - DNA, 7 bp, Unknown
  misc_feature (1)..( 7): Result.002 file - promoters60/1574059
ttcttca

SEQ ID NO: 121021 - DNA, 6 bp, Unknown
  misc_feature (1)..( 6): Result.002 file - promoters60/1574059
gtgtta

SEQ ID NO: 121022 - DNA, 6 bp, Unknown
  misc_feature (1)..( 6): Result.002 file - promoters60/1574059
gtgtta

SEQ ID NO: 121023 - DNA, 8 bp, Unknown
  misc_feature (1)..( 8): Result.002 file - promoters60/1574059
ttgtgatc

SEQ ID NO: 121024 - DNA, 8 bp, Unknown
  misc_feature (1)..( 8): Result.002 file - promoters60/1574059
ttgtaatc

SEQ ID NO: 121025 - DNA, 8 bp, Unknown
  misc_feature (1)..( 8): Result.002 file - promoters60/1574059
atgtagaa

SEQ ID NO: 121026 - DNA, 8 bp, Unknown
  misc_feature (1)..( 8): Result.002 file - promoters60/1574059
atgaagaa

SEQ ID NO: 121027 - DNA, 6 bp, Unknown
  misc_feature (1)..( 6): Result.002 file - promoters60/1574059
ttatgt

SEQ ID NO: 121028 - DNA, 6 bp, Unknown
  misc_feature (1)..( 6): Result.002 file - promoters60/1574059
ttatgt

SEQ ID NO: 121029 - DNA, 8 bp, Unknown
  misc_feature (1)..( 8): Result.002 file - promoters60/1574059
tttagttt

SEQ ID NO: 121030 - DNA, 8 bp, Unknown
  misc_feature (1)..( 8): Result.002 file - promoters60/1574059
tttatttt

SEQ ID NO: 121031 - DNA, 7 bp, Unknown
  misc_feature (1)..( 7): Result.002 file - promoters60/1574059
ctaaaac

SEQ ID NO: 121032 - DNA, 7 bp, Unknown
  misc_feature (1)..( 7): Result.002 file - promoters60/1574059
gtaaaac

SEQ ID NO: 121033 - DNA, 7 bp, Unknown
  misc_feature (1)..( 7): Result.002 file - promoters60/1574059
gtaaaac

SEQ ID NO: 121034 - DNA, 8 bp, Unknown
  misc_feature (1)..( 8): Result.002 file - promoters60/1574059
agacgaac

SEQ ID NO: 121035 - DNA, 8 bp, Unknown
  misc_feature (1)..( 8): Result.002 file - promoters60/1574059
agaggaac

SEQ ID NO: 121036 - DNA, 6 bp, Unknown
  misc_feature (1)..( 6): Result.002 file - promoters60/1574059
gaagaa

SEQ ID NO: 121037 - DNA, 6 bp, Unknown
  misc_feature (1)..( 6): Result.002 file - promoters60/1574059
gaagaa

SEQ ID NO: 121038 - DNA, 6 bp, Unknown
  misc_feature (1)..( 6): Result.002 file - promoters60/1574059
tggaga

SEQ ID NO: 121039 - DNA, 6 bp, Unknown
  misc_feature (1)..( 6): Result.002 file - promoters60/1574059
tggaga

SEQ ID NO: 121040 - DNA, 8 bp, Unknown
  misc_feature (1)..( 8): Result.002 file - promoters60/1574059
aatgcttt

SEQ ID NO: 121041 - DNA, 8 bp, Unknown
  misc_feature (1)..( 8): Result.002 file - promoters60/1574059
aatggttt

SEQ ID NO: 121042 - DNA, 7 bp, Unknown
  misc_feature (1)..( 7): Result.002 file - promoters60/1574059
atatttt

SEQ ID NO: 121043 - DNA, 7 bp, Unknown
  misc_feature (1)..( 7): Result.002 file - promoters60/1574059
atatttt

SEQ ID NO: 121044 - DNA, 7 bp, Unknown
  misc_feature (1)..( 7): Result.002 file - promoters60/1574059
aaataaa

SEQ ID NO: 121045 - DNA, 7 bp, Unknown
  misc_feature (1)..( 7): Result.002 file - promoters60/1574059
aaataaa

SEQ ID NO: 121046 - DNA, 6 bp, Unknown
  misc_feature (1)..( 6): Result.002 file - promoters60/1574059
caaagg

SEQ ID NO: 121047 - DNA, 6 bp, Unknown
  misc_feature (1)..( 6): Result.002 file - promoters60/1574059
caaagg

SEQ ID NO: 121048 - DNA, 7 bp, Unknown
  misc_feature (1)..( 7): Result.002 file - promoters60/1580171
aatcgta

SEQ ID NO: 121049 - DNA, 7 bp, Unknown
  misc_feature (1)..( 7): Result.002 file - promoters60/1580171
aatggta

SEQ ID NO: 121050 - DNA, 7 bp, Unknown
  misc_feature (1)..( 7): Result.002 file - promoters60/1580171
agagaaa

SEQ ID NO: 121051 - DNA, 7 bp, Unknown
  misc_feature (1)..( 7): Result.002 file - promoters60/1580171
agaaaaa

SEQ ID NO: 121052 - DNA, 7 bp, Unknown
  misc_feature (1)..( 7): Result.002 file - promoters60/1580171
attatct

SEQ ID NO: 121053 - DNA, 7 bp, Unknown
  misc_feature (1)..( 7): Result.002 file - promoters60/1580171
attttct

SEQ ID NO: 121054 - DNA, 6 bp, Unknown
  misc_feature (1)..( 6): Result.002 file - promoters60/1580171
atgaaa

SEQ ID NO: 121055 - DNA, 6 bp, Unknown
  misc_feature (1)..( 6): Result.002 file - promoters60/1580171
atgaaa

SEQ ID NO: 121056 - DNA, 8 bp, Unknown
  misc_feature (1)..( 8): Result.002 file - promoters60/1580171
atttgtaa

SEQ ID NO: 121057 - DNA, 8 bp, Unknown
  misc_feature (1)..( 8): Result.002 file - promoters60/1580171
attggtaa

SEQ ID NO: 121058 - DNA, 8 bp, Unknown
  misc_feature (1)..( 8): Result.002 file - promoters60/1580171
ttgacttt

SEQ ID NO: 121059 - DNA, 8 bp, Unknown
  misc_feature (1)..( 8): Result.002 file - promoters60/1580171
ttgaattt

SEQ ID NO: 121060 - DNA, 8 bp, Unknown
  misc_feature (1)..( 8): Result.002 file - promoters60/1580171
aactaaaa

SEQ ID NO: 121061 - DNA, 8 bp, Unknown
  misc_feature (1)..( 8): Result.002 file - promoters60/1580171
aactaaaa

SEQ ID NO: 121062 - DNA, 7 bp, Unknown
  misc_feature (1)..( 7): Result.002 file - promoters60/1580171
cttcttc

SEQ ID NO: 121063 - DNA, 7 bp, Unknown
  misc_feature (1)..( 7): Result.002 file - promoters60/1580171
cttcttc

SEQ ID NO: 121064 - DNA, 7 bp, Unknown
  misc_feature (1)..( 7): Result.002 file - promoters60/1580171
taaaaaa

SEQ ID NO: 121065 - DNA, 7 bp, Unknown
  misc_feature (1)..( 7): Result.002 file - promoters60/1580171
taaaaaa

SEQ ID NO: 121066 - DNA, 7 bp, Unknown
  misc_feature (1)..( 7): Result.002 file - promoters60/1580171
aaaattc

SEQ ID NO: 121067 - DNA, 7 bp, Unknown
  misc_feature (1)..( 7): Result.002 file - promoters60/1580171
aaaattc

SEQ ID NO: 121068 - DNA, 7 bp, Unknown
  misc_feature (1)..( 7): Result.002 file - promoters60/1580171
taaattc

SEQ ID NO: 121069 - DNA, 9 bp, Unknown
  misc_feature (1)..( 9): Result.002 file - promoters60/1580171
attagaaac

SEQ ID NO: 121070 - DNA, 9 bp, Unknown
  misc_feature (1)..( 9): Result.002 file - promoters60/1580171
tttataaac

SEQ ID NO: 121071 - DNA, 9 bp, Unknown
  misc_feature (1)..( 9): Result.002 file - promoters60/1580171
tttataatt

SEQ ID NO: 121072 - DNA, 6 bp, Unknown
  misc_feature (1)..( 6): Result.002 file - promoters60/1580171
atgcat

SEQ ID NO: 121073 - DNA, 6 bp, Unknown
  misc_feature (1)..( 6): Result.002 file - promoters60/1580171
atgcat

SEQ ID NO: 121074 - DNA, 8 bp, Unknown
  misc_feature (1)..( 8): Result.002 file - promoters60/1580171
aaattctt

SEQ ID NO: 121075 - DNA, 8 bp, Unknown
  misc_feature (1)..( 8): Result.002 file - promoters60/1580171
aaaatctt

SEQ ID NO: 121076 - DNA, 7 bp, Unknown
  misc_feature (1)..( 7): Result.002 file - promoters60/1580171
aagatgt

SEQ ID NO: 121077 - DNA, 7 bp, Unknown
  misc_feature (1)..( 7): Result.002 file - promoters60/1580171
aagatgt

SEQ ID NO: 121078 - DNA, 7 bp, Unknown
  misc_feature (1)..( 7): Result.002 file - promoters60/1580171
ttgaaga

SEQ ID NO: 121079 - DNA, 7 bp, Unknown
  misc_feature (1)..( 7): Result.002 file - promoters60/1580171
ttgtaga

SEQ ID NO: 121080 - DNA, 6 bp, Unknown
  misc_feature (1)..( 6): Result.002 file - promoters60/1580171
attttt

SEQ ID NO: 121081 - DNA, 6 bp, Unknown
  misc_feature (1)..( 6): Result.002 file - promoters60/1580171
attttt

SEQ ID NO: 121082 - DNA, 7 bp, Unknown
  misc_feature (1)..( 7): Result.002 file - promoters60/1580171
taagttt

SEQ ID NO: 121083 - DNA, 7 bp, Unknown
  misc_feature (1)..( 7): Result.002 file - promoters60/1580171
taaattt

SEQ ID NO: 121084 - DNA, 6 bp, Unknown
  misc_feature (1)..( 6): Result.002 file - promoters60/1580171
atgatt

SEQ ID NO: 121085 - DNA, 6 bp, Unknown
  misc_feature (1)..( 6): Result.002 file - promoters60/1580171
atgatt

SEQ ID NO: 121086 - DNA, 7 bp, Unknown
  misc_feature (1)..( 7): Result.002 file - promoters60/1580171
tttataa

SEQ ID NO: 121087 - DNA, 7 bp, Unknown
  misc_feature (1)..( 7): Result.002 file - promoters60/1580171
tttgtaa

SEQ ID NO: 121088 - DNA, 7 bp, Unknown
  misc_feature (1)..( 7): Result.002 file - promoters60/1580171
aaattta

SEQ ID NO: 121089 - DNA, 7 bp, Unknown
  misc_feature (1)..( 7): Result.002 file - promoters60/1580171
aaattta

SEQ ID NO: 121090 - DNA, 6 bp, Unknown
  misc_feature (1)..( 6): Result.002 file - promoters60/1580171
aaataa

SEQ ID NO: 121091 - DNA, 6 bp, Unknown
  misc_feature (1)..( 6): Result.002 file - promoters60/1580171
aaataa

SEQ ID NO: 121092 - DNA, 8 bp, Unknown
  misc_feature (1)..( 8): Result.002 file - promoters60/1580171
aaataaaa

SEQ ID NO: 121093 - DNA, 8 bp, Unknown
  misc_feature (1)..( 8): Result.002 file - promoters60/1580171
aaaaaaaa

SEQ ID NO: 121094 - DNA, 8 bp, Unknown
  misc_feature (1)..( 8): Result.002 file - promoters60/1580171
attatttt

SEQ ID NO: 121095 - DNA, 8 bp, Unknown
  misc_feature (1)..( 8): Result.002 file - promoters60/1580171
attttttt

SEQ ID NO: 121096 - DNA, 9 bp, Unknown
  misc_feature (1)..( 9): Result.002 file - promoters60/1580171
ttactattt

SEQ ID NO: 121097 - DNA, 9 bp, Unknown
  misc_feature (1)..( 9): Result.002 file - promoters60/1580171
ttaatattt

SEQ ID NO: 121098 - DNA, 9 bp, Unknown
  misc_feature (1)..( 9): Result.002 file - promoters60/1580500
aattttgac

SEQ ID NO: 121099 - DNA, 9 bp, Unknown
  misc_feature (1)..( 9): Result.002 file - promoters60/1580500
aatgttgat

SEQ ID NO: 121100 - DNA, 9 bp, Unknown
  misc_feature (1)..( 9): Result.002 file - promoters60/1580500
gattttgaa

SEQ ID NO: 121101 - DNA, 9 bp, Unknown
  misc_feature (1)..( 9): Result.002 file - promoters60/1580500
tattttaca

SEQ ID NO: 121102 - DNA, 9 bp, Unknown
  misc_feature (1)..( 9): Result.002 file - promoters60/1580500
atttttaca

SEQ ID NO: 121103 - DNA, 9 bp, Unknown
  misc_feature (1)..( 9): Result.002 file - promoters60/1580500
tatgttaac

SEQ ID NO: 121104 - DNA, 11 bp, Unknown
  misc_feature (1)..( 11): Result.002 file - promoters60/1580500
attgtaatcat

SEQ ID NO: 121105 - DNA, 11 bp, Unknown
  misc_feature (1)..( 11): Result.002 file - promoters60/1580500
atgttaaacat

SEQ ID NO: 121106 - DNA, 11 bp, Unknown
  misc_feature (1)..( 11): Result.002 file - promoters60/1580500
atggtaatctc

SEQ ID NO: 121107 - DNA, 11 bp, Unknown
  misc_feature (1)..( 11): Result.002 file - promoters60/1580500
ctgttaaacca

SEQ ID NO: 121108 - DNA, 11 bp, Unknown
  misc_feature (1)..( 11): Result.002 file - promoters60/1580500
ctgataattgt

SEQ ID NO: 121109 - DNA, 11 bp, Unknown
  misc_feature (1)..( 11): Result.002 file - promoters60/1580500
gagttgaacaa

SEQ ID NO: 121110 - DNA, 10 bp, Unknown
  misc_feature (1)..( 10): Result.002 file - promoters60/1580500
aattttaatc

SEQ ID NO: 121111 - DNA, 10 bp, Unknown
  misc_feature (1)..( 10): Result.002 file - promoters60/1580500
attttgaatg

SEQ ID NO: 121112 - DNA, 10 bp, Unknown
  misc_feature (1)..( 10): Result.002 file - promoters60/1580500
tattttacag

SEQ ID NO: 121113 - DNA, 10 bp, Unknown
  misc_feature (1)..( 10): Result.002 file - promoters60/1580500
tatttttaca

SEQ ID NO: 121114 - DNA, 10 bp, Unknown
  misc_feature (1)..( 10): Result.002 file - promoters60/1580500
gaagtgaatg

SEQ ID NO: 121115 - DNA, 10 bp, Unknown
  misc_feature (1)..( 10): Result.002 file - promoters60/1580500
tatgttaaca

SEQ ID NO: 121116 - DNA, 12 bp, Unknown
  misc_feature (1)..( 12): Result.002 file - promoters60/1580870
taattttaattt

SEQ ID NO: 121117 - DNA, 12 bp, Unknown
  misc_feature (1)..( 12): Result.002 file - promoters60/1580870
taatcttagaag

SEQ ID NO: 121118 - DNA, 12 bp, Unknown
  misc_feature (1)..( 12): Result.002 file - promoters60/1580870
tgattttcattt

SEQ ID NO: 121119 - DNA, 8 bp, Unknown
  misc_feature (1)..( 8): Result.002 file - promoters60/1580870
ttttcaaa

SEQ ID NO: 121120 - DNA, 8 bp, Unknown
  misc_feature (1)..( 8): Result.002 file - promoters60/1580870
atttaaaa

SEQ ID NO: 121121 - DNA, 8 bp, Unknown
  misc_feature (1)..( 8): Result.002 file - promoters60/1580870
atttaatg

SEQ ID NO: 121122 - DNA, 8 bp, Unknown
  misc_feature (1)..( 8): Result.002 file - promoters60/1580870
ctatttgg

SEQ ID NO: 121123 - DNA, 8 bp, Unknown
  misc_feature (1)..( 8): Result.002 file - promoters60/1580870
atatttgt

SEQ ID NO: 121124 - DNA, 8 bp, Unknown
  misc_feature (1)..( 8): Result.002 file - promoters60/1580870
atatatgt

SEQ ID NO: 121125 - DNA, 8 bp, Unknown
  misc_feature (1)..( 8): Result.002 file - promoters60/1580870
tttccaaa

SEQ ID NO: 121126 - DNA, 8 bp, Unknown
  misc_feature (1)..( 8): Result.002 file - promoters60/1580870
tttctaaa

SEQ ID NO: 121127 - DNA, 8 bp, Unknown
  misc_feature (1)..( 8): Result.002 file - promoters60/1580870
attctaac

SEQ ID NO: 121128 - DNA, 7 bp, Unknown
  misc_feature (1)..( 7): Result.002 file - promoters60/1580870
attaaat

SEQ ID NO: 121129 - DNA, 7 bp, Unknown
  misc_feature (1)..( 7): Result.002 file - promoters60/1580870
atttaat

SEQ ID NO: 121130 - DNA, 7 bp, Unknown
  misc_feature (1)..( 7): Result.002 file - promoters60/1580870
atttaaa

SEQ ID NO: 121131 - DNA, 9 bp, Unknown
  misc_feature (1)..( 9): Result.002 file - promoters60/1580870
tatctttaa

SEQ ID NO: 121132 - DNA, 9 bp, Unknown
  misc_feature (1)..( 9): Result.002 file - promoters60/1580870
tatgtttcc

SEQ ID NO: 121133 - DNA, 9 bp, Unknown
  misc_feature (1)..( 9): Result.002 file - promoters60/1580870
aatatttgt

SEQ ID NO: 121134 - DNA, 7 bp, Unknown
  misc_feature (1)..( 7): Result.002 file - promoters60/1580870
tgtatat

SEQ ID NO: 121135 - DNA, 7 bp, Unknown
  misc_feature (1)..( 7): Result.002 file - promoters60/1580870
agtatat

SEQ ID NO: 121136 - DNA, 7 bp, Unknown
  misc_feature (1)..( 7): Result.002 file - promoters60/1580870
tgtctat

SEQ ID NO: 121137 - DNA, 14 bp, Unknown
  misc_feature (1)..( 14): Result.002 file - promoters60/1580932
aaataaattaatta

SEQ ID NO: 121138 - DNA, 14 bp, Unknown
  misc_feature (1)..( 14): Result.002 file - promoters60/1580932
cacaaaactaaaaa

SEQ ID NO: 121139 - DNA, 14 bp, Unknown
  misc_feature (1)..( 14): Result.002 file - promoters60/1580932
cacgaaactactac

SEQ ID NO: 121140 - DNA, 14 bp, Unknown
  misc_feature (1)..( 14): Result.002 file - promoters60/1580932
aacccaactacaaa

SEQ ID NO: 121141 - DNA, 14 bp, Unknown
  misc_feature (1)..( 14): Result.002 file - promoters60/1580932
gacgatactaaaaa

SEQ ID NO: 121142 - DNA, 14 bp, Unknown
  misc_feature (1)..( 14): Result.002 file - promoters60/1580932
tgtaatattaaaat

SEQ ID NO: 121143 - DNA, 12 bp, Unknown
  misc_feature (1)..( 12): Result.002 file - promoters60/1580932
taattaaactgg

SEQ ID NO: 121144 - DNA, 12 bp, Unknown
  misc_feature (1)..( 12): Result.002 file - promoters60/1580932
taactaaattgg

SEQ ID NO: 121145 - DNA, 12 bp, Unknown
  misc_feature (1)..( 12): Result.002 file - promoters60/1580932
atattaaaataa

SEQ ID NO: 121146 - DNA, 12 bp, Unknown
  misc_feature (1)..( 12): Result.002 file - promoters60/1580932
ctgctgaattgg

SEQ ID NO: 121147 - DNA, 12 bp, Unknown
  misc_feature (1)..( 12): Result.002 file - promoters60/1580932
cttatgatttgc

SEQ ID NO: 121148 - DNA, 12 bp, Unknown
  misc_feature (1)..( 12): Result.002 file - promoters60/1580932
atactaaaaaca

SEQ ID NO: 121149 - DNA, 12 bp, Unknown
  misc_feature (1)..( 12): Result.002 file - promoters60/1580932
ataaatcgttag

SEQ ID NO: 121150 - DNA, 12 bp, Unknown
  misc_feature (1)..( 12): Result.002 file - promoters60/1580932
ccgaatcgatag

SEQ ID NO: 121151 - DNA, 12 bp, Unknown
  misc_feature (1)..( 12): Result.002 file - promoters60/1580932
gagaatcattaa

SEQ ID NO: 121152 - DNA, 12 bp, Unknown
  misc_feature (1)..( 12): Result.002 file - promoters60/1580932
gagcatcaacgt

SEQ ID NO: 121153 - DNA, 12 bp, Unknown
  misc_feature (1)..( 12): Result.002 file - promoters60/1580932
agaaatagatat

SEQ ID NO: 121154 - DNA, 12 bp, Unknown
  misc_feature (1)..( 12): Result.002 file - promoters60/1580932
cttcataaatca

SEQ ID NO: 121155 - DNA, 12 bp, Unknown
  misc_feature (1)..( 12): Result.002 file - promoters60/1580932
aaaaatcatgta

SEQ ID NO: 121156 - DNA, 7 bp, Unknown
  misc_feature (1)..( 7): Result.002 file - promoters60/1580983
aattttt

SEQ ID NO: 121157 - DNA, 7 bp, Unknown
  misc_feature (1)..( 7): Result.002 file - promoters60/1580983
tattttt

SEQ ID NO: 121158 - DNA, 7 bp, Unknown
  misc_feature (1)..( 7): Result.002 file - promoters60/1580983
aatttta

SEQ ID NO: 121159 - DNA, 6 bp, Unknown
  misc_feature (1)..( 6): Result.002 file - promoters60/1580983
tttact

SEQ ID NO: 121160 - DNA, 6 bp, Unknown
  misc_feature (1)..( 6): Result.002 file - promoters60/1580983
tttact

SEQ ID NO: 121161 - DNA, 7 bp, Unknown
  misc_feature (1)..( 7): Result.002 file - promoters60/1580983
cctcaga

SEQ ID NO: 121162 - DNA, 7 bp, Unknown
  misc_feature (1)..( 7): Result.002 file - promoters60/1580983
ccttaga

SEQ ID NO: 121163 - DNA, 8 bp, Unknown
  misc_feature (1)..( 8): Result.002 file - promoters60/1580983
aaaaaatc

SEQ ID NO: 121164 - DNA, 8 bp, Unknown
  misc_feature (1)..( 8): Result.002 file - promoters60/1580983
aaaatatc

SEQ ID NO: 121165 - DNA, 11 bp, Unknown
  misc_feature (1)..( 11): Result.002 file - promoters60/1580983
tcgatgaaatt

SEQ ID NO: 121166 - DNA, 11 bp, Unknown
  misc_feature (1)..( 11): Result.002 file - promoters60/1580983
taaatgagatt

SEQ ID NO: 121167 - DNA, 11 bp, Unknown
  misc_feature (1)..( 11): Result.002 file - promoters60/1580983
taaatgaggga

SEQ ID NO: 121168 - DNA, 7 bp, Unknown
  misc_feature (1)..( 7): Result.002 file - promoters60/1580983
gaaaggg

SEQ ID NO: 121169 - DNA, 7 bp, Unknown
  misc_feature (1)..( 7): Result.002 file - promoters60/1580983
gaaaggg

SEQ ID NO: 121170 - DNA, 7 bp, Unknown
  misc_feature (1)..( 7): Result.002 file - promoters60/1580983
atagaaa

SEQ ID NO: 121171 - DNA, 7 bp, Unknown
  misc_feature (1)..( 7): Result.002 file - promoters60/1580983
atacaaa

SEQ ID NO: 121172 - DNA, 6 bp, Unknown
  misc_feature (1)..( 6): Result.002 file - promoters60/1580983
agagaa

SEQ ID NO: 121173 - DNA, 6 bp, Unknown
  misc_feature (1)..( 6): Result.002 file - promoters60/1580983
agagaa

SEQ ID NO: 121174 - DNA, 6 bp, Unknown
  misc_feature (1)..( 6): Result.002 file - promoters60/1580983
taaaat

SEQ ID NO: 121175 - DNA, 6 bp, Unknown
  misc_feature (1)..( 6): Result.002 file - promoters60/1580983
taaaat

SEQ ID NO: 121176 - DNA, 7 bp, Unknown
  misc_feature (1)..( 7): Result.002 file - promoters60/1580983
attaatt

SEQ ID NO: 121177 - DNA, 7 bp, Unknown
  misc_feature (1)..( 7): Result.002 file - promoters60/1580983
atttatt

SEQ ID NO: 121178 - DNA, 6 bp, Unknown
  misc_feature (1)..( 6): Result.002 file - promoters60/1580983
aaaatc

SEQ ID NO: 121179 - DNA, 6 bp, Unknown
  misc_feature (1)..( 6): Result.002 file - promoters60/1580983
aaaatc

SEQ ID NO: 121180 - DNA, 10 bp, Unknown
  misc_feature (1)..( 10): Result.002 file - promoters60/1581038
atttttttca

SEQ ID NO: 121181 - DNA, 10 bp, Unknown
  misc_feature (1)..( 10): Result.002 file - promoters60/1581038
actttcttcc

SEQ ID NO: 121182 - DNA, 10 bp, Unknown
  misc_feature (1)..( 10): Result.002 file - promoters60/1581038
gtatttttcc

SEQ ID NO: 121183 - DNA, 10 bp, Unknown
  misc_feature (1)..( 10): Result.002 file - promoters60/1581038
attttattca

SEQ ID NO: 121184 - DNA, 8 bp, Unknown
  misc_feature (1)..( 8): Result.002 file - promoters60/1581038
atttaaca

SEQ ID NO: 121185 - DNA, 8 bp, Unknown
  misc_feature (1)..( 8): Result.002 file - promoters60/1581038
tttttaca

SEQ ID NO: 121186 - DNA, 8 bp, Unknown
  misc_feature (1)..( 8): Result.002 file - promoters60/1581038
atttaaaa

SEQ ID NO: 121187 - DNA, 8 bp, Unknown
  misc_feature (1)..( 8): Result.002 file - promoters60/1581038
gttataca

SEQ ID NO: 121188 - DNA, 8 bp, Unknown
  misc_feature (1)..( 8): Result.002 file - promoters60/1581038
tttttatc

SEQ ID NO: 121189 - DNA, 19 bp, Unknown
  misc_feature (1)..( 19): Result.002 file - promoters60/1581038
ttaacattgatataaaaaa

SEQ ID NO: 121190 - DNA, 19 bp, Unknown
  misc_feature (1)..( 19): Result.002 file - promoters60/1581038
tttgttgtattctaaaaag

SEQ ID NO: 121191 - DNA, 20 bp, Unknown
  misc_feature (1)..( 20): Result.002 file - promoters60/1581038
atttattttttataagaaaa

SEQ ID NO: 121192 - DNA, 20 bp, Unknown
  misc_feature (1)..( 20): Result.002 file - promoters60/1581038
atttactttctataatttaa

SEQ ID NO: 121193 - DNA, 20 bp, Unknown
  misc_feature (1)..( 20): Result.002 file - promoters60/1581038
tcccacggcttttaattttg

SEQ ID NO: 121194 - DNA, 15 bp, Unknown
  misc_feature (1)..( 15): Result.002 file - promoters60/1581038
atttctttttgtgaa

SEQ ID NO: 121195 - DNA, 15 bp, Unknown
  misc_feature (1)..( 15): Result.002 file - promoters60/1581038
tattctatttgctgg

SEQ ID NO: 121196 - DNA, 15 bp, Unknown
  misc_feature (1)..( 15): Result.002 file - promoters60/1581038
ttttaattttgtcta

SEQ ID NO: 121197 - DNA, 15 bp, Unknown
  misc_feature (1)..( 15): Result.002 file - promoters60/1581038
ctttctataatttaa

SEQ ID NO: 121198 - DNA, 15 bp, Unknown
  misc_feature (1)..( 15): Result.002 file - promoters60/1581038
atttattttttataa

SEQ ID NO: 121199 - DNA, 15 bp, Unknown
  misc_feature (1)..( 15): Result.002 file - promoters60/1581038
ctggctttttatcca

SEQ ID NO: 121200 - DNA, 8 bp, Unknown
  misc_feature (1)..( 8): Result.002 file - promoters60/1581038
tatttttc

SEQ ID NO: 121201 - DNA, 8 bp, Unknown
  misc_feature (1)..( 8): Result.002 file - promoters60/1581038
tatttttc

SEQ ID NO: 121202 - DNA, 8 bp, Unknown
  misc_feature (1)..( 8): Result.002 file - promoters60/1581038
catttttg

SEQ ID NO: 121203 - DNA, 8 bp, Unknown
  misc_feature (1)..( 8): Result.002 file - promoters60/1581038
cattttat

SEQ ID NO: 121204 - DNA, 10 bp, Unknown
  misc_feature (1)..( 10): Result.002 file - promoters60/1581038
aaatatttaa

SEQ ID NO: 121205 - DNA, 10 bp, Unknown
  misc_feature (1)..( 10): Result.002 file - promoters60/1581038
gaatattagt

SEQ ID NO: 121206 - DNA, 10 bp, Unknown
  misc_feature (1)..( 10): Result.002 file - promoters60/1581038
aaatctttca

SEQ ID NO: 121207 - DNA, 10 bp, Unknown
  misc_feature (1)..( 10): Result.002 file - promoters60/1581038
atatattagt

SEQ ID NO: 121208 - DNA, 10 bp, Unknown
  misc_feature (1)..( 10): Result.002 file - promoters60/1581038
catatataaa

SEQ ID NO: 121209 - DNA, 10 bp, Unknown
  misc_feature (1)..( 10): Result.002 file - promoters60/1581038
tatatataat

SEQ ID NO: 121210 - DNA, 10 bp, Unknown
  misc_feature (1)..( 10): Result.002 file - promoters60/1581038
gctttataaa

SEQ ID NO: 121211 - DNA, 10 bp, Unknown
  misc_feature (1)..( 10): Result.002 file - promoters60/1581038
tatttataac

SEQ ID NO: 121212 - DNA, 10 bp, Unknown
  misc_feature (1)..( 10): Result.002 file - promoters60/1581038
tttaattttt

SEQ ID NO: 121213 - DNA, 10 bp, Unknown
  misc_feature (1)..( 10): Result.002 file - promoters60/1581038
tttaattaaa

SEQ ID NO: 121214 - DNA, 10 bp, Unknown
  misc_feature (1)..( 10): Result.002 file - promoters60/1581038
ataaataact

SEQ ID NO: 121215 - DNA, 10 bp, Unknown
  misc_feature (1)..( 10): Result.002 file - promoters60/1581038
accaatgaat

SEQ ID NO: 121216 - DNA, 10 bp, Unknown
  misc_feature (1)..( 10): Result.002 file - promoters60/1581038
atgaatgaaa

SEQ ID NO: 121217 - DNA, 8 bp, Unknown
  misc_feature (1)..( 8): Result.002 file - promoters60/1581038
caattttt

SEQ ID NO: 121218 - DNA, 8 bp, Unknown
  misc_feature (1)..( 8): Result.002 file - promoters60/1581038
aaatttta

SEQ ID NO: 121219 - DNA, 8 bp, Unknown
  misc_feature (1)..( 8): Result.002 file - promoters60/1581038
aaatttat

SEQ ID NO: 121220 - DNA, 8 bp, Unknown
  misc_feature (1)..( 8): Result.002 file - promoters60/1581038
ttatttta

SEQ ID NO: 121221 - DNA, 8 bp, Unknown
  misc_feature (1)..( 8): Result.002 file - promoters60/1581038
tattttta

SEQ ID NO: 121222 - DNA, 8 bp, Unknown
  misc_feature (1)..( 8): Result.002 file - promoters60/1581038
tatttttt

SEQ ID NO: 121223 - DNA, 8 bp, Unknown
  misc_feature (1)..( 8): Result.002 file - promoters60/1581038
gcttttta

SEQ ID NO: 121224 - DNA, 9 bp, Unknown
  misc_feature (1)..( 9): Result.002 file - promoters60/1581038
catttattt

SEQ ID NO: 121225 - DNA, 10 bp, Unknown
  misc_feature (1)..( 10): Result.002 file - promoters60/1581038
agaaattata

SEQ ID NO: 121226 - DNA, 10 bp, Unknown
  misc_feature (1)..( 10): Result.002 file - promoters60/1581038
aaaaaatata

SEQ ID NO: 121227 - DNA, 10 bp, Unknown
  misc_feature (1)..( 10): Result.002 file - promoters60/1581038
taaaattaac

SEQ ID NO: 121228 - DNA, 10 bp, Unknown
  misc_feature (1)..( 10): Result.002 file - promoters60/1581038
aataaataac

SEQ ID NO: 121229 - DNA, 10 bp, Unknown
  misc_feature (1)..( 10): Result.002 file - promoters60/1581038
accaatgaat

SEQ ID NO: 121230 - DNA, 8 bp, Unknown
  misc_feature (1)..( 8): Result.002 file - promoters60/1581038
tctctctc

SEQ ID NO: 121231 - DNA, 8 bp, Unknown
  misc_feature (1)..( 8): Result.002 file - promoters60/1581038
tctctctt

SEQ ID NO: 121232 - DNA, 8 bp, Unknown
  misc_feature (1)..( 8): Result.002 file - promoters60/1581038
cctctctt

SEQ ID NO: 121233 - DNA, 8 bp, Unknown
  misc_feature (1)..( 8): Result.002 file - promoters60/1581038
tctcgctt

SEQ ID NO: 121234 - DNA, 7 bp, Unknown
  misc_feature (1)..( 7): Result.002 file - promoters60/1581038
ctctctg

SEQ ID NO: 121235 - DNA, 7 bp, Unknown
  misc_feature (1)..( 7): Result.002 file - promoters60/1581038
ctctctt

SEQ ID NO: 121236 - DNA, 7 bp, Unknown
  misc_feature (1)..( 7): Result.002 file - promoters60/1581038
ctctctt

SEQ ID NO: 121237 - DNA, 7 bp, Unknown
  misc_feature (1)..( 7): Result.002 file - promoters60/1581038
ctcgctt

SEQ ID NO: 121238 - DNA, 8 bp, Unknown
  misc_feature (1)..( 8): Result.002 file - promoters60/1581038
caaaattc

SEQ ID NO: 121239 - DNA, 8 bp, Unknown
  misc_feature (1)..( 8): Result.002 file - promoters60/1581038
caatattg

SEQ ID NO: 121240 - DNA, 8 bp, Unknown
  misc_feature (1)..( 8): Result.002 file - promoters60/1581038
taatattt

SEQ ID NO: 121241 - DNA, 8 bp, Unknown
  misc_feature (1)..( 8): Result.002 file - promoters60/1581038
aaatcttg

SEQ ID NO: 121242 - DNA, 13 bp, Unknown
  misc_feature (1)..( 13): Result.002 file - promoters60/1581038
ttttcttttttta

SEQ ID NO: 121243 - DNA, 13 bp, Unknown
  misc_feature (1)..( 13): Result.002 file - promoters60/1581038
cagaaatttatta

SEQ ID NO: 121244 - DNA, 13 bp, Unknown
  misc_feature (1)..( 13): Result.002 file - promoters60/1581038
ttttattttatta

SEQ ID NO: 121245 - DNA, 13 bp, Unknown
  misc_feature (1)..( 13): Result.002 file - promoters60/1581038
tcaaattttagat

SEQ ID NO: 121246 - DNA, 9 bp, Unknown
  misc_feature (1)..( 9): Result.002 file - promoters60/1581987
gtggctttg

SEQ ID NO: 121247 - DNA, 9 bp, Unknown
  misc_feature (1)..( 9): Result.002 file - promoters60/1581987
atgggtttg

SEQ ID NO: 121248 - DNA, 9 bp, Unknown
  misc_feature (1)..( 9): Result.002 file - promoters60/1581987
gtggctttg

SEQ ID NO: 121249 - DNA, 9 bp, Unknown
  misc_feature (1)..( 9): Result.002 file - promoters60/1581987
gtggctgca

SEQ ID NO: 121250 - DNA, 9 bp, Unknown
  misc_feature (1)..( 9): Result.002 file - promoters60/1581987
gtggctggt

SEQ ID NO: 121251 - DNA, 10 bp, Unknown
  misc_feature (1)..( 10): Result.002 file - promoters60/1581987
tttatgagaa

SEQ ID NO: 121252 - DNA, 10 bp, Unknown
  misc_feature (1)..( 10): Result.002 file - promoters60/1581987
tttatgaatt

SEQ ID NO: 121253 - DNA, 10 bp, Unknown
  misc_feature (1)..( 10): Result.002 file - promoters60/1581987
gttataaata

SEQ ID NO: 121254 - DNA, 10 bp, Unknown
  misc_feature (1)..( 10): Result.002 file - promoters60/1581987
tatatgaatt

SEQ ID NO: 121255 - DNA, 6 bp, Unknown
  misc_feature (1)..( 6): Result.002 file - promoters60/1582293
taacca

SEQ ID NO: 121256 - DNA, 6 bp, Unknown
  misc_feature (1)..( 6): Result.002 file - promoters60/1582293
taacca

SEQ ID NO: 121257 - DNA, 11 bp, Unknown
  misc_feature (1)..( 11): Result.002 file - promoters60/1582293
aaattacttac

SEQ ID NO: 121258 - DNA, 11 bp, Unknown
  misc_feature (1)..( 11): Result.002 file - promoters60/1582293
atattactata

SEQ ID NO: 121259 - DNA, 11 bp, Unknown
  misc_feature (1)..( 11): Result.002 file - promoters60/1582293
atagtacaata

SEQ ID NO: 121260 - DNA, 9 bp, Unknown
  misc_feature (1)..( 9): Result.002 file - promoters60/1582293
actaatgat

SEQ ID NO: 121261 - DNA, 9 bp, Unknown
  misc_feature (1)..( 9): Result.002 file - promoters60/1582293
tataatgat

SEQ ID NO: 121262 - DNA, 9 bp, Unknown
  misc_feature (1)..( 9): Result.002 file - promoters60/1582293
aataattac

SEQ ID NO: 121263 - DNA, 7 bp, Unknown
  misc_feature (1)..( 7): Result.002 file - promoters60/1582293
ggtttaa

SEQ ID NO: 121264 - DNA, 7 bp, Unknown
  misc_feature (1)..( 7): Result.002 file - promoters60/1582293
ggtttaa

SEQ ID NO: 121265 - DNA, 7 bp, Unknown
  misc_feature (1)..( 7): Result.002 file - promoters60/1582293
tttcttt

SEQ ID NO: 121266 - DNA, 7 bp, Unknown
  misc_feature (1)..( 7): Result.002 file - promoters60/1582293
ttttttt

SEQ ID NO: 121267 - DNA, 7 bp, Unknown
  misc_feature (1)..( 7): Result.002 file - promoters60/1582293
ccatttt

SEQ ID NO: 121268 - DNA, 7 bp, Unknown
  misc_feature (1)..( 7): Result.002 file - promoters60/1582293
ccatttt

SEQ ID NO: 121269 - DNA, 6 bp, Unknown
  misc_feature (1)..( 6): Result.002 file - promoters60/1582293
acataa

SEQ ID NO: 121270 - DNA, 6 bp, Unknown
  misc_feature (1)..( 6): Result.002 file - promoters60/1582293
acataa

SEQ ID NO: 121271 - DNA, 10 bp, Unknown
  misc_feature (1)..( 10): Result.002 file - promoters60/1582293
acatacatta

SEQ ID NO: 121272 - DNA, 10 bp, Unknown
  misc_feature (1)..( 10): Result.002 file - promoters60/1582293
atataaatta

SEQ ID NO: 121273 - DNA, 10 bp, Unknown
  misc_feature (1)..( 10): Result.002 file - promoters60/1582293
atatgaatca

SEQ ID NO: 121274 - DNA, 7 bp, Unknown
  misc_feature (1)..( 7): Result.002 file - promoters60/1582293
atattat

SEQ ID NO: 121275 - DNA, 7 bp, Unknown
  misc_feature (1)..( 7): Result.002 file - promoters60/1582293
atattat

SEQ ID NO: 121276 - DNA, 11 bp, Unknown
  misc_feature (1)..( 11): Result.002 file - promoters60/1582293
tagattttttt

SEQ ID NO: 121277 - DNA, 11 bp, Unknown
  misc_feature (1)..( 11): Result.002 file - promoters60/1582293
tagattttttt

SEQ ID NO: 121278 - DNA, 6 bp, Unknown
  misc_feature (1)..( 6): Result.002 file - promoters60/1582293
taaaaa

SEQ ID NO: 121279 - DNA, 6 bp, Unknown
  misc_feature (1)..( 6): Result.002 file - promoters60/1582293
taaaaa

SEQ ID NO: 121280 - DNA, 6 bp, Unknown
  misc_feature (1)..( 6): Result.002 file - promoters60/1582293
aaaaca

SEQ ID NO: 121281 - DNA, 6 bp, Unknown
  misc_feature (1)..( 6): Result.002 file - promoters60/1582293
aaaaca

SEQ ID NO: 121282 - DNA, 11 bp, Unknown
  misc_feature (1)..( 11): Result.002 file - promoters60/1582293
aaatggcccaa

SEQ ID NO: 121283 - DNA, 11 bp, Unknown
  misc_feature (1)..( 11): Result.002 file - promoters60/1582293
aaaaggcccaa

SEQ ID NO: 121284 - DNA, 6 bp, Unknown
  misc_feature (1)..( 6): Result.002 file - promoters60/1582293
atcaaa

SEQ ID NO: 121285 - DNA, 6 bp, Unknown
  misc_feature (1)..( 6): Result.002 file - promoters60/1582293
atcaaa

SEQ ID NO: 121286 - DNA, 6 bp, Unknown
  misc_feature (1)..( 6): Result.002 file - promoters60/1582293
tacaac

SEQ ID NO: 121287 - DNA, 6 bp, Unknown
  misc_feature (1)..( 6): Result.002 file - promoters60/1582293
tacaac

SEQ ID NO: 121288 - DNA, 7 bp, Unknown
  misc_feature (1)..( 7): Result.002 file - promoters60/1582293
taatatc

SEQ ID NO: 121289 - DNA, 7 bp, Unknown
  misc_feature (1)..( 7): Result.002 file - promoters60/1582293
taacatc

SEQ ID NO: 121290 - DNA, 8 bp, Unknown
  misc_feature (1)..( 8): Result.002 file - promoters60/1582293
atagcaca

SEQ ID NO: 121291 - DNA, 8 bp, Unknown
  misc_feature (1)..( 8): Result.002 file - promoters60/1582293
atagtaca

SEQ ID NO: 121292 - DNA, 8 bp, Unknown
  misc_feature (1)..( 8): Result.002 file - promoters60/1582293
atcaaata

SEQ ID NO: 121293 - DNA, 8 bp, Unknown
  misc_feature (1)..( 8): Result.002 file - promoters60/1582293
atcagata

SEQ ID NO: 121294 - DNA, 6 bp, Unknown
  misc_feature (1)..( 6): Result.002 file - promoters60/1582293
taaaaa

SEQ ID NO: 121295 - DNA, 6 bp, Unknown
  misc_feature (1)..( 6): Result.002 file - promoters60/1582293
taaaaa

SEQ ID NO: 121296 - DNA, 7 bp, Unknown
  misc_feature (1)..( 7): Result.002 file - promoters60/1582293
aaaatat

SEQ ID NO: 121297 - DNA, 7 bp, Unknown
  misc_feature (1)..( 7): Result.002 file - promoters60/1582293
aaaatat

SEQ ID NO: 121298 - DNA, 7 bp, Unknown
  misc_feature (1)..( 7): Result.002 file - promoters60/1582293
aaagaag

SEQ ID NO: 121299 - DNA, 7 bp, Unknown
  misc_feature (1)..( 7): Result.002 file - promoters60/1582293
aaaaaag

SEQ ID NO: 121300 - DNA, 8 bp, Unknown
  misc_feature (1)..( 8): Result.002 file - promoters60/1582293
aaatatag

SEQ ID NO: 121301 - DNA, 8 bp, Unknown
  misc_feature (1)..( 8): Result.002 file - promoters60/1582293
aaacatag

SEQ ID NO: 121302 - DNA, 9 bp, Unknown
  misc_feature (1)..( 9): Result.002 file - promoters60/1582322
tctatttat

SEQ ID NO: 121303 - DNA, 9 bp, Unknown
  misc_feature (1)..( 9): Result.002 file - promoters60/1582322
tctctttgt

SEQ ID NO: 121304 - DNA, 9 bp, Unknown
  misc_feature (1)..( 9): Result.002 file - promoters60/1582322
tttttttct

SEQ ID NO: 121305 - DNA, 6 bp, Unknown
  misc_feature (1)..( 6): Result.002 file - promoters60/1582322
gcacaa

SEQ ID NO: 121306 - DNA, 6 bp, Unknown
  misc_feature (1)..( 6): Result.002 file - promoters60/1582322
gcacaa

SEQ ID NO: 121307 - DNA, 7 bp, Unknown
  misc_feature (1)..( 7): Result.002 file - promoters60/1582322
tcataat

SEQ ID NO: 121308 - DNA, 7 bp, Unknown
  misc_feature (1)..( 7): Result.002 file - promoters60/1582322
tcagaat

SEQ ID NO: 121309 - DNA, 7 bp, Unknown
  misc_feature (1)..( 7): Result.002 file - promoters60/1582322
gaactta

SEQ ID NO: 121310 - DNA, 7 bp, Unknown
  misc_feature (1)..( 7): Result.002 file - promoters60/1582322
gaattta

SEQ ID NO: 121311 - DNA, 6 bp, Unknown
  misc_feature (1)..( 6): Result.002 file - promoters60/1582322
gttttg

SEQ ID NO: 121312 - DNA, 6 bp, Unknown
  misc_feature (1)..( 6): Result.002 file - promoters60/1582322
gttttg

SEQ ID NO: 121313 - DNA, 6 bp, Unknown
  misc_feature (1)..( 6): Result.002 file - promoters60/1582322
atctta

SEQ ID NO: 121314 - DNA, 6 bp, Unknown
  misc_feature (1)..( 6): Result.002 file - promoters60/1582322
atctta

SEQ ID NO: 121315 - DNA, 7 bp, Unknown
  misc_feature (1)..( 7): Result.002 file - promoters60/1582322
aattaaa

SEQ ID NO: 121316 - DNA, 7 bp, Unknown
  misc_feature (1)..( 7): Result.002 file - promoters60/1582322
aatcaaa

SEQ ID NO: 121317 - DNA, 7 bp, Unknown
  misc_feature (1)..( 7): Result.002 file - promoters60/1582322
ttccctt

SEQ ID NO: 121318 - DNA, 7 bp, Unknown
  misc_feature (1)..( 7): Result.002 file - promoters60/1582322
ttcgctt

SEQ ID NO: 121319 - DNA, 7 bp, Unknown
  misc_feature (1)..( 7): Result.002 file - promoters60/1582322
tttttta

SEQ ID NO: 121320 - DNA, 7 bp, Unknown
  misc_feature (1)..( 7): Result.002 file - promoters60/1582322
tttatta

SEQ ID NO: 121321 - DNA, 8 bp, Unknown
  misc_feature (1)..( 8): Result.002 file - promoters60/1582322
tttatcta

SEQ ID NO: 121322 - DNA, 8 bp, Unknown
  misc_feature (1)..( 8): Result.002 file - promoters60/1582322
tttttcta

SEQ ID NO: 121323 - DNA, 8 bp, Unknown
  misc_feature (1)..( 8): Result.002 file - promoters60/1582322
tttctctt

SEQ ID NO: 121324 - DNA, 6 bp, Unknown
  misc_feature (1)..( 6): Result.002 file - promoters60/1582322
attttt

SEQ ID NO: 121325 - DNA, 6 bp, Unknown
  misc_feature (1)..( 6): Result.002 file - promoters60/1582322
attttt

SEQ ID NO: 121326 - DNA, 8 bp, Unknown
  misc_feature (1)..( 8): Result.002 file - promoters60/1582322
aaagattt

SEQ ID NO: 121327 - DNA, 8 bp, Unknown
  misc_feature (1)..( 8): Result.002 file - promoters60/1582322
aaagattt

SEQ ID NO: 121328 - DNA, 8 bp, Unknown
  misc_feature (1)..( 8): Result.002 file - promoters60/1582322
ggtatttg

SEQ ID NO: 121329 - DNA, 8 bp, Unknown
  misc_feature (1)..( 8): Result.002 file - promoters60/1582322
ggtgtttg

SEQ ID NO: 121330 - DNA, 6 bp, Unknown
  misc_feature (1)..( 6): Result.002 file - promoters60/1582322
atgaat

SEQ ID NO: 121331 - DNA, 6 bp, Unknown
  misc_feature (1)..( 6): Result.002 file - promoters60/1582322
atgaat

SEQ ID NO: 121332 - DNA, 7 bp, Unknown
  misc_feature (1)..( 7): Result.002 file - promoters60/1582322
ttacaat

SEQ ID NO: 121333 - DNA, 7 bp, Unknown
  misc_feature (1)..( 7): Result.002 file - promoters60/1582322
ttataat

SEQ ID NO: 121334 - DNA, 8 bp, Unknown
  misc_feature (1)..( 8): Result.002 file - promoters60/1582322
aattataa

SEQ ID NO: 121335 - DNA, 8 bp, Unknown
  misc_feature (1)..( 8): Result.002 file - promoters60/1582322
aattttaa

SEQ ID NO: 121336 - DNA, 14 bp, Unknown
  misc_feature (1)..( 14): Result.002 file - promoters60/1582322
aatttctcccaaaa

SEQ ID NO: 121337 - DNA, 14 bp, Unknown
  misc_feature (1)..( 14): Result.002 file - promoters60/1582322
aatttctgccaaaa

SEQ ID NO: 121338 - DNA, 8 bp, Unknown
  misc_feature (1)..( 8): Result.002 file - promoters60/1582322
aatctata

SEQ ID NO: 121339 - DNA, 8 bp, Unknown
  misc_feature (1)..( 8): Result.002 file - promoters60/1582322
aatcaata

SEQ ID NO: 121340 - DNA, 6 bp, Unknown
  misc_feature (1)..( 6): Result.002 file - promoters60/1582322
ttttct

SEQ ID NO: 121341 - DNA, 6 bp, Unknown
  misc_feature (1)..( 6): Result.002 file - promoters60/1582322
ttttct

SEQ ID NO: 121342 - DNA, 8 bp, Unknown
  misc_feature (1)..( 8): Result.002 file - promoters60/1582322
gaagaaat

SEQ ID NO: 121343 - DNA, 8 bp, Unknown
  misc_feature (1)..( 8): Result.002 file - promoters60/1582322
gaagaaat

SEQ ID NO: 121344 - DNA, 7 bp, Unknown
  misc_feature (1)..( 7): Result.002 file - promoters60/1582322
aagtttc

SEQ ID NO: 121345 - DNA, 7 bp, Unknown
  misc_feature (1)..( 7): Result.002 file - promoters60/1582322
aagcttc

SEQ ID NO: 121346 - DNA, 7 bp, Unknown
  misc_feature (1)..( 7): Result.002 file - promoters60/1582576
tatgtag

SEQ ID NO: 121347 - DNA, 7 bp, Unknown
  misc_feature (1)..( 7): Result.002 file - promoters60/1582576
tatttag

SEQ ID NO: 121348 - DNA, 7 bp, Unknown
  misc_feature (1)..( 7): Result.002 file - promoters60/1582576
tatttaa

SEQ ID NO: 121349 - DNA, 10 bp, Unknown
  misc_feature (1)..( 10): Result.002 file - promoters60/1582576
aaaaatgtat

SEQ ID NO: 121350 - DNA, 10 bp, Unknown
  misc_feature (1)..( 10): Result.002 file - promoters60/1582576
taaaatatat

SEQ ID NO: 121351 - DNA, 11 bp, Unknown
  misc_feature (1)..( 11): Result.002 file - promoters60/1582576
aaataatatat

SEQ ID NO: 121352 - DNA, 7 bp, Unknown
  misc_feature (1)..( 7): Result.002 file - promoters60/1582576
taaataa

SEQ ID NO: 121353 - DNA, 7 bp, Unknown
  misc_feature (1)..( 7): Result.002 file - promoters60/1582576
aaaataa

SEQ ID NO: 121354 - DNA, 8 bp, Unknown
  misc_feature (1)..( 8): Result.002 file - promoters60/1582576
taaagtaa

SEQ ID NO: 121355 - DNA, 8 bp, Unknown
  misc_feature (1)..( 8): Result.002 file - promoters60/1582576
taactaat

SEQ ID NO: 121356 - DNA, 8 bp, Unknown
  misc_feature (1)..( 8): Result.002 file - promoters60/1582576
taattaat

SEQ ID NO: 121357 - DNA, 8 bp, Unknown
  misc_feature (1)..( 8): Result.002 file - promoters60/1582576
gaataaat

SEQ ID NO: 121358 - DNA, 7 bp, Unknown
  misc_feature (1)..( 7): Result.002 file - promoters60/1582576
aaataac

SEQ ID NO: 121359 - DNA, 7 bp, Unknown
  misc_feature (1)..( 7): Result.002 file - promoters60/1582576
aaataat

SEQ ID NO: 121360 - DNA, 7 bp, Unknown
  misc_feature (1)..( 7): Result.002 file - promoters60/1582576
taataat

SEQ ID NO: 121361 - DNA, 7 bp, Unknown
  misc_feature (1)..( 7): Result.002 file - promoters60/1582576
aataaat

SEQ ID NO: 121362 - DNA, 7 bp, Unknown
  misc_feature (1)..( 7): Result.002 file - promoters60/1582576
aataaaa

SEQ ID NO: 121363 - DNA, 7 bp, Unknown
  misc_feature (1)..( 7): Result.002 file - promoters60/1582576
aataaaa

SEQ ID NO: 121364 - DNA, 7 bp, Unknown
  misc_feature (1)..( 7): Result.002 file - promoters60/1582576
ttaaaat

SEQ ID NO: 121365 - DNA, 7 bp, Unknown
  misc_feature (1)..( 7): Result.002 file - promoters60/1582576
ctaaaat

SEQ ID NO: 121366 - DNA, 7 bp, Unknown
  misc_feature (1)..( 7): Result.002 file - promoters60/1582576
ctacaat

SEQ ID NO: 121367 - DNA, 7 bp, Unknown
  misc_feature (1)..( 7): Result.002 file - promoters60/1582576
aaaagac

SEQ ID NO: 121368 - DNA, 7 bp, Unknown
  misc_feature (1)..( 7): Result.002 file - promoters60/1582576
aaatgac

SEQ ID NO: 121369 - DNA, 7 bp, Unknown
  misc_feature (1)..( 7): Result.002 file - promoters60/1582576
aaaaact

SEQ ID NO: 121370 - DNA, 8 bp, Unknown
  misc_feature (1)..( 8): Result.002 file - promoters60/1582576
aaaataaa

SEQ ID NO: 121371 - DNA, 8 bp, Unknown
  misc_feature (1)..( 8): Result.002 file - promoters60/1582576
aaaacaaa

SEQ ID NO: 121372 - DNA, 8 bp, Unknown
  misc_feature (1)..( 8): Result.002 file - promoters60/1582576
aaagtaaa

SEQ ID NO: 121373 - DNA, 12 bp, Unknown
  misc_feature (1)..( 12): Result.002 file - promoters60/1582658
ttttttttgaat

SEQ ID NO: 121374 - DNA, 12 bp, Unknown
  misc_feature (1)..( 12): Result.002 file - promoters60/1582658
tttcttttgtcg

SEQ ID NO: 121375 - DNA, 12 bp, Unknown
  misc_feature (1)..( 12): Result.002 file - promoters60/1582658
cgaggtttggaa

SEQ ID NO: 121376 - DNA, 7 bp, Unknown
  misc_feature (1)..( 7): Result.002 file - promoters60/1582658
ttttaaa

SEQ ID NO: 121377 - DNA, 7 bp, Unknown
  misc_feature (1)..( 7): Result.002 file - promoters60/1582658
ttttaat

SEQ ID NO: 121378 - DNA, 7 bp, Unknown
  misc_feature (1)..( 7): Result.002 file - promoters60/1582658
tttcatc

SEQ ID NO: 121379 - DNA, 9 bp, Unknown
  misc_feature (1)..( 9): Result.002 file - promoters60/1582658
attttttag

SEQ ID NO: 121380 - DNA, 9 bp, Unknown
  misc_feature (1)..( 9): Result.002 file - promoters60/1582658
atttttaat

SEQ ID NO: 121381 - DNA, 9 bp, Unknown
  misc_feature (1)..( 9): Result.002 file - promoters60/1582658
attttatag

SEQ ID NO: 121382 - DNA, 7 bp, Unknown
  misc_feature (1)..( 7): Result.002 file - promoters60/1582658
gaacttt

SEQ ID NO: 121383 - DNA, 7 bp, Unknown
  misc_feature (1)..( 7): Result.002 file - promoters60/1582658
gaagttt

SEQ ID NO: 121384 - DNA, 7 bp, Unknown
  misc_feature (1)..( 7): Result.002 file - promoters60/1582658
taagttt

SEQ ID NO: 121385 - DNA, 8 bp, Unknown
  misc_feature (1)..( 8): Result.002 file - promoters60/1582658
gaatattt

SEQ ID NO: 121386 - DNA, 8 bp, Unknown
  misc_feature (1)..( 8): Result.002 file - promoters60/1582658
aaatgttt

SEQ ID NO: 121387 - DNA, 8 bp, Unknown
  misc_feature (1)..( 8): Result.002 file - promoters60/1582658
aaatgttg

SEQ ID NO: 121388 - DNA, 7 bp, Unknown
  misc_feature (1)..( 7): Result.002 file - promoters60/1582658
atcgttt

SEQ ID NO: 121389 - DNA, 7 bp, Unknown
  misc_feature (1)..( 7): Result.002 file - promoters60/1582658
atcattt

SEQ ID NO: 121390 - DNA, 7 bp, Unknown
  misc_feature (1)..( 7): Result.002 file - promoters60/1582658
ttcattt

SEQ ID NO: 121391 - DNA, 8 bp, Unknown
  misc_feature (1)..( 8): Result.002 file - promoters60/1582658
attgcatc

SEQ ID NO: 121392 - DNA, 8 bp, Unknown
  misc_feature (1)..( 8): Result.002 file - promoters60/1582658
atttcatc

SEQ ID NO: 121393 - DNA, 8 bp, Unknown
  misc_feature (1)..( 8): Result.002 file - promoters60/1582658
ttttaatc

SEQ ID NO: 121394 - DNA, 9 bp, Unknown
  misc_feature (1)..( 9): Result.002 file - promoters60/1583044
attaataca

SEQ ID NO: 121395 - DNA, 9 bp, Unknown
  misc_feature (1)..( 9): Result.002 file - promoters60/1583044
attcataat

SEQ ID NO: 121396 - DNA, 9 bp, Unknown
  misc_feature (1)..( 9): Result.002 file - promoters60/1583044
ggtcaaaat

SEQ ID NO: 121397 - DNA, 7 bp, Unknown
  misc_feature (1)..( 7): Result.002 file - promoters60/1595585
taggtct

SEQ ID NO: 121398 - DNA, 7 bp, Unknown
  misc_feature (1)..( 7): Result.002 file - promoters60/1595585
tagctct

SEQ ID NO: 121399 - DNA, 7 bp, Unknown
  misc_feature (1)..( 7): Result.002 file - promoters60/1595585
ttctaac

SEQ ID NO: 121400 - DNA, 7 bp, Unknown
  misc_feature (1)..( 7): Result.002 file - promoters60/1595585
ttctaaa

SEQ ID NO: 121401 - DNA, 8 bp, Unknown
  misc_feature (1)..( 8): Result.002 file - promoters60/1595585
gtcttaat

SEQ ID NO: 121402 - DNA, 6 bp, Unknown
  misc_feature (1)..( 6): Result.002 file - promoters60/1595585
aatgaa

SEQ ID NO: 121403 - DNA, 6 bp, Unknown
  misc_feature (1)..( 6): Result.002 file - promoters60/1595585
aatgaa

SEQ ID NO: 121404 - DNA, 6 bp, Unknown
  misc_feature (1)..( 6): Result.002 file - promoters60/1595585
aaactc

SEQ ID NO: 121405 - DNA, 6 bp, Unknown
  misc_feature (1)..( 6): Result.002 file - promoters60/1595585
aaactc

SEQ ID NO: 121406 - DNA, 6 bp, Unknown
  misc_feature (1)..( 6): Result.002 file - promoters60/1595585
aaaata

SEQ ID NO: 121407 - DNA, 6 bp, Unknown
  misc_feature (1)..( 6): Result.002 file - promoters60/1595585
aaaata

SEQ ID NO: 121408 - DNA, 7 bp, Unknown
  misc_feature (1)..( 7): Result.002 file - promoters60/1595585
ctaaatt

SEQ ID NO: 121409 - DNA, 7 bp, Unknown
  misc_feature (1)..( 7): Result.002 file - promoters60/1595585
ctatatt

SEQ ID NO: 121410 - DNA, 7 bp, Unknown
  misc_feature (1)..( 7): Result.002 file - promoters60/1595585
aaaaaat

SEQ ID NO: 121411 - DNA, 7 bp, Unknown
  misc_feature (1)..( 7): Result.002 file - promoters60/1595585
aaataat

SEQ ID NO: 121412 - DNA, 6 bp, Unknown
  misc_feature (1)..( 6): Result.002 file - promoters60/1595585
gacccg

SEQ ID NO: 121413 - DNA, 6 bp, Unknown
  misc_feature (1)..( 6): Result.002 file - promoters60/1595585
gacccg

SEQ ID NO: 121414 - DNA, 9 bp, Unknown
  misc_feature (1)..( 9): Result.002 file - promoters60/1595585
attttatcc

SEQ ID NO: 121415 - DNA, 9 bp, Unknown
  misc_feature (1)..( 9): Result.002 file - promoters60/1595585
attatatcc

SEQ ID NO: 121416 - DNA, 7 bp, Unknown
  misc_feature (1)..( 7): Result.002 file - promoters60/1595585
ctgctct

SEQ ID NO: 121417 - DNA, 7 bp, Unknown
  misc_feature (1)..( 7): Result.002 file - promoters60/1595585
ctgatct

SEQ ID NO: 121418 - DNA, 6 bp, Unknown
  misc_feature (1)..( 6): Result.002 file - promoters60/1595585
accact

SEQ ID NO: 121419 - DNA, 6 bp, Unknown
  misc_feature (1)..( 6): Result.002 file - promoters60/1595585
accact

SEQ ID NO: 121420 - DNA, 10 bp, Unknown
  misc_feature (1)..( 10): Result.002 file - promoters60/1595585
cacttggttt

SEQ ID NO: 121421 - DNA, 10 bp, Unknown
  misc_feature (1)..( 10): Result.002 file - promoters60/1595585
cactcggttt

SEQ ID NO: 121422 - DNA, 7 bp, Unknown
  misc_feature (1)..( 7): Result.002 file - promoters60/1595585
ttttcat

SEQ ID NO: 121423 - DNA, 7 bp, Unknown
  misc_feature (1)..( 7): Result.002 file - promoters60/1595585
ttttcat

SEQ ID NO: 121424 - DNA, 8 bp, Unknown
  misc_feature (1)..( 8): Result.002 file - promoters60/1595651
aaagaaat

SEQ ID NO: 121425 - DNA, 8 bp, Unknown
  misc_feature (1)..( 8): Result.002 file - promoters60/1595651
aaagaaat

SEQ ID NO: 121426 - DNA, 9 bp, Unknown
  misc_feature (1)..( 9): Result.002 file - promoters60/1595651
aatctccat

SEQ ID NO: 121427 - DNA, 9 bp, Unknown
  misc_feature (1)..( 9): Result.002 file - promoters60/1595651
aatatccat

SEQ ID NO: 121428 - DNA, 7 bp, Unknown
  misc_feature (1)..( 7): Result.002 file - promoters60/1595651
taacttg

SEQ ID NO: 121429 - DNA, 7 bp, Unknown
  misc_feature (1)..( 7): Result.002 file - promoters60/1595651
taatttg

SEQ ID NO: 121430 - DNA, 7 bp, Unknown
  misc_feature (1)..( 7): Result.002 file - promoters60/1595651
tcaaatt

SEQ ID NO: 121431 - DNA, 7 bp, Unknown
  misc_feature (1)..( 7): Result.002 file - promoters60/1595651
tcaaatt

SEQ ID NO: 121432 - DNA, 8 bp, Unknown
  misc_feature (1)..( 8): Result.002 file - promoters60/1595651
aacaaaaa

SEQ ID NO: 121433 - DNA, 8 bp, Unknown
  misc_feature (1)..( 8): Result.002 file - promoters60/1595651
aacaaaaa

SEQ ID NO: 121434 - DNA, 6 bp, Unknown
  misc_feature (1)..( 6): Result.002 file - promoters60/1595651
acattt

SEQ ID NO: 121435 - DNA, 6 bp, Unknown
  misc_feature (1)..( 6): Result.002 file - promoters60/1595651
acattt

SEQ ID NO: 121436 - DNA, 10 bp, Unknown
  misc_feature (1)..( 10): Result.002 file - promoters60/1595651
aagaaaacaa

SEQ ID NO: 121437 - DNA, 10 bp, Unknown
  misc_feature (1)..( 10): Result.002 file - promoters60/1595651
aagaaaacaa

SEQ ID NO: 121438 - DNA, 6 bp, Unknown
  misc_feature (1)..( 6): Result.002 file - promoters60/1595651
caaaaa

SEQ ID NO: 121439 - DNA, 6 bp, Unknown
  misc_feature (1)..( 6): Result.002 file - promoters60/1595651
caaaaa

SEQ ID NO: 121440 - DNA, 10 bp, Unknown
  misc_feature (1)..( 10): Result.002 file - promoters60/1595651
ctaaacgggc

SEQ ID NO: 121441 - DNA, 10 bp, Unknown
  misc_feature (1)..( 10): Result.002 file - promoters60/1595651
ctaaacgggc

SEQ ID NO: 121442 - DNA, 7 bp, Unknown
  misc_feature (1)..( 7): Result.002 file - promoters60/1595651
gtcatat

SEQ ID NO: 121443 - DNA, 7 bp, Unknown
  misc_feature (1)..( 7): Result.002 file - promoters60/1595651
gtcatat

SEQ ID NO: 121444 - DNA, 7 bp, Unknown
  misc_feature (1)..( 7): Result.002 file - promoters60/1595651
tccattg

SEQ ID NO: 121445 - DNA, 7 bp, Unknown
  misc_feature (1)..( 7): Result.002 file - promoters60/1595651
tccattg

SEQ ID NO: 121446 - DNA, 7 bp, Unknown
  misc_feature (1)..( 7): Result.002 file - promoters60/1595651
taattaa

SEQ ID NO: 121447 - DNA, 7 bp, Unknown
  misc_feature (1)..( 7): Result.002 file - promoters60/1595651
taactaa

SEQ ID NO: 121448 - DNA, 6 bp, Unknown
  misc_feature (1)..( 6): Result.002 file - promoters60/1595651
ttcaga

SEQ ID NO: 121449 - DNA, 6 bp, Unknown
  misc_feature (1)..( 6): Result.002 file - promoters60/1595651
ttcaga

SEQ ID NO: 121450 - DNA, 6 bp, Unknown
  misc_feature (1)..( 6): Result.002 file - promoters60/1595651
aaatgt

SEQ ID NO: 121451 - DNA, 6 bp, Unknown
  misc_feature (1)..( 6): Result.002 file - promoters60/1595651
aaatgt

SEQ ID NO: 121452 - DNA, 7 bp, Unknown
  misc_feature (1)..( 7): Result.002 file - promoters60/1595651
ttttaaa

SEQ ID NO: 121453 - DNA, 7 bp, Unknown
  misc_feature (1)..( 7): Result.002 file - promoters60/1595651
ttttaaa

SEQ ID NO: 121454 - DNA, 9 bp, Unknown
  misc_feature (1)..( 9): Result.002 file - promoters60/1595651
attgattgt

SEQ ID NO: 121455 - DNA, 9 bp, Unknown
  misc_feature (1)..( 9): Result.002 file - promoters60/1595651
attcattgt

SEQ ID NO: 121456 - DNA, 7 bp, Unknown
  misc_feature (1)..( 7): Result.002 file - promoters60/1595651
ttgagac

SEQ ID NO: 121457 - DNA, 7 bp, Unknown
  misc_feature (1)..( 7): Result.002 file - promoters60/1595651
ttgggac

SEQ ID NO: 121458 - DNA, 9 bp, Unknown
  misc_feature (1)..( 9): Result.002 file - promoters60/1595707
attttattt

SEQ ID NO: 121459 - DNA, 9 bp, Unknown
  misc_feature (1)..( 9): Result.002 file - promoters60/1595707
tttttattc

SEQ ID NO: 121460 - DNA, 9 bp, Unknown
  misc_feature (1)..( 9): Result.002 file - promoters60/1595707
attttgttt

SEQ ID NO: 121461 - DNA, 9 bp, Unknown
  misc_feature (1)..( 9): Result.002 file - promoters60/1595707
tttttattc

SEQ ID NO: 121462 - DNA, 10 bp, Unknown
  misc_feature (1)..( 10): Result.002 file - promoters60/1595707
atttggctct

SEQ ID NO: 121463 - DNA, 10 bp, Unknown
  misc_feature (1)..( 10): Result.002 file - promoters60/1595707
attgggccta

SEQ ID NO: 121464 - DNA, 10 bp, Unknown
  misc_feature (1)..( 10): Result.002 file - promoters60/1595707
gactggccct

SEQ ID NO: 121465 - DNA, 10 bp, Unknown
  misc_feature (1)..( 10): Result.002 file - promoters60/1595707
gactggccct

SEQ ID NO: 121466 - DNA, 11 bp, Unknown
  misc_feature (1)..( 11): Result.002 file - promoters60/1595707
atttgtttatt

SEQ ID NO: 121467 - DNA, 11 bp, Unknown
  misc_feature (1)..( 11): Result.002 file - promoters60/1595707
attagtttatc

SEQ ID NO: 121468 - DNA, 11 bp, Unknown
  misc_feature (1)..( 11): Result.002 file - promoters60/1595707
acgtgttaatt

SEQ ID NO: 121469 - DNA, 11 bp, Unknown
  misc_feature (1)..( 11): Result.002 file - promoters60/1595707
aactttttatt

SEQ ID NO: 121470 - DNA, 11 bp, Unknown
  misc_feature (1)..( 11): Result.002 file - promoters60/1595707
aatacaaatct

SEQ ID NO: 121471 - DNA, 11 bp, Unknown
  misc_feature (1)..( 11): Result.002 file - promoters60/1595707
aataccaatca

SEQ ID NO: 121472 - DNA, 11 bp, Unknown
  misc_feature (1)..( 11): Result.002 file - promoters60/1595707
cagcccagtca

SEQ ID NO: 121473 - DNA, 11 bp, Unknown
  misc_feature (1)..( 11): Result.002 file - promoters60/1595707
aatacaaatct

SEQ ID NO: 121474 - DNA, 12 bp, Unknown
  misc_feature (1)..( 12): Result.002 file - promoters60/1595741
ttttttaataag

SEQ ID NO: 121475 - DNA, 12 bp, Unknown
  misc_feature (1)..( 12): Result.002 file - promoters60/1595741
aatttcaataac

SEQ ID NO: 121476 - DNA, 12 bp, Unknown
  misc_feature (1)..( 12): Result.002 file - promoters60/1595741
atgtctaaaaag

SEQ ID NO: 121477 - DNA, 12 bp, Unknown
  misc_feature (1)..( 12): Result.002 file - promoters60/1595741
aatttcatttga

SEQ ID NO: 121478 - DNA, 12 bp, Unknown
  misc_feature (1)..( 12): Result.002 file - promoters60/1595741
tattttattgtt

SEQ ID NO: 121479 - DNA, 12 bp, Unknown
  misc_feature (1)..( 12): Result.002 file - promoters60/1595741
gctttcgttttg

SEQ ID NO: 121480 - DNA, 9 bp, Unknown
  misc_feature (1)..( 9): Result.002 file - promoters60/1595752
atcataatc

SEQ ID NO: 121481 - DNA, 9 bp, Unknown
  misc_feature (1)..( 9): Result.002 file - promoters60/1595752
atcagaatc

SEQ ID NO: 121482 - DNA, 9 bp, Unknown
  misc_feature (1)..( 9): Result.002 file - promoters60/1595752
aaatttctt

SEQ ID NO: 121483 - DNA, 9 bp, Unknown
  misc_feature (1)..( 9): Result.002 file - promoters60/1595752
gaatctctt

SEQ ID NO: 121484 - DNA, 10 bp, Unknown
  misc_feature (1)..( 10): Result.002 file - promoters60/1595752
taagtttgca

SEQ ID NO: 121485 - DNA, 9 bp, Unknown
  misc_feature (1)..( 9): Result.002 file - promoters60/1595752
ccaaacaat

SEQ ID NO: 121486 - DNA, 9 bp, Unknown
  misc_feature (1)..( 9): Result.002 file - promoters60/1595752
ccaaccaat

SEQ ID NO: 121487 - DNA, 7 bp, Unknown
  misc_feature (1)..( 7): Result.002 file - promoters60/1595752
agaacaa

SEQ ID NO: 121488 - DNA, 7 bp, Unknown
  misc_feature (1)..( 7): Result.002 file - promoters60/1595752
agagcaa

SEQ ID NO: 121489 - DNA, 7 bp, Unknown
  misc_feature (1)..( 7): Result.002 file - promoters60/1595752
aaccacc

SEQ ID NO: 121490 - DNA, 7 bp, Unknown
  misc_feature (1)..( 7): Result.002 file - promoters60/1595752
aacaacc

SEQ ID NO: 121491 - DNA, 7 bp, Unknown
  misc_feature (1)..( 7): Result.002 file - promoters60/1595752
aaccacc

SEQ ID NO: 121492 - DNA, 6 bp, Unknown
  misc_feature (1)..( 6): Result.002 file - promoters60/1595752
ataacc

SEQ ID NO: 121493 - DNA, 6 bp, Unknown
  misc_feature (1)..( 6): Result.002 file - promoters60/1595752
ataacc

SEQ ID NO: 121494 - DNA, 7 bp, Unknown
  misc_feature (1)..( 7): Result.002 file - promoters60/1595752
acctaat

SEQ ID NO: 121495 - DNA, 7 bp, Unknown
  misc_feature (1)..( 7): Result.002 file - promoters60/1595752
acctaat

SEQ ID NO: 121496 - DNA, 8 bp, Unknown
  misc_feature (1)..( 8): Result.002 file - promoters60/1595752
tatatata

SEQ ID NO: 121497 - DNA, 8 bp, Unknown
  misc_feature (1)..( 8): Result.002 file - promoters60/1595752
tataaata

SEQ ID NO: 121498 - DNA, 8 bp, Unknown
  misc_feature (1)..( 8): Result.002 file - promoters60/1595752
tatataaa

SEQ ID NO: 121499 - DNA, 7 bp, Unknown
  misc_feature (1)..( 7): Result.002 file - promoters60/1595752
aaaatca

SEQ ID NO: 121500 - DNA, 7 bp, Unknown
  misc_feature (1)..( 7): Result.002 file - promoters60/1595752
aaaatca

SEQ ID NO: 121501 - DNA, 8 bp, Unknown
  misc_feature (1)..( 8): Result.002 file - promoters60/1595752
atttacat

SEQ ID NO: 121502 - DNA, 8 bp, Unknown
  misc_feature (1)..( 8): Result.002 file - promoters60/1595752
attcacat

SEQ ID NO: 121503 - DNA, 6 bp, Unknown
  misc_feature (1)..( 6): Result.002 file - promoters60/1595752
atattt

SEQ ID NO: 121504 - DNA, 6 bp, Unknown
  misc_feature (1)..( 6): Result.002 file - promoters60/1595752
atattt

SEQ ID NO: 121505 - DNA, 7 bp, Unknown
  misc_feature (1)..( 7): Result.002 file - promoters60/1595752
ataattt

SEQ ID NO: 121506 - DNA, 7 bp, Unknown
  misc_feature (1)..( 7): Result.002 file - promoters60/1595752
tcataaa

SEQ ID NO: 121507 - DNA, 7 bp, Unknown
  misc_feature (1)..( 7): Result.002 file - promoters60/1595752
tcaaaaa

SEQ ID NO: 121508 - DNA, 6 bp, Unknown
  misc_feature (1)..( 6): Result.002 file - promoters60/1595752
attgct

SEQ ID NO: 121509 - DNA, 6 bp, Unknown
  misc_feature (1)..( 6): Result.002 file - promoters60/1595752
attgct

SEQ ID NO: 121510 - DNA, 8 bp, Unknown
  misc_feature (1)..( 8): Result.002 file - promoters60/1595752
acatctaa

SEQ ID NO: 121511 - DNA, 8 bp, Unknown
  misc_feature (1)..( 8): Result.002 file - promoters60/1595752
aaatctaa

SEQ ID NO: 121512 - DNA, 8 bp, Unknown
  misc_feature (1)..( 8): Result.002 file - promoters60/1595752
aaatctat

SEQ ID NO: 121513 - DNA, 7 bp, Unknown
  misc_feature (1)..( 7): Result.002 file - promoters60/1595752
atggtca

SEQ ID NO: 121514 - DNA, 7 bp, Unknown
  misc_feature (1)..( 7): Result.002 file - promoters60/1595752
atggtca

SEQ ID NO: 121515 - DNA, 8 bp, Unknown
  misc_feature (1)..( 8): Result.002 file - promoters60/1595752
agaacaat

SEQ ID NO: 121516 - DNA, 8 bp, Unknown
  misc_feature (1)..( 8): Result.002 file - promoters60/1595752
agaccaat

SEQ ID NO: 121517 - DNA, 6 bp, Unknown
  misc_feature (1)..( 6): Result.002 file - promoters60/1595752
tgcatt

SEQ ID NO: 121518 - DNA, 6 bp, Unknown
  misc_feature (1)..( 6): Result.002 file - promoters60/1595752
tgcatt

SEQ ID NO: 121519 - DNA, 6 bp, Unknown
  misc_feature (1)..( 6): Result.002 file - promoters60/1595752
tttatt

SEQ ID NO: 121520 - DNA, 6 bp, Unknown
  misc_feature (1)..( 6): Result.002 file - promoters60/1595752
tttatt

SEQ ID NO: 121521 - DNA, 7 bp, Unknown
  misc_feature (1)..( 7): Result.002 file - promoters60/1595752
attcaaa

SEQ ID NO: 121522 - DNA, 7 bp, Unknown
  misc_feature (1)..( 7): Result.002 file - promoters60/1595752
attgaaa

SEQ ID NO: 121523 - DNA, 6 bp, Unknown
  misc_feature (1)..( 6): Result.002 file - promoters60/1595752
caatca

SEQ ID NO: 121524 - DNA, 6 bp, Unknown
  misc_feature (1)..( 6): Result.002 file - promoters60/1595752
caatca

SEQ ID NO: 121525 - DNA, 8 bp, Unknown
  misc_feature (1)..( 8): Result.002 file - promoters60/1595752
ttgggttt

SEQ ID NO: 121526 - DNA, 8 bp, Unknown
  misc_feature (1)..( 8): Result.002 file - promoters60/1595752
ttgagttt

SEQ ID NO: 121527 - DNA, 9 bp, Unknown
  misc_feature (1)..( 9): Result.002 file - promoters60/1595752
accctccaa

SEQ ID NO: 121528 - DNA, 9 bp, Unknown
  misc_feature (1)..( 9): Result.002 file - promoters60/1595752
accctccaa

SEQ ID NO: 121529 - DNA, 11 bp, Unknown
  misc_feature (1)..( 11): Result.002 file - promoters60/1595752
aaagttagatg

SEQ ID NO: 121530 - DNA, 11 bp, Unknown
  misc_feature (1)..( 11): Result.002 file - promoters60/1595752
aaagttagatg

SEQ ID NO: 121531 - DNA, 7 bp, Unknown
  misc_feature (1)..( 7): Result.002 file - promoters60/1595752
gacaaaa

SEQ ID NO: 121532 - DNA, 7 bp, Unknown
  misc_feature (1)..( 7): Result.002 file - promoters60/1595752
gacaaaa

SEQ ID NO: 121533 - DNA, 6 bp, Unknown
  misc_feature (1)..( 6): Result.002 file - promoters60/1595752
aacact

SEQ ID NO: 121534 - DNA, 6 bp, Unknown
  misc_feature (1)..( 6): Result.002 file - promoters60/1595752
aacact

SEQ ID NO: 121535 - DNA, 11 bp, Unknown
  misc_feature (1)..( 11): Result.002 file - promoters60/1595772
attaatattta

SEQ ID NO: 121536 - DNA, 11 bp, Unknown
  misc_feature (1)..( 11): Result.002 file - promoters60/1595772
cgtaatgtttc

SEQ ID NO: 121537 - DNA, 11 bp, Unknown
  misc_feature (1)..( 11): Result.002 file - promoters60/1595772
aataaaattaa

SEQ ID NO: 121538 - DNA, 11 bp, Unknown
  misc_feature (1)..( 11): Result.002 file - promoters60/1595772
attaataatta

SEQ ID NO: 121539 - DNA, 7 bp, Unknown
  misc_feature (1)..( 7): Result.002 file - promoters60/1595772
aaatatc

SEQ ID NO: 121540 - DNA, 7 bp, Unknown
  misc_feature (1)..( 7): Result.002 file - promoters60/1595772
aaatata

SEQ ID NO: 121541 - DNA, 8 bp, Unknown
  misc_feature (1)..( 8): Result.002 file - promoters60/1595772
aaattata

SEQ ID NO: 121542 - DNA, 8 bp, Unknown
  misc_feature (1)..( 8): Result.002 file - promoters60/1595772
taaagatc

SEQ ID NO: 121543 - DNA, 12 bp, Unknown
  misc_feature (1)..( 12): Result.002 file - promoters60/1595772
agttaaaaaata

SEQ ID NO: 121544 - DNA, 12 bp, Unknown
  misc_feature (1)..( 12): Result.002 file - promoters60/1595772
gcagaaaaaata

SEQ ID NO: 121545 - DNA, 12 bp, Unknown
  misc_feature (1)..( 12): Result.002 file - promoters60/1595772
caataaaaaaaa

SEQ ID NO: 121546 - DNA, 12 bp, Unknown
  misc_feature (1)..( 12): Result.002 file - promoters60/1595772
aattaaagtcaa

SEQ ID NO: 121547 - DNA, 8 bp, Unknown
  misc_feature (1)..( 8): Result.002 file - promoters60/1595772
tttttatt

SEQ ID NO: 121548 - DNA, 8 bp, Unknown
  misc_feature (1)..( 8): Result.002 file - promoters60/1595772
attttatt

SEQ ID NO: 121549 - DNA, 8 bp, Unknown
  misc_feature (1)..( 8): Result.002 file - promoters60/1595772
tttttatt

SEQ ID NO: 121550 - DNA, 8 bp, Unknown
  misc_feature (1)..( 8): Result.002 file - promoters60/1595772
tttgtatc

SEQ ID NO: 121551 - DNA, 10 bp, Unknown
  misc_feature (1)..( 10): Result.002 file - promoters60/1595772
atattttcag

SEQ ID NO: 121552 - DNA, 10 bp, Unknown
  misc_feature (1)..( 10): Result.002 file - promoters60/1595772
atatttagtt

SEQ ID NO: 121553 - DNA, 10 bp, Unknown
  misc_feature (1)..( 10): Result.002 file - promoters60/1595772
ttatttaaaa

SEQ ID NO: 121554 - DNA, 10 bp, Unknown
  misc_feature (1)..( 10): Result.002 file - promoters60/1595772
aaattgaaaa

SEQ ID NO: 121555 - DNA, 11 bp, Unknown
  misc_feature (1)..( 11): Result.002 file - promoters60/1595772
gtttaaaaatt

SEQ ID NO: 121556 - DNA, 11 bp, Unknown
  misc_feature (1)..( 11): Result.002 file - promoters60/1595772
gtttaatttat

SEQ ID NO: 121557 - DNA, 11 bp, Unknown
  misc_feature (1)..( 11): Result.002 file - promoters60/1595772
gttaaaaaatt

SEQ ID NO: 121558 - DNA, 11 bp, Unknown
  misc_feature (1)..( 11): Result.002 file - promoters60/1595772
atttcattaag

SEQ ID NO: 121559 - DNA, 8 bp, Unknown
  misc_feature (1)..( 8): Result.002 file - promoters60/1595772
atagttta

SEQ ID NO: 121560 - DNA, 8 bp, Unknown
  misc_feature (1)..( 8): Result.002 file - promoters60/1595772
ataatttc

SEQ ID NO: 121561 - DNA, 8 bp, Unknown
  misc_feature (1)..( 8): Result.002 file - promoters60/1595772
gaaatttc

SEQ ID NO: 121562 - DNA, 9 bp, Unknown
  misc_feature (1)..( 9): Result.002 file - promoters60/1595772
agaacttta

SEQ ID NO: 121563 - DNA, 10 bp, Unknown
  misc_feature (1)..( 10): Result.002 file - promoters60/1595772
aaataaattt

SEQ ID NO: 121564 - DNA, 10 bp, Unknown
  misc_feature (1)..( 10): Result.002 file - promoters60/1595772
ttatatattc

SEQ ID NO: 121565 - DNA, 9 bp, Unknown
  misc_feature (1)..( 9): Result.002 file - promoters60/1595772
aataaaaaa

SEQ ID NO: 121566 - DNA, 9 bp, Unknown
  misc_feature (1)..( 9): Result.002 file - promoters60/1595772
aatacaaaa

SEQ ID NO: 121567 - DNA, 10 bp, Unknown
  misc_feature (1)..( 10): Result.002 file - promoters60/1595772
aattaaagtc

SEQ ID NO: 121568 - DNA, 9 bp, Unknown
  misc_feature (1)..( 9): Result.002 file - promoters60/1595772
ctaaaaatg

SEQ ID NO: 121569 - DNA, 9 bp, Unknown
  misc_feature (1)..( 9): Result.002 file - promoters60/1595772
ccaaaaatg

SEQ ID NO: 121570 - DNA, 9 bp, Unknown
  misc_feature (1)..( 9): Result.002 file - promoters60/1595772
ttaaaaaag

SEQ ID NO: 121571 - DNA, 9 bp, Unknown
  misc_feature (1)..( 9): Result.002 file - promoters60/1595772
ttaaaagtt

SEQ ID NO: 121572 - DNA, 11 bp, Unknown
  misc_feature (1)..( 11): Result.002 file - promoters60/1595772
ctttgaataaa

SEQ ID NO: 121573 - DNA, 11 bp, Unknown
  misc_feature (1)..( 11): Result.002 file - promoters60/1595772
atttaaataaa

SEQ ID NO: 121574 - DNA, 11 bp, Unknown
  misc_feature (1)..( 11): Result.002 file - promoters60/1595772
atttaaagaca

SEQ ID NO: 121575 - DNA, 11 bp, Unknown
  misc_feature (1)..( 11): Result.002 file - promoters60/1595772
gtttaaaacaa

SEQ ID NO: 121576 - DNA, 11 bp, Unknown
  misc_feature (1)..( 11): Result.002 file - promoters60/1595772
agaaaaacaaa

SEQ ID NO: 121577 - DNA, 10 bp, Unknown
  misc_feature (1)..( 10): Result.002 file - promoters60/1595772
ctcaacaaac

SEQ ID NO: 121578 - DNA, 10 bp, Unknown
  misc_feature (1)..( 10): Result.002 file - promoters60/1595772
aacaagaaaa

SEQ ID NO: 121579 - DNA, 10 bp, Unknown
  misc_feature (1)..( 10): Result.002 file - promoters60/1595772
aaaaacaaaa

SEQ ID NO: 121580 - DNA, 10 bp, Unknown
  misc_feature (1)..( 10): Result.002 file - promoters60/1595772
aaagacaaaa

SEQ ID NO: 121581 - DNA, 10 bp, Unknown
  misc_feature (1)..( 10): Result.002 file - promoters60/1595772
taaaacaaag

SEQ ID NO: 121582 - DNA, 10 bp, Unknown
  misc_feature (1)..( 10): Result.002 file - promoters60/1595772
caaacaaaaa

SEQ ID NO: 121583 - DNA, 10 bp, Unknown
  misc_feature (1)..( 10): Result.002 file - promoters60/1595772
aaaataaaaa

SEQ ID NO: 121584 - DNA, 10 bp, Unknown
  misc_feature (1)..( 10): Result.002 file - promoters60/1595772
aaaacaaaat

SEQ ID NO: 121585 - DNA, 10 bp, Unknown
  misc_feature (1)..( 10): Result.002 file - promoters60/1595772
aaaacaaagt

SEQ ID NO: 121586 - DNA, 11 bp, Unknown
  misc_feature (1)..( 11): Result.002 file - promoters60/1595772
ctaaattttaa

SEQ ID NO: 121587 - DNA, 11 bp, Unknown
  misc_feature (1)..( 11): Result.002 file - promoters60/1595772
aaaaattataa

SEQ ID NO: 121588 - DNA, 11 bp, Unknown
  misc_feature (1)..( 11): Result.002 file - promoters60/1595772
ataaattcatt

SEQ ID NO: 121589 - DNA, 11 bp, Unknown
  misc_feature (1)..( 11): Result.002 file - promoters60/1595772
ataaactcagt

SEQ ID NO: 121590 - DNA, 10 bp, Unknown
  misc_feature (1)..( 10): Result.002 file - promoters60/1595772
aataaaccaa

SEQ ID NO: 121591 - DNA, 10 bp, Unknown
  misc_feature (1)..( 10): Result.002 file - promoters60/1595772
tataaactaa

SEQ ID NO: 121592 - DNA, 10 bp, Unknown
  misc_feature (1)..( 10): Result.002 file - promoters60/1595772
aataaattca

SEQ ID NO: 121593 - DNA, 10 bp, Unknown
  misc_feature (1)..( 10): Result.002 file - promoters60/1595772
tataaactca

SEQ ID NO: 121594 - DNA, 7 bp, Unknown
  misc_feature (1)..( 7): Result.002 file - promoters60/1595772
aaaacaa

SEQ ID NO: 121595 - DNA, 7 bp, Unknown
  misc_feature (1)..( 7): Result.002 file - promoters60/1595772
taaacaa

SEQ ID NO: 121596 - DNA, 7 bp, Unknown
  misc_feature (1)..( 7): Result.002 file - promoters60/1595772
aaaacaa

SEQ ID NO: 121597 - DNA, 7 bp, Unknown
  misc_feature (1)..( 7): Result.002 file - promoters60/1595772
aaaacaa

SEQ ID NO: 121598 - DNA, 10 bp, Unknown
  misc_feature (1)..( 10): Result.002 file - promoters60/1595772
atataaataa

SEQ ID NO: 121599 - DNA, 10 bp, Unknown
  misc_feature (1)..( 10): Result.002 file - promoters60/1595772
ttataaatac

SEQ ID NO: 121600 - DNA, 10 bp, Unknown
  misc_feature (1)..( 10): Result.002 file - promoters60/1595772
atataagtgt

SEQ ID NO: 121601 - DNA, 10 bp, Unknown
  misc_feature (1)..( 10): Result.002 file - promoters60/1595772
ctatatataa

SEQ ID NO: 121602 - DNA, 7 bp, Unknown
  misc_feature (1)..( 7): Result.002 file - promoters60/1595829
tatttta

SEQ ID NO: 121603 - DNA, 7 bp, Unknown
  misc_feature (1)..( 7): Result.002 file - promoters60/1595829
tattttg

SEQ ID NO: 121604 - DNA, 7 bp, Unknown
  misc_feature (1)..( 7): Result.002 file - promoters60/1595829
aatttta

SEQ ID NO: 121605 - DNA, 9 bp, Unknown
  misc_feature (1)..( 9): Result.002 file - promoters60/1595829
atataaatt

SEQ ID NO: 121606 - DNA, 9 bp, Unknown
  misc_feature (1)..( 9): Result.002 file - promoters60/1595829
atatcaata

SEQ ID NO: 121607 - DNA, 9 bp, Unknown
  misc_feature (1)..( 9): Result.002 file - promoters60/1595829
taataaatt

SEQ ID NO: 121608 - DNA, 9 bp, Unknown
  misc_feature (1)..( 9): Result.002 file - promoters60/1662827
tttttttaa

SEQ ID NO: 121609 - DNA, 9 bp, Unknown
  misc_feature (1)..( 9): Result.002 file - promoters60/1662827
tttttttgg

SEQ ID NO: 121610 - DNA, 9 bp, Unknown
  misc_feature (1)..( 9): Result.002 file - promoters60/1662827
tttatttgt

SEQ ID NO: 121611 - DNA, 9 bp, Unknown
  misc_feature (1)..( 9): Result.002 file - promoters60/1662827
tatatctgt

SEQ ID NO: 121612 - DNA, 11 bp, Unknown
  misc_feature (1)..( 11): Result.002 file - promoters60/1662827
aaactatttaa

SEQ ID NO: 121613 - DNA, 11 bp, Unknown
  misc_feature (1)..( 11): Result.002 file - promoters60/1662827
cttctatataa

SEQ ID NO: 121614 - DNA, 11 bp, Unknown
  misc_feature (1)..( 11): Result.002 file - promoters60/1662827
tgactattatc

SEQ ID NO: 121615 - DNA, 11 bp, Unknown
  misc_feature (1)..( 11): Result.002 file - promoters60/1662827
tgattatcctt

SEQ ID NO: 121616 - DNA, 7 bp, Unknown
  misc_feature (1)..( 7): Result.002 file - promoters60/1662895
tgttggt

SEQ ID NO: 121617 - DNA, 7 bp, Unknown
  misc_feature (1)..( 7): Result.002 file - promoters60/1662895
tgttggt

SEQ ID NO: 121618 - DNA, 6 bp, Unknown
  misc_feature (1)..( 6): Result.002 file - promoters60/1662895
tcatgt

SEQ ID NO: 121619 - DNA, 6 bp, Unknown
  misc_feature (1)..( 6): Result.002 file - promoters60/1662895
tcatgt

SEQ ID NO: 121620 - DNA, 7 bp, Unknown
  misc_feature (1)..( 7): Result.002 file - promoters60/1662895
tttttca

SEQ ID NO: 121621 - DNA, 7 bp, Unknown
  misc_feature (1)..( 7): Result.002 file - promoters60/1662895
tttttca

SEQ ID NO: 121622 - DNA, 6 bp, Unknown
  misc_feature (1)..( 6): Result.002 file - promoters60/1662895
gttttt

SEQ ID NO: 121623 - DNA, 6 bp, Unknown
  misc_feature (1)..( 6): Result.002 file - promoters60/1662895
gttttt

SEQ ID NO: 121624 - DNA, 13 bp, Unknown
  misc_feature (1)..( 13): Result.002 file - promoters60/1662895
ctaaaaagtaatt

SEQ ID NO: 121625 - DNA, 13 bp, Unknown
  misc_feature (1)..( 13): Result.002 file - promoters60/1662895
ctaaaaagtaatt

SEQ ID NO: 121626 - DNA, 6 bp, Unknown
  misc_feature (1)..( 6): Result.002 file - promoters60/1662895
agaaaa

SEQ ID NO: 121627 - DNA, 6 bp, Unknown
  misc_feature (1)..( 6): Result.002 file - promoters60/1662895
agaaaa

SEQ ID NO: 121628 - DNA, 7 bp, Unknown
  misc_feature (1)..( 7): Result.002 file - promoters60/1662895
gtttcat

SEQ ID NO: 121629 - DNA, 7 bp, Unknown
  misc_feature (1)..( 7): Result.002 file - promoters60/1662895
gttacat

SEQ ID NO: 121630 - DNA, 7 bp, Unknown
  misc_feature (1)..( 7): Result.002 file - promoters60/1662895
tttcaga

SEQ ID NO: 121631 - DNA, 7 bp, Unknown
  misc_feature (1)..( 7): Result.002 file - promoters60/1662895
tttgaga

SEQ ID NO: 121632 - DNA, 6 bp, Unknown
  misc_feature (1)..( 6): Result.002 file - promoters60/1662895
gagaaa

SEQ ID NO: 121633 - DNA, 6 bp, Unknown
  misc_feature (1)..( 6): Result.002 file - promoters60/1662895
gagaaa

SEQ ID NO: 121634 - DNA, 7 bp, Unknown
  misc_feature (1)..( 7): Result.002 file - promoters60/1662895
tatgtaa

SEQ ID NO: 121635 - DNA, 7 bp, Unknown
  misc_feature (1)..( 7): Result.002 file - promoters60/1662895
tatataa

SEQ ID NO: 121636 - DNA, 7 bp, Unknown
  misc_feature (1)..( 7): Result.002 file - promoters60/1662895
taagagg

SEQ ID NO: 121637 - DNA, 7 bp, Unknown
  misc_feature (1)..( 7): Result.002 file - promoters60/1662895
taatagg

SEQ ID NO: 121638 - DNA, 6 bp, Unknown
  misc_feature (1)..( 6): Result.002 file - promoters60/1662895
gagatt

SEQ ID NO: 121639 - DNA, 6 bp, Unknown
  misc_feature (1)..( 6): Result.002 file - promoters60/1662895
gagatt

SEQ ID NO: 121640 - DNA, 11 bp, Unknown
  misc_feature (1)..( 11): Result.002 file - promoters60/1662895
aattgaagttt

SEQ ID NO: 121641 - DNA, 11 bp, Unknown
  misc_feature (1)..( 11): Result.002 file - promoters60/1662895
aattgaaattt

SEQ ID NO: 121642 - DNA, 14 bp, Unknown
  misc_feature (1)..( 14): Result.002 file - promoters60/1662917
tgcattagttcttc

SEQ ID NO: 121643 - DNA, 14 bp, Unknown
  misc_feature (1)..( 14): Result.002 file - promoters60/1662917
taaatttgttatgt

SEQ ID NO: 121644 - DNA, 14 bp, Unknown
  misc_feature (1)..( 14): Result.002 file - promoters60/1662917
gttattagttaacc

SEQ ID NO: 121645 - DNA, 14 bp, Unknown
  misc_feature (1)..( 14): Result.002 file - promoters60/1662917
taaattttttaaaa

SEQ ID NO: 121646 - DNA, 14 bp, Unknown
  misc_feature (1)..( 14): Result.002 file - promoters60/1662917
tataattgttaatc

SEQ ID NO: 121647 - DNA, 14 bp, Unknown
  misc_feature (1)..( 14): Result.002 file - promoters60/1662917
tatacgttttaaaa

SEQ ID NO: 121648 - DNA, 16 bp, Unknown
  misc_feature (1)..( 16): Result.002 file - promoters60/1662917
attcgaatttttcaat

SEQ ID NO: 121649 - DNA, 16 bp, Unknown
  misc_feature (1)..( 16): Result.002 file - promoters60/1662917
tttagtctattttaat

SEQ ID NO: 121650 - DNA, 16 bp, Unknown
  misc_feature (1)..( 16): Result.002 file - promoters60/1662917
atttgaaattttcata

SEQ ID NO: 121651 - DNA, 16 bp, Unknown
  misc_feature (1)..( 16): Result.002 file - promoters60/1662917
caatcccaattctaac

SEQ ID NO: 121652 - DNA, 16 bp, Unknown
  misc_feature (1)..( 16): Result.002 file - promoters60/1662917
gcgctaaacttttaaa

SEQ ID NO: 121653 - DNA, 13 bp, Unknown
  misc_feature (1)..( 13): Result.002 file - promoters60/1662917
ttttgaagaattt

SEQ ID NO: 121654 - DNA, 13 bp, Unknown
  misc_feature (1)..( 13): Result.002 file - promoters60/1662917
ttttgatgaatgt

SEQ ID NO: 121655 - DNA, 13 bp, Unknown
  misc_feature (1)..( 13): Result.002 file - promoters60/1662917
atttgctgaataa

SEQ ID NO: 121656 - DNA, 13 bp, Unknown
  misc_feature (1)..( 13): Result.002 file - promoters60/1662917
tttcgatgtataa

SEQ ID NO: 121657 - DNA, 13 bp, Unknown
  misc_feature (1)..( 13): Result.002 file - promoters60/1662917
cccttgtgaatgt

SEQ ID NO: 121658 - DNA, 19 bp, Unknown
  misc_feature (1)..( 19): Result.002 file - promoters60/1662917
ataaaaatgttagatagga

SEQ ID NO: 121659 - DNA, 19 bp, Unknown
  misc_feature (1)..( 19): Result.002 file - promoters60/1662917
tcataaattttaaaattat

SEQ ID NO: 121660 - DNA, 19 bp, Unknown
  misc_feature (1)..( 19): Result.002 file - promoters60/1662917
tgttaaatatgaatattac

SEQ ID NO: 121661 - DNA, 20 bp, Unknown
  misc_feature (1)..( 20): Result.002 file - promoters60/1662917
atgtaaattttgaaataatt

SEQ ID NO: 121662 - DNA, 20 bp, Unknown
  misc_feature (1)..( 20): Result.002 file - promoters60/1662917
ttttaaattttttaaaatat

SEQ ID NO: 121663 - DNA, 20 bp, Unknown
  misc_feature (1)..( 20): Result.002 file - promoters60/1662917
tgttaatcttttgattctaa

SEQ ID NO: 121664 - DNA, 8 bp, Unknown
  misc_feature (1)..( 8): Result.002 file - promoters60/1662917
cattaaag

SEQ ID NO: 121665 - DNA, 8 bp, Unknown
  misc_feature (1)..( 8): Result.002 file - promoters60/1662917
aattcaag

SEQ ID NO: 121666 - DNA, 8 bp, Unknown
  misc_feature (1)..( 8): Result.002 file - promoters60/1662917
cattaata

SEQ ID NO: 121667 - DNA, 8 bp, Unknown
  misc_feature (1)..( 8): Result.002 file - promoters60/1662917
gatttata

SEQ ID NO: 121668 - DNA, 10 bp, Unknown
  misc_feature (1)..( 10): Result.002 file - promoters60/1662917
cttatataaa

SEQ ID NO: 121669 - DNA, 10 bp, Unknown
  misc_feature (1)..( 10): Result.002 file - promoters60/1662917
tatatataat

SEQ ID NO: 121670 - DNA, 10 bp, Unknown
  misc_feature (1)..( 10): Result.002 file - promoters60/1662917
tataaataaa

SEQ ID NO: 121671 - DNA, 10 bp, Unknown
  misc_feature (1)..( 10): Result.002 file - promoters60/1662917
tgtatataaa

SEQ ID NO: 121672 - DNA, 10 bp, Unknown
  misc_feature (1)..( 10): Result.002 file - promoters60/1662917
tacctataaa

SEQ ID NO: 121673 - DNA, 10 bp, Unknown
  misc_feature (1)..( 10): Result.002 file - promoters60/1662917
tataaacaaa

SEQ ID NO: 121674 - DNA, 10 bp, Unknown
  misc_feature (1)..( 10): Result.002 file - promoters60/1662917
aataaccaaa

SEQ ID NO: 121675 - DNA, 10 bp, Unknown
  misc_feature (1)..( 10): Result.002 file - promoters60/1662917
tataaataaa

SEQ ID NO: 121676 - DNA, 10 bp, Unknown
  misc_feature (1)..( 10): Result.002 file - promoters60/1662917
tgtatataaa

SEQ ID NO: 121677 - DNA, 10 bp, Unknown
  misc_feature (1)..( 10): Result.002 file - promoters60/1662917
tataaatatc

SEQ ID NO: 121678 - DNA, 10 bp, Unknown
  misc_feature (1)..( 10): Result.002 file - promoters60/1662917
aaatttgtat

SEQ ID NO: 121679 - DNA, 10 bp, Unknown
  misc_feature (1)..( 10): Result.002 file - promoters60/1662917
gaatatgttt

SEQ ID NO: 121680 - DNA, 10 bp, Unknown
  misc_feature (1)..( 10): Result.002 file - promoters60/1662917
tagtatatac

SEQ ID NO: 121681 - DNA, 10 bp, Unknown
  misc_feature (1)..( 10): Result.002 file - promoters60/1662917
taatatgtac

SEQ ID NO: 121682 - DNA, 12 bp, Unknown
  misc_feature (1)..( 12): Result.002 file - promoters60/1662917
cttataattatg

SEQ ID NO: 121683 - DNA, 12 bp, Unknown
  misc_feature (1)..( 12): Result.002 file - promoters60/1662917
ataataataatg

SEQ ID NO: 121684 - DNA, 12 bp, Unknown
  misc_feature (1)..( 12): Result.002 file - promoters60/1662917
tttataagtata

SEQ ID NO: 121685 - DNA, 12 bp, Unknown
  misc_feature (1)..( 12): Result.002 file - promoters60/1662917
tttgtaacttca

SEQ ID NO: 121686 - DNA, 12 bp, Unknown
  misc_feature (1)..( 12): Result.002 file - promoters60/1662917
tttaaaagtaag

SEQ ID NO: 121687 - DNA, 12 bp, Unknown
  misc_feature (1)..( 12): Result.002 file - promoters60/1662917
gttattagttaa

SEQ ID NO: 121688 - DNA, 16 bp, Unknown
  misc_feature (1)..( 16): Result.002 file - promoters60/1662917
tgttagataggaaaaa

SEQ ID NO: 121689 - DNA, 16 bp, Unknown
  misc_feature (1)..( 16): Result.002 file - promoters60/1662917
atatggatagtaaaaa

SEQ ID NO: 121690 - DNA, 16 bp, Unknown
  misc_feature (1)..( 16): Result.002 file - promoters60/1662917
tgttaaatatgaatat

SEQ ID NO: 121691 - DNA, 16 bp, Unknown
  misc_feature (1)..( 16): Result.002 file - promoters60/1662917
tctaaaatattgttca

SEQ ID NO: 121692 - DNA, 10 bp, Unknown
  misc_feature (1)..( 10): Result.002 file - promoters60/1662917
gtaatgtaat

SEQ ID NO: 121693 - DNA, 10 bp, Unknown
  misc_feature (1)..( 10): Result.002 file - promoters60/1662917
tgaatgtata

SEQ ID NO: 121694 - DNA, 10 bp, Unknown
  misc_feature (1)..( 10): Result.002 file - promoters60/1662917
ataatgtaaa

SEQ ID NO: 121695 - DNA, 10 bp, Unknown
  misc_feature (1)..( 10): Result.002 file - promoters60/1662917
tcgatgtata

SEQ ID NO: 121696 - DNA, 10 bp, Unknown
  misc_feature (1)..( 10): Result.002 file - promoters60/1662917
tgaatgtcaa

SEQ ID NO: 121697 - DNA, 15 bp, Unknown
  misc_feature (1)..( 15): Result.002 file - promoters60/1662917
tatacgttttaaaag

SEQ ID NO: 121698 - DNA, 15 bp, Unknown
  misc_feature (1)..( 15): Result.002 file - promoters60/1662917
aacaatttttaaatt

SEQ ID NO: 121699 - DNA, 15 bp, Unknown
  misc_feature (1)..( 15): Result.002 file - promoters60/1662917
atatctttataagta

SEQ ID NO: 121700 - DNA, 15 bp, Unknown
  misc_feature (1)..( 15): Result.002 file - promoters60/1662917
ataactttatgttat

SEQ ID NO: 121701 - DNA, 8 bp, Unknown
  misc_feature (1)..( 8): Result.002 file - promoters60/1662917
aaaaatat

SEQ ID NO: 121702 - DNA, 8 bp, Unknown
  misc_feature (1)..( 8): Result.002 file - promoters60/1662917
aaatatac

SEQ ID NO: 121703 - DNA, 8 bp, Unknown
  misc_feature (1)..( 8): Result.002 file - promoters60/1662917
aaatgtca

SEQ ID NO: 121704 - DNA, 8 bp, Unknown
  misc_feature (1)..( 8): Result.002 file - promoters60/1662917
aaatgtta

SEQ ID NO: 121705 - DNA, 12 bp, Unknown
  misc_feature (1)..( 12): Result.002 file - promoters60/1662917
aaaaatatatac

SEQ ID NO: 121706 - DNA, 12 bp, Unknown
  misc_feature (1)..( 12): Result.002 file - promoters60/1662917
gatagtatatac

SEQ ID NO: 121707 - DNA, 12 bp, Unknown
  misc_feature (1)..( 12): Result.002 file - promoters60/1662917
tttaatatgtac

SEQ ID NO: 121708 - DNA, 12 bp, Unknown
  misc_feature (1)..( 12): Result.002 file - promoters60/1662917
tagaatatgttt

SEQ ID NO: 121709 - DNA, 9 bp, Unknown
  misc_feature (1)..( 9): Result.002 file - promoters60/1662917
aaaattatt

SEQ ID NO: 121710 - DNA, 9 bp, Unknown
  misc_feature (1)..( 9): Result.002 file - promoters60/1662917
taaaatatt

SEQ ID NO: 121711 - DNA, 9 bp, Unknown
  misc_feature (1)..( 9): Result.002 file - promoters60/1662917
taaaatata

SEQ ID NO: 121712 - DNA, 9 bp, Unknown
  misc_feature (1)..( 9): Result.002 file - promoters60/1662917
ttaaatatg

SEQ ID NO: 121713 - DNA, 7 bp, Unknown
  misc_feature (1)..( 7): Result.002 file - promoters60/1663024
tctctct

SEQ ID NO: 121714 - DNA, 7 bp, Unknown
  misc_feature (1)..( 7): Result.002 file - promoters60/1663024
tctttct

SEQ ID NO: 121715 - DNA, 9 bp, Unknown
  misc_feature (1)..( 9): Result.002 file - promoters60/1663024
gaaacccta

SEQ ID NO: 121716 - DNA, 9 bp, Unknown
  misc_feature (1)..( 9): Result.002 file - promoters60/1663024
gaagcccta

SEQ ID NO: 121717 - DNA, 6 bp, Unknown
  misc_feature (1)..( 6): Result.002 file - promoters60/1663024
atcgtc

SEQ ID NO: 121718 - DNA, 6 bp, Unknown
  misc_feature (1)..( 6): Result.002 file - promoters60/1663024
atcgtc

SEQ ID NO: 121719 - DNA, 7 bp, Unknown
  misc_feature (1)..( 7): Result.002 file - promoters60/1663024
gcttcca

SEQ ID NO: 121720 - DNA, 7 bp, Unknown
  misc_feature (1)..( 7): Result.002 file - promoters60/1663024
gctacca

SEQ ID NO: 121721 - DNA, 7 bp, Unknown
  misc_feature (1)..( 7): Result.002 file - promoters60/1663024
gttcatg

SEQ ID NO: 121722 - DNA, 7 bp, Unknown
  misc_feature (1)..( 7): Result.002 file - promoters60/1663024
gttgatg

SEQ ID NO: 121723 - DNA, 7 bp, Unknown
  misc_feature (1)..( 7): Result.002 file - promoters60/1663024
aagcatg

SEQ ID NO: 121724 - DNA, 7 bp, Unknown
  misc_feature (1)..( 7): Result.002 file - promoters60/1663024
aagtatg

SEQ ID NO: 121725 - DNA, 6 bp, Unknown
  misc_feature (1)..( 6): Result.002 file - promoters60/1663024
atgcgg

SEQ ID NO: 121726 - DNA, 6 bp, Unknown
  misc_feature (1)..( 6): Result.002 file - promoters60/1663024
atgcgg

SEQ ID NO: 121727 - DNA, 7 bp, Unknown
  misc_feature (1)..( 7): Result.002 file - promoters60/1663024
ggtatca

SEQ ID NO: 121728 - DNA, 7 bp, Unknown
  misc_feature (1)..( 7): Result.002 file - promoters60/1663024
ggtatca

SEQ ID NO: 121729 - DNA, 6 bp, Unknown
  misc_feature (1)..( 6): Result.002 file - promoters60/1663024
caagga

SEQ ID NO: 121730 - DNA, 6 bp, Unknown
  misc_feature (1)..( 6): Result.002 file - promoters60/1663024
caagga

SEQ ID NO: 121731 - DNA, 6 bp, Unknown
  misc_feature (1)..( 6): Result.002 file - promoters60/1663024
gtttcc

SEQ ID NO: 121732 - DNA, 6 bp, Unknown
  misc_feature (1)..( 6): Result.002 file - promoters60/1663024
gtttcc

SEQ ID NO: 121733 - DNA, 6 bp, Unknown
  misc_feature (1)..( 6): Result.002 file - promoters60/1663135
aacaaa

SEQ ID NO: 121734 - DNA, 6 bp, Unknown
  misc_feature (1)..( 6): Result.002 file - promoters60/1663135
aacaaa

SEQ ID NO: 121735 - DNA, 8 bp, Unknown
  misc_feature (1)..( 8): Result.002 file - promoters60/1663135
atactttc

SEQ ID NO: 121736 - DNA, 8 bp, Unknown
  misc_feature (1)..( 8): Result.002 file - promoters60/1663135
acactttc

SEQ ID NO: 121737 - DNA, 8 bp, Unknown
  misc_feature (1)..( 8): Result.002 file - promoters60/1663135
acattttc

SEQ ID NO: 121738 - DNA, 7 bp, Unknown
  misc_feature (1)..( 7): Result.002 file - promoters60/1663135
tttttaa

SEQ ID NO: 121739 - DNA, 7 bp, Unknown
  misc_feature (1)..( 7): Result.002 file - promoters60/1663135
tttttaa

SEQ ID NO: 121740 - DNA, 7 bp, Unknown
  misc_feature (1)..( 7): Result.002 file - promoters60/1663135
tttgtaa

SEQ ID NO: 121741 - DNA, 6 bp, Unknown
  misc_feature (1)..( 6): Result.002 file - promoters60/1663135
ttcttt

SEQ ID NO: 121742 - DNA, 6 bp, Unknown
  misc_feature (1)..( 6): Result.002 file - promoters60/1663135
ttcttt

SEQ ID NO: 121743 - DNA, 9 bp, Unknown
  misc_feature (1)..( 9): Result.002 file - promoters60/1663135
tataaaatt

SEQ ID NO: 121744 - DNA, 9 bp, Unknown
  misc_feature (1)..( 9): Result.002 file - promoters60/1663135
aataaaatt

SEQ ID NO: 121745 - DNA, 9 bp, Unknown
  misc_feature (1)..( 9): Result.002 file - promoters60/1663135
aataaatga

SEQ ID NO: 121746 - DNA, 6 bp, Unknown
  misc_feature (1)..( 6): Result.002 file - promoters60/1663135
taaata

SEQ ID NO: 121747 - DNA, 6 bp, Unknown
  misc_feature (1)..( 6): Result.002 file - promoters60/1663135
taaata

SEQ ID NO: 121748 - DNA, 10 bp, Unknown
  misc_feature (1)..( 10): Result.002 file - promoters60/1663135
caaaacaaaa

SEQ ID NO: 121749 - DNA, 10 bp, Unknown
  misc_feature (1)..( 10): Result.002 file - promoters60/1663135
caaaactagt

SEQ ID NO: 121750 - DNA, 10 bp, Unknown
  misc_feature (1)..( 10): Result.002 file - promoters60/1663135
aaaaagaaaa

SEQ ID NO: 121751 - DNA, 6 bp, Unknown
  misc_feature (1)..( 6): Result.002 file - promoters60/1663135
tgtttt

SEQ ID NO: 121752 - DNA, 6 bp, Unknown
  misc_feature (1)..( 6): Result.002 file - promoters60/1663135
tgtttt

SEQ ID NO: 121753 - DNA, 7 bp, Unknown
  misc_feature (1)..( 7): Result.002 file - promoters60/1663135
aacataa

SEQ ID NO: 121754 - DNA, 7 bp, Unknown
  misc_feature (1)..( 7): Result.002 file - promoters60/1663135
aacatag

SEQ ID NO: 121755 - DNA, 7 bp, Unknown
  misc_feature (1)..( 7): Result.002 file - promoters60/1663135
tacatag

SEQ ID NO: 121756 - DNA, 6 bp, Unknown
  misc_feature (1)..( 6): Result.002 file - promoters60/1663135
ttgtaa

SEQ ID NO: 121757 - DNA, 6 bp, Unknown
  misc_feature (1)..( 6): Result.002 file - promoters60/1663135
ttgtaa

SEQ ID NO: 121758 - DNA, 6 bp, Unknown
  misc_feature (1)..( 6): Result.002 file - promoters60/1663135
tttgga

SEQ ID NO: 121759 - DNA, 6 bp, Unknown
  misc_feature (1)..( 6): Result.002 file - promoters60/1663135
tttgga

SEQ ID NO: 121760 - DNA, 8 bp, Unknown
  misc_feature (1)..( 8): Result.002 file - promoters60/1663135
aatcaaat

SEQ ID NO: 121761 - DNA, 8 bp, Unknown
  misc_feature (1)..( 8): Result.002 file - promoters60/1663135
aataaaat

SEQ ID NO: 121762 - DNA, 6 bp, Unknown
  misc_feature (1)..( 6): Result.002 file - promoters60/1663135
tctctc

SEQ ID NO: 121763 - DNA, 6 bp, Unknown
  misc_feature (1)..( 6): Result.002 file - promoters60/1663135
tctctc

SEQ ID NO: 121764 - DNA, 6 bp, Unknown
  misc_feature (1)..( 6): Result.002 file - promoters60/1663135
tcagat

SEQ ID NO: 121765 - DNA, 6 bp, Unknown
  misc_feature (1)..( 6): Result.002 file - promoters60/1663135
tcagat

SEQ ID NO: 121766 - DNA, 7 bp, Unknown
  misc_feature (1)..( 7): Result.002 file - promoters60/1663135
tttttgt

SEQ ID NO: 121767 - DNA, 7 bp, Unknown
  misc_feature (1)..( 7): Result.002 file - promoters60/1663135
tttatgt

SEQ ID NO: 121768 - DNA, 7 bp, Unknown
  misc_feature (1)..( 7): Result.002 file - promoters60/1663135
tatgtat

SEQ ID NO: 121769 - DNA, 7 bp, Unknown
  misc_feature (1)..( 7): Result.002 file - promoters60/1663135
tatttat

SEQ ID NO: 121770 - DNA, 8 bp, Unknown
  misc_feature (1)..( 8): Result.002 file - promoters60/1663135
taacaccg

SEQ ID NO: 121771 - DNA, 8 bp, Unknown
  misc_feature (1)..( 8): Result.002 file - promoters60/1663135
taaaaccg

SEQ ID NO: 121772 - DNA, 12 bp, Unknown
  misc_feature (1)..( 12): Result.002 file - promoters60/1663168
ttcttttcatta

SEQ ID NO: 121773 - DNA, 12 bp, Unknown
  misc_feature (1)..( 12): Result.002 file - promoters60/1663168
gtctgttcgtct

SEQ ID NO: 121774 - DNA, 12 bp, Unknown
  misc_feature (1)..( 12): Result.002 file - promoters60/1663168
ttctttttgttc

SEQ ID NO: 121775 - DNA, 12 bp, Unknown
  misc_feature (1)..( 12): Result.002 file - promoters60/1663168
ccattttcaagt

SEQ ID NO: 121776 - DNA, 12 bp, Unknown
  misc_feature (1)..( 12): Result.002 file - promoters60/1663168
ttttgttggtct

SEQ ID NO: 121777 - DNA, 8 bp, Unknown
  misc_feature (1)..( 8): Result.002 file - promoters60/1663217
atgatata

SEQ ID NO: 121778 - DNA, 8 bp, Unknown
  misc_feature (1)..( 8): Result.002 file - promoters60/1663217
atgatata

SEQ ID NO: 121779 - DNA, 7 bp, Unknown
  misc_feature (1)..( 7): Result.002 file - promoters60/1663217
tataaaa

SEQ ID NO: 121780 - DNA, 7 bp, Unknown
  misc_feature (1)..( 7): Result.002 file - promoters60/1663217
tatgaaa

SEQ ID NO: 121781 - DNA, 6 bp, Unknown
  misc_feature (1)..( 6): Result.002 file - promoters60/1663217
tatgat

SEQ ID NO: 121782 - DNA, 6 bp, Unknown
  misc_feature (1)..( 6): Result.002 file - promoters60/1663217
tatgat

SEQ ID NO: 121783 - DNA, 14 bp, Unknown
  misc_feature (1)..( 14): Result.002 file - promoters60/1663217
tgacttttgtcatt

SEQ ID NO: 121784 - DNA, 14 bp, Unknown
  misc_feature (1)..( 14): Result.002 file - promoters60/1663217
tgattttcgtcatt

SEQ ID NO: 121785 - DNA, 6 bp, Unknown
  misc_feature (1)..( 6): Result.002 file - promoters60/1663217
attgta

SEQ ID NO: 121786 - DNA, 6 bp, Unknown
  misc_feature (1)..( 6): Result.002 file - promoters60/1663217
attgta

SEQ ID NO: 121787 - DNA, 7 bp, Unknown
  misc_feature (1)..( 7): Result.002 file - promoters60/1663217
aaattga

SEQ ID NO: 121788 - DNA, 7 bp, Unknown
  misc_feature (1)..( 7): Result.002 file - promoters60/1663217
aaagtga

SEQ ID NO: 121789 - DNA, 10 bp, Unknown
  misc_feature (1)..( 10): Result.002 file - promoters60/1663217
aaaccaatcc

SEQ ID NO: 121790 - DNA, 10 bp, Unknown
  misc_feature (1)..( 10): Result.002 file - promoters60/1663217
aaaccgatcc

SEQ ID NO: 121791 - DNA, 10 bp, Unknown
  misc_feature (1)..( 10): Result.002 file - promoters60/1663217
ataacaataa

SEQ ID NO: 121792 - DNA, 10 bp, Unknown
  misc_feature (1)..( 10): Result.002 file - promoters60/1663217
ataagaataa

SEQ ID NO: 121793 - DNA, 7 bp, Unknown
  misc_feature (1)..( 7): Result.002 file - promoters60/1663217
taagtaa

SEQ ID NO: 121794 - DNA, 7 bp, Unknown
  misc_feature (1)..( 7): Result.002 file - promoters60/1663217
taaataa

SEQ ID NO: 121795 - DNA, 7 bp, Unknown
  misc_feature (1)..( 7): Result.002 file - promoters60/1663217
tagaaac

SEQ ID NO: 121796 - DNA, 7 bp, Unknown
  misc_feature (1)..( 7): Result.002 file - promoters60/1663217
tagaaac

SEQ ID NO: 121797 - DNA, 6 bp, Unknown
  misc_feature (1)..( 6): Result.002 file - promoters60/1663217
ccaaat

SEQ ID NO: 121798 - DNA, 6 bp, Unknown
  misc_feature (1)..( 6): Result.002 file - promoters60/1663217
ccaaat

SEQ ID NO: 121799 - DNA, 7 bp, Unknown
  misc_feature (1)..( 7): Result.002 file - promoters60/1663217
tcataaa

SEQ ID NO: 121800 - DNA, 7 bp, Unknown
  misc_feature (1)..( 7): Result.002 file - promoters60/1663217
tcacaaa

SEQ ID NO: 121801 - DNA, 6 bp, Unknown
  misc_feature (1)..( 6): Result.002 file - promoters60/1663217
tcaaag

SEQ ID NO: 121802 - DNA, 6 bp, Unknown
  misc_feature (1)..( 6): Result.002 file - promoters60/1663217
tcaaag

SEQ ID NO: 121803 - DNA, 7 bp, Unknown
  misc_feature (1)..( 7): Result.002 file - promoters60/1663217
acgtgcc

SEQ ID NO: 121804 - DNA, 7 bp, Unknown
  misc_feature (1)..( 7): Result.002 file - promoters60/1663217
acgtgcc

SEQ ID NO: 121805 - DNA, 6 bp, Unknown
  misc_feature (1)..( 6): Result.002 file - promoters60/1663217
tcttct

SEQ ID NO: 121806 - DNA, 6 bp, Unknown
  misc_feature (1)..( 6): Result.002 file - promoters60/1663217
tcttct

SEQ ID NO: 121807 - DNA, 12 bp, Unknown
  misc_feature (1)..( 12): Result.002 file - promoters60/1663278
tatttaaaacgt

SEQ ID NO: 121808 - DNA, 12 bp, Unknown
  misc_feature (1)..( 12): Result.002 file - promoters60/1663278
tattgaaaaaga

SEQ ID NO: 121809 - DNA, 12 bp, Unknown
  misc_feature (1)..( 12): Result.002 file - promoters60/1663278
aattgaaacttt

SEQ ID NO: 121810 - DNA, 12 bp, Unknown
  misc_feature (1)..( 12): Result.002 file - promoters60/1663278
gagggaaagaga

SEQ ID NO: 121811 - DNA, 8 bp, Unknown
  misc_feature (1)..( 8): Result.002 file - promoters60/1663353
ttttgaaa

SEQ ID NO: 121812 - DNA, 8 bp, Unknown
  misc_feature (1)..( 8): Result.002 file - promoters60/1663353
ttttcaaa

SEQ ID NO: 121813 - DNA, 8 bp, Unknown
  misc_feature (1)..( 8): Result.002 file - promoters60/1663353
ttttgatg

SEQ ID NO: 121814 - DNA, 8 bp, Unknown
  misc_feature (1)..( 8): Result.002 file - promoters60/1663353
ttctaaac

SEQ ID NO: 121815 - DNA, 8 bp, Unknown
  misc_feature (1)..( 8): Result.002 file - promoters60/1663353
tatcattt

SEQ ID NO: 121816 - DNA, 8 bp, Unknown
  misc_feature (1)..( 8): Result.002 file - promoters60/1663353
aatctttt

SEQ ID NO: 121817 - DNA, 8 bp, Unknown
  misc_feature (1)..( 8): Result.002 file - promoters60/1663353
catcgttt

SEQ ID NO: 121818 - DNA, 8 bp, Unknown
  misc_feature (1)..( 8): Result.002 file - promoters60/1663353
catcgtcg

SEQ ID NO: 121819 - DNA, 9 bp, Unknown
  misc_feature (1)..( 9): Result.002 file - promoters60/1663353
tttttcttc

SEQ ID NO: 121820 - DNA, 9 bp, Unknown
  misc_feature (1)..( 9): Result.002 file - promoters60/1663353
tctttcttc

SEQ ID NO: 121821 - DNA, 9 bp, Unknown
  misc_feature (1)..( 9): Result.002 file - promoters60/1663353
tttttattc

SEQ ID NO: 121822 - DNA, 9 bp, Unknown
  misc_feature (1)..( 9): Result.002 file - promoters60/1663353
ccttacttg

SEQ ID NO: 121823 - DNA, 10 bp, Unknown
  misc_feature (1)..( 10): Result.002 file - promoters60/1663353
catgttttga

SEQ ID NO: 121824 - DNA, 10 bp, Unknown
  misc_feature (1)..( 10): Result.002 file - promoters60/1663353
tatgttctga

SEQ ID NO: 121825 - DNA, 10 bp, Unknown
  misc_feature (1)..( 10): Result.002 file - promoters60/1663353
agtgttttca

SEQ ID NO: 121826 - DNA, 10 bp, Unknown
  misc_feature (1)..( 10): Result.002 file - promoters60/1663353
tatgttgcaa

SEQ ID NO: 121827 - DNA, 8 bp, Unknown
  misc_feature (1)..( 8): Result.002 file - promoters60/1664727
tattgaaa

SEQ ID NO: 121828 - DNA, 8 bp, Unknown
  misc_feature (1)..( 8): Result.002 file - promoters60/1664727
tattaaaa

SEQ ID NO: 121829 - DNA, 8 bp, Unknown
  misc_feature (1)..( 8): Result.002 file - promoters60/1664727
aaagttga

SEQ ID NO: 121830 - DNA, 8 bp, Unknown
  misc_feature (1)..( 8): Result.002 file - promoters60/1664727
aaagttga

SEQ ID NO: 121831 - DNA, 8 bp, Unknown
  misc_feature (1)..( 8): Result.002 file - promoters60/1664727
caagtaaa

SEQ ID NO: 121832 - DNA, 8 bp, Unknown
  misc_feature (1)..( 8): Result.002 file - promoters60/1664727
aaagaaaa

SEQ ID NO: 121833 - DNA, 8 bp, Unknown
  misc_feature (1)..( 8): Result.002 file - promoters60/1664727
aaagaata

SEQ ID NO: 121834 - DNA, 8 bp, Unknown
  misc_feature (1)..( 8): Result.002 file - promoters60/1664727
aaatgaat

SEQ ID NO: 121835 - DNA, 8 bp, Unknown
  misc_feature (1)..( 8): Result.002 file - promoters60/1664727
aaataaat

SEQ ID NO: 121836 - DNA, 7 bp, Unknown
  misc_feature (1)..( 7): Result.002 file - promoters60/1664727
ataacaa

SEQ ID NO: 121837 - DNA, 7 bp, Unknown
  misc_feature (1)..( 7): Result.002 file - promoters60/1664727
ataccaa

SEQ ID NO: 121838 - DNA, 7 bp, Unknown
  misc_feature (1)..( 7): Result.002 file - promoters60/1664727
tgtattt

SEQ ID NO: 121839 - DNA, 7 bp, Unknown
  misc_feature (1)..( 7): Result.002 file - promoters60/1664727
tgttttt

SEQ ID NO: 121840 - DNA, 8 bp, Unknown
  misc_feature (1)..( 8): Result.002 file - promoters60/1664727
tggaaagg

SEQ ID NO: 121841 - DNA, 8 bp, Unknown
  misc_feature (1)..( 8): Result.002 file - promoters60/1664727
tggtaagg

SEQ ID NO: 121842 - DNA, 6 bp, Unknown
  misc_feature (1)..( 6): Result.002 file - promoters60/1664727
aaagtt

SEQ ID NO: 121843 - DNA, 6 bp, Unknown
  misc_feature (1)..( 6): Result.002 file - promoters60/1664727
aaagtt

SEQ ID NO: 121844 - DNA, 7 bp, Unknown
  misc_feature (1)..( 7): Result.002 file - promoters60/1664727
gtgaaaa

SEQ ID NO: 121845 - DNA, 7 bp, Unknown
  misc_feature (1)..( 7): Result.002 file - promoters60/1664727
gtggaaa

SEQ ID NO: 121846 - DNA, 8 bp, Unknown
  misc_feature (1)..( 8): Result.002 file - promoters60/1664727
caatgtaa

SEQ ID NO: 121847 - DNA, 8 bp, Unknown
  misc_feature (1)..( 8): Result.002 file - promoters60/1664727
caatttaa

SEQ ID NO: 121848 - DNA, 8 bp, Unknown
  misc_feature (1)..( 8): Result.002 file - promoters60/1664727
tttagctt

SEQ ID NO: 121849 - DNA, 8 bp, Unknown
  misc_feature (1)..( 8): Result.002 file - promoters60/1664727
tttatctt

SEQ ID NO: 121850 - DNA, 6 bp, Unknown
  misc_feature (1)..( 6): Result.002 file - promoters60/1664727
gaatta

SEQ ID NO: 121851 - DNA, 6 bp, Unknown
  misc_feature (1)..( 6): Result.002 file - promoters60/1664727
gaatta

SEQ ID NO: 121852 - DNA, 6 bp, Unknown
  misc_feature (1)..( 6): Result.002 file - promoters60/1664727
gcggaa

SEQ ID NO: 121853 - DNA, 6 bp, Unknown
  misc_feature (1)..( 6): Result.002 file - promoters60/1664727
gcggaa

SEQ ID NO: 121854 - DNA, 7 bp, Unknown
  misc_feature (1)..( 7): Result.002 file - promoters60/1664727
tattttc

SEQ ID NO: 121855 - DNA, 7 bp, Unknown
  misc_feature (1)..( 7): Result.002 file - promoters60/1664727
tatcttc

SEQ ID NO: 121856 - DNA, 6 bp, Unknown
  misc_feature (1)..( 6): Result.002 file - promoters60/1664727
tccttg

SEQ ID NO: 121857 - DNA, 6 bp, Unknown
  misc_feature (1)..( 6): Result.002 file - promoters60/1664727
tccttg

SEQ ID NO: 121858 - DNA, 7 bp, Unknown
  misc_feature (1)..( 7): Result.002 file - promoters60/1664727
gatatat

SEQ ID NO: 121859 - DNA, 7 bp, Unknown
  misc_feature (1)..( 7): Result.002 file - promoters60/1664727
gatgtat

SEQ ID NO: 121860 - DNA, 10 bp, Unknown
  misc_feature (1)..( 10): Result.002 file - promoters60/1664731
tttttagatt

SEQ ID NO: 121861 - DNA, 10 bp, Unknown
  misc_feature (1)..( 10): Result.002 file - promoters60/1664731
ggcttagatt

SEQ ID NO: 121862 - DNA, 10 bp, Unknown
  misc_feature (1)..( 10): Result.002 file - promoters60/1664731
ggctttgatg

SEQ ID NO: 121863 - DNA, 6 bp, Unknown
  misc_feature (1)..( 6): Result.002 file - promoters60/1664731
tttttt

SEQ ID NO: 121864 - DNA, 6 bp, Unknown
  misc_feature (1)..( 6): Result.002 file - promoters60/1664731
tttttt

SEQ ID NO: 121865 - DNA, 6 bp, Unknown
  misc_feature (1)..( 6): Result.002 file - promoters60/1664731
aaatat

SEQ ID NO: 121866 - DNA, 6 bp, Unknown
  misc_feature (1)..( 6): Result.002 file - promoters60/1664731
aaatat

SEQ ID NO: 121867 - DNA, 8 bp, Unknown
  misc_feature (1)..( 8): Result.002 file - promoters60/1664731
aaatctca

SEQ ID NO: 121868 - DNA, 8 bp, Unknown
  misc_feature (1)..( 8): Result.002 file - promoters60/1664731
aaatatca

SEQ ID NO: 121869 - DNA, 6 bp, Unknown
  misc_feature (1)..( 6): Result.002 file - promoters60/1664731
acacat

SEQ ID NO: 121870 - DNA, 6 bp, Unknown
  misc_feature (1)..( 6): Result.002 file - promoters60/1664731
acacat

SEQ ID NO: 121871 - DNA, 7 bp, Unknown
  misc_feature (1)..( 7): Result.002 file - promoters60/1664731
atgatta

SEQ ID NO: 121872 - DNA, 7 bp, Unknown
  misc_feature (1)..( 7): Result.002 file - promoters60/1664731
atgatta

SEQ ID NO: 121873 - DNA, 8 bp, Unknown
  misc_feature (1)..( 8): Result.002 file - promoters60/1664731
aatgggcc

SEQ ID NO: 121874 - DNA, 8 bp, Unknown
  misc_feature (1)..( 8): Result.002 file - promoters60/1664731
aatgggcc

SEQ ID NO: 121875 - DNA, 7 bp, Unknown
  misc_feature (1)..( 7): Result.002 file - promoters60/1664731
atgatat

SEQ ID NO: 121876 - DNA, 7 bp, Unknown
  misc_feature (1)..( 7): Result.002 file - promoters60/1664731
atgatat

SEQ ID NO: 121877 - DNA, 6 bp, Unknown
  misc_feature (1)..( 6): Result.002 file - promoters60/1664731
ttttaa

SEQ ID NO: 121878 - DNA, 6 bp, Unknown
  misc_feature (1)..( 6): Result.002 file - promoters60/1664731
ttttaa

SEQ ID NO: 121879 - DNA, 7 bp, Unknown
  misc_feature (1)..( 7): Result.002 file - promoters60/1664731
ttttaga

SEQ ID NO: 121880 - DNA, 7 bp, Unknown
  misc_feature (1)..( 7): Result.002 file - promoters60/1664731
tttgaga

SEQ ID NO: 121881 - DNA, 7 bp, Unknown
  misc_feature (1)..( 7): Result.002 file - promoters60/1664731
gtaaaat

SEQ ID NO: 121882 - DNA, 7 bp, Unknown
  misc_feature (1)..( 7): Result.002 file - promoters60/1664731
gtaaaat

SEQ ID NO: 121883 - DNA, 8 bp, Unknown
  misc_feature (1)..( 8): Result.002 file - promoters60/1664870
tttgattc

SEQ ID NO: 121884 - DNA, 8 bp, Unknown
  misc_feature (1)..( 8): Result.002 file - promoters60/1664870
attgattc

SEQ ID NO: 121885 - DNA, 8 bp, Unknown
  misc_feature (1)..( 8): Result.002 file - promoters60/1664870
tttgtttc

SEQ ID NO: 121886 - DNA, 7 bp, Unknown
  misc_feature (1)..( 7): Result.002 file - promoters60/1664870
tacaaat

SEQ ID NO: 121887 - DNA, 7 bp, Unknown
  misc_feature (1)..( 7): Result.002 file - promoters60/1664870
aacaaat

SEQ ID NO: 121888 - DNA, 7 bp, Unknown
  misc_feature (1)..( 7): Result.002 file - promoters60/1664870
aacaaac

SEQ ID NO: 121889 - DNA, 9 bp, Unknown
  misc_feature (1)..( 9): Result.002 file - promoters60/1664870
taagtaaaa

SEQ ID NO: 121890 - DNA, 9 bp, Unknown
  misc_feature (1)..( 9): Result.002 file - promoters60/1664870
taactaaaa

SEQ ID NO: 121891 - DNA, 9 bp, Unknown
  misc_feature (1)..( 9): Result.002 file - promoters60/1664870
taatgactt

SEQ ID NO: 121892 - DNA, 8 bp, Unknown
  misc_feature (1)..( 8): Result.002 file - promoters60/1664870
taaaaacc

SEQ ID NO: 121893 - DNA, 8 bp, Unknown
  misc_feature (1)..( 8): Result.002 file - promoters60/1664870
taataact

SEQ ID NO: 121894 - DNA, 8 bp, Unknown
  misc_feature (1)..( 8): Result.002 file - promoters60/1664870
taatgact

SEQ ID NO: 121895 - DNA, 14 bp, Unknown
  misc_feature (1)..( 14): Result.002 file - promoters60/1664931
aaagcaaaacacat

SEQ ID NO: 121896 - DNA, 14 bp, Unknown
  misc_feature (1)..( 14): Result.002 file - promoters60/1664931
tccacaaaacatcc

SEQ ID NO: 121897 - DNA, 14 bp, Unknown
  misc_feature (1)..( 14): Result.002 file - promoters60/1664931
tacataaaacaaaa

SEQ ID NO: 121898 - DNA, 14 bp, Unknown
  misc_feature (1)..( 14): Result.002 file - promoters60/1664931
tggagcaaataaat

SEQ ID NO: 121899 - DNA, 14 bp, Unknown
  misc_feature (1)..( 14): Result.002 file - promoters60/1664931
tccacgaaactact

SEQ ID NO: 121900 - DNA, 14 bp, Unknown
  misc_feature (1)..( 14): Result.002 file - promoters60/1664931
tccacgcccaaatc

SEQ ID NO: 121901 - DNA, 8 bp, Unknown
  misc_feature (1)..( 8): Result.002 file - promoters60/1665056
ttttttct

SEQ ID NO: 121902 - DNA, 8 bp, Unknown
  misc_feature (1)..( 8): Result.002 file - promoters60/1665056
aattttct

SEQ ID NO: 121903 - DNA, 8 bp, Unknown
  misc_feature (1)..( 8): Result.002 file - promoters60/1665056
aattttca

SEQ ID NO: 121904 - DNA, 12 bp, Unknown
  misc_feature (1)..( 12): Result.002 file - promoters60/1665056
cataaaattcaa

SEQ ID NO: 121905 - DNA, 12 bp, Unknown
  misc_feature (1)..( 12): Result.002 file - promoters60/1665056
tctaatattcaa

SEQ ID NO: 121906 - DNA, 12 bp, Unknown
  misc_feature (1)..( 12): Result.002 file - promoters60/1665056
tataaaaaattg

SEQ ID NO: 121907 - DNA, 12 bp, Unknown
  misc_feature (1)..( 12): Result.002 file - promoters60/1665056
tatcaaatgaca

SEQ ID NO: 121908 - DNA, 14 bp, Unknown
  misc_feature (1)..( 14): Result.002 file - promoters60/1665056
tggaaaaaaataac

SEQ ID NO: 121909 - DNA, 14 bp, Unknown
  misc_feature (1)..( 14): Result.002 file - promoters60/1665056
tacaaagaaataac

SEQ ID NO: 121910 - DNA, 14 bp, Unknown
  misc_feature (1)..( 14): Result.002 file - promoters60/1665056
ttataaaaaattga

SEQ ID NO: 121911 - DNA, 14 bp, Unknown
  misc_feature (1)..( 14): Result.002 file - promoters60/1665056
tatacaaaagcttc

SEQ ID NO: 121912 - DNA, 9 bp, Unknown
  misc_feature (1)..( 9): Result.002 file - promoters60/1665056
cttaagtca

SEQ ID NO: 121913 - DNA, 9 bp, Unknown
  misc_feature (1)..( 9): Result.002 file - promoters60/1665056
cttaattca

SEQ ID NO: 121914 - DNA, 9 bp, Unknown
  misc_feature (1)..( 9): Result.002 file - promoters60/1665056
attaattaa

SEQ ID NO: 121915 - DNA, 8 bp, Unknown
  misc_feature (1)..( 8): Result.002 file - promoters60/1665056
tttaccag

SEQ ID NO: 121916 - DNA, 8 bp, Unknown
  misc_feature (1)..( 8): Result.002 file - promoters60/1665056
tttgccag

SEQ ID NO: 121917 - DNA, 8 bp, Unknown
  misc_feature (1)..( 8): Result.002 file - promoters60/1665056
tttgtacg

SEQ ID NO: 121918 - DNA, 7 bp, Unknown
  misc_feature (1)..( 7): Result.002 file - promoters60/1665080
tttgtta

SEQ ID NO: 121919 - DNA, 7 bp, Unknown
  misc_feature (1)..( 7): Result.002 file - promoters60/1665080
tttgttt

SEQ ID NO: 121920 - DNA, 7 bp, Unknown
  misc_feature (1)..( 7): Result.002 file - promoters60/1665080
tttctta

SEQ ID NO: 121921 - DNA, 9 bp, Unknown
  misc_feature (1)..( 9): Result.002 file - promoters60/1665080
cttgatttg

SEQ ID NO: 121922 - DNA, 9 bp, Unknown
  misc_feature (1)..( 9): Result.002 file - promoters60/1665080
ctttatttg

SEQ ID NO: 121923 - DNA, 10 bp, Unknown
  misc_feature (1)..( 10): Result.002 file - promoters60/1665080
tccctttttt

SEQ ID NO: 121924 - DNA, 10 bp, Unknown
  misc_feature (1)..( 10): Result.002 file - promoters60/1665080
cttctttttt

SEQ ID NO: 121925 - DNA, 10 bp, Unknown
  misc_feature (1)..( 10): Result.002 file - promoters60/1665080
tcccttttgg

SEQ ID NO: 121926 - DNA, 7 bp, Unknown
  misc_feature (1)..( 7): Result.002 file - promoters60/1665080
aaggata

SEQ ID NO: 121927 - DNA, 7 bp, Unknown
  misc_feature (1)..( 7): Result.002 file - promoters60/1665080
aaggata

SEQ ID NO: 121928 - DNA, 9 bp, Unknown
  misc_feature (1)..( 9): Result.002 file - promoters60/1665080
agcaaaaaa

SEQ ID NO: 121929 - DNA, 9 bp, Unknown
  misc_feature (1)..( 9): Result.002 file - promoters60/1665080
agcagaaaa

SEQ ID NO: 121930 - DNA, 9 bp, Unknown
  misc_feature (1)..( 9): Result.002 file - promoters60/1665080
atgttcttt

SEQ ID NO: 121931 - DNA, 9 bp, Unknown
  misc_feature (1)..( 9): Result.002 file - promoters60/1665080
atgttattt

SEQ ID NO: 121932 - DNA, 6 bp, Unknown
  misc_feature (1)..( 6): Result.002 file - promoters60/1665080
tataca

SEQ ID NO: 121933 - DNA, 6 bp, Unknown
  misc_feature (1)..( 6): Result.002 file - promoters60/1665080
tataca

SEQ ID NO: 121934 - DNA, 9 bp, Unknown
  misc_feature (1)..( 9): Result.002 file - promoters60/1665080
attcaacta

SEQ ID NO: 121935 - DNA, 9 bp, Unknown
  misc_feature (1)..( 9): Result.002 file - promoters60/1665080
attaaacta

SEQ ID NO: 121936 - DNA, 9 bp, Unknown
  misc_feature (1)..( 9): Result.002 file - promoters60/1665080
tttaaacca

SEQ ID NO: 121937 - DNA, 6 bp, Unknown
  misc_feature (1)..( 6): Result.002 file - promoters60/1665080
tttttc

SEQ ID NO: 121938 - DNA, 6 bp, Unknown
  misc_feature (1)..( 6): Result.002 file - promoters60/1665080
tttttc

SEQ ID NO: 121939 - DNA, 6 bp, Unknown
  misc_feature (1)..( 6): Result.002 file - promoters60/1665080
ggaaca

SEQ ID NO: 121940 - DNA, 6 bp, Unknown
  misc_feature (1)..( 6): Result.002 file - promoters60/1665080
ggaaca

SEQ ID NO: 121941 - DNA, 10 bp, Unknown
  misc_feature (1)..( 10): Result.002 file - promoters60/1665080
gaacatgttc

SEQ ID NO: 121942 - DNA, 10 bp, Unknown
  misc_feature (1)..( 10): Result.002 file - promoters60/1665080
gaacatgttc

SEQ ID NO: 121943 - DNA, 9 bp, Unknown
  misc_feature (1)..( 9): Result.002 file - promoters60/1665080
aatatttat

SEQ ID NO: 121944 - DNA, 9 bp, Unknown
  misc_feature (1)..( 9): Result.002 file - promoters60/1665080
aatagttat

SEQ ID NO: 121945 - DNA, 9 bp, Unknown
  misc_feature (1)..( 9): Result.002 file - promoters60/1665080
tcttccaag

SEQ ID NO: 121946 - DNA, 9 bp, Unknown
  misc_feature (1)..( 9): Result.002 file - promoters60/1665080
tcttccaag

SEQ ID NO: 121947 - DNA, 7 bp, Unknown
  misc_feature (1)..( 7): Result.002 file - promoters60/1665080
tagataa

SEQ ID NO: 121948 - DNA, 7 bp, Unknown
  misc_feature (1)..( 7): Result.002 file - promoters60/1665080
taggtaa

SEQ ID NO: 121949 - DNA, 6 bp, Unknown
  misc_feature (1)..( 6): Result.002 file - promoters60/1665080
cttttt

SEQ ID NO: 121950 - DNA, 6 bp, Unknown
  misc_feature (1)..( 6): Result.002 file - promoters60/1665080
cttttt

SEQ ID NO: 121951 - DNA, 7 bp, Unknown
  misc_feature (1)..( 7): Result.002 file - promoters60/1665080
tacaaaa

SEQ ID NO: 121952 - DNA, 7 bp, Unknown
  misc_feature (1)..( 7): Result.002 file - promoters60/1665080
tacaaaa

SEQ ID NO: 121953 - DNA, 7 bp, Unknown
  misc_feature (1)..( 7): Result.002 file - promoters60/1665080
gcaaaaa

SEQ ID NO: 121954 - DNA, 7 bp, Unknown
  misc_feature (1)..( 7): Result.002 file - promoters60/1665080
gcaaaaa

SEQ ID NO: 121955 - DNA, 7 bp, Unknown
  misc_feature (1)..( 7): Result.002 file - promoters60/1665080
tttgttt

SEQ ID NO: 121956 - DNA, 7 bp, Unknown
  misc_feature (1)..( 7): Result.002 file - promoters60/1665080
tttgttt

SEQ ID NO: 121957 - DNA, 6 bp, Unknown
  misc_feature (1)..( 6): Result.002 file - promoters60/1665080
ttcttt

SEQ ID NO: 121958 - DNA, 6 bp, Unknown
  misc_feature (1)..( 6): Result.002 file - promoters60/1665080
ttcttt

SEQ ID NO: 121959 - DNA, 12 bp, Unknown
  misc_feature (1)..( 12): Result.002 file - promoters60/1665080
aaaaatatatat

SEQ ID NO: 121960 - DNA, 12 bp, Unknown
  misc_feature (1)..( 12): Result.002 file - promoters60/1665080
aaaaatatttat

SEQ ID NO: 121961 - DNA, 6 bp, Unknown
  misc_feature (1)..( 6): Result.002 file - promoters60/1665080
gggcct

SEQ ID NO: 121962 - DNA, 6 bp, Unknown
  misc_feature (1)..( 6): Result.002 file - promoters60/1665080
gggcct

SEQ ID NO: 121963 - DNA, 6 bp, Unknown
  misc_feature (1)..( 6): Result.002 file - promoters60/1665112
ttttat

SEQ ID NO: 121964 - DNA, 6 bp, Unknown
  misc_feature (1)..( 6): Result.002 file - promoters60/1665112
ttttat

SEQ ID NO: 121965 - DNA, 6 bp, Unknown
  misc_feature (1)..( 6): Result.002 file - promoters60/1665112
gtcatt

SEQ ID NO: 121966 - DNA, 6 bp, Unknown
  misc_feature (1)..( 6): Result.002 file - promoters60/1665112
gtcatt

SEQ ID NO: 121967 - DNA, 9 bp, Unknown
  misc_feature (1)..( 9): Result.002 file - promoters60/1665112
ttaaaaaca

SEQ ID NO: 121968 - DNA, 9 bp, Unknown
  misc_feature (1)..( 9): Result.002 file - promoters60/1665112
ttagaaaca

SEQ ID NO: 121969 - DNA, 7 bp, Unknown
  misc_feature (1)..( 7): Result.002 file - promoters60/1665112
aaagatt

SEQ ID NO: 121970 - DNA, 7 bp, Unknown
  misc_feature (1)..( 7): Result.002 file - promoters60/1665112
aaagatt

SEQ ID NO: 121971 - DNA, 6 bp, Unknown
  misc_feature (1)..( 6): Result.002 file - promoters60/1665112
tttaaa

SEQ ID NO: 121972 - DNA, 6 bp, Unknown
  misc_feature (1)..( 6): Result.002 file - promoters60/1665112
tttaaa

SEQ ID NO: 121973 - DNA, 6 bp, Unknown
  misc_feature (1)..( 6): Result.002 file - promoters60/1665112
ttttta

SEQ ID NO: 121974 - DNA, 6 bp, Unknown
  misc_feature (1)..( 6): Result.002 file - promoters60/1665112
ttttta

SEQ ID NO: 121975 - DNA, 7 bp, Unknown
  misc_feature (1)..( 7): Result.002 file - promoters60/1665112
aagtttt

SEQ ID NO: 121976 - DNA, 7 bp, Unknown
  misc_feature (1)..( 7): Result.002 file - promoters60/1665112
aagattt

SEQ ID NO: 121977 - DNA, 7 bp, Unknown
  misc_feature (1)..( 7): Result.002 file - promoters60/1665112
ataattt

SEQ ID NO: 121978 - DNA, 7 bp, Unknown
  misc_feature (1)..( 7): Result.002 file - promoters60/1665112
atatttt

SEQ ID NO: 121979 - DNA, 8 bp, Unknown
  misc_feature (1)..( 8): Result.002 file - promoters60/1665112
aaggaaag

SEQ ID NO: 121980 - DNA, 8 bp, Unknown
  misc_feature (1)..( 8): Result.002 file - promoters60/1665112
aaggtaag

SEQ ID NO: 121981 - DNA, 6 bp, Unknown
  misc_feature (1)..( 6): Result.002 file - promoters60/1665112
atttat

SEQ ID NO: 121982 - DNA, 6 bp, Unknown
  misc_feature (1)..( 6): Result.002 file - promoters60/1665112
atttat

SEQ ID NO: 121983 - DNA, 6 bp, Unknown
  misc_feature (1)..( 6): Result.002 file - promoters60/1665112
atgatc

SEQ ID NO: 121984 - DNA, 6 bp, Unknown
  misc_feature (1)..( 6): Result.002 file - promoters60/1665112
atgatc

SEQ ID NO: 121985 - DNA, 7 bp, Unknown
  misc_feature (1)..( 7): Result.002 file - promoters60/1665112
gttggag

SEQ ID NO: 121986 - DNA, 7 bp, Unknown
  misc_feature (1)..( 7): Result.002 file - promoters60/1665112
gttagag

SEQ ID NO: 121987 - DNA, 6 bp, Unknown
  misc_feature (1)..( 6): Result.002 file - promoters60/1665112
tcatat

SEQ ID NO: 121988 - DNA, 6 bp, Unknown
  misc_feature (1)..( 6): Result.002 file - promoters60/1665112
tcatat

SEQ ID NO: 121989 - DNA, 7 bp, Unknown
  misc_feature (1)..( 7): Result.002 file - promoters60/1665112
ttaggtg

SEQ ID NO: 121990 - DNA, 7 bp, Unknown
  misc_feature (1)..( 7): Result.002 file - promoters60/1665112
ttatgtg

SEQ ID NO: 121991 - DNA, 8 bp, Unknown
  misc_feature (1)..( 8): Result.002 file - promoters60/1665112
atatatac

SEQ ID NO: 121992 - DNA, 8 bp, Unknown
  misc_feature (1)..( 8): Result.002 file - promoters60/1665112
atacatac

SEQ ID NO: 121993 - DNA, 6 bp, Unknown
  misc_feature (1)..( 6): Result.002 file - promoters60/1665112
ttcaaa

SEQ ID NO: 121994 - DNA, 6 bp, Unknown
  misc_feature (1)..( 6): Result.002 file - promoters60/1665112
ttcaaa

SEQ ID NO: 121995 - DNA, 9 bp, Unknown
  misc_feature (1)..( 9): Result.002 file - promoters60/1673798
aaactaaaa

SEQ ID NO: 121996 - DNA, 9 bp, Unknown
  misc_feature (1)..( 9): Result.002 file - promoters60/1673798
aaaataaaa

SEQ ID NO: 121997 - DNA, 9 bp, Unknown
  misc_feature (1)..( 9): Result.002 file - promoters60/1673798
aaagtaaac

SEQ ID NO: 121998 - DNA, 9 bp, Unknown
  misc_feature (1)..( 9): Result.002 file - promoters60/1673798
gcaataaat

SEQ ID NO: 121999 - DNA, 9 bp, Unknown
  misc_feature (1)..( 9): Result.002 file - promoters60/1673798
aaacaaaat

SEQ ID NO: 122000 - DNA, 7 bp, Unknown
  misc_feature (1)..( 7): Result.002 file - promoters60/1673806
ttcttta

SEQ ID NO: 122001 - DNA, 7 bp, Unknown
  misc_feature (1)..( 7): Result.002 file - promoters60/1673806
ttcgtta

SEQ ID NO: 122002 - DNA, 7 bp, Unknown
  misc_feature (1)..( 7): Result.002 file - promoters60/1673806
ttttttt

SEQ ID NO: 122003 - DNA, 7 bp, Unknown
  misc_feature (1)..( 7): Result.002 file - promoters60/1673806
ctcgtta

SEQ ID NO: 122004 - DNA, 8 bp, Unknown
  misc_feature (1)..( 8): Result.002 file - promoters60/1673806
taaaaaat

SEQ ID NO: 122005 - DNA, 8 bp, Unknown
  misc_feature (1)..( 8): Result.002 file - promoters60/1673806
aaaataat

SEQ ID NO: 122006 - DNA, 8 bp, Unknown
  misc_feature (1)..( 8): Result.002 file - promoters60/1673806
taaagaat

SEQ ID NO: 122007 - DNA, 8 bp, Unknown
  misc_feature (1)..( 8): Result.002 file - promoters60/1673806
tgaaaaat

SEQ ID NO: 122008 - DNA, 11 bp, Unknown
  misc_feature (1)..( 11): Result.002 file - promoters60/1673806
cgacaattttg

SEQ ID NO: 122009 - DNA, 11 bp, Unknown
  misc_feature (1)..( 11): Result.002 file - promoters60/1673806
atacaattttg

SEQ ID NO: 122010 - DNA, 11 bp, Unknown
  misc_feature (1)..( 11): Result.002 file - promoters60/1673806
tgaaaatttta

SEQ ID NO: 122011 - DNA, 11 bp, Unknown
  misc_feature (1)..( 11): Result.002 file - promoters60/1673806
atagaatcctt

SEQ ID NO: 122012 - DNA, 11 bp, Unknown
  misc_feature (1)..( 11): Result.002 file - promoters60/1673806
aaataaattat

SEQ ID NO: 122013 - DNA, 11 bp, Unknown
  misc_feature (1)..( 11): Result.002 file - promoters60/1673806
acataatttat

SEQ ID NO: 122014 - DNA, 11 bp, Unknown
  misc_feature (1)..( 11): Result.002 file - promoters60/1673806
tcataattcga

SEQ ID NO: 122015 - DNA, 11 bp, Unknown
  misc_feature (1)..( 11): Result.002 file - promoters60/1673806
acattattgat

SEQ ID NO: 122016 - DNA, 8 bp, Unknown
  misc_feature (1)..( 8): Result.002 file - promoters60/1673826
ttctgatt

SEQ ID NO: 122017 - DNA, 8 bp, Unknown
  misc_feature (1)..( 8): Result.002 file - promoters60/1673826
ttctgatt

SEQ ID NO: 122018 - DNA, 8 bp, Unknown
  misc_feature (1)..( 8): Result.002 file - promoters60/1673826
atagattc

SEQ ID NO: 122019 - DNA, 8 bp, Unknown
  misc_feature (1)..( 8): Result.002 file - promoters60/1673826
ataggttc

SEQ ID NO: 122020 - DNA, 6 bp, Unknown
  misc_feature (1)..( 6): Result.002 file - promoters60/1673826
tttgta

SEQ ID NO: 122021 - DNA, 6 bp, Unknown
  misc_feature (1)..( 6): Result.002 file - promoters60/1673826
tttgta

SEQ ID NO: 122022 - DNA, 6 bp, Unknown
  misc_feature (1)..( 6): Result.002 file - promoters60/1673826
attatt

SEQ ID NO: 122023 - DNA, 6 bp, Unknown
  misc_feature (1)..( 6): Result.002 file - promoters60/1673826
attatt

SEQ ID NO: 122024 - DNA, 6 bp, Unknown
  misc_feature (1)..( 6): Result.002 file - promoters60/1673826
gtcaaa

SEQ ID NO: 122025 - DNA, 6 bp, Unknown
  misc_feature (1)..( 6): Result.002 file - promoters60/1673826
gtcaaa

SEQ ID NO: 122026 - DNA, 8 bp, Unknown
  misc_feature (1)..( 8): Result.002 file - promoters60/1673826
ttgaactt

SEQ ID NO: 122027 - DNA, 8 bp, Unknown
  misc_feature (1)..( 8): Result.002 file - promoters60/1673826
ttgaactt

SEQ ID NO: 122028 - DNA, 8 bp, Unknown
  misc_feature (1)..( 8): Result.002 file - promoters60/1673826
ttagtaat

SEQ ID NO: 122029 - DNA, 8 bp, Unknown
  misc_feature (1)..( 8): Result.002 file - promoters60/1673826
ttattaat

SEQ ID NO: 122030 - DNA, 7 bp, Unknown
  misc_feature (1)..( 7): Result.002 file - promoters60/1673826
tatataa

SEQ ID NO: 122031 - DNA, 7 bp, Unknown
  misc_feature (1)..( 7): Result.002 file - promoters60/1673826
tatttaa

SEQ ID NO: 122032 - DNA, 6 bp, Unknown
  misc_feature (1)..( 6): Result.002 file - promoters60/1673826
taaatt

SEQ ID NO: 122033 - DNA, 6 bp, Unknown
  misc_feature (1)..( 6): Result.002 file - promoters60/1673826
taaatt

SEQ ID NO: 122034 - DNA, 6 bp, Unknown
  misc_feature (1)..( 6): Result.002 file - promoters60/1673826
aaatat

SEQ ID NO: 122035 - DNA, 6 bp, Unknown
  misc_feature (1)..( 6): Result.002 file - promoters60/1673826
aaatat

SEQ ID NO: 122036 - DNA, 8 bp, Unknown
  misc_feature (1)..( 8): Result.002 file - promoters60/1673826
tataacaa

SEQ ID NO: 122037 - DNA, 8 bp, Unknown
  misc_feature (1)..( 8): Result.002 file - promoters60/1673826
tatcacaa

SEQ ID NO: 122038 - DNA, 7 bp, Unknown
  misc_feature (1)..( 7): Result.002 file - promoters60/1673826
aagtaat

SEQ ID NO: 122039 - DNA, 7 bp, Unknown
  misc_feature (1)..( 7): Result.002 file - promoters60/1673826
aagaaat

SEQ ID NO: 122040 - DNA, 6 bp, Unknown
  misc_feature (1)..( 6): Result.002 file - promoters60/1673826
attttt

SEQ ID NO: 122041 - DNA, 6 bp, Unknown
  misc_feature (1)..( 6): Result.002 file - promoters60/1673826
attttt

SEQ ID NO: 122042 - DNA, 7 bp, Unknown
  misc_feature (1)..( 7): Result.002 file - promoters60/1673826
aaagata

SEQ ID NO: 122043 - DNA, 7 bp, Unknown
  misc_feature (1)..( 7): Result.002 file - promoters60/1673826
aaaaata

SEQ ID NO: 122044 - DNA, 9 bp, Unknown
  misc_feature (1)..( 9): Result.002 file - promoters60/1673847
aaataaaat

SEQ ID NO: 122045 - DNA, 9 bp, Unknown
  misc_feature (1)..( 9): Result.002 file - promoters60/1673847
aaataaaat

SEQ ID NO: 122046 - DNA, 8 bp, Unknown
  misc_feature (1)..( 8): Result.002 file - promoters60/1673847
attaaaaa

SEQ ID NO: 122047 - DNA, 8 bp, Unknown
  misc_feature (1)..( 8): Result.002 file - promoters60/1673847
attgaaaa

SEQ ID NO: 122048 - DNA, 10 bp, Unknown
  misc_feature (1)..( 10): Result.002 file - promoters60/1673847
gtaataacac

SEQ ID NO: 122049 - DNA, 10 bp, Unknown
  misc_feature (1)..( 10): Result.002 file - promoters60/1673847
gtaatgacac

SEQ ID NO: 122050 - DNA, 6 bp, Unknown
  misc_feature (1)..( 6): Result.002 file - promoters60/1673847
taaaaa

SEQ ID NO: 122051 - DNA, 6 bp, Unknown
  misc_feature (1)..( 6): Result.002 file - promoters60/1673847
taaaaa

SEQ ID NO: 122052 - DNA, 6 bp, Unknown
  misc_feature (1)..( 6): Result.002 file - promoters60/1673847
gattaa

SEQ ID NO: 122053 - DNA, 6 bp, Unknown
  misc_feature (1)..( 6): Result.002 file - promoters60/1673847
gattaa

SEQ ID NO: 122054 - DNA, 7 bp, Unknown
  misc_feature (1)..( 7): Result.002 file - promoters60/1673847
aatataa

SEQ ID NO: 122055 - DNA, 7 bp, Unknown
  misc_feature (1)..( 7): Result.002 file - promoters60/1673847
aatttaa

SEQ ID NO: 122056 - DNA, 11 bp, Unknown
  misc_feature (1)..( 11): Result.002 file - promoters60/1673847
atacatcttta

SEQ ID NO: 122057 - DNA, 11 bp, Unknown
  misc_feature (1)..( 11): Result.002 file - promoters60/1673847
atagatcttat

SEQ ID NO: 122058 - DNA, 11 bp, Unknown
  misc_feature (1)..( 11): Result.002 file - promoters60/1673847
tctaatcttat

SEQ ID NO: 122059 - DNA, 7 bp, Unknown
  misc_feature (1)..( 7): Result.002 file - promoters60/1673847
ttcaata

SEQ ID NO: 122060 - DNA, 7 bp, Unknown
  misc_feature (1)..( 7): Result.002 file - promoters60/1673847
ttcaata

SEQ ID NO: 122061 - DNA, 8 bp, Unknown
  misc_feature (1)..( 8): Result.002 file - promoters60/1673847
atattttt

SEQ ID NO: 122062 - DNA, 8 bp, Unknown
  misc_feature (1)..( 8): Result.002 file - promoters60/1673847
atatgttt

SEQ ID NO: 122063 - DNA, 6 bp, Unknown
  misc_feature (1)..( 6): Result.002 file - promoters60/1673847
ctatct

SEQ ID NO: 122064 - DNA, 6 bp, Unknown
  misc_feature (1)..( 6): Result.002 file - promoters60/1673847
ctatct

SEQ ID NO: 122065 - DNA, 6 bp, Unknown
  misc_feature (1)..( 6): Result.002 file - promoters60/1673847
acttgt

SEQ ID NO: 122066 - DNA, 6 bp, Unknown
  misc_feature (1)..( 6): Result.002 file - promoters60/1673847
acttgt

SEQ ID NO: 122067 - DNA, 6 bp, Unknown
  misc_feature (1)..( 6): Result.002 file - promoters60/1673847
tataaa

SEQ ID NO: 122068 - DNA, 6 bp, Unknown
  misc_feature (1)..( 6): Result.002 file - promoters60/1673847
tataaa

SEQ ID NO: 122069 - DNA, 8 bp, Unknown
  misc_feature (1)..( 8): Result.002 file - promoters60/1673847
taaccttg

SEQ ID NO: 122070 - DNA, 8 bp, Unknown
  misc_feature (1)..( 8): Result.002 file - promoters60/1673847
taagcttg

SEQ ID NO: 122071 - DNA, 7 bp, Unknown
  misc_feature (1)..( 7): Result.002 file - promoters60/1673847
tttgtat

SEQ ID NO: 122072 - DNA, 7 bp, Unknown
  misc_feature (1)..( 7): Result.002 file - promoters60/1673847
tttgtat

SEQ ID NO: 122073 - DNA, 7 bp, Unknown
  misc_feature (1)..( 7): Result.002 file - promoters60/1673847
tctggtt

SEQ ID NO: 122074 - DNA, 7 bp, Unknown
  misc_feature (1)..( 7): Result.002 file - promoters60/1673847
tctggtt

SEQ ID NO: 122075 - DNA, 6 bp, Unknown
  misc_feature (1)..( 6): Result.002 file - promoters60/1673847
tttgag

SEQ ID NO: 122076 - DNA, 6 bp, Unknown
  misc_feature (1)..( 6): Result.002 file - promoters60/1673847
tttgag

SEQ ID NO: 122077 - DNA, 7 bp, Unknown
  misc_feature (1)..( 7): Result.002 file - promoters60/1673849
atagttt

SEQ ID NO: 122078 - DNA, 7 bp, Unknown
  misc_feature (1)..( 7): Result.002 file - promoters60/1673849
atatttt

SEQ ID NO: 122079 - DNA, 9 bp, Unknown
  misc_feature (1)..( 9): Result.002 file - promoters60/1673849
tcataaaaa

SEQ ID NO: 122080 - DNA, 9 bp, Unknown
  misc_feature (1)..( 9): Result.002 file - promoters60/1673849
tcatataaa

SEQ ID NO: 122081 - DNA, 7 bp, Unknown
  misc_feature (1)..( 7): Result.002 file - promoters60/1673849
aaaaatt

SEQ ID NO: 122082 - DNA, 7 bp, Unknown
  misc_feature (1)..( 7): Result.002 file - promoters60/1673849
aaacatt

SEQ ID NO: 122083 - DNA, 6 bp, Unknown
  misc_feature (1)..( 6): Result.002 file - promoters60/1673849
tatatt

SEQ ID NO: 122084 - DNA, 6 bp, Unknown
  misc_feature (1)..( 6): Result.002 file - promoters60/1673849
tatatt

SEQ ID NO: 122085 - DNA, 6 bp, Unknown
  misc_feature (1)..( 6): Result.002 file - promoters60/1673849
aaaatc

SEQ ID NO: 122086 - DNA, 6 bp, Unknown
  misc_feature (1)..( 6): Result.002 file - promoters60/1673849
aaaatc

SEQ ID NO: 122087 - DNA, 7 bp, Unknown
  misc_feature (1)..( 7): Result.002 file - promoters60/1673849
tgtctaa

SEQ ID NO: 122088 - DNA, 7 bp, Unknown
  misc_feature (1)..( 7): Result.002 file - promoters60/1673849
tgtataa

SEQ ID NO: 122089 - DNA, 6 bp, Unknown
  misc_feature (1)..( 6): Result.002 file - promoters60/1673849
acatca

SEQ ID NO: 122090 - DNA, 6 bp, Unknown
  misc_feature (1)..( 6): Result.002 file - promoters60/1673849
acatca

SEQ ID NO: 122091 - DNA, 9 bp, Unknown
  misc_feature (1)..( 9): Result.002 file - promoters60/1673849
tatataatt

SEQ ID NO: 122092 - DNA, 9 bp, Unknown
  misc_feature (1)..( 9): Result.002 file - promoters60/1673849
tatattatt

SEQ ID NO: 122093 - DNA, 9 bp, Unknown
  misc_feature (1)..( 9): Result.002 file - promoters60/1673849
tatcaaagg

SEQ ID NO: 122094 - DNA, 9 bp, Unknown
  misc_feature (1)..( 9): Result.002 file - promoters60/1673849
tattaaata

SEQ ID NO: 122095 - DNA, 9 bp, Unknown
  misc_feature (1)..( 9): Result.002 file - promoters60/1673849
aattacata

SEQ ID NO: 122096 - DNA, 7 bp, Unknown
  misc_feature (1)..( 7): Result.002 file - promoters60/1673849
aaaagtt

SEQ ID NO: 122097 - DNA, 7 bp, Unknown
  misc_feature (1)..( 7): Result.002 file - promoters60/1673849
aaaagtt

SEQ ID NO: 122098 - DNA, 6 bp, Unknown
  misc_feature (1)..( 6): Result.002 file - promoters60/1673849
ccacgt

SEQ ID NO: 122099 - DNA, 6 bp, Unknown
  misc_feature (1)..( 6): Result.002 file - promoters60/1673849
ccacgt

SEQ ID NO: 122100 - DNA, 6 bp, Unknown
  misc_feature (1)..( 6): Result.002 file - promoters60/1673849
tatatg

SEQ ID NO: 122101 - DNA, 6 bp, Unknown
  misc_feature (1)..( 6): Result.002 file - promoters60/1673849
tatatg

SEQ ID NO: 122102 - DNA, 6 bp, Unknown
  misc_feature (1)..( 6): Result.002 file - promoters60/1673849
tatttt

SEQ ID NO: 122103 - DNA, 6 bp, Unknown
  misc_feature (1)..( 6): Result.002 file - promoters60/1673849
tatttt

SEQ ID NO: 122104 - DNA, 6 bp, Unknown
  misc_feature (1)..( 6): Result.002 file - promoters60/1673849
aatcca

SEQ ID NO: 122105 - DNA, 6 bp, Unknown
  misc_feature (1)..( 6): Result.002 file - promoters60/1673849
aatcca

SEQ ID NO: 122106 - DNA, 7 bp, Unknown
  misc_feature (1)..( 7): Result.002 file - promoters60/1673849
gagtttt

SEQ ID NO: 122107 - DNA, 7 bp, Unknown
  misc_feature (1)..( 7): Result.002 file - promoters60/1673849
gagattt

SEQ ID NO: 122108 - DNA, 6 bp, Unknown
  misc_feature (1)..( 6): Result.002 file - promoters60/1673849
acaaaa

SEQ ID NO: 122109 - DNA, 6 bp, Unknown
  misc_feature (1)..( 6): Result.002 file - promoters60/1673849
acaaaa

SEQ ID NO: 122110 - DNA, 7 bp, Unknown
  misc_feature (1)..( 7): Result.002 file - promoters60/1673849
tttacgt

SEQ ID NO: 122111 - DNA, 7 bp, Unknown
  misc_feature (1)..( 7): Result.002 file - promoters60/1673849
ttttcgt

SEQ ID NO: 122112 - DNA, 8 bp, Unknown
  misc_feature (1)..( 8): Result.002 file - promoters60/1673849
tctcgttc

SEQ ID NO: 122113 - DNA, 8 bp, Unknown
  misc_feature (1)..( 8): Result.002 file - promoters60/1673849
tctctttc

SEQ ID NO: 122114 - DNA, 6 bp, Unknown
  misc_feature (1)..( 6): Result.002 file - promoters60/1673853
ttaaag

SEQ ID NO: 122115 - DNA, 6 bp, Unknown
  misc_feature (1)..( 6): Result.002 file - promoters60/1673853
ttaaag

SEQ ID NO: 122116 - DNA, 9 bp, Unknown
  misc_feature (1)..( 9): Result.002 file - promoters60/1673853
taatttggt

SEQ ID NO: 122117 - DNA, 9 bp, Unknown
  misc_feature (1)..( 9): Result.002 file - promoters60/1673853
taattgggt

SEQ ID NO: 122118 - DNA, 8 bp, Unknown
  misc_feature (1)..( 8): Result.002 file - promoters60/1673853
tattcatt

SEQ ID NO: 122119 - DNA, 8 bp, Unknown
  misc_feature (1)..( 8): Result.002 file - promoters60/1673853
tattaatt

SEQ ID NO: 122120 - DNA, 10 bp, Unknown
  misc_feature (1)..( 10): Result.002 file - promoters60/1673853
actatatata

SEQ ID NO: 122121 - DNA, 10 bp, Unknown
  misc_feature (1)..( 10): Result.002 file - promoters60/1673853
aatatatata

SEQ ID NO: 122122 - DNA, 10 bp, Unknown
  misc_feature (1)..( 10): Result.002 file - promoters60/1673853
actatataaa

SEQ ID NO: 122123 - DNA, 8 bp, Unknown
  misc_feature (1)..( 8): Result.002 file - promoters60/1673853
gaaaaaag

SEQ ID NO: 122124 - DNA, 8 bp, Unknown
  misc_feature (1)..( 8): Result.002 file - promoters60/1673853
gaacaaac

SEQ ID NO: 122125 - DNA, 8 bp, Unknown
  misc_feature (1)..( 8): Result.002 file - promoters60/1673853
aaacgaac

SEQ ID NO: 122126 - DNA, 7 bp, Unknown
  misc_feature (1)..( 7): Result.002 file - promoters60/1673853
gaagatt

SEQ ID NO: 122127 - DNA, 7 bp, Unknown
  misc_feature (1)..( 7): Result.002 file - promoters60/1673853
gaatatt

SEQ ID NO: 122128 - DNA, 7 bp, Unknown
  misc_feature (1)..( 7): Result.002 file - promoters60/1673853
taacaag

SEQ ID NO: 122129 - DNA, 7 bp, Unknown
  misc_feature (1)..( 7): Result.002 file - promoters60/1673853
taacaag

SEQ ID NO: 122130 - DNA, 8 bp, Unknown
  misc_feature (1)..( 8): Result.002 file - promoters60/1673853
aataagac

SEQ ID NO: 122131 - DNA, 8 bp, Unknown
  misc_feature (1)..( 8): Result.002 file - promoters60/1673853
aattagac

SEQ ID NO: 122132 - DNA, 6 bp, Unknown
  misc_feature (1)..( 6): Result.002 file - promoters60/1673853
tttgaa

SEQ ID NO: 122133 - DNA, 6 bp, Unknown
  misc_feature (1)..( 6): Result.002 file - promoters60/1673853
tttgaa

SEQ ID NO: 122134 - DNA, 6 bp, Unknown
  misc_feature (1)..( 6): Result.002 file - promoters60/1673853
ttcaaa

SEQ ID NO: 122135 - DNA, 6 bp, Unknown
  misc_feature (1)..( 6): Result.002 file - promoters60/1673853
ttcaaa

SEQ ID NO: 122136 - DNA, 6 bp, Unknown
  misc_feature (1)..( 6): Result.002 file - promoters60/1673853
aaaata

SEQ ID NO: 122137 - DNA, 6 bp, Unknown
  misc_feature (1)..( 6): Result.002 file - promoters60/1673853
aaaata

SEQ ID NO: 122138 - DNA, 7 bp, Unknown
  misc_feature (1)..( 7): Result.002 file - promoters60/1673853
aaacgaa

SEQ ID NO: 122139 - DNA, 7 bp, Unknown
  misc_feature (1)..( 7): Result.002 file - promoters60/1673853
aaatgaa

SEQ ID NO: 122140 - DNA, 7 bp, Unknown
  misc_feature (1)..( 7): Result.002 file - promoters60/1673853
ttaaata

SEQ ID NO: 122141 - DNA, 7 bp, Unknown
  misc_feature (1)..( 7): Result.002 file - promoters60/1673853
ttagata

SEQ ID NO: 122142 - DNA, 6 bp, Unknown
  misc_feature (1)..( 6): Result.002 file - promoters60/1673853
taaaaa

SEQ ID NO: 122143 - DNA, 6 bp, Unknown
  misc_feature (1)..( 6): Result.002 file - promoters60/1673853
taaaaa

SEQ ID NO: 122144 - DNA, 7 bp, Unknown
  misc_feature (1)..( 7): Result.002 file - promoters60/1673853
ggttaga

SEQ ID NO: 122145 - DNA, 7 bp, Unknown
  misc_feature (1)..( 7): Result.002 file - promoters60/1673853
ggtgaga

SEQ ID NO: 122146 - DNA, 6 bp, Unknown
  misc_feature (1)..( 6): Result.002 file - promoters60/1673853
gagaaa

SEQ ID NO: 122147 - DNA, 6 bp, Unknown
  misc_feature (1)..( 6): Result.002 file - promoters60/1673853
gagaaa

SEQ ID NO: 122148 - DNA, 7 bp, Unknown
  misc_feature (1)..( 7): Result.002 file - promoters60/1710026
cggcttg

SEQ ID NO: 122149 - DNA, 7 bp, Unknown
  misc_feature (1)..( 7): Result.002 file - promoters60/1710026
cggtttg

SEQ ID NO: 122150 - DNA, 7 bp, Unknown
  misc_feature (1)..( 7): Result.002 file - promoters60/1710026
cggcttg

SEQ ID NO: 122151 - DNA, 7 bp, Unknown
  misc_feature (1)..( 7): Result.002 file - promoters60/1710026
aatcgga

SEQ ID NO: 122152 - DNA, 7 bp, Unknown
  misc_feature (1)..( 7): Result.002 file - promoters60/1710026
aattgga

SEQ ID NO: 122153 - DNA, 7 bp, Unknown
  misc_feature (1)..( 7): Result.002 file - promoters60/1710026
aatcgga

SEQ ID NO: 122154 - DNA, 14 bp, Unknown
  misc_feature (1)..( 14): Result.002 file - promoters60/1710026
tctggggaatcggc

SEQ ID NO: 122155 - DNA, 14 bp, Unknown
  misc_feature (1)..( 14): Result.002 file - promoters60/1710026
tctgggaaatcgga

SEQ ID NO: 122156 - DNA, 14 bp, Unknown
  misc_feature (1)..( 14): Result.002 file - promoters60/1710026
cgtttggaattgga

SEQ ID NO: 122157 - DNA, 14 bp, Unknown
  misc_feature (1)..( 14): Result.002 file - promoters60/1710026
atgcggaaattaaa

SEQ ID NO: 122158 - DNA, 6 bp, Unknown
  misc_feature (1)..( 6): Result.002 file - promoters60/1710026
tttcaa

SEQ ID NO: 122159 - DNA, 6 bp, Unknown
  misc_feature (1)..( 6): Result.002 file - promoters60/1710026
tttcaa

SEQ ID NO: 122160 - DNA, 6 bp, Unknown
  misc_feature (1)..( 6): Result.002 file - promoters60/1710026
tttcaa

SEQ ID NO: 122161 - DNA, 6 bp, Unknown
  misc_feature (1)..( 6): Result.002 file - promoters60/1710026
ggaaat

SEQ ID NO: 122162 - DNA, 6 bp, Unknown
  misc_feature (1)..( 6): Result.002 file - promoters60/1710026
ggaaat

SEQ ID NO: 122163 - DNA, 6 bp, Unknown
  misc_feature (1)..( 6): Result.002 file - promoters60/1710026
ggaaat

SEQ ID NO: 122164 - DNA, 9 bp, Unknown
  misc_feature (1)..( 9): Result.002 file - promoters60/1710026
atttgaatc

SEQ ID NO: 122165 - DNA, 9 bp, Unknown
  misc_feature (1)..( 9): Result.002 file - promoters60/1710026
atttcaatc

SEQ ID NO: 122166 - DNA, 9 bp, Unknown
  misc_feature (1)..( 9): Result.002 file - promoters60/1710026
gtttcaaat

SEQ ID NO: 122167 - DNA, 11 bp, Unknown
  misc_feature (1)..( 11): Result.002 file - promoters60/1711228
aaccaaaaatc

SEQ ID NO: 122168 - DNA, 11 bp, Unknown
  misc_feature (1)..( 11): Result.002 file - promoters60/1711228
aactaaagtaa

SEQ ID NO: 122169 - DNA, 11 bp, Unknown
  misc_feature (1)..( 11): Result.002 file - promoters60/1711228
aactaaaagag

SEQ ID NO: 122170 - DNA, 12 bp, Unknown
  misc_feature (1)..( 12): Result.002 file - promoters60/1711228
caacaaaaacaa

SEQ ID NO: 122171 - DNA, 12 bp, Unknown
  misc_feature (1)..( 12): Result.002 file - promoters60/1711228
gacataaatttt

SEQ ID NO: 122172 - DNA, 12 bp, Unknown
  misc_feature (1)..( 12): Result.002 file - promoters60/1711228
gatgtaaatgag

SEQ ID NO: 122173 - DNA, 13 bp, Unknown
  misc_feature (1)..( 13): Result.002 file - promoters60/1711228
atgaagaagaaga

SEQ ID NO: 122174 - DNA, 13 bp, Unknown
  misc_feature (1)..( 13): Result.002 file - promoters60/1711228
accaagaagaaaa

SEQ ID NO: 122175 - DNA, 13 bp, Unknown
  misc_feature (1)..( 13): Result.002 file - promoters60/1711228
aaaaagaagacaa

SEQ ID NO: 122176 - DNA, 13 bp, Unknown
  misc_feature (1)..( 13): Result.002 file - promoters60/1711228
agaaacaagaaaa

SEQ ID NO: 122177 - DNA, 13 bp, Unknown
  misc_feature (1)..( 13): Result.002 file - promoters60/1711228
cttaagaaatctt

SEQ ID NO: 122178 - DNA, 13 bp, Unknown
  misc_feature (1)..( 13): Result.002 file - promoters60/1711228
cttaacaaaactt

SEQ ID NO: 122179 - DNA, 12 bp, Unknown
  misc_feature (1)..( 12): Result.002 file - promoters60/1711318
tattttgacgat

SEQ ID NO: 122180 - DNA, 12 bp, Unknown
  misc_feature (1)..( 12): Result.002 file - promoters60/1711318
tgttttgactaa

SEQ ID NO: 122181 - DNA, 12 bp, Unknown
  misc_feature (1)..( 12): Result.002 file - promoters60/1711318
tatgttgttaaa

SEQ ID NO: 122182 - DNA, 12 bp, Unknown
  misc_feature (1)..( 12): Result.002 file - promoters60/1711318
tttattgaataa

SEQ ID NO: 122183 - DNA, 12 bp, Unknown
  misc_feature (1)..( 12): Result.002 file - promoters60/1711318
taaattgaatgt

SEQ ID NO: 122184 - DNA, 12 bp, Unknown
  misc_feature (1)..( 12): Result.002 file - promoters60/1711318
caaattgatttt

SEQ ID NO: 122185 - DNA, 12 bp, Unknown
  misc_feature (1)..( 12): Result.002 file - promoters60/1711318
ctaattgaacct

SEQ ID NO: 122186 - DNA, 13 bp, Unknown
  misc_feature (1)..( 13): Result.002 file - promoters60/1711318
tagcatatccttt

SEQ ID NO: 122187 - DNA, 13 bp, Unknown
  misc_feature (1)..( 13): Result.002 file - promoters60/1711318
tagcttattaaag

SEQ ID NO: 122188 - DNA, 13 bp, Unknown
  misc_feature (1)..( 13): Result.002 file - promoters60/1711318
atgcatataacca

SEQ ID NO: 122189 - DNA, 13 bp, Unknown
  misc_feature (1)..( 13): Result.002 file - promoters60/1711318
taacatgtaacta

SEQ ID NO: 122190 - DNA, 13 bp, Unknown
  misc_feature (1)..( 13): Result.002 file - promoters60/1711318
aatctttttaaag

SEQ ID NO: 122191 - DNA, 13 bp, Unknown
  misc_feature (1)..( 13): Result.002 file - promoters60/1711318
tattatttcaaat

SEQ ID NO: 122192 - DNA, 14 bp, Unknown
  misc_feature (1)..( 14): Result.002 file - promoters60/1711318
gacgattaaaaatc

SEQ ID NO: 122193 - DNA, 14 bp, Unknown
  misc_feature (1)..( 14): Result.002 file - promoters60/1711318
agaaaataaaaaag

SEQ ID NO: 122194 - DNA, 14 bp, Unknown
  misc_feature (1)..( 14): Result.002 file - promoters60/1711318
tgcagctaataata

SEQ ID NO: 122195 - DNA, 14 bp, Unknown
  misc_feature (1)..( 14): Result.002 file - promoters60/1711318
agacaatgaaactc

SEQ ID NO: 122196 - DNA, 14 bp, Unknown
  misc_feature (1)..( 14): Result.002 file - promoters60/1711318
tgattaagaaaata

SEQ ID NO: 122197 - DNA, 14 bp, Unknown
  misc_feature (1)..( 14): Result.002 file - promoters60/1711318
atttttagcaaata

SEQ ID NO: 122198 - DNA, 10 bp, Unknown
  misc_feature (1)..( 10): Result.002 file - promoters60/1711318
cataagagag

SEQ ID NO: 122199 - DNA, 10 bp, Unknown
  misc_feature (1)..( 10): Result.002 file - promoters60/1711318
aataatagaa

SEQ ID NO: 122200 - DNA, 10 bp, Unknown
  misc_feature (1)..( 10): Result.002 file - promoters60/1711318
aatcatatgg

SEQ ID NO: 122201 - DNA, 10 bp, Unknown
  misc_feature (1)..( 10): Result.002 file - promoters60/1711318
agtcatattc

SEQ ID NO: 122202 - DNA, 10 bp, Unknown
  misc_feature (1)..( 10): Result.002 file - promoters60/1711318
agttatattg

SEQ ID NO: 122203 - DNA, 10 bp, Unknown
  misc_feature (1)..( 10): Result.002 file - promoters60/1711318
caatatattg

SEQ ID NO: 122204 - DNA, 11 bp, Unknown
  misc_feature (1)..( 11): Result.002 file - promoters60/1711318
tctgaaaattt

SEQ ID NO: 122205 - DNA, 11 bp, Unknown
  misc_feature (1)..( 11): Result.002 file - promoters60/1711318
gaaaaaaattg

SEQ ID NO: 122206 - DNA, 11 bp, Unknown
  misc_feature (1)..( 11): Result.002 file - promoters60/1711318
aaaataaattg

SEQ ID NO: 122207 - DNA, 11 bp, Unknown
  misc_feature (1)..( 11): Result.002 file - promoters60/1711318
aatttaaattt

SEQ ID NO: 122208 - DNA, 11 bp, Unknown
  misc_feature (1)..( 11): Result.002 file - promoters60/1711318
aaaaaaaatta

SEQ ID NO: 122209 - DNA, 11 bp, Unknown
  misc_feature (1)..( 11): Result.002 file - promoters60/1711318
tcaaaacattg

SEQ ID NO: 122210 - DNA, 16 bp, Unknown
  misc_feature (1)..( 16): Result.002 file - promoters60/1711586
ctgaaattttaggaaa

SEQ ID NO: 122211 - DNA, 16 bp, Unknown
  misc_feature (1)..( 16): Result.002 file - promoters60/1711586
aaaaaattataggaaa

SEQ ID NO: 122212 - DNA, 16 bp, Unknown
  misc_feature (1)..( 16): Result.002 file - promoters60/1711586
aaaaaattgagataaa

SEQ ID NO: 122213 - DNA, 7 bp, Unknown
  misc_feature (1)..( 7): Result.002 file - promoters60/1711586
ttacaat

SEQ ID NO: 122214 - DNA, 7 bp, Unknown
  misc_feature (1)..( 7): Result.002 file - promoters60/1711586
ctacaat

SEQ ID NO: 122215 - DNA, 7 bp, Unknown
  misc_feature (1)..( 7): Result.002 file - promoters60/1711586
ttacaaa

SEQ ID NO: 122216 - DNA, 7 bp, Unknown
  misc_feature (1)..( 7): Result.002 file - promoters60/1711586
catgtat

SEQ ID NO: 122217 - DNA, 7 bp, Unknown
  misc_feature (1)..( 7): Result.002 file - promoters60/1711586
catctat

SEQ ID NO: 122218 - DNA, 7 bp, Unknown
  misc_feature (1)..( 7): Result.002 file - promoters60/1711586
tatgtat

SEQ ID NO: 122219 - DNA, 10 bp, Unknown
  misc_feature (1)..( 10): Result.002 file - promoters60/1711586
gatatatcaa

SEQ ID NO: 122220 - DNA, 10 bp, Unknown
  misc_feature (1)..( 10): Result.002 file - promoters60/1711586
gatatagcaa

SEQ ID NO: 122221 - DNA, 10 bp, Unknown
  misc_feature (1)..( 10): Result.002 file - promoters60/1711586
tatattgcaa

SEQ ID NO: 122222 - DNA, 9 bp, Unknown
  misc_feature (1)..( 9): Result.002 file - promoters60/1711586
aacaaaatc

SEQ ID NO: 122223 - DNA, 9 bp, Unknown
  misc_feature (1)..( 9): Result.002 file - promoters60/1711586
aacataatc

SEQ ID NO: 122224 - DNA, 9 bp, Unknown
  misc_feature (1)..( 9): Result.002 file - promoters60/1711586
ttcataatc

SEQ ID NO: 122225 - DNA, 11 bp, Unknown
  misc_feature (1)..( 11): Result.002 file - promoters60/1711586
ttttgtagatt

SEQ ID NO: 122226 - DNA, 11 bp, Unknown
  misc_feature (1)..( 11): Result.002 file - promoters60/1711586
cattgtaggtc

SEQ ID NO: 122227 - DNA, 11 bp, Unknown
  misc_feature (1)..( 11): Result.002 file - promoters60/1711586
ttttgtggatt

SEQ ID NO: 122228 - DNA, 8 bp, Unknown
  misc_feature (1)..( 8): Result.002 file - promoters60/1711586
ttatatat

SEQ ID NO: 122229 - DNA, 8 bp, Unknown
  misc_feature (1)..( 8): Result.002 file - promoters60/1711586
gtatataa

SEQ ID NO: 122230 - DNA, 8 bp, Unknown
  misc_feature (1)..( 8): Result.002 file - promoters60/1711586
ttatgtat

SEQ ID NO: 122231 - DNA, 10 bp, Unknown
  misc_feature (1)..( 10): Result.002 file - promoters60/1711586
ataaaaagaa

SEQ ID NO: 122232 - DNA, 10 bp, Unknown
  misc_feature (1)..( 10): Result.002 file - promoters60/1711586
ataaaaacaa

SEQ ID NO: 122233 - DNA, 10 bp, Unknown
  misc_feature (1)..( 10): Result.002 file - promoters60/1711586
caaaaatcaa

SEQ ID NO: 122234 - DNA, 7 bp, Unknown
  misc_feature (1)..( 7): Result.002 file - promoters60/1711586
gaaacaa

SEQ ID NO: 122235 - DNA, 7 bp, Unknown
  misc_feature (1)..( 7): Result.002 file - promoters60/1711586
aaaacaa

SEQ ID NO: 122236 - DNA, 8 bp, Unknown
  misc_feature (1)..( 8): Result.002 file - promoters60/1711586
aaaatcaa

SEQ ID NO: 122237 - DNA, 6 bp, Unknown
  misc_feature (1)..( 6): Result.002 file - promoters60/1711630
ttttgt

SEQ ID NO: 122238 - DNA, 6 bp, Unknown
  misc_feature (1)..( 6): Result.002 file - promoters60/1711630
ttttgt

SEQ ID NO: 122239 - DNA, 10 bp, Unknown
  misc_feature (1)..( 10): Result.002 file - promoters60/1711630
tttccaagta

SEQ ID NO: 122240 - DNA, 10 bp, Unknown
  misc_feature (1)..( 10): Result.002 file - promoters60/1711630
ttttcaagta

SEQ ID NO: 122241 - DNA, 9 bp, Unknown
  misc_feature (1)..( 9): Result.002 file - promoters60/1711630
tccaatttc

SEQ ID NO: 122242 - DNA, 9 bp, Unknown
  misc_feature (1)..( 9): Result.002 file - promoters60/1711630
tccattttc

SEQ ID NO: 122243 - DNA, 6 bp, Unknown
  misc_feature (1)..( 6): Result.002 file - promoters60/1711630
tgttta

SEQ ID NO: 122244 - DNA, 6 bp, Unknown
  misc_feature (1)..( 6): Result.002 file - promoters60/1711630
tgttta

SEQ ID NO: 122245 - DNA, 7 bp, Unknown
  misc_feature (1)..( 7): Result.002 file - promoters60/1711630
ctatctt

SEQ ID NO: 122246 - DNA, 7 bp, Unknown
  misc_feature (1)..( 7): Result.002 file - promoters60/1711630
ctatctt

SEQ ID NO: 122247 - DNA, 9 bp, Unknown
  misc_feature (1)..( 9): Result.002 file - promoters60/1711630
tcttctttt

SEQ ID NO: 122248 - DNA, 9 bp, Unknown
  misc_feature (1)..( 9): Result.003 file - promoters60/1711630
tcttatttt

SEQ ID NO: 122249 - DNA, 7 bp, Unknown
  misc_feature (1)..( 7): Result.003 file - promoters60/1711630
actgatt

SEQ ID NO: 122250 - DNA, 7 bp, Unknown
  misc_feature (1)..( 7): Result.003 file - promoters60/1711630
actgatt

SEQ ID NO: 122251 - DNA, 6 bp, Unknown
  misc_feature (1)..( 6): Result.003 file - promoters60/1711630
cattga

SEQ ID NO: 122252 - DNA, 6 bp, Unknown
  misc_feature (1)..( 6): Result.003 file - promoters60/1711630
cattga

SEQ ID NO: 122253 - DNA, 6 bp, Unknown
  misc_feature (1)..( 6): Result.003 file - promoters60/1711630
tattat

SEQ ID NO: 122254 - DNA, 6 bp, Unknown
  misc_feature (1)..( 6): Result.003 file - promoters60/1711630
tattat

SEQ ID NO: 122255 - DNA, 6 bp, Unknown
  misc_feature (1)..( 6): Result.003 file - promoters60/1711630
ctttta

SEQ ID NO: 122256 - DNA, 6 bp, Unknown
  misc_feature (1)..( 6): Result.003 file - promoters60/1711630
ctttta

SEQ ID NO: 122257 - DNA, 6 bp, Unknown
  misc_feature (1)..( 6): Result.003 file - promoters60/1711630
tgtttt

SEQ ID NO: 122258 - DNA, 6 bp, Unknown
  misc_feature (1)..( 6): Result.003 file - promoters60/1711630
tgtttt

SEQ ID NO: 122259 - DNA, 8 bp, Unknown
  misc_feature (1)..( 8): Result.003 file - promoters60/1711630
cttcgaat

SEQ ID NO: 122260 - DNA, 8 bp, Unknown
  misc_feature (1)..( 8): Result.003 file - promoters60/1711630
cttagaat

SEQ ID NO: 122261 - DNA, 6 bp, Unknown
  misc_feature (1)..( 6): Result.003 file - promoters60/1711630
cttgga

SEQ ID NO: 122262 - DNA, 6 bp, Unknown
  misc_feature (1)..( 6): Result.003 file - promoters60/1711630
cttgga

SEQ ID NO: 122263 - DNA, 6 bp, Unknown
  misc_feature (1)..( 6): Result.003 file - promoters60/1711630
cttttc

SEQ ID NO: 122264 - DNA, 6 bp, Unknown
  misc_feature (1)..( 6): Result.003 file - promoters60/1711630
cttttc

SEQ ID NO: 122265 - DNA, 6 bp, Unknown
  misc_feature (1)..( 6): Result.003 file - promoters60/1711630
ttttaa

SEQ ID NO: 122266 - DNA, 6 bp, Unknown
  misc_feature (1)..( 6): Result.003 file - promoters60/1711630
ttttaa

SEQ ID NO: 122267 - DNA, 7 bp, Unknown
  misc_feature (1)..( 7): Result.003 file - promoters60/1711630
tttcttt

SEQ ID NO: 122268 - DNA, 7 bp, Unknown
  misc_feature (1)..( 7): Result.003 file - promoters60/1711630
ttttttt

SEQ ID NO: 122269 - DNA, 7 bp, Unknown
  misc_feature (1)..( 7): Result.003 file - promoters60/1711630
cataatc

SEQ ID NO: 122270 - DNA, 7 bp, Unknown
  misc_feature (1)..( 7): Result.003 file - promoters60/1711630
cattatc

SEQ ID NO: 122271 - DNA, 7 bp, Unknown
  misc_feature (1)..( 7): Result.003 file - promoters60/1711630
ttaatct

SEQ ID NO: 122272 - DNA, 7 bp, Unknown
  misc_feature (1)..( 7): Result.003 file - promoters60/1711630
ttaatct

SEQ ID NO: 122273 - DNA, 8 bp, Unknown
  misc_feature (1)..( 8): Result.003 file - promoters60/1711630
gaaactgt

SEQ ID NO: 122274 - DNA, 8 bp, Unknown
  misc_feature (1)..( 8): Result.003 file - promoters60/1711630
gaatctgt

SEQ ID NO: 122275 - DNA, 6 bp, Unknown
  misc_feature (1)..( 6): Result.003 file - promoters60/1711630
agtgat

SEQ ID NO: 122276 - DNA, 6 bp, Unknown
  misc_feature (1)..( 6): Result.003 file - promoters60/1711630
agtgat

SEQ ID NO: 122277 - DNA, 6 bp, Unknown
  misc_feature (1)..( 6): Result.003 file - promoters60/1711630
ctatag

SEQ ID NO: 122278 - DNA, 6 bp, Unknown
  misc_feature (1)..( 6): Result.003 file - promoters60/1711630
ctatag

SEQ ID NO: 122279 - DNA, 8 bp, Unknown
  misc_feature (1)..( 8): Result.003 file - promoters60/1712150
aaagaata

SEQ ID NO: 122280 - DNA, 8 bp, Unknown
  misc_feature (1)..( 8): Result.003 file - promoters60/1712150
aaaaaata

SEQ ID NO: 122281 - DNA, 8 bp, Unknown
  misc_feature (1)..( 8): Result.003 file - promoters60/1712150
taaaaatt

SEQ ID NO: 122282 - DNA, 9 bp, Unknown
  misc_feature (1)..( 9): Result.003 file - promoters60/1712150
acaagcatt

SEQ ID NO: 122283 - DNA, 9 bp, Unknown
  misc_feature (1)..( 9): Result.003 file - promoters60/1712150
acacgcaag

SEQ ID NO: 122284 - DNA, 9 bp, Unknown
  misc_feature (1)..( 9): Result.003 file - promoters60/1712150
tgacgtaag

SEQ ID NO: 122285 - DNA, 7 bp, Unknown
  misc_feature (1)..( 7): Result.003 file - promoters60/1712150
tcaatca

SEQ ID NO: 122286 - DNA, 7 bp, Unknown
  misc_feature (1)..( 7): Result.003 file - promoters60/1712150
tcattca

SEQ ID NO: 122287 - DNA, 7 bp, Unknown
  misc_feature (1)..( 7): Result.003 file - promoters60/1712150
tcattcg

SEQ ID NO: 122288 - DNA, 11 bp, Unknown
  misc_feature (1)..( 11): Result.003 file - promoters60/1712150
aaatttaatct

SEQ ID NO: 122289 - DNA, 11 bp, Unknown
  misc_feature (1)..( 11): Result.003 file - promoters60/1712150
aaatttattct

SEQ ID NO: 122290 - DNA, 11 bp, Unknown
  misc_feature (1)..( 11): Result.003 file - promoters60/1712150
gcttttatttt

SEQ ID NO: 122291 - DNA, 7 bp, Unknown
  misc_feature (1)..( 7): Result.003 file - promoters60/1712150
gaaaaca

SEQ ID NO: 122292 - DNA, 7 bp, Unknown
  misc_feature (1)..( 7): Result.003 file - promoters60/1712150
aaaaaca

SEQ ID NO: 122293 - DNA, 7 bp, Unknown
  misc_feature (1)..( 7): Result.003 file - promoters60/1712150
aaaaacc

SEQ ID NO: 122294 - DNA, 8 bp, Unknown
  misc_feature (1)..( 8): Result.003 file - promoters60/1712150
aagaaaat

SEQ ID NO: 122295 - DNA, 8 bp, Unknown
  misc_feature (1)..( 8): Result.003 file - promoters60/1712150
gagagaat

SEQ ID NO: 122296 - DNA, 8 bp, Unknown
  misc_feature (1)..( 8): Result.003 file - promoters60/1712150
aagaaaaa

SEQ ID NO: 122297 - DNA, 7 bp, Unknown
  misc_feature (1)..( 7): Result.003 file - promoters60/1712174
aaatcta

SEQ ID NO: 122298 - DNA, 7 bp, Unknown
  misc_feature (1)..( 7): Result.003 file - promoters60/1712174
gaatcta

SEQ ID NO: 122299 - DNA, 7 bp, Unknown
  misc_feature (1)..( 7): Result.003 file - promoters60/1712174
gaatctc

SEQ ID NO: 122300 - DNA, 7 bp, Unknown
  misc_feature (1)..( 7): Result.003 file - promoters60/1712174
ttttatc

SEQ ID NO: 122301 - DNA, 7 bp, Unknown
  misc_feature (1)..( 7): Result.003 file - promoters60/1712174
ttttatc

SEQ ID NO: 122302 - DNA, 7 bp, Unknown
  misc_feature (1)..( 7): Result.003 file - promoters60/1712174
atttatc

SEQ ID NO: 122303 - DNA, 8 bp, Unknown
  misc_feature (1)..( 8): Result.003 file - promoters60/1712174
actatttg

SEQ ID NO: 122304 - DNA, 8 bp, Unknown
  misc_feature (1)..( 8): Result.003 file - promoters60/1712174
attatttg

SEQ ID NO: 122305 - DNA, 8 bp, Unknown
  misc_feature (1)..( 8): Result.003 file - promoters60/1712174
attgtttt

SEQ ID NO: 122306 - DNA, 9 bp, Unknown
  misc_feature (1)..( 9): Result.003 file - promoters60/1712174
ctcaaaaaa

SEQ ID NO: 122307 - DNA, 9 bp, Unknown
  misc_feature (1)..( 9): Result.003 file - promoters60/1712174
gtcaaaaaa

SEQ ID NO: 122308 - DNA, 9 bp, Unknown
  misc_feature (1)..( 9): Result.003 file - promoters60/1712174
gtcaaatcc

SEQ ID NO: 122309 - DNA, 9 bp, Unknown
  misc_feature (1)..( 9): Result.003 file - promoters60/1713765
taaactaca

SEQ ID NO: 122310 - DNA, 9 bp, Unknown
  misc_feature (1)..( 9): Result.003 file - promoters60/1713765
aaaattact

SEQ ID NO: 122311 - DNA, 9 bp, Unknown
  misc_feature (1)..( 9): Result.003 file - promoters60/1713765
caaacaatt

SEQ ID NO: 122312 - DNA, 9 bp, Unknown
  misc_feature (1)..( 9): Result.003 file - promoters60/1713765
agaaagaaa

SEQ ID NO: 122313 - DNA, 9 bp, Unknown
  misc_feature (1)..( 9): Result.003 file - promoters60/1713765
agagagaat

SEQ ID NO: 122314 - DNA, 9 bp, Unknown
  misc_feature (1)..( 9): Result.003 file - promoters60/1713765
tcggagaat

SEQ ID NO: 122315 - DNA, 7 bp, Unknown
  misc_feature (1)..( 7): Result.003 file - promoters60/1713765
ttgcata

SEQ ID NO: 122316 - DNA, 7 bp, Unknown
  misc_feature (1)..( 7): Result.003 file - promoters60/1713765
ttgaata

SEQ ID NO: 122317 - DNA, 7 bp, Unknown
  misc_feature (1)..( 7): Result.003 file - promoters60/1713765
ttgaatc

SEQ ID NO: 122318 - DNA, 10 bp, Unknown
  misc_feature (1)..( 10): Result.003 file - promoters60/1713780
ttaaacatta

SEQ ID NO: 122319 - DNA, 10 bp, Unknown
  misc_feature (1)..( 10): Result.003 file - promoters60/1713780
caaaacataa

SEQ ID NO: 122320 - DNA, 10 bp, Unknown
  misc_feature (1)..( 10): Result.003 file - promoters60/1713780
caaaaaataa

SEQ ID NO: 122321 - DNA, 10 bp, Unknown
  misc_feature (1)..( 10): Result.003 file - promoters60/1713780
caaaatatat

SEQ ID NO: 122322 - DNA, 7 bp, Unknown
  misc_feature (1)..( 7): Result.003 file - promoters60/1713780
aaaatag

SEQ ID NO: 122323 - DNA, 7 bp, Unknown
  misc_feature (1)..( 7): Result.003 file - promoters60/1713780
aaaatat

SEQ ID NO: 122324 - DNA, 7 bp, Unknown
  misc_feature (1)..( 7): Result.003 file - promoters60/1713780
aaattat

SEQ ID NO: 122325 - DNA, 7 bp, Unknown
  misc_feature (1)..( 7): Result.003 file - promoters60/1713780
tatccgt

SEQ ID NO: 122326 - DNA, 7 bp, Unknown
  misc_feature (1)..( 7): Result.003 file - promoters60/1713780
tattcgt

SEQ ID NO: 122327 - DNA, 7 bp, Unknown
  misc_feature (1)..( 7): Result.003 file - promoters60/1713780
tattcgg

SEQ ID NO: 122328 - DNA, 11 bp, Unknown
  misc_feature (1)..( 11): Result.003 file - promoters60/1713804
ccatagattca

SEQ ID NO: 122329 - DNA, 11 bp, Unknown
  misc_feature (1)..( 11): Result.003 file - promoters60/1713804
taaaagaatca

SEQ ID NO: 122330 - DNA, 11 bp, Unknown
  misc_feature (1)..( 11): Result.003 file - promoters60/1713804
taaaaaaatta

SEQ ID NO: 122331 - DNA, 10 bp, Unknown
  misc_feature (1)..( 10): Result.003 file - promoters60/1713804
aactgacata

SEQ ID NO: 122332 - DNA, 10 bp, Unknown
  misc_feature (1)..( 10): Result.003 file - promoters60/1713804
aactgagttt

SEQ ID NO: 122333 - DNA, 10 bp, Unknown
  misc_feature (1)..( 10): Result.003 file - promoters60/1713804
cactgatttt

SEQ ID NO: 122334 - DNA, 7 bp, Unknown
  misc_feature (1)..( 7): Result.003 file - promoters60/1713804
ttagatc

SEQ ID NO: 122335 - DNA, 7 bp, Unknown
  misc_feature (1)..( 7): Result.003 file - promoters60/1713804
ttatatc

SEQ ID NO: 122336 - DNA, 7 bp, Unknown
  misc_feature (1)..( 7): Result.003 file - promoters60/1713804
ttatatc

SEQ ID NO: 122337 - DNA, 6 bp, Unknown
  misc_feature (1)..( 6): Result.003 file - promoters60/1713811
aaaaag

SEQ ID NO: 122338 - DNA, 6 bp, Unknown
  misc_feature (1)..( 6): Result.003 file - promoters60/1713811
aaaaag

SEQ ID NO: 122339 - DNA, 8 bp, Unknown
  misc_feature (1)..( 8): Result.003 file - promoters60/1713811
gattaaaa

SEQ ID NO: 122340 - DNA, 8 bp, Unknown
  misc_feature (1)..( 8): Result.003 file - promoters60/1713811
gatgaaaa

SEQ ID NO: 122341 - DNA, 7 bp, Unknown
  misc_feature (1)..( 7): Result.003 file - promoters60/1713811
aatgtat

SEQ ID NO: 122342 - DNA, 7 bp, Unknown
  misc_feature (1)..( 7): Result.003 file - promoters60/1713811
aatgtat

SEQ ID NO: 122343 - DNA, 6 bp, Unknown
  misc_feature (1)..( 6): Result.003 file - promoters60/1713811
tcgtgt

SEQ ID NO: 122344 - DNA, 6 bp, Unknown
  misc_feature (1)..( 6): Result.003 file - promoters60/1713811
tcgtgt

SEQ ID NO: 122345 - DNA, 6 bp, Unknown
  misc_feature (1)..( 6): Result.003 file - promoters60/1713811
ttttct

SEQ ID NO: 122346 - DNA, 6 bp, Unknown
  misc_feature (1)..( 6): Result.003 file - promoters60/1713811
ttttct

SEQ ID NO: 122347 - DNA, 7 bp, Unknown
  misc_feature (1)..( 7): Result.003 file - promoters60/1713811
gaatttg

SEQ ID NO: 122348 - DNA, 7 bp, Unknown
  misc_feature (1)..( 7): Result.003 file - promoters60/1713811
gaatttg

SEQ ID NO: 122349 - DNA, 6 bp, Unknown
  misc_feature (1)..( 6): Result.003 file - promoters60/1713811
ttctct

SEQ ID NO: 122350 - DNA, 6 bp, Unknown
  misc_feature (1)..( 6): Result.003 file - promoters60/1713811
ttctct

SEQ ID NO: 122351 - DNA, 6 bp, Unknown
  misc_feature (1)..( 6): Result.003 file - promoters60/1713811
tatttt

SEQ ID NO: 122352 - DNA, 6 bp, Unknown
  misc_feature (1)..( 6): Result.003 file - promoters60/1713811
tatttt

SEQ ID NO: 122353 - DNA, 7 bp, Unknown
  misc_feature (1)..( 7): Result.003 file - promoters60/1713811
ttttaat

SEQ ID NO: 122354 - DNA, 7 bp, Unknown
  misc_feature (1)..( 7): Result.003 file - promoters60/1713811
ttttaat

SEQ ID NO: 122355 - DNA, 7 bp, Unknown
  misc_feature (1)..( 7): Result.003 file - promoters60/1713811
taattga

SEQ ID NO: 122356 - DNA, 7 bp, Unknown
  misc_feature (1)..( 7): Result.003 file - promoters60/1713811
taagtga

SEQ ID NO: 122357 - DNA, 6 bp, Unknown
  misc_feature (1)..( 6): Result.003 file - promoters60/1713811
catcat

SEQ ID NO: 122358 - DNA, 6 bp, Unknown
  misc_feature (1)..( 6): Result.003 file - promoters60/1713811
catcat

SEQ ID NO: 122359 - DNA, 6 bp, Unknown
  misc_feature (1)..( 6): Result.003 file - promoters60/1713811
tcatat

SEQ ID NO: 122360 - DNA, 6 bp, Unknown
  misc_feature (1)..( 6): Result.003 file - promoters60/1713811
tcatat

SEQ ID NO: 122361 - DNA, 7 bp, Unknown
  misc_feature (1)..( 7): Result.003 file - promoters60/1713811
ttaggtg

SEQ ID NO: 122362 - DNA, 7 bp, Unknown
  misc_feature (1)..( 7): Result.003 file - promoters60/1713811
ttatgtg

SEQ ID NO: 122363 - DNA, 8 bp, Unknown
  misc_feature (1)..( 8): Result.003 file - promoters60/1713811
atatatac

SEQ ID NO: 122364 - DNA, 8 bp, Unknown
  misc_feature (1)..( 8): Result.003 file - promoters60/1713811
atacatac

SEQ ID NO: 122365 - DNA, 6 bp, Unknown
  misc_feature (1)..( 6): Result.003 file - promoters60/1713811
ttcaaa

SEQ ID NO: 122366 - DNA, 6 bp, Unknown
  misc_feature (1)..( 6): Result.003 file - promoters60/1713811
ttcaaa

SEQ ID NO: 122367 - DNA, 7 bp, Unknown
  misc_feature (1)..( 7): Result.003 file - promoters60/1713842
tatttat

SEQ ID NO: 122368 - DNA, 7 bp, Unknown
  misc_feature (1)..( 7): Result.003 file - promoters60/1713842
tatttaa

SEQ ID NO: 122369 - DNA, 7 bp, Unknown
  misc_feature (1)..( 7): Result.003 file - promoters60/1713842
aattttt

SEQ ID NO: 122370 - DNA, 8 bp, Unknown
  misc_feature (1)..( 8): Result.003 file - promoters60/1713842
caaaccca

SEQ ID NO: 122371 - DNA, 8 bp, Unknown
  misc_feature (1)..( 8): Result.003 file - promoters60/1713842
caaacctg

SEQ ID NO: 122372 - DNA, 8 bp, Unknown
  misc_feature (1)..( 8): Result.003 file - promoters60/1713842
gaaagctg

SEQ ID NO: 122373 - DNA, 8 bp, Unknown
  misc_feature (1)..( 8): Result.003 file - promoters60/1713842
agagacat

SEQ ID NO: 122374 - DNA, 8 bp, Unknown
  misc_feature (1)..( 8): Result.003 file - promoters60/1713842
agatacag

SEQ ID NO: 122375 - DNA, 8 bp, Unknown
  misc_feature (1)..( 8): Result.003 file - promoters60/1713842
cgatccag

SEQ ID NO: 122376 - DNA, 9 bp, Unknown
  misc_feature (1)..( 9): Result.003 file - promoters60/1713842
tttaaagct

SEQ ID NO: 122377 - DNA, 9 bp, Unknown
  misc_feature (1)..( 9): Result.003 file - promoters60/1713842
tttcaagtt

SEQ ID NO: 122378 - DNA, 9 bp, Unknown
  misc_feature (1)..( 9): Result.003 file - promoters60/1713842
tctcacgtt

SEQ ID NO: 122379 - DNA, 10 bp, Unknown
  misc_feature (1)..( 10): Result.003 file - promoters60/1713895
tagattttct

SEQ ID NO: 122380 - DNA, 10 bp, Unknown
  misc_feature (1)..( 10): Result.003 file - promoters60/1713895
gtcattatct

SEQ ID NO: 122381 - DNA, 10 bp, Unknown
  misc_feature (1)..( 10): Result.003 file - promoters60/1713895
gagattttaa

SEQ ID NO: 122382 - DNA, 10 bp, Unknown
  misc_feature (1)..( 10): Result.003 file - promoters60/1713895
gtcatcatcc

SEQ ID NO: 122383 - DNA, 9 bp, Unknown
  misc_feature (1)..( 9): Result.003 file - promoters60/1713895
aaagcccat

SEQ ID NO: 122384 - DNA, 9 bp, Unknown
  misc_feature (1)..( 9): Result.003 file - promoters60/1713895
taggcccat

SEQ ID NO: 122385 - DNA, 9 bp, Unknown
  misc_feature (1)..( 9): Result.003 file - promoters60/1713895
aaagcccat

SEQ ID NO: 122386 - DNA, 11 bp, Unknown
  misc_feature (1)..( 11): Result.003 file - promoters60/1713895
gtttacttgct

SEQ ID NO: 122387 - DNA, 11 bp, Unknown
  misc_feature (1)..( 11): Result.003 file - promoters60/1713895
atttatttgtg

SEQ ID NO: 122388 - DNA, 11 bp, Unknown
  misc_feature (1)..( 11): Result.003 file - promoters60/1713895
atttattagtg

SEQ ID NO: 122389 - DNA, 11 bp, Unknown
  misc_feature (1)..( 11): Result.003 file - promoters60/1713895
atttttttctg

SEQ ID NO: 122390 - DNA, 8 bp, Unknown
  misc_feature (1)..( 8): Result.003 file - promoters60/1713895
tagtacta

SEQ ID NO: 122391 - DNA, 8 bp, Unknown
  misc_feature (1)..( 8): Result.003 file - promoters60/1713895
atgtacta

SEQ ID NO: 122392 - DNA, 8 bp, Unknown
  misc_feature (1)..( 8): Result.003 file - promoters60/1713895
atgaactc

SEQ ID NO: 122393 - DNA, 6 bp, Unknown
  misc_feature (1)..( 6): Result.003 file - promoters60/1713895
tcaaaa

SEQ ID NO: 122394 - DNA, 6 bp, Unknown
  misc_feature (1)..( 6): Result.003 file - promoters60/1713895
tcaaaa

SEQ ID NO: 122395 - DNA, 6 bp, Unknown
  misc_feature (1)..( 6): Result.003 file - promoters60/1713895
tcaaaa

SEQ ID NO: 122396 - DNA, 8 bp, Unknown
  misc_feature (1)..( 8): Result.003 file - promoters60/1713895
atattttc

SEQ ID NO: 122397 - DNA, 8 bp, Unknown
  misc_feature (1)..( 8): Result.003 file - promoters60/1713895
atatcttc

SEQ ID NO: 122398 - DNA, 8 bp, Unknown
  misc_feature (1)..( 8): Result.003 file - promoters60/1713895
ttattttc

SEQ ID NO: 122399 - DNA, 11 bp, Unknown
  misc_feature (1)..( 11): Result.003 file - promoters60/1714694
gttcaattttt

SEQ ID NO: 122400 - DNA, 11 bp, Unknown
  misc_feature (1)..( 11): Result.003 file - promoters60/1714694
tatcatttttt

SEQ ID NO: 122401 - DNA, 11 bp, Unknown
  misc_feature (1)..( 11): Result.003 file - promoters60/1714694
tatgattaagc

SEQ ID NO: 122402 - DNA, 8 bp, Unknown
  misc_feature (1)..( 8): Result.003 file - promoters60/1714694
ttgtattt

SEQ ID NO: 122403 - DNA, 8 bp, Unknown
  misc_feature (1)..( 8): Result.003 file - promoters60/1714694
ttgtatat

SEQ ID NO: 122404 - DNA, 8 bp, Unknown
  misc_feature (1)..( 8): Result.003 file - promoters60/1714694
atgtctat

SEQ ID NO: 122405 - DNA, 7 bp, Unknown
  misc_feature (1)..( 7): Result.003 file - promoters60/1714694
attgctt

SEQ ID NO: 122406 - DNA, 7 bp, Unknown
  misc_feature (1)..( 7): Result.003 file - promoters60/1714694
tttgctt

SEQ ID NO: 122407 - DNA, 7 bp, Unknown
  misc_feature (1)..( 7): Result.003 file - promoters60/1714694
tttactt

SEQ ID NO: 122408 - DNA, 7 bp, Unknown
  misc_feature (1)..( 7): Result.003 file - promoters60/1714772
aaacaaa

SEQ ID NO: 122409 - DNA, 7 bp, Unknown
  misc_feature (1)..( 7): Result.003 file - promoters60/1714772
aaagaaa

SEQ ID NO: 122410 - DNA, 7 bp, Unknown
  misc_feature (1)..( 7): Result.003 file - promoters60/1714772
aaacaaa

SEQ ID NO: 122411 - DNA, 11 bp, Unknown
  misc_feature (1)..( 11): Result.003 file - promoters60/1714772
taaagaaaaag

SEQ ID NO: 122412 - DNA, 11 bp, Unknown
  misc_feature (1)..( 11): Result.003 file - promoters60/1714772
aaaataaatga

SEQ ID NO: 122413 - DNA, 11 bp, Unknown
  misc_feature (1)..( 11): Result.003 file - promoters60/1714772
taaataaaaag

SEQ ID NO: 122414 - DNA, 8 bp, Unknown
  misc_feature (1)..( 8): Result.003 file - promoters60/1714772
aaaaagaa

SEQ ID NO: 122415 - DNA, 8 bp, Unknown
  misc_feature (1)..( 8): Result.003 file - promoters60/1714772
taaatgaa

SEQ ID NO: 122416 - DNA, 8 bp, Unknown
  misc_feature (1)..( 8): Result.003 file - promoters60/1714772
aaaaagtt

SEQ ID NO: 122417 - DNA, 8 bp, Unknown
  misc_feature (1)..( 8): Result.003 file - promoters60/1714772
aaacaaaa

SEQ ID NO: 122418 - DNA, 8 bp, Unknown
  misc_feature (1)..( 8): Result.003 file - promoters60/1714772
tcacaaaa

SEQ ID NO: 122419 - DNA, 8 bp, Unknown
  misc_feature (1)..( 8): Result.003 file - promoters60/1714772
aaataaaa

SEQ ID NO: 122420 - DNA, 9 bp, Unknown
  misc_feature (1)..( 9): Result.003 file - promoters60/1714772
aaattaagt

SEQ ID NO: 122421 - DNA, 9 bp, Unknown
  misc_feature (1)..( 9): Result.003 file - promoters60/1714772
aaagtaaag

SEQ ID NO: 122422 - DNA, 9 bp, Unknown
  misc_feature (1)..( 9): Result.003 file - promoters60/1714772
aaagaaaag

SEQ ID NO: 122423 - DNA, 9 bp, Unknown
  misc_feature (1)..( 9): Result.003 file - promoters60/1714772
gtttgtaaa

SEQ ID NO: 122424 - DNA, 9 bp, Unknown
  misc_feature (1)..( 9): Result.003 file - promoters60/1714772
ttttttaaa

SEQ ID NO: 122425 - DNA, 9 bp, Unknown
  misc_feature (1)..( 9): Result.003 file - promoters60/1714772
atttgttat

SEQ ID NO: 122426 - DNA, 10 bp, Unknown
  misc_feature (1)..( 10): Result.003 file - promoters60/1714772
atattttctt

SEQ ID NO: 122427 - DNA, 10 bp, Unknown
  misc_feature (1)..( 10): Result.003 file - promoters60/1714772
atatttttta

SEQ ID NO: 122428 - DNA, 10 bp, Unknown
  misc_feature (1)..( 10): Result.003 file - promoters60/1714772
caatttgtta

SEQ ID NO: 122429 - DNA, 7 bp, Unknown
  misc_feature (1)..( 7): Result.003 file - promoters60/1714831
aaacgcc

SEQ ID NO: 122430 - DNA, 7 bp, Unknown
  misc_feature (1)..( 7): Result.003 file - promoters60/1714831
aaacgca

SEQ ID NO: 122431 - DNA, 7 bp, Unknown
  misc_feature (1)..( 7): Result.003 file - promoters60/1714831
aaatgca

SEQ ID NO: 122432 - DNA, 8 bp, Unknown
  misc_feature (1)..( 8): Result.003 file - promoters60/1714831
aaattgcg

SEQ ID NO: 122433 - DNA, 12 bp, Unknown
  misc_feature (1)..( 12): Result.003 file - promoters60/1714865
gaaaaaaaaaaa

SEQ ID NO: 122434 - DNA, 12 bp, Unknown
  misc_feature (1)..( 12): Result.003 file - promoters60/1714865
gaaaaaaaaaaa

SEQ ID NO: 122435 - DNA, 12 bp, Unknown
  misc_feature (1)..( 12): Result.003 file - promoters60/1714865
gaaatacaaaaa

SEQ ID NO: 122436 - DNA, 13 bp, Unknown
  misc_feature (1)..( 13): Result.003 file - promoters60/1714865
taaaaatcaaaac

SEQ ID NO: 122437 - DNA, 11 bp, Unknown
  misc_feature (1)..( 11): Result.003 file - promoters60/1714865
atttattatgt

SEQ ID NO: 122438 - DNA, 11 bp, Unknown
  misc_feature (1)..( 11): Result.003 file - promoters60/1714865
acatattatgt

SEQ ID NO: 122439 - DNA, 11 bp, Unknown
  misc_feature (1)..( 11): Result.003 file - promoters60/1714865
atttgttaaaa

SEQ ID NO: 122440 - DNA, 8 bp, Unknown
  misc_feature (1)..( 8): Result.003 file - promoters60/1714865
tgaacaaa

SEQ ID NO: 122441 - DNA, 8 bp, Unknown
  misc_feature (1)..( 8): Result.003 file - promoters60/1714865
agaataaa

SEQ ID NO: 122442 - DNA, 9 bp, Unknown
  misc_feature (1)..( 9): Result.003 file - promoters60/1714865
tgaaaataa

SEQ ID NO: 122443 - DNA, 11 bp, Unknown
  misc_feature (1)..( 11): Result.003 file - promoters60/1714865
tgaaaaaaaaa

SEQ ID NO: 122444 - DNA, 11 bp, Unknown
  misc_feature (1)..( 11): Result.003 file - promoters60/1714865
ataaaataaaa

SEQ ID NO: 122445 - DNA, 11 bp, Unknown
  misc_feature (1)..( 11): Result.003 file - promoters60/1714865
ttcaaataaat

SEQ ID NO: 122446 - DNA, 11 bp, Unknown
  misc_feature (1)..( 11): Result.003 file - promoters60/1714865
ataaaataagt

SEQ ID NO: 122447 - DNA, 10 bp, Unknown
  misc_feature (1)..( 10): Result.003 file - promoters60/1714865
taaaacgagt

SEQ ID NO: 122448 - DNA, 10 bp, Unknown
  misc_feature (1)..( 10): Result.003 file - promoters60/1714865
aaaaaagagt

SEQ ID NO: 122449 - DNA, 10 bp, Unknown
  misc_feature (1)..( 10): Result.003 file - promoters60/1714865
aaaaaagaaa

SEQ ID NO: 122450 - DNA, 8 bp, Unknown
  misc_feature (1)..( 8): Result.003 file - promoters60/1714865
ataaataa

SEQ ID NO: 122451 - DNA, 8 bp, Unknown
  misc_feature (1)..( 8): Result.003 file - promoters60/1714865
ataaataa

SEQ ID NO: 122452 - DNA, 8 bp, Unknown
  misc_feature (1)..( 8): Result.003 file - promoters60/1714865
ataaaaaa

SEQ ID NO: 122453 - DNA, 8 bp, Unknown
  misc_feature (1)..( 8): Result.003 file - promoters60/1714865
ataaatgc

SEQ ID NO: 122454 - DNA, 9 bp, Unknown
  misc_feature (1)..( 9): Result.003 file - promoters60/1714865
gaaataccc

SEQ ID NO: 122455 - DNA, 9 bp, Unknown
  misc_feature (1)..( 9): Result.003 file - promoters60/1714865
gaaatacaa

SEQ ID NO: 122456 - DNA, 9 bp, Unknown
  misc_feature (1)..( 9): Result.003 file - promoters60/1714865
aaaattcaa

SEQ ID NO: 122457 - DNA, 8 bp, Unknown
  misc_feature (1)..( 8): Result.003 file - promoters60/1714865
aaaccaat

SEQ ID NO: 122458 - DNA, 8 bp, Unknown
  misc_feature (1)..( 8): Result.003 file - promoters60/1714865
aaacaaat

SEQ ID NO: 122459 - DNA, 8 bp, Unknown
  misc_feature (1)..( 8): Result.003 file - promoters60/1714865
taacaaac

SEQ ID NO: 122460 - DNA, 11 bp, Unknown
  misc_feature (1)..( 11): Result.003 file - promoters60/1714865
aatgtttattt

SEQ ID NO: 122461 - DNA, 11 bp, Unknown
  misc_feature (1)..( 11): Result.003 file - promoters60/1714865
aaatattattt

SEQ ID NO: 122462 - DNA, 11 bp, Unknown
  misc_feature (1)..( 11): Result.003 file - promoters60/1714865
aaataatatta

SEQ ID NO: 122463 - DNA, 9 bp, Unknown
  misc_feature (1)..( 9): Result.003 file - promoters60/1714865
taaataaat

SEQ ID NO: 122464 - DNA, 9 bp, Unknown
  misc_feature (1)..( 9): Result.003 file - promoters60/1714865
taaatacaa

SEQ ID NO: 122465 - DNA, 9 bp, Unknown
  misc_feature (1)..( 9): Result.003 file - promoters60/1714865
aaaatgcaa

SEQ ID NO: 122466 - DNA, 9 bp, Unknown
  misc_feature (1)..( 9): Result.003 file - promoters60/1714865
ataaatttt

SEQ ID NO: 122467 - DNA, 9 bp, Unknown
  misc_feature (1)..( 9): Result.003 file - promoters60/1714865
aaaaatttg

SEQ ID NO: 122468 - DNA, 9 bp, Unknown
  misc_feature (1)..( 9): Result.003 file - promoters60/1714865
aaaaatgca

SEQ ID NO: 122469 - DNA, 9 bp, Unknown
  misc_feature (1)..( 9): Result.003 file - promoters60/1714865
aaaaatcaa

SEQ ID NO: 122470 - DNA, 10 bp, Unknown
  misc_feature (1)..( 10): Result.003 file - promoters60/1714865
caaaacaaaa

SEQ ID NO: 122471 - DNA, 10 bp, Unknown
  misc_feature (1)..( 10): Result.003 file - promoters60/1714865
caaaaaaaaa

SEQ ID NO: 122472 - DNA, 11 bp, Unknown
  misc_feature (1)..( 11): Result.003 file - promoters60/1714865
taatattaaaa

SEQ ID NO: 122473 - DNA, 8 bp, Unknown
  misc_feature (1)..( 8): Result.003 file - promoters60/1714865
agaaaaat

SEQ ID NO: 122474 - DNA, 8 bp, Unknown
  misc_feature (1)..( 8): Result.003 file - promoters60/1714865
agaaaaat

SEQ ID NO: 122475 - DNA, 8 bp, Unknown
  misc_feature (1)..( 8): Result.003 file - promoters60/1714865
acaaaaat

SEQ ID NO: 122476 - DNA, 8 bp, Unknown
  misc_feature (1)..( 8): Result.003 file - promoters60/1714865
ttataatt

SEQ ID NO: 122477 - DNA, 8 bp, Unknown
  misc_feature (1)..( 8): Result.003 file - promoters60/1714865
tgataatt

SEQ ID NO: 122478 - DNA, 8 bp, Unknown
  misc_feature (1)..( 8): Result.003 file - promoters60/1714865
ttaaaatc

SEQ ID NO: 122479 - DNA, 8 bp, Unknown
  misc_feature (1)..( 8): Result.003 file - promoters60/1714912
aaccaaaa

SEQ ID NO: 122480 - DNA, 8 bp, Unknown
  misc_feature (1)..( 8): Result.003 file - promoters60/1714912
aacaaaaa

SEQ ID NO: 122481 - DNA, 6 bp, Unknown
  misc_feature (1)..( 6): Result.003 file - promoters60/1714912
aaaaga

SEQ ID NO: 122482 - DNA, 6 bp, Unknown
  misc_feature (1)..( 6): Result.003 file - promoters60/1714912
aaaaga

SEQ ID NO: 122483 - DNA, 6 bp, Unknown
  misc_feature (1)..( 6): Result.003 file - promoters60/1714912
gtatag

SEQ ID NO: 122484 - DNA, 6 bp, Unknown
  misc_feature (1)..( 6): Result.003 file - promoters60/1714912
gtatag

SEQ ID NO: 122485 - DNA, 11 bp, Unknown
  misc_feature (1)..( 11): Result.003 file - promoters60/1714912
aaaaagaaaaa

SEQ ID NO: 122486 - DNA, 11 bp, Unknown
  misc_feature (1)..( 11): Result.003 file - promoters60/1714912
aagaagaaaag

SEQ ID NO: 122487 - DNA, 11 bp, Unknown
  misc_feature (1)..( 11): Result.003 file - promoters60/1714912
aaaaataaaaa

SEQ ID NO: 122488 - DNA, 7 bp, Unknown
  misc_feature (1)..( 7): Result.003 file - promoters60/1714912
agaaaaa

SEQ ID NO: 122489 - DNA, 7 bp, Unknown
  misc_feature (1)..( 7): Result.003 file - promoters60/1714912
agagaaa

SEQ ID NO: 122490 - DNA, 8 bp, Unknown
  misc_feature (1)..( 8): Result.003 file - promoters60/1714912
ataaattc

SEQ ID NO: 122491 - DNA, 8 bp, Unknown
  misc_feature (1)..( 8): Result.003 file - promoters60/1714912
atagattc

SEQ ID NO: 122492 - DNA, 6 bp, Unknown
  misc_feature (1)..( 6): Result.003 file - promoters60/1714912
gtttga

SEQ ID NO: 122493 - DNA, 6 bp, Unknown
  misc_feature (1)..( 6): Result.003 file - promoters60/1714912
gtttga

SEQ ID NO: 122494 - DNA, 9 bp, Unknown
  misc_feature (1)..( 9): Result.003 file - promoters60/1714912
gaaacaaac

SEQ ID NO: 122495 - DNA, 9 bp, Unknown
  misc_feature (1)..( 9): Result.003 file - promoters60/1714912
gaaccaaac

SEQ ID NO: 122496 - DNA, 6 bp, Unknown
  misc_feature (1)..( 6): Result.003 file - promoters60/1714912
ttgtgg

SEQ ID NO: 122497 - DNA, 6 bp, Unknown
  misc_feature (1)..( 6): Result.003 file - promoters60/1714912
ttgtgg

SEQ ID NO: 122498 - DNA, 10 bp, Unknown
  misc_feature (1)..( 10): Result.003 file - promoters60/1714912
ggtccctctt

SEQ ID NO: 122499 - DNA, 10 bp, Unknown
  misc_feature (1)..( 10): Result.003 file - promoters60/1714912
ggtccatctt

SEQ ID NO: 122500 - DNA, 6 bp, Unknown
  misc_feature (1)..( 6): Result.003 file - promoters60/1714912
aaaaaa

SEQ ID NO: 122501 - DNA, 6 bp, Unknown
  misc_feature (1)..( 6): Result.003 file - promoters60/1714912
aaaaaa

SEQ ID NO: 122502 - DNA, 9 bp, Unknown
  misc_feature (1)..( 9): Result.003 file - promoters60/1714912
ttaaataaa

SEQ ID NO: 122503 - DNA, 9 bp, Unknown
  misc_feature (1)..( 9): Result.003 file - promoters60/1714912
ttaaaaaaa

SEQ ID NO: 122504 - DNA, 6 bp, Unknown
  misc_feature (1)..( 6): Result.003 file - promoters60/1714912
caaaaa

SEQ ID NO: 122505 - DNA, 6 bp, Unknown
  misc_feature (1)..( 6): Result.003 file - promoters60/1714912
caaaaa

SEQ ID NO: 122506 - DNA, 6 bp, Unknown
  misc_feature (1)..( 6): Result.003 file - promoters60/1714912
aaaaga

SEQ ID NO: 122507 - DNA, 6 bp, Unknown
  misc_feature (1)..( 6): Result.003 file - promoters60/1714912
aaaaga

SEQ ID NO: 122508 - DNA, 7 bp, Unknown
  misc_feature (1)..( 7): Result.003 file - promoters60/1714912
tgataca

SEQ ID NO: 122509 - DNA, 7 bp, Unknown
  misc_feature (1)..( 7): Result.003 file - promoters60/1714912
tgataca

SEQ ID NO: 122510 - DNA, 15 bp, Unknown
  misc_feature (1)..( 15): Result.003 file - promoters60/1714912
accaatcagaattgt

SEQ ID NO: 122511 - DNA, 15 bp, Unknown
  misc_feature (1)..( 15): Result.003 file - promoters60/1714912
accaatcagatttgt

SEQ ID NO: 122512 - DNA, 7 bp, Unknown
  misc_feature (1)..( 7): Result.003 file - promoters60/1714912
tctagtg

SEQ ID NO: 122513 - DNA, 7 bp, Unknown
  misc_feature (1)..( 7): Result.003 file - promoters60/1714912
tctcgtg

SEQ ID NO: 122514 - DNA, 6 bp, Unknown
  misc_feature (1)..( 6): Result.003 file - promoters60/1714912
ttaaag

SEQ ID NO: 122515 - DNA, 6 bp, Unknown
  misc_feature (1)..( 6): Result.003 file - promoters60/1714912
ttaaag

SEQ ID NO: 122516 - DNA, 6 bp, Unknown
  misc_feature (1)..( 6): Result.003 file - promoters60/1714912
gtggta

SEQ ID NO: 122517 - DNA, 6 bp, Unknown
  misc_feature (1)..( 6): Result.003 file - promoters60/1714912
gtggta

SEQ ID NO: 122518 - DNA, 10 bp, Unknown
  misc_feature (1)..( 10): Result.003 file - promoters60/1714974
ttgaatttag

SEQ ID NO: 122519 - DNA, 10 bp, Unknown
  misc_feature (1)..( 10): Result.003 file - promoters60/1714974
ttgtatttat

SEQ ID NO: 122520 - DNA, 10 bp, Unknown
  misc_feature (1)..( 10): Result.003 file - promoters60/1714974
gtggatttat

SEQ ID NO: 122521 - DNA, 7 bp, Unknown
  misc_feature (1)..( 7): Result.003 file - promoters60/1714974
caatcaa

SEQ ID NO: 122522 - DNA, 7 bp, Unknown
  misc_feature (1)..( 7): Result.003 file - promoters60/1714974
caaacaa

SEQ ID NO: 122523 - DNA, 6 bp, Unknown
  misc_feature (1)..( 6): Result.003 file - promoters60/1714974
cttcac

SEQ ID NO: 122524 - DNA, 6 bp, Unknown
  misc_feature (1)..( 6): Result.003 file - promoters60/1714974
cttcac

SEQ ID NO: 122525 - DNA, 8 bp, Unknown
  misc_feature (1)..( 8): Result.003 file - promoters60/1714974
ataacgtt

SEQ ID NO: 122526 - DNA, 8 bp, Unknown
  misc_feature (1)..( 8): Result.003 file - promoters60/1714974
ataaggtt

SEQ ID NO: 122527 - DNA, 8 bp, Unknown
  misc_feature (1)..( 8): Result.003 file - promoters60/1714974
atatgtag

SEQ ID NO: 122528 - DNA, 8 bp, Unknown
  misc_feature (1)..( 8): Result.003 file - promoters60/1714974
atatttag

SEQ ID NO: 122529 - DNA, 8 bp, Unknown
  misc_feature (1)..( 8): Result.003 file - promoters60/1714974
cgactcaa

SEQ ID NO: 122530 - DNA, 8 bp, Unknown
  misc_feature (1)..( 8): Result.003 file - promoters60/1714974
cgacccaa

SEQ ID NO: 122531 - DNA, 6 bp, Unknown
  misc_feature (1)..( 6): Result.003 file - promoters60/1714974
ggtcta

SEQ ID NO: 122532 - DNA, 6 bp, Unknown
  misc_feature (1)..( 6): Result.003 file - promoters60/1714974
ggtcta

SEQ ID NO: 122533 - DNA, 7 bp, Unknown
  misc_feature (1)..( 7): Result.003 file - promoters60/1714974
gaagaat

SEQ ID NO: 122534 - DNA, 7 bp, Unknown
  misc_feature (1)..( 7): Result.003 file - promoters60/1714974
gaataat

SEQ ID NO: 122535 - DNA, 9 bp, Unknown
  misc_feature (1)..( 9): Result.003 file - promoters60/1714974
ttcttcttc

SEQ ID NO: 122536 - DNA, 9 bp, Unknown
  misc_feature (1)..( 9): Result.003 file - promoters60/1714974
ttctttttc

SEQ ID NO: 122537 - DNA, 7 bp, Unknown
  misc_feature (1)..( 7): Result.003 file - promoters60/1714974
cttttgt

SEQ ID NO: 122538 - DNA, 7 bp, Unknown
  misc_feature (1)..( 7): Result.003 file - promoters60/1714974
cttttgt

SEQ ID NO: 122539 - DNA, 6 bp, Unknown
  misc_feature (1)..( 6): Result.003 file - promoters60/1714974
tacttt

SEQ ID NO: 122540 - DNA, 6 bp, Unknown
  misc_feature (1)..( 6): Result.003 file - promoters60/1714974
tacttt

SEQ ID NO: 122541 - DNA, 9 bp, Unknown
  misc_feature (1)..( 9): Result.003 file - promoters60/1714974
aaacgaaat

SEQ ID NO: 122542 - DNA, 9 bp, Unknown
  misc_feature (1)..( 9): Result.003 file - promoters60/1714974
aaaccaaat

SEQ ID NO: 122543 - DNA, 7 bp, Unknown
  misc_feature (1)..( 7): Result.003 file - promoters60/1714974
tattaaa

SEQ ID NO: 122544 - DNA, 7 bp, Unknown
  misc_feature (1)..( 7): Result.003 file - promoters60/1714974
tataaaa

SEQ ID NO: 122545 - DNA, 6 bp, Unknown
  misc_feature (1)..( 6): Result.003 file - promoters60/1714974
tttgag

SEQ ID NO: 122546 - DNA, 6 bp, Unknown
  misc_feature (1)..( 6): Result.003 file - promoters60/1714974
tttgag

SEQ ID NO: 122547 - DNA, 6 bp, Unknown
  misc_feature (1)..( 6): Result.003 file - promoters60/1714974
aaaaac

SEQ ID NO: 122548 - DNA, 6 bp, Unknown
  misc_feature (1)..( 6): Result.003 file - promoters60/1714974
aaaaac

SEQ ID NO: 122549 - DNA, 11 bp, Unknown
  misc_feature (1)..( 11): Result.003 file - promoters60/1714974
aaaaaatgatt

SEQ ID NO: 122550 - DNA, 11 bp, Unknown
  misc_feature (1)..( 11): Result.003 file - promoters60/1714974
aaaaaatcatt

SEQ ID NO: 122551 - DNA, 9 bp, Unknown
  misc_feature (1)..( 9): Result.003 file - promoters60/1714989
gaaaatatt

SEQ ID NO: 122552 - DNA, 9 bp, Unknown
  misc_feature (1)..( 9): Result.003 file - promoters60/1714989
aaaaataag

SEQ ID NO: 122553 - DNA, 9 bp, Unknown
  misc_feature (1)..( 9): Result.003 file - promoters60/1714989
aaaaattaa

SEQ ID NO: 122554 - DNA, 9 bp, Unknown
  misc_feature (1)..( 9): Result.003 file - promoters60/1714989
aaaaatcgt

SEQ ID NO: 122555 - DNA, 9 bp, Unknown
  misc_feature (1)..( 9): Result.003 file - promoters60/1714989
aaacatatt

SEQ ID NO: 122556 - DNA, 9 bp, Unknown
  misc_feature (1)..( 9): Result.003 file - promoters60/1714989
taaaatttc

SEQ ID NO: 122557 - DNA, 9 bp, Unknown
  misc_feature (1)..( 9): Result.003 file - promoters60/1714989
taaacttaa

SEQ ID NO: 122558 - DNA, 9 bp, Unknown
  misc_feature (1)..( 9): Result.003 file - promoters60/1714989
caaaattga

SEQ ID NO: 122559 - DNA, 11 bp, Unknown
  misc_feature (1)..( 11): Result.003 file - promoters60/1714989
aaaataaataa

SEQ ID NO: 122560 - DNA, 11 bp, Unknown
  misc_feature (1)..( 11): Result.003 file - promoters60/1714989
ttaataaagct

SEQ ID NO: 122561 - DNA, 11 bp, Unknown
  misc_feature (1)..( 11): Result.003 file - promoters60/1714989
aaaattaatat

SEQ ID NO: 122562 - DNA, 11 bp, Unknown
  misc_feature (1)..( 11): Result.003 file - promoters60/1714989
gaaagaaagag

SEQ ID NO: 122563 - DNA, 11 bp, Unknown
  misc_feature (1)..( 11): Result.003 file - promoters60/1714989
gagataatatt

SEQ ID NO: 122564 - DNA, 11 bp, Unknown
  misc_feature (1)..( 11): Result.003 file - promoters60/1714989
attataaaata

SEQ ID NO: 122565 - DNA, 11 bp, Unknown
  misc_feature (1)..( 11): Result.003 file - promoters60/1714989
tgaaaaacaaa

SEQ ID NO: 122566 - DNA, 11 bp, Unknown
  misc_feature (1)..( 11): Result.003 file - promoters60/1714989
gggaaaaaaaa

SEQ ID NO: 122567 - DNA, 11 bp, Unknown
  misc_feature (1)..( 11): Result.003 file - promoters60/1714989
ctataaataaa

SEQ ID NO: 122568 - DNA, 11 bp, Unknown
  misc_feature (1)..( 11): Result.003 file - promoters60/1714989
agtcaaacaaa

SEQ ID NO: 122569 - DNA, 11 bp, Unknown
  misc_feature (1)..( 11): Result.003 file - promoters60/1714989
ttttaaaaaaa

SEQ ID NO: 122570 - DNA, 11 bp, Unknown
  misc_feature (1)..( 11): Result.003 file - promoters60/1714989
cacaaaaaaaa

SEQ ID NO: 122571 - DNA, 11 bp, Unknown
  misc_feature (1)..( 11): Result.003 file - promoters60/1714989
ttagaaacaga

SEQ ID NO: 122572 - DNA, 10 bp, Unknown
  misc_feature (1)..( 10): Result.003 file - promoters60/1714989
tacaaaacta

SEQ ID NO: 122573 - DNA, 10 bp, Unknown
  misc_feature (1)..( 10): Result.003 file - promoters60/1714989
tacaaaaaaa

SEQ ID NO: 122574 - DNA, 10 bp, Unknown
  misc_feature (1)..( 10): Result.003 file - promoters60/1714989
cccaaaaata

SEQ ID NO: 122575 - DNA, 10 bp, Unknown
  misc_feature (1)..( 10): Result.003 file - promoters60/1714989
tcctaaaatc

SEQ ID NO: 122576 - DNA, 10 bp, Unknown
  misc_feature (1)..( 10): Result.003 file - promoters60/1714989
ctaaaaaatc

SEQ ID NO: 122577 - DNA, 10 bp, Unknown
  misc_feature (1)..( 10): Result.003 file - promoters60/1714989
aataaacata

SEQ ID NO: 122578 - DNA, 10 bp, Unknown
  misc_feature (1)..( 10): Result.003 file - promoters60/1714989
cccaaaattg

SEQ ID NO: 122579 - DNA, 13 bp, Unknown
  misc_feature (1)..( 13): Result.003 file - promoters60/1714989
aataaataaaagc

SEQ ID NO: 122580 - DNA, 13 bp, Unknown
  misc_feature (1)..( 13): Result.003 file - promoters60/1714989
aaacaataaaatt

SEQ ID NO: 122581 - DNA, 13 bp, Unknown
  misc_feature (1)..( 13): Result.003 file - promoters60/1714989
gagaaagaaagag

SEQ ID NO: 122582 - DNA, 13 bp, Unknown
  misc_feature (1)..( 13): Result.003 file - promoters60/1714989
acattataaaata

SEQ ID NO: 122583 - DNA, 13 bp, Unknown
  misc_feature (1)..( 13): Result.003 file - promoters60/1714989
aaacagtaaaacc

SEQ ID NO: 122584 - DNA, 13 bp, Unknown
  misc_feature (1)..( 13): Result.003 file - promoters60/1714989
aggagataatatt

SEQ ID NO: 122585 - DNA, 9 bp, Unknown
  misc_feature (1)..( 9): Result.003 file - promoters60/1714989
taagattag

SEQ ID NO: 122586 - DNA, 9 bp, Unknown
  misc_feature (1)..( 9): Result.003 file - promoters60/1714989
taaaatttc

SEQ ID NO: 122587 - DNA, 9 bp, Unknown
  misc_feature (1)..( 9): Result.003 file - promoters60/1714989
taaaattcc

SEQ ID NO: 122588 - DNA, 9 bp, Unknown
  misc_feature (1)..( 9): Result.003 file - promoters60/1714989
aaaaattaa

SEQ ID NO: 122589 - DNA, 10 bp, Unknown
  misc_feature (1)..( 10): Result.003 file - promoters60/1714989
taacaattct

SEQ ID NO: 122590 - DNA, 11 bp, Unknown
  misc_feature (1)..( 11): Result.003 file - promoters60/1714989
gataaacttaa

SEQ ID NO: 122591 - DNA, 11 bp, Unknown
  misc_feature (1)..( 11): Result.003 file - promoters60/1714989
cccaaaattga

SEQ ID NO: 122592 - DNA, 6 bp, Unknown
  misc_feature (1)..( 6): Result.003 file - promoters60/1715220
tttttt

SEQ ID NO: 122593 - DNA, 6 bp, Unknown
  misc_feature (1)..( 6): Result.003 file - promoters60/1715220
tttttt

SEQ ID NO: 122594 - DNA, 6 bp, Unknown
  misc_feature (1)..( 6): Result.003 file - promoters60/1715220
caataa

SEQ ID NO: 122595 - DNA, 6 bp, Unknown
  misc_feature (1)..( 6): Result.003 file - promoters60/1715220
caataa

SEQ ID NO: 122596 - DNA, 6 bp, Unknown
  misc_feature (1)..( 6): Result.003 file - promoters60/1715220
tttaat

SEQ ID NO: 122597 - DNA, 6 bp, Unknown
  misc_feature (1)..( 6): Result.003 file - promoters60/1715220
tttaat

SEQ ID NO: 122598 - DNA, 7 bp, Unknown
  misc_feature (1)..( 7): Result.003 file - promoters60/1715220
aaatata

SEQ ID NO: 122599 - DNA, 7 bp, Unknown
  misc_feature (1)..( 7): Result.003 file - promoters60/1715220
aaaaata

SEQ ID NO: 122600 - DNA, 7 bp, Unknown
  misc_feature (1)..( 7): Result.003 file - promoters60/1715220
cttaaga

SEQ ID NO: 122601 - DNA, 7 bp, Unknown
  misc_feature (1)..( 7): Result.003 file - promoters60/1715220
ctttaga

SEQ ID NO: 122602 - DNA, 6 bp, Unknown
  misc_feature (1)..( 6): Result.003 file - promoters60/1715220
tcagag

SEQ ID NO: 122603 - DNA, 6 bp, Unknown
  misc_feature (1)..( 6): Result.003 file - promoters60/1715220
tcagag

SEQ ID NO: 122604 - DNA, 6 bp, Unknown
  misc_feature (1)..( 6): Result.003 file - promoters60/1715220
tcttgg

SEQ ID NO: 122605 - DNA, 6 bp, Unknown
  misc_feature (1)..( 6): Result.003 file - promoters60/1715220
tcttgg

SEQ ID NO: 122606 - DNA, 7 bp, Unknown
  misc_feature (1)..( 7): Result.003 file - promoters60/1715220
gttattg

SEQ ID NO: 122607 - DNA, 7 bp, Unknown
  misc_feature (1)..( 7): Result.003 file - promoters60/1715220
gttgttg

SEQ ID NO: 122608 - DNA, 7 bp, Unknown
  misc_feature (1)..( 7): Result.003 file - promoters60/1715220
cgtgttc

SEQ ID NO: 122609 - DNA, 7 bp, Unknown
  misc_feature (1)..( 7): Result.003 file - promoters60/1715220
cgttttc

SEQ ID NO: 122610 - DNA, 6 bp, Unknown
  misc_feature (1)..( 6): Result.003 file - promoters60/1715220
tgttgt

SEQ ID NO: 122611 - DNA, 6 bp, Unknown
  misc_feature (1)..( 6): Result.003 file - promoters60/1715220
tgttgt

SEQ ID NO: 122612 - DNA, 8 bp, Unknown
  misc_feature (1)..( 8): Result.003 file - promoters60/1715220
ttcttctg

SEQ ID NO: 122613 - DNA, 8 bp, Unknown
  misc_feature (1)..( 8): Result.003 file - promoters60/1715220
ttctgctg

SEQ ID NO: 122614 - DNA, 6 bp, Unknown
  misc_feature (1)..( 6): Result.003 file - promoters60/1715220
accaaa

SEQ ID NO: 122615 - DNA, 6 bp, Unknown
  misc_feature (1)..( 6): Result.003 file - promoters60/1715220
accaaa

SEQ ID NO: 122616 - DNA, 6 bp, Unknown
  misc_feature (1)..( 6): Result.003 file - promoters60/1715220
agttgt

SEQ ID NO: 122617 - DNA, 6 bp, Unknown
  misc_feature (1)..( 6): Result.003 file - promoters60/1715220
agttgt

SEQ ID NO: 122618 - DNA, 6 bp, Unknown
  misc_feature (1)..( 6): Result.003 file - promoters60/1715220
cttcct

SEQ ID NO: 122619 - DNA, 6 bp, Unknown
  misc_feature (1)..( 6): Result.003 file - promoters60/1715220
cttcct

SEQ ID NO: 122620 - DNA, 6 bp, Unknown
  misc_feature (1)..( 6): Result.003 file - promoters60/1715220
ctgtca

SEQ ID NO: 122621 - DNA, 6 bp, Unknown
  misc_feature (1)..( 6): Result.003 file - promoters60/1715220
ctgtca

SEQ ID NO: 122622 - DNA, 6 bp, Unknown
  misc_feature (1)..( 6): Result.003 file - promoters60/1715220
atttta

SEQ ID NO: 122623 - DNA, 6 bp, Unknown
  misc_feature (1)..( 6): Result.003 file - promoters60/1715220
atttta

SEQ ID NO: 122624 - DNA, 10 bp, Unknown
  misc_feature (1)..( 10): Result.003 file - promoters60/1715347
acattgtaac

SEQ ID NO: 122625 - DNA, 10 bp, Unknown
  misc_feature (1)..( 10): Result.003 file - promoters60/1715347
acattggtta

SEQ ID NO: 122626 - DNA, 10 bp, Unknown
  misc_feature (1)..( 10): Result.003 file - promoters60/1715347
ccattgtgtg

SEQ ID NO: 122627 - DNA, 10 bp, Unknown
  misc_feature (1)..( 10): Result.003 file - promoters60/1715347
gcattgtttc

SEQ ID NO: 122628 - DNA, 10 bp, Unknown
  misc_feature (1)..( 10): Result.003 file - promoters60/1715347
agattctttt

SEQ ID NO: 122629 - DNA, 10 bp, Unknown
  misc_feature (1)..( 10): Result.003 file - promoters60/1715347
ttattctttt

SEQ ID NO: 122630 - DNA, 9 bp, Unknown
  misc_feature (1)..( 9): Result.003 file - promoters60/1715347
cattgtaac

SEQ ID NO: 122631 - DNA, 9 bp, Unknown
  misc_feature (1)..( 9): Result.003 file - promoters60/1715347
aattctaac

SEQ ID NO: 122632 - DNA, 9 bp, Unknown
  misc_feature (1)..( 9): Result.003 file - promoters60/1715347
cattgtgtg

SEQ ID NO: 122633 - DNA, 9 bp, Unknown
  misc_feature (1)..( 9): Result.003 file - promoters60/1715347
cattgtttc

SEQ ID NO: 122634 - DNA, 9 bp, Unknown
  misc_feature (1)..( 9): Result.003 file - promoters60/1715347
gattctttt

SEQ ID NO: 122635 - DNA, 9 bp, Unknown
  misc_feature (1)..( 9): Result.003 file - promoters60/1715347
tattctttt

SEQ ID NO: 122636 - DNA, 10 bp, Unknown
  misc_feature (1)..( 10): Result.003 file - promoters60/1715347
agaatctcga

SEQ ID NO: 122637 - DNA, 10 bp, Unknown
  misc_feature (1)..( 10): Result.003 file - promoters60/1715347
tgaagctctc

SEQ ID NO: 122638 - DNA, 10 bp, Unknown
  misc_feature (1)..( 10): Result.003 file - promoters60/1715347
acaatatcga

SEQ ID NO: 122639 - DNA, 10 bp, Unknown
  misc_feature (1)..( 10): Result.003 file - promoters60/1715347
tgaagcaact

SEQ ID NO: 122640 - DNA, 10 bp, Unknown
  misc_feature (1)..( 10): Result.003 file - promoters60/1715347
ttacactatt

SEQ ID NO: 122641 - DNA, 10 bp, Unknown
  misc_feature (1)..( 10): Result.003 file - promoters60/1715347
cgacagtata

SEQ ID NO: 122642 - DNA, 11 bp, Unknown
  misc_feature (1)..( 11): Result.003 file - promoters60/1715388
attgggccttt

SEQ ID NO: 122643 - DNA, 11 bp, Unknown
  misc_feature (1)..( 11): Result.003 file - promoters60/1715388
aatgggccttt

SEQ ID NO: 122644 - DNA, 11 bp, Unknown
  misc_feature (1)..( 11): Result.003 file - promoters60/1715388
aattggcgcag

SEQ ID NO: 122645 - DNA, 8 bp, Unknown
  misc_feature (1)..( 8): Result.003 file - promoters60/1715388
aaatcaga

SEQ ID NO: 122646 - DNA, 8 bp, Unknown
  misc_feature (1)..( 8): Result.003 file - promoters60/1715388
aaatcaag

SEQ ID NO: 122647 - DNA, 8 bp, Unknown
  misc_feature (1)..( 8): Result.003 file - promoters60/1715388
taattaag

SEQ ID NO: 122648 - DNA, 10 bp, Unknown
  misc_feature (1)..( 10): Result.003 file - promoters60/1715388
ttgttcttat

SEQ ID NO: 122649 - DNA, 10 bp, Unknown
  misc_feature (1)..( 10): Result.003 file - promoters60/1715388
ttgttattaa

SEQ ID NO: 122650 - DNA, 10 bp, Unknown
  misc_feature (1)..( 10): Result.003 file - promoters60/1715388
ggtttactaa

SEQ ID NO: 122651 - DNA, 9 bp, Unknown
  misc_feature (1)..( 9): Result.003 file - promoters60/1715388
tttctgttc

SEQ ID NO: 122652 - DNA, 9 bp, Unknown
  misc_feature (1)..( 9): Result.003 file - promoters60/1715388
tttatgttc

SEQ ID NO: 122653 - DNA, 9 bp, Unknown
  misc_feature (1)..( 9): Result.003 file - promoters60/1715388
ctactgttc

SEQ ID NO: 122654 - DNA, 6 bp, Unknown
  misc_feature (1)..( 6): Result.003 file - promoters60/1715478
aagaaa

SEQ ID NO: 122655 - DNA, 6 bp, Unknown
  misc_feature (1)..( 6): Result.003 file - promoters60/1715478
aagaaa

SEQ ID NO: 122656 - DNA, 7 bp, Unknown
  misc_feature (1)..( 7): Result.003 file - promoters60/1715478
agaaagt

SEQ ID NO: 122657 - DNA, 7 bp, Unknown
  misc_feature (1)..( 7): Result.003 file - promoters60/1715478
agatagt

SEQ ID NO: 122658 - DNA, 6 bp, Unknown
  misc_feature (1)..( 6): Result.003 file - promoters60/1715478
aaatgc

SEQ ID NO: 122659 - DNA, 6 bp, Unknown
  misc_feature (1)..( 6): Result.003 file - promoters60/1715478
aaatgc

SEQ ID NO: 122660 - DNA, 9 bp, Unknown
  misc_feature (1)..( 9): Result.003 file - promoters60/1715478
ctttataat

SEQ ID NO: 122661 - DNA, 9 bp, Unknown
  misc_feature (1)..( 9): Result.003 file - promoters60/1715478
cattaaaat

SEQ ID NO: 122662 - DNA, 10 bp, Unknown
  misc_feature (1)..( 10): Result.003 file - promoters60/1715478
acttcataga

SEQ ID NO: 122663 - DNA, 9 bp, Unknown
  misc_feature (1)..( 9): Result.003 file - promoters60/1715478
tactccatt

SEQ ID NO: 122664 - DNA, 9 bp, Unknown
  misc_feature (1)..( 9): Result.003 file - promoters60/1715478
tactcaatt

SEQ ID NO: 122665 - DNA, 8 bp, Unknown
  misc_feature (1)..( 8): Result.003 file - promoters60/1715478
ggtgtgat

SEQ ID NO: 122666 - DNA, 8 bp, Unknown
  misc_feature (1)..( 8): Result.003 file - promoters60/1715478
ggtgggat

SEQ ID NO: 122667 - DNA, 6 bp, Unknown
  misc_feature (1)..( 6): Result.003 file - promoters60/1715478
tggaaa

SEQ ID NO: 122668 - DNA, 6 bp, Unknown
  misc_feature (1)..( 6): Result.003 file - promoters60/1715478
tggaaa

SEQ ID NO: 122669 - DNA, 8 bp, Unknown
  misc_feature (1)..( 8): Result.003 file - promoters60/1715478
caacacca

SEQ ID NO: 122670 - DNA, 8 bp, Unknown
  misc_feature (1)..( 8): Result.003 file - promoters60/1715478
caactcca

SEQ ID NO: 122671 - DNA, 7 bp, Unknown
  misc_feature (1)..( 7): Result.003 file - promoters60/1715478
ttacttg

SEQ ID NO: 122672 - DNA, 7 bp, Unknown
  misc_feature (1)..( 7): Result.003 file - promoters60/1715478
ttaattg

SEQ ID NO: 122673 - DNA, 7 bp, Unknown
  misc_feature (1)..( 7): Result.003 file - promoters60/1715478
catttcc

SEQ ID NO: 122674 - DNA, 7 bp, Unknown
  misc_feature (1)..( 7): Result.003 file - promoters60/1715478
catatcc

SEQ ID NO: 122675 - DNA, 7 bp, Unknown
  misc_feature (1)..( 7): Result.003 file - promoters60/1715478
ttatgtc

SEQ ID NO: 122676 - DNA, 7 bp, Unknown
  misc_feature (1)..( 7): Result.003 file - promoters60/1715478
ttatgtc

SEQ ID NO: 122677 - DNA, 10 bp, Unknown
  misc_feature (1)..( 10): Result.003 file - promoters60/1715478
ttttactaac

SEQ ID NO: 122678 - DNA, 10 bp, Unknown
  misc_feature (1)..( 10): Result.003 file - promoters60/1715478
ttttaataac

SEQ ID NO: 122679 - DNA, 7 bp, Unknown
  misc_feature (1)..( 7): Result.003 file - promoters60/1715478
attggta

SEQ ID NO: 122680 - DNA, 7 bp, Unknown
  misc_feature (1)..( 7): Result.003 file - promoters60/1715478
attagta

SEQ ID NO: 122681 - DNA, 7 bp, Unknown
  misc_feature (1)..( 7): Result.003 file - promoters60/1715478
gattcag

SEQ ID NO: 122682 - DNA, 7 bp, Unknown
  misc_feature (1)..( 7): Result.003 file - promoters60/1715478
gattcag

SEQ ID NO: 122683 - DNA, 7 bp, Unknown
  misc_feature (1)..( 7): Result.003 file - promoters60/1715478
gatggat

SEQ ID NO: 122684 - DNA, 7 bp, Unknown
  misc_feature (1)..( 7): Result.003 file - promoters60/1715478
gatcgat

SEQ ID NO: 122685 - DNA, 9 bp, Unknown
  misc_feature (1)..( 9): Result.003 file - promoters60/1715482
caattcaca

SEQ ID NO: 122686 - DNA, 9 bp, Unknown
  misc_feature (1)..( 9): Result.003 file - promoters60/1715482
taattcaaa

SEQ ID NO: 122687 - DNA, 9 bp, Unknown
  misc_feature (1)..( 9): Result.003 file - promoters60/1715482
taactcatg

SEQ ID NO: 122688 - DNA, 9 bp, Unknown
  misc_feature (1)..( 9): Result.003 file - promoters60/1715482
aaattaaaa

SEQ ID NO: 122689 - DNA, 9 bp, Unknown
  misc_feature (1)..( 9): Result.003 file - promoters60/1715482
aaaacaact

SEQ ID NO: 122690 - DNA, 9 bp, Unknown
  misc_feature (1)..( 9): Result.003 file - promoters60/1715482
caaataact

SEQ ID NO: 122691 - DNA, 9 bp, Unknown
  misc_feature (1)..( 9): Result.003 file - promoters60/1715482
aaaacagta

SEQ ID NO: 122692 - DNA, 9 bp, Unknown
  misc_feature (1)..( 9): Result.003 file - promoters60/1715482
gaaacaatc

SEQ ID NO: 122693 - DNA, 6 bp, Unknown
  misc_feature (1)..( 6): Result.003 file - promoters60/1715510
atgatt

SEQ ID NO: 122694 - DNA, 6 bp, Unknown
  misc_feature (1)..( 6): Result.003 file - promoters60/1715510
atgatt

SEQ ID NO: 122695 - DNA, 6 bp, Unknown
  misc_feature (1)..( 6): Result.003 file - promoters60/1715510
aaaaga

SEQ ID NO: 122696 - DNA, 6 bp, Unknown
  misc_feature (1)..( 6): Result.003 file - promoters60/1715510
aaaaga

SEQ ID NO: 122697 - DNA, 7 bp, Unknown
  misc_feature (1)..( 7): Result.003 file - promoters60/1715510
aaatatt

SEQ ID NO: 122698 - DNA, 7 bp, Unknown
  misc_feature (1)..( 7): Result.003 file - promoters60/1715510
aaatatt

SEQ ID NO: 122699 - DNA, 8 bp, Unknown
  misc_feature (1)..( 8): Result.003 file - promoters60/1715510
attcaatt

SEQ ID NO: 122700 - DNA, 8 bp, Unknown
  misc_feature (1)..( 8): Result.003 file - promoters60/1715510
atttaatt

SEQ ID NO: 122701 - DNA, 7 bp, Unknown
  misc_feature (1)..( 7): Result.003 file - promoters60/1715510
tcatttt

SEQ ID NO: 122702 - DNA, 7 bp, Unknown
  misc_feature (1)..( 7): Result.003 file - promoters60/1715510
tcaattt

SEQ ID NO: 122703 - DNA, 7 bp, Unknown
  misc_feature (1)..( 7): Result.003 file - promoters60/1715510
tttgttt

SEQ ID NO: 122704 - DNA, 7 bp, Unknown
  misc_feature (1)..( 7): Result.003 file - promoters60/1715510
tttattt

SEQ ID NO: 122705 - DNA, 6 bp, Unknown
  misc_feature (1)..( 6): Result.003 file - promoters60/1715510
agtaaa

SEQ ID NO: 122706 - DNA, 6 bp, Unknown
  misc_feature (1)..( 6): Result.003 file - promoters60/1715510
agtaaa

SEQ ID NO: 122707 - DNA, 6 bp, Unknown
  misc_feature (1)..( 6): Result.003 file - promoters60/1715510
acaaaa

SEQ ID NO: 122708 - DNA, 6 bp, Unknown
  misc_feature (1)..( 6): Result.003 file - promoters60/1715510
acaaaa

SEQ ID NO: 122709 - DNA, 9 bp, Unknown
  misc_feature (1)..( 9): Result.003 file - promoters60/1715510
aattacaca

SEQ ID NO: 122710 - DNA, 9 bp, Unknown
  misc_feature (1)..( 9): Result.003 file - promoters60/1715510
aattataca

SEQ ID NO: 122711 - DNA, 7 bp, Unknown
  misc_feature (1)..( 7): Result.003 file - promoters60/1715510
aaagtaa

SEQ ID NO: 122712 - DNA, 7 bp, Unknown
  misc_feature (1)..( 7): Result.003 file - promoters60/1715510
aaactaa

SEQ ID NO: 122713 - DNA, 7 bp, Unknown
  misc_feature (1)..( 7): Result.003 file - promoters60/1715510
attatga

SEQ ID NO: 122714 - DNA, 7 bp, Unknown
  misc_feature (1)..( 7): Result.003 file - promoters60/1715510
attttga

SEQ ID NO: 122715 - DNA, 8 bp, Unknown
  misc_feature (1)..( 8): Result.003 file - promoters60/1715510
tttgtatt

SEQ ID NO: 122716 - DNA, 8 bp, Unknown
  misc_feature (1)..( 8): Result.003 file - promoters60/1715510
tttggatt

SEQ ID NO: 122717 - DNA, 8 bp, Unknown
  misc_feature (1)..( 8): Result.003 file - promoters60/1715510
gactacct

SEQ ID NO: 122718 - DNA, 8 bp, Unknown
  misc_feature (1)..( 8): Result.003 file - promoters60/1715510
gactgcct

SEQ ID NO: 122719 - DNA, 6 bp, Unknown
  misc_feature (1)..( 6): Result.003 file - promoters60/1715510
atccaa

SEQ ID NO: 122720 - DNA, 6 bp, Unknown
  misc_feature (1)..( 6): Result.003 file - promoters60/1715510
atccaa

SEQ ID NO: 122721 - DNA, 7 bp, Unknown
  misc_feature (1)..( 7): Result.003 file - promoters60/1715510
ttctcgt

SEQ ID NO: 122722 - DNA, 7 bp, Unknown
  misc_feature (1)..( 7): Result.003 file - promoters60/1715510
ttcacgt

SEQ ID NO: 122723 - DNA, 6 bp, Unknown
  misc_feature (1)..( 6): Result.003 file - promoters60/1715510
atttga

SEQ ID NO: 122724 - DNA, 6 bp, Unknown
  misc_feature (1)..( 6): Result.003 file - promoters60/1715510
atttga

SEQ ID NO: 122725 - DNA, 6 bp, Unknown
  misc_feature (1)..( 6): Result.003 file - promoters60/1715516
agaata

SEQ ID NO: 122726 - DNA, 6 bp, Unknown
  misc_feature (1)..( 6): Result.003 file - promoters60/1715516
agaata

SEQ ID NO: 122727 - DNA, 7 bp, Unknown
  misc_feature (1)..( 7): Result.003 file - promoters60/1715516
atatttt

SEQ ID NO: 122728 - DNA, 7 bp, Unknown
  misc_feature (1)..( 7): Result.003 file - promoters60/1715516
ttatttt

SEQ ID NO: 122729 - DNA, 7 bp, Unknown
  misc_feature (1)..( 7): Result.003 file - promoters60/1715516
ttatttc

SEQ ID NO: 122730 - DNA, 6 bp, Unknown
  misc_feature (1)..( 6): Result.003 file - promoters60/1715516
taacaa

SEQ ID NO: 122731 - DNA, 6 bp, Unknown
  misc_feature (1)..( 6): Result.003 file - promoters60/1715516
taacaa

SEQ ID NO: 122732 - DNA, 8 bp, Unknown
  misc_feature (1)..( 8): Result.003 file - promoters60/1715516
atttaata

SEQ ID NO: 122733 - DNA, 8 bp, Unknown
  misc_feature (1)..( 8): Result.003 file - promoters60/1715516
atttaaaa

SEQ ID NO: 122734 - DNA, 8 bp, Unknown
  misc_feature (1)..( 8): Result.003 file - promoters60/1715516
attaaaaa

SEQ ID NO: 122735 - DNA, 6 bp, Unknown
  misc_feature (1)..( 6): Result.003 file - promoters60/1715516
taatta

SEQ ID NO: 122736 - DNA, 6 bp, Unknown
  misc_feature (1)..( 6): Result.003 file - promoters60/1715516
taatta

SEQ ID NO: 122737 - DNA, 6 bp, Unknown
  misc_feature (1)..( 6): Result.003 file - promoters60/1715516
ccatga

SEQ ID NO: 122738 - DNA, 6 bp, Unknown
  misc_feature (1)..( 6): Result.003 file - promoters60/1715516
ccatga

SEQ ID NO: 122739 - DNA, 7 bp, Unknown
  misc_feature (1)..( 7): Result.003 file - promoters60/1715516
gataata

SEQ ID NO: 122740 - DNA, 7 bp, Unknown
  misc_feature (1)..( 7): Result.003 file - promoters60/1715516
gatgata

SEQ ID NO: 122741 - DNA, 7 bp, Unknown
  misc_feature (1)..( 7): Result.003 file - promoters60/1715516
ttacaaa

SEQ ID NO: 122742 - DNA, 7 bp, Unknown
  misc_feature (1)..( 7): Result.003 file - promoters60/1715516
ttaaaaa

SEQ ID NO: 122743 - DNA, 8 bp, Unknown
  misc_feature (1)..( 8): Result.003 file - promoters60/1715516
taattaaa

SEQ ID NO: 122744 - DNA, 8 bp, Unknown
  misc_feature (1)..( 8): Result.003 file - promoters60/1715516
taatgaaa

SEQ ID NO: 122745 - DNA, 6 bp, Unknown
  misc_feature (1)..( 6): Result.003 file - promoters60/1715516
aaacaa

SEQ ID NO: 122746 - DNA, 6 bp, Unknown
  misc_feature (1)..( 6): Result.003 file - promoters60/1715516
aaacaa

SEQ ID NO: 122747 - DNA, 12 bp, Unknown
  misc_feature (1)..( 12): Result.003 file - promoters60/1715516
ctcctataaatt

SEQ ID NO: 122748 - DNA, 12 bp, Unknown
  misc_feature (1)..( 12): Result.003 file - promoters60/1715516
ttcctatatatc

SEQ ID NO: 122749 - DNA, 12 bp, Unknown
  misc_feature (1)..( 12): Result.003 file - promoters60/1715516
ctcttatatatt

SEQ ID NO: 122750 - DNA, 6 bp, Unknown
  misc_feature (1)..( 6): Result.003 file - promoters60/1715516
ttttta

SEQ ID NO: 122751 - DNA, 6 bp, Unknown
  misc_feature (1)..( 6): Result.003 file - promoters60/1715516
ttttta

SEQ ID NO: 122752 - DNA, 7 bp, Unknown
  misc_feature (1)..( 7): Result.003 file - promoters60/1715516
atatatt

SEQ ID NO: 122753 - DNA, 7 bp, Unknown
  misc_feature (1)..( 7): Result.003 file - promoters60/1715516
atagatt

SEQ ID NO: 122754 - DNA, 7 bp, Unknown
  misc_feature (1)..( 7): Result.003 file - promoters60/1715516
atttcca

SEQ ID NO: 122755 - DNA, 7 bp, Unknown
  misc_feature (1)..( 7): Result.003 file - promoters60/1715516
attacca

SEQ ID NO: 122756 - DNA, 10 bp, Unknown
  misc_feature (1)..( 10): Result.003 file - promoters60/1715516
aagatatatg

SEQ ID NO: 122757 - DNA, 10 bp, Unknown
  misc_feature (1)..( 10): Result.003 file - promoters60/1715516
aagaaatatg

SEQ ID NO: 122758 - DNA, 7 bp, Unknown
  misc_feature (1)..( 7): Result.003 file - promoters60/1715516
atatgaa

SEQ ID NO: 122759 - DNA, 7 bp, Unknown
  misc_feature (1)..( 7): Result.003 file - promoters60/1715516
ataggaa

SEQ ID NO: 122760 - DNA, 7 bp, Unknown
  misc_feature (1)..( 7): Result.003 file - promoters60/1715516
aaaacaa

SEQ ID NO: 122761 - DNA, 7 bp, Unknown
  misc_feature (1)..( 7): Result.003 file - promoters60/1715516
aaagcaa

SEQ ID NO: 122762 - DNA, 12 bp, Unknown
  misc_feature (1)..( 12): Result.003 file - promoters60/1715516
aaaagaagaaag

SEQ ID NO: 122763 - DNA, 12 bp, Unknown
  misc_feature (1)..( 12): Result.003 file - promoters60/1715516
aaacgaagaaag

SEQ ID NO: 122764 - DNA, 7 bp, Unknown
  misc_feature (1)..( 7): Result.003 file - promoters60/1715516
agcccat

SEQ ID NO: 122765 - DNA, 7 bp, Unknown
  misc_feature (1)..( 7): Result.003 file - promoters60/1715516
agcacat

SEQ ID NO: 122766 - DNA, 7 bp, Unknown
  misc_feature (1)..( 7): Result.003 file - promoters60/1715516
tatttct

SEQ ID NO: 122767 - DNA, 7 bp, Unknown
  misc_feature (1)..( 7): Result.003 file - promoters60/1715516
tatatct

SEQ ID NO: 122768 - DNA, 10 bp, Unknown
  misc_feature (1)..( 10): Result.003 file - promoters60/1715516
atattttaac

SEQ ID NO: 122769 - DNA, 10 bp, Unknown
  misc_feature (1)..( 10): Result.003 file - promoters60/1715516
atagtttaac

SEQ ID NO: 122770 - DNA, 7 bp, Unknown
  misc_feature (1)..( 7): Result.003 file - promoters60/1715516
aaggaaa

SEQ ID NO: 122771 - DNA, 7 bp, Unknown
  misc_feature (1)..( 7): Result.003 file - promoters60/1715516
aagtaaa

SEQ ID NO: 122772 - DNA, 8 bp, Unknown
  misc_feature (1)..( 8): Result.003 file - promoters60/1715516
aactattt

SEQ ID NO: 122773 - DNA, 8 bp, Unknown
  misc_feature (1)..( 8): Result.003 file - promoters60/1715516
aacttttt

SEQ ID NO: 122774 - DNA, 6 bp, Unknown
  misc_feature (1)..( 6): Result.003 file - promoters60/1715516
aatatg

SEQ ID NO: 122775 - DNA, 6 bp, Unknown
  misc_feature (1)..( 6): Result.003 file - promoters60/1715516
aatatg

SEQ ID NO: 122776 - DNA, 6 bp, Unknown
  misc_feature (1)..( 6): Result.003 file - promoters60/1715516
ttaggc

SEQ ID NO: 122777 - DNA, 6 bp, Unknown
  misc_feature (1)..( 6): Result.003 file - promoters60/1715516
ttaggc

SEQ ID NO: 122778 - DNA, 11 bp, Unknown
  misc_feature (1)..( 11): Result.003 file - promoters60/1715535
aaaaatattcg

SEQ ID NO: 122779 - DNA, 11 bp, Unknown
  misc_feature (1)..( 11): Result.003 file - promoters60/1715535
taaactattta

SEQ ID NO: 122780 - DNA, 11 bp, Unknown
  misc_feature (1)..( 11): Result.003 file - promoters60/1715535
gcaaattttca

SEQ ID NO: 122781 - DNA, 11 bp, Unknown
  misc_feature (1)..( 11): Result.003 file - promoters60/1715535
aaaaatacatg

SEQ ID NO: 122782 - DNA, 11 bp, Unknown
  misc_feature (1)..( 11): Result.003 file - promoters60/1715535
gtggattttct

SEQ ID NO: 122783 - DNA, 11 bp, Unknown
  misc_feature (1)..( 11): Result.003 file - promoters60/1715535
gaaaatttcac

SEQ ID NO: 122784 - DNA, 11 bp, Unknown
  misc_feature (1)..( 11): Result.003 file - promoters60/1715535
caaaatttcac

SEQ ID NO: 122785 - DNA, 19 bp, Unknown
  misc_feature (1)..( 19): Result.003 file - promoters60/1715535
tttttctcttaacaattat

SEQ ID NO: 122786 - DNA, 19 bp, Unknown
  misc_feature (1)..( 19): Result.003 file - promoters60/1715535
gtagactcttagcaaaact

SEQ ID NO: 122787 - DNA, 19 bp, Unknown
  misc_feature (1)..( 19): Result.003 file - promoters60/1715535
aaatacccagaacaatgat

SEQ ID NO: 122788 - DNA, 19 bp, Unknown
  misc_feature (1)..( 19): Result.003 file - promoters60/1715535
tgaatttaaaaacaagtat

SEQ ID NO: 122789 - DNA, 19 bp, Unknown
  misc_feature (1)..( 19): Result.003 file - promoters60/1715535
gtaaacttttaaatagaaa

SEQ ID NO: 122790 - DNA, 19 bp, Unknown
  misc_feature (1)..( 19): Result.003 file - promoters60/1715535
agaaaatctgaaaaattca

SEQ ID NO: 122791 - DNA, 13 bp, Unknown
  misc_feature (1)..( 13): Result.003 file - promoters60/1715535
tgtaattatattc

SEQ ID NO: 122792 - DNA, 13 bp, Unknown
  misc_feature (1)..( 13): Result.003 file - promoters60/1715535
aaaaattatataa

SEQ ID NO: 122793 - DNA, 13 bp, Unknown
  misc_feature (1)..( 13): Result.003 file - promoters60/1715535
ctcgtgtattttc

SEQ ID NO: 122794 - DNA, 13 bp, Unknown
  misc_feature (1)..( 13): Result.003 file - promoters60/1715535
aacaattatgttt

SEQ ID NO: 122795 - DNA, 13 bp, Unknown
  misc_feature (1)..( 13): Result.003 file - promoters60/1715535
accaataataaaa

SEQ ID NO: 122796 - DNA, 13 bp, Unknown
  misc_feature (1)..( 13): Result.003 file - promoters60/1715535
aacgattaaatgt

SEQ ID NO: 122797 - DNA, 11 bp, Unknown
  misc_feature (1)..( 11): Result.003 file - promoters60/1715595
ggtctcatata

SEQ ID NO: 122798 - DNA, 11 bp, Unknown
  misc_feature (1)..( 11): Result.003 file - promoters60/1715595
ggtctcacata

SEQ ID NO: 122799 - DNA, 11 bp, Unknown
  misc_feature (1)..( 11): Result.003 file - promoters60/1715595
atacacacata

SEQ ID NO: 122800 - DNA, 9 bp, Unknown
  misc_feature (1)..( 9): Result.003 file - promoters60/1715595
ctcaggcct

SEQ ID NO: 122801 - DNA, 9 bp, Unknown
  misc_feature (1)..( 9): Result.003 file - promoters60/1715595
ctccggcga

SEQ ID NO: 122802 - DNA, 9 bp, Unknown
  misc_feature (1)..( 9): Result.003 file - promoters60/1715595
taccgacga

SEQ ID NO: 122803 - DNA, 7 bp, Unknown
  misc_feature (1)..( 7): Result.003 file - promoters60/1715615
tataatg

SEQ ID NO: 122804 - DNA, 7 bp, Unknown
  misc_feature (1)..( 7): Result.003 file - promoters60/1715615
tatcatg

SEQ ID NO: 122805 - DNA, 6 bp, Unknown
  misc_feature (1)..( 6): Result.003 file - promoters60/1715615
ttgttt

SEQ ID NO: 122806 - DNA, 6 bp, Unknown
  misc_feature (1)..( 6): Result.003 file - promoters60/1715615
ttgttt

SEQ ID NO: 122807 - DNA, 6 bp, Unknown
  misc_feature (1)..( 6): Result.003 file - promoters60/1715615
aatcag

SEQ ID NO: 122808 - DNA, 6 bp, Unknown
  misc_feature (1)..( 6): Result.003 file - promoters60/1715615
aatcag

SEQ ID NO: 122809 - DNA, 6 bp, Unknown
  misc_feature (1)..( 6): Result.003 file - promoters60/1715615
taagga

SEQ ID NO: 122810 - DNA, 6 bp, Unknown
  misc_feature (1)..( 6): Result.003 file - promoters60/1715615
taagga

SEQ ID NO: 122811 - DNA, 8 bp, Unknown
  misc_feature (1)..( 8): Result.003 file - promoters60/1715615
actgttcc

SEQ ID NO: 122812 - DNA, 8 bp, Unknown
  misc_feature (1)..( 8): Result.003 file - promoters60/1715615
tctgttcc

SEQ ID NO: 122813 - DNA, 8 bp, Unknown
  misc_feature (1)..( 8): Result.003 file - promoters60/1715615
tctgttaa

SEQ ID NO: 122814 - DNA, 6 bp, Unknown
  misc_feature (1)..( 6): Result.003 file - promoters60/1715615
taaaga

SEQ ID NO: 122815 - DNA, 6 bp, Unknown
  misc_feature (1)..( 6): Result.003 file - promoters60/1715615
taaaga

SEQ ID NO: 122816 - DNA, 7 bp, Unknown
  misc_feature (1)..( 7): Result.003 file - promoters60/1715615
atctaag

SEQ ID NO: 122817 - DNA, 7 bp, Unknown
  misc_feature (1)..( 7): Result.003 file - promoters60/1715615
atcgaag

SEQ ID NO: 122818 - DNA, 7 bp, Unknown
  misc_feature (1)..( 7): Result.003 file - promoters60/1715615
aattctc

SEQ ID NO: 122819 - DNA, 7 bp, Unknown
  misc_feature (1)..( 7): Result.003 file - promoters60/1715615
aatgctc

SEQ ID NO: 122820 - DNA, 9 bp, Unknown
  misc_feature (1)..( 9): Result.003 file - promoters60/1715615
atgtgcatt

SEQ ID NO: 122821 - DNA, 9 bp, Unknown
  misc_feature (1)..( 9): Result.003 file - promoters60/1715615
atgtccatt

SEQ ID NO: 122822 - DNA, 8 bp, Unknown
  misc_feature (1)..( 8): Result.003 file - promoters60/1715615
ttttgttt

SEQ ID NO: 122823 - DNA, 8 bp, Unknown
  misc_feature (1)..( 8): Result.003 file - promoters60/1715615
ttttcttt

SEQ ID NO: 122824 - DNA, 7 bp, Unknown
  misc_feature (1)..( 7): Result.003 file - promoters60/1715615
atctctt

SEQ ID NO: 122825 - DNA, 7 bp, Unknown
  misc_feature (1)..( 7): Result.003 file - promoters60/1715615
atctctt

SEQ ID NO: 122826 - DNA, 8 bp, Unknown
  misc_feature (1)..( 8): Result.003 file - promoters60/1715615
tcaacttt

SEQ ID NO: 122827 - DNA, 8 bp, Unknown
  misc_feature (1)..( 8): Result.003 file - promoters60/1715615
tcatcttt

SEQ ID NO: 122828 - DNA, 7 bp, Unknown
  misc_feature (1)..( 7): Result.003 file - promoters60/1715615
gaaacaa

SEQ ID NO: 122829 - DNA, 7 bp, Unknown
  misc_feature (1)..( 7): Result.003 file - promoters60/1715615
gaagcaa

SEQ ID NO: 122830 - DNA, 11 bp, Unknown
  misc_feature (1)..( 11): Result.003 file - promoters60/1715810
ttaatttaaag

SEQ ID NO: 122831 - DNA, 11 bp, Unknown
  misc_feature (1)..( 11): Result.003 file - promoters60/1715810
ttaaattaaaa

SEQ ID NO: 122832 - DNA, 11 bp, Unknown
  misc_feature (1)..( 11): Result.003 file - promoters60/1715810
gaaaataaaat

SEQ ID NO: 122833 - DNA, 11 bp, Unknown
  misc_feature (1)..( 11): Result.003 file - promoters60/1715810
ggaaatgaaat

SEQ ID NO: 122834 - DNA, 7 bp, Unknown
  misc_feature (1)..( 7): Result.003 file - promoters60/1715810
aaatttt

SEQ ID NO: 122835 - DNA, 7 bp, Unknown
  misc_feature (1)..( 7): Result.003 file - promoters60/1715810
gaatttt

SEQ ID NO: 122836 - DNA, 7 bp, Unknown
  misc_feature (1)..( 7): Result.003 file - promoters60/1715810
gaattta

SEQ ID NO: 122837 - DNA, 8 bp, Unknown
  misc_feature (1)..( 8): Result.003 file - promoters60/1715810
gtttcttt

SEQ ID NO: 122838 - DNA, 8 bp, Unknown
  misc_feature (1)..( 8): Result.003 file - promoters60/1715810
ttttctta

SEQ ID NO: 122839 - DNA, 8 bp, Unknown
  misc_feature (1)..( 8): Result.003 file - promoters60/1715810
gtttattt

SEQ ID NO: 122840 - DNA, 10 bp, Unknown
  misc_feature (1)..( 10): Result.003 file - promoters60/1715810
aaaaatcaag

SEQ ID NO: 122841 - DNA, 10 bp, Unknown
  misc_feature (1)..( 10): Result.003 file - promoters60/1715810
aaaaaacaaa

SEQ ID NO: 122842 - DNA, 10 bp, Unknown
  misc_feature (1)..( 10): Result.003 file - promoters60/1715810
caaaatcaag

SEQ ID NO: 122843 - DNA, 12 bp, Unknown
  misc_feature (1)..( 12): Result.003 file - promoters60/1715810
aaaagactaaaa

SEQ ID NO: 122844 - DNA, 12 bp, Unknown
  misc_feature (1)..( 12): Result.003 file - promoters60/1715810
aaaagagtaaaa

SEQ ID NO: 122845 - DNA, 12 bp, Unknown
  misc_feature (1)..( 12): Result.003 file - promoters60/1715810
aaaaaacttaga

SEQ ID NO: 122846 - DNA, 11 bp, Unknown
  misc_feature (1)..( 11): Result.003 file - promoters60/1715810
aaaaagacatc

SEQ ID NO: 122847 - DNA, 11 bp, Unknown
  misc_feature (1)..( 11): Result.003 file - promoters60/1715810
aaaaagaaaag

SEQ ID NO: 122848 - DNA, 11 bp, Unknown
  misc_feature (1)..( 11): Result.003 file - promoters60/1715810
ttaaagtaaag

SEQ ID NO: 122849 - DNA, 6 bp, Unknown
  misc_feature (1)..( 6): Result.003 file - promoters60/1715810
taaatt

SEQ ID NO: 122850 - DNA, 6 bp, Unknown
  misc_feature (1)..( 6): Result.003 file - promoters60/1715810
taaatt

SEQ ID NO: 122851 - DNA, 6 bp, Unknown
  misc_feature (1)..( 6): Result.003 file - promoters60/1715810
taaatt

SEQ ID NO: 122852 - DNA, 8 bp, Unknown
  misc_feature (1)..( 8): Result.003 file - promoters60/1715810
acctaaac

SEQ ID NO: 122853 - DNA, 8 bp, Unknown
  misc_feature (1)..( 8): Result.003 file - promoters60/1715810
aactaaac

SEQ ID NO: 122854 - DNA, 8 bp, Unknown
  misc_feature (1)..( 8): Result.003 file - promoters60/1715810
aactaaaa

SEQ ID NO: 122855 - DNA, 9 bp, Unknown
  misc_feature (1)..( 9): Result.003 file - promoters60/1715810
ttaaataat

SEQ ID NO: 122856 - DNA, 9 bp, Unknown
  misc_feature (1)..( 9): Result.003 file - promoters60/1715810
ttaactaaa

SEQ ID NO: 122857 - DNA, 9 bp, Unknown
  misc_feature (1)..( 9): Result.003 file - promoters60/1715810
aaaactaaa

SEQ ID NO: 122858 - DNA, 10 bp, Unknown
  misc_feature (1)..( 10): Result.003 file - promoters60/1716040
aagtttaaaa

SEQ ID NO: 122859 - DNA, 9 bp, Unknown
  misc_feature (1)..( 9): Result.003 file - promoters60/1716040
tttttaaat

SEQ ID NO: 122860 - DNA, 10 bp, Unknown
  misc_feature (1)..( 10): Result.003 file - promoters60/1716040
gttattaaag

SEQ ID NO: 122861 - DNA, 10 bp, Unknown
  misc_feature (1)..( 10): Result.003 file - promoters60/1716040
aaaaaacttt

SEQ ID NO: 122862 - DNA, 10 bp, Unknown
  misc_feature (1)..( 10): Result.003 file - promoters60/1716040
ttgcaacttt

SEQ ID NO: 122863 - DNA, 10 bp, Unknown
  misc_feature (1)..( 10): Result.003 file - promoters60/1716040
ttgcaccttt

SEQ ID NO: 122864 - DNA, 9 bp, Unknown
  misc_feature (1)..( 9): Result.003 file - promoters60/1716040
tttcttatt

SEQ ID NO: 122865 - DNA, 9 bp, Unknown
  misc_feature (1)..( 9): Result.003 file - promoters60/1716040
aatctaatt

SEQ ID NO: 122866 - DNA, 9 bp, Unknown
  misc_feature (1)..( 9): Result.003 file - promoters60/1716040
ttttttaat

SEQ ID NO: 122867 - DNA, 8 bp, Unknown
  misc_feature (1)..( 8): Result.003 file - promoters60/1716040
tattattt

SEQ ID NO: 122868 - DNA, 8 bp, Unknown
  misc_feature (1)..( 8): Result.003 file - promoters60/1716040
gattcttt

SEQ ID NO: 122869 - DNA, 8 bp, Unknown
  misc_feature (1)..( 8): Result.003 file - promoters60/1716040
gattctct

SEQ ID NO: 122870 - DNA, 8 bp, Unknown
  misc_feature (1)..( 8): Result.003 file - promoters60/1716040
atttcagg

SEQ ID NO: 122871 - DNA, 8 bp, Unknown
  misc_feature (1)..( 8): Result.003 file - promoters60/1716040
atttcatg

SEQ ID NO: 122872 - DNA, 8 bp, Unknown
  misc_feature (1)..( 8): Result.003 file - promoters60/1716040
attacatg

SEQ ID NO: 122873 - DNA, 7 bp, Unknown
  misc_feature (1)..( 7): Result.003 file - promoters60/1716040
ttggttc

SEQ ID NO: 122874 - DNA, 7 bp, Unknown
  misc_feature (1)..( 7): Result.003 file - promoters60/1716040
atggttc

SEQ ID NO: 122875 - DNA, 7 bp, Unknown
  misc_feature (1)..( 7): Result.003 file - promoters60/1716040
atggttt

SEQ ID NO: 122876 - DNA, 9 bp, Unknown
  misc_feature (1)..( 9): Result.003 file - promoters60/1806998
tataaagaa

SEQ ID NO: 122877 - DNA, 9 bp, Unknown
  misc_feature (1)..( 9): Result.003 file - promoters60/1806998
tatgaaggt

SEQ ID NO: 122878 - DNA, 9 bp, Unknown
  misc_feature (1)..( 9): Result.003 file - promoters60/1806998
aataacgaa

SEQ ID NO: 122879 - DNA, 10 bp, Unknown
  misc_feature (1)..( 10): Result.003 file - promoters60/1806998
aactcaaaaa

SEQ ID NO: 122880 - DNA, 10 bp, Unknown
  misc_feature (1)..( 10): Result.003 file - promoters60/1806998
aacacaaagt

SEQ ID NO: 122881 - DNA, 10 bp, Unknown
  misc_feature (1)..( 10): Result.003 file - promoters60/1806998
ataacaaagt

SEQ ID NO: 122882 - DNA, 8 bp, Unknown
  misc_feature (1)..( 8): Result.003 file - promoters60/1807067
ttttcaaa

SEQ ID NO: 122883 - DNA, 8 bp, Unknown
  misc_feature (1)..( 8): Result.003 file - promoters60/1807067
ttttgaaa

SEQ ID NO: 122884 - DNA, 8 bp, Unknown
  misc_feature (1)..( 8): Result.003 file - promoters60/1807067
atttaaaa

SEQ ID NO: 122885 - DNA, 10 bp, Unknown
  misc_feature (1)..( 10): Result.003 file - promoters60/1807067
caacttattt

SEQ ID NO: 122886 - DNA, 10 bp, Unknown
  misc_feature (1)..( 10): Result.003 file - promoters60/1807067
taacttattg

SEQ ID NO: 122887 - DNA, 10 bp, Unknown
  misc_feature (1)..( 10): Result.003 file - promoters60/1807067
caactaattt

SEQ ID NO: 122888 - DNA, 8 bp, Unknown
  misc_feature (1)..( 8): Result.003 file - promoters60/1807067
aatatttt

SEQ ID NO: 122889 - DNA, 8 bp, Unknown
  misc_feature (1)..( 8): Result.003 file - promoters60/1807067
gttatttt

SEQ ID NO: 122890 - DNA, 8 bp, Unknown
  misc_feature (1)..( 8): Result.003 file - promoters60/1807067
aatatttt

SEQ ID NO: 122891 - DNA, 13 bp, Unknown
  misc_feature (1)..( 13): Result.003 file - promoters60/1807067
attatattaacat

SEQ ID NO: 122892 - DNA, 13 bp, Unknown
  misc_feature (1)..( 13): Result.003 file - promoters60/1807067
attttatcaatgg

SEQ ID NO: 122893 - DNA, 13 bp, Unknown
  misc_feature (1)..( 13): Result.003 file - promoters60/1807067
tgtatatgaacat

SEQ ID NO: 122894 - DNA, 9 bp, Unknown
  misc_feature (1)..( 9): Result.003 file - promoters60/1807067
atgatcaaa

SEQ ID NO: 122895 - DNA, 9 bp, Unknown
  misc_feature (1)..( 9): Result.003 file - promoters60/1807067
atgttcata

SEQ ID NO: 122896 - DNA, 9 bp, Unknown
  misc_feature (1)..( 9): Result.003 file - promoters60/1807067
aagataaaa

SEQ ID NO: 122897 - DNA, 8 bp, Unknown
  misc_feature (1)..( 8): Result.003 file - promoters60/1807067
ttaaaaca

SEQ ID NO: 122898 - DNA, 8 bp, Unknown
  misc_feature (1)..( 8): Result.003 file - promoters60/1807067
ttaaaaca

SEQ ID NO: 122899 - DNA, 8 bp, Unknown
  misc_feature (1)..( 8): Result.003 file - promoters60/1807067
ataaaaca

SEQ ID NO: 122900 - DNA, 10 bp, Unknown
  misc_feature (1)..( 10): Result.003 file - promoters60/1807067
ttgatcaaca

SEQ ID NO: 122901 - DNA, 10 bp, Unknown
  misc_feature (1)..( 10): Result.003 file - promoters60/1807067
ttgataaacg

SEQ ID NO: 122902 - DNA, 10 bp, Unknown
  misc_feature (1)..( 10): Result.003 file - promoters60/1807067
ggtatccaca

SEQ ID NO: 122903 - DNA, 9 bp, Unknown
  misc_feature (1)..( 9): Result.003 file - promoters60/1807067
atgtattat

SEQ ID NO: 122904 - DNA, 9 bp, Unknown
  misc_feature (1)..( 9): Result.003 file - promoters60/1807067
atgaattag

SEQ ID NO: 122905 - DNA, 9 bp, Unknown
  misc_feature (1)..( 9): Result.003 file - promoters60/1807067
gtgtaatat

SEQ ID NO: 122906 - DNA, 10 bp, Unknown
  misc_feature (1)..( 10): Result.003 file - promoters60/1807067
atatcaataa

SEQ ID NO: 122907 - DNA, 10 bp, Unknown
  misc_feature (1)..( 10): Result.003 file - promoters60/1807067
atataaataa

SEQ ID NO: 122908 - DNA, 10 bp, Unknown
  misc_feature (1)..( 10): Result.003 file - promoters60/1807067
atataaagaa

SEQ ID NO: 122909 - DNA, 7 bp, Unknown
  misc_feature (1)..( 7): Result.003 file - promoters60/1807067
aattttt

SEQ ID NO: 122910 - DNA, 7 bp, Unknown
  misc_feature (1)..( 7): Result.003 file - promoters60/1807067
aatattt

SEQ ID NO: 122911 - DNA, 6 bp, Unknown
  misc_feature (1)..( 6): Result.003 file - promoters60/1807067
atattt

SEQ ID NO: 122912 - DNA, 10 bp, Unknown
  misc_feature (1)..( 10): Result.003 file - promoters60/1807067
cacatatata

SEQ ID NO: 122913 - DNA, 10 bp, Unknown
  misc_feature (1)..( 10): Result.003 file - promoters60/1807067
tttatatata

SEQ ID NO: 122914 - DNA, 10 bp, Unknown
  misc_feature (1)..( 10): Result.003 file - promoters60/1807067
tctttaaata

SEQ ID NO: 122915 - DNA, 8 bp, Unknown
  misc_feature (1)..( 8): Result.003 file - promoters60/1807067
tatataaa

SEQ ID NO: 122916 - DNA, 8 bp, Unknown
  misc_feature (1)..( 8): Result.003 file - promoters60/1807067
tatttaaa

SEQ ID NO: 122917 - DNA, 8 bp, Unknown
  misc_feature (1)..( 8): Result.003 file - promoters60/1807067
tctttaaa

SEQ ID NO: 122918 - DNA, 8 bp, Unknown
  misc_feature (1)..( 8): Result.003 file - promoters60/1807067
acatgtat

SEQ ID NO: 122919 - DNA, 8 bp, Unknown
  misc_feature (1)..( 8): Result.003 file - promoters60/1807067
acatgtta

SEQ ID NO: 122920 - DNA, 8 bp, Unknown
  misc_feature (1)..( 8): Result.003 file - promoters60/1807067
tcatatta

SEQ ID NO: 122921 - DNA, 9 bp, Unknown
  misc_feature (1)..( 9): Result.003 file - promoters60/1807244
tgtcctaat

SEQ ID NO: 122922 - DNA, 9 bp, Unknown
  misc_feature (1)..( 9): Result.003 file - promoters60/1807244
tgtcttaac

SEQ ID NO: 122923 - DNA, 9 bp, Unknown
  misc_feature (1)..( 9): Result.003 file - promoters60/1807244
cgtccgaat

SEQ ID NO: 122924 - DNA, 6 bp, Unknown
  misc_feature (1)..( 6): Result.003 file - promoters60/1807244
gagaga

SEQ ID NO: 122925 - DNA, 6 bp, Unknown
  misc_feature (1)..( 6): Result.003 file - promoters60/1807244
gagaga

SEQ ID NO: 122926 - DNA, 8 bp, Unknown
  misc_feature (1)..( 8): Result.003 file - promoters60/1807244
gaattagg

SEQ ID NO: 122927 - DNA, 8 bp, Unknown
  misc_feature (1)..( 8): Result.003 file - promoters60/1807244
gaagtagg

SEQ ID NO: 122928 - DNA, 6 bp, Unknown
  misc_feature (1)..( 6): Result.003 file - promoters60/1807244
aagcta

SEQ ID NO: 122929 - DNA, 6 bp, Unknown
  misc_feature (1)..( 6): Result.003 file - promoters60/1807244
aagcta

SEQ ID NO: 122930 - DNA, 7 bp, Unknown
  misc_feature (1)..( 7): Result.003 file - promoters60/1807244
catacta

SEQ ID NO: 122931 - DNA, 7 bp, Unknown
  misc_feature (1)..( 7): Result.003 file - promoters60/1807244
catacta

SEQ ID NO: 122932 - DNA, 7 bp, Unknown
  misc_feature (1)..( 7): Result.003 file - promoters60/1807244
aaagcag

SEQ ID NO: 122933 - DNA, 7 bp, Unknown
  misc_feature (1)..( 7): Result.003 file - promoters60/1807244
aaaacag

SEQ ID NO: 122934 - DNA, 6 bp, Unknown
  misc_feature (1)..( 6): Result.003 file - promoters60/1807244
gtggga

SEQ ID NO: 122935 - DNA, 6 bp, Unknown
  misc_feature (1)..( 6): Result.003 file - promoters60/1807244
gtggga

SEQ ID NO: 122936 - DNA, 6 bp, Unknown
  misc_feature (1)..( 6): Result.003 file - promoters60/1807244
ttcttg

SEQ ID NO: 122937 - DNA, 6 bp, Unknown
  misc_feature (1)..( 6): Result.003 file - promoters60/1807244
ttcttg

SEQ ID NO: 122938 - DNA, 6 bp, Unknown
  misc_feature (1)..( 6): Result.003 file - promoters60/1807244
attaaa

SEQ ID NO: 122939 - DNA, 6 bp, Unknown
  misc_feature (1)..( 6): Result.003 file - promoters60/1807244
attaaa

SEQ ID NO: 122940 - DNA, 7 bp, Unknown
  misc_feature (1)..( 7): Result.003 file - promoters60/1807244
aacctcc

SEQ ID NO: 122941 - DNA, 7 bp, Unknown
  misc_feature (1)..( 7): Result.003 file - promoters60/1807244
aacgtcc

SEQ ID NO: 122942 - DNA, 9 bp, Unknown
  misc_feature (1)..( 9): Result.003 file - promoters60/1807244
aagatcgaa

SEQ ID NO: 122943 - DNA, 9 bp, Unknown
  misc_feature (1)..( 9): Result.003 file - promoters60/1807244
aagttcgaa

SEQ ID NO: 122944 - DNA, 7 bp, Unknown
  misc_feature (1)..( 7): Result.003 file - promoters60/1807244
atgcagc

SEQ ID NO: 122945 - DNA, 7 bp, Unknown
  misc_feature (1)..( 7): Result.003 file - promoters60/1807244
atggagc

SEQ ID NO: 122946 - DNA, 6 bp, Unknown
  misc_feature (1)..( 6): Result.003 file - promoters60/1807244
tcacat

SEQ ID NO: 122947 - DNA, 6 bp, Unknown
  misc_feature (1)..( 6): Result.003 file - promoters60/1807244
tcacat

SEQ ID NO: 122948 - DNA, 6 bp, Unknown
  misc_feature (1)..( 6): Result.003 file - promoters60/1807244
aaacat

SEQ ID NO: 122949 - DNA, 6 bp, Unknown
  misc_feature (1)..( 6): Result.003 file - promoters60/1807244
aaacat

SEQ ID NO: 122950 - DNA, 8 bp, Unknown
  misc_feature (1)..( 8): Result.003 file - promoters60/1807415
ctttttct

SEQ ID NO: 122951 - DNA, 8 bp, Unknown
  misc_feature (1)..( 8): Result.003 file - promoters60/1807415
ctttgtct

SEQ ID NO: 122952 - DNA, 8 bp, Unknown
  misc_feature (1)..( 8): Result.003 file - promoters60/1807415
gtttgtcc

SEQ ID NO: 122953 - DNA, 8 bp, Unknown
  misc_feature (1)..( 8): Result.003 file - promoters60/1807415
tttctctc

SEQ ID NO: 122954 - DNA, 8 bp, Unknown
  misc_feature (1)..( 8): Result.003 file - promoters60/1807415
tttctctc

SEQ ID NO: 122955 - DNA, 8 bp, Unknown
  misc_feature (1)..( 8): Result.003 file - promoters60/1807415
attctctg

SEQ ID NO: 122956 - DNA, 7 bp, Unknown
  misc_feature (1)..( 7): Result.003 file - promoters60/1807415
caaataa

SEQ ID NO: 122957 - DNA, 7 bp, Unknown
  misc_feature (1)..( 7): Result.003 file - promoters60/1807415
caaataa

SEQ ID NO: 122958 - DNA, 7 bp, Unknown
  misc_feature (1)..( 7): Result.003 file - promoters60/1807415
taaataa

SEQ ID NO: 122959 - DNA, 7 bp, Unknown
  misc_feature (1)..( 7): Result.003 file - promoters60/1807415
atcttta

SEQ ID NO: 122960 - DNA, 7 bp, Unknown
  misc_feature (1)..( 7): Result.003 file - promoters60/1807415
ttcttta

SEQ ID NO: 122961 - DNA, 7 bp, Unknown
  misc_feature (1)..( 7): Result.003 file - promoters60/1807415
atttttt

SEQ ID NO: 122962 - DNA, 7 bp, Unknown
  misc_feature (1)..( 7): Result.003 file - promoters60/1807415
atttttc

SEQ ID NO: 122963 - DNA, 10 bp, Unknown
  misc_feature (1)..( 10): Result.003 file - promoters60/1807415
catttaatat

SEQ ID NO: 122964 - DNA, 10 bp, Unknown
  misc_feature (1)..( 10): Result.003 file - promoters60/1807415
cattaaataa

SEQ ID NO: 122965 - DNA, 10 bp, Unknown
  misc_feature (1)..( 10): Result.003 file - promoters60/1807415
taccaaataa

SEQ ID NO: 122966 - DNA, 9 bp, Unknown
  misc_feature (1)..( 9): Result.003 file - promoters60/1807736
atttttata

SEQ ID NO: 122967 - DNA, 9 bp, Unknown
  misc_feature (1)..( 9): Result.003 file - promoters60/1807736
atttgtata

SEQ ID NO: 122968 - DNA, 9 bp, Unknown
  misc_feature (1)..( 9): Result.003 file - promoters60/1807736
cattgtatc

SEQ ID NO: 122969 - DNA, 18 bp, Unknown
  misc_feature (1)..( 18): Result.003 file - promoters60/1807771
cagtatatcattcttttg

SEQ ID NO: 122970 - DNA, 18 bp, Unknown
  misc_feature (1)..( 18): Result.003 file - promoters60/1807771
atgtatttcactcttttt

SEQ ID NO: 122971 - DNA, 18 bp, Unknown
  misc_feature (1)..( 18): Result.003 file - promoters60/1807771
atggattgtcatgtgttg

SEQ ID NO: 122972 - DNA, 18 bp, Unknown
  misc_feature (1)..( 18): Result.003 file - promoters60/1807771
atatttttcactaattca

SEQ ID NO: 122973 - DNA, 18 bp, Unknown
  misc_feature (1)..( 18): Result.003 file - promoters60/1807771
ttgatatatgtccttttt

SEQ ID NO: 122974 - DNA, 18 bp, Unknown
  misc_feature (1)..( 18): Result.003 file - promoters60/1807771
cttattttcaaaaaaatt

SEQ ID NO: 122975 - DNA, 12 bp, Unknown
  misc_feature (1)..( 12): Result.003 file - promoters60/1807771
tgattaaattga

SEQ ID NO: 122976 - DNA, 12 bp, Unknown
  misc_feature (1)..( 12): Result.003 file - promoters60/1807771
tgatttaataaa

SEQ ID NO: 122977 - DNA, 12 bp, Unknown
  misc_feature (1)..( 12): Result.003 file - promoters60/1807771
aacataaattgt

SEQ ID NO: 122978 - DNA, 12 bp, Unknown
  misc_feature (1)..( 12): Result.003 file - promoters60/1807771
aaaataaataca

SEQ ID NO: 122979 - DNA, 12 bp, Unknown
  misc_feature (1)..( 12): Result.003 file - promoters60/1807771
agaataaaaaca

SEQ ID NO: 122980 - DNA, 12 bp, Unknown
  misc_feature (1)..( 12): Result.003 file - promoters60/1807771
agaataaatatc

SEQ ID NO: 122981 - DNA, 7 bp, Unknown
  misc_feature (1)..( 7): Result.003 file - promoters60/1807774
aaagttt

SEQ ID NO: 122982 - DNA, 7 bp, Unknown
  misc_feature (1)..( 7): Result.003 file - promoters60/1807774
aaatttt

SEQ ID NO: 122983 - DNA, 7 bp, Unknown
  misc_feature (1)..( 7): Result.003 file - promoters60/1807774
aaattta

SEQ ID NO: 122984 - DNA, 8 bp, Unknown
  misc_feature (1)..( 8): Result.003 file - promoters60/1807774
atatcaac

SEQ ID NO: 122985 - DNA, 8 bp, Unknown
  misc_feature (1)..( 8): Result.003 file - promoters60/1807774
ataccaac

SEQ ID NO: 122986 - DNA, 8 bp, Unknown
  misc_feature (1)..( 8): Result.003 file - promoters60/1807774
ttacaaac

SEQ ID NO: 122987 - DNA, 10 bp, Unknown
  misc_feature (1)..( 10): Result.003 file - promoters60/1807774
ttttggaaat

SEQ ID NO: 122988 - DNA, 10 bp, Unknown
  misc_feature (1)..( 10): Result.003 file - promoters60/1807774
ttttcgaaag

SEQ ID NO: 122989 - DNA, 10 bp, Unknown
  misc_feature (1)..( 10): Result.003 file - promoters60/1807774
ccaaggaaat

SEQ ID NO: 122990 - DNA, 8 bp, Unknown
  misc_feature (1)..( 8): Result.003 file - promoters60/1807774
cactgttc

SEQ ID NO: 122991 - DNA, 8 bp, Unknown
  misc_feature (1)..( 8): Result.003 file - promoters60/1807774
cactgttt

SEQ ID NO: 122992 - DNA, 8 bp, Unknown
  misc_feature (1)..( 8): Result.003 file - promoters60/1807774
tactattt

SEQ ID NO: 122993 - DNA, 10 bp, Unknown
  misc_feature (1)..( 10): Result.003 file - promoters60/1807774
taaaaagctc

SEQ ID NO: 122994 - DNA, 10 bp, Unknown
  misc_feature (1)..( 10): Result.003 file - promoters60/1807774
taaaaaatat

SEQ ID NO: 122995 - DNA, 10 bp, Unknown
  misc_feature (1)..( 10): Result.003 file - promoters60/1807774
taaaaatttt

SEQ ID NO: 122996 - DNA, 10 bp, Unknown
  misc_feature (1)..( 10): Result.003 file - promoters60/1807774
taacaatttt

SEQ ID NO: 122997 - DNA, 8 bp, Unknown
  misc_feature (1)..( 8): Result.003 file - promoters60/1807774
atttgttt

SEQ ID NO: 122998 - DNA, 8 bp, Unknown
  misc_feature (1)..( 8): Result.003 file - promoters60/1807774
atttattt

SEQ ID NO: 122999 - DNA, 8 bp, Unknown
  misc_feature (1)..( 8): Result.003 file - promoters60/1807774
attaattg

SEQ ID NO: 123000 - DNA, 11 bp, Unknown
  misc_feature (1)..( 11): Result.003 file - promoters60/1807774
taacaattttt

SEQ ID NO: 123001 - DNA, 11 bp, Unknown
  misc_feature (1)..( 11): Result.003 file - promoters60/1807774
catttattttt

SEQ ID NO: 123002 - DNA, 11 bp, Unknown
  misc_feature (1)..( 11): Result.003 file - promoters60/1807774
taaaaatttta

SEQ ID NO: 123003 - DNA, 8 bp, Unknown
  misc_feature (1)..( 8): Result.003 file - promoters60/1807774
tataaata

SEQ ID NO: 123004 - DNA, 8 bp, Unknown
  misc_feature (1)..( 8): Result.003 file - promoters60/1807774
tatatata

SEQ ID NO: 123005 - DNA, 8 bp, Unknown
  misc_feature (1)..( 8): Result.003 file - promoters60/1807774
tataaaac

SEQ ID NO: 123006 - DNA, 10 bp, Unknown
  misc_feature (1)..( 10): Result.003 file - promoters60/1808111
ataaagaaag

SEQ ID NO: 123007 - DNA, 10 bp, Unknown
  misc_feature (1)..( 10): Result.003 file - promoters60/1808111
ttaaaaaaaa

SEQ ID NO: 123008 - DNA, 10 bp, Unknown
  misc_feature (1)..( 10): Result.003 file - promoters60/1808111
aaaaaaaaaa

SEQ ID NO: 123009 - DNA, 10 bp, Unknown
  misc_feature (1)..( 10): Result.003 file - promoters60/1808111
caaaacaaaa

SEQ ID NO: 123010 - DNA, 10 bp, Unknown
  misc_feature (1)..( 10): Result.003 file - promoters60/1808111
ttaaaaaagg

SEQ ID NO: 123011 - DNA, 11 bp, Unknown
  misc_feature (1)..( 11): Result.003 file - promoters60/1808111
acaaagggata

SEQ ID NO: 123012 - DNA, 11 bp, Unknown
  misc_feature (1)..( 11): Result.003 file - promoters60/1808111
ataaatggaaa

SEQ ID NO: 123013 - DNA, 11 bp, Unknown
  misc_feature (1)..( 11): Result.003 file - promoters60/1808111
atatatgtgat

SEQ ID NO: 123014 - DNA, 11 bp, Unknown
  misc_feature (1)..( 11): Result.003 file - promoters60/1808111
caaaatggaaa

SEQ ID NO: 123015 - DNA, 34 bp, Unknown; identical to SEQ ID NO: 76977
  misc_feature (1)..( 34): Result.003 file - promoters60/1808111

SEQ ID NO: 123016 - DNA, 34 bp, Unknown; identical to SEQ ID NO: 104971
  misc_feature (1)..( 34): Result.003 file - promoters60/1808111

SEQ ID NO: 123017 - DNA, 34 bp, Unknown; identical to SEQ ID NO: 104972
  misc_feature (1)..( 34): Result.003 file - promoters60/1808111

SEQ ID NO: 123018 - DNA, 34 bp, Unknown; identical to SEQ ID NO: 76979
  misc_feature (1)..( 34): Result.003 file - promoters60/1808111

SEQ ID NO: 123019 - DNA, 8 bp, Unknown
  misc_feature (1)..( 8): Result.003 file - promoters60/1808137
tgtttaaa

SEQ ID NO: 123020 - DNA, 8 bp, Unknown
  misc_feature (1)..( 8): Result.003 file - promoters60/1808137
tgtgtaaa

SEQ ID NO: 123021 - DNA, 8 bp, Unknown
  misc_feature (1)..( 8): Result.003 file - promoters60/1808137
acgtgatg

SEQ ID NO: 123022 - DNA, 8 bp, Unknown
  misc_feature (1)..( 8): Result.003 file - promoters60/1808137
acgttatg

SEQ ID NO: 123023 - DNA, 6 bp, Unknown
  misc_feature (1)..( 6): Result.003 file - promoters60/1808137
atgggc

SEQ ID NO: 123024 - DNA, 6 bp, Unknown
  misc_feature (1)..( 6): Result.003 file - promoters60/1808137
atgggc

SEQ ID NO: 123025 - DNA, 6 bp, Unknown
  misc_feature (1)..( 6): Result.003 file - promoters60/1808137
ccaata

SEQ ID NO: 123026 - DNA, 6 bp, Unknown
  misc_feature (1)..( 6): Result.003 file - promoters60/1808137
ccaata

SEQ ID NO: 123027 - DNA, 10 bp, Unknown
  misc_feature (1)..( 10): Result.003 file - promoters60/1808137
ggtttatttt

SEQ ID NO: 123028 - DNA, 10 bp, Unknown
  misc_feature (1)..( 10): Result.003 file - promoters60/1808137
ggtttattca

SEQ ID NO: 123029 - DNA, 10 bp, Unknown
  misc_feature (1)..( 10): Result.003 file - promoters60/1808137
attttatttt

SEQ ID NO: 123030 - DNA, 6 bp, Unknown
  misc_feature (1)..( 6): Result.003 file - promoters60/1808137
gatgtt

SEQ ID NO: 123031 - DNA, 6 bp, Unknown
  misc_feature (1)..( 6): Result.003 file - promoters60/1808137
gatgtt

SEQ ID NO: 123032 - DNA, 7 bp, Unknown
  misc_feature (1)..( 7): Result.003 file - promoters60/1808137
tttaatt

SEQ ID NO: 123033 - DNA, 7 bp, Unknown
  misc_feature (1)..( 7): Result.003 file - promoters60/1808137
tttgatt

SEQ ID NO: 123034 - DNA, 6 bp, Unknown
  misc_feature (1)..( 6): Result.003 file - promoters60/1808137
ttaaga

SEQ ID NO: 123035 - DNA, 6 bp, Unknown
  misc_feature (1)..( 6): Result.003 file - promoters60/1808137
ttaaga

SEQ ID NO: 123036 - DNA, 6 bp, Unknown
  misc_feature (1)..( 6): Result.003 file - promoters60/1808137
gaaaag

SEQ ID NO: 123037 - DNA, 6 bp, Unknown
  misc_feature (1)..( 6): Result.003 file - promoters60/1808137
gaaaag

SEQ ID NO: 123038 - DNA, 7 bp, Unknown
  misc_feature (1)..( 7): Result.003 file - promoters60/1808137
atggtaa

SEQ ID NO: 123039 - DNA, 7 bp, Unknown
  misc_feature (1)..( 7): Result.003 file - promoters60/1808137
atgataa

SEQ ID NO: 123040 - DNA, 7 bp, Unknown
  misc_feature (1)..( 7): Result.003 file - promoters60/1808137
aacctgt

SEQ ID NO: 123041 - DNA, 7 bp, Unknown
  misc_feature (1)..( 7): Result.003 file - promoters60/1808137
aacttgt

SEQ ID NO: 123042 - DNA, 8 bp, Unknown
  misc_feature (1)..( 8): Result.003 file - promoters60/1808137
ttggatat

SEQ ID NO: 123043 - DNA, 8 bp, Unknown
  misc_feature (1)..( 8): Result.003 file - promoters60/1808137
ttgcatat

SEQ ID NO: 123044 - DNA, 8 bp, Unknown
  misc_feature (1)..( 8): Result.003 file - promoters60/1808137
tgttatgc

SEQ ID NO: 123045 - DNA, 8 bp, Unknown
  misc_feature (1)..( 8): Result.003 file - promoters60/1808137
tgttttgc

SEQ ID NO: 123046 - DNA, 7 bp, Unknown
  misc_feature (1)..( 7): Result.003 file - promoters60/1808137
ttgctaa

SEQ ID NO: 123047 - DNA, 7 bp, Unknown
  misc_feature (1)..( 7): Result.003 file - promoters60/1808137
ttgttaa

SEQ ID NO: 123048 - DNA, 6 bp, Unknown
  misc_feature (1)..( 6): Result.003 file - promoters60/1808137
ttcctt

SEQ ID NO: 123049 - DNA, 6 bp, Unknown
  misc_feature (1)..( 6): Result.003 file - promoters60/1808137
ttcctt

SEQ ID NO: 123050 - DNA, 6 bp, Unknown
  misc_feature (1)..( 6): Result.003 file - promoters60/1808137
aagaga

SEQ ID NO: 123051 - DNA, 6 bp, Unknown
  misc_feature (1)..( 6): Result.003 file - promoters60/1808137
aagaga

SEQ ID NO: 123052 - DNA, 7 bp, Unknown
  misc_feature (1)..( 7): Result.003 file - promoters60/1808137
aaggaag

SEQ ID NO: 123053 - DNA, 7 bp, Unknown
  misc_feature (1)..( 7): Result.003 file - promoters60/1808137
aagaaag

SEQ ID NO: 123054 - DNA, 13 bp, Unknown
  misc_feature (1)..( 13): Result.003 file - promoters60/1808156
atggtttgtttat

SEQ ID NO: 123055 - DNA, 13 bp, Unknown
  misc_feature (1)..( 13): Result.003 file - promoters60/1808156
cctagatgtgtat

SEQ ID NO: 123056 - DNA, 13 bp, Unknown
  misc_feature (1)..( 13): Result.003 file - promoters60/1808156
atggtctgttttc

SEQ ID NO: 123057 - DNA, 13 bp, Unknown
  misc_feature (1)..( 13): Result.003 file - promoters60/1808156
cgtttctcttttt

SEQ ID NO: 123058 - DNA, 10 bp, Unknown
  misc_feature (1)..( 10): Result.003 file - promoters60/1808156
aaaatttgaa

SEQ ID NO: 123059 - DNA, 10 bp, Unknown
  misc_feature (1)..( 10): Result.003 file - promoters60/1808156
aaactttgat

SEQ ID NO: 123060 - DNA, 10 bp, Unknown
  misc_feature (1)..( 10): Result.003 file - promoters60/1808156
acaatgtgaa

SEQ ID NO: 123061 - DNA, 10 bp, Unknown
  misc_feature (1)..( 10): Result.003 file - promoters60/1808156
gcaatatgat

SEQ ID NO: 123062 - DNA, 11 bp, Unknown
  misc_feature (1)..( 11): Result.003 file - promoters60/1808172
ccttgagttta

SEQ ID NO: 123063 - DNA, 11 bp, Unknown
  misc_feature (1)..( 11): Result.003 file - promoters60/1808172
ttttgactttt

SEQ ID NO: 123064 - DNA, 11 bp, Unknown
  misc_feature (1)..( 11): Result.003 file - promoters60/1808172
tgttgaatttt

SEQ ID NO: 123065 - DNA, 11 bp, Unknown
  misc_feature (1)..( 11): Result.003 file - promoters60/1808172
tgttgaatttt

SEQ ID NO: 123066 - DNA, 11 bp, Unknown
  misc_feature (1)..( 11): Result.003 file - promoters60/1808172
cgttggcttct

SEQ ID NO: 123067 - DNA, 11 bp, Unknown
  misc_feature (1)..( 11): Result.003 file - promoters60/1808172
attctaatttt

SEQ ID NO: 123068 - DNA, 11 bp, Unknown
  misc_feature (1)..( 11): Result.003 file - promoters60/1808172
agttaactttg

SEQ ID NO: 123069 - DNA, 11 bp, Unknown
  misc_feature (1)..( 11): Result.003 file - promoters60/1808172
agtcaacttgt

SEQ ID NO: 123070 - DNA, 10 bp, Unknown
  misc_feature (1)..( 10): Result.003 file - promoters60/1808172
aaaaacaaac

SEQ ID NO: 123071 - DNA, 10 bp, Unknown
  misc_feature (1)..( 10): Result.003 file - promoters60/1808172
cggaacaaaa

SEQ ID NO: 123072 - DNA, 10 bp, Unknown
  misc_feature (1)..( 10): Result.003 file - promoters60/1808172
tttaaaaaaa

SEQ ID NO: 123073 - DNA, 10 bp, Unknown
  misc_feature (1)..( 10): Result.003 file - promoters60/1808172
tcaaacaaat

SEQ ID NO: 123074 - DNA, 10 bp, Unknown
  misc_feature (1)..( 10): Result.003 file - promoters60/1808172
tataagaaaa

SEQ ID NO: 123075 - DNA, 10 bp, Unknown
  misc_feature (1)..( 10): Result.003 file - promoters60/1808172
tatgagaaat

SEQ ID NO: 123076 - DNA, 12 bp, Unknown
  misc_feature (1)..( 12): Result.003 file - promoters60/1808172
aatgaaaaacaa

SEQ ID NO: 123077 - DNA, 12 bp, Unknown
  misc_feature (1)..( 12): Result.003 file - promoters60/1808172
aatgaaattcat

SEQ ID NO: 123078 - DNA, 13 bp, Unknown
  misc_feature (1)..( 13): Result.003 file - promoters60/1808172
tatgagaaatcat

SEQ ID NO: 123079 - DNA, 13 bp, Unknown
  misc_feature (1)..( 13): Result.003 file - promoters60/1808172
aatgatattcgta

SEQ ID NO: 123080 - DNA, 13 bp, Unknown
  misc_feature (1)..( 13): Result.003 file - promoters60/1808172
aatgttatttttt

SEQ ID NO: 123081 - DNA, 13 bp, Unknown
  misc_feature (1)..( 13): Result.003 file - promoters60/1808172
tctgttatctttt

SEQ ID NO: 123082 - DNA, 13 bp, Unknown
  misc_feature (1)..( 13): Result.003 file - promoters60/1808172
ctatttatttcct

SEQ ID NO: 123083 - DNA, 14 bp, Unknown
  misc_feature (1)..( 14): Result.003 file - promoters60/1808172
atattattagtagg

SEQ ID NO: 123084 - DNA, 14 bp, Unknown
  misc_feature (1)..( 14): Result.003 file - promoters60/1808172
atataattattttg

SEQ ID NO: 123085 - DNA, 14 bp, Unknown
  misc_feature (1)..( 14): Result.003 file - promoters60/1808172
ttattatattgaga

SEQ ID NO: 123086 - DNA, 14 bp, Unknown
  misc_feature (1)..( 14): Result.003 file - promoters60/1808172
ccttaattaccgat

SEQ ID NO: 123087 - DNA, 14 bp, Unknown
  misc_feature (1)..( 14): Result.003 file - promoters60/1808172
gattaattcttttc

SEQ ID NO: 123088 - DNA, 14 bp, Unknown
  misc_feature (1)..( 14): Result.003 file - promoters60/1808172
ttttaatgattttg

SEQ ID NO: 123089 - DNA, 14 bp, Unknown
  misc_feature (1)..( 14): Result.003 file - promoters60/1808172
attctatttcctta

SEQ ID NO: 123090 - DNA, 13 bp, Unknown
  misc_feature (1)..( 13): Result.003 file - promoters60/1808172
cgttaatttttga

SEQ ID NO: 123091 - DNA, 13 bp, Unknown
  misc_feature (1)..( 13): Result.003 file - promoters60/1808172
ttctaattttcta

SEQ ID NO: 123092 - DNA, 13 bp, Unknown
  misc_feature (1)..( 13): Result.003 file - promoters60/1808172
gttgaattttgga

SEQ ID NO: 123093 - DNA, 13 bp, Unknown
  misc_feature (1)..( 13): Result.003 file - promoters60/1808172
gttgaattttttt

SEQ ID NO: 123094 - DNA, 13 bp, Unknown
  misc_feature (1)..( 13): Result.003 file - promoters60/1808172
agttaactttgta

SEQ ID NO: 123095 - DNA, 13 bp, Unknown
  misc_feature (1)..( 13): Result.003 file - promoters60/1808172
tcatcacttggta

SEQ ID NO: 123096 - DNA, 13 bp, Unknown
  misc_feature (1)..( 13): Result.003 file - promoters60/1808172
agtcaacttgtac

SEQ ID NO: 123097 - DNA, 6 bp, Unknown
  misc_feature (1)..( 6): Result.003 file - promoters60/1808572
aattct

SEQ ID NO: 123098 - DNA, 6 bp, Unknown
  misc_feature (1)..( 6): Result.003 file - promoters60/1808572
aattct

SEQ ID NO: 123099 - DNA, 11 bp, Unknown
  misc_feature (1)..( 11): Result.003 file - promoters60/1808572
actaattaata

SEQ ID NO: 123100 - DNA, 11 bp, Unknown
  misc_feature (1)..( 11): Result.003 file - promoters60/1808572
actaatttgta

SEQ ID NO: 123101 - DNA, 11 bp, Unknown
  misc_feature (1)..( 11): Result.003 file - promoters60/1808572
aataattagta

SEQ ID NO: 123102 - DNA, 8 bp, Unknown
  misc_feature (1)..( 8): Result.003 file - promoters60/1808572
aaaaatac

SEQ ID NO: 123103 - DNA, 8 bp, Unknown
  misc_feature (1)..( 8): Result.003 file - promoters60/1808572
aaaaatac

SEQ ID NO: 123104 - DNA, 8 bp, Unknown
  misc_feature (1)..( 8): Result.003 file - promoters60/1808572
ataaatta

SEQ ID NO: 123105 - DNA, 8 bp, Unknown
  misc_feature (1)..( 8): Result.003 file - promoters60/1808572
gtaaatta

SEQ ID NO: 123106 - DNA, 8 bp, Unknown
  misc_feature (1)..( 8): Result.003 file - promoters60/1808572
gtaaataa

SEQ ID NO: 123107 - DNA, 7 bp, Unknown
  misc_feature (1)..( 7): Result.003 file - promoters60/1808572
aaaaaaa

SEQ ID NO: 123108 - DNA, 7 bp, Unknown
  misc_feature (1)..( 7): Result.003 file - promoters60/1808572
aaaaaaa

SEQ ID NO: 123109 - DNA, 7 bp, Unknown
  misc_feature (1)..( 7): Result.003 file - promoters60/1808572
aaaaaac

SEQ ID NO: 123110 - DNA, 7 bp, Unknown
  misc_feature (1)..( 7): Result.003 file - promoters60/1808572
tgaacca

SEQ ID NO: 123111 - DNA, 7 bp, Unknown
  misc_feature (1)..( 7): Result.003 file - promoters60/1808572
tgaccca

SEQ ID NO: 123112 - DNA, 6 bp, Unknown
  misc_feature (1)..( 6): Result.003 file - promoters60/1808572
gatttg

SEQ ID NO: 123113 - DNA, 6 bp, Unknown
  misc_feature (1)..( 6): Result.003 file - promoters60/1808572
gatttg

SEQ ID NO: 123114 - DNA, 9 bp, Unknown
  misc_feature (1)..( 9): Result.003 file - promoters60/1808572
ttattttat

SEQ ID NO: 123115 - DNA, 9 bp, Unknown
  misc_feature (1)..( 9): Result.003 file - promoters60/1808572
ttaatttat

SEQ ID NO: 123116 - DNA, 9 bp, Unknown
  misc_feature (1)..( 9): Result.003 file - promoters60/1808572
tttttttga

SEQ ID NO: 123117 - DNA, 9 bp, Unknown
  misc_feature (1)..( 9): Result.003 file - promoters60/1808572
aacatcttg

SEQ ID NO: 123118 - DNA, 9 bp, Unknown
  misc_feature (1)..( 9): Result.003 file - promoters60/1808572
aacattttg

SEQ ID NO: 123119 - DNA, 8 bp, Unknown
  misc_feature (1)..( 8): Result.003 file - promoters60/1808572
taataaag

SEQ ID NO: 123120 - DNA, 8 bp, Unknown
  misc_feature (1)..( 8): Result.003 file - promoters60/1808572
atataaag

SEQ ID NO: 123121 - DNA, 8 bp, Unknown
  misc_feature (1)..( 8): Result.003 file - promoters60/1808572
atataaat

SEQ ID NO: 123122 - DNA, 7 bp, Unknown
  misc_feature (1)..( 7): Result.003 file - promoters60/1808572
tttgagt

SEQ ID NO: 123123 - DNA, 7 bp, Unknown
  misc_feature (1)..( 7): Result.003 file - promoters60/1808572
tttaagt

SEQ ID NO: 123124 - DNA, 6 bp, Unknown
  misc_feature (1)..( 6): Result.003 file - promoters60/1808572
taatag

SEQ ID NO: 123125 - DNA, 6 bp, Unknown
  misc_feature (1)..( 6): Result.003 file - promoters60/1808572
taatag

SEQ ID NO: 123126 - DNA, 7 bp, Unknown
  misc_feature (1)..( 7): Result.003 file - promoters60/1808572
actgaaa

SEQ ID NO: 123127 - DNA, 7 bp, Unknown
  misc_feature (1)..( 7): Result.003 file - promoters60/1808572
actcaaa

SEQ ID NO: 123128 - DNA, 8 bp, Unknown
  misc_feature (1)..( 8): Result.003 file - promoters60/1808572
actatcat

SEQ ID NO: 123129 - DNA, 8 bp, Unknown
  misc_feature (1)..( 8): Result.003 file - promoters60/1808572
actatcat

SEQ ID NO: 123130 - DNA, 6 bp, Unknown
  misc_feature (1)..( 6): Result.003 file - promoters60/1808572
atttca

SEQ ID NO: 123131 - DNA, 6 bp, Unknown
  misc_feature (1)..( 6): Result.003 file - promoters60/1808572
atttca

SEQ ID NO: 123132 - DNA, 6 bp, Unknown
  misc_feature (1)..( 6): Result.003 file - promoters60/1808572
ttttag

SEQ ID NO: 123133 - DNA, 6 bp, Unknown
  misc_feature (1)..( 6): Result.003 file - promoters60/1808572
ttttag

SEQ ID NO: 123134 - DNA, 6 bp, Unknown
  misc_feature (1)..( 6): Result.003 file - promoters60/1808572
cataat

SEQ ID NO: 123135 - DNA, 6 bp, Unknown
  misc_feature (1)..( 6): Result.003 file - promoters60/1808572
cataat

SEQ ID NO: 123136 - DNA, 8 bp, Unknown
  misc_feature (1)..( 8): Result.003 file - promoters60/1808572
agcgtggg

SEQ ID NO: 123137 - DNA, 8 bp, Unknown
  misc_feature (1)..( 8): Result.003 file - promoters60/1808572
agcgcggg

SEQ ID NO: 123138 - DNA, 7 bp, Unknown
  misc_feature (1)..( 7): Result.003 file - promoters60/1808572
aaattaa

SEQ ID NO: 123139 - DNA, 7 bp, Unknown
  misc_feature (1)..( 7): Result.003 file - promoters60/1808572
aaactaa

SEQ ID NO: 123140 - DNA, 7 bp, Unknown
  misc_feature (1)..( 7): Result.003 file - promoters60/1808572
aaagaat

SEQ ID NO: 123141 - DNA, 7 bp, Unknown
  misc_feature (1)..( 7): Result.003 file - promoters60/1808572
aaataat

SEQ ID NO: 123142 - DNA, 8 bp, Unknown
  misc_feature (1)..( 8): Result.003 file - promoters60/1808572
taatgcaa

SEQ ID NO: 123143 - DNA, 8 bp, Unknown
  misc_feature (1)..( 8): Result.003 file - promoters60/1808572
taatgcaa

SEQ ID NO: 123144 - DNA, 6 bp, Unknown
  misc_feature (1)..( 6): Result.003 file - promoters60/1808572
aattaa

SEQ ID NO: 123145 - DNA, 6 bp, Unknown
  misc_feature (1)..( 6): Result.003 file - promoters60/1808572
aattaa

SEQ ID NO: 123146 - DNA, 7 bp, Unknown
  misc_feature (1)..( 7): Result.003 file - promoters60/1808696
taacgtt

SEQ ID NO: 123147 - DNA, 7 bp, Unknown
  misc_feature (1)..( 7): Result.003 file - promoters60/1808696
taaggtt

SEQ ID NO: 123148 - DNA, 7 bp, Unknown
  misc_feature (1)..( 7): Result.003 file - promoters60/1808696
taaagtt

SEQ ID NO: 123149 - DNA, 15 bp, Unknown
  misc_feature (1)..( 15): Result.003 file - promoters60/1808696
aaaagcatacaaata

SEQ ID NO: 123150 - DNA, 15 bp, Unknown
  misc_feature (1)..( 15): Result.003 file - promoters60/1808696
aaaagaatagcttct

SEQ ID NO: 123151 - DNA, 15 bp, Unknown
  misc_feature (1)..( 15): Result.003 file - promoters60/1808696
gaaggcatacagata

SEQ ID NO: 123152 - DNA, 16 bp, Unknown
  misc_feature (1)..( 16): Result.003 file - promoters60/1808696
gatagatataatggag

SEQ ID NO: 123153 - DNA, 8 bp, Unknown
  misc_feature (1)..( 8): Result.003 file - promoters60/1808696
ctattatt

SEQ ID NO: 123154 - DNA, 8 bp, Unknown
  misc_feature (1)..( 8): Result.003 file - promoters60/1808696
ctagtata

SEQ ID NO: 123155 - DNA, 8 bp, Unknown
  misc_feature (1)..( 8): Result.003 file - promoters60/1808696
aaattatt

SEQ ID NO: 123156 - DNA, 8 bp, Unknown
  misc_feature (1)..( 8): Result.003 file - promoters60/1808696
ctattact

SEQ ID NO: 123157 - DNA, 9 bp, Unknown
  misc_feature (1)..( 9): Result.003 file - promoters60/1808696
aaatagtta

SEQ ID NO: 123158 - DNA, 9 bp, Unknown
  misc_feature (1)..( 9): Result.003 file - promoters60/1808696
taattgttt

SEQ ID NO: 123159 - DNA, 9 bp, Unknown
  misc_feature (1)..( 9): Result.003 file - promoters60/1808696
aaatattta

SEQ ID NO: 123160 - DNA, 9 bp, Unknown
  misc_feature (1)..( 9): Result.003 file - promoters60/1808696
atattgttt

SEQ ID NO: 123161 - DNA, 8 bp, Unknown
  misc_feature (1)..( 8): Result.003 file - promoters60/1808696
acgttatt

SEQ ID NO: 123162 - DNA, 8 bp, Unknown
  misc_feature (1)..( 8): Result.003 file - promoters60/1808696
tggttatt

SEQ ID NO: 123163 - DNA, 8 bp, Unknown
  misc_feature (1)..( 8): Result.003 file - promoters60/1808696
tgggtata

SEQ ID NO: 123164 - DNA, 7 bp, Unknown
  misc_feature (1)..( 7): Result.003 file - promoters60/1808696
tacgtaa

SEQ ID NO: 123165 - DNA, 7 bp, Unknown
  misc_feature (1)..( 7): Result.003 file - promoters60/1808696
tacataa

SEQ ID NO: 123166 - DNA, 7 bp, Unknown
  misc_feature (1)..( 7): Result.003 file - promoters60/1808696
cacataa

SEQ ID NO: 123167 - DNA, 7 bp, Unknown
  misc_feature (1)..( 7): Result.003 file - promoters60/1808696
ggttcta

SEQ ID NO: 123168 - DNA, 7 bp, Unknown
  misc_feature (1)..( 7): Result.003 file - promoters60/1808696
tgttcta

SEQ ID NO: 123169 - DNA, 7 bp, Unknown
  misc_feature (1)..( 7): Result.003 file - promoters60/1808696
tgttctt

SEQ ID NO: 123170 - DNA, 9 bp, Unknown
  misc_feature (1)..( 9): Result.003 file - promoters60/1809157
aaatattaa

SEQ ID NO: 123171 - DNA, 9 bp, Unknown
  misc_feature (1)..( 9): Result.003 file - promoters60/1809157
aaataataa

SEQ ID NO: 123172 - DNA, 10 bp, Unknown
  misc_feature (1)..( 10): Result.003 file - promoters60/1809157
aaactatccc

SEQ ID NO: 123173 - DNA, 11 bp, Unknown
  misc_feature (1)..( 11): Result.003 file - promoters60/1809157
tagataagtaa

SEQ ID NO: 123174 - DNA, 11 bp, Unknown
  misc_feature (1)..( 11): Result.003 file - promoters60/1809157
gagaaaagtct

SEQ ID NO: 123175 - DNA, 11 bp, Unknown
  misc_feature (1)..( 11): Result.003 file - promoters60/1809157
caactatacat

SEQ ID NO: 123176 - DNA, 10 bp, Unknown
  misc_feature (1)..( 10): Result.003 file - promoters60/1809222
aaaagatagc

SEQ ID NO: 123177 - DNA, 10 bp, Unknown
  misc_feature (1)..( 10): Result.003 file - promoters60/1809222
gaaatatata

SEQ ID NO: 123178 - DNA, 10 bp, Unknown
  misc_feature (1)..( 10): Result.003 file - promoters60/1809222
gaaatagatt

SEQ ID NO: 123179 - DNA, 10 bp, Unknown
  misc_feature (1)..( 10): Result.003 file - promoters60/1809222
ttagtagatt

SEQ ID NO: 123180 - DNA, 10 bp, Unknown
  misc_feature (1)..( 10): Result.003 file - promoters60/1809222
ttaatttatt

SEQ ID NO: 123181 - DNA, 10 bp, Unknown
  misc_feature (1)..( 10): Result.003 file - promoters60/1809222
tgattacttt

SEQ ID NO: 123182 - DNA, 11 bp, Unknown
  misc_feature (1)..( 11): Result.003 file - promoters60/1809233
taaaatttcgc

SEQ ID NO: 123183 - DNA, 11 bp, Unknown
  misc_feature (1)..( 11): Result.003 file - promoters60/1809233
taatattaaga

SEQ ID NO: 123184 - DNA, 11 bp, Unknown
  misc_feature (1)..( 11): Result.003 file - promoters60/1809233
agaaattgcgc

SEQ ID NO: 123185 - DNA, 11 bp, Unknown
  misc_feature (1)..( 11): Result.003 file - promoters60/1809233
taatcttagaa

SEQ ID NO: 123186 - DNA, 11 bp, Unknown
  misc_feature (1)..( 11): Result.003 file - promoters60/1809233
ctgaattgcaa

SEQ ID NO: 123187 - DNA, 12 bp, Unknown
  misc_feature (1)..( 12): Result.003 file - promoters60/1809233
tatcatataagt

SEQ ID NO: 123188 - DNA, 12 bp, Unknown
  misc_feature (1)..( 12): Result.003 file - promoters60/1809233
ttctatataact

SEQ ID NO: 123189 - DNA, 12 bp, Unknown
  misc_feature (1)..( 12): Result.003 file - promoters60/1809233
tactgtattagt

SEQ ID NO: 123190 - DNA, 12 bp, Unknown
  misc_feature (1)..( 12): Result.003 file - promoters60/1809233
tactgttttaga

SEQ ID NO: 123191 - DNA, 11 bp, Unknown
  misc_feature (1)..( 11): Result.003 file - promoters60/1809233
aaacataaatt

SEQ ID NO: 123192 - DNA, 11 bp, Unknown
  misc_feature (1)..( 11): Result.003 file - promoters60/1809233
aaaaataaata

SEQ ID NO: 123193 - DNA, 11 bp, Unknown
  misc_feature (1)..( 11): Result.003 file - promoters60/1809233
gacaatagata

SEQ ID NO: 123194 - DNA, 11 bp, Unknown
  misc_feature (1)..( 11): Result.003 file - promoters60/1809233
attaataaaaa

SEQ ID NO: 123195 - DNA, 9 bp, Unknown
  misc_feature (1)..( 9): Result.003 file - promoters60/1809233
gttaggtat

SEQ ID NO: 123196 - DNA, 9 bp, Unknown
  misc_feature (1)..( 9): Result.003 file - promoters60/1809233
aatagatat

SEQ ID NO: 123197 - DNA, 9 bp, Unknown
  misc_feature (1)..( 9): Result.003 file - promoters60/1809233
aataaataa

SEQ ID NO: 123198 - DNA, 9 bp, Unknown
  misc_feature (1)..( 9): Result.003 file - promoters60/1809233
aataaaaac

SEQ ID NO: 123199 - DNA, 6 bp, Unknown
  misc_feature (1)..( 6): Result.003 file - promoters60/1809243
agtgtt

SEQ ID NO: 123200 - DNA, 6 bp, Unknown
  misc_feature (1)..( 6): Result.003 file - promoters60/1809243
agtgtt

SEQ ID NO: 123201 - DNA, 6 bp, Unknown
  misc_feature (1)..( 6): Result.003 file - promoters60/1809243
aataaa

SEQ ID NO: 123202 - DNA, 6 bp, Unknown
  misc_feature (1)..( 6): Result.003 file - promoters60/1809243
aataaa

SEQ ID NO: 123203 - DNA, 10 bp, Unknown
  misc_feature (1)..( 10): Result.003 file - promoters60/1809243
aaattaattt

SEQ ID NO: 123204 - DNA, 10 bp, Unknown
  misc_feature (1)..( 10): Result.003 file - promoters60/1809243
aaattagaac

SEQ ID NO: 123205 - DNA, 10 bp, Unknown
  misc_feature (1)..( 10): Result.003 file - promoters60/1809243
taattaattt

SEQ ID NO: 123206 - DNA, 6 bp, Unknown
  misc_feature (1)..( 6): Result.003 file - promoters60/1809243
caagtc

SEQ ID NO: 123207 - DNA, 6 bp, Unknown
  misc_feature (1)..( 6): Result.003 file - promoters60/1809243
caagtc

SEQ ID NO: 123208 - DNA, 7 bp, Unknown
  misc_feature (1)..( 7): Result.003 file - promoters60/1809243
taatctt

SEQ ID NO: 123209 - DNA, 7 bp, Unknown
  misc_feature (1)..( 7): Result.003 file - promoters60/1809243
taatctt

SEQ ID NO: 123210 - DNA, 6 bp, Unknown
  misc_feature (1)..( 6): Result.003 file - promoters60/1809243
acacgt

SEQ ID NO: 123211 - DNA, 6 bp, Unknown
  misc_feature (1)..( 6): Result.003 file - promoters60/1809243
acacgt

SEQ ID NO: 123212 - DNA, 6 bp, Unknown
  misc_feature (1)..( 6): Result.003 file - promoters60/1809243
ttaacc

SEQ ID NO: 123213 - DNA, 6 bp, Unknown
  misc_feature (1)..( 6): Result.003 file - promoters60/1809243
ttaacc

SEQ ID NO: 123214 - DNA, 7 bp, Unknown
  misc_feature (1)..( 7): Result.003 file - promoters60/1809243
caatttt

SEQ ID NO: 123215 - DNA, 7 bp, Unknown
  misc_feature (1)..( 7): Result.003 file - promoters60/1809243
caaattt

SEQ ID NO: 123216 - DNA, 7 bp, Unknown
  misc_feature (1)..( 7): Result.003 file - promoters60/1809243
ttttgaa

SEQ ID NO: 123217 - DNA, 7 bp, Unknown
  misc_feature (1)..( 7): Result.003 file - promoters60/1809243
tttggaa

SEQ ID NO: 123218 - DNA, 7 bp, Unknown
  misc_feature (1)..( 7): Result.003 file - promoters60/1809243
attaatt

SEQ ID NO: 123219 - DNA, 7 bp, Unknown
  misc_feature (1)..( 7): Result.003 file - promoters60/1809243
attaatt

SEQ ID NO: 123220 - DNA, 6 bp, Unknown
  misc_feature (1)..( 6): Result.003 file - promoters60/1809243
ttaaaa

SEQ ID NO: 123221 - DNA, 6 bp, Unknown
  misc_feature (1)..( 6): Result.003 file - promoters60/1809243
ttaaaa

SEQ ID NO: 123222 - DNA, 8 bp, Unknown
  misc_feature (1)..( 8): Result.003 file - promoters60/1809243
attgttcc

SEQ ID NO: 123223 - DNA, 8 bp, Unknown
  misc_feature (1)..( 8): Result.003 file - promoters60/1809243
atttttcc

SEQ ID NO: 123224 - DNA, 7 bp, Unknown
  misc_feature (1)..( 7): Result.003 file - promoters60/1809243
agagaaa

SEQ ID NO: 123225 - DNA, 7 bp, Unknown
  misc_feature (1)..( 7): Result.003 file - promoters60/1809243
agaaaaa

SEQ ID NO: 123226 - DNA, 8 bp, Unknown
  misc_feature (1)..( 8): Result.003 file - promoters60/1809243
aaagacaa

SEQ ID NO: 123227 - DNA, 8 bp, Unknown
  misc_feature (1)..( 8): Result.003 file - promoters60/1809243
aaaaacaa

SEQ ID NO: 123228 - DNA, 6 bp, Unknown
  misc_feature (1)..( 6): Result.003 file - promoters60/1809243
agttgg

SEQ ID NO: 123229 - DNA, 6 bp, Unknown
  misc_feature (1)..( 6): Result.003 file - promoters60/1809243
agttgg

SEQ ID NO: 123230 - DNA, 6 bp, Unknown
  misc_feature (1)..( 6): Result.003 file - promoters60/1809243
tttccc

SEQ ID NO: 123231 - DNA, 6 bp, Unknown
  misc_feature (1)..( 6): Result.003 file - promoters60/1809243
tttccc

SEQ ID NO: 123232 - DNA, 10 bp, Unknown
  misc_feature (1)..( 10): Result.003 file - promoters60/1809253
aattacaaaa

SEQ ID NO: 123233 - DNA, 10 bp, Unknown
  misc_feature (1)..( 10): Result.003 file - promoters60/1809253
aataacaata

SEQ ID NO: 123234 - DNA, 10 bp, Unknown
  misc_feature (1)..( 10): Result.003 file - promoters60/1809253
ttttagaaaa

SEQ ID NO: 123235 - DNA, 6 bp, Unknown
  misc_feature (1)..( 6): Result.003 file - promoters60/1809253
aaaaat

SEQ ID NO: 123236 - DNA, 6 bp, Unknown
  misc_feature (1)..( 6): Result.003 file - promoters60/1809253
aaaaat

SEQ ID NO: 123237 - DNA, 11 bp, Unknown
  misc_feature (1)..( 11): Result.003 file - promoters60/1809253
aataaaagcaa

SEQ ID NO: 123238 - DNA, 11 bp, Unknown
  misc_feature (1)..( 11): Result.003 file - promoters60/1809253
aataaaaacaa

SEQ ID NO: 123239 - DNA, 7 bp, Unknown
  misc_feature (1)..( 7): Result.003 file - promoters60/1809253
acagaaa

SEQ ID NO: 123240 - DNA, 7 bp, Unknown
  misc_feature (1)..( 7): Result.003 file - promoters60/1809253
acaaaaa

SEQ ID NO: 123241 - DNA, 7 bp, Unknown
  misc_feature (1)..( 7): Result.003 file - promoters60/1809253
aaccaac

SEQ ID NO: 123242 - DNA, 7 bp, Unknown
  misc_feature (1)..( 7): Result.003 file - promoters60/1809253
aaccaac

SEQ ID NO: 123243 - DNA, 6 bp, Unknown
  misc_feature (1)..( 6): Result.003 file - promoters60/1809253
aaaata

SEQ ID NO: 123244 - DNA, 6 bp, Unknown
  misc_feature (1)..( 6): Result.003 file - promoters60/1809253
aaaata

SEQ ID NO: 123245 - DNA, 7 bp, Unknown
  misc_feature (1)..( 7): Result.003 file - promoters60/1809253
atatata

SEQ ID NO: 123246 - DNA, 7 bp, Unknown
  misc_feature (1)..( 7): Result.003 file - promoters60/1809253
atatatt

SEQ ID NO: 123247 - DNA, 7 bp, Unknown
  misc_feature (1)..( 7): Result.003 file - promoters60/1809253
ataaata

SEQ ID NO: 123248 - DNA, 8 bp, Unknown
  misc_feature (1)..( 8): Result.003 file - promoters60/1809253
caaaatct

SEQ ID NO: 123249 - DNA, 8 bp, Unknown
  misc_feature (1)..( 8): Result.003 file - promoters60/1809253
caacatct

SEQ ID NO: 123250 - DNA, 7 bp, Unknown
  misc_feature (1)..( 7): Result.003 file - promoters60/1809253
aaatgtc

SEQ ID NO: 123251 - DNA, 7 bp, Unknown
  misc_feature (1)..( 7): Result.003 file - promoters60/1809253
aaaagtc

SEQ ID NO: 123252 - DNA, 6 bp, Unknown
  misc_feature (1)..( 6): Result.003 file - promoters60/1809253
atgtca

SEQ ID NO: 123253 - DNA, 6 bp, Unknown
  misc_feature (1)..( 6): Result.003 file - promoters60/1809253
atgtca

SEQ ID NO: 123254 - DNA, 11 bp, Unknown
  misc_feature (1)..( 11): Result.003 file - promoters60/1809253
tatgtttccaa

SEQ ID NO: 123255 - DNA, 11 bp, Unknown
  misc_feature (1)..( 11): Result.003 file - promoters60/1809253
tatgtttacaa

SEQ ID NO: 123256 - DNA, 8 bp, Unknown
  misc_feature (1)..( 8): Result.003 file - promoters60/1809253
tgtttgta

SEQ ID NO: 123257 - DNA, 8 bp, Unknown
  misc_feature (1)..( 8): Result.003 file - promoters60/1809253
tgtctgta

SEQ ID NO: 123258 - DNA, 7 bp, Unknown
  misc_feature (1)..( 7): Result.003 file - promoters60/1809253
attcttt

SEQ ID NO: 123259 - DNA, 7 bp, Unknown
  misc_feature (1)..( 7): Result.003 file - promoters60/1809253
attattt

SEQ ID NO: 123260 - DNA, 6 bp, Unknown
  misc_feature (1)..( 6): Result.003 file - promoters60/1809253
tcgttt

SEQ ID NO: 123261 - DNA, 6 bp, Unknown
  misc_feature (1)..( 6): Result.003 file - promoters60/1809253
tcgttt

SEQ ID NO: 123262 - DNA, 8 bp, Unknown
  misc_feature (1)..( 8): Result.003 file - promoters60/1809253
gtttactt

SEQ ID NO: 123263 - DNA, 8 bp, Unknown
  misc_feature (1)..( 8): Result.003 file - promoters60/1809253
gttgactt

SEQ ID NO: 123264 - DNA, 6 bp, Unknown
  misc_feature (1)..( 6): Result.003 file - promoters60/1809253
tttcaa

SEQ ID NO: 123265 - DNA, 6 bp, Unknown
  misc_feature (1)..( 6): Result.003 file - promoters60/1809253
tttcaa

SEQ ID NO: 123266 - DNA, 6 bp, Unknown
  misc_feature (1)..( 6): Result.003 file - promoters60/1809253
tctttc

SEQ ID NO: 123267 - DNA, 6 bp, Unknown
  misc_feature (1)..( 6): Result.003 file - promoters60/1809253
tctttc

SEQ ID NO: 123268 - DNA, 9 bp, Unknown
  misc_feature (1)..( 9): Result.003 file - promoters60/1809253
caaaaaaac

SEQ ID NO: 123269 - DNA, 9 bp, Unknown
  misc_feature (1)..( 9): Result.003 file - promoters60/1809253
caaaataac

SEQ ID NO: 123270 - DNA, 6 bp, Unknown
  misc_feature (1)..( 6): Result.003 file - promoters60/1809253
aacaaa

SEQ ID NO: 123271 - DNA, 6 bp, Unknown
  misc_feature (1)..( 6): Result.003 file - promoters60/1809253
aacaaa

SEQ ID NO: 123272 - DNA, 11 bp, Unknown
  misc_feature (1)..( 11): Result.003 file - promoters60/1830195
caaggaaagaa

SEQ ID NO: 123273 - DNA, 11 bp, Unknown
  misc_feature (1)..( 11): Result.003 file - promoters60/1830195
caaagaatttt

SEQ ID NO: 123274 - DNA, 11 bp, Unknown
  misc_feature (1)..( 11): Result.003 file - promoters60/1830195
caatgaactct

SEQ ID NO: 123275 - DNA, 11 bp, Unknown
  misc_feature (1)..( 11): Result.003 file - promoters60/1830195
taaagaaaaag

SEQ ID NO: 123276 - DNA, 11 bp, Unknown
  misc_feature (1)..( 11): Result.003 file - promoters60/1830195
atatgaaccat

SEQ ID NO: 123277 - DNA, 11 bp, Unknown
  misc_feature (1)..( 11): Result.003 file - promoters60/1830195
ctcagaataag

SEQ ID NO: 123278 - DNA, 9 bp, Unknown
  misc_feature (1)..( 9): Result.003 file - promoters60/1923743
cggcggttc

SEQ ID NO: 123279 - DNA, 9 bp, Unknown
  misc_feature (1)..( 9): Result.003 file - promoters60/1923743
cggcgtttc

SEQ ID NO: 123280 - DNA, 7 bp, Unknown
  misc_feature (1)..( 7): Result.003 file - promoters60/1923743
ttcgaaa

SEQ ID NO: 123281 - DNA, 7 bp, Unknown
  misc_feature (1)..( 7): Result.003 file - promoters60/1923743
ttcaaaa

SEQ ID NO: 123282 - DNA, 9 bp, Unknown
  misc_feature (1)..( 9): Result.003 file - promoters60/1923743
acactaaaa

SEQ ID NO: 123283 - DNA, 9 bp, Unknown
  misc_feature (1)..( 9): Result.003 file - promoters60/1923743
acaataatt

SEQ ID NO: 123284 - DNA, 9 bp, Unknown
  misc_feature (1)..( 9): Result.003 file - promoters60/1923743
aaactaaaa

SEQ ID NO: 123285 - DNA, 6 bp, Unknown
  misc_feature (1)..( 6): Result.003 file - promoters60/1923743
tctaac

SEQ ID NO: 123286 - DNA, 6 bp, Unknown
  misc_feature (1)..( 6): Result.003 file - promoters60/1923743
tctaac

SEQ ID NO: 123287 - DNA, 7 bp, Unknown
  misc_feature (1)..( 7): Result.003 file - promoters60/1923743
gattttt

SEQ ID NO: 123288 - DNA, 7 bp, Unknown
  misc_feature (1)..( 7): Result.003 file - promoters60/1923743
gattttt

SEQ ID NO: 123289 - DNA, 6 bp, Unknown
  misc_feature (1)..( 6): Result.003 file - promoters60/1923743
taaaca

SEQ ID NO: 123290 - DNA, 6 bp, Unknown
  misc_feature (1)..( 6): Result.003 file - promoters60/1923743
taaaca

SEQ ID NO: 123291 - DNA, 7 bp, Unknown
  misc_feature (1)..( 7): Result.003 file - promoters60/1923743
gatgacg

SEQ ID NO: 123292 - DNA, 7 bp, Unknown
  misc_feature (1)..( 7): Result.003 file - promoters60/1923743
gataacg

SEQ ID NO: 123293 - DNA, 9 bp, Unknown
  misc_feature (1)..( 9): Result.003 file - promoters60/1923743
cggttcgtt

SEQ ID NO: 123294 - DNA, 9 bp, Unknown
  misc_feature (1)..( 9): Result.003 file - promoters60/1923743
atgtttgtt

SEQ ID NO: 123295 - DNA, 9 bp, Unknown
  misc_feature (1)..( 9): Result.003 file - promoters60/1923743
atggttgtg

SEQ ID NO: 123296 - DNA, 8 bp, Unknown
  misc_feature (1)..( 8): Result.003 file - promoters60/1923743
tgttcaaa

SEQ ID NO: 123297 - DNA, 8 bp, Unknown
  misc_feature (1)..( 8): Result.003 file - promoters60/1923743
tgtttaaa

SEQ ID NO: 123298 - DNA, 7 bp, Unknown
  misc_feature (1)..( 7): Result.003 file - promoters60/1923743
aaggagt

SEQ ID NO: 123299 - DNA, 7 bp, Unknown
  misc_feature (1)..( 7): Result.003 file - promoters60/1923743
aagaagt

SEQ ID NO: 123300 - DNA, 6 bp, Unknown
  misc_feature (1)..( 6): Result.003 file - promoters60/1923743
ctaaaa

SEQ ID NO: 123301 - DNA, 6 bp, Unknown
  misc_feature (1)..( 6): Result.003 file - promoters60/1923743
ctaaaa

SEQ ID NO: 123302 - DNA, 7 bp, Unknown
  misc_feature (1)..( 7): Result.003 file - promoters60/1923743
aggagtt

SEQ ID NO: 123303 - DNA, 7 bp, Unknown
  misc_feature (1)..( 7): Result.003 file - promoters60/1923743
aggtgtt

SEQ ID NO: 123304 - DNA, 6 bp, Unknown
  misc_feature (1)..( 6): Result.003 file - promoters60/1923743
aacaaa

SEQ ID NO: 123305 - DNA, 6 bp, Unknown
  misc_feature (1)..( 6): Result.003 file - promoters60/1923743
aacaaa

SEQ ID NO: 123306 - DNA, 7 bp, Unknown
  misc_feature (1)..( 7): Result.003 file - promoters60/1923743
atccaat

SEQ ID NO: 123307 - DNA, 7 bp, Unknown
  misc_feature (1)..( 7): Result.003 file - promoters60/1923743
atccaat

SEQ ID NO: 123308 - DNA, 6 bp, Unknown
  misc_feature (1)..( 6): Result.003 file - promoters60/1923743
tattct

SEQ ID NO: 123309 - DNA, 6 bp, Unknown
  misc_feature (1)..( 6): Result.003 file - promoters60/1923743
tattct

SEQ ID NO: 123310 - DNA, 8 bp, Unknown
  misc_feature (1)..( 8): Result.003 file - promoters60/1923743
taatttaa

SEQ ID NO: 123311 - DNA, 8 bp, Unknown
  misc_feature (1)..( 8): Result.003 file - promoters60/1923743
taatgtaa

SEQ ID NO: 123312 - DNA, 9 bp, Unknown
  misc_feature (1)..( 9): Result.003 file - promoters60/1923743
taatgtact

SEQ ID NO: 123313 - DNA, 9 bp, Unknown
  misc_feature (1)..( 9): Result.003 file - promoters60/1923743
taatgcact

SEQ ID NO: 123314 - DNA, 6 bp, Unknown
  misc_feature (1)..( 6): Result.003 file - promoters60/1923743
actatt

SEQ ID NO: 123315 - DNA, 6 bp, Unknown
  misc_feature (1)..( 6): Result.003 file - promoters60/1923743
actatt

SEQ ID NO: 123316 - DNA, 7 bp, Unknown
  misc_feature (1)..( 7): Result.003 file - promoters60/1923743
cgactat

SEQ ID NO: 123317 - DNA, 7 bp, Unknown
  misc_feature (1)..( 7): Result.003 file - promoters60/1923743
cgagtat

SEQ ID NO: 123318 - DNA, 7 bp, Unknown
  misc_feature (1)..( 7): Result.003 file - promoters60/1923750
attgaaa

SEQ ID NO: 123319 - DNA, 7 bp, Unknown
  misc_feature (1)..( 7): Result.003 file - promoters60/1923750
attaaaa

SEQ ID NO: 123320 - DNA, 6 bp, Unknown
  misc_feature (1)..( 6): Result.003 file - promoters60/1923750
tattta

SEQ ID NO: 123321 - DNA, 6 bp, Unknown
  misc_feature (1)..( 6): Result.003 file - promoters60/1923750
tattta

SEQ ID NO: 123322 - DNA, 7 bp, Unknown
  misc_feature (1)..( 7): Result.003 file - promoters60/1923750
gatattc

SEQ ID NO: 123323 - DNA, 7 bp, Unknown
  misc_feature (1)..( 7): Result.003 file - promoters60/1923750
gatcttc

SEQ ID NO: 123324 - DNA, 6 bp, Unknown
  misc_feature (1)..( 6): Result.003 file - promoters60/1923750
aaaaca

SEQ ID NO: 123325 - DNA, 6 bp, Unknown
  misc_feature (1)..( 6): Result.003 file - promoters60/1923750
aaaaca

SEQ ID NO: 123326 - DNA, 10 bp, Unknown
  misc_feature (1)..( 10): Result.003 file - promoters60/1923750
agaaaacaaa

SEQ ID NO: 123327 - DNA, 10 bp, Unknown
  misc_feature (1)..( 10): Result.003 file - promoters60/1923750
agaaaaaaaa

SEQ ID NO: 123328 - DNA, 6 bp, Unknown
  misc_feature (1)..( 6): Result.003 file - promoters60/1923750
ataata

SEQ ID NO: 123329 - DNA, 6 bp, Unknown
  misc_feature (1)..( 6): Result.003 file - promoters60/1923750
ataata

SEQ ID NO: 123330 - DNA, 7 bp, Unknown
  misc_feature (1)..( 7): Result.003 file - promoters60/1923750
aaacaca

SEQ ID NO: 123331 - DNA, 7 bp, Unknown
  misc_feature (1)..( 7): Result.003 file - promoters60/1923750
aaataca

SEQ ID NO: 123332 - DNA, 7 bp, Unknown
  misc_feature (1)..( 7): Result.003 file - promoters60/1923750
actttag

SEQ ID NO: 123333 - DNA, 7 bp, Unknown
  misc_feature (1)..( 7): Result.003 file - promoters60/1923750
actatag

SEQ ID NO: 123334 - DNA, 6 bp, Unknown
  misc_feature (1)..( 6): Result.003 file - promoters60/1923750
actata

SEQ ID NO: 123335 - DNA, 6 bp, Unknown
  misc_feature (1)..( 6): Result.003 file - promoters60/1923750
actata

SEQ ID NO: 123336 - DNA, 7 bp, Unknown
  misc_feature (1)..( 7): Result.003 file - promoters60/1923750
acattta

SEQ ID NO: 123337 - DNA, 7 bp, Unknown
  misc_feature (1)..( 7): Result.003 file - promoters60/1923750
acagtta

SEQ ID NO: 123338 - DNA, 6 bp, Unknown
  misc_feature (1)..( 6): Result.003 file - promoters60/1923750
ttaatc

SEQ ID NO: 123339 - DNA, 6 bp, Unknown
  misc_feature (1)..( 6): Result.003 file - promoters60/1923750
ttaatc

SEQ ID NO: 123340 - DNA, 8 bp, Unknown
  misc_feature (1)..( 8): Result.003 file - promoters60/1923750
taccaaaa

SEQ ID NO: 123341 - DNA, 8 bp, Unknown
  misc_feature (1)..( 8): Result.003 file - promoters60/1923750
tacaaaaa

SEQ ID NO: 123342 - DNA, 6 bp, Unknown
  misc_feature (1)..( 6): Result.003 file - promoters60/1923750
aattat

SEQ ID NO: 123343 - DNA, 6 bp, Unknown
  misc_feature (1)..( 6): Result.003 file - promoters60/1923750
aattat

SEQ ID NO: 123344 - DNA, 7 bp, Unknown
  misc_feature (1)..( 7): Result.003 file - promoters60/1923750
taatcac

SEQ ID NO: 123345 - DNA, 7 bp, Unknown
  misc_feature (1)..( 7): Result.003 file - promoters60/1923750
taaacac

SEQ ID NO: 123346 - DNA, 6 bp, Unknown
  misc_feature (1)..( 6): Result.003 file - promoters60/1923750
caaaac

SEQ ID NO: 123347 - DNA, 6 bp, Unknown
  misc_feature (1)..( 6): Result.003 file - promoters60/1923750
caaaac

SEQ ID NO: 123348 - DNA, 8 bp, Unknown
  misc_feature (1)..( 8): Result.003 file - promoters60/1923750
tactattt

SEQ ID NO: 123349 - DNA, 8 bp, Unknown
  misc_feature (1)..( 8): Result.003 file - promoters60/1923750
tacaattt

SEQ ID NO: 123350 - DNA, 9 bp, Unknown
  misc_feature (1)..( 9): Result.003 file - promoters60/1923750
cagcttttt

SEQ ID NO: 123351 - DNA, 9 bp, Unknown
  misc_feature (1)..( 9): Result.003 file - promoters60/1923750
cagtttttt

SEQ ID NO: 123352 - DNA, 6 bp, Unknown
  misc_feature (1)..( 6): Result.003 file - promoters60/1923750
acaact

SEQ ID NO: 123353 - DNA, 6 bp, Unknown
  misc_feature (1)..( 6): Result.003 file - promoters60/1923750
acaact

SEQ ID NO: 123354 - DNA, 7 bp, Unknown
  misc_feature (1)..( 7): Result.003 file - promoters60/1923750
tttctaa

SEQ ID NO: 123355 - DNA, 7 bp, Unknown
  misc_feature (1)..( 7): Result.003 file - promoters60/1923750
tttctaa

SEQ ID NO: 123356 - DNA, 6 bp, Unknown
  misc_feature (1)..( 6): Result.003 file - promoters60/1923750
ctccaa

SEQ ID NO: 123357 - DNA, 6 bp, Unknown
  misc_feature (1)..( 6): Result.003 file - promoters60/1923750
ctccaa

SEQ ID NO: 123358 - DNA, 7 bp, Unknown
  misc_feature (1)..( 7): Result.003 file - promoters60/1923750
tactatt

SEQ ID NO: 123359 - DNA, 7 bp, Unknown
  misc_feature (1)..( 7): Result.003 file - promoters60/1923750
tacaatt

SEQ ID NO: 123360 - DNA, 7 bp, Unknown
  misc_feature (1)..( 7): Result.003 file - promoters60/1923750
acataaa

SEQ ID NO: 123361 - DNA, 7 bp, Unknown
  misc_feature (1)..( 7): Result.003 file - promoters60/1923750
acataaa

SEQ ID NO: 123362 - DNA, 7 bp, Unknown
  misc_feature (1)..( 7): Result.003 file - promoters60/1923750
aaatttt

SEQ ID NO: 123363 - DNA, 7 bp, Unknown
  misc_feature (1)..( 7): Result.003 file - promoters60/1923750
aaacttt

SEQ ID NO: 123364 - DNA, 6 bp, Unknown
  misc_feature (1)..( 6): Result.003 file - promoters60/1923750
taaata

SEQ ID NO: 123365 - DNA, 6 bp, Unknown
  misc_feature (1)..( 6): Result.003 file - promoters60/1923750
taaata

SEQ ID NO: 123366 - DNA, 10 bp, Unknown
  misc_feature (1)..( 10): Result.003 file - promoters60/1957018
taattttgat

SEQ ID NO: 123367 - DNA, 10 bp, Unknown
  misc_feature (1)..( 10): Result.003 file - promoters60/1957018
aaattttcgt

SEQ ID NO: 123368 - DNA, 10 bp, Unknown
  misc_feature (1)..( 10): Result.003 file - promoters60/1957018
taatttgatt

SEQ ID NO: 123369 - DNA, 10 bp, Unknown
  misc_feature (1)..( 10): Result.003 file - promoters60/1957018
taatttgggg

SEQ ID NO: 123370 - DNA, 10 bp, Unknown
  misc_feature (1)..( 10): Result.003 file - promoters60/1957018
taattttgat

SEQ ID NO: 123371 - DNA, 10 bp, Unknown
  misc_feature (1)..( 10): Result.003 file - promoters60/1957018
caattcgatt

SEQ ID NO: 123372 - DNA, 20 bp, Unknown
  misc_feature (1)..( 20): Result.003 file - promoters60/1957018
aagaaaaaaagaaaagaaag

SEQ ID NO: 123373 - DNA, 20 bp, Unknown
  misc_feature (1)..( 20): Result.003 file - promoters60/1957018
tttagatttagataagtaaa

SEQ ID NO: 123374 - DNA, 20 bp, Unknown
  misc_feature (1)..( 20): Result.003 file - promoters60/1957018
tattgaaaaagaaaaagaaa

SEQ ID NO: 123375 - DNA, 20 bp, Unknown
  misc_feature (1)..( 20): Result.003 file - promoters60/1957018
aaacaaaaaaaataaacaaa

SEQ ID NO: 123376 - DNA, 20 bp, Unknown
  misc_feature (1)..( 20): Result.003 file - promoters60/1957018
gtgtgtggcggataagcaaa

SEQ ID NO: 123377 - DNA, 20 bp, Unknown
  misc_feature (1)..( 20): Result.003 file - promoters60/1957018
tgggttgttatatattgcaa

SEQ ID NO: 123378 - DNA, 8 bp, Unknown
  misc_feature (1)..( 8): Result.003 file - promoters60/1957018
attatcag

SEQ ID NO: 123379 - DNA, 8 bp, Unknown
  misc_feature (1)..( 8): Result.003 file - promoters60/1957018
attttcaa

SEQ ID NO: 123380 - DNA, 8 bp, Unknown
  misc_feature (1)..( 8): Result.003 file - promoters60/1957018
attatcat

SEQ ID NO: 123381 - DNA, 8 bp, Unknown
  misc_feature (1)..( 8): Result.003 file - promoters60/1957018
attctcag

SEQ ID NO: 123382 - DNA, 8 bp, Unknown
  misc_feature (1)..( 8): Result.003 file - promoters60/1957018
attatcag

SEQ ID NO: 123383 - DNA, 8 bp, Unknown
  misc_feature (1)..( 8): Result.003 file - promoters60/1957018
attaacat

SEQ ID NO: 123384 - DNA, 9 bp, Unknown
  misc_feature (1)..( 9): Result.003 file - promoters60/1957018
agattctag

SEQ ID NO: 123385 - DNA, 9 bp, Unknown
  misc_feature (1)..( 9): Result.003 file - promoters60/1957018
ggattctta

SEQ ID NO: 123386 - DNA, 9 bp, Unknown
  misc_feature (1)..( 9): Result.003 file - promoters60/1957018
agattcaat

SEQ ID NO: 123387 - DNA, 9 bp, Unknown
  misc_feature (1)..( 9): Result.003 file - promoters60/1957018
atattttta

SEQ ID NO: 123388 - DNA, 9 bp, Unknown
  misc_feature (1)..( 9): Result.003 file - promoters60/1957018
ggatgcttt

SEQ ID NO: 123389 - DNA, 9 bp, Unknown
  misc_feature (1)..( 9): Result.003 file - promoters60/1957018
agattctag

SEQ ID NO: 123390 - DNA, 10 bp, Unknown
  misc_feature (1)..( 10): Result.003 file - promoters60/1957018
tatttttaaa

SEQ ID NO: 123391 - DNA, 10 bp, Unknown
  misc_feature (1)..( 10): Result.003 file - promoters60/1957018
gctttttaac

SEQ ID NO: 123392 - DNA, 10 bp, Unknown
  misc_feature (1)..( 10): Result.003 file - promoters60/1957018
gattcttact

SEQ ID NO: 123393 - DNA, 10 bp, Unknown
  misc_feature (1)..( 10): Result.003 file - promoters60/1957018
cttgtttaac

SEQ ID NO: 123394 - DNA, 10 bp, Unknown
  misc_feature (1)..( 10): Result.003 file - promoters60/1957018
gattctagaa

SEQ ID NO: 123395 - DNA, 10 bp, Unknown
  misc_feature (1)..( 10): Result.003 file - promoters60/1957018
gattcttttc

SEQ ID NO: 123396 - DNA, 12 bp, Unknown
  misc_feature (1)..( 12): Result.003 file - promoters60/1957212
ctaaaagacaga

SEQ ID NO: 123397 - DNA, 12 bp, Unknown
  misc_feature (1)..( 12): Result.003 file - promoters60/1957212
taaaacgacatg

SEQ ID NO: 123398 - DNA, 12 bp, Unknown
  misc_feature (1)..( 12): Result.003 file - promoters60/1957212
tttggagacaga

SEQ ID NO: 123399 - DNA, 12 bp, Unknown
  misc_feature (1)..( 12): Result.003 file - promoters60/1957212
gaaaaagaaaaa

SEQ ID NO: 123400 - DNA, 12 bp, Unknown
  misc_feature (1)..( 12): Result.003 file - promoters60/1957212
ggaaacatatcc

SEQ ID NO: 123401 - DNA, 9 bp, Unknown
  misc_feature (1)..( 9): Result.003 file - promoters60/1957296
aatgtagtt

SEQ ID NO: 123402 - DNA, 9 bp, Unknown
  misc_feature (1)..( 9): Result.003 file - promoters60/1957296
aatgttgtt

SEQ ID NO: 123403 - DNA, 10 bp, Unknown
  misc_feature (1)..( 10): Result.003 file - promoters60/1957296
tcttctactt

SEQ ID NO: 123404 - DNA, 10 bp, Unknown
  misc_feature (1)..( 10): Result.003 file - promoters60/1957296
tctactactt

SEQ ID NO: 123405 - DNA, 6 bp, Unknown
  misc_feature (1)..( 6): Result.003 file - promoters60/1957296
aagaaa

SEQ ID NO: 123406 - DNA, 6 bp, Unknown
  misc_feature (1)..( 6): Result.003 file - promoters60/1957296
aagaaa

SEQ ID NO: 123407 - DNA, 6 bp, Unknown
  misc_feature (1)..( 6): Result.003 file - promoters60/1957296
aattga

SEQ ID NO: 123408 - DNA, 6 bp, Unknown
  misc_feature (1)..( 6): Result.003 file - promoters60/1957296
aattga

SEQ ID NO: 123409 - DNA, 7 bp, Unknown
  misc_feature (1)..( 7): Result.003 file - promoters60/1957296
gaaaatt

SEQ ID NO: 123410 - DNA, 7 bp, Unknown
  misc_feature (1)..( 7): Result.003 file - promoters60/1957296
gaaaatt

SEQ ID NO: 123411 - DNA, 6 bp, Unknown
  misc_feature (1)..( 6): Result.003 file - promoters60/1957296
tgtctt

SEQ ID NO: 123412 - DNA, 6 bp, Unknown
  misc_feature (1)..( 6): Result.003 file - promoters60/1957296
tgtctt

SEQ ID NO: 123413 - DNA, 8 bp, Unknown
  misc_feature (1)..( 8): Result.003 file - promoters60/1957296
atcagtgt

SEQ ID NO: 123414 - DNA, 8 bp, Unknown
  misc_feature (1)..( 8): Result.003 file - promoters60/1957296
atcaatgt

SEQ ID NO: 123415 - DNA, 7 bp, Unknown
  misc_feature (1)..( 7): Result.003 file - promoters60/1957296
aatttat

SEQ ID NO: 123416 - DNA, 7 bp, Unknown
  misc_feature (1)..( 7): Result.003 file - promoters60/1957296
aatttat

SEQ ID NO: 123417 - DNA, 6 bp, Unknown
  misc_feature (1)..( 6): Result.003 file - promoters60/1957296
agaaca

SEQ ID NO: 123418 - DNA, 6 bp, Unknown
  misc_feature (1)..( 6): Result.003 file - promoters60/1957296
agaaca

SEQ ID NO: 123419 - DNA, 6 bp, Unknown
  misc_feature (1)..( 6): Result.003 file - promoters60/1957296
gatcaa

SEQ ID NO: 123420 - DNA, 6 bp, Unknown
  misc_feature (1)..( 6): Result.003 file - promoters60/1957296
gatcaa

SEQ ID NO: 123421 - DNA, 6 bp, Unknown
  misc_feature (1)..( 6): Result.003 file - promoters60/1957296
ttaaaa

SEQ ID NO: 123422 - DNA, 6 bp, Unknown
  misc_feature (1)..( 6): Result.003 file - promoters60/1957296
ttaaaa

SEQ ID NO: 123423 - DNA, 6 bp, Unknown
  misc_feature (1)..( 6): Result.003 file - promoters60/1957296
aaaatt

SEQ ID NO: 123424 - DNA, 6 bp, Unknown
  misc_feature (1)..( 6): Result.003 file - promoters60/1957296
aaaatt

SEQ ID NO: 123425 - DNA, 8 bp, Unknown
  misc_feature (1)..( 8): Result.003 file - promoters60/1957296
aattaatt

SEQ ID NO: 123426 - DNA, 8 bp, Unknown
  misc_feature (1)..( 8): Result.003 file - promoters60/1957296
aatcaatt

SEQ ID NO: 123427 - DNA, 7 bp, Unknown
  misc_feature (1)..( 7): Result.003 file - promoters60/1957296
attaaat

SEQ ID NO: 123428 - DNA, 7 bp, Unknown
  misc_feature (1)..( 7): Result.003 file - promoters60/1957296
attaaat

SEQ ID NO: 123429 - DNA, 6 bp, Unknown
  misc_feature (1)..( 6): Result.003 file - promoters60/1957296
tataca

SEQ ID NO: 123430 - DNA, 6 bp, Unknown
  misc_feature (1)..( 6): Result.003 file - promoters60/1957296
tataca

SEQ ID NO: 123431 - DNA, 7 bp, Unknown
  misc_feature (1)..( 7): Result.003 file - promoters60/1957303
aaagcga

SEQ ID NO: 123432 - DNA, 7 bp, Unknown
  misc_feature (1)..( 7): Result.003 file - promoters60/1957303
aaaccga

SEQ ID NO: 123433 - DNA, 7 bp, Unknown
  misc_feature (1)..( 7): Result.003 file - promoters60/1957303
aaaacga

SEQ ID NO: 123434 - DNA, 10 bp, Unknown
  misc_feature (1)..( 10): Result.003 file - promoters60/1957303
gaagaaaaaa

SEQ ID NO: 123435 - DNA, 10 bp, Unknown
  misc_feature (1)..( 10): Result.003 file - promoters60/1957303
gaacaaaacc

SEQ ID NO: 123436 - DNA, 10 bp, Unknown
  misc_feature (1)..( 10): Result.003 file - promoters60/1957303
gaaaaaaaaa

SEQ ID NO: 123437 - DNA, 8 bp, Unknown
  misc_feature (1)..( 8): Result.003 file - promoters60/1957303
aaacgact

SEQ ID NO: 123438 - DNA, 8 bp, Unknown
  misc_feature (1)..( 8): Result.003 file - promoters60/1957303
aaacgaaa

SEQ ID NO: 123439 - DNA, 8 bp, Unknown
  misc_feature (1)..( 8): Result.003 file - promoters60/1957303
aaaagaaa

SEQ ID NO: 123440 - DNA, 8 bp, Unknown
  misc_feature (1)..( 8): Result.003 file - promoters60/1957303
ttagaaag

SEQ ID NO: 123441 - DNA, 8 bp, Unknown
  misc_feature (1)..( 8): Result.003 file - promoters60/1957303
gaagaaag

SEQ ID NO: 123442 - DNA, 8 bp, Unknown
  misc_feature (1)..( 8): Result.003 file - promoters60/1957303
gaagaaaa

SEQ ID NO: 123443 - DNA, 14 bp, Unknown
  misc_feature (1)..( 14): Result.003 file - promoters60/1957303
ttataaaaattgaa

SEQ ID NO: 123444 - DNA, 14 bp, Unknown
  misc_feature (1)..( 14): Result.003 file - promoters60/1957303
agaagcaaatcgaa

SEQ ID NO: 123445 - DNA, 14 bp, Unknown
  misc_feature (1)..( 14): Result.003 file - promoters60/1957303
agaagaaaatcccg

SEQ ID NO: 123446 - DNA, 8 bp, Unknown
  misc_feature (1)..( 8): Result.003 file - promoters60/1957303
ctttaaaa

SEQ ID NO: 123447 - DNA, 8 bp, Unknown
  misc_feature (1)..( 8): Result.003 file - promoters60/1957303
ttttaaag

SEQ ID NO: 123448 - DNA, 8 bp, Unknown
  misc_feature (1)..( 8): Result.003 file - promoters60/1957303
atttgaag

SEQ ID NO: 123449 - DNA, 8 bp, Unknown
  misc_feature (1)..( 8): Result.003 file - promoters60/1957303
ccaaatct

SEQ ID NO: 123450 - DNA, 8 bp, Unknown
  misc_feature (1)..( 8): Result.003 file - promoters60/1957303
ccaaatct

SEQ ID NO: 123451 - DNA, 8 bp, Unknown
  misc_feature (1)..( 8): Result.003 file - promoters60/1957303
gcaaatcg

SEQ ID NO: 123452 - DNA, 8 bp, Unknown
  misc_feature (1)..( 8): Result.003 file - promoters60/1959878
tgtttaaa

SEQ ID NO: 123453 - DNA, 8 bp, Unknown
  misc_feature (1)..( 8): Result.003 file - promoters60/1959878
tgtgtaaa

SEQ ID NO: 123454 - DNA, 8 bp, Unknown
  misc_feature (1)..( 8): Result.003 file - promoters60/1959878
acgtgatg

SEQ ID NO: 123455 - DNA, 8 bp, Unknown
  misc_feature (1)..( 8): Result.003 file - promoters60/1959878
acgttatg

SEQ ID NO: 123456 - DNA, 6 bp, Unknown
  misc_feature (1)..( 6): Result.003 file - promoters60/1959878
atgggc

SEQ ID NO: 123457 - DNA, 6 bp, Unknown
  misc_feature (1)..( 6): Result.003 file - promoters60/1959878
atgggc

SEQ ID NO: 123458 - DNA, 6 bp, Unknown
  misc_feature (1)..( 6): Result.003 file - promoters60/1959878
ccaata

SEQ ID NO: 123459 - DNA, 6 bp, Unknown
  misc_feature (1)..( 6): Result.003 file - promoters60/1959878
ccaata

SEQ ID NO: 123460 - DNA, 10 bp, Unknown
  misc_feature (1)..( 10): Result.003 file - promoters60/1959878
ggtttatttt

SEQ ID NO: 123461 - DNA, 10 bp, Unknown
  misc_feature (1)..( 10): Result.003 file - promoters60/1959878
ggtttattca

SEQ ID NO: 123462 - DNA, 10 bp, Unknown
  misc_feature (1)..( 10): Result.003 file - promoters60/1959878
attttatttt

SEQ ID NO: 123463 - DNA, 6 bp, Unknown
  misc_feature (1)..( 6): Result.003 file - promoters60/1959878
gatgtt

SEQ ID NO: 123464 - DNA, 6 bp, Unknown
  misc_feature (1)..( 6): Result.003 file - promoters60/1959878
gatgtt

SEQ ID NO: 123465 - DNA, 7 bp, Unknown
  misc_feature (1)..( 7): Result.003 file - promoters60/1959878
tttaatt

SEQ ID NO: 123466 - DNA, 7 bp, Unknown
  misc_feature (1)..( 7): Result.003 file - promoters60/1959878
tttgatt

SEQ ID NO: 123467 - DNA, 6 bp, Unknown
  misc_feature (1)..( 6): Result.003 file - promoters60/1959878
ttaaga

SEQ ID NO: 123468 - DNA, 6 bp, Unknown
  misc_feature (1)..( 6): Result.003 file - promoters60/1959878
ttaaga

SEQ ID NO: 123469 - DNA, 6 bp, Unknown
  misc_feature (1)..( 6): Result.003 file - promoters60/1959878
gaaaag

SEQ ID NO: 123470 - DNA, 6 bp, Unknown
  misc_feature (1)..( 6): Result.003 file - promoters60/1959878
gaaaag

SEQ ID NO: 123471 - DNA, 7 bp, Unknown
  misc_feature (1)..( 7): Result.003 file - promoters60/1959878
atggtaa

SEQ ID NO: 123472 - DNA, 7 bp, Unknown
  misc_feature (1)..( 7): Result.003 file - promoters60/1959878
atgataa

SEQ ID NO: 123473 - DNA, 7 bp, Unknown
  misc_feature (1)..( 7): Result.003 file - promoters60/1959878
aacctgt

SEQ ID NO: 123474 - DNA, 7 bp, Unknown
  misc_feature (1)..( 7): Result.003 file - promoters60/1959878
aacttgt

SEQ ID NO: 123475 - DNA, 8 bp, Unknown
  misc_feature (1)..( 8): Result.003 file - promoters60/1959878
ttggatat

SEQ ID NO: 123476 - DNA, 8 bp, Unknown
  misc_feature (1)..( 8): Result.003 file - promoters60/1959878
ttgcatat

SEQ ID NO: 123477 - DNA, 8 bp, Unknown
  misc_feature (1)..( 8): Result.003 file - promoters60/1959878
tgttatgc

SEQ ID NO: 123478 - DNA, 8 bp, Unknown
  misc_feature (1)..( 8): Result.003 file - promoters60/1959878
tgttttgc

SEQ ID NO: 123479 - DNA, 7 bp, Unknown
  misc_feature (1)..( 7): Result.003 file - promoters60/1959878
ttgctaa

SEQ ID NO: 123480 - DNA, 7 bp, Unknown
  misc_feature (1)..( 7): Result.003 file - promoters60/1959878
ttgttaa

SEQ ID NO: 123481 - DNA, 6 bp, Unknown
  misc_feature (1)..( 6): Result.003 file - promoters60/1959878
ttcctt

SEQ ID NO: 123482 - DNA, 6 bp, Unknown
  misc_feature (1)..( 6): Result.003 file - promoters60/1959878
ttcctt

SEQ ID NO: 123483 - DNA, 6 bp, Unknown
  misc_feature (1)..( 6): Result.003 file - promoters60/1959878
aagaga

SEQ ID NO: 123484 - DNA, 6 bp, Unknown
  misc_feature (1)..( 6): Result.003 file - promoters60/1959878
aagaga

SEQ ID NO: 123485 - DNA, 7 bp, Unknown
  misc_feature (1)..( 7): Result.003 file - promoters60/1959878
aaggaag

SEQ ID NO: 123486 - DNA, 7 bp, Unknown
  misc_feature (1)..( 7): Result.003 file - promoters60/1959878
aagaaag

SEQ ID NO: 123487 - DNA, 7 bp, Unknown
  misc_feature (1)..( 7): Result.003 file - promoters60/1959904
tttgtgt

SEQ ID NO: 123488 - DNA, 7 bp, Unknown
  misc_feature (1)..( 7): Result.003 file - promoters60/1959904
tttttgt

SEQ ID NO: 123489 - DNA, 10 bp, Unknown
  misc_feature (1)..( 10): Result.003 file - promoters60/1959904
tttgcctttt

SEQ ID NO: 123490 - DNA, 10 bp, Unknown
  misc_feature (1)..( 10): Result.003 file - promoters60/1959904
tttacctttt

SEQ ID NO: 123491 - DNA, 6 bp, Unknown
  misc_feature (1)..( 6): Result.003 file - promoters60/1959904
caaatt

SEQ ID NO: 123492 - DNA, 6 bp, Unknown
  misc_feature (1)..( 6): Result.003 file - promoters60/1959904
caaatt

SEQ ID NO: 123493 - DNA, 7 bp, Unknown
  misc_feature (1)..( 7): Result.003 file - promoters60/1959904
ttagtca

SEQ ID NO: 123494 - DNA, 7 bp, Unknown
  misc_feature (1)..( 7): Result.003 file - promoters60/1959904
ttattca

SEQ ID NO: 123495 - DNA, 6 bp, Unknown
  misc_feature (1)..( 6): Result.003 file - promoters60/1959904
ttgatg

SEQ ID NO: 123496 - DNA, 6 bp, Unknown
  misc_feature (1)..( 6): Result.003 file - promoters60/1959904
ttgatg

SEQ ID NO: 123497 - DNA, 8 bp, Unknown
  misc_feature (1)..( 8): Result.003 file - promoters60/1959904
atatggcc

SEQ ID NO: 123498 - DNA, 8 bp, Unknown
  misc_feature (1)..( 8): Result.003 file - promoters60/1959904
ataaggcc

SEQ ID NO: 123499 - DNA, 8 bp, Unknown
  misc_feature (1)..( 8): Result.003 file - promoters60/1959904
atcatcaa

SEQ ID NO: 123500 - DNA, 8 bp, Unknown
  misc_feature (1)..( 8): Result.003 file - promoters60/1959904
atcatcaa

SEQ ID NO: 123501 - DNA, 7 bp, Unknown
  misc_feature (1)..( 7): Result.003 file - promoters60/1959904
tcttttt

SEQ ID NO: 123502 - DNA, 7 bp, Unknown
  misc_feature (1)..( 7): Result.003 file - promoters60/1959904
tctgttt

SEQ ID NO: 123503 - DNA, 6 bp, Unknown
  misc_feature (1)..( 6): Result.003 file - promoters60/1959904
tttgtt

SEQ ID NO: 123504 - DNA, 6 bp, Unknown
  misc_feature (1)..( 6): Result.003 file - promoters60/1959904
tttgtt

SEQ ID NO: 123505 - DNA, 6 bp, Unknown
  misc_feature (1)..( 6): Result.003 file - promoters60/1959904
attgtt

SEQ ID NO: 123506 - DNA, 6 bp, Unknown
  misc_feature (1)..( 6): Result.003 file - promoters60/1959904
attgtt

SEQ ID NO: 123507 - DNA, 7 bp, Unknown
  misc_feature (1)..( 7): Result.003 file - promoters60/1959904
ttttgtt

SEQ ID NO: 123508 - DNA, 7 bp, Unknown
  misc_feature (1)..( 7): Result.003 file - promoters60/1959904
ttttgtt

SEQ ID NO: 123509 - DNA, 8 bp, Unknown
  misc_feature (1)..( 8): Result.003 file - promoters60/1959904
ataatctt

SEQ ID NO: 123510 - DNA, 8 bp, Unknown
  misc_feature (1)..( 8): Result.003 file - promoters60/1959904
ataatctt

SEQ ID NO: 123511 - DNA, 8 bp, Unknown
  misc_feature (1)..( 8): Result.003 file - promoters60/1959904
tgtttaaa

SEQ ID NO: 123512 - DNA, 8 bp, Unknown
  misc_feature (1)..( 8): Result.003 file - promoters60/1959904
tgtgtaaa

SEQ ID NO: 123513 - DNA, 8 bp, Unknown
  misc_feature (1)..( 8): Result.003 file - promoters60/1959904
acgtgatg

SEQ ID NO: 123514 - DNA, 8 bp, Unknown
  misc_feature (1)..( 8): Result.003 file - promoters60/1959904
acgttatg

SEQ ID NO: 123515 - DNA, 6 bp, Unknown
  misc_feature (1)..( 6): Result.003 file - promoters60/1959904
atgggc

SEQ ID NO: 123516 - DNA, 6 bp, Unknown
  misc_feature (1)..( 6): Result.003 file - promoters60/1959904
atgggc

SEQ ID NO: 123517 - DNA, 6 bp, Unknown
  misc_feature (1)..( 6): Result.003 file - promoters60/1959904
ccaata

SEQ ID NO: 123518 - DNA, 6 bp, Unknown
  misc_feature (1)..( 6): Result.003 file - promoters60/1959904
ccaata

SEQ ID NO: 123519 - DNA, 8 bp, Unknown
  misc_feature (1)..( 8): Result.003 file - promoters60/1959904
ggtttatt

SEQ ID NO: 123520 - DNA, 8 bp, Unknown
  misc_feature (1)..( 8): Result.003 file - promoters60/1959904
ggtttatt

SEQ ID NO: 123521 - DNA, 7 bp, Unknown
  misc_feature (1)..( 7): Result.003 file - promoters60/1959965
tatctta

SEQ ID NO: 123522 - DNA, 7 bp, Unknown
  misc_feature (1)..( 7): Result.003 file - promoters60/1959965
tatgtta

SEQ ID NO: 123523 - DNA, 9 bp, Unknown
  misc_feature (1)..( 9): Result.003 file - promoters60/1959965
atattattt

SEQ ID NO: 123524 - DNA, 9 bp, Unknown
  misc_feature (1)..( 9): Result.003 file - promoters60/1959965
atataattt

SEQ ID NO: 123525 - DNA, 13 bp, Unknown
  misc_feature (1)..( 13): Result.003 file - promoters60/1959965
tttatacatataa

SEQ ID NO: 123526 - DNA, 13 bp, Unknown
  misc_feature (1)..( 13): Result.003 file - promoters60/1959965
aaacttcatctaa

SEQ ID NO: 123527 - DNA, 13 bp, Unknown
  misc_feature (1)..( 13): Result.003 file - promoters60/1959965
aaagttcatctgt

SEQ ID NO: 123528 - DNA, 6 bp, Unknown
  misc_feature (1)..( 6): Result.003 file - promoters60/1959965
tttcat

SEQ ID NO: 123529 - DNA, 6 bp, Unknown
  misc_feature (1)..( 6): Result.003 file - promoters60/1959965
tttcat

SEQ ID NO: 123530 - DNA, 7 bp, Unknown
  misc_feature (1)..( 7): Result.003 file - promoters60/1959965
agaaaaa

SEQ ID NO: 123531 - DNA, 7 bp, Unknown
  misc_feature (1)..( 7): Result.003 file - promoters60/1959965
agaaaaa

SEQ ID NO: 123532 - DNA, 7 bp, Unknown
  misc_feature (1)..( 7): Result.003 file - promoters60/1959965
ccatttt

SEQ ID NO: 123533 - DNA, 7 bp, Unknown
  misc_feature (1)..( 7): Result.003 file - promoters60/1959965
acatttt

SEQ ID NO: 123534 - DNA, 7 bp, Unknown
  misc_feature (1)..( 7): Result.003 file - promoters60/1959965
ccatttg

SEQ ID NO: 123535 - DNA, 8 bp, Unknown
  misc_feature (1)..( 8): Result.003 file - promoters60/1959965
ttatatat

SEQ ID NO: 123536 - DNA, 8 bp, Unknown
  misc_feature (1)..( 8): Result.003 file - promoters60/1959965
ttaaatat

SEQ ID NO: 123537 - DNA, 6 bp, Unknown
  misc_feature (1)..( 6): Result.003 file - promoters60/1959965
atgaat

SEQ ID NO: 123538 - DNA, 6 bp, Unknown
  misc_feature (1)..( 6): Result.003 file - promoters60/1959965
atgaat

SEQ ID NO: 123539 - DNA, 8 bp, Unknown
  misc_feature (1)..( 8): Result.003 file - promoters60/1959965
ttttcatt

SEQ ID NO: 123540 - DNA, 8 bp, Unknown
  misc_feature (1)..( 8): Result.003 file - promoters60/1959965
ttttcatt

SEQ ID NO: 123541 - DNA, 7 bp, Unknown
  misc_feature (1)..( 7): Result.003 file - promoters60/1959965
ttaggag

SEQ ID NO: 123542 - DNA, 7 bp, Unknown
  misc_feature (1)..( 7): Result.003 file - promoters60/1959965
ttaggag

SEQ ID NO: 123543 - DNA, 7 bp, Unknown
  misc_feature (1)..( 7): Result.003 file - promoters60/1959965
tgatacc

SEQ ID NO: 123544 - DNA, 7 bp, Unknown
  misc_feature (1)..( 7): Result.003 file - promoters60/1959965
tgaaacc

SEQ ID NO: 123545 - DNA, 7 bp, Unknown
  misc_feature (1)..( 7): Result.003 file - promoters60/1959965
tttactc

SEQ ID NO: 123546 - DNA, 7 bp, Unknown
  misc_feature (1)..( 7): Result.003 file - promoters60/1959965
ttttctc

SEQ ID NO: 123547 - DNA, 7 bp, Unknown
  misc_feature (1)..( 7): Result.003 file - promoters60/1959965
tcctttt

SEQ ID NO: 123548 - DNA, 7 bp, Unknown
  misc_feature (1)..( 7): Result.003 file - promoters60/1959965
tcctttt

SEQ ID NO: 123549 - DNA, 6 bp, Unknown
  misc_feature (1)..( 6): Result.003 file - promoters60/1959965
attttt

SEQ ID NO: 123550 - DNA, 6 bp, Unknown
  misc_feature (1)..( 6): Result.003 file - promoters60/1959965
attttt

SEQ ID NO: 123551 - DNA, 6 bp, Unknown
  misc_feature (1)..( 6): Result.003 file - promoters60/1959965
agagat

SEQ ID NO: 123552 - DNA, 6 bp, Unknown
  misc_feature (1)..( 6): Result.003 file - promoters60/1959965
agagat

SEQ ID NO: 123553 - DNA, 7 bp, Unknown
  misc_feature (1)..( 7): Result.003 file - promoters60/1959965
tattgtt

SEQ ID NO: 123554 - DNA, 7 bp, Unknown
  misc_feature (1)..( 7): Result.003 file - promoters60/1959965
tatagtt

SEQ ID NO: 123555 - DNA, 7 bp, Unknown
  misc_feature (1)..( 7): Result.003 file - promoters60/1959965
tatatgt

SEQ ID NO: 123556 - DNA, 7 bp, Unknown
  misc_feature (1)..( 7): Result.003 file - promoters60/1959965
tatgtgt

SEQ ID NO: 123557 - DNA, 7 bp, Unknown
  misc_feature (1)..( 7): Result.003 file - promoters60/1959965
taagatt

SEQ ID NO: 123558 - DNA, 7 bp, Unknown
  misc_feature (1)..( 7): Result.003 file - promoters60/1959965
taagatt

SEQ ID NO: 123559 - DNA, 7 bp, Unknown
  misc_feature (1)..( 7): Result.003 file - promoters60/1959965
tggttat

SEQ ID NO: 123560 - DNA, 7 bp, Unknown
  misc_feature (1)..( 7): Result.003 file - promoters60/1959965
tggatat

SEQ ID NO: 123561 - DNA, 8 bp, Unknown
  misc_feature (1)..( 8): Result.003 file - promoters60/1959965
attgtttt

SEQ ID NO: 123562 - DNA, 8 bp, Unknown
  misc_feature (1)..( 8): Result.003 file - promoters60/1959965
attttttt

SEQ ID NO: 123563 - DNA, 8 bp, Unknown
  misc_feature (1)..( 8): Result.003 file - promoters60/1959977
taagtaac

SEQ ID NO: 123564 - DNA, 8 bp, Unknown
  misc_feature (1)..( 8): Result.003 file - promoters60/1959977
gaagtaac

SEQ ID NO: 123565 - DNA, 8 bp, Unknown
  misc_feature (1)..( 8): Result.003 file - promoters60/1959977
gaagaaac

SEQ ID NO: 123566 - DNA, 8 bp, Unknown
  misc_feature (1)..( 8): Result.003 file - promoters60/1959977
caagaaaa

SEQ ID NO: 123567 - DNA, 8 bp, Unknown
  misc_feature (1)..( 8): Result.003 file - promoters60/1959977
aaagaaaa

SEQ ID NO: 123568 - DNA, 13 bp, Unknown
  misc_feature (1)..( 13): Result.003 file - promoters60/1974282
tagatacagattg

SEQ ID NO: 123569 - DNA, 13 bp, Unknown
  misc_feature (1)..( 13): Result.003 file - promoters60/1974282
atttcacaaattc

SEQ ID NO: 123570 - DNA, 13 bp, Unknown
  misc_feature (1)..( 13): Result.003 file - promoters60/1974282
gaagataagattg

SEQ ID NO: 123571 - DNA, 13 bp, Unknown
  misc_feature (1)..( 13): Result.003 file - promoters60/1974282
atttcaaaaatac

SEQ ID NO: 123572 - DNA, 13 bp, Unknown
  misc_feature (1)..( 13): Result.003 file - promoters60/1974282
gcttcaaacaaaa

SEQ ID NO: 123573 - DNA, 7 bp, Unknown
  misc_feature (1)..( 7): Result.003 file - promoters60/1974282
ttttaaa

SEQ ID NO: 123574 - DNA, 7 bp, Unknown
  misc_feature (1)..( 7): Result.003 file - promoters60/1974282
tttcaaa

SEQ ID NO: 123575 - DNA, 7 bp, Unknown
  misc_feature (1)..( 7): Result.003 file - promoters60/1974282
ttttaaa

SEQ ID NO: 123576 - DNA, 7 bp, Unknown
  misc_feature (1)..( 7): Result.003 file - promoters60/1974282
gttcaaa

SEQ ID NO: 123577 - DNA, 10 bp, Unknown
  misc_feature (1)..( 10): Result.003 file - promoters60/1974282
ttttgtgttt

SEQ ID NO: 123578 - DNA, 10 bp, Unknown
  misc_feature (1)..( 10): Result.003 file - promoters60/1974282
ttttatgttt

SEQ ID NO: 123579 - DNA, 10 bp, Unknown
  misc_feature (1)..( 10): Result.003 file - promoters60/1974282
ttttgggttc

SEQ ID NO: 123580 - DNA, 10 bp, Unknown
  misc_feature (1)..( 10): Result.003 file - promoters60/1974282
ttttatcaaa

SEQ ID NO: 123581 - DNA, 10 bp, Unknown
  misc_feature (1)..( 10): Result.003 file - promoters60/1974282
ccacaaaaca

SEQ ID NO: 123582 - DNA, 10 bp, Unknown
  misc_feature (1)..( 10): Result.003 file - promoters60/1974282
tatcaaaacc

SEQ ID NO: 123583 - DNA, 10 bp, Unknown
  misc_feature (1)..( 10): Result.003 file - promoters60/1974282
attcaaaatt

SEQ ID NO: 123584 - DNA, 10 bp, Unknown
  misc_feature (1)..( 10): Result.003 file - promoters60/1974282
attcaacatt

SEQ ID NO: 123585 - DNA, 10 bp, Unknown
  misc_feature (1)..( 10): Result.003 file - promoters60/1974282
aatttttgcg

SEQ ID NO: 123586 - DNA, 10 bp, Unknown
  misc_feature (1)..( 10): Result.003 file - promoters60/1974282
cctttttgta

SEQ ID NO: 123587 - DNA, 10 bp, Unknown
  misc_feature (1)..( 10): Result.003 file - promoters60/1974282
aattttatat

SEQ ID NO: 123588 - DNA, 10 bp, Unknown
  misc_feature (1)..( 10): Result.003 file - promoters60/1974282
ccttttcgta

SEQ ID NO: 123589 - DNA, 9 bp, Unknown
  misc_feature (1)..( 9): Result.003 file - promoters60/1974501
aaataattt

SEQ ID NO: 123590 - DNA, 9 bp, Unknown
  misc_feature (1)..( 9): Result.003 file - promoters60/1974501
ttatatttt

SEQ ID NO: 123591 - DNA, 9 bp, Unknown
  misc_feature (1)..( 9): Result.003 file - promoters60/1974501
aaaaaattt

SEQ ID NO: 123592 - DNA, 8 bp, Unknown
  misc_feature (1)..( 8): Result.003 file - promoters60/1974501
caaataat

SEQ ID NO: 123593 - DNA, 8 bp, Unknown
  misc_feature (1)..( 8): Result.003 file - promoters60/1974501
caaataat

SEQ ID NO: 123594 - DNA, 8 bp, Unknown
  misc_feature (1)..( 8): Result.003 file - promoters60/1974501
aaaagaat

SEQ ID NO: 123595 - DNA, 11 bp, Unknown
  misc_feature (1)..( 11): Result.003 file - promoters60/1974501
tcacgaataga

SEQ ID NO: 123596 - DNA, 11 bp, Unknown
  misc_feature (1)..( 11): Result.003 file - promoters60/1974501
tcacaaataca

SEQ ID NO: 123597 - DNA, 11 bp, Unknown
  misc_feature (1)..( 11): Result.003 file - promoters60/1974501
atacaaacaca

SEQ ID NO: 123598 - DNA, 7 bp, Unknown
  misc_feature (1)..( 7): Result.003 file - promoters60/1974501
actatag

SEQ ID NO: 123599 - DNA, 7 bp, Unknown
  misc_feature (1)..( 7): Result.003 file - promoters60/1974501
actataa

SEQ ID NO: 123600 - DNA, 7 bp, Unknown
  misc_feature (1)..( 7): Result.003 file - promoters60/1974501
actgtag

SEQ ID NO: 123601 - DNA, 15 bp, Unknown
  misc_feature (1)..( 15): Result.003 file - promoters60/1974501
tgaaatcatttatta

SEQ ID NO: 123602 - DNA, 15 bp, Unknown
  misc_feature (1)..( 15): Result.003 file - promoters60/1974501
aatacaaatttattg

SEQ ID NO: 123603 - DNA, 15 bp, Unknown
  misc_feature (1)..( 15): Result.003 file - promoters60/1974501
aatataaatgtattg

SEQ ID NO: 123604 - DNA, 10 bp, Unknown
  misc_feature (1)..( 10): Result.003 file - promoters60/1974501
atgtatttgt

SEQ ID NO: 123605 - DNA, 10 bp, Unknown
  misc_feature (1)..( 10): Result.003 file - promoters60/1974501
agatatttgt

SEQ ID NO: 123606 - DNA, 10 bp, Unknown
  misc_feature (1)..( 10): Result.003 file - promoters60/1974501
atgtctttcc

SEQ ID NO: 123607 - DNA, 7 bp, Unknown
  misc_feature (1)..( 7): Result.003 file - promoters60/1975887
cttatta

SEQ ID NO: 123608 - DNA, 7 bp, Unknown
  misc_feature (1)..( 7): Result.003 file - promoters60/1975887
cttattg

SEQ ID NO: 123609 - DNA, 7 bp, Unknown
  misc_feature (1)..( 7): Result.003 file - promoters60/1975887
tttattg

SEQ ID NO: 123610 - DNA, 7 bp, Unknown
  misc_feature (1)..( 7): Result.003 file - promoters60/1975887
tttattt

SEQ ID NO: 123611 - DNA, 9 bp, Unknown
  misc_feature (1)..( 9): Result.003 file - promoters60/1975887
atgaattgc

SEQ ID NO: 123612 - DNA, 9 bp, Unknown
  misc_feature (1)..( 9): Result.003 file - promoters60/1975887
tttaattgc

SEQ ID NO: 123613 - DNA, 9 bp, Unknown
  misc_feature (1)..( 9): Result.003 file - promoters60/1975887
ttttattgt

SEQ ID NO: 123614 - DNA, 9 bp, Unknown
  misc_feature (1)..( 9): Result.003 file - promoters60/1975887
tgtaattgt

SEQ ID NO: 123615 - DNA, 9 bp, Unknown
  misc_feature (1)..( 9): Result.003 file - promoters60/1975887
attgtaatt

SEQ ID NO: 123616 - DNA, 9 bp, Unknown
  misc_feature (1)..( 9): Result.003 file - promoters60/1975887
actgtaatc

SEQ ID NO: 123617 - DNA, 9 bp, Unknown
  misc_feature (1)..( 9): Result.003 file - promoters60/1975887
attgtaaca

SEQ ID NO: 123618 - DNA, 9 bp, Unknown
  misc_feature (1)..( 9): Result.003 file - promoters60/1975887
attgtaatt

SEQ ID NO: 123619 - DNA, 8 bp, Unknown
  misc_feature (1)..( 8): Result.003 file - promoters60/1975887
tatgtgtt

SEQ ID NO: 123620 - DNA, 8 bp, Unknown
  misc_feature (1)..( 8): Result.003 file - promoters60/1975887
aatgggtt

SEQ ID NO: 123621 - DNA, 8 bp, Unknown
  misc_feature (1)..( 8): Result.003 file - promoters60/1975887
tatttgtt

SEQ ID NO: 123622 - DNA, 11 bp, Unknown
  misc_feature (1)..( 11): Result.003 file - promoters60/1975887
gtatttgtaaa

SEQ ID NO: 123623 - DNA, 11 bp, Unknown
  misc_feature (1)..( 11): Result.003 file - promoters60/1975887
tttattgtaac

SEQ ID NO: 123624 - DNA, 11 bp, Unknown
  misc_feature (1)..( 11): Result.003 file - promoters60/1975887
gtaattgtaaa

SEQ ID NO: 123625 - DNA, 11 bp, Unknown
  misc_feature (1)..( 11): Result.003 file - promoters60/1975887
ttaattgctta

SEQ ID NO: 123626 - DNA, 11 bp, Unknown
  misc_feature (1)..( 11): Result.003 file - promoters60/1975887
tatagtattga

SEQ ID NO: 123627 - DNA, 11 bp, Unknown
  misc_feature (1)..( 11): Result.003 file - promoters60/1975887
taaagttttga

SEQ ID NO: 123628 - DNA, 11 bp, Unknown
  misc_feature (1)..( 11): Result.003 file - promoters60/1975887
taaaatttggt

SEQ ID NO: 123629 - DNA, 8 bp, Unknown
  misc_feature (1)..( 8): Result.003 file - promoters60/1975887
tatcaaaa

SEQ ID NO: 123630 - DNA, 8 bp, Unknown
  misc_feature (1)..( 8): Result.003 file - promoters60/1975887
tatgaaaa

SEQ ID NO: 123631 - DNA, 8 bp, Unknown
  misc_feature (1)..( 8): Result.003 file - promoters60/1975887
aatgaaac

SEQ ID NO: 123632 - DNA, 7 bp, Unknown
  misc_feature (1)..( 7): Result.003 file - promoters60/1975887
gtatcaa

SEQ ID NO: 123633 - DNA, 7 bp, Unknown
  misc_feature (1)..( 7): Result.003 file - promoters60/1975887
gtatcac

SEQ ID NO: 123634 - DNA, 7 bp, Unknown
  misc_feature (1)..( 7): Result.003 file - promoters60/1975887
gtatcaa

SEQ ID NO: 123635 - DNA, 9 bp, Unknown
  misc_feature (1)..( 9): Result.003 file - promoters60/1975887
agaaagaaa

SEQ ID NO: 123636 - DNA, 9 bp, Unknown
  misc_feature (1)..( 9): Result.003 file - promoters60/1975887
agacagaag

SEQ ID NO: 123637 - DNA, 9 bp, Unknown
  misc_feature (1)..( 9): Result.003 file - promoters60/1975887
gcccagaag

SEQ ID NO: 123638 - DNA, 10 bp, Unknown
  misc_feature (1)..( 10): Result.003 file - promoters60/1975887
aaaggtcatt

SEQ ID NO: 123639 - DNA, 10 bp, Unknown
  misc_feature (1)..( 10): Result.003 file - promoters60/1975887
aaaggtttct

SEQ ID NO: 123640 - DNA, 10 bp, Unknown
  misc_feature (1)..( 10): Result.003 file - promoters60/1975887
aaagatttct

SEQ ID NO: 123641 - DNA, 6 bp, Unknown
  misc_feature (1)..( 6): Result.003 file - promoters60/1975895
atataa

SEQ ID NO: 123642 - DNA, 6 bp, Unknown
  misc_feature (1)..( 6): Result.003 file - promoters60/1975895
atataa

SEQ ID NO: 123643 - DNA, 6 bp, Unknown
  misc_feature (1)..( 6): Result.003 file - promoters60/1975895
catgat

SEQ ID NO: 123644 - DNA, 6 bp, Unknown
  misc_feature (1)..( 6): Result.003 file - promoters60/1975895
catgat

SEQ ID NO: 123645 - DNA, 6 bp, Unknown
  misc_feature (1)..( 6): Result.003 file - promoters60/1975895
actata

SEQ ID NO: 123646 - DNA, 6 bp, Unknown
  misc_feature (1)..( 6): Result.003 file - promoters60/1975895
actata

SEQ ID NO: 123647 - DNA, 7 bp, Unknown
  misc_feature (1)..( 7): Result.003 file - promoters60/1975895
attcacg

SEQ ID NO: 123648 - DNA, 7 bp, Unknown
  misc_feature (1)..( 7): Result.003 file - promoters60/1975895
attcacg

SEQ ID NO: 123649 - DNA, 9 bp, Unknown
  misc_feature (1)..( 9): Result.003 file - promoters60/1975895
aaaattaaa

SEQ ID NO: 123650 - DNA, 9 bp, Unknown
  misc_feature (1)..( 9): Result.003 file - promoters60/1975895
aaaaataaa

SEQ ID NO: 123651 - DNA, 6 bp, Unknown
  misc_feature (1)..( 6): Result.003 file - promoters60/1975895
acgaat

SEQ ID NO: 123652 - DNA, 6 bp, Unknown
  misc_feature (1)..( 6): Result.003 file - promoters60/1975895
acgaat

SEQ ID NO: 123653 - DNA, 8 bp, Unknown
  misc_feature (1)..( 8): Result.003 file - promoters60/1975895
atgtacaa

SEQ ID NO: 123654 - DNA, 8 bp, Unknown
  misc_feature (1)..( 8): Result.003 file - promoters60/1975895
atgtgcaa

SEQ ID NO: 123655 - DNA, 7 bp, Unknown
  misc_feature (1)..( 7): Result.003 file - promoters60/1975895
acaagaa

SEQ ID NO: 123656 - DNA, 7 bp, Unknown
  misc_feature (1)..( 7): Result.003 file - promoters60/1975895
acaagaa

SEQ ID NO: 123657 - DNA, 6 bp, Unknown
  misc_feature (1)..( 6): Result.003 file - promoters60/1975895
taattt

SEQ ID NO: 123658 - DNA, 6 bp, Unknown
  misc_feature (1)..( 6): Result.003 file - promoters60/1975895
taattt

SEQ ID NO: 123659 - DNA, 10 bp, Unknown
  misc_feature (1)..( 10): Result.003 file - promoters60/1975895
ataaaagctt

SEQ ID NO: 123660 - DNA, 10 bp, Unknown
  misc_feature (1)..( 10): Result.003 file - promoters60/1975895
ataaaggctt

SEQ ID NO: 123661 - DNA, 8 bp, Unknown
  misc_feature (1)..( 8): Result.003 file - promoters60/1975895
catcgtct

SEQ ID NO: 123662 - DNA, 8 bp, Unknown
  misc_feature (1)..( 8): Result.003 file - promoters60/1975895
catcttct

SEQ ID NO: 123663 - DNA, 6 bp, Unknown
  misc_feature (1)..( 6): Result.003 file - promoters60/1975895
tctaac

SEQ ID NO: 123664 - DNA, 6 bp, Unknown
  misc_feature (1)..( 6): Result.003 file - promoters60/1975895
tctaac

SEQ ID NO: 123665 - DNA, 9 bp, Unknown
  misc_feature (1)..( 9): Result.003 file - promoters60/1975895
ttttccgct

SEQ ID NO: 123666 - DNA, 9 bp, Unknown
  misc_feature (1)..( 9): Result.003 file - promoters60/1975895
ttttcagct

SEQ ID NO: 123667 - DNA, 15 bp, Unknown
  misc_feature (1)..( 15): Result.003 file - promoters60/1975923
acacaaaaatacatt

SEQ ID NO: 123668 - DNA, 15 bp, Unknown
  misc_feature (1)..( 15): Result.003 file - promoters60/1975923
aaccaataatggccc

SEQ ID NO: 123669 - DNA, 15 bp, Unknown
  misc_feature (1)..( 15): Result.003 file - promoters60/1975923
acacacaaagtccct

SEQ ID NO: 123670 - DNA, 15 bp, Unknown
  misc_feature (1)..( 15): Result.003 file - promoters60/1975923
atacaaaaaaggcgg

SEQ ID NO: 123671 - DNA, 15 bp, Unknown
  misc_feature (1)..( 15): Result.003 file - promoters60/1975923
ggtaaaagatacaac

SEQ ID NO: 123672 - DNA, 15 bp, Unknown
  misc_feature (1)..( 15): Result.003 file - promoters60/1975923
ttaaaataattctta

SEQ ID NO: 123673 - DNA, 15 bp, Unknown
  misc_feature (1)..( 15): Result.003 file - promoters60/1975923
agcacgagatgcaaa

SEQ ID NO: 123674 - DNA, 11 bp, Unknown
  misc_feature (1)..( 11): Result.003 file - promoters60/1975923
tatttaaacgt

SEQ ID NO: 123675 - DNA, 11 bp, Unknown
  misc_feature (1)..( 11): Result.003 file - promoters60/1975923
tatttaaaaat

SEQ ID NO: 123676 - DNA, 11 bp, Unknown
  misc_feature (1)..( 11): Result.003 file - promoters60/1975923
gattaaaacta

SEQ ID NO: 123677 - DNA, 11 bp, Unknown
  misc_feature (1)..( 11): Result.003 file - promoters60/1975923
ggtttaaaaag

SEQ ID NO: 123678 - DNA, 12 bp, Unknown
  misc_feature (1)..( 12): Result.003 file - promoters60/1975923
aatttataaatg

SEQ ID NO: 123679 - DNA, 12 bp, Unknown
  misc_feature (1)..( 12): Result.003 file - promoters60/1975923
aggataaaatta

SEQ ID NO: 123680 - DNA, 12 bp, Unknown
  misc_feature (1)..( 12): Result.003 file - promoters60/1975923
cttttttaatga

SEQ ID NO: 123681 - DNA, 10 bp, Unknown
  misc_feature (1)..( 10): Result.003 file - promoters60/1975923
ttaataaaat

SEQ ID NO: 123682 - DNA, 10 bp, Unknown
  misc_feature (1)..( 10): Result.003 file - promoters60/1975923
tttataaaaa

SEQ ID NO: 123683 - DNA, 10 bp, Unknown
  misc_feature (1)..( 10): Result.003 file - promoters60/1975923
ttaataaaaa

SEQ ID NO: 123684 - DNA, 10 bp, Unknown
  misc_feature (1)..( 10): Result.003 file - promoters60/1975923
ttaatacaat

SEQ ID NO: 123685 - DNA, 10 bp, Unknown
  misc_feature (1)..( 10): Result.003 file - promoters60/1975923
aaaataaatt

SEQ ID NO: 123686 - DNA, 10 bp, Unknown
  misc_feature (1)..( 10): Result.003 file - promoters60/1975923
tcaatacaag

SEQ ID NO: 123687 - DNA, 11 bp, Unknown
  misc_feature (1)..( 11): Result.003 file - promoters60/1975923
ttaattcaatt

SEQ ID NO: 123688 - DNA, 11 bp, Unknown
  misc_feature (1)..( 11): Result.003 file - promoters60/1975923
caaatttaatt

SEQ ID NO: 123689 - DNA, 11 bp, Unknown
  misc_feature (1)..( 11): Result.003 file - promoters60/1975923
aaaattatttt

SEQ ID NO: 123690 - DNA, 11 bp, Unknown
  misc_feature (1)..( 11): Result.003 file - promoters60/1975923
ccaatataaag

SEQ ID NO: 123691 - DNA, 11 bp, Unknown
  misc_feature (1)..( 11): Result.003 file - promoters60/1975923
gaaattaaagg

SEQ ID NO: 123692 - DNA, 11 bp, Unknown
  misc_feature (1)..( 11): Result.003 file - promoters60/1975923
taaactaattt

SEQ ID NO: 123693 - DNA, 10 bp, Unknown
  misc_feature (1)..( 10): Result.003 file - promoters60/1975923
aaagttatag

SEQ ID NO: 123694 - DNA, 10 bp, Unknown
  misc_feature (1)..( 10): Result.003 file - promoters60/1975923
aaatttataa

SEQ ID NO: 123695 - DNA, 10 bp, Unknown
  misc_feature (1)..( 10): Result.003 file - promoters60/1975923
aaaattagtg

SEQ ID NO: 123696 - DNA, 10 bp, Unknown
  misc_feature (1)..( 10): Result.003 file - promoters60/1975923
taatttaaaa

SEQ ID NO: 123697 - DNA, 10 bp, Unknown
  misc_feature (1)..( 10): Result.003 file - promoters60/1975923
acttttttaa

SEQ ID NO: 123698 - DNA, 10 bp, Unknown
  misc_feature (1)..( 10): Result.003 file - promoters60/1975923
gagtttcaat

SEQ ID NO: 123699 - DNA, 18 bp, Unknown
  misc_feature (1)..( 18): Result.003 file - promoters60/1975940
taataacatcaataaact

SEQ ID NO: 123700 - DNA, 18 bp, Unknown
  misc_feature (1)..( 18): Result.003 file - promoters60/1975940
ctaaaacaccaaaaccaa

SEQ ID NO: 123701 - DNA, 18 bp, Unknown
  misc_feature (1)..( 18): Result.003 file - promoters60/1975940
taaaaacattaataagta

SEQ ID NO: 123702 - DNA, 18 bp, Unknown
  misc_feature (1)..( 18): Result.003 file - promoters60/1975940
aaaataaaccaaagtaaa

SEQ ID NO: 123703 - DNA, 18 bp, Unknown
  misc_feature (1)..( 18): Result.003 file - promoters60/1975940
gatccgaaccaaattgat

SEQ ID NO: 123704 - DNA, 19 bp, Unknown
  misc_feature (1)..( 19): Result.003 file - promoters60/1975940
ataacaaatacaaacttta

SEQ ID NO: 123705 - DNA, 14 bp, Unknown
  misc_feature (1)..( 14): Result.003 file - promoters60/1975940
agattttttatttt

SEQ ID NO: 123706 - DNA, 14 bp, Unknown
  misc_feature (1)..( 14): Result.003 file - promoters60/1975940
agaatttttgtaga

SEQ ID NO: 123707 - DNA, 14 bp, Unknown
  misc_feature (1)..( 14): Result.003 file - promoters60/1975940
tgattttgactatg

SEQ ID NO: 123708 - DNA, 14 bp, Unknown
  misc_feature (1)..( 14): Result.003 file - promoters60/1975940
aaattttttaattt

SEQ ID NO: 123709 - DNA, 14 bp, Unknown
  misc_feature (1)..( 14): Result.003 file - promoters60/1975940
agaattagttaatg

SEQ ID NO: 123710 - DNA, 14 bp, Unknown
  misc_feature (1)..( 14): Result.003 file - promoters60/1975940
atattttgcataga

SEQ ID NO: 123711 - DNA, 10 bp, Unknown
  misc_feature (1)..( 10): Result.003 file - promoters60/1975940
aattttattt

SEQ ID NO: 123712 - DNA, 10 bp, Unknown
  misc_feature (1)..( 10): Result.003 file - promoters60/1975940
ctttttattt

SEQ ID NO: 123713 - DNA, 10 bp, Unknown
  misc_feature (1)..( 10): Result.003 file - promoters60/1975940
catttgattg

SEQ ID NO: 123714 - DNA, 10 bp, Unknown
  misc_feature (1)..( 10): Result.003 file - promoters60/1975940
agaattattt

SEQ ID NO: 123715 - DNA, 10 bp, Unknown
  misc_feature (1)..( 10): Result.003 file - promoters60/1975940
aatcttaata

SEQ ID NO: 123716 - DNA, 10 bp, Unknown
  misc_feature (1)..( 10): Result.003 file - promoters60/1975940
tggttggttg

SEQ ID NO: 123717 - DNA, 12 bp, Unknown
  misc_feature (1)..( 12): Result.003 file - promoters60/1975956
tagatttattaa

SEQ ID NO: 123718 - DNA, 12 bp, Unknown
  misc_feature (1)..( 12): Result.003 file - promoters60/1975956
tagaattactaa

SEQ ID NO: 123719 - DNA, 7 bp, Unknown
  misc_feature (1)..( 7): Result.003 file - promoters60/1975956
taataat

SEQ ID NO: 123720 - DNA, 7 bp, Unknown
  misc_feature (1)..( 7): Result.003 file - promoters60/1975956
taataat

SEQ ID NO: 123721 - DNA, 6 bp, Unknown
  misc_feature (1)..( 6): Result.003 file - promoters60/1975956
aatttt

SEQ ID NO: 123722 - DNA, 6 bp, Unknown
  misc_feature (1)..( 6): Result.003 file - promoters60/1975956
aatttt

SEQ ID NO: 123723 - DNA, 14 bp, Unknown
  misc_feature (1)..( 14): Result.003 file - promoters60/1975956
ttgaatcaatattt

SEQ ID NO: 123724 - DNA, 14 bp, Unknown
  misc_feature (1)..( 14): Result.003 file - promoters60/1975956
atatatatatattt

SEQ ID NO: 123725 - DNA, 14 bp, Unknown
  misc_feature (1)..( 14): Result.003 file - promoters60/1975956
ttgattcaaaattc

SEQ ID NO: 123726 - DNA, 7 bp, Unknown
  misc_feature (1)..( 7): Result.003 file - promoters60/1975956
tatccaa

SEQ ID NO: 123727 - DNA, 7 bp, Unknown
  misc_feature (1)..( 7): Result.003 file - promoters60/1975956
tatacaa

SEQ ID NO: 123728 - DNA, 11 bp, Unknown
  misc_feature (1)..( 11): Result.003 file - promoters60/1975956
ttttctacaat

SEQ ID NO: 123729 - DNA, 11 bp, Unknown
  misc_feature (1)..( 11): Result.003 file - promoters60/1975956
ttttctaaaat

SEQ ID NO: 123730 - DNA, 7 bp, Unknown
  misc_feature (1)..( 7): Result.003 file - promoters60/1975956
tataatt

SEQ ID NO: 123731 - DNA, 7 bp, Unknown
  misc_feature (1)..( 7): Result.003 file - promoters60/1975956
tatgatt

SEQ ID NO: 123732 - DNA, 8 bp, Unknown
  misc_feature (1)..( 8): Result.003 file - promoters60/1975956
ctaaaaaa

SEQ ID NO: 123733 - DNA, 8 bp, Unknown
  misc_feature (1)..( 8): Result.003 file - promoters60/1975956
tgaaaaaa

SEQ ID NO: 123734 - DNA, 8 bp, Unknown
  misc_feature (1)..( 8): Result.003 file - promoters60/1975956
tgagaaag

SEQ ID NO: 123735 - DNA, 9 bp, Unknown
  misc_feature (1)..( 9): Result.003 file - promoters60/1975956
taaatttct

SEQ ID NO: 123736 - DNA, 9 bp, Unknown
  misc_feature (1)..( 9): Result.003 file - promoters60/1975956
taactttca

SEQ ID NO: 123737 - DNA, 9 bp, Unknown
  misc_feature (1)..( 9): Result.003 file - promoters60/1975956
ggtatttct

SEQ ID NO: 123738 - DNA, 7 bp, Unknown
  misc_feature (1)..( 7): Result.003 file - promoters60/1975956
aagagaa

SEQ ID NO: 123739 - DNA, 7 bp, Unknown
  misc_feature (1)..( 7): Result.003 file - promoters60/1975956
aagtgaa

SEQ ID NO: 123740 - DNA, 8 bp, Unknown
  misc_feature (1)..( 8): Result.003 file - promoters60/1975956
atggcttg

SEQ ID NO: 123741 - DNA, 8 bp, Unknown
  misc_feature (1)..( 8): Result.003 file - promoters60/1975956
atgggttg

SEQ ID NO: 123742 - DNA, 7 bp, Unknown
  misc_feature (1)..( 7): Result.003 file - promoters60/1975956
tggattt

SEQ ID NO: 123743 - DNA, 7 bp, Unknown
  misc_feature (1)..( 7): Result.003 file - promoters60/1975956
tggattt

SEQ ID NO: 123744 - DNA, 6 bp, Unknown
  misc_feature (1)..( 6): Result.003 file - promoters60/1975956
aagatt

SEQ ID NO: 123745 - DNA, 6 bp, Unknown
  misc_feature (1)..( 6): Result.003 file - promoters60/1975956
aagatt

SEQ ID NO: 123746 - DNA, 6 bp, Unknown
  misc_feature (1)..( 6): Result.003 file - promoters60/1975956
ttggtt

SEQ ID NO: 123747 - DNA, 6 bp, Unknown
  misc_feature (1)..( 6): Result.003 file - promoters60/1975956
ttggtt

SEQ ID NO: 123748 - DNA, 6 bp, Unknown
  misc_feature (1)..( 6): Result.003 file - promoters60/1975956
ttaacc

SEQ ID NO: 123749 - DNA, 6 bp, Unknown
  misc_feature (1)..( 6): Result.003 file - promoters60/1975956
ttaacc

SEQ ID NO: 123750 - DNA, 7 bp, Unknown
  misc_feature (1)..( 7): Result.003 file - promoters60/1975956
ctcactc

SEQ ID NO: 123751 - DNA, 7 bp, Unknown
  misc_feature (1)..( 7): Result.003 file - promoters60/1975956
ctcgctc

SEQ ID NO: 123752 - DNA, 6 bp, Unknown
  misc_feature (1)..( 6): Result.003 file - promoters60/1975956
ataatt

SEQ ID NO: 123753 - DNA, 6 bp, Unknown
  misc_feature (1)..( 6): Result.003 file - promoters60/1975956
ataatt

SEQ ID NO: 123754 - DNA, 8 bp, Unknown
  misc_feature (1)..( 8): Result.003 file - promoters60/1975956
gaaatata

SEQ ID NO: 123755 - DNA, 8 bp, Unknown
  misc_feature (1)..( 8): Result.003 file - promoters60/1975956
gaactata

SEQ ID NO: 123756 - DNA, 6 bp, Unknown
  misc_feature (1)..( 6): Result.003 file - promoters60/1975956
ttatcc

SEQ ID NO: 123757 - DNA, 6 bp, Unknown
  misc_feature (1)..( 6): Result.003 file - promoters60/1975956
ttatcc

SEQ ID NO: 123758 - DNA, 6 bp, Unknown
  misc_feature (1)..( 6): Result.003 file - promoters60/1975956
atttaa

SEQ ID NO: 123759 - DNA, 6 bp, Unknown
  misc_feature (1)..( 6): Result.003 file - promoters60/1975956
atttaa

SEQ ID NO: 123760 - DNA, 9 bp, Unknown
  misc_feature (1)..( 9): Result.003 file - promoters60/1976000
aaaacacga

SEQ ID NO: 123761 - DNA, 9 bp, Unknown
  misc_feature (1)..( 9): Result.003 file - promoters60/1976000
aaaacaatt

SEQ ID NO: 123762 - DNA, 9 bp, Unknown
  misc_feature (1)..( 9): Result.003 file - promoters60/1976000
caaacgatt

SEQ ID NO: 123763 - DNA, 7 bp, Unknown
  misc_feature (1)..( 7): Result.003 file - promoters60/1976000
aaacata

SEQ ID NO: 123764 - DNA, 7 bp, Unknown
  misc_feature (1)..( 7): Result.003 file - promoters60/1976000
aaaaata

SEQ ID NO: 123765 - DNA, 6 bp, Unknown
  misc_feature (1)..( 6): Result.003 file - promoters60/1976000
tgacaa

SEQ ID NO: 123766 - DNA, 6 bp, Unknown
  misc_feature (1)..( 6): Result.003 file - promoters60/1976000
tgacaa

SEQ ID NO: 123767 - DNA, 7 bp, Unknown
  misc_feature (1)..( 7): Result.003 file - promoters60/1976000
attacaa

SEQ ID NO: 123768 - DNA, 7 bp, Unknown
  misc_feature (1)..( 7): Result.003 file - promoters60/1976000
attgcaa

SEQ ID NO: 123769 - DNA, 6 bp, Unknown
  misc_feature (1)..( 6): Result.003 file - promoters60/1976000
taatta

SEQ ID NO: 123770 - DNA, 6 bp, Unknown
  misc_feature (1)..( 6): Result.003 file - promoters60/1976000
taatta

SEQ ID NO: 123771 - DNA, 7 bp, Unknown
  misc_feature (1)..( 7): Result.003 file - promoters60/1976000
tcttctg

SEQ ID NO: 123772 - DNA, 7 bp, Unknown
  misc_feature (1)..( 7): Result.003 file - promoters60/1976000
tctactg

SEQ ID NO: 123773 - DNA, 6 bp, Unknown
  misc_feature (1)..( 6): Result.003 file - promoters60/1976000
aaattg

SEQ ID NO: 123774 - DNA, 6 bp, Unknown
  misc_feature (1)..( 6): Result.003 file - promoters60/1976000
aaattg

SEQ ID NO: 123775 - DNA, 6 bp, Unknown
  misc_feature (1)..( 6): Result.003 file - promoters60/1976000
ccctat

SEQ ID NO: 123776 - DNA, 6 bp, Unknown
  misc_feature (1)..( 6): Result.003 file - promoters60/1976000
ccctat

SEQ ID NO: 123777 - DNA, 7 bp, Unknown
  misc_feature (1)..( 7): Result.003 file - promoters60/1976000
ctaaaat

SEQ ID NO: 123778 - DNA, 7 bp, Unknown
  misc_feature (1)..( 7): Result.003 file - promoters60/1976000
ctacaat

SEQ ID NO: 123779 - DNA, 7 bp, Unknown
  misc_feature (1)..( 7): Result.003 file - promoters60/1976000
ttttgtt

SEQ ID NO: 123780 - DNA, 7 bp, Unknown
  misc_feature (1)..( 7): Result.003 file - promoters60/1976000
ttttgtt

SEQ ID NO: 123781 - DNA, 7 bp, Unknown
  misc_feature (1)..( 7): Result.003 file - promoters60/1976000
ttagtaa

SEQ ID NO: 123782 - DNA, 7 bp, Unknown
  misc_feature (1)..( 7): Result.003 file - promoters60/1976000
ttattaa

SEQ ID NO: 123783 - DNA, 7 bp, Unknown
  misc_feature (1)..( 7): Result.003 file - promoters60/1976000
tcttttc

SEQ ID NO: 123784 - DNA, 7 bp, Unknown
  misc_feature (1)..( 7): Result.003 file - promoters60/1976000
tctgttc

SEQ ID NO: 123785 - DNA, 6 bp, Unknown
  misc_feature (1)..( 6): Result.003 file - promoters60/1976000
aataat

SEQ ID NO: 123786 - DNA, 6 bp, Unknown
  misc_feature (1)..( 6): Result.003 file - promoters60/1976000
aataat

SEQ ID NO: 123787 - DNA, 7 bp, Unknown
  misc_feature (1)..( 7): Result.003 file - promoters60/1976008
gaaaaaa

SEQ ID NO: 123788 - DNA, 7 bp, Unknown
  misc_feature (1)..( 7): Result.003 file - promoters60/1976008
caaaaaa

SEQ ID NO: 123789 - DNA, 7 bp, Unknown
  misc_feature (1)..( 7): Result.003 file - promoters60/1976008
caaaaac

SEQ ID NO: 123790 - DNA, 8 bp, Unknown
  misc_feature (1)..( 8): Result.003 file - promoters60/1976008
cggagaaa

SEQ ID NO: 123791 - DNA, 8 bp, Unknown
  misc_feature (1)..( 8): Result.003 file - promoters60/1976008
cggagaat

SEQ ID NO: 123792 - DNA, 8 bp, Unknown
  misc_feature (1)..( 8): Result.003 file - promoters60/1976008
ttgagaat

SEQ ID NO: 123793 - DNA, 8 bp, Unknown
  misc_feature (1)..( 8): Result.003 file - promoters60/1976008
gatcagat

SEQ ID NO: 123794 - DNA, 8 bp, Unknown
  misc_feature (1)..( 8): Result.003 file - promoters60/1976008
aatcagaa

SEQ ID NO: 123795 - DNA, 8 bp, Unknown
  misc_feature (1)..( 8): Result.003 file - promoters60/1976008
aatccgaa

SEQ ID NO: 123796 - DNA, 11 bp, Unknown
  misc_feature (1)..( 11): Result.003 file - promoters60/1976008
ttctgatgtga

SEQ ID NO: 123797 - DNA, 11 bp, Unknown
  misc_feature (1)..( 11): Result.003 file - promoters60/1976008
ttcagatctca

SEQ ID NO: 123798 - DNA, 11 bp, Unknown
  misc_feature (1)..( 11): Result.003 file - promoters60/1976008
cacagagctca

SEQ ID NO: 123799 - DNA, 7 bp, Unknown
  misc_feature (1)..( 7): Result.003 file - promoters60/1976008
aaaaaac

SEQ ID NO: 123800 - DNA, 7 bp, Unknown
  misc_feature (1)..( 7): Result.003 file - promoters60/1976008
caaaaac

SEQ ID NO: 123801 - DNA, 7 bp, Unknown
  misc_feature (1)..( 7): Result.003 file - promoters60/1976008
caaaaaa

SEQ ID NO: 123802 - DNA, 9 bp, Unknown
  misc_feature (1)..( 9): Result.003 file - promoters60/1976008
ctatccaat

SEQ ID NO: 123803 - DNA, 9 bp, Unknown
  misc_feature (1)..( 9): Result.003 file - promoters60/1976008
atatcaaat

SEQ ID NO: 123804 - DNA, 9 bp, Unknown
  misc_feature (1)..( 9): Result.003 file - promoters60/1976008
atatcactc

SEQ ID NO: 123805 - DNA, 10 bp, Unknown
  misc_feature (1)..( 10): Result.003 file - promoters60/1976008
tggaaaaaaa

SEQ ID NO: 123806 - DNA, 10 bp, Unknown
  misc_feature (1)..( 10): Result.003 file - promoters60/1976008
tggaaaattt

SEQ ID NO: 123807 - DNA, 10 bp, Unknown
  misc_feature (1)..( 10): Result.003 file - promoters60/1976008
ctgaacattt

SEQ ID NO: 123808 - DNA, 13 bp, Unknown
  misc_feature (1)..( 13): Result.003 file - promoters60/1976019
gttataaaagtgg

SEQ ID NO: 123809 - DNA, 13 bp, Unknown
  misc_feature (1)..( 13): Result.003 file - promoters60/1976019
acgaaaaaagttt

SEQ ID NO: 123810 - DNA, 13 bp, Unknown
  misc_feature (1)..( 13): Result.003 file - promoters60/1976019
cactaaaaaggtt

SEQ ID NO: 123811 - DNA, 13 bp, Unknown
  misc_feature (1)..( 13): Result.003 file - promoters60/1976019
aaaaaaaaagtca

SEQ ID NO: 123812 - DNA, 13 bp, Unknown
  misc_feature (1)..( 13): Result.003 file - promoters60/1976019
ctactaaaatcaa

SEQ ID NO: 123813 - DNA, 13 bp, Unknown
  misc_feature (1)..( 13): Result.003 file - promoters60/1976019
tgctaaaaatcct

SEQ ID NO: 123814 - DNA, 12 bp, Unknown
  misc_feature (1)..( 12): Result.003 file - promoters60/1976019
tatataaaaaag

SEQ ID NO: 123815 - DNA, 12 bp, Unknown
  misc_feature (1)..( 12): Result.003 file - promoters60/1976019
aggataaaatta

SEQ ID NO: 123816 - DNA, 13 bp, Unknown
  misc_feature (1)..( 13): Result.003 file - promoters60/1976019
acaataacaaaca

SEQ ID NO: 123817 - DNA, 13 bp, Unknown
  misc_feature (1)..( 13): Result.003 file - promoters60/1976019
attatcaaaattg

SEQ ID NO: 123818 - DNA, 13 bp, Unknown
  misc_feature (1)..( 13): Result.003 file - promoters60/1976019
agaataaaaacag

SEQ ID NO: 123819 - DNA, 13 bp, Unknown
  misc_feature (1)..( 13): Result.003 file - promoters60/1976019
agaataaatccgt

SEQ ID NO: 123820 - DNA, 13 bp, Unknown
  misc_feature (1)..( 13): Result.003 file - promoters60/1976019
agccgaacacaca

SEQ ID NO: 123821 - DNA, 9 bp, Unknown
  misc_feature (1)..( 9): Result.003 file - promoters60/1976019
gattctgaa

SEQ ID NO: 123822 - DNA, 9 bp, Unknown
  misc_feature (1)..( 9): Result.003 file - promoters60/1976019
acttcagaa

SEQ ID NO: 123823 - DNA, 9 bp, Unknown
  misc_feature (1)..( 9): Result.003 file - promoters60/1976019
gattctgca

SEQ ID NO: 123824 - DNA, 9 bp, Unknown
  misc_feature (1)..( 9): Result.003 file - promoters60/1976019
aagtcagaa

SEQ ID NO: 123825 - DNA, 9 bp, Unknown
  misc_feature (1)..( 9): Result.003 file - promoters60/1976019
ccttgagat

SEQ ID NO: 123826 - DNA, 10 bp, Unknown
  misc_feature (1)..( 10): Result.003 file - promoters60/1976019
attccatgat

SEQ ID NO: 123827 - DNA, 10 bp, Unknown
  misc_feature (1)..( 10): Result.003 file - promoters60/1976078
ataaaaaagc

SEQ ID NO: 123828 - DNA, 10 bp, Unknown
  misc_feature (1)..( 10): Result.003 file - promoters60/1976078
ttaaaaagaa

SEQ ID NO: 123829 - DNA, 10 bp, Unknown
  misc_feature (1)..( 10): Result.003 file - promoters60/1976078
ataaaaacag

SEQ ID NO: 123830 - DNA, 10 bp, Unknown
  misc_feature (1)..( 10): Result.003 file - promoters60/1976078
agaaaaacag

SEQ ID NO: 123831 - DNA, 10 bp, Unknown
  misc_feature (1)..( 10): Result.003 file - promoters60/1976078
agaaaaaaat

SEQ ID NO: 123832 - DNA, 10 bp, Unknown
  misc_feature (1)..( 10): Result.003 file - promoters60/1976078
ttaaaaaata

SEQ ID NO: 123833 - DNA, 6 bp, Unknown
  misc_feature (1)..( 6): Result.003 file - promoters60/1976158
aataat

SEQ ID NO: 123834 - DNA, 6 bp, Unknown
  misc_feature (1)..( 6): Result.003 file - promoters60/1976158
aataat

SEQ ID NO: 123835 - DNA, 7 bp, Unknown
  misc_feature (1)..( 7): Result.003 file - promoters60/1976158
tacatat

SEQ ID NO: 123836 - DNA, 7 bp, Unknown
  misc_feature (1)..( 7): Result.003 file - promoters60/1976158
tacttat

SEQ ID NO: 123837 - DNA, 12 bp, Unknown
  misc_feature (1)..( 12): Result.003 file - promoters60/1976158
tacatatctact

SEQ ID NO: 123838 - DNA, 12 bp, Unknown
  misc_feature (1)..( 12): Result.003 file - promoters60/1976158
aatttatttact

SEQ ID NO: 123839 - DNA, 12 bp, Unknown
  misc_feature (1)..( 12): Result.003 file - promoters60/1976158
aattgatttctt

SEQ ID NO: 123840 - DNA, 6 bp, Unknown
  misc_feature (1)..( 6): Result.003 file - promoters60/1976158
atgatt

SEQ ID NO: 123841 - DNA, 6 bp, Unknown
  misc_feature (1)..( 6): Result.003 file - promoters60/1976158
atgatt

SEQ ID NO: 123842 - DNA, 7 bp, Unknown
  misc_feature (1)..( 7): Result.003 file - promoters60/1976158
tgtaatt

SEQ ID NO: 123843 - DNA, 7 bp, Unknown
  misc_feature (1)..( 7): Result.003 file - promoters60/1976158
tgtaatt

SEQ ID NO: 123844 - DNA, 6 bp, Unknown
  misc_feature (1)..( 6): Result.003 file - promoters60/1976158
gagata

SEQ ID NO: 123845 - DNA, 6 bp, Unknown
  misc_feature (1)..( 6): Result.003 file - promoters60/1976158
gagata

SEQ ID NO: 123846 - DNA, 6 bp, Unknown
  misc_feature (1)..( 6): Result.003 file - promoters60/1976158
caacaa

SEQ ID NO: 123847 - DNA, 6 bp, Unknown
  misc_feature (1)..( 6): Result.003 file - promoters60/1976158
caacaa

SEQ ID NO: 123848 - DNA, 10 bp, Unknown
  misc_feature (1)..( 10): Result.003 file - promoters60/1976158
tgactcaaaa

SEQ ID NO: 123849 - DNA, 10 bp, Unknown
  misc_feature (1)..( 10): Result.003 file - promoters60/1976158
ttagtcaaaa

SEQ ID NO: 123850 - DNA, 10 bp, Unknown
  misc_feature (1)..( 10): Result.003 file - promoters60/1976158
ttaatcaaac

SEQ ID NO: 123851 - DNA, 6 bp, Unknown
  misc_feature (1)..( 6): Result.003 file - promoters60/1976158
tcaatt

SEQ ID NO: 123852 - DNA, 6 bp, Unknown
  misc_feature (1)..( 6): Result.003 file - promoters60/1976158
tcaatt

SEQ ID NO: 123853 - DNA, 10 bp, Unknown
  misc_feature (1)..( 10): Result.003 file - promoters60/1976158
aatatacata

SEQ ID NO: 123854 - DNA, 10 bp, Unknown
  misc_feature (1)..( 10): Result.003 file - promoters60/1976158
aatatacttt

SEQ ID NO: 123855 - DNA, 10 bp, Unknown
  misc_feature (1)..( 10): Result.003 file - promoters60/1976158
attataattt

SEQ ID NO: 123856 - DNA, 8 bp, Unknown
  misc_feature (1)..( 8): Result.003 file - promoters60/1976158
tcatgttt

SEQ ID NO: 123857 - DNA, 8 bp, Unknown
  misc_feature (1)..( 8): Result.003 file - promoters60/1976158
tcaagttt

SEQ ID NO: 123858 - DNA, 6 bp, Unknown
  misc_feature (1)..( 6): Result.003 file - promoters60/1976158
tttaca

SEQ ID NO: 123859 - DNA, 6 bp, Unknown
  misc_feature (1)..( 6): Result.003 file - promoters60/1976158
tttaca

SEQ ID NO: 123860 - DNA, 7 bp, Unknown
  misc_feature (1)..( 7): Result.003 file - promoters60/1976158
aacgaca

SEQ ID NO: 123861 - DNA, 7 bp, Unknown
  misc_feature (1)..( 7): Result.003 file - promoters60/1976158
aacaaca

SEQ ID NO: 123862 - DNA, 8 bp, Unknown
  misc_feature (1)..( 8): Result.003 file - promoters60/1976158
caaactat

SEQ ID NO: 123863 - DNA, 8 bp, Unknown
  misc_feature (1)..( 8): Result.003 file - promoters60/1976158
aaaattat

SEQ ID NO: 123864 - DNA, 8 bp, Unknown
  misc_feature (1)..( 8): Result.003 file - promoters60/1976158
aaaattcg

SEQ ID NO: 123865 - DNA, 6 bp, Unknown
  misc_feature (1)..( 6): Result.003 file - promoters60/1976158
ttttgt

SEQ ID NO: 123866 - DNA, 6 bp, Unknown
  misc_feature (1)..( 6): Result.003 file - promoters60/1976158
ttttgt

SEQ ID NO: 123867 - DNA, 7 bp, Unknown
  misc_feature (1)..( 7): Result.003 file - promoters60/1976158
ttataat

SEQ ID NO: 123868 - DNA, 7 bp, Unknown
  misc_feature (1)..( 7): Result.003 file - promoters60/1976158
ttagaat

SEQ ID NO: 123869 - DNA, 7 bp, Unknown
  misc_feature (1)..( 7): Result.003 file - promoters60/1976158
tttttta

SEQ ID NO: 123870 - DNA, 7 bp, Unknown
  misc_feature (1)..( 7): Result.003 file - promoters60/1976158
tttctta

SEQ ID NO: 123871 - DNA, 7 bp, Unknown
  misc_feature (1)..( 7): Result.003 file - promoters60/1976158
taatcaa

SEQ ID NO: 123872 - DNA, 7 bp, Unknown
  misc_feature (1)..( 7): Result.003 file - promoters60/1976158
taatcaa

SEQ ID NO: 123873 - DNA, 8 bp, Unknown
  misc_feature (1)..( 8): Result.003 file - promoters60/1976158
agaaaaaa

SEQ ID NO: 123874 - DNA, 8 bp, Unknown
  misc_feature (1)..( 8): Result.003 file - promoters60/1976158
agaaaaaa

SEQ ID NO: 123875 - DNA, 11 bp, Unknown
  misc_feature (1)..( 11): Result.003 file - promoters60/1976158
caattttctat

SEQ ID NO: 123876 - DNA, 11 bp, Unknown
  misc_feature (1)..( 11): Result.003 file - promoters60/1976158
caattttgtat

SEQ ID NO: 123877 - DNA, 6 bp, Unknown
  misc_feature (1)..( 6): Result.003 file - promoters60/1976158
gaaaca

SEQ ID NO: 123878 - DNA, 6 bp, Unknown
  misc_feature (1)..( 6): Result.003 file - promoters60/1976158
gaaaca

SEQ ID NO: 123879 - DNA, 6 bp, Unknown
  misc_feature (1)..( 6): Result.003 file - promoters60/1976158
aataaa

SEQ ID NO: 123880 - DNA, 6 bp, Unknown
  misc_feature (1)..( 6): Result.003 file - promoters60/1976158
aataaa

SEQ ID NO: 123881 - DNA, 8 bp, Unknown
  misc_feature (1)..( 8): Result.003 file - promoters60/1976158
aaagaaaa

SEQ ID NO: 123882 - DNA, 8 bp, Unknown
  misc_feature (1)..( 8): Result.003 file - promoters60/1976158
aaagaaaa

SEQ ID NO: 123883 - DNA, 7 bp, Unknown
  misc_feature (1)..( 7): Result.003 file - promoters60/1976158
aaaatca

SEQ ID NO: 123884 - DNA, 7 bp, Unknown
  misc_feature (1)..( 7): Result.003 file - promoters60/1976158
aaattca

SEQ ID NO: 123885 - DNA, 6 bp, Unknown
  misc_feature (1)..( 6): Result.003 file - promoters60/1976158
taaata

SEQ ID NO: 123886 - DNA, 6 bp, Unknown
  misc_feature (1)..( 6): Result.003 file - promoters60/1976158
taaata

SEQ ID NO: 123887 - DNA, 10 bp, Unknown
  misc_feature (1)..( 10): Result.003 file - promoters60/1976170
agagatcctt

SEQ ID NO: 123888 - DNA, 10 bp, Unknown
  misc_feature (1)..( 10): Result.003 file - promoters60/1976170
agagatactt

SEQ ID NO: 123889 - DNA, 6 bp, Unknown
  misc_feature (1)..( 6): Result.003 file - promoters60/1976170
tttaac

SEQ ID NO: 123890 - DNA, 6 bp, Unknown
  misc_feature (1)..( 6): Result.003 file - promoters60/1976170
tttaac

SEQ ID NO: 123891 - DNA, 6 bp, Unknown
  misc_feature (1)..( 6): Result.003 file - promoters60/1976170
aatata

SEQ ID NO: 123892 - DNA, 6 bp, Unknown
  misc_feature (1)..( 6): Result.003 file - promoters60/1976170
aatata

SEQ ID NO: 123893 - DNA, 6 bp, Unknown
  misc_feature (1)..( 6): Result.003 file - promoters60/1976170
ggaaaa

SEQ ID NO: 123894 - DNA, 6 bp, Unknown
  misc_feature (1)..( 6): Result.003 file - promoters60/1976170
ggaaaa

SEQ ID NO: 123895 - DNA, 7 bp, Unknown
  misc_feature (1)..( 7): Result.003 file - promoters60/1976170
gacaagg

SEQ ID NO: 123896 - DNA, 7 bp, Unknown
  misc_feature (1)..( 7): Result.003 file - promoters60/1976170
gaccagg

SEQ ID NO: 123897 - DNA, 8 bp, Unknown
  misc_feature (1)..( 8): Result.003 file - promoters60/1976170
tttttctt

SEQ ID NO: 123898 - DNA, 8 bp, Unknown
  misc_feature (1)..( 8): Result.003 file - promoters60/1976170
ttttactt

SEQ ID NO: 123899 - DNA, 9 bp, Unknown
  misc_feature (1)..( 9): Result.003 file - promoters60/1976170
aatatgtaa

SEQ ID NO: 123900 - DNA, 9 bp, Unknown
  misc_feature (1)..( 9): Result.003 file - promoters60/1976170
aatatgtaa

SEQ ID NO: 123901 - DNA, 9 bp, Unknown
  misc_feature (1)..( 9): Result.003 file - promoters60/1976170
aaacaaaaa

SEQ ID NO: 123902 - DNA, 9 bp, Unknown
  misc_feature (1)..( 9): Result.003 file - promoters60/1976170
aaacataaa

SEQ ID NO: 123903 - DNA, 12 bp, Unknown
  misc_feature (1)..( 12): Result.003 file - promoters60/1976174
gggcttaatacc

SEQ ID NO: 123904 - DNA, 12 bp, Unknown
  misc_feature (1)..( 12): Result.003 file - promoters60/1976174
tgatttaataaa

SEQ ID NO: 123905 - DNA, 12 bp, Unknown
  misc_feature (1)..( 12): Result.003 file - promoters60/1976174
atgattaaattg

SEQ ID NO: 123906 - DNA, 12 bp, Unknown
  misc_feature (1)..( 12): Result.003 file - promoters60/1976174
atgatgaaatat

SEQ ID NO: 123907 - DNA, 12 bp, Unknown
  misc_feature (1)..( 12): Result.003 file - promoters60/1976174
caacataaattg

SEQ ID NO: 123908 - DNA, 12 bp, Unknown
  misc_feature (1)..( 12): Result.003 file - promoters60/1976174
aagattaaacaa

SEQ ID NO: 123909 - DNA, 12 bp, Unknown
  misc_feature (1)..( 12): Result.003 file - promoters60/1976174
taaaataaatac

SEQ ID NO: 123910 - DNA, 10 bp, Unknown
  misc_feature (1)..( 10): Result.003 file - promoters60/1976226
gaaaatatat

SEQ ID NO: 123911 - DNA, 10 bp, Unknown
  misc_feature (1)..( 10): Result.003 file - promoters60/1976226
aaaagtatta

SEQ ID NO: 123912 - DNA, 10 bp, Unknown
  misc_feature (1)..( 10): Result.003 file - promoters60/1976226
aaaattatat

SEQ ID NO: 123913 - DNA, 10 bp, Unknown
  misc_feature (1)..( 10): Result.003 file - promoters60/1976226
gaagataaga

SEQ ID NO: 123914 - DNA, 14 bp, Unknown
  misc_feature (1)..( 14): Result.003 file - promoters60/1976333
gaaaggtttttgtt

SEQ ID NO: 123915 - DNA, 14 bp, Unknown
  misc_feature (1)..( 14): Result.003 file - promoters60/1976333
aatcggtgtttcac

SEQ ID NO: 123916 - DNA, 14 bp, Unknown
  misc_feature (1)..( 14): Result.003 file - promoters60/1976333
taaaagtttgatat

SEQ ID NO: 123917 - DNA, 14 bp, Unknown
  misc_feature (1)..( 14): Result.003 file - promoters60/1976333
ataaaatttcacaa

SEQ ID NO: 123918 - DNA, 14 bp, Unknown
  misc_feature (1)..( 14): Result.003 file - promoters60/1976333
taaaagtttgttat

SEQ ID NO: 123919 - DNA, 20 bp, Unknown
  misc_feature (1)..( 20): Result.003 file - promoters60/1976333
gtgatcaagattcaatattt

SEQ ID NO: 123920 - DNA, 20 bp, Unknown
  misc_feature (1)..( 20): Result.003 file - promoters60/1976333
atgatcacaagaactaaact

SEQ ID NO: 123921 - DNA, 20 bp, Unknown
  misc_feature (1)..( 20): Result.003 file - promoters60/1976333
tcgataaagagtcaaaattt

SEQ ID NO: 123922 - DNA, 20 bp, Unknown
  misc_feature (1)..( 20): Result.003 file - promoters60/1976333
aaaaaaaattctagtcttga

SEQ ID NO: 123923 - DNA, 20 bp, Unknown
  misc_feature (1)..( 20): Result.003 file - promoters60/1976333
aaatgaaatttccggagcag

SEQ ID NO: 123924 - DNA, 20 bp, Unknown
  misc_feature (1)..( 20): Result.003 file - promoters60/1976333
agactcaattaaaataaagg

SEQ ID NO: 123925 - DNA, 18 bp, Unknown
  misc_feature (1)..( 18): Result.003 file - promoters60/1976333
gatcaagattcaatattt

SEQ ID NO: 123926 - DNA, 18 bp, Unknown
  misc_feature (1)..( 18): Result.003 file - promoters60/1976333
acgttagactcaattaaa

SEQ ID NO: 123927 - DNA, 18 bp, Unknown
  misc_feature (1)..( 18): Result.003 file - promoters60/1976333
gataaagagtcaaaattt

SEQ ID NO: 123928 - DNA, 18 bp, Unknown
  misc_feature (1)..( 18): Result.003 file - promoters60/1976333
atttaagattatataaat

SEQ ID NO: 123929 - DNA, 18 bp, Unknown
  misc_feature (1)..( 18): Result.003 file - promoters60/1976333
aaaaaaaattctagtctt

SEQ ID NO: 123930 - DNA, 8 bp, Unknown
  misc_feature (1)..( 8): Result.003 file - promoters60/1976333
taaactct

SEQ ID NO: 123931 - DNA, 8 bp, Unknown
  misc_feature (1)..( 8): Result.003 file - promoters60/1976333
aaaattct

SEQ ID NO: 123932 - DNA, 8 bp, Unknown
  misc_feature (1)..( 8): Result.003 file - promoters60/1976333
aaaatttc

SEQ ID NO: 123933 - DNA, 8 bp, Unknown
  misc_feature (1)..( 8): Result.003 file - promoters60/1976333
gaaatttc

SEQ ID NO: 123934 - DNA, 8 bp, Unknown
  misc_feature (1)..( 8): Result.003 file - promoters60/1976333
caaattta

SEQ ID NO: 123935 - DNA, 9 bp, Unknown
  misc_feature (1)..( 9): Result.003 file - promoters60/1976336
ctacgaaaa

SEQ ID NO: 123936 - DNA, 9 bp, Unknown
  misc_feature (1)..( 9): Result.003 file - promoters60/1976336
aaacgaaat

SEQ ID NO: 123937 - DNA, 9 bp, Unknown
  misc_feature (1)..( 9): Result.003 file - promoters60/1976336
ctactaaat

SEQ ID NO: 123938 - DNA, 9 bp, Unknown
  misc_feature (1)..( 9): Result.003 file - promoters60/1976336
atactaaaa

SEQ ID NO: 123939 - DNA, 9 bp, Unknown
  misc_feature (1)..( 9): Result.003 file - promoters60/1976336
tcacgaaat

SEQ ID NO: 123940 - DNA, 9 bp, Unknown
  misc_feature (1)..( 9): Result.003 file - promoters60/1976336
agactaaaa

SEQ ID NO: 123941 - DNA, 10 bp, Unknown
  misc_feature (1)..( 10): Result.003 file - promoters60/1976336
agacttaaaa

SEQ ID NO: 123942 - DNA, 10 bp, Unknown
  misc_feature (1)..( 10): Result.003 file - promoters60/1976336
cacatagtga

SEQ ID NO: 123943 - DNA, 10 bp, Unknown
  misc_feature (1)..( 10): Result.003 file - promoters60/1976336
gacagagtta

SEQ ID NO: 123944 - DNA, 10 bp, Unknown
  misc_feature (1)..( 10): Result.003 file - promoters60/1976336
cacaaagtat

SEQ ID NO: 123945 - DNA, 10 bp, Unknown
  misc_feature (1)..( 10): Result.003 file - promoters60/1976336
aacaaaaact

SEQ ID NO: 123946 - DNA, 10 bp, Unknown
  misc_feature (1)..( 10): Result.003 file - promoters60/1976336
aacaaattgt

SEQ ID NO: 123947 - DNA, 10 bp, Unknown
  misc_feature (1)..( 10): Result.003 file - promoters60/1976336
cacaaagact

SEQ ID NO: 123948 - DNA, 10 bp, Unknown
  misc_feature (1)..( 10): Result.003 file - promoters60/1976336
tccacaaaac

SEQ ID NO: 123949 - DNA, 10 bp, Unknown
  misc_feature (1)..( 10): Result.003 file - promoters60/1976336
tacacaaagt

SEQ ID NO: 123950 - DNA, 10 bp, Unknown
  misc_feature (1)..( 10): Result.003 file - promoters60/1976336
tccataaagc

SEQ ID NO: 123951 - DNA, 10 bp, Unknown
  misc_feature (1)..( 10): Result.003 file - promoters60/1976336
ctcacaaaga

SEQ ID NO: 123952 - DNA, 10 bp, Unknown
  misc_feature (1)..( 10): Result.003 file - promoters60/1976336
gagacagagt

SEQ ID NO: 123953 - DNA, 10 bp, Unknown
  misc_feature (1)..( 10): Result.003 file - promoters60/1976336
taaacaaaaa

SEQ ID NO: 123954 - DNA, 13 bp, Unknown
  misc_feature (1)..( 13): Result.003 file - promoters60/1976354
atagtaaaaaaaa

SEQ ID NO: 123955 - DNA, 13 bp, Unknown
  misc_feature (1)..( 13): Result.003 file - promoters60/1976354
actctaaaaaaaa

SEQ ID NO: 123956 - DNA, 13 bp, Unknown
  misc_feature (1)..( 13): Result.003 file - promoters60/1976354
atagtgaaaattg

SEQ ID NO: 123957 - DNA, 13 bp, Unknown
  misc_feature (1)..( 13): Result.003 file - promoters60/1976354
caattaaataaat

SEQ ID NO: 123958 - DNA, 13 bp, Unknown
  misc_feature (1)..( 13): Result.003 file - promoters60/1976354
agaagaaaaaaat

SEQ ID NO: 123959 - DNA, 13 bp, Unknown
  misc_feature (1)..( 13): Result.003 file - promoters60/1976354
taacagaataaaa

SEQ ID NO: 123960 - DNA, 10 bp, Unknown
  misc_feature (1)..( 10): Result.003 file - promoters60/1976354
gtcacaaaat

SEQ ID NO: 123961 - DNA, 10 bp, Unknown
  misc_feature (1)..( 10): Result.003 file - promoters60/1976354
ttcaaaaaaa

SEQ ID NO: 123962 - DNA, 10 bp, Unknown
  misc_feature (1)..( 10): Result.003 file - promoters60/1976354
ttcataaaat

SEQ ID NO: 123963 - DNA, 10 bp, Unknown
  misc_feature (1)..( 10): Result.003 file - promoters60/1976354
gtcacaagac

SEQ ID NO: 123964 - DNA, 10 bp, Unknown
  misc_feature (1)..( 10): Result.003 file - promoters60/1976354
atgaaaaaat

SEQ ID NO: 123965 - DNA, 10 bp, Unknown
  misc_feature (1)..( 10): Result.003 file - promoters60/1976354
cacataaata

SEQ ID NO: 123966 - DNA, 11 bp, Unknown
  misc_feature (1)..( 11): Result.003 file - promoters60/1976354
tcacaaaattt

SEQ ID NO: 123967 - DNA, 11 bp, Unknown
  misc_feature (1)..( 11): Result.003 file - promoters60/1976354
caaaaaaattg

SEQ ID NO: 123968 - DNA, 11 bp, Unknown
  misc_feature (1)..( 11): Result.003 file - promoters60/1976354
tcataaaatac

SEQ ID NO: 123969 - DNA, 11 bp, Unknown
  misc_feature (1)..( 11): Result.003 file - promoters60/1976354
cttcaaaatta

SEQ ID NO: 123970 - DNA, 11 bp, Unknown
  misc_feature (1)..( 11): Result.003 file - promoters60/1976354
tgaaaaaatag

SEQ ID NO: 123971 - DNA, 11 bp, Unknown
  misc_feature (1)..( 11): Result.003 file - promoters60/1976354
acataaataca

SEQ ID NO: 123972 - DNA, 11 bp, Unknown
  misc_feature (1)..( 11): Result.003 file - promoters60/1976354
aaccaaaatcc

SEQ ID NO: 123973 - DNA, 9 bp, Unknown
  misc_feature (1)..( 9): Result.003 file - promoters60/1976354
ataaaaata

SEQ ID NO: 123974 - DNA, 9 bp, Unknown
  misc_feature (1)..( 9): Result.003 file - promoters60/1976354
ttaataata

SEQ ID NO: 123975 - DNA, 9 bp, Unknown
  misc_feature (1)..( 9): Result.003 file - promoters60/1976354
ctaaaaatc

SEQ ID NO: 123976 - DNA, 9 bp, Unknown
  misc_feature (1)..( 9): Result.003 file - promoters60/1976354
ctaaaagaa

SEQ ID NO: 123977 - DNA, 9 bp, Unknown
  misc_feature (1)..( 9): Result.003 file - promoters60/1976354
aaaattata

SEQ ID NO: 123978 - DNA, 10 bp, Unknown
  misc_feature (1)..( 10): Result.003 file - promoters60/1976354
caaacttatc

SEQ ID NO: 123979 - DNA, 14 bp, Unknown
  misc_feature (1)..( 14): Result.003 file - promoters60/1976354
aagttatagtaaaa

SEQ ID NO: 123980 - DNA, 14 bp, Unknown
  misc_feature (1)..( 14): Result.003 file - promoters60/1976354
aagttttagcaaat

SEQ ID NO: 123981 - DNA, 14 bp, Unknown
  misc_feature (1)..( 14): Result.003 file - promoters60/1976354
gattttttgcatca

SEQ ID NO: 123982 - DNA, 14 bp, Unknown
  misc_feature (1)..( 14): Result.003 file - promoters60/1976354
tcttcgaagcaaat

SEQ ID NO: 123983 - DNA, 14 bp, Unknown
  misc_feature (1)..( 14): Result.003 file - promoters60/1976354
tttgattagtaaaa

SEQ ID NO: 123984 - DNA, 14 bp, Unknown
  misc_feature (1)..( 14): Result.003 file - promoters60/1976354
tgagattactaaca

SEQ ID NO: 123985 - DNA, 9 bp, Unknown
  misc_feature (1)..( 9): Result.003 file - promoters60/1976354
aaaaaaatc

SEQ ID NO: 123986 - DNA, 9 bp, Unknown
  misc_feature (1)..( 9): Result.003 file - promoters60/1976354
tacaaaatc

SEQ ID NO: 123987 - DNA, 9 bp, Unknown
  misc_feature (1)..( 9): Result.003 file - promoters60/1976354
aaaaaaatt

SEQ ID NO: 123988 - DNA, 9 bp, Unknown
  misc_feature (1)..( 9): Result.003 file - promoters60/1976354
gataaaatt

SEQ ID NO: 123989 - DNA, 9 bp, Unknown
  misc_feature (1)..( 9): Result.003 file - promoters60/1976354
gtgaaaatt

SEQ ID NO: 123990 - DNA, 9 bp, Unknown
  misc_feature (1)..( 9): Result.003 file - promoters60/1976354
cacagaatc

SEQ ID NO: 123991 - DNA, 9 bp, Unknown
  misc_feature (1)..( 9): Result.003 file - promoters60/1976354
aacagaata

SEQ ID NO: 123992 - DNA, 13 bp, Unknown
  misc_feature (1)..( 13): Result.003 file - promoters60/1976354
tttggttcctttc

SEQ ID NO: 123993 - DNA, 13 bp, Unknown
  misc_feature (1)..( 13): Result.003 file - promoters60/1976354
gttggttagttta

SEQ ID NO: 123994 - DNA, 13 bp, Unknown
  misc_feature (1)..( 13): Result.003 file - promoters60/1976354
tttgattagtaaa

SEQ ID NO: 123995 - DNA, 13 bp, Unknown
  misc_feature (1)..( 13): Result.003 file - promoters60/1976354
aagttttagcaaa

SEQ ID NO: 123996 - DNA, 13 bp, Unknown
  misc_feature (1)..( 13): Result.003 file - promoters60/1976354
tgagattactaac

SEQ ID NO: 123997 - DNA, 13 bp, Unknown
  misc_feature (1)..( 13): Result.003 file - promoters60/1976354
tttaattctcagc

SEQ ID NO: 123998 - DNA, 14 bp, Unknown
  misc_feature (1)..( 14): Result.003 file - promoters60/1976381
cctcaaaaaagctg

SEQ ID NO: 123999 - DNA, 14 bp, Unknown
  misc_feature (1)..( 14): Result.003 file - promoters60/1976381
tttttaaaaaggga

SEQ ID NO: 124000 - DNA, 14 bp, Unknown
  misc_feature (1)..( 14): Result.003 file - promoters60/1976381
ctcatgaaaagctt

SEQ ID NO: 124001 - DNA, 14 bp, Unknown
  misc_feature (1)..( 14): Result.003 file - promoters60/1976381
atacaaaaaaggcg

SEQ ID NO: 124002 - DNA, 14 bp, Unknown
  misc_feature (1)..( 14): Result.003 file - promoters60/1976381
ttttagaaattaca

SEQ ID NO: 124003 - DNA, 14 bp, Unknown
  misc_feature (1)..( 14): Result.003 file - promoters60/1976381
attgataaaagctt

SEQ ID NO: 124004 - DNA, 11 bp, Unknown
  misc_feature (1)..( 11): Result.003 file - promoters60/1976381
cacataaacat

SEQ ID NO: 124005 - DNA, 11 bp, Unknown
  misc_feature (1)..( 11): Result.003 file - promoters60/1976381
ttcataaatca

SEQ ID NO: 124006 - DNA, 11 bp, Unknown
  misc_feature (1)..( 11): Result.003 file - promoters60/1976381
tgcattaacaa

SEQ ID NO: 124007 - DNA, 11 bp, Unknown
  misc_feature (1)..( 11): Result.003 file - promoters60/1976381
ttcttaaaaga

SEQ ID NO: 124008 - DNA, 11 bp, Unknown
  misc_feature (1)..( 11): Result.003 file - promoters60/1976381
agcttaaagtt

SEQ ID NO: 124009 - DNA, 11 bp, Unknown
  misc_feature (1)..( 11): Result.003 file - promoters60/1976381
ttaattgacaa

SEQ ID NO: 124010 - DNA, 11 bp, Unknown
  misc_feature (1)..( 11): Result.003 file - promoters60/1976381
agcagtaacgg

SEQ ID NO: 124011 - DNA, 7 bp, Unknown
  misc_feature (1)..( 7): Result.003 file - promoters60/1976419
attggtt

SEQ ID NO: 124012 - DNA, 7 bp, Unknown
  misc_feature (1)..( 7): Result.003 file - promoters60/1976419
attagtt

SEQ ID NO: 124013 - DNA, 8 bp, Unknown
  misc_feature (1)..( 8): Result.003 file - promoters60/1976419
tataaaaa

SEQ ID NO: 124014 - DNA, 8 bp, Unknown
  misc_feature (1)..( 8): Result.003 file - promoters60/1976419
tatagaaa

SEQ ID NO: 124015 - DNA, 7 bp, Unknown
  misc_feature (1)..( 7): Result.003 file - promoters60/1976419
agacatt

SEQ ID NO: 124016 - DNA, 7 bp, Unknown
  misc_feature (1)..( 7): Result.003 file - promoters60/1976419
agatatt

SEQ ID NO: 124017 - DNA, 6 bp, Unknown
  misc_feature (1)..( 6): Result.003 file - promoters60/1976419
actttt

SEQ ID NO: 124018 - DNA, 6 bp, Unknown
  misc_feature (1)..( 6): Result.003 file - promoters60/1976419
actttt

SEQ ID NO: 124019 - DNA, 7 bp, Unknown
  misc_feature (1)..( 7): Result.003 file - promoters60/1976419
acacgat

SEQ ID NO: 124020 - DNA, 7 bp, Unknown
  misc_feature (1)..( 7): Result.003 file - promoters60/1976419
acaggat

SEQ ID NO: 124021 - DNA, 6 bp, Unknown
  misc_feature (1)..( 6): Result.003 file - promoters60/1976419
cgaaaa

SEQ ID NO: 124022 - DNA, 6 bp, Unknown
  misc_feature (1)..( 6): Result.003 file - promoters60/1976419
cgaaaa

SEQ ID NO: 124023 - DNA, 9 bp, Unknown
  misc_feature (1)..( 9): Result.003 file - promoters60/1976419
ccaaaagta

SEQ ID NO: 124024 - DNA, 9 bp, Unknown
  misc_feature (1)..( 9): Result.003 file - promoters60/1976419
ccaacagta

SEQ ID NO: 124025 - DNA, 8 bp, Unknown
  misc_feature (1)..( 8): Result.003 file - promoters60/1976419
tcctacct

SEQ ID NO: 124026 - DNA, 8 bp, Unknown
  misc_feature (1)..( 8): Result.003 file - promoters60/1976419
tcctgcct

SEQ ID NO: 124027 - DNA, 8 bp, Unknown
  misc_feature (1)..( 8): Result.003 file - promoters60/1976419
atatttta

SEQ ID NO: 124028 - DNA, 8 bp, Unknown
  misc_feature (1)..( 8): Result.003 file - promoters60/1976419
atatatta

SEQ ID NO: 124029 - DNA, 6 bp, Unknown
  misc_feature (1)..( 6): Result.003 file - promoters60/1976419
tttata

SEQ ID NO: 124030 - DNA, 6 bp, Unknown
  misc_feature (1)..( 6): Result.003 file - promoters60/1976419
tttata

SEQ ID NO: 124031 - DNA, 7 bp, Unknown
  misc_feature (1)..( 7): Result.003 file - promoters60/1976419
aatgcac

SEQ ID NO: 124032 - DNA, 7 bp, Unknown
  misc_feature (1)..( 7): Result.003 file - promoters60/1976419
aatacac

SEQ ID NO: 124033 - DNA, 7 bp, Unknown
  misc_feature (1)..( 7): Result.003 file - promoters60/1976419
tacgtaa

SEQ ID NO: 124034 - DNA, 7 bp, Unknown
  misc_feature (1)..( 7): Result.003 file - promoters60/1976419
tacctaa

SEQ ID NO: 124035 - DNA, 8 bp, Unknown
  misc_feature (1)..( 8): Result.003 file - promoters60/1976419
tgatgtaa

SEQ ID NO: 124036 - DNA, 8 bp, Unknown
  misc_feature (1)..( 8): Result.003 file - promoters60/1976419
tgaagtaa

SEQ ID NO: 124037 - DNA, 8 bp, Unknown
  misc_feature (1)..( 8): Result.003 file - promoters60/1976419
ggttgatt

SEQ ID NO: 124038 - DNA, 8 bp, Unknown
  misc_feature (1)..( 8): Result.003 file - promoters60/1976419
ggttcatt

SEQ ID NO: 124039 - DNA, 6 bp, Unknown
  misc_feature (1)..( 6): Result.003 file - promoters60/1976419
agaata

SEQ ID NO: 124040 - DNA, 6 bp, Unknown
  misc_feature (1)..( 6): Result.003 file - promoters60/1976419
agaata

SEQ ID NO: 124041 - DNA, 6 bp, Unknown
  misc_feature (1)..( 6): Result.003 file - promoters60/1976419
gctatg

SEQ ID NO: 124042 - DNA, 6 bp, Unknown
  misc_feature (1)..( 6): Result.003 file - promoters60/1976419
gctatg

SEQ ID NO: 124043 - DNA, 6 bp, Unknown
  misc_feature (1)..( 6): Result.003 file - promoters60/1976419
tgatcc

SEQ ID NO: 124044 - DNA, 6 bp, Unknown
  misc_feature (1)..( 6): Result.003 file - promoters60/1976419
tgatcc

SEQ ID NO: 124045 - DNA, 10 bp, Unknown
  misc_feature (1)..( 10): Result.003 file - promoters60/1976457
aggataaacc

SEQ ID NO: 124046 - DNA, 10 bp, Unknown
  misc_feature (1)..( 10): Result.003 file - promoters60/1976457
ataataaact

SEQ ID NO: 124047 - DNA, 10 bp, Unknown
  misc_feature (1)..( 10): Result.003 file - promoters60/1976457
atactaaaag

SEQ ID NO: 124048 - DNA, 10 bp, Unknown
  misc_feature (1)..( 10): Result.003 file - promoters60/1976457
taaataaaat

SEQ ID NO: 124049 - DNA, 10 bp, Unknown
  misc_feature (1)..( 10): Result.003 file - promoters60/1976457
tcaaaaaaaa

SEQ ID NO: 124050 - DNA, 10 bp, Unknown
  misc_feature (1)..( 10): Result.003 file - promoters60/1976457
aaacaaaaca

SEQ ID NO: 124051 - DNA, 11 bp, Unknown
  misc_feature (1)..( 11): Result.003 file - promoters60/1976457
taaacttttca

SEQ ID NO: 124052 - DNA, 11 bp, Unknown
  misc_feature (1)..( 11): Result.003 file - promoters60/1976457
aaaagtttttg

SEQ ID NO: 124053 - DNA, 11 bp, Unknown
  misc_feature (1)..( 11): Result.003 file - promoters60/1976457
caaagttgtag

SEQ ID NO: 124054 - DNA, 11 bp, Unknown
  misc_feature (1)..( 11): Result.003 file - promoters60/1976457
caaaattgaag

SEQ ID NO: 124055 - DNA, 11 bp, Unknown
  misc_feature (1)..( 11): Result.003 file - promoters60/1976457
tttagttttgt

SEQ ID NO: 124056 - DNA, 11 bp, Unknown
  misc_feature (1)..( 11): Result.003 file - promoters60/1976457
gaaaatagttt

SEQ ID NO: 124057 - DNA, 12 bp, Unknown
  misc_feature (1)..( 12): Result.003 file - promoters60/1976457
taataaaatatt

SEQ ID NO: 124058 - DNA, 12 bp, Unknown
  misc_feature (1)..( 12): Result.003 file - promoters60/1976457
caaaaaaatatt

SEQ ID NO: 124059 - DNA, 12 bp, Unknown
  misc_feature (1)..( 12): Result.003 file - promoters60/1976457
taaaaaaatata

SEQ ID NO: 124060 - DNA, 12 bp, Unknown
  misc_feature (1)..( 12): Result.003 file - promoters60/1976457
tgatgaaatatt

SEQ ID NO: 124061 - DNA, 12 bp, Unknown
  misc_feature (1)..( 12): Result.003 file - promoters60/1976457
aataaaaatatt

SEQ ID NO: 124062 - DNA, 12 bp, Unknown
  misc_feature (1)..( 12): Result.003 file - promoters60/1976457
aaaaaaaaaagg

SEQ ID NO: 124063 - DNA, 13 bp, Unknown
  misc_feature (1)..( 13): Result.003 file - promoters60/1976457
ggttttgagaaaa

SEQ ID NO: 124064 - DNA, 13 bp, Unknown
  misc_feature (1)..( 13): Result.003 file - promoters60/1976457
cagtttgagaata

SEQ ID NO: 124065 - DNA, 13 bp, Unknown
  misc_feature (1)..( 13): Result.003 file - promoters60/1976457
ctttttgatatga

SEQ ID NO: 124066 - DNA, 13 bp, Unknown
  misc_feature (1)..( 13): Result.003 file - promoters60/1976457
tcatatgaaaaaa

SEQ ID NO: 124067 - DNA, 13 bp, Unknown
  misc_feature (1)..( 13): Result.003 file - promoters60/1976457
taattttatatat

SEQ ID NO: 124068 - DNA, 13 bp, Unknown
  misc_feature (1)..( 13): Result.003 file - promoters60/1976457
taattctataaca

SEQ ID NO: 124069 - DNA, 9 bp, Unknown
  misc_feature (1)..( 9): Result.003 file - promoters60/1976457
ataataaac

SEQ ID NO: 124070 - DNA, 9 bp, Unknown
  misc_feature (1)..( 9): Result.003 file - promoters60/1976457
gtaataata

SEQ ID NO: 124071 - DNA, 9 bp, Unknown
  misc_feature (1)..( 9): Result.003 file - promoters60/1976457
atactaaaa

SEQ ID NO: 124072 - DNA, 9 bp, Unknown
  misc_feature (1)..( 9): Result.003 file - promoters60/1976457
taaataaaa

SEQ ID NO: 124073 - DNA, 9 bp, Unknown
  misc_feature (1)..( 9): Result.003 file - promoters60/1976457
ataataatg

SEQ ID NO: 124074 - DNA, 9 bp, Unknown
  misc_feature (1)..( 9): Result.003 file - promoters60/1976457
aaaacaaaa

SEQ ID NO: 124075 - DNA, 9 bp, Unknown
  misc_feature (1)..( 9): Result.003 file - promoters60/1976457
aaatcgtta

SEQ ID NO: 124076 - DNA, 9 bp, Unknown
  misc_feature (1)..( 9): Result.003 file - promoters60/1976457
gaatcatta

SEQ ID NO: 124077 - DNA, 9 bp, Unknown
  misc_feature (1)..( 9): Result.003 file - promoters60/1976457
aaaccgtat

SEQ ID NO: 124078 - DNA, 9 bp, Unknown
  misc_feature (1)..( 9): Result.003 file - promoters60/1976457
ccatcctta

SEQ ID NO: 124079 - DNA, 9 bp, Unknown
  misc_feature (1)..( 9): Result.003 file - promoters60/1976457
caatcataa

SEQ ID NO: 124080 - DNA, 9 bp, Unknown
  misc_feature (1)..( 9): Result.003 file - promoters60/1976457
aaattattt

SEQ ID NO: 124081 - DNA, 9 bp, Unknown
  misc_feature (1)..( 9): Result.003 file - promoters60/1976504
aaagaacct

SEQ ID NO: 124082 - DNA, 9 bp, Unknown
  misc_feature (1)..( 9): Result.003 file - promoters60/1976504
ctagatcct

SEQ ID NO: 124083 - DNA, 9 bp, Unknown
  misc_feature (1)..( 9): Result.003 file - promoters60/1976504
aaataactg

SEQ ID NO: 124084 - DNA, 9 bp, Unknown
  misc_feature (1)..( 9): Result.003 file - promoters60/1976504
aaagaacga

SEQ ID NO: 124085 - DNA, 9 bp, Unknown
  misc_feature (1)..( 9): Result.003 file - promoters60/1976504
tcataactt

SEQ ID NO: 124086 - DNA, 9 bp, Unknown
  misc_feature (1)..( 9): Result.003 file - promoters60/1976504
aaataacaa

SEQ ID NO: 124087 - DNA, 9 bp, Unknown
  misc_feature (1)..( 9): Result.003 file - promoters60/1976504
aaataaaaa

SEQ ID NO: 124088 - DNA, 9 bp, Unknown
  misc_feature (1)..( 9): Result.003 file - promoters60/1976511
ccttctcta

SEQ ID NO: 124089 - DNA, 9 bp, Unknown
  misc_feature (1)..( 9): Result.003 file - promoters60/1976511
ttttctctt

SEQ ID NO: 124090 - DNA, 9 bp, Unknown
  misc_feature (1)..( 9): Result.003 file - promoters60/1976511
tcttctctt

SEQ ID NO: 124091 - DNA, 9 bp, Unknown
  misc_feature (1)..( 9): Result.003 file - promoters60/1976511
aattctcta

SEQ ID NO: 124092 - DNA, 10 bp, Unknown
  misc_feature (1)..( 10): Result.003 file - promoters60/1976511
tcttcttctg

SEQ ID NO: 124093 - DNA, 11 bp, Unknown
  misc_feature (1)..( 11): Result.003 file - promoters60/1976511
attttgatttg

SEQ ID NO: 124094 - DNA, 11 bp, Unknown
  misc_feature (1)..( 11): Result.003 file - promoters60/1976511
attttgattaa

SEQ ID NO: 124095 - DNA, 11 bp, Unknown
  misc_feature (1)..( 11): Result.003 file - promoters60/1976511
ttactgattaa

SEQ ID NO: 124096 - DNA, 11 bp, Unknown
  misc_feature (1)..( 11): Result.003 file - promoters60/1976511
gttttgactag

SEQ ID NO: 124097 - DNA, 11 bp, Unknown
  misc_feature (1)..( 11): Result.003 file - promoters60/1976511
cctttgaccag

SEQ ID NO: 124098 - DNA, 6 bp, Unknown
  misc_feature (1)..( 6): Result.003 file - promoters60/1976550
tagcct

SEQ ID NO: 124099 - DNA, 6 bp, Unknown
  misc_feature (1)..( 6): Result.003 file - promoters60/1976550
tagcct

SEQ ID NO: 124100 - DNA, 7 bp, Unknown
  misc_feature (1)..( 7): Result.003 file - promoters60/1976550
ttagttg

SEQ ID NO: 124101 - DNA, 7 bp, Unknown
  misc_feature (1)..( 7): Result.003 file - promoters60/1976550
ttatttg

SEQ ID NO: 124102 - DNA, 8 bp, Unknown
  misc_feature (1)..( 8): Result.003 file - promoters60/1976550
aaattaaa

SEQ ID NO: 124103 - DNA, 8 bp, Unknown
  misc_feature (1)..( 8): Result.003 file - promoters60/1976550
aaataaaa

SEQ ID NO: 124104 - DNA, 7 bp, Unknown
  misc_feature (1)..( 7): Result.003 file - promoters60/1976550
tgtaaaa

SEQ ID NO: 124105 - DNA, 7 bp, Unknown
  misc_feature (1)..( 7): Result.003 file - promoters60/1976550
tgtaaaa

SEQ ID NO: 124106 - DNA, 6 bp, Unknown
  misc_feature (1)..( 6): Result.003 file - promoters60/1976550
aaaatt

SEQ ID NO: 124107 - DNA, 6 bp, Unknown
  misc_feature (1)..( 6): Result.003 file - promoters60/1976550
aaaatt

SEQ ID NO: 124108 - DNA, 7 bp, Unknown
  misc_feature (1)..( 7): Result.003 file - promoters60/1976550
tcctaat

SEQ ID NO: 124109 - DNA, 7 bp, Unknown
  misc_feature (1)..( 7): Result.003 file - promoters60/1976550
tcccaat

SEQ ID NO: 124110 - DNA, 7 bp, Unknown
  misc_feature (1)..( 7): Result.003 file - promoters60/1976550
aaattca

SEQ ID NO: 124111 - DNA, 7 bp, Unknown
  misc_feature (1)..( 7): Result.003 file - promoters60/1976550
aaaatca

SEQ ID NO: 124112 - DNA, 8 bp, Unknown
  misc_feature (1)..( 8): Result.003 file - promoters60/1976550
ttgtttaa

SEQ ID NO: 124113 - DNA, 8 bp, Unknown
  misc_feature (1)..( 8): Result.003 file - promoters60/1976550
ttgcttaa

SEQ ID NO: 124114 - DNA, 9 bp, Unknown
  misc_feature (1)..( 9): Result.003 file - promoters60/1976550
ttaaatttt

SEQ ID NO: 124115 - DNA, 9 bp, Unknown
  misc_feature (1)..( 9): Result.003 file - promoters60/1976550
ttaaaattt

SEQ ID NO: 124116 - DNA, 6 bp, Unknown
  misc_feature (1)..( 6): Result.003 file - promoters60/1976550
aaagtc

SEQ ID NO: 124117 - DNA, 6 bp, Unknown
  misc_feature (1)..( 6): Result.003 file - promoters60/1976550
aaagtc

SEQ ID NO: 124118 - DNA, 7 bp, Unknown
  misc_feature (1)..( 7): Result.003 file - promoters60/1976550
gataaaa

SEQ ID NO: 124119 - DNA, 7 bp, Unknown
  misc_feature (1)..( 7): Result.003 file - promoters60/1976550
gatcaaa

SEQ ID NO: 124120 - DNA, 7 bp, Unknown
  misc_feature (1)..( 7): Result.003 file - promoters60/1976550
tttttgt

SEQ ID NO: 124121 - DNA, 7 bp, Unknown
  misc_feature (1)..( 7): Result.003 file - promoters60/1976550
tttttgt

SEQ ID NO: 124122 - DNA, 10 bp, Unknown
  misc_feature (1)..( 10): Result.003 file - promoters60/1976550
taatttgata

SEQ ID NO: 124123 - DNA, 10 bp, Unknown
  misc_feature (1)..( 10): Result.003 file - promoters60/1976550
taatctgatc

SEQ ID NO: 124124 - DNA, 10 bp, Unknown
  misc_feature (1)..( 10): Result.003 file - promoters60/1976550
caatcttatc

SEQ ID NO: 124125 - DNA, 7 bp, Unknown
  misc_feature (1)..( 7): Result.003 file - promoters60/1976550
gtttgca

SEQ ID NO: 124126 - DNA, 7 bp, Unknown
  misc_feature (1)..( 7): Result.003 file - promoters60/1976550
gtttgca

SEQ ID NO: 124127 - DNA, 9 bp, Unknown
  misc_feature (1)..( 9): Result.003 file - promoters60/1976550
taagcaaaa

SEQ ID NO: 124128 - DNA, 9 bp, Unknown
  misc_feature (1)..( 9): Result.003 file - promoters60/1976550
taagtaaaa

SEQ ID NO: 124129 - DNA, 6 bp, Unknown
  misc_feature (1)..( 6): Result.003 file - promoters60/1976550
ctaaaa

SEQ ID NO: 124130 - DNA, 6 bp, Unknown
  misc_feature (1)..( 6): Result.003 file - promoters60/1976550
ctaaaa

SEQ ID NO: 124131 - DNA, 9 bp, Unknown
  misc_feature (1)..( 9): Result.003 file - promoters60/1976550
attgattta

SEQ ID NO: 124132 - DNA, 9 bp, Unknown
  misc_feature (1)..( 9): Result.003 file - promoters60/1976550
atttattta

SEQ ID NO: 124133 - DNA, 7 bp, Unknown
  misc_feature (1)..( 7): Result.003 file - promoters60/1976550
tgataaa

SEQ ID NO: 124134 - DNA, 7 bp, Unknown
  misc_feature (1)..( 7): Result.003 file - promoters60/1976550
tgataaa

SEQ ID NO: 124135 - DNA, 7 bp, Unknown
  misc_feature (1)..( 7): Result.003 file - promoters60/1977519
taaaaat

SEQ ID NO: 124136 - DNA, 7 bp, Unknown
  misc_feature (1)..( 7): Result.003 file - promoters60/1977519
taataat

SEQ ID NO: 124137 - DNA, 8 bp, Unknown
  misc_feature (1)..( 8): Result.003 file - promoters60/1977519
tatttttg

SEQ ID NO: 124138 - DNA, 8 bp, Unknown
  misc_feature (1)..( 8): Result.003 file - promoters60/1977519
tattgttg

SEQ ID NO: 124139 - DNA, 10 bp, Unknown
  misc_feature (1)..( 10): Result.003 file - promoters60/1977519
ttgagtcaat

SEQ ID NO: 124140 - DNA, 10 bp, Unknown
  misc_feature (1)..( 10): Result.003 file - promoters60/1977519
ttgaatcaat

SEQ ID NO: 124141 - DNA, 10 bp, Unknown
  misc_feature (1)..( 10): Result.003 file - promoters60/1977519
ttgattcaaa

SEQ ID NO: 124142 - DNA, 9 bp, Unknown
  misc_feature (1)..( 9): Result.003 file - promoters60/1977519
gattttgtt

SEQ ID NO: 124143 - DNA, 9 bp, Unknown
  misc_feature (1)..( 9): Result.003 file - promoters60/1977519
gatttggtt

SEQ ID NO: 124144 - DNA, 9 bp, Unknown
  misc_feature (1)..( 9): Result.003 file - promoters60/1977519
gtcttggtt

SEQ ID NO: 124145 - DNA, 6 bp, Unknown
  misc_feature (1)..( 6): Result.003 file - promoters60/1977519
agagaa

SEQ ID NO: 124146 - DNA, 6 bp, Unknown
  misc_feature (1)..( 6): Result.003 file - promoters60/1977519
agagaa

SEQ ID NO: 124147 - DNA, 6 bp, Unknown
  misc_feature (1)..( 6): Result.003 file - promoters60/1977519
aattat

SEQ ID NO: 124148 - DNA, 6 bp, Unknown
  misc_feature (1)..( 6): Result.003 file - promoters60/1977519
aattat

SEQ ID NO: 124149 - DNA, 6 bp, Unknown
  misc_feature (1)..( 6): Result.003 file - promoters60/1977519
taaatt

SEQ ID NO: 124150 - DNA, 6 bp, Unknown
  misc_feature (1)..( 6): Result.003 file - promoters60/1977519
taaatt

SEQ ID NO: 124151 - DNA, 7 bp, Unknown
  misc_feature (1)..( 7): Result.003 file - promoters60/1977519
cctacaa

SEQ ID NO: 124152 - DNA, 7 bp, Unknown
  misc_feature (1)..( 7): Result.003 file - promoters60/1977519
cctacaa

SEQ ID NO: 124153 - DNA, 6 bp, Unknown
  misc_feature (1)..( 6): Result.003 file - promoters60/1977519
aaccta

SEQ ID NO: 124154 - DNA, 6 bp, Unknown
  misc_feature (1)..( 6): Result.003 file - promoters60/1977519
aaccta

SEQ ID NO: 124155 - DNA, 6 bp, Unknown
  misc_feature (1)..( 6): Result.003 file - promoters60/1977519
attttg

SEQ ID NO: 124156 - DNA, 6 bp, Unknown
  misc_feature (1)..( 6): Result.003 file - promoters60/1977519
attttg

SEQ ID NO: 124157 - DNA, 6 bp, Unknown
  misc_feature (1)..( 6): Result.003 file - promoters60/1977519
tgatat

SEQ ID NO: 124158 - DNA, 6 bp, Unknown
  misc_feature (1)..( 6): Result.003 file - promoters60/1977519
tgatat

SEQ ID NO: 124159 - DNA, 7 bp, Unknown
  misc_feature (1)..( 7): Result.003 file - promoters60/1977519
tggattt

SEQ ID NO: 124160 - DNA, 7 bp, Unknown
  misc_feature (1)..( 7): Result.003 file - promoters60/1977519
tggattt

SEQ ID NO: 124161 - DNA, 6 bp, Unknown
  misc_feature (1)..( 6): Result.003 file - promoters60/1977519
aagatt

SEQ ID NO: 124162 - DNA, 6 bp, Unknown
  misc_feature (1)..( 6): Result.003 file - promoters60/1977519
aagatt

SEQ ID NO: 124163 - DNA, 6 bp, Unknown
  misc_feature (1)..( 6): Result.003 file - promoters60/1977519
ttaacc

SEQ ID NO: 124164 - DNA, 6 bp, Unknown
  misc_feature (1)..( 6): Result.003 file - promoters60/1977519
ttaacc

SEQ ID NO: 124165 - DNA, 7 bp, Unknown
  misc_feature (1)..( 7): Result.003 file - promoters60/1977519
ctcactc

SEQ ID NO: 124166 - DNA, 7 bp, Unknown
  misc_feature (1)..( 7): Result.003 file - promoters60/1977519
ctcgctc

SEQ ID NO: 124167 - DNA, 6 bp, Unknown
  misc_feature (1)..( 6): Result.003 file - promoters60/1977519
atttct

SEQ ID NO: 124168 - DNA, 6 bp, Unknown
  misc_feature (1)..( 6): Result.003 file - promoters60/1977519
atttct

SEQ ID NO: 124169 - DNA, 10 bp, Unknown
  misc_feature (1)..( 10): Result.003 file - promoters60/1977533
aaaaatattc

SEQ ID NO: 124170 - DNA, 10 bp, Unknown
  misc_feature (1)..( 10): Result.003 file - promoters60/1977533
aaacatagac

SEQ ID NO: 124171 - DNA, 10 bp, Unknown
  misc_feature (1)..( 10): Result.003 file - promoters60/1977533
taaattattc

SEQ ID NO: 124172 - DNA, 10 bp, Unknown
  misc_feature (1)..( 10): Result.003 file - promoters60/1977533
aaaaacaaag

SEQ ID NO: 124173 - DNA, 10 bp, Unknown
  misc_feature (1)..( 10): Result.003 file - promoters60/1977533
gaaatcatca

SEQ ID NO: 124174 - DNA, 14 bp, Unknown
  misc_feature (1)..( 14): Result.003 file - promoters60/1977533
tttattctgatatt

SEQ ID NO: 124175 - DNA, 14 bp, Unknown
  misc_feature (1)..( 14): Result.003 file - promoters60/1977533
tgtattctctctca

SEQ ID NO: 124176 - DNA, 14 bp, Unknown
  misc_feature (1)..( 14): Result.003 file - promoters60/1977533
tggattttgaaatt

SEQ ID NO: 124177 - DNA, 14 bp, Unknown
  misc_feature (1)..( 14): Result.003 file - promoters60/1977533
ttttttctactgaa

SEQ ID NO: 124178 - DNA, 14 bp, Unknown
  misc_feature (1)..( 14): Result.003 file - promoters60/1977533
ttgattttgcctcg

SEQ ID NO: 124179 - DNA, 8 bp, Unknown
  misc_feature (1)..( 8): Result.003 file - promoters60/1977533
tgatttat

SEQ ID NO: 124180 - DNA, 8 bp, Unknown
  misc_feature (1)..( 8): Result.003 file - promoters60/1977533
tgattttg

SEQ ID NO: 124181 - DNA, 8 bp, Unknown
  misc_feature (1)..( 8): Result.003 file - promoters60/1977533
ggattttg

SEQ ID NO: 124182 - DNA, 8 bp, Unknown
  misc_feature (1)..( 8): Result.003 file - promoters60/1977533
gaattttg

SEQ ID NO: 124183 - DNA, 8 bp, Unknown
  misc_feature (1)..( 8): Result.003 file - promoters60/1977533
gaagtttg

SEQ ID NO: 124184 - DNA, 8 bp, Unknown
  misc_feature (1)..( 8): Result.003 file - promoters60/1977533
ttaacaga

SEQ ID NO: 124185 - DNA, 8 bp, Unknown
  misc_feature (1)..( 8): Result.003 file - promoters60/1977533
ttaacaac

SEQ ID NO: 124186 - DNA, 8 bp, Unknown
  misc_feature (1)..( 8): Result.003 file - promoters60/1977533
ttaacaac

SEQ ID NO: 124187 - DNA, 8 bp, Unknown
  misc_feature (1)..( 8): Result.003 file - promoters60/1977533
gtaataga

SEQ ID NO: 124188 - DNA, 8 bp, Unknown
  misc_feature (1)..( 8): Result.003 file - promoters60/1977533
gtaataaa

SEQ ID NO: 124189 - DNA, 10 bp, Unknown
  misc_feature (1)..( 10): Result.003 file - promoters60/1977537
tttcactctt

SEQ ID NO: 124190 - DNA, 10 bp, Unknown
  misc_feature (1)..( 10): Result.003 file - promoters60/1977537
tttctctctt

SEQ ID NO: 124191 - DNA, 10 bp, Unknown
  misc_feature (1)..( 10): Result.003 file - promoters60/1977537
cctctctcaa

SEQ ID NO: 124192 - DNA, 7 bp, Unknown
  misc_feature (1)..( 7): Result.003 file - promoters60/1977537
aaatatt

SEQ ID NO: 124193 - DNA, 7 bp, Unknown
  misc_feature (1)..( 7): Result.003 file - promoters60/1977537
aaatatt

SEQ ID NO: 124194 - DNA, 12 bp, Unknown
  misc_feature (1)..( 12): Result.003 file - promoters60/1977537
taaatattgggc

SEQ ID NO: 124195 - DNA, 12 bp, Unknown
  misc_feature (1)..( 12): Result.003 file - promoters60/1977537
taaacattcata

SEQ ID NO: 124196 - DNA, 12 bp, Unknown
  misc_feature (1)..( 12): Result.003 file - promoters60/1977537
agaatattcggc

SEQ ID NO: 124197 - DNA, 7 bp, Unknown
  misc_feature (1)..( 7): Result.003 file - promoters60/1977537
tttgcca

SEQ ID NO: 124198 - DNA, 7 bp, Unknown
  misc_feature (1)..( 7): Result.003 file - promoters60/1977537
tttccca

SEQ ID NO: 124199 - DNA, 7 bp, Unknown
  misc_feature (1)..( 7): Result.003 file - promoters60/1977537
gcaaatt

SEQ ID NO: 124200 - DNA, 7 bp, Unknown
  misc_feature (1)..( 7): Result.003 file - promoters60/1977537
gcatatt

SEQ ID NO: 124201 - DNA, 6 bp, Unknown
  misc_feature (1)..( 6): Result.003 file - promoters60/1977537
tttgat

SEQ ID NO: 124202 - DNA, 6 bp, Unknown
  misc_feature (1)..( 6): Result.003 file - promoters60/1977537
tttgat

SEQ ID NO: 124203 - DNA, 8 bp, Unknown
  misc_feature (1)..( 8): Result.003 file - promoters60/1977537
tttttatc

SEQ ID NO: 124204 - DNA, 8 bp, Unknown
  misc_feature (1)..( 8): Result.003 file - promoters60/1977537
ttttcatc

SEQ ID NO: 124205 - DNA, 8 bp, Unknown
  misc_feature (1)..( 8): Result.003 file - promoters60/1977537
tttccatt

SEQ ID NO: 124206 - DNA, 9 bp, Unknown
  misc_feature (1)..( 9): Result.003 file - promoters60/1977537
tattttttt

SEQ ID NO: 124207 - DNA, 9 bp, Unknown
  misc_feature (1)..( 9): Result.003 file - promoters60/1977537
gattttttt

SEQ ID NO: 124208 - DNA, 9 bp, Unknown
  misc_feature (1)..( 9): Result.003 file - promoters60/1977537
gattttgag

SEQ ID NO: 124209 - DNA, 6 bp, Unknown
  misc_feature (1)..( 6): Result.003 file - promoters60/1977537
tgttat

SEQ ID NO: 124210 - DNA, 6 bp, Unknown
  misc_feature (1)..( 6): Result.003 file - promoters60/1977537
tgttat

SEQ ID NO: 124211 - DNA, 8 bp, Unknown
  misc_feature (1)..( 8): Result.003 file - promoters60/1977537
tgtttgtt

SEQ ID NO: 124212 - DNA, 8 bp, Unknown
  misc_feature (1)..( 8): Result.003 file - promoters60/1977537
tgtatgtt

SEQ ID NO: 124213 - DNA, 6 bp, Unknown
  misc_feature (1)..( 6): Result.003 file - promoters60/1977537
ctctta

SEQ ID NO: 124214 - DNA, 6 bp, Unknown
  misc_feature (1)..( 6): Result.003 file - promoters60/1977537
ctctta

SEQ ID NO: 124215 - DNA, 6 bp, Unknown
  misc_feature (1)..( 6): Result.003 file - promoters60/1977537
atttaa

SEQ ID NO: 124216 - DNA, 6 bp, Unknown
  misc_feature (1)..( 6): Result.003 file - promoters60/1977537
atttaa

SEQ ID NO: 124217 - DNA, 6 bp, Unknown
  misc_feature (1)..( 6): Result.003 file - promoters60/1977537
aaattt

SEQ ID NO: 124218 - DNA, 6 bp, Unknown
  misc_feature (1)..( 6): Result.003 file - promoters60/1977537
aaattt

SEQ ID NO: 124219 - DNA, 7 bp, Unknown
  misc_feature (1)..( 7): Result.003 file - promoters60/1977537
attgggc

SEQ ID NO: 124220 - DNA, 7 bp, Unknown
  misc_feature (1)..( 7): Result.003 file - promoters60/1977537
atttggc

SEQ ID NO: 124221 - DNA, 6 bp, Unknown
  misc_feature (1)..( 6): Result.003 file - promoters60/1977537
gattga

SEQ ID NO: 124222 - DNA, 6 bp, Unknown
  misc_feature (1)..( 6): Result.003 file - promoters60/1977537
gattga

SEQ ID NO: 124223 - DNA, 7 bp, Unknown
  misc_feature (1)..( 7): Result.003 file - promoters60/1977537
taattta

SEQ ID NO: 124224 - DNA, 7 bp, Unknown
  misc_feature (1)..( 7): Result.003 file - promoters60/1977537
taactta

SEQ ID NO: 124225 - DNA, 7 bp, Unknown
  misc_feature (1)..( 7): Result.003 file - promoters60/1985373
aaatttc

SEQ ID NO: 124226 - DNA, 7 bp, Unknown
  misc_feature (1)..( 7): Result.003 file - promoters60/1985373
aaagttc

SEQ ID NO: 124227 - DNA, 8 bp, Unknown
  misc_feature (1)..( 8): Result.003 file - promoters60/1985373
cttttttt

SEQ ID NO: 124228 - DNA, 8 bp, Unknown
  misc_feature (1)..( 8): Result.003 file - promoters60/1985373
ctttttta

SEQ ID NO: 124229 - DNA, 8 bp, Unknown
  misc_feature (1)..( 8): Result.003 file - promoters60/1985373
attttttt

SEQ ID NO: 124230 - DNA, 11 bp, Unknown
  misc_feature (1)..( 11): Result.003 file - promoters60/1985373
ttaaaaacctt

SEQ ID NO: 124231 - DNA, 11 bp, Unknown
  misc_feature (1)..( 11): Result.003 file - promoters60/1985373
ttataaagtat

SEQ ID NO: 124232 - DNA, 11 bp, Unknown
  misc_feature (1)..( 11): Result.003 file - promoters60/1985373
taatacagtat

SEQ ID NO: 124233 - DNA, 14 bp, Unknown
  misc_feature (1)..( 14): Result.003 file - promoters60/1985373
atgtttaatttaca

SEQ ID NO: 124234 - DNA, 14 bp, Unknown
  misc_feature (1)..( 14): Result.003 file - promoters60/1985373
atatataatttaca

SEQ ID NO: 124235 - DNA, 14 bp, Unknown
  misc_feature (1)..( 14): Result.003 file - promoters60/1985373
tatgcttatttttc

SEQ ID NO: 124236 - DNA, 12 bp, Unknown
  misc_feature (1)..( 12): Result.003 file - promoters60/1985373
aattcaatttat

SEQ ID NO: 124237 - DNA, 12 bp, Unknown
  misc_feature (1)..( 12): Result.003 file - promoters60/1985373
aatacaacttat

SEQ ID NO: 124238 - DNA, 6 bp, Unknown
  misc_feature (1)..( 6): Result.003 file - promoters60/1985373
ttatat

SEQ ID NO: 124239 - DNA, 6 bp, Unknown
  misc_feature (1)..( 6): Result.003 file - promoters60/1985373
ttatat

SEQ ID NO: 124240 - DNA, 7 bp, Unknown
  misc_feature (1)..( 7): Result.003 file - promoters60/1985373
gtttgtt

SEQ ID NO: 124241 - DNA, 7 bp, Unknown
  misc_feature (1)..( 7): Result.003 file - promoters60/1985373
gttcgtt

SEQ ID NO: 124242 - DNA, 9 bp, Unknown
  misc_feature (1)..( 9): Result.003 file - promoters60/1985373
ttgaaatac

SEQ ID NO: 124243 - DNA, 9 bp, Unknown
  misc_feature (1)..( 9): Result.003 file - promoters60/1985373
tagaaataa

SEQ ID NO: 124244 - DNA, 9 bp, Unknown
  misc_feature (1)..( 9): Result.003 file - promoters60/1985373
ttgacatac

SEQ ID NO: 124245 - DNA, 6 bp, Unknown
  misc_feature (1)..( 6): Result.003 file - promoters60/1985373
tatggc

SEQ ID NO: 124246 - DNA, 6 bp, Unknown
  misc_feature (1)..( 6): Result.003 file - promoters60/1985373
tatggc

SEQ ID NO: 124247 - DNA, 7 bp, Unknown
  misc_feature (1)..( 7): Result.003 file - promoters60/1985373
acctaaa

SEQ ID NO: 124248 - DNA, 7 bp, Unknown
  misc_feature (1)..( 7): Result.003 file - promoters60/1985373
acccaaa

SEQ ID NO: 124249 - DNA, 6 bp, Unknown
  misc_feature (1)..( 6): Result.003 file - promoters60/1985373
tctaaa

SEQ ID NO: 124250 - DNA, 6 bp, Unknown
  misc_feature (1)..( 6): Result.003 file - promoters60/1985373
tctaaa

SEQ ID NO: 124251 - DNA, 6 bp, Unknown
  misc_feature (1)..( 6): Result.003 file - promoters60/1985373
aaactt

SEQ ID NO: 124252 - DNA, 6 bp, Unknown
  misc_feature (1)..( 6): Result.003 file - promoters60/1985373
aaactt

SEQ ID NO: 124253 - DNA, 6 bp, Unknown
  misc_feature (1)..( 6): Result.003 file - promoters60/1985373
ttcaaa

SEQ ID NO: 124254 - DNA, 6 bp, Unknown
  misc_feature (1)..( 6): Result.003 file - promoters60/1985373
ttcaaa

SEQ ID NO: 124255 - DNA, 6 bp, Unknown
  misc_feature (1)..( 6): Result.003 file - promoters60/1985373
ttcatt

SEQ ID NO: 124256 - DNA, 6 bp, Unknown
  misc_feature (1)..( 6): Result.003 file - promoters60/1985373
ttcatt

SEQ ID NO: 124257 - DNA, 6 bp, Unknown
  misc_feature (1)..( 6): Result.003 file - promoters60/1985373
aataat

SEQ ID NO: 124258 - DNA, 6 bp, Unknown
  misc_feature (1)..( 6): Result.003 file - promoters60/1985373
aataat

SEQ ID NO: 124259 - DNA, 8 bp, Unknown
  misc_feature (1)..( 8): Result.003 file - promoters60/1985373
tgttgaaa

SEQ ID NO: 124260 - DNA, 8 bp, Unknown
  misc_feature (1)..( 8): Result.003 file - promoters60/1985373
tgtcgaaa

SEQ ID NO: 124261 - DNA, 6 bp, Unknown
  misc_feature (1)..( 6): Result.003 file - promoters60/1985373
aaaagt

SEQ ID NO: 124262 - DNA, 6 bp, Unknown
  misc_feature (1)..( 6): Result.003 file - promoters60/1985373
aaaagt

SEQ ID NO: 124263 - DNA, 8 bp, Unknown
  misc_feature (1)..( 8): Result.003 file - promoters60/1985373
aaaacaat

SEQ ID NO: 124264 - DNA, 8 bp, Unknown
  misc_feature (1)..( 8): Result.003 file - promoters60/1985373
aaaaaaat

SEQ ID NO: 124265 - DNA, 6 bp, Unknown
  misc_feature (1)..( 6): Result.003 file - promoters60/1985373
aattat

SEQ ID NO: 124266 - DNA, 6 bp, Unknown
  misc_feature (1)..( 6): Result.003 file - promoters60/1985373
aattat

SEQ ID NO: 124267 - DNA, 6 bp, Unknown
  misc_feature (1)..( 6): Result.003 file - promoters60/1985373
aaaatt

SEQ ID NO: 124268 - DNA, 6 bp, Unknown
  misc_feature (1)..( 6): Result.003 file - promoters60/1985373
aaaatt

SEQ ID NO: 124269 - DNA, 6 bp, Unknown
  misc_feature (1)..( 6): Result.003 file - promoters60/1985373
attata

SEQ ID NO: 124270 - DNA, 6 bp, Unknown
  misc_feature (1)..( 6): Result.003 file - promoters60/1985373
attata

SEQ ID NO: 124271 - DNA, 6 bp, Unknown
  misc_feature (1)..( 6): Result.003 file - promoters60/1985373
aaacaa

SEQ ID NO: 124272 - DNA, 6 bp, Unknown
  misc_feature (1)..( 6): Result.003 file - promoters60/1985373
aaacaa

SEQ ID NO: 124273 - DNA, 6 bp, Unknown
  misc_feature (1)..( 6): Result.003 file - promoters60/1985373
aattga

SEQ ID NO: 124274 - DNA, 6 bp, Unknown
  misc_feature (1)..( 6): Result.003 file - promoters60/1985373
aattga

SEQ ID NO: 124275 - DNA, 9 bp, Unknown
  misc_feature (1)..( 9): Result.003 file - promoters60/1985373
atttttttg

SEQ ID NO: 124276 - DNA, 9 bp, Unknown
  misc_feature (1)..( 9): Result.003 file - promoters60/1985373
attcttttg

SEQ ID NO: 124277 - DNA, 7 bp, Unknown
  misc_feature (1)..( 7): Result.003 file - promoters60/1985373
ttttctt

SEQ ID NO: 124278 - DNA, 7 bp, Unknown
  misc_feature (1)..( 7): Result.003 file - promoters60/1985373
tttgctt

SEQ ID NO: 124279 - DNA, 6 bp, Unknown
  misc_feature (1)..( 6): Result.003 file - promoters60/1985373
tattgg

SEQ ID NO: 124280 - DNA, 6 bp, Unknown
  misc_feature (1)..( 6): Result.003 file - promoters60/1985373
tattgg

SEQ ID NO: 124281 - DNA, 9 bp, Unknown
  misc_feature (1)..( 9): Result.003 file - promoters60/1985373
ataaaaaga

SEQ ID NO: 124282 - DNA, 9 bp, Unknown
  misc_feature (1)..( 9): Result.003 file - promoters60/1985373
atagaaaga

SEQ ID NO: 124283 - DNA, 8 bp, Unknown
  misc_feature (1)..( 8): Result.003 file - promoters60/1985590
gtttatat

SEQ ID NO: 124284 - DNA, 8 bp, Unknown
  misc_feature (1)..( 8): Result.003 file - promoters60/1985590
ttttctat

SEQ ID NO: 124285 - DNA, 8 bp, Unknown
  misc_feature (1)..( 8): Result.003 file - promoters60/1985590
gttcataa

SEQ ID NO: 124286 - DNA, 8 bp, Unknown
  misc_feature (1)..( 8): Result.003 file - promoters60/1985590
caattcat

SEQ ID NO: 124287 - DNA, 8 bp, Unknown
  misc_feature (1)..( 8): Result.003 file - promoters60/1985590
caaatcaa

SEQ ID NO: 124288 - DNA, 8 bp, Unknown
  misc_feature (1)..( 8): Result.003 file - promoters60/1985590
gaattaaa

SEQ ID NO: 124289 - DNA, 7 bp, Unknown
  misc_feature (1)..( 7): Result.003 file - promoters60/1985590
gtatata

SEQ ID NO: 124290 - DNA, 7 bp, Unknown
  misc_feature (1)..( 7): Result.003 file - promoters60/1985590
gtaaata

SEQ ID NO: 124291 - DNA, 7 bp, Unknown
  misc_feature (1)..( 7): Result.003 file - promoters60/1985590
ttaaata

SEQ ID NO: 124292 - DNA, 11 bp, Unknown
  misc_feature (1)..( 11): Result.003 file - promoters60/1985590
tttaaatacgt

SEQ ID NO: 124293 - DNA, 11 bp, Unknown
  misc_feature (1)..( 11): Result.003 file - promoters60/1985590
tttcaatatga

SEQ ID NO: 124294 - DNA, 11 bp, Unknown
  misc_feature (1)..( 11): Result.003 file - promoters60/1985590
aagaaagacgt

SEQ ID NO: 124295 - DNA, 9 bp, Unknown
  misc_feature (1)..( 9): Result.003 file - promoters60/1985590
gaaaataaa

SEQ ID NO: 124296 - DNA, 9 bp, Unknown
  misc_feature (1)..( 9): Result.003 file - promoters60/1985590
aaaactaat

SEQ ID NO: 124297 - DNA, 9 bp, Unknown
  misc_feature (1)..( 9): Result.003 file - promoters60/1985590
gaaaattta

SEQ ID NO: 124298 - DNA, 9 bp, Unknown
  misc_feature (1)..( 9): Result.003 file - promoters60/1985590
caaaataaa

SEQ ID NO: 124299 - DNA, 12 bp, Unknown
  misc_feature (1)..( 12): Result.003 file - promoters60/1985590
gaacacatgaag

SEQ ID NO: 124300 - DNA, 12 bp, Unknown
  misc_feature (1)..( 12): Result.003 file - promoters60/1985590
aaacacaactgt

SEQ ID NO: 124301 - DNA, 12 bp, Unknown
  misc_feature (1)..( 12): Result.003 file - promoters60/1985590
taacaaatacaa

SEQ ID NO: 124302 - DNA, 11 bp, Unknown
  misc_feature (1)..( 11): Result.003 file - promoters60/1985590
ttttaaattat

SEQ ID NO: 124303 - DNA, 11 bp, Unknown
  misc_feature (1)..( 11): Result.003 file - promoters60/1985590
tttttaattat

SEQ ID NO: 124304 - DNA, 11 bp, Unknown
  misc_feature (1)..( 11): Result.003 file - promoters60/1985590
tctttaattag

SEQ ID NO: 124305 - DNA, 7 bp, Unknown
  misc_feature (1)..( 7): Result.003 file - promoters60/1985590
ttcataa

SEQ ID NO: 124306 - DNA, 7 bp, Unknown
  misc_feature (1)..( 7): Result.003 file - promoters60/1985590
atcataa

SEQ ID NO: 124307 - DNA, 7 bp, Unknown
  misc_feature (1)..( 7): Result.003 file - promoters60/1985590
ttcatat

SEQ ID NO: 124308 - DNA, 11 bp, Unknown
  misc_feature (1)..( 11): Result.003 file - promoters60/1985590
ataatattagt

SEQ ID NO: 124309 - DNA, 11 bp, Unknown
  misc_feature (1)..( 11): Result.003 file - promoters60/1985590
ttcatatgagt

SEQ ID NO: 124310 - DNA, 11 bp, Unknown
  misc_feature (1)..( 11): Result.003 file - promoters60/1985590
ttcatatgaaa

SEQ ID NO: 124311 - DNA, 11 bp, Unknown
  misc_feature (1)..( 11): Result.003 file - promoters60/1985590
ctagaagaaaa

SEQ ID NO: 124312 - DNA, 11 bp, Unknown
  misc_feature (1)..( 11): Result.003 file - promoters60/1985590
acagaggaaaa

SEQ ID NO: 124313 - DNA, 11 bp, Unknown
  misc_feature (1)..( 11): Result.003 file - promoters60/1985590
gaagaagaaag

SEQ ID NO: 124314 - DNA, 7 bp, Unknown
  misc_feature (1)..( 7): Result.003 file - promoters60/1985590
ttatgtg

SEQ ID NO: 124315 - DNA, 7 bp, Unknown
  misc_feature (1)..( 7): Result.003 file - promoters60/1985590
ttatgtt

SEQ ID NO: 124316 - DNA, 7 bp, Unknown
  misc_feature (1)..( 7): Result.003 file - promoters60/1985590
gtatgtt

SEQ ID NO: 124317 - DNA, 6 bp, Unknown
  misc_feature (1)..( 6): Result.003 file - promoters60/1985621
ggattt

SEQ ID NO: 124318 - DNA, 6 bp, Unknown
  misc_feature (1)..( 6): Result.003 file - promoters60/1985621
ggattt

SEQ ID NO: 124319 - DNA, 7 bp, Unknown
  misc_feature (1)..( 7): Result.003 file - promoters60/1985621
gagagga

SEQ ID NO: 124320 - DNA, 7 bp, Unknown
  misc_feature (1)..( 7): Result.003 file - promoters60/1985621
gagagga

SEQ ID NO: 124321 - DNA, 6 bp, Unknown
  misc_feature (1)..( 6): Result.003 file - promoters60/1985621
ttttct

SEQ ID NO: 124322 - DNA, 6 bp, Unknown
  misc_feature (1)..( 6): Result.003 file - promoters60/1985621
ttttct

SEQ ID NO: 124323 - DNA, 10 bp, Unknown
  misc_feature (1)..( 10): Result.003 file - promoters60/1985621
tacatatatg

SEQ ID NO: 124324 - DNA, 10 bp, Unknown
  misc_feature (1)..( 10): Result.003 file - promoters60/1985621
tacataaatg

SEQ ID NO: 124325 - DNA, 7 bp, Unknown
  misc_feature (1)..( 7): Result.003 file - promoters60/1985621
aaagtaa

SEQ ID NO: 124326 - DNA, 7 bp, Unknown
  misc_feature (1)..( 7): Result.003 file - promoters60/1985621
aaaataa

SEQ ID NO: 124327 - DNA, 7 bp, Unknown
  misc_feature (1)..( 7): Result.003 file - promoters60/1985621
aaactaa

SEQ ID NO: 124328 - DNA, 12 bp, Unknown
  misc_feature (1)..( 12): Result.003 file - promoters60/1985621
aataaaaccaaa

SEQ ID NO: 124329 - DNA, 12 bp, Unknown
  misc_feature (1)..( 12): Result.003 file - promoters60/1985621
aatcaaacgaaa

SEQ ID NO: 124330 - DNA, 8 bp, Unknown
  misc_feature (1)..( 8): Result.003 file - promoters60/1985621
ctacttct

SEQ ID NO: 124331 - DNA, 8 bp, Unknown
  misc_feature (1)..( 8): Result.003 file - promoters60/1985621
ctatttct

SEQ ID NO: 124332 - DNA, 7 bp, Unknown
  misc_feature (1)..( 7): Result.003 file - promoters60/1985621
aactcgt

SEQ ID NO: 124333 - DNA, 7 bp, Unknown
  misc_feature (1)..( 7): Result.003 file - promoters60/1985621
aacccgt

SEQ ID NO: 124334 - DNA, 6 bp, Unknown
  misc_feature (1)..( 6): Result.003 file - promoters60/1985621
cattta

SEQ ID NO: 124335 - DNA, 6 bp, Unknown
  misc_feature (1)..( 6): Result.003 file - promoters60/1985621
cattta

SEQ ID NO: 124336 - DNA, 6 bp, Unknown
  misc_feature (1)..( 6): Result.003 file - promoters60/1985621
ctaata

SEQ ID NO: 124337 - DNA, 6 bp, Unknown
  misc_feature (1)..( 6): Result.003 file - promoters60/1985621
ctaata

SEQ ID NO: 124338 - DNA, 6 bp, Unknown
  misc_feature (1)..( 6): Result.003 file - promoters60/1985621
atttaa

SEQ ID NO: 124339 - DNA, 6 bp, Unknown
  misc_feature (1)..( 6): Result.003 file - promoters60/1985621
atttaa

SEQ ID NO: 124340 - DNA, 8 bp, Unknown
  misc_feature (1)..( 8): Result.003 file - promoters60/1985621
gaagtaac

SEQ ID NO: 124341 - DNA, 8 bp, Unknown
  misc_feature (1)..( 8): Result.003 file - promoters60/1985621
gaagaaac

SEQ ID NO: 124342 - DNA, 6 bp, Unknown
  misc_feature (1)..( 6): Result.003 file - promoters60/1985621
gaggtt

SEQ ID NO: 124343 - DNA, 6 bp, Unknown
  misc_feature (1)..( 6): Result.003 file - promoters60/1985621
gaggtt

SEQ ID NO: 124344 - DNA, 6 bp, Unknown
  misc_feature (1)..( 6): Result.003 file - promoters60/1985621
tagtgt

SEQ ID NO: 124345 - DNA, 6 bp, Unknown
  misc_feature (1)..( 6): Result.003 file - promoters60/1985621
tagtgt

SEQ ID NO: 124346 - DNA, 7 bp, Unknown
  misc_feature (1)..( 7): Result.003 file - promoters60/1985621
tttaaac

SEQ ID NO: 124347 - DNA, 7 bp, Unknown
  misc_feature (1)..( 7): Result.003 file - promoters60/1985621
tttaaac

SEQ ID NO: 124348 - DNA, 7 bp, Unknown
  misc_feature (1)..( 7): Result.003 file - promoters60/1989445
taaaatg

SEQ ID NO: 124349 - DNA, 7 bp, Unknown
  misc_feature (1)..( 7): Result.003 file - promoters60/1989445
taaaata

SEQ ID NO: 124350 - DNA, 7 bp, Unknown
  misc_feature (1)..( 7): Result.003 file - promoters60/1989445
caaaata

SEQ ID NO: 124351 - DNA, 7 bp, Unknown
  misc_feature (1)..( 7): Result.003 file - promoters60/1989445
caaaata

SEQ ID NO: 124352 - DNA, 14 bp, Unknown
  misc_feature (1)..( 14): Result.003 file - promoters60/1989445
tttttattttattt

SEQ ID NO: 124353 - DNA, 14 bp, Unknown
  misc_feature (1)..( 14): Result.003 file - promoters60/1989445
catttctttgtaag

SEQ ID NO: 124354 - DNA, 14 bp, Unknown
  misc_feature (1)..( 14): Result.003 file - promoters60/1989445
attttattttattt

SEQ ID NO: 124355 - DNA, 14 bp, Unknown
  misc_feature (1)..( 14): Result.003 file - promoters60/1989445
catctctgatagat

SEQ ID NO: 124356 - DNA, 11 bp, Unknown
  misc_feature (1)..( 11): Result.003 file - promoters60/1989445
ataaattaatg

SEQ ID NO: 124357 - DNA, 11 bp, Unknown
  misc_feature (1)..( 11): Result.003 file - promoters60/1989445
atatattaatg

SEQ ID NO: 124358 - DNA, 11 bp, Unknown
  misc_feature (1)..( 11): Result.003 file - promoters60/1989445
ataaatgagag

SEQ ID NO: 124359 - DNA, 11 bp, Unknown
  misc_feature (1)..( 11): Result.003 file - promoters60/1989445
atatatatgta

SEQ ID NO: 124360 - DNA, 13 bp, Unknown
  misc_feature (1)..( 13): Result.003 file - promoters60/1989445
attttcagaaatt

SEQ ID NO: 124361 - DNA, 13 bp, Unknown
  misc_feature (1)..( 13): Result.003 file - promoters60/1989445
aacgcatgaaatt

SEQ ID NO: 124362 - DNA, 13 bp, Unknown
  misc_feature (1)..( 13): Result.003 file - promoters60/1989445
attctcagaaatg

SEQ ID NO: 124363 - DNA, 13 bp, Unknown
  misc_feature (1)..( 13): Result.003 file - promoters60/1989445
cgtctcagctcat

SEQ ID NO: 124364 - DNA, 12 bp, Unknown
  misc_feature (1)..( 12): Result.003 file - promoters60/2025006
tttaaaataaat

SEQ ID NO: 124365 - DNA, 12 bp, Unknown
  misc_feature (1)..( 12): Result.003 file - promoters60/2025006
tttaaaaaaaaa

SEQ ID NO: 124366 - DNA, 12 bp, Unknown
  misc_feature (1)..( 12): Result.003 file - promoters60/2025006
aatctgataaat

SEQ ID NO: 124367 - DNA, 12 bp, Unknown
  misc_feature (1)..( 12): Result.003 file - promoters60/2025006
aacaccataaat

SEQ ID NO: 124368 - DNA, 9 bp, Unknown
  misc_feature (1)..( 9): Result.003 file - promoters60/2025006
ataaacaat

SEQ ID NO: 124369 - DNA, 9 bp, Unknown
  misc_feature (1)..( 9): Result.003 file - promoters60/2025006
ataaactca

SEQ ID NO: 124370 - DNA, 9 bp, Unknown
  misc_feature (1)..( 9): Result.003 file - promoters60/2025006
atatacaca

SEQ ID NO: 124371 - DNA, 7 bp, Unknown
  misc_feature (1)..( 7): Result.003 file - promoters60/2025006
aatcata

SEQ ID NO: 124372 - DNA, 7 bp, Unknown
  misc_feature (1)..( 7): Result.003 file - promoters60/2025006
aattata

SEQ ID NO: 124373 - DNA, 7 bp, Unknown
  misc_feature (1)..( 7): Result.003 file - promoters60/2025006
aatcata

SEQ ID NO: 124374 - DNA, 7 bp, Unknown
  misc_feature (1)..( 7): Result.003 file - promoters60/2025006
gtttgaa

SEQ ID NO: 124375 - DNA, 7 bp, Unknown
  misc_feature (1)..( 7): Result.003 file - promoters60/2025006
atttgaa

SEQ ID NO: 124376 - DNA, 7 bp, Unknown
  misc_feature (1)..( 7): Result.003 file - promoters60/2025006
gttcgaa

SEQ ID NO: 124377 - DNA, 13 bp, Unknown
  misc_feature (1)..( 13): Result.003 file - promoters60/2025006
aatagagaaaacg

SEQ ID NO: 124378 - DNA, 13 bp, Unknown
  misc_feature (1)..( 13): Result.003 file - promoters60/2025006
aatagaaaaaacg

SEQ ID NO: 124379 - DNA, 13 bp, Unknown
  misc_feature (1)..( 13): Result.003 file - promoters60/2025006
aaaggaaaaagcc

SEQ ID NO: 124380 - DNA, 9 bp, Unknown
  misc_feature (1)..( 9): Result.003 file - promoters60/2025006
tctataaaa

SEQ ID NO: 124381 - DNA, 9 bp, Unknown
  misc_feature (1)..( 9): Result.003 file - promoters60/2025006
taaataaaa

SEQ ID NO: 124382 - DNA, 9 bp, Unknown
  misc_feature (1)..( 9): Result.003 file - promoters60/2025006
taaataaat

SEQ ID NO: 124383 - DNA, 9 bp, Unknown
  misc_feature (1)..( 9): Result.003 file - promoters60/2025006
ccaatcata

SEQ ID NO: 124384 - DNA, 9 bp, Unknown
  misc_feature (1)..( 9): Result.003 file - promoters60/2025006
taaataata

SEQ ID NO: 124385 - DNA, 9 bp, Unknown
  misc_feature (1)..( 9): Result.003 file - promoters60/2025006
taaaaaatt

SEQ ID NO: 124386 - DNA, 7 bp, Unknown
  misc_feature (1)..( 7): Result.003 file - promoters60/2025006
gtaaatg

SEQ ID NO: 124387 - DNA, 7 bp, Unknown
  misc_feature (1)..( 7): Result.003 file - promoters60/2025006
gtaaata

SEQ ID NO: 124388 - DNA, 7 bp, Unknown
  misc_feature (1)..( 7): Result.003 file - promoters60/2025006
ataaatg

SEQ ID NO: 124389 - DNA, 16 bp, Unknown
  misc_feature (1)..( 16): Result.003 file - promoters60/2025006
tttaactagtttaata

SEQ ID NO: 124390 - DNA, 16 bp, Unknown
  misc_feature (1)..( 16): Result.003 file - promoters60/2025006
tttgactatttttata

SEQ ID NO: 124391 - DNA, 16 bp, Unknown
  misc_feature (1)..( 16): Result.003 file - promoters60/2025006
tacgggttttttaatt

SEQ ID NO: 124392 - DNA, 8 bp, Unknown
  misc_feature (1)..( 8): Result.003 file - promoters60/2025006
acccaaac

SEQ ID NO: 124393 - DNA, 8 bp, Unknown
  misc_feature (1)..( 8): Result.003 file - promoters60/2025006
accaaaat

SEQ ID NO: 124394 - DNA, 8 bp, Unknown
  misc_feature (1)..( 8): Result.003 file - promoters60/2025006
cacaaaat

SEQ ID NO: 124395 - DNA, 7 bp, Unknown
  misc_feature (1)..( 7): Result.003 file - promoters60/2025133
gggtttt

SEQ ID NO: 124396 - DNA, 7 bp, Unknown
  misc_feature (1)..( 7): Result.003 file - promoters60/2025133
gggattt

SEQ ID NO: 124397 - DNA, 10 bp, Unknown
  misc_feature (1)..( 10): Result.003 file - promoters60/2025133
aaaaaaaaaa

SEQ ID NO: 124398 - DNA, 10 bp, Unknown
  misc_feature (1)..( 10): Result.003 file - promoters60/2025133
aaaaaaaaaa

SEQ ID NO: 124399 - DNA, 7 bp, Unknown
  misc_feature (1)..( 7): Result.003 file - promoters60/2025133
gttgaaa

SEQ ID NO: 124400 - DNA, 7 bp, Unknown
  misc_feature (1)..( 7): Result.003 file - promoters60/2025133
gttcaaa

SEQ ID NO: 124401 - DNA, 6 bp, Unknown
  misc_feature (1)..( 6): Result.003 file - promoters60/2025133
aaaaag

SEQ ID NO: 124402 - DNA, 6 bp, Unknown
  misc_feature (1)..( 6): Result.003 file - promoters60/2025133
aaaaag

SEQ ID NO: 124403 - DNA, 6 bp, Unknown
  misc_feature (1)..( 6): Result.003 file - promoters60/2025133
gcagaa

SEQ ID NO: 124404 - DNA, 6 bp, Unknown
  misc_feature (1)..( 6): Result.003 file - promoters60/2025133
gcagaa

SEQ ID NO: 124405 - DNA, 7 bp, Unknown
  misc_feature (1)..( 7): Result.003 file - promoters60/2025133
tgaatag

SEQ ID NO: 124406 - DNA, 7 bp, Unknown
  misc_feature (1)..( 7): Result.003 file - promoters60/2025133
tgaatag

SEQ ID NO: 124407 - DNA, 7 bp, Unknown
  misc_feature (1)..( 7): Result.003 file - promoters60/2025133
aacgaat

SEQ ID NO: 124408 - DNA, 7 bp, Unknown
  misc_feature (1)..( 7): Result.003 file - promoters60/2025133
aacaaat

SEQ ID NO: 124409 - DNA, 7 bp, Unknown
  misc_feature (1)..( 7): Result.003 file - promoters60/2025133
caaacgt

SEQ ID NO: 124410 - DNA, 7 bp, Unknown
  misc_feature (1)..( 7): Result.003 file - promoters60/2025133
caaccgt

SEQ ID NO: 124411 - DNA, 8 bp, Unknown
  misc_feature (1)..( 8): Result.003 file - promoters60/2025133
ctggagag

SEQ ID NO: 124412 - DNA, 8 bp, Unknown
  misc_feature (1)..( 8): Result.003 file - promoters60/2025133
ctgtagag

SEQ ID NO: 124413 - DNA, 6 bp, Unknown
  misc_feature (1)..( 6): Result.003 file - promoters60/2025133
ttaata

SEQ ID NO: 124414 - DNA, 6 bp, Unknown
  misc_feature (1)..( 6): Result.003 file - promoters60/2025133
ttaata

SEQ ID NO: 124415 - DNA, 6 bp, Unknown
  misc_feature (1)..( 6): Result.003 file - promoters60/2025133
ttaata

SEQ ID NO: 124416 - DNA, 6 bp, Unknown
  misc_feature (1)..( 6): Result.003 file - promoters60/2025133
ttaata

SEQ ID NO: 124417 - DNA, 7 bp, Unknown
  misc_feature (1)..( 7): Result.003 file - promoters60/2025133
tttgaag

SEQ ID NO: 124418 - DNA, 7 bp, Unknown
  misc_feature (1)..( 7): Result.003 file - promoters60/2025133
tttcaag

SEQ ID NO: 124419 - DNA, 8 bp, Unknown
  misc_feature (1)..( 8): Result.003 file - promoters60/2025133
gtttcata

SEQ ID NO: 124420 - DNA, 8 bp, Unknown
  misc_feature (1)..( 8): Result.003 file - promoters60/2025133
gtttaata

SEQ ID NO: 124421 - DNA, 6 bp, Unknown
  misc_feature (1)..( 6): Result.003 file - promoters60/2025133
accaat

SEQ ID NO: 124422 - DNA, 6 bp, Unknown
  misc_feature (1)..( 6): Result.003 file - promoters60/2025133
accaat

SEQ ID NO: 124423 - DNA, 7 bp, Unknown
  misc_feature (1)..( 7): Result.003 file - promoters60/2025133
tctgaac

SEQ ID NO: 124424 - DNA, 7 bp, Unknown
  misc_feature (1)..( 7): Result.003 file - promoters60/2025133
tcttaac

SEQ ID NO: 124425 - DNA, 7 bp, Unknown
  misc_feature (1)..( 7): Result.003 file - promoters60/2025133
tatttta

SEQ ID NO: 124426 - DNA, 7 bp, Unknown
  misc_feature (1)..( 7): Result.003 file - promoters60/2025133
tatttta

SEQ ID NO: 124427 - DNA, 6 bp, Unknown
  misc_feature (1)..( 6): Result.003 file - promoters60/2025133
aaattt

SEQ ID NO: 124428 - DNA, 6 bp, Unknown
  misc_feature (1)..( 6): Result.003 file - promoters60/2025133
aaattt

SEQ ID NO: 124429 - DNA, 8 bp, Unknown
  misc_feature (1)..( 8): Result.003 file - promoters60/2025133
gtgtagaa

SEQ ID NO: 124430 - DNA, 8 bp, Unknown
  misc_feature (1)..( 8): Result.003 file - promoters60/2025133
gtgtagaa

SEQ ID NO: 124431 - DNA, 6 bp, Unknown
  misc_feature (1)..( 6): Result.003 file - promoters60/2025133
aaaata

SEQ ID NO: 124432 - DNA, 6 bp, Unknown
  misc_feature (1)..( 6): Result.003 file - promoters60/2025133
aaaata

SEQ ID NO: 124433 - DNA, 8 bp, Unknown
  misc_feature (1)..( 8): Result.003 file - promoters60/2025133
ttattaac

SEQ ID NO: 124434 - DNA, 8 bp, Unknown
  misc_feature (1)..( 8): Result.003 file - promoters60/2025133
ttattaac

SEQ ID NO: 124435 - DNA, 12 bp, Unknown
  misc_feature (1)..( 12): Result.003 file - promoters60/2025468
cttttgtatttg

SEQ ID NO: 124436 - DNA, 12 bp, Unknown
  misc_feature (1)..( 12): Result.003 file - promoters60/2025468
catttgtacaaa

SEQ ID NO: 124437 - DNA, 12 bp, Unknown
  misc_feature (1)..( 12): Result.003 file - promoters60/2025468
attttgtttttg

SEQ ID NO: 124438 - DNA, 12 bp, Unknown
  misc_feature (1)..( 12): Result.003 file - promoters60/2025468
attttggtgttt

SEQ ID NO: 124439 - DNA, 8 bp, Unknown
  misc_feature (1)..( 8): Result.003 file - promoters60/2025468
tttgttaa

SEQ ID NO: 124440 - DNA, 8 bp, Unknown
  misc_feature (1)..( 8): Result.003 file - promoters60/2025468
tttgtttg

SEQ ID NO: 124441 - DNA, 9 bp, Unknown
  misc_feature (1)..( 9): Result.003 file - promoters60/2025468
tttagttcc

SEQ ID NO: 124442 - DNA, 9 bp, Unknown
  misc_feature (1)..( 9): Result.003 file - promoters60/2025468
ttgacttgt

SEQ ID NO: 124443 - DNA, 6 bp, Unknown
  misc_feature (1)..( 6): Result.003 file - promoters60/2025592
gaagtt

SEQ ID NO: 124444 - DNA, 6 bp, Unknown
  misc_feature (1)..( 6): Result.003 file - promoters60/2025592
gaagtt

SEQ ID NO: 124445 - DNA, 6 bp, Unknown
  misc_feature (1)..( 6): Result.003 file - promoters60/2025592
atatta

SEQ ID NO: 124446 - DNA, 6 bp, Unknown
  misc_feature (1)..( 6): Result.003 file - promoters60/2025592
atatta

SEQ ID NO: 124447 - DNA, 7 bp, Unknown
  misc_feature (1)..( 7): Result.003 file - promoters60/2025592
aatgcat

SEQ ID NO: 124448 - DNA, 7 bp, Unknown
  misc_feature (1)..( 7): Result.003 file - promoters60/2025592
aatacat

SEQ ID NO: 124449 - DNA, 7 bp, Unknown
  misc_feature (1)..( 7): Result.003 file - promoters60/2025592
atgaata

SEQ ID NO: 124450 - DNA, 7 bp, Unknown
  misc_feature (1)..( 7): Result.003 file - promoters60/2025592
atgtata

SEQ ID NO: 124451 - DNA, 9 bp, Unknown
  misc_feature (1)..( 9): Result.003 file - promoters60/2025592
tgtctaaaa

SEQ ID NO: 124452 - DNA, 9 bp, Unknown
  misc_feature (1)..( 9): Result.003 file - promoters60/2025592
tgtttaaaa

SEQ ID NO: 124453 - DNA, 8 bp, Unknown
  misc_feature (1)..( 8): Result.003 file - promoters60/2025592
aaaataaa

SEQ ID NO: 124454 - DNA, 8 bp, Unknown
  misc_feature (1)..( 8): Result.003 file - promoters60/2025592
caaacaaa

SEQ ID NO: 124455 - DNA, 8 bp, Unknown
  misc_feature (1)..( 8): Result.003 file - promoters60/2025592
ataataaa

SEQ ID NO: 124456 - DNA, 7 bp, Unknown
  misc_feature (1)..( 7): Result.003 file - promoters60/2025592
tttaaaa

SEQ ID NO: 124457 - DNA, 7 bp, Unknown
  misc_feature (1)..( 7): Result.003 file - promoters60/2025592
tttcaaa

SEQ ID NO: 124458 - DNA, 7 bp, Unknown
  misc_feature (1)..( 7): Result.003 file - promoters60/2025592
gttttga

SEQ ID NO: 124459 - DNA, 7 bp, Unknown
  misc_feature (1)..( 7): Result.003 file - promoters60/2025592
gttgtga

SEQ ID NO: 124460 - DNA, 7 bp, Unknown
  misc_feature (1)..( 7): Result.003 file - promoters60/2025592
atttttt

SEQ ID NO: 124461 - DNA, 7 bp, Unknown
  misc_feature (1)..( 7): Result.003 file - promoters60/2025592
atttttt

SEQ ID NO: 124462 - DNA, 6 bp, Unknown
  misc_feature (1)..( 6): Result.003 file - promoters60/2025592
tttgat

SEQ ID NO: 124463 - DNA, 6 bp, Unknown
  misc_feature (1)..( 6): Result.003 file - promoters60/2025592
tttgat

SEQ ID NO: 124464 - DNA, 12 bp, Unknown
  misc_feature (1)..( 12): Result.003 file - promoters60/2025592
tcagtaatgttt

SEQ ID NO: 124465 - DNA, 12 bp, Unknown
  misc_feature (1)..( 12): Result.003 file - promoters60/2025592
caattaatattt

SEQ ID NO: 124466 - DNA, 12 bp, Unknown
  misc_feature (1)..( 12): Result.003 file - promoters60/2025592
caaataatattc

SEQ ID NO: 124467 - DNA, 8 bp, Unknown
  misc_feature (1)..( 8): Result.003 file - promoters60/2025592
attctaat

SEQ ID NO: 124468 - DNA, 8 bp, Unknown
  misc_feature (1)..( 8): Result.003 file - promoters60/2025592
attataat

SEQ ID NO: 124469 - DNA, 6 bp, Unknown
  misc_feature (1)..( 6): Result.003 file - promoters60/2025592
ttaatg

SEQ ID NO: 124470 - DNA, 6 bp, Unknown
  misc_feature (1)..( 6): Result.003 file - promoters60/2025592
ttaatg

SEQ ID NO: 124471 - DNA, 6 bp, Unknown
  misc_feature (1)..( 6): Result.003 file - promoters60/2025592
catttc

SEQ ID NO: 124472 - DNA, 6 bp, Unknown
  misc_feature (1)..( 6): Result.003 file - promoters60/2025592
catttc

SEQ ID NO: 124473 - DNA, 8 bp, Unknown
  misc_feature (1)..( 8): Result.003 file - promoters60/2025592
aaacacaa

SEQ ID NO: 124474 - DNA, 8 bp, Unknown
  misc_feature (1)..( 8): Result.003 file - promoters60/2025592
aaagacaa

SEQ ID NO: 124475 - DNA, 7 bp, Unknown
  misc_feature (1)..( 7): Result.003 file - promoters60/2025592
acaaagc

SEQ ID NO: 124476 - DNA, 7 bp, Unknown
  misc_feature (1)..( 7): Result.003 file - promoters60/2025592
acaaagc

SEQ ID NO: 124477 - DNA, 7 bp, Unknown
  misc_feature (1)..( 7): Result.003 file - promoters60/2025592
tgtggtt

SEQ ID NO: 124478 - DNA, 7 bp, Unknown
  misc_feature (1)..( 7): Result.003 file - promoters60/2025592
tgtagtt

SEQ ID NO: 124479 - DNA, 6 bp, Unknown
  misc_feature (1)..( 6): Result.003 file - promoters60/2025592
cgtaaa

SEQ ID NO: 124480 - DNA, 6 bp, Unknown
  misc_feature (1)..( 6): Result.003 file - promoters60/2025592
cgtaaa

SEQ ID NO: 124481 - DNA, 8 bp, Unknown
  misc_feature (1)..( 8): Result.003 file - promoters60/2025592
taaatcaa

SEQ ID NO: 124482 - DNA, 8 bp, Unknown
  misc_feature (1)..( 8): Result.003 file - promoters60/2025592
taaaacaa

SEQ ID NO: 124483 - DNA, 6 bp, Unknown
  misc_feature (1)..( 6): Result.003 file - promoters60/2025592
atattt

SEQ ID NO: 124484 - DNA, 6 bp, Unknown
  misc_feature (1)..( 6): Result.003 file - promoters60/2025592
atattt

SEQ ID NO: 124485 - DNA, 6 bp, Unknown
  misc_feature (1)..( 6): Result.003 file - promoters60/2025592
ttgtat

SEQ ID NO: 124486 - DNA, 6 bp, Unknown
  misc_feature (1)..( 6): Result.003 file - promoters60/2025592
ttgtat

SEQ ID NO: 124487 - DNA, 9 bp, Unknown
  misc_feature (1)..( 9): Result.003 file - promoters60/2025627
cttttgttc

SEQ ID NO: 124488 - DNA, 9 bp, Unknown
  misc_feature (1)..( 9): Result.003 file - promoters60/2025627
atttttttc

SEQ ID NO: 124489 - DNA, 9 bp, Unknown
  misc_feature (1)..( 9): Result.003 file - promoters60/2025627
atttattta

SEQ ID NO: 124490 - DNA, 7 bp, Unknown
  misc_feature (1)..( 7): Result.003 file - promoters60/2025627
ttataat

SEQ ID NO: 124491 - DNA, 7 bp, Unknown
  misc_feature (1)..( 7): Result.003 file - promoters60/2025627
ttagaat

SEQ ID NO: 124492 - DNA, 8 bp, Unknown
  misc_feature (1)..( 8): Result.003 file - promoters60/2025627
tttcttat

SEQ ID NO: 124493 - DNA, 8 bp, Unknown
  misc_feature (1)..( 8): Result.003 file - promoters60/2025627
tttattat

SEQ ID NO: 124494 - DNA, 9 bp, Unknown
  misc_feature (1)..( 9): Result.003 file - promoters60/2025627
aataataaa

SEQ ID NO: 124495 - DNA, 9 bp, Unknown
  misc_feature (1)..( 9): Result.003 file - promoters60/2025627
attaaaaaa

SEQ ID NO: 124496 - DNA, 9 bp, Unknown
  misc_feature (1)..( 9): Result.003 file - promoters60/2025627
attagaaat

SEQ ID NO: 124497 - DNA, 7 bp, Unknown
  misc_feature (1)..( 7): Result.003 file - promoters60/2025627
atcatgc

SEQ ID NO: 124498 - DNA, 7 bp, Unknown
  misc_feature (1)..( 7): Result.003 file - promoters60/2025627
atcatgc

SEQ ID NO: 124499 - DNA, 6 bp, Unknown
  misc_feature (1)..( 6): Result.003 file - promoters60/2025627
tcacat

SEQ ID NO: 124500 - DNA, 6 bp, Unknown
  misc_feature (1)..( 6): Result.003 file - promoters60/2025627
tcacat

SEQ ID NO: 124501 - DNA, 7 bp, Unknown
  misc_feature (1)..( 7): Result.003 file - promoters60/2025627
aagtaaa

SEQ ID NO: 124502 - DNA, 7 bp, Unknown
  misc_feature (1)..( 7): Result.003 file - promoters60/2025627
aagtaaa

SEQ ID NO: 124503 - DNA, 8 bp, Unknown
  misc_feature (1)..( 8): Result.003 file - promoters60/2025627
ttttcttt

SEQ ID NO: 124504 - DNA, 8 bp, Unknown
  misc_feature (1)..( 8): Result.003 file - promoters60/2025627
atttattt

SEQ ID NO: 124505 - DNA, 8 bp, Unknown
  misc_feature (1)..( 8): Result.003 file - promoters60/2025627
attttttt

SEQ ID NO: 124506 - DNA, 6 bp, Unknown
  misc_feature (1)..( 6): Result.003 file - promoters60/2025627
ttttac

SEQ ID NO: 124507 - DNA, 6 bp, Unknown
  misc_feature (1)..( 6): Result.003 file - promoters60/2025627
ttttac

SEQ ID NO: 124508 - DNA, 10 bp, Unknown
  misc_feature (1)..( 10): Result.003 file - promoters60/2025627
taattttttt

SEQ ID NO: 124509 - DNA, 10 bp, Unknown
  misc_feature (1)..( 10): Result.003 file - promoters60/2025627
taatattttt

SEQ ID NO: 124510 - DNA, 10 bp, Unknown
  misc_feature (1)..( 10): Result.003 file - promoters60/2025627
gaatattacg

SEQ ID NO: 124511 - DNA, 8 bp, Unknown
  misc_feature (1)..( 8): Result.003 file - promoters60/2025627
attcactt

SEQ ID NO: 124512 - DNA, 8 bp, Unknown
  misc_feature (1)..( 8): Result.003 file - promoters60/2025627
atttactt

SEQ ID NO: 124513 - DNA, 7 bp, Unknown
  misc_feature (1)..( 7): Result.003 file - promoters60/2025627
aaataat

SEQ ID NO: 124514 - DNA, 7 bp, Unknown
  misc_feature (1)..( 7): Result.003 file - promoters60/2025627
aaacaat

SEQ ID NO: 124515 - DNA, 9 bp, Unknown
  misc_feature (1)..( 9): Result.003 file - promoters60/2025627
tttatctaa

SEQ ID NO: 124516 - DNA, 9 bp, Unknown
  misc_feature (1)..( 9): Result.003 file - promoters60/2025627
tttttctaa

SEQ ID NO: 124517 - DNA, 8 bp, Unknown
  misc_feature (1)..( 8): Result.003 file - promoters60/2025627
taattcat

SEQ ID NO: 124518 - DNA, 8 bp, Unknown
  misc_feature (1)..( 8): Result.003 file - promoters60/2025627
taattcat

SEQ ID NO: 124519 - DNA, 7 bp, Unknown
  misc_feature (1)..( 7): Result.003 file - promoters60/2025627
aatttct

SEQ ID NO: 124520 - DNA, 7 bp, Unknown
  misc_feature (1)..( 7): Result.003 file - promoters60/2025627
aatctct

SEQ ID NO: 124521 - DNA, 8 bp, Unknown
  misc_feature (1)..( 8): Result.003 file - promoters60/2025627
tcttttca

SEQ ID NO: 124522 - DNA, 8 bp, Unknown
  misc_feature (1)..( 8): Result.003 file - promoters60/2025627
tcttttca

SEQ ID NO: 124523 - DNA, 6 bp, Unknown
  misc_feature (1)..( 6): Result.003 file - promoters60/2025627
tttcag

SEQ ID NO: 124524 - DNA, 6 bp, Unknown
  misc_feature (1)..( 6): Result.003 file - promoters60/2025627
tttcag

SEQ ID NO: 124525 - DNA, 7 bp, Unknown
  misc_feature (1)..( 7): Result.003 file - promoters60/2025627
aaatatt

SEQ ID NO: 124526 - DNA, 7 bp, Unknown
  misc_feature (1)..( 7): Result.003 file - promoters60/2025627
aaatatt

SEQ ID NO: 124527 - DNA, 11 bp, Unknown
  misc_feature (1)..( 11): Result.003 file - promoters60/2025627
tactgttttag

SEQ ID NO: 124528 - DNA, 11 bp, Unknown
  misc_feature (1)..( 11): Result.003 file - promoters60/2025627
tactgtattag

SEQ ID NO: 124529 - DNA, 6 bp, Unknown
  misc_feature (1)..( 6): Result.003 file - promoters60/2025627
tataat

SEQ ID NO: 124530 - DNA, 6 bp, Unknown
  misc_feature (1)..( 6): Result.003 file - promoters60/2025627
tataat

SEQ ID NO: 124531 - DNA, 8 bp, Unknown
  misc_feature (1)..( 8): Result.003 file - promoters60/2025627
taatatta

SEQ ID NO: 124532 - DNA, 8 bp, Unknown
  misc_feature (1)..( 8): Result.003 file - promoters60/2025627
taatctta

SEQ ID NO: 124533 - DNA, 7 bp, Unknown
  misc_feature (1)..( 7): Result.003 file - promoters60/2026537
ttttgta

SEQ ID NO: 124534 - DNA, 7 bp, Unknown
  misc_feature (1)..( 7): Result.003 file - promoters60/2026537
tttggta

SEQ ID NO: 124535 - DNA, 6 bp, Unknown
  misc_feature (1)..( 6): Result.003 file - promoters60/2026537
acaaat

SEQ ID NO: 124536 - DNA, 6 bp, Unknown
  misc_feature (1)..( 6): Result.003 file - promoters60/2026537
acaaat

SEQ ID NO: 124537 - DNA, 7 bp, Unknown
  misc_feature (1)..( 7): Result.003 file - promoters60/2026537
tggcatt

SEQ ID NO: 124538 - DNA, 7 bp, Unknown
  misc_feature (1)..( 7): Result.003 file - promoters60/2026537
tggaatt

SEQ ID NO: 124539 - DNA, 6 bp, Unknown
  misc_feature (1)..( 6): Result.003 file - promoters60/2026537
ttcggt

SEQ ID NO: 124540 - DNA, 6 bp, Unknown
  misc_feature (1)..( 6): Result.003 file - promoters60/2026537
ttcggt

SEQ ID NO: 124541 - DNA, 8 bp, Unknown
  misc_feature (1)..( 8): Result.003 file - promoters60/2026537
aggacgat

SEQ ID NO: 124542 - DNA, 8 bp, Unknown
  misc_feature (1)..( 8): Result.003 file - promoters60/2026537
aggtcgat

SEQ ID NO: 124543 - DNA, 11 bp, Unknown
  misc_feature (1)..( 11): Result.003 file - promoters60/2026771
aaattgtaatt

SEQ ID NO: 124544 - DNA, 11 bp, Unknown
  misc_feature (1)..( 11): Result.003 file - promoters60/2026771
acattataaaa

SEQ ID NO: 124545 - DNA, 11 bp, Unknown
  misc_feature (1)..( 11): Result.003 file - promoters60/2026771
ttgttgttatt

SEQ ID NO: 124546 - DNA, 11 bp, Unknown
  misc_feature (1)..( 11): Result.003 file - promoters60/2026771
taattgtataa

SEQ ID NO: 124547 - DNA, 11 bp, Unknown
  misc_feature (1)..( 11): Result.003 file - promoters60/2026771
aaaatgtaaat

SEQ ID NO: 124548 - DNA, 11 bp, Unknown
  misc_feature (1)..( 11): Result.003 file - promoters60/2026771
tttttataatc

SEQ ID NO: 124549 - DNA, 12 bp, Unknown
  misc_feature (1)..( 12): Result.003 file - promoters60/2026771
cataaaaaatat

SEQ ID NO: 124550 - DNA, 12 bp, Unknown
  misc_feature (1)..( 12): Result.003 file - promoters60/2026771
tttaaaaaaaga

SEQ ID NO: 124551 - DNA, 12 bp, Unknown
  misc_feature (1)..( 12): Result.003 file - promoters60/2026771
tctaaaaagtta

SEQ ID NO: 124552 - DNA, 12 bp, Unknown
  misc_feature (1)..( 12): Result.003 file - promoters60/2026771
attagaaacaga

SEQ ID NO: 124553 - DNA, 12 bp, Unknown
  misc_feature (1)..( 12): Result.003 file - promoters60/2026771
tttataaacaag

SEQ ID NO: 124554 - DNA, 12 bp, Unknown
  misc_feature (1)..( 12): Result.003 file - promoters60/2026771
attacaaatatg

SEQ ID NO: 124555 - DNA, 17 bp, Unknown
  misc_feature (1)..( 17): Result.003 file - promoters60/2026771
gaggggttaaattggtt

SEQ ID NO: 124556 - DNA, 17 bp, Unknown
  misc_feature (1)..( 17): Result.003 file - promoters60/2026771
ataacccaaaattgacc

SEQ ID NO: 124557 - DNA, 17 bp, Unknown
  misc_feature (1)..( 17): Result.003 file - promoters60/2026771
aaatcgtaaaattccca

SEQ ID NO: 124558 - DNA, 17 bp, Unknown
  misc_feature (1)..( 17): Result.003 file - promoters60/2026771
aaatcgtaaaatttttg

SEQ ID NO: 124559 - DNA, 17 bp, Unknown
  misc_feature (1)..( 17): Result.003 file - promoters60/2026771
ttcaaattaaatcatat

SEQ ID NO: 124560 - DNA, 17 bp, Unknown
  misc_feature (1)..( 17): Result.003 file - promoters60/2026771
tcttctatgtatttaat

SEQ ID NO: 124561 - DNA, 12 bp, Unknown
  misc_feature (1)..( 12): Result.003 file - promoters60/2026771
aattttgtaaat

SEQ ID NO: 124562 - DNA, 12 bp, Unknown
  misc_feature (1)..( 12): Result.003 file - promoters60/2026771
ctttttataatc

SEQ ID NO: 124563 - DNA, 12 bp, Unknown
  misc_feature (1)..( 12): Result.003 file - promoters60/2026771
aattttgtttca

SEQ ID NO: 124564 - DNA, 12 bp, Unknown
  misc_feature (1)..( 12): Result.003 file - promoters60/2026771
caaaatgtaaat

SEQ ID NO: 124565 - DNA, 12 bp, Unknown
  misc_feature (1)..( 12): Result.003 file - promoters60/2026771
ggtttggtttct

SEQ ID NO: 124566 - DNA, 12 bp, Unknown
  misc_feature (1)..( 12): Result.003 file - promoters60/2026771
gacattataaaa

SEQ ID NO: 124567 - DNA, 12 bp, Unknown
  misc_feature (1)..( 12): Result.003 file - promoters60/2026771
aaattttgtaaa

SEQ ID NO: 124568 - DNA, 12 bp, Unknown
  misc_feature (1)..( 12): Result.003 file - promoters60/2026771
aaatttattgtt

SEQ ID NO: 124569 - DNA, 12 bp, Unknown
  misc_feature (1)..( 12): Result.003 file - promoters60/2026771
taattttgtttc

SEQ ID NO: 124570 - DNA, 12 bp, Unknown
  misc_feature (1)..( 12): Result.003 file - promoters60/2026771
gggtttggtttc

SEQ ID NO: 124571 - DNA, 12 bp, Unknown
  misc_feature (1)..( 12): Result.003 file - promoters60/2026771
ctatttatttcc

SEQ ID NO: 124572 - DNA, 12 bp, Unknown
  misc_feature (1)..( 12): Result.003 file - promoters60/2026771
taatttcaaaat

SEQ ID NO: 124573 - DNA, 8 bp, Unknown
  misc_feature (1)..( 8): Result.003 file - promoters60/2027233
atcaattt

SEQ ID NO: 124574 - DNA, 8 bp, Unknown
  misc_feature (1)..( 8): Result.003 file - promoters60/2027233
atcaatcc

SEQ ID NO: 124575 - DNA, 8 bp, Unknown
  misc_feature (1)..( 8): Result.003 file - promoters60/2027233
ttcaatcc

SEQ ID NO: 124576 - DNA, 8 bp, Unknown
  misc_feature (1)..( 8): Result.003 file - promoters60/2027233
ttcaatag

SEQ ID NO: 124577 - DNA, 8 bp, Unknown
  misc_feature (1)..( 8): Result.003 file - promoters60/2027233
ttcaataa

SEQ ID NO: 124578 - DNA, 8 bp, Unknown
  misc_feature (1)..( 8): Result.003 file - promoters60/2027233
ttcaatcc

SEQ ID NO: 124579 - DNA, 8 bp, Unknown
  misc_feature (1)..( 8): Result.003 file - promoters60/2027233
ttcaatag

SEQ ID NO: 124580 - DNA, 8 bp, Unknown
  misc_feature (1)..( 8): Result.003 file - promoters60/2027233
atcaatcc

SEQ ID NO: 124581 - DNA, 13 bp, Unknown
  misc_feature (1)..( 13): Result.003 file - promoters60/2027233
aagtatttgatat

SEQ ID NO: 124582 - DNA, 13 bp, Unknown
  misc_feature (1)..( 13): Result.003 file - promoters60/2027233
tgagattggattt

SEQ ID NO: 124583 - DNA, 13 bp, Unknown
  misc_feature (1)..( 13): Result.003 file - promoters60/2027233
tttgatttgattt

SEQ ID NO: 124584 - DNA, 13 bp, Unknown
  misc_feature (1)..( 13): Result.003 file - promoters60/2027233
tgaaattagatcg

SEQ ID NO: 124585 - DNA, 17 bp, Unknown
  misc_feature (1)..( 17): Result.003 file - promoters60/2027233
gacaagtttttatgttt

SEQ ID NO: 124586 - DNA, 17 bp, Unknown
  misc_feature (1)..( 17): Result.003 file - promoters60/2027233
tgaaagtctttttgttt

SEQ ID NO: 124587 - DNA, 17 bp, Unknown
  misc_feature (1)..( 17): Result.003 file - promoters60/2027233
gacaagtttcctctacc

SEQ ID NO: 124588 - DNA, 17 bp, Unknown
  misc_feature (1)..( 17): Result.003 file - promoters60/2027233
ccgatgtgtaggatcgg

SEQ ID NO: 124589 - DNA, 6 bp, Unknown
  misc_feature (1)..( 6): Result.003 file - promoters60/2027253
aataag

SEQ ID NO: 124590 - DNA, 6 bp, Unknown
  misc_feature (1)..( 6): Result.003 file - promoters60/2027253
aataag

SEQ ID NO: 124591 - DNA, 9 bp, Unknown
  misc_feature (1)..( 9): Result.003 file - promoters60/2027253
aaaataaat

SEQ ID NO: 124592 - DNA, 9 bp, Unknown
  misc_feature (1)..( 9): Result.003 file - promoters60/2027253
aaaatgaat

SEQ ID NO: 124593 - DNA, 9 bp, Unknown
  misc_feature (1)..( 9): Result.003 file - promoters60/2027253
aaaaaaaag

SEQ ID NO: 124594 - DNA, 6 bp, Unknown
  misc_feature (1)..( 6): Result.003 file - promoters60/2027253
taattg

SEQ ID NO: 124595 - DNA, 6 bp, Unknown
  misc_feature (1)..( 6): Result.003 file - promoters60/2027253
taattg

SEQ ID NO: 124596 - DNA, 6 bp, Unknown
  misc_feature (1)..( 6): Result.003 file - promoters60/2027253
aaccgt

SEQ ID NO: 124597 - DNA, 6 bp, Unknown
  misc_feature (1)..( 6): Result.003 file - promoters60/2027253
aaccgt

SEQ ID NO: 124598 - DNA, 8 bp, Unknown
  misc_feature (1)..( 8): Result.003 file - promoters60/2027253
ttttaaat

SEQ ID NO: 124599 - DNA, 8 bp, Unknown
  misc_feature (1)..( 8): Result.003 file - promoters60/2027253
tttaaaat

SEQ ID NO: 124600 - DNA, 8 bp, Unknown
  misc_feature (1)..( 8): Result.003 file - promoters60/2027253
tcagttaa

SEQ ID NO: 124601 - DNA, 8 bp, Unknown
  misc_feature (1)..( 8): Result.003 file - promoters60/2027253
tcaattaa

SEQ ID NO: 124602 - DNA, 6 bp, Unknown
  misc_feature (1)..( 6): Result.003 file - promoters60/2027253
tcatgt

SEQ ID NO: 124603 - DNA, 6 bp, Unknown
  misc_feature (1)..( 6): Result.003 file - promoters60/2027253
tcatgt

SEQ ID NO: 124604 - DNA, 8 bp, Unknown
  misc_feature (1)..( 8): Result.003 file - promoters60/2027253
taaacgca

SEQ ID NO: 124605 - DNA, 8 bp, Unknown
  misc_feature (1)..( 8): Result.003 file - promoters60/2027253
taaaagca

SEQ ID NO: 124606 - DNA, 7 bp, Unknown
  misc_feature (1)..( 7): Result.003 file - promoters60/2027253
catttta

SEQ ID NO: 124607 - DNA, 7 bp, Unknown
  misc_feature (1)..( 7): Result.003 file - promoters60/2027253
catatta

SEQ ID NO: 124608 - DNA, 6 bp, Unknown
  misc_feature (1)..( 6): Result.003 file - promoters60/2027253
gataag

SEQ ID NO: 124609 - DNA, 6 bp, Unknown
  misc_feature (1)..( 6): Result.003 file - promoters60/2027253
gataag

SEQ ID NO: 124610 - DNA, 6 bp, Unknown
  misc_feature (1)..( 6): Result.003 file - promoters60/2027253
actaaa

SEQ ID NO: 124611 - DNA, 6 bp, Unknown
  misc_feature (1)..( 6): Result.003 file - promoters60/2027253
actaaa

SEQ ID NO: 124612 - DNA, 8 bp, Unknown
  misc_feature (1)..( 8): Result.003 file - promoters60/2027253
tttttaac

SEQ ID NO: 124613 - DNA, 8 bp, Unknown
  misc_feature (1)..( 8): Result.003 file - promoters60/2027253
tttctaac

SEQ ID NO: 124614 - DNA, 6 bp, Unknown
  misc_feature (1)..( 6): Result.003 file - promoters60/2027253
atacaa

SEQ ID NO: 124615 - DNA, 6 bp, Unknown
  misc_feature (1)..( 6): Result.003 file - promoters60/2027253
atacaa

SEQ ID NO: 124616 - DNA, 6 bp, Unknown
  misc_feature (1)..( 6): Result.003 file - promoters60/2027253
tatata

SEQ ID NO: 124617 - DNA, 6 bp, Unknown
  misc_feature (1)..( 6): Result.003 file - promoters60/2027253
tatata

SEQ ID NO: 124618 - DNA, 6 bp, Unknown
  misc_feature (1)..( 6): Result.003 file - promoters60/2027268
ttaaca

SEQ ID NO: 124619 - DNA, 6 bp, Unknown
  misc_feature (1)..( 6): Result.003 file - promoters60/2027268
ttaaca

SEQ ID NO: 124620 - DNA, 7 bp, Unknown
  misc_feature (1)..( 7): Result.003 file - promoters60/2027268
caatttt

SEQ ID NO: 124621 - DNA, 7 bp, Unknown
  misc_feature (1)..( 7): Result.003 file - promoters60/2027268
caatttt

SEQ ID NO: 124622 - DNA, 11 bp, Unknown
  misc_feature (1)..( 11): Result.003 file - promoters60/2027268
ttttgctaaaa

SEQ ID NO: 124623 - DNA, 11 bp, Unknown
  misc_feature (1)..( 11): Result.003 file - promoters60/2027268
tttttctaaaa

SEQ ID NO: 124624 - DNA, 11 bp, Unknown
  misc_feature (1)..( 11): Result.003 file - promoters60/2027268
atctgctaatg

SEQ ID NO: 124625 - DNA, 8 bp, Unknown
  misc_feature (1)..( 8): Result.003 file - promoters60/2027268
agattact

SEQ ID NO: 124626 - DNA, 8 bp, Unknown
  misc_feature (1)..( 8): Result.003 file - promoters60/2027268
agattact

SEQ ID NO: 124627 - DNA, 7 bp, Unknown
  misc_feature (1)..( 7): Result.003 file - promoters60/2027268
tttgatt

SEQ ID NO: 124628 - DNA, 7 bp, Unknown
  misc_feature (1)..( 7): Result.003 file - promoters60/2027268
tttgatt

SEQ ID NO: 124629 - DNA, 7 bp, Unknown
  misc_feature (1)..( 7): Result.003 file - promoters60/2027268
taaaaga

SEQ ID NO: 124630 - DNA, 7 bp, Unknown
  misc_feature (1)..( 7): Result.003 file - promoters60/2027268
taaaaga

SEQ ID NO: 124631 - DNA, 10 bp, Unknown
  misc_feature (1)..( 10): Result.003 file - promoters60/2027268
aacagaataa

SEQ ID NO: 124632 - DNA, 10 bp, Unknown
  misc_feature (1)..( 10): Result.003 file - promoters60/2027268
aacagagtaa

SEQ ID NO: 124633 - DNA, 8 bp, Unknown
  misc_feature (1)..( 8): Result.003 file - promoters60/2027268
ccggatcg

SEQ ID NO: 124634 - DNA, 8 bp, Unknown
  misc_feature (1)..( 8): Result.003 file - promoters60/2027268
ccggttcg

SEQ ID NO: 124635 - DNA, 8 bp, Unknown
  misc_feature (1)..( 8): Result.003 file - promoters60/2027268
accctaga

SEQ ID NO: 124636 - DNA, 8 bp, Unknown
  misc_feature (1)..( 8): Result.003 file - promoters60/2027268
accgtaga

SEQ ID NO: 124637 - DNA, 7 bp, Unknown
  misc_feature (1)..( 7): Result.003 file - promoters60/2027268
agagaca

SEQ ID NO: 124638 - DNA, 7 bp, Unknown
  misc_feature (1)..( 7): Result.003 file - promoters60/2027268
agataca

SEQ ID NO: 124639 - DNA, 6 bp, Unknown
  misc_feature (1)..( 6): Result.003 file - promoters60/2027268
attata

SEQ ID NO: 124640 - DNA, 6 bp, Unknown
  misc_feature (1)..( 6): Result.003 file - promoters60/2027268
attata

SEQ ID NO: 124641 - DNA, 7 bp, Unknown
  misc_feature (1)..( 7): Result.003 file - promoters60/2027268
tttaaag

SEQ ID NO: 124642 - DNA, 7 bp, Unknown
  misc_feature (1)..( 7): Result.003 file - promoters60/2027268
tttcaag

SEQ ID NO: 124643 - DNA, 13 bp, Unknown
  misc_feature (1)..( 13): Result.003 file - promoters60/2027268
ttgaatcaatatt

SEQ ID NO: 124644 - DNA, 13 bp, Unknown
  misc_feature (1)..( 13): Result.003 file - promoters60/2027268
ttgattcaaaatt

SEQ ID NO: 124645 - DNA, 7 bp, Unknown
  misc_feature (1)..( 7): Result.003 file - promoters60/2027268
tggattt

SEQ ID NO: 124646 - DNA, 7 bp, Unknown
  misc_feature (1)..( 7): Result.003 file - promoters60/2027268
tggattt

SEQ ID NO: 124647 - DNA, 6 bp, Unknown
  misc_feature (1)..( 6): Result.003 file - promoters60/2027268
aagatt

SEQ ID NO: 124648 - DNA, 6 bp, Unknown
  misc_feature (1)..( 6): Result.003 file - promoters60/2027268
aagatt

SEQ ID NO: 124649 - DNA, 6 bp, Unknown
  misc_feature (1)..( 6): Result.003 file - promoters60/2027268
ttggtt

SEQ ID NO: 124650 - DNA, 6 bp, Unknown
  misc_feature (1)..( 6): Result.003 file - promoters60/2027268
ttggtt

SEQ ID NO: 124651 - DNA, 6 bp, Unknown
  misc_feature (1)..( 6): Result.003 file - promoters60/2027268
ttaacc

SEQ ID NO: 124652 - DNA, 6 bp, Unknown
  misc_feature (1)..( 6): Result.003 file - promoters60/2027268
ttaacc

SEQ ID NO: 124653 - DNA, 7 bp, Unknown
  misc_feature (1)..( 7): Result.003 file - promoters60/2027268
ctcactc

SEQ ID NO: 124654 - DNA, 7 bp, Unknown
  misc_feature (1)..( 7): Result.003 file - promoters60/2027268
ctcgctc

SEQ ID NO: 124655 - DNA, 6 bp, Unknown
  misc_feature (1)..( 6): Result.003 file - promoters60/2027268
atttct

SEQ ID NO: 124656 - DNA, 6 bp, Unknown
  misc_feature (1)..( 6): Result.003 file - promoters60/2027268
atttct

SEQ ID NO: 124657 - DNA, 7 bp, Unknown
  misc_feature (1)..( 7): Result.003 file - promoters60/2028945
ttgaaat

SEQ ID NO: 124658 - DNA, 7 bp, Unknown
  misc_feature (1)..( 7): Result.003 file - promoters60/2028945
ttgaaat

SEQ ID NO: 124659 - DNA, 7 bp, Unknown
  misc_feature (1)..( 7): Result.003 file - promoters60/2028945
ctgaaat

SEQ ID NO: 124660 - DNA, 13 bp, Unknown
  misc_feature (1)..( 13): Result.003 file - promoters60/2028945
taaaaatttaaat

SEQ ID NO: 124661 - DNA, 13 bp, Unknown
  misc_feature (1)..( 13): Result.003 file - promoters60/2028945
taaatatttaaat

SEQ ID NO: 124662 - DNA, 13 bp, Unknown
  misc_feature (1)..( 13): Result.003 file - promoters60/2028945
agcagttttaaaa

SEQ ID NO: 124663 - DNA, 6 bp, Unknown
  misc_feature (1)..( 6): Result.003 file - promoters60/2028945
cataaa

SEQ ID NO: 124664 - DNA, 6 bp, Unknown
  misc_feature (1)..( 6): Result.003 file - promoters60/2028945
cataaa

SEQ ID NO: 124665 - DNA, 7 bp, Unknown
  misc_feature (1)..( 7): Result.003 file - promoters60/2028945
cattaaa

SEQ ID NO: 124666 - DNA, 7 bp, Unknown
  misc_feature (1)..( 7): Result.003 file - promoters60/2028945
atgaata

SEQ ID NO: 124667 - DNA, 7 bp, Unknown
  misc_feature (1)..( 7): Result.003 file - promoters60/2028945
atgcata

SEQ ID NO: 124668 - DNA, 8 bp, Unknown
  misc_feature (1)..( 8): Result.003 file - promoters60/2028945
tatgaaaa

SEQ ID NO: 124669 - DNA, 8 bp, Unknown
  misc_feature (1)..( 8): Result.003 file - promoters60/2028945
tatgaaaa

SEQ ID NO: 124670 - DNA, 7 bp, Unknown
  misc_feature (1)..( 7): Result.003 file - promoters60/2028945
atactat

SEQ ID NO: 124671 - DNA, 7 bp, Unknown
  misc_feature (1)..( 7): Result.003 file - promoters60/2028945
atagtat

SEQ ID NO: 124672 - DNA, 9 bp, Unknown
  misc_feature (1)..( 9): Result.003 file - promoters60/2028945
aacatttat

SEQ ID NO: 124673 - DNA, 9 bp, Unknown
  misc_feature (1)..( 9): Result.003 file - promoters60/2028945
aacatttat

SEQ ID NO: 124674 - DNA, 8 bp, Unknown
  misc_feature (1)..( 8): Result.003 file - promoters60/2028945
tttaattt

SEQ ID NO: 124675 - DNA, 8 bp, Unknown
  misc_feature (1)..( 8): Result.003 file - promoters60/2028945
attatttt

SEQ ID NO: 124676 - DNA, 8 bp, Unknown
  misc_feature (1)..( 8): Result.003 file - promoters60/2028945
tttaattt

SEQ ID NO: 124677 - DNA, 8 bp, Unknown
  misc_feature (1)..( 8): Result.003 file - promoters60/2028945
ttaatgca

SEQ ID NO: 124678 - DNA, 8 bp, Unknown
  misc_feature (1)..( 8): Result.003 file - promoters60/2028945
ttaaagca

SEQ ID NO: 124679 - DNA, 6 bp, Unknown
  misc_feature (1)..( 6): Result.003 file - promoters60/2028945
gttaaa

SEQ ID NO: 124680 - DNA, 6 bp, Unknown
  misc_feature (1)..( 6): Result.003 file - promoters60/2028945
gttaaa

SEQ ID NO: 124681 - DNA, 8 bp, Unknown
  misc_feature (1)..( 8): Result.003 file - promoters60/2028945
ttttgttt

SEQ ID NO: 124682 - DNA, 8 bp, Unknown
  misc_feature (1)..( 8): Result.003 file - promoters60/2028945
ttttattt

SEQ ID NO: 124683 - DNA, 8 bp, Unknown
  misc_feature (1)..( 8): Result.003 file - promoters60/2028945
ctctcaat

SEQ ID NO: 124684 - DNA, 8 bp, Unknown
  misc_feature (1)..( 8): Result.003 file - promoters60/2028945
atcttaat

SEQ ID NO: 124685 - DNA, 8 bp, Unknown
  misc_feature (1)..( 8): Result.003 file - promoters60/2028945
atcataat

SEQ ID NO: 124686 - DNA, 6 bp, Unknown
  misc_feature (1)..( 6): Result.003 file - promoters60/2028945
tttttc

SEQ ID NO: 124687 - DNA, 6 bp, Unknown
  misc_feature (1)..( 6): Result.003 file - promoters60/2028945
tttttc

SEQ ID NO: 124688 - DNA, 6 bp, Unknown
  misc_feature (1)..( 6): Result.003 file - promoters60/2028945
ttaatt

SEQ ID NO: 124689 - DNA, 6 bp, Unknown
  misc_feature (1)..( 6): Result.003 file - promoters60/2028945
ttaatt

SEQ ID NO: 124690 - DNA, 8 bp, Unknown
  misc_feature (1)..( 8): Result.003 file - promoters60/2028945
aaaaatta

SEQ ID NO: 124691 - DNA, 8 bp, Unknown
  misc_feature (1)..( 8): Result.003 file - promoters60/2028945
aaacatta

SEQ ID NO: 124692 - DNA, 8 bp, Unknown
  misc_feature (1)..( 8): Result.003 file - promoters60/2028945
gaacttta

SEQ ID NO: 124693 - DNA, 6 bp, Unknown
  misc_feature (1)..( 6): Result.003 file - promoters60/2028945
atcact

SEQ ID NO: 124694 - DNA, 6 bp, Unknown
  misc_feature (1)..( 6): Result.003 file - promoters60/2028945
atcact

SEQ ID NO: 124695 - DNA, 8 bp, Unknown
  misc_feature (1)..( 8): Result.003 file - promoters60/2028945
aaaatttt

SEQ ID NO: 124696 - DNA, 8 bp, Unknown
  misc_feature (1)..( 8): Result.003 file - promoters60/2028945
aaaacttt

SEQ ID NO: 124697 - DNA, 7 bp, Unknown
  misc_feature (1)..( 7): Result.003 file - promoters60/2028945
tttttaa

SEQ ID NO: 124698 - DNA, 7 bp, Unknown
  misc_feature (1)..( 7): Result.003 file - promoters60/2028945
tttataa

SEQ ID NO: 124699 - DNA, 6 bp, Unknown
  misc_feature (1)..( 6): Result.003 file - promoters60/2028945
taacac

SEQ ID NO: 124700 - DNA, 6 bp, Unknown
  misc_feature (1)..( 6): Result.003 file - promoters60/2028945
taacac

SEQ ID NO: 124701 - DNA, 6 bp, Unknown
  misc_feature (1)..( 6): Result.003 file - promoters60/2028945
accaat

SEQ ID NO: 124702 - DNA, 6 bp, Unknown
  misc_feature (1)..( 6): Result.003 file - promoters60/2028945
accaat

SEQ ID NO: 124703 - DNA, 8 bp, Unknown
  misc_feature (1)..( 8): Result.003 file - promoters60/2028985
ttttggaa

SEQ ID NO: 124704 - DNA, 8 bp, Unknown
  misc_feature (1)..( 8): Result.003 file - promoters60/2028985
ttttagaa

SEQ ID NO: 124705 - DNA, 6 bp, Unknown
  misc_feature (1)..( 6): Result.003 file - promoters60/2028985
tttaat

SEQ ID NO: 124706 - DNA, 6 bp, Unknown
  misc_feature (1)..( 6): Result.003 file - promoters60/2028985
tttaat

SEQ ID NO: 124707 - DNA, 7 bp, Unknown
  misc_feature (1)..( 7): Result.003 file - promoters60/2028985
tgaattc

SEQ ID NO: 124708 - DNA, 7 bp, Unknown
  misc_feature (1)..( 7): Result.003 file - promoters60/2028985
tgatttc

SEQ ID NO: 124709 - DNA, 10 bp, Unknown
  misc_feature (1)..( 10): Result.003 file - promoters60/2028985
gtttagtgaa

SEQ ID NO: 124710 - DNA, 10 bp, Unknown
  misc_feature (1)..( 10): Result.003 file - promoters60/2028985
gttttgtgaa

SEQ ID NO: 124711 - DNA, 6 bp, Unknown
  misc_feature (1)..( 6): Result.003 file - promoters60/2028985
aagtaa

SEQ ID NO: 124712 - DNA, 6 bp, Unknown
  misc_feature (1)..( 6): Result.003 file - promoters60/2028985
aagtaa

SEQ ID NO: 124713 - DNA, 7 bp, Unknown
  misc_feature (1)..( 7): Result.003 file - promoters60/2028985
taacaag

SEQ ID NO: 124714 - DNA, 7 bp, Unknown
  misc_feature (1)..( 7): Result.003 file - promoters60/2028985
taaaaag

SEQ ID NO: 124715 - DNA, 11 bp, Unknown
  misc_feature (1)..( 11): Result.003 file - promoters60/2028985
tgatgaattga

SEQ ID NO: 124716 - DNA, 11 bp, Unknown
  misc_feature (1)..( 11): Result.003 file - promoters60/2028985
tgatgacttga

SEQ ID NO: 124717 - DNA, 7 bp, Unknown
  misc_feature (1)..( 7): Result.003 file - promoters60/2028985
gtgaatg

SEQ ID NO: 124718 - DNA, 7 bp, Unknown
  misc_feature (1)..( 7): Result.003 file - promoters60/2028985
gtggatg

SEQ ID NO: 124719 - DNA, 6 bp, Unknown
  misc_feature (1)..( 6): Result.003 file - promoters60/2028985
tctttg

SEQ ID NO: 124720 - DNA, 6 bp, Unknown
  misc_feature (1)..( 6): Result.003 file - promoters60/2028985
tctttg

SEQ ID NO: 124721 - DNA, 6 bp, Unknown
  misc_feature (1)..( 6): Result.003 file - promoters60/2028985
taatgt

SEQ ID NO: 124722 - DNA, 6 bp, Unknown
  misc_feature (1)..( 6): Result.003 file - promoters60/2028985
taatgt

SEQ ID NO: 124723 - DNA, 6 bp, Unknown
  misc_feature (1)..( 6): Result.003 file - promoters60/2028985
tataat

SEQ ID NO: 124724 - DNA, 6 bp, Unknown
  misc_feature (1)..( 6): Result.003 file - promoters60/2028985
tataat

SEQ ID NO: 124725 - DNA, 8 bp, Unknown
  misc_feature (1)..( 8): Result.003 file - promoters60/2028985
caaaccgt

SEQ ID NO: 124726 - DNA, 8 bp, Unknown
  misc_feature (1)..( 8): Result.003 file - promoters60/2028985
caaaccgt

SEQ ID NO: 124727 - DNA, 8 bp, Unknown
  misc_feature (1)..( 8): Result.003 file - promoters60/2028985
aacatagt

SEQ ID NO: 124728 - DNA, 8 bp, Unknown
  misc_feature (1)..( 8): Result.003 file - promoters60/2028985
aacatagt

SEQ ID NO: 124729 - DNA, 8 bp, Unknown
  misc_feature (1)..( 8): Result.003 file - promoters60/2028985
tcaaaaaa

SEQ ID NO: 124730 - DNA, 8 bp, Unknown
  misc_feature (1)..( 8): Result.003 file - promoters60/2028985
tcaaaaaa

SEQ ID NO: 124731 - DNA, 7 bp, Unknown
  misc_feature (1)..( 7): Result.003 file - promoters60/2028985
agtgcgg

SEQ ID NO: 124732 - DNA, 7 bp, Unknown
  misc_feature (1)..( 7): Result.003 file - promoters60/2028985
agttcgg

SEQ ID NO: 124733 - DNA, 9 bp, Unknown
  misc_feature (1)..( 9): Result.003 file - promoters60/2028993
attgctgca

SEQ ID NO: 124734 - DNA, 9 bp, Unknown
  misc_feature (1)..( 9): Result.003 file - promoters60/2028993
attactgca

SEQ ID NO: 124735 - DNA, 11 bp, Unknown
  misc_feature (1)..( 11): Result.003 file - promoters60/2028993
ttcttaaatgg

SEQ ID NO: 124736 - DNA, 11 bp, Unknown
  misc_feature (1)..( 11): Result.003 file - promoters60/2028993
ttcttacatgg

SEQ ID NO: 124737 - DNA, 8 bp, Unknown
  misc_feature (1)..( 8): Result.003 file - promoters60/2028993
gtcagaaa

SEQ ID NO: 124738 - DNA, 8 bp, Unknown
  misc_feature (1)..( 8): Result.003 file - promoters60/2028993
gtcataaa

SEQ ID NO: 124739 - DNA, 9 bp, Unknown
  misc_feature (1)..( 9): Result.003 file - promoters60/2028993
attaaccaa

SEQ ID NO: 124740 - DNA, 9 bp, Unknown
  misc_feature (1)..( 9): Result.003 file - promoters60/2028993
attcacctc

SEQ ID NO: 124741 - DNA, 9 bp, Unknown
  misc_feature (1)..( 9): Result.003 file - promoters60/2028993
cttaaccaa

SEQ ID NO: 124742 - DNA, 13 bp, Unknown
  misc_feature (1)..( 13): Result.003 file - promoters60/2028993
ttactaaaattac

SEQ ID NO: 124743 - DNA, 13 bp, Unknown
  misc_feature (1)..( 13): Result.003 file - promoters60/2028993
ttactaaaatata

SEQ ID NO: 124744 - DNA, 13 bp, Unknown
  misc_feature (1)..( 13): Result.003 file - promoters60/2028993
aaatagaaattta

SEQ ID NO: 124745 - DNA, 7 bp, Unknown
  misc_feature (1)..( 7): Result.003 file - promoters60/2028993
attataa

SEQ ID NO: 124746 - DNA, 7 bp, Unknown
  misc_feature (1)..( 7): Result.003 file - promoters60/2028993
attataa

SEQ ID NO: 124747 - DNA, 6 bp, Unknown
  misc_feature (1)..( 6): Result.003 file - promoters60/2028993
cactat

SEQ ID NO: 124748 - DNA, 6 bp, Unknown
  misc_feature (1)..( 6): Result.003 file - promoters60/2028993
cactat

SEQ ID NO: 124749 - DNA, 7 bp, Unknown
  misc_feature (1)..( 7): Result.003 file - promoters60/2028993
taaaaat

SEQ ID NO: 124750 - DNA, 7 bp, Unknown
  misc_feature (1)..( 7): Result.003 file - promoters60/2028993
taataat

SEQ ID NO: 124751 - DNA, 7 bp, Unknown
  misc_feature (1)..( 7): Result.003 file - promoters60/2028993
taagttg

SEQ ID NO: 124752 - DNA, 7 bp, Unknown
  misc_feature (1)..( 7): Result.003 file - promoters60/2028993
taatttg

SEQ ID NO: 124753 - DNA, 8 bp, Unknown
  misc_feature (1)..( 8): Result.003 file - promoters60/2028993
ataaacca

SEQ ID NO: 124754 - DNA, 8 bp, Unknown
  misc_feature (1)..( 8): Result.003 file - promoters60/2028993
atatacca

SEQ ID NO: 124755 - DNA, 7 bp, Unknown
  misc_feature (1)..( 7): Result.003 file - promoters60/2028993
aaattta

SEQ ID NO: 124756 - DNA, 7 bp, Unknown
  misc_feature (1)..( 7): Result.003 file - promoters60/2028993
aaaatta

SEQ ID NO: 124757 - DNA, 6 bp, Unknown
  misc_feature (1)..( 6): Result.003 file - promoters60/2028993
aataag

SEQ ID NO: 124758 - DNA, 6 bp, Unknown
  misc_feature (1)..( 6): Result.003 file - promoters60/2028993
aataag

SEQ ID NO: 124759 - DNA, 7 bp, Unknown
  misc_feature (1)..( 7): Result.003 file - promoters60/2028993
taacaac

SEQ ID NO: 124760 - DNA, 7 bp, Unknown
  misc_feature (1)..( 7): Result.003 file - promoters60/2028993
taaaaac

SEQ ID NO: 124761 - DNA, 8 bp, Unknown
  misc_feature (1)..( 8): Result.003 file - promoters60/2028993
tgataata

SEQ ID NO: 124762 - DNA, 8 bp, Unknown
  misc_feature (1)..( 8): Result.003 file - promoters60/2028993
tgaaaata

SEQ ID NO: 124763 - DNA, 6 bp, Unknown
  misc_feature (1)..( 6): Result.003 file - promoters60/2028993
aagcaa

SEQ ID NO: 124764 - DNA, 6 bp, Unknown
  misc_feature (1)..( 6): Result.003 file - promoters60/2028993
aagcaa

SEQ ID NO: 124765 - DNA, 10 bp, Unknown
  misc_feature (1)..( 10): Result.003 file - promoters60/2028993
ccacaaaaaa

SEQ ID NO: 124766 - DNA, 10 bp, Unknown
  misc_feature (1)..( 10): Result.003 file - promoters60/2028993
ccaaaaaaaa

SEQ ID NO: 124767 - DNA, 10 bp, Unknown
  misc_feature (1)..( 10): Result.003 file - promoters60/2028993
tgtaatgctt

SEQ ID NO: 124768 - DNA, 10 bp, Unknown
  misc_feature (1)..( 10): Result.003 file - promoters60/2028993
tgtaattctt

SEQ ID NO: 124769 - DNA, 6 bp, Unknown
  misc_feature (1)..( 6): Result.003 file - promoters60/2028993
taatta

SEQ ID NO: 124770 - DNA, 6 bp, Unknown
  misc_feature (1)..( 6): Result.003 file - promoters60/2028993
taatta

SEQ ID NO: 124771 - DNA, 7 bp, Unknown
  misc_feature (1)..( 7): Result.003 file - promoters60/2028997
attttgt

SEQ ID NO: 124772 - DNA, 7 bp, Unknown
  misc_feature (1)..( 7): Result.003 file - promoters60/2028997
attctgt

SEQ ID NO: 124773 - DNA, 7 bp, Unknown
  misc_feature (1)..( 7): Result.003 file - promoters60/2028997
cttctat

SEQ ID NO: 124774 - DNA, 7 bp, Unknown
  misc_feature (1)..( 7): Result.003 file - promoters60/2028997
cttgtat

SEQ ID NO: 124775 - DNA, 7 bp, Unknown
  misc_feature (1)..( 7): Result.003 file - promoters60/2028997
tttcatt

SEQ ID NO: 124776 - DNA, 7 bp, Unknown
  misc_feature (1)..( 7): Result.003 file - promoters60/2028997
tttgatt

SEQ ID NO: 124777 - DNA, 7 bp, Unknown
  misc_feature (1)..( 7): Result.003 file - promoters60/2028997
gtatctt

SEQ ID NO: 124778 - DNA, 7 bp, Unknown
  misc_feature (1)..( 7): Result.003 file - promoters60/2028997
gtatctt

SEQ ID NO: 124779 - DNA, 6 bp, Unknown
  misc_feature (1)..( 6): Result.003 file - promoters60/2028997
catcat

SEQ ID NO: 124780 - DNA, 6 bp, Unknown
  misc_feature (1)..( 6): Result.003 file - promoters60/2028997
catcat

SEQ ID NO: 124781 - DNA, 6 bp, Unknown
  misc_feature (1)..( 6): Result.003 file - promoters60/2028997
aagaaa

SEQ ID NO: 124782 - DNA, 6 bp, Unknown
  misc_feature (1)..( 6): Result.003 file - promoters60/2028997
aagaaa

SEQ ID NO: 124783 - DNA, 7 bp, Unknown
  misc_feature (1)..( 7): Result.003 file - promoters60/2028997
aaagaaa

SEQ ID NO: 124784 - DNA, 7 bp, Unknown
  misc_feature (1)..( 7): Result.003 file - promoters60/2028997
aaagaaa

SEQ ID NO: 124785 - DNA, 9 bp, Unknown
  misc_feature (1)..( 9): Result.003 file - promoters60/2028997
ctcggtgat

SEQ ID NO: 124786 - DNA, 9 bp, Unknown
  misc_feature (1)..( 9): Result.003 file - promoters60/2028997
ctcagtgat

SEQ ID NO: 124787 - DNA, 7 bp, Unknown
  misc_feature (1)..( 7): Result.003 file - promoters60/2028997
gttcttt

SEQ ID NO: 124788 - DNA, 7 bp, Unknown
  misc_feature (1)..( 7): Result.003 file - promoters60/2028997
gtttttt

SEQ ID NO: 124789 - DNA, 7 bp, Unknown
  misc_feature (1)..( 7): Result.003 file - promoters60/2028997
attggaa

SEQ ID NO: 124790 - DNA, 7 bp, Unknown
  misc_feature (1)..( 7): Result.003 file - promoters60/2028997
attggaa

SEQ ID NO: 124791 - DNA, 6 bp, Unknown
  misc_feature (1)..( 6): Result.003 file - promoters60/2028997
aaggta

SEQ ID NO: 124792 - DNA, 6 bp, Unknown
  misc_feature (1)..( 6): Result.003 file - promoters60/2028997
aaggta

SEQ ID NO: 124793 - DNA, 8 bp, Unknown
  misc_feature (1)..( 8): Result.003 file - promoters60/2029009
acttaaaa

SEQ ID NO: 124794 - DNA, 8 bp, Unknown
  misc_feature (1)..( 8): Result.003 file - promoters60/2029009
ttttaaaa

SEQ ID NO: 124795 - DNA, 8 bp, Unknown
  misc_feature (1)..( 8): Result.003 file - promoters60/2029009
actgaaat

SEQ ID NO: 124796 - DNA, 9 bp, Unknown
  misc_feature (1)..( 9): Result.003 file - promoters60/2029009
tatactttt

SEQ ID NO: 124797 - DNA, 9 bp, Unknown
  misc_feature (1)..( 9): Result.003 file - promoters60/2029009
tattctttt

SEQ ID NO: 124798 - DNA, 7 bp, Unknown
  misc_feature (1)..( 7): Result.003 file - promoters60/2029009
acattaa

SEQ ID NO: 124799 - DNA, 7 bp, Unknown
  misc_feature (1)..( 7): Result.003 file - promoters60/2029009
acattaa

SEQ ID NO: 124800 - DNA, 7 bp, Unknown
  misc_feature (1)..( 7): Result.003 file - promoters60/2029009
attttgg

SEQ ID NO: 124801 - DNA, 7 bp, Unknown
  misc_feature (1)..( 7): Result.003 file - promoters60/2029009
attttgg

SEQ ID NO: 124802 - DNA, 7 bp, Unknown
  misc_feature (1)..( 7): Result.003 file - promoters60/2029009
aagaaaa

SEQ ID NO: 124803 - DNA, 7 bp, Unknown
  misc_feature (1)..( 7): Result.003 file - promoters60/2029009
aagaaaa

SEQ ID NO: 124804 - DNA, 7 bp, Unknown
  misc_feature (1)..( 7): Result.003 file - promoters60/2029009
aatcaaa

SEQ ID NO: 124805 - DNA, 7 bp, Unknown
  misc_feature (1)..( 7): Result.003 file - promoters60/2029009
aataaaa

SEQ ID NO: 124806 - DNA, 6 bp, Unknown
  misc_feature (1)..( 6): Result.003 file - promoters60/2029009
aaaaat

SEQ ID NO: 124807 - DNA, 6 bp, Unknown
  misc_feature (1)..( 6): Result.003 file - promoters60/2029009
aaaaat

SEQ ID NO: 124808 - DNA, 7 bp, Unknown
  misc_feature (1)..( 7): Result.003 file - promoters60/2029009
tttatcc

SEQ ID NO: 124809 - DNA, 7 bp, Unknown
  misc_feature (1)..( 7): Result.003 file - promoters60/2029009
tttgtcc

SEQ ID NO: 124810 - DNA, 6 bp, Unknown
  misc_feature (1)..( 6): Result.003 file - promoters60/2029009
ttagaa

SEQ ID NO: 124811 - DNA, 6 bp, Unknown
  misc_feature (1)..( 6): Result.003 file - promoters60/2029009
ttagaa

SEQ ID NO: 124812 - DNA, 6 bp, Unknown
  misc_feature (1)..( 6): Result.003 file - promoters60/2029009
ttaaca

SEQ ID NO: 124813 - DNA, 6 bp, Unknown
  misc_feature (1)..( 6): Result.003 file - promoters60/2029009
ttaaca

SEQ ID NO: 124814 - DNA, 6 bp, Unknown
  misc_feature (1)..( 6): Result.003 file - promoters60/2029009
taaaac

SEQ ID NO: 124815 - DNA, 6 bp, Unknown
  misc_feature (1)..( 6): Result.003 file - promoters60/2029009
taaaac

SEQ ID NO: 124816 - DNA, 6 bp, Unknown
  misc_feature (1)..( 6): Result.003 file - promoters60/2029009
tcaact

SEQ ID NO: 124817 - DNA, 6 bp, Unknown
  misc_feature (1)..( 6): Result.003 file - promoters60/2029009
tcaact

SEQ ID NO: 124818 - DNA, 6 bp, Unknown
  misc_feature (1)..( 6): Result.003 file - promoters60/2029009
aaaaaa

SEQ ID NO: 124819 - DNA, 6 bp, Unknown
  misc_feature (1)..( 6): Result.003 file - promoters60/2029009
aaaaaa

SEQ ID NO: 124820 - DNA, 6 bp, Unknown
  misc_feature (1)..( 6): Result.003 file - promoters60/2029009
aaaaat

SEQ ID NO: 124821 - DNA, 6 bp, Unknown
  misc_feature (1)..( 6): Result.003 file - promoters60/2029009
aaaaat

SEQ ID NO: 124822 - DNA, 6 bp, Unknown
  misc_feature (1)..( 6): Result.003 file - promoters60/2029009
aatgaa

SEQ ID NO: 124823 - DNA, 6 bp, Unknown
  misc_feature (1)..( 6): Result.003 file - promoters60/2029009
aatgaa

SEQ ID NO: 124824 - DNA, 8 bp, Unknown
  misc_feature (1)..( 8): Result.003 file - promoters60/2029009
gaatacga

SEQ ID NO: 124825 - DNA, 8 bp, Unknown
  misc_feature (1)..( 8): Result.003 file - promoters60/2029009
gaatccga

SEQ ID NO: 124826 - DNA, 6 bp, Unknown
  misc_feature (1)..( 6): Result.003 file - promoters60/2029009
aacata

SEQ ID NO: 124827 - DNA, 6 bp, Unknown
  misc_feature (1)..( 6): Result.003 file - promoters60/2029009
aacata

SEQ ID NO: 124828 - DNA, 6 bp, Unknown
  misc_feature (1)..( 6): Result.003 file - promoters60/2029009
cttgat

SEQ ID NO: 124829 - DNA, 6 bp, Unknown
  misc_feature (1)..( 6): Result.003 file - promoters60/2029009
cttgat

SEQ ID NO: 124830 - DNA, 7 bp, Unknown
  misc_feature (1)..( 7): Result.003 file - promoters60/2029009
agggtta

SEQ ID NO: 124831 - DNA, 7 bp, Unknown
  misc_feature (1)..( 7): Result.003 file - promoters60/2029009
aggatta

SEQ ID NO: 124832 - DNA, 9 bp, Unknown
  misc_feature (1)..( 9): Result.003 file - promoters60/2029016
ttaaaatca

SEQ ID NO: 124833 - DNA, 9 bp, Unknown
  misc_feature (1)..( 9): Result.003 file - promoters60/2029016
agtaaatca

SEQ ID NO: 124834 - DNA, 9 bp, Unknown
  misc_feature (1)..( 9): Result.003 file - promoters60/2029016
aataaattg

SEQ ID NO: 124835 - DNA, 7 bp, Unknown
  misc_feature (1)..( 7): Result.003 file - promoters60/2029016
ttgtaaa

SEQ ID NO: 124836 - DNA, 7 bp, Unknown
  misc_feature (1)..( 7): Result.003 file - promoters60/2029016
ttgtaat

SEQ ID NO: 124837 - DNA, 7 bp, Unknown
  misc_feature (1)..( 7): Result.003 file - promoters60/2029016
ttggaaa

SEQ ID NO: 124838 - DNA, 10 bp, Unknown
  misc_feature (1)..( 10): Result.003 file - promoters60/2029016
tcatgttgtg

SEQ ID NO: 124839 - DNA, 10 bp, Unknown
  misc_feature (1)..( 10): Result.003 file - promoters60/2029016
tcaagttaaa

SEQ ID NO: 124840 - DNA, 10 bp, Unknown
  misc_feature (1)..( 10): Result.003 file - promoters60/2029016
aaaagtgaaa

SEQ ID NO: 124841 - DNA, 8 bp, Unknown
  misc_feature (1)..( 8): Result.003 file - promoters60/2029016
atagtttg

SEQ ID NO: 124842 - DNA, 8 bp, Unknown
  misc_feature (1)..( 8): Result.003 file - promoters60/2029016
ttagtttt

SEQ ID NO: 124843 - DNA, 8 bp, Unknown
  misc_feature (1)..( 8): Result.003 file - promoters60/2029016
ttattttt

SEQ ID NO: 124844 - DNA, 11 bp, Unknown
  misc_feature (1)..( 11): Result.003 file - promoters60/2029016
tatctaataaa

SEQ ID NO: 124845 - DNA, 11 bp, Unknown
  misc_feature (1)..( 11): Result.003 file - promoters60/2029016
caaataataaa

SEQ ID NO: 124846 - DNA, 11 bp, Unknown
  misc_feature (1)..( 11): Result.003 file - promoters60/2029016
caattaagaaa

SEQ ID NO: 124847 - DNA, 8 bp, Unknown
  misc_feature (1)..( 8): Result.003 file - promoters60/2029016
aaaaatct

SEQ ID NO: 124848 - DNA, 8 bp, Unknown
  misc_feature (1)..( 8): Result.003 file - promoters60/2029016
aaagatca

SEQ ID NO: 124849 - DNA, 8 bp, Unknown
  misc_feature (1)..( 8): Result.003 file - promoters60/2029016
ttagatca

SEQ ID NO: 124850 - DNA, 11 bp, Unknown
  misc_feature (1)..( 11): Result.003 file - promoters60/2029031
gaaagttcatc

SEQ ID NO: 124851 - DNA, 11 bp, Unknown
  misc_feature (1)..( 11): Result.003 file - promoters60/2029031
caaagttgtag

SEQ ID NO: 124852 - DNA, 11 bp, Unknown
  misc_feature (1)..( 11): Result.003 file - promoters60/2029031
aaaagtttttg

SEQ ID NO: 124853 - DNA, 11 bp, Unknown
  misc_feature (1)..( 11): Result.003 file - promoters60/2029031
caaaattgaag

SEQ ID NO: 124854 - DNA, 11 bp, Unknown
  misc_feature (1)..( 11): Result.003 file - promoters60/2029031
gaaaatagttt

SEQ ID NO: 124855 - DNA, 11 bp, Unknown
  misc_feature (1)..( 11): Result.003 file - promoters60/2029031
tttagttttgt

SEQ ID NO: 124856 - DNA, 12 bp, Unknown
  misc_feature (1)..( 12): Result.003 file - promoters60/2029033
cggctttttcta

SEQ ID NO: 124857 - DNA, 12 bp, Unknown
  misc_feature (1)..( 12): Result.003 file - promoters60/2029033
gattctttccta

SEQ ID NO: 124858 - DNA, 12 bp, Unknown
  misc_feature (1)..( 12): Result.003 file - promoters60/2029033
atttatttcctt

SEQ ID NO: 124859 - DNA, 12 bp, Unknown
  misc_feature (1)..( 12): Result.003 file - promoters60/2029033
atttatttactt

SEQ ID NO: 124860 - DNA, 13 bp, Unknown
  misc_feature (1)..( 13): Result.003 file - promoters60/2029033
gattattcattta

SEQ ID NO: 124861 - DNA, 13 bp, Unknown
  misc_feature (1)..( 13): Result.003 file - promoters60/2029033
gatttttcattaa

SEQ ID NO: 124862 - DNA, 13 bp, Unknown
  misc_feature (1)..( 13): Result.003 file - promoters60/2029033
cgttcttcttttg

SEQ ID NO: 124863 - DNA, 13 bp, Unknown
  misc_feature (1)..( 13): Result.003 file - promoters60/2029033
ataatttaattaa

SEQ ID NO: 124864 - DNA, 7 bp, Unknown
  misc_feature (1)..( 7): Result.003 file - promoters60/2029033
tctctat

SEQ ID NO: 124865 - DNA, 7 bp, Unknown
  misc_feature (1)..( 7): Result.003 file - promoters60/2029033
tctttat

SEQ ID NO: 124866 - DNA, 7 bp, Unknown
  misc_feature (1)..( 7): Result.003 file - promoters60/2029033
tttttct

SEQ ID NO: 124867 - DNA, 7 bp, Unknown
  misc_feature (1)..( 7): Result.003 file - promoters60/2029033
tctctat

SEQ ID NO: 124868 - DNA, 6 bp, Unknown
  misc_feature (1)..( 6): Result.003 file - promoters60/2029049
tttagg

SEQ ID NO: 124869 - DNA, 6 bp, Unknown
  misc_feature (1)..( 6): Result.003 file - promoters60/2029049
tttagg

SEQ ID NO: 124870 - DNA, 6 bp, Unknown
  misc_feature (1)..( 6): Result.003 file - promoters60/2029049
taaaac

SEQ ID NO: 124871 - DNA, 6 bp, Unknown
  misc_feature (1)..( 6): Result.003 file - promoters60/2029049
taaaac

SEQ ID NO: 124872 - DNA, 7 bp, Unknown
  misc_feature (1)..( 7): Result.003 file - promoters60/2029049
aaaatta

SEQ ID NO: 124873 - DNA, 7 bp, Unknown
  misc_feature (1)..( 7): Result.003 file - promoters60/2029049
aaattta

SEQ ID NO: 124874 - DNA, 10 bp, Unknown
  misc_feature (1)..( 10): Result.003 file - promoters60/2029049
aaaaaataaa

SEQ ID NO: 124875 - DNA, 10 bp, Unknown
  misc_feature (1)..( 10): Result.003 file - promoters60/2029049
aaaaaaaaaa

SEQ ID NO: 124876 - DNA, 7 bp, Unknown
  misc_feature (1)..( 7): Result.003 file - promoters60/2029049
gggggac

SEQ ID NO: 124877 - DNA, 7 bp, Unknown
  misc_feature (1)..( 7): Result.003 file - promoters60/2029049
gggtgac

SEQ ID NO: 124878 - DNA, 9 bp, Unknown
  misc_feature (1)..( 9): Result.003 file - promoters60/2029049
gagattttt

SEQ ID NO: 124879 - DNA, 9 bp, Unknown
  misc_feature (1)..( 9): Result.003 file - promoters60/2029049
gagatattt

SEQ ID NO: 124880 - DNA, 6 bp, Unknown
  misc_feature (1)..( 6): Result.003 file - promoters60/2029049
attgtg

SEQ ID NO: 124881 - DNA, 6 bp, Unknown
  misc_feature (1)..( 6): Result.003 file - promoters60/2029049
attgtg

SEQ ID NO: 124882 - DNA, 6 bp, Unknown
  misc_feature (1)..( 6): Result.003 file - promoters60/2029049
ttgttt

SEQ ID NO: 124883 - DNA, 6 bp, Unknown
  misc_feature (1)..( 6): Result.003 file - promoters60/2029049
ttgttt

SEQ ID NO: 124884 - DNA, 9 bp, Unknown
  misc_feature (1)..( 9): Result.003 file - promoters60/2029049
tatcggttt

SEQ ID NO: 124885 - DNA, 9 bp, Unknown
  misc_feature (1)..( 9): Result.003 file - promoters60/2029049
tatcgcttt

SEQ ID NO: 124886 - DNA, 9 bp, Unknown
  misc_feature (1)..( 9): Result.003 file - promoters60/2029049
tttcgtata

SEQ ID NO: 124887 - DNA, 9 bp, Unknown
  misc_feature (1)..( 9): Result.003 file - promoters60/2029049
tttcctata

SEQ ID NO: 124888 - DNA, 7 bp, Unknown
  misc_feature (1)..( 7): Result.003 file - promoters60/2029049
ctttcaa

SEQ ID NO: 124889 - DNA, 7 bp, Unknown
  misc_feature (1)..( 7): Result.003 file - promoters60/2029049
ctttcaa

SEQ ID NO: 124890 - DNA, 6 bp, Unknown
  misc_feature (1)..( 6): Result.003 file - promoters60/2029049
caattt

SEQ ID NO: 124891 - DNA, 6 bp, Unknown
  misc_feature (1)..( 6): Result.003 file - promoters60/2029049
caattt

SEQ ID NO: 124892 - DNA, 14 bp, Unknown
  misc_feature (1)..( 14): Result.003 file - promoters60/2029075
aggaaatgaaaaat

SEQ ID NO: 124893 - DNA, 14 bp, Unknown
  misc_feature (1)..( 14): Result.003 file - promoters60/2029075
caaaaaagaaatta

SEQ ID NO: 124894 - DNA, 14 bp, Unknown
  misc_feature (1)..( 14): Result.003 file - promoters60/2029075
tcaaaatcaaattt

SEQ ID NO: 124895 - DNA, 14 bp, Unknown
  misc_feature (1)..( 14): Result.003 file - promoters60/2029075
aaaaaataaaaaat

SEQ ID NO: 124896 - DNA, 14 bp, Unknown
  misc_feature (1)..( 14): Result.003 file - promoters60/2029075
caaaaatgaataat

SEQ ID NO: 124897 - DNA, 14 bp, Unknown
  misc_feature (1)..( 14): Result.003 file - promoters60/2029075
caacaatcagtcaa

SEQ ID NO: 124898 - DNA, 11 bp, Unknown
  misc_feature (1)..( 11): Result.003 file - promoters60/2029075
attttaatctc

SEQ ID NO: 124899 - DNA, 11 bp, Unknown
  misc_feature (1)..( 11): Result.003 file - promoters60/2029075
tttttattcta

SEQ ID NO: 124900 - DNA, 11 bp, Unknown
  misc_feature (1)..( 11): Result.003 file - promoters60/2029075
attttacagtt

SEQ ID NO: 124901 - DNA, 11 bp, Unknown
  misc_feature (1)..( 11): Result.003 file - promoters60/2029075
gttgtattcta

SEQ ID NO: 124902 - DNA, 11 bp, Unknown
  misc_feature (1)..( 11): Result.003 file - promoters60/2029075
caattaatctc

SEQ ID NO: 124903 - DNA, 11 bp, Unknown
  misc_feature (1)..( 11): Result.003 file - promoters60/2029075
tatgtaatttg

SEQ ID NO: 124904 - DNA, 10 bp, Unknown
  misc_feature (1)..( 10): Result.003 file - promoters60/2029075
caaaaaagaa

SEQ ID NO: 124905 - DNA, 10 bp, Unknown
  misc_feature (1)..( 10): Result.003 file - promoters60/2029075
taaaaaactc

SEQ ID NO: 124906 - DNA, 10 bp, Unknown
  misc_feature (1)..( 10): Result.003 file - promoters60/2029075
caaaaatgaa

SEQ ID NO: 124907 - DNA, 10 bp, Unknown
  misc_feature (1)..( 10): Result.003 file - promoters60/2029075
gaaaaaaaat

SEQ ID NO: 124908 - DNA, 10 bp, Unknown
  misc_feature (1)..( 10): Result.003 file - promoters60/2029075
caacaatcag

SEQ ID NO: 124909 - DNA, 10 bp, Unknown
  misc_feature (1)..( 10): Result.003 file - promoters60/2029075
gaaacactta

SEQ ID NO: 124910 - DNA, 9 bp, Unknown
  misc_feature (1)..( 9): Result.003 file - promoters60/2029079
tatataata

SEQ ID NO: 124911 - DNA, 9 bp, Unknown
  misc_feature (1)..( 9): Result.003 file - promoters60/2029079
tataaaata

SEQ ID NO: 124912 - DNA, 9 bp, Unknown
  misc_feature (1)..( 9): Result.003 file - promoters60/2029079
tatttaatt

SEQ ID NO: 124913 - DNA, 9 bp, Unknown
  misc_feature (1)..( 9): Result.003 file - promoters60/2029079
tatgaaaca

SEQ ID NO: 124914 - DNA, 10 bp, Unknown
  misc_feature (1)..( 10): Result.003 file - promoters60/2029079
gctaacaaat

SEQ ID NO: 124915 - DNA, 10 bp, Unknown
  misc_feature (1)..( 10): Result.003 file - promoters60/2029079
tttaagaaag

SEQ ID NO: 124916 - DNA, 10 bp, Unknown
  misc_feature (1)..( 10): Result.003 file - promoters60/2029079
tcgaagaaag

SEQ ID NO: 124917 - DNA, 10 bp, Unknown
  misc_feature (1)..( 10): Result.003 file - promoters60/2029079
tcgaagaagg

SEQ ID NO: 124918 - DNA, 19 bp, Unknown
  misc_feature (1)..( 19): Result.003 file - promoters60/2029087
aacaaactacaaaagttta

SEQ ID NO: 124919 - DNA, 13 bp, Unknown
  misc_feature (1)..( 13): Result.003 file - promoters60/2029087
cagaaaatgtttt

SEQ ID NO: 124920 - DNA, 19 bp, Unknown
  misc_feature (1)..( 19): Result.003 file - promoters60/2029087
agtttagggaaaatggatc

SEQ ID NO: 124921 - DNA, 19 bp, Unknown
  misc_feature (1)..( 19): Result.003 file - promoters60/2029087
ccaacacattcaatatttt

SEQ ID NO: 124922 - DNA, 15 bp, Unknown
  misc_feature (1)..( 15): Result.003 file - promoters60/2029087
atcactgatccaaca

SEQ ID NO: 124923 - DNA, 15 bp, Unknown
  misc_feature (1)..( 15): Result.003 file - promoters60/2029087
atcactgatccaaca

SEQ ID NO: 124924 - DNA, 15 bp, Unknown
  misc_feature (1)..( 15): Result.003 file - promoters60/2029087
atcactgatccaaca

SEQ ID NO: 124925 - DNA, 7 bp, Unknown
  misc_feature (1)..( 7): Result.003 file - promoters60/2029087
aattatc

SEQ ID NO: 124926 - DNA, 7 bp, Unknown
  misc_feature (1)..( 7): Result.003 file - promoters60/2029087
cattatc

SEQ ID NO: 124927 - DNA, 7 bp, Unknown
  misc_feature (1)..( 7): Result.003 file - promoters60/2029087
cattata

SEQ ID NO: 124928 - DNA, 7 bp, Unknown
  misc_feature (1)..( 7): Result.003 file - promoters60/2029087
aattatc

SEQ ID NO: 124929 - DNA, 6 bp, Unknown
  misc_feature (1)..( 6): Result.003 file - promoters60/2056926
tgggtt

SEQ ID NO: 124930 - DNA, 6 bp, Unknown
  misc_feature (1)..( 6): Result.003 file - promoters60/2056926
tgggtt

SEQ ID NO: 124931 - DNA, 7 bp, Unknown
  misc_feature (1)..( 7): Result.003 file - promoters60/2056926
tcaaaaa

SEQ ID NO: 124932 - DNA, 7 bp, Unknown
  misc_feature (1)..( 7): Result.003 file - promoters60/2056926
tcataaa

SEQ ID NO: 124933 - DNA, 8 bp, Unknown
  misc_feature (1)..( 8): Result.003 file - promoters60/2056926
agaacaat

SEQ ID NO: 124934 - DNA, 8 bp, Unknown
  misc_feature (1)..( 8): Result.003 file - promoters60/2056926
agaataat

SEQ ID NO: 124935 - DNA, 6 bp, Unknown
  misc_feature (1)..( 6): Result.003 file - promoters60/2056926
acgaaa

SEQ ID NO: 124936 - DNA, 6 bp, Unknown
  misc_feature (1)..( 6): Result.003 file - promoters60/2056926
acgaaa

SEQ ID NO: 124937 - DNA, 8 bp, Unknown
  misc_feature (1)..( 8): Result.003 file - promoters60/2056926
aataaaat

SEQ ID NO: 124938 - DNA, 8 bp, Unknown
  misc_feature (1)..( 8): Result.003 file - promoters60/2056926
aataaaag

SEQ ID NO: 124939 - DNA, 8 bp, Unknown
  misc_feature (1)..( 8): Result.003 file - promoters60/2056926
aatacaag

SEQ ID NO: 124940 - DNA, 8 bp, Unknown
  misc_feature (1)..( 8): Result.003 file - promoters60/2056926
aaaggtct

SEQ ID NO: 124941 - DNA, 8 bp, Unknown
  misc_feature (1)..( 8): Result.003 file - promoters60/2056926
aaagatct

SEQ ID NO: 124942 - DNA, 7 bp, Unknown
  misc_feature (1)..( 7): Result.003 file - promoters60/2056926
agatttg

SEQ ID NO: 124943 - DNA, 7 bp, Unknown
  misc_feature (1)..( 7): Result.003 file - promoters60/2056926
agatttg

SEQ ID NO: 124944 - DNA, 7 bp, Unknown
  misc_feature (1)..( 7): Result.003 file - promoters60/2056926
gttttca

SEQ ID NO: 124945 - DNA, 7 bp, Unknown
  misc_feature (1)..( 7): Result.003 file - promoters60/2056926
gttctca

SEQ ID NO: 124946 - DNA, 7 bp, Unknown
  misc_feature (1)..( 7): Result.003 file - promoters60/2056926
ataagac

SEQ ID NO: 124947 - DNA, 7 bp, Unknown
  misc_feature (1)..( 7): Result.003 file - promoters60/2056926
atatgac

SEQ ID NO: 124948 - DNA, 7 bp, Unknown
  misc_feature (1)..( 7): Result.003 file - promoters60/2056926
aatcata

SEQ ID NO: 124949 - DNA, 7 bp, Unknown
  misc_feature (1)..( 7): Result.003 file - promoters60/2056926
aataata

SEQ ID NO: 124950 - DNA, 9 bp, Unknown
  misc_feature (1)..( 9): Result.003 file - promoters60/2056926
aaagaaaat

SEQ ID NO: 124951 - DNA, 9 bp, Unknown
  misc_feature (1)..( 9): Result.003 file - promoters60/2056926
aaagaaaat

SEQ ID NO: 124952 - DNA, 11 bp, Unknown
  misc_feature (1)..( 11): Result.003 file - promoters60/2056926
attattctctg

SEQ ID NO: 124953 - DNA, 11 bp, Unknown
  misc_feature (1)..( 11): Result.003 file - promoters60/2056926
attcttcgctg

SEQ ID NO: 124954 - DNA, 7 bp, Unknown
  misc_feature (1)..( 7): Result.003 file - promoters60/2056926
gtctaga

SEQ ID NO: 124955 - DNA, 7 bp, Unknown
  misc_feature (1)..( 7): Result.003 file - promoters60/2056926
gtcaaga

SEQ ID NO: 124956 - DNA, 7 bp, Unknown
  misc_feature (1)..( 7): Result.003 file - promoters60/2056926
cttatat

SEQ ID NO: 124957 - DNA, 7 bp, Unknown
  misc_feature (1)..( 7): Result.003 file - promoters60/2056926
cttttat

SEQ ID NO: 124958 - DNA, 12 bp, Unknown
  misc_feature (1)..( 12): Result.003 file - promoters60/2056926
taactttttagt

SEQ ID NO: 124959 - DNA, 12 bp, Unknown
  misc_feature (1)..( 12): Result.003 file - promoters60/2056926
taacttttgagt

SEQ ID NO: 124960 - DNA, 7 bp, Unknown
  misc_feature (1)..( 7): Result.003 file - promoters60/2056926
tctacac

SEQ ID NO: 124961 - DNA, 7 bp, Unknown
  misc_feature (1)..( 7): Result.003 file - promoters60/2056926
tcttcac

SEQ ID NO: 124962 - DNA, 6 bp, Unknown
  misc_feature (1)..( 6): Result.003 file - promoters60/2056926
acttgt

SEQ ID NO: 124963 - DNA, 6 bp, Unknown
  misc_feature (1)..( 6): Result.003 file - promoters60/2056926
acttgt

SEQ ID NO: 124964 - DNA, 12 bp, Unknown
  misc_feature (1)..( 12): Result.003 file - promoters60/2104991
taaattataata

SEQ ID NO: 124965 - DNA, 14 bp, Unknown
  misc_feature (1)..( 14): Result.003 file - promoters60/2104991
ctaaaattagcagt

SEQ ID NO: 124966 - DNA, 14 bp, Unknown
  misc_feature (1)..( 14): Result.003 file - promoters60/2104991
ttttaattatattg

SEQ ID NO: 124967 - DNA, 14 bp, Unknown
  misc_feature (1)..( 14): Result.003 file - promoters60/2104991
ttttctttatcttg

SEQ ID NO: 124968 - DNA, 14 bp, Unknown
  misc_feature (1)..( 14): Result.003 file - promoters60/2104991
attaaattttggta

SEQ ID NO: 124969 - DNA, 14 bp, Unknown
  misc_feature (1)..( 14): Result.003 file - promoters60/2104991
cgaaaatgttgggt

SEQ ID NO: 124970 - DNA, 12 bp, Unknown
  misc_feature (1)..( 12): Result.003 file - promoters60/2104991
atttcacaaatt

SEQ ID NO: 124971 - DNA, 12 bp, Unknown
  misc_feature (1)..( 12): Result.003 file - promoters60/2104991
atttcaaaaata

SEQ ID NO: 124972 - DNA, 12 bp, Unknown
  misc_feature (1)..( 12): Result.003 file - promoters60/2104991
gtatcataaagc

SEQ ID NO: 124973 - DNA, 12 bp, Unknown
  misc_feature (1)..( 12): Result.003 file - promoters60/2104991
gcttcaaacaaa

SEQ ID NO: 124974 - DNA, 12 bp, Unknown
  misc_feature (1)..( 12): Result.003 file - promoters60/2104991
gtaacaaaaaag

SEQ ID NO: 124975 - DNA, 12 bp, Unknown
  misc_feature (1)..( 12): Result.003 file - promoters60/2104991
aattaagaaaaa

SEQ ID NO: 124976 - DNA, 14 bp, Unknown
  misc_feature (1)..( 14): Result.003 file - promoters60/2104991
tacttttttttttt

SEQ ID NO: 124977 - DNA, 14 bp, Unknown
  misc_feature (1)..( 14): Result.003 file - promoters60/2104991
tactttttagtgat

SEQ ID NO: 124978 - DNA, 14 bp, Unknown
  misc_feature (1)..( 14): Result.003 file - promoters60/2104991
ctctttttttgttt

SEQ ID NO: 124979 - DNA, 14 bp, Unknown
  misc_feature (1)..( 14): Result.003 file - promoters60/2104991
aacttgttaaatct

SEQ ID NO: 124980 - DNA, 14 bp, Unknown
  misc_feature (1)..( 14): Result.003 file - promoters60/2104991
tacatttagataaa

SEQ ID NO: 124981 - DNA, 14 bp, Unknown
  misc_feature (1)..( 14): Result.003 file - promoters60/2104991
tagtttttgatttt

SEQ ID NO: 124982 - DNA, 7 bp, Unknown
  misc_feature (1)..( 7): Result.003 file - promoters60/2105109
tttatat

SEQ ID NO: 124983 - DNA, 7 bp, Unknown
  misc_feature (1)..( 7): Result.003 file - promoters60/2105109
tttatat

SEQ ID NO: 124984 - DNA, 7 bp, Unknown
  misc_feature (1)..( 7): Result.003 file - promoters60/2105109
attatat

SEQ ID NO: 124985 - DNA, 7 bp, Unknown
  misc_feature (1)..( 7): Result.003 file - promoters60/2105109
tttgtat

SEQ ID NO: 124986 - DNA, 9 bp, Unknown
  misc_feature (1)..( 9): Result.003 file - promoters60/2105109
tattagtcc

SEQ ID NO: 124987 - DNA, 9 bp, Unknown
  misc_feature (1)..( 9): Result.003 file - promoters60/2105109
tatcagtat

SEQ ID NO: 124988 - DNA, 9 bp, Unknown
  misc_feature (1)..( 9): Result.003 file - promoters60/2105109
tattagtat

SEQ ID NO: 124989 - DNA, 9 bp, Unknown
  misc_feature (1)..( 9): Result.003 file - promoters60/2105109
gattagttt

SEQ ID NO: 124990 - DNA, 28 bp, Unknown
  misc_feature (1)..( 28): Result.003 file - promoters60/2105109
gttaaagcccaagaagtaacaataaaga

SEQ ID NO: 124991 - DNA, 28 bp, Unknown
  misc_feature (1)..( 28): Result.003 file - promoters60/2105109
ccgaaaacccgacccgagtcatgtttct

SEQ ID NO: 124992 - DNA, 28 bp, Unknown
  misc_feature (1)..( 28): Result.003 file - promoters60/2105109
tttaaggcccaataagtaacaataaaga

SEQ ID NO: 124993 - DNA, 28 bp, Unknown
  misc_feature (1)..( 28): Result.003 file - promoters60/2105109
aataaaaaccctcactcttccaatttga

SEQ ID NO: 124994 - DNA, 10 bp, Unknown
  misc_feature (1)..( 10): Result.003 file - promoters60/2105109
ataaagccca

SEQ ID NO: 124995 - DNA, 10 bp, Unknown
  misc_feature (1)..( 10): Result.003 file - promoters60/2105109
aataagccca

SEQ ID NO: 124996 - DNA, 10 bp, Unknown
  misc_feature (1)..( 10): Result.003 file - promoters60/2105109
cctaaggcca

SEQ ID NO: 124997 - DNA, 10 bp, Unknown
  misc_feature (1)..( 10): Result.003 file - promoters60/2105109
cctaagccca

SEQ ID NO: 124998 - DNA, 17 bp, Unknown
  misc_feature (1)..( 17): Result.003 file - promoters60/2105109
ttttacctttttaccag

SEQ ID NO: 124999 - DNA, 17 bp, Unknown
  misc_feature (1)..( 17): Result.003 file - promoters60/2105109
gactcccttattatgtc

SEQ ID NO: 125000 - DNA, 17 bp, Unknown
  misc_feature (1)..( 17): Result.003 file - promoters60/2105109
tttgacctttttgtcct

SEQ ID NO: 125001 - DNA, 17 bp, Unknown
  misc_feature (1)..( 17): Result.003 file - promoters60/2105109
gtacgtagtatgatgtc

SEQ ID NO: 125002 - DNA, 8 bp, Unknown
  misc_feature (1)..( 8): Result.003 file - promoters60/2105109
caataaag

SEQ ID NO: 125003 - DNA, 8 bp, Unknown
  misc_feature (1)..( 8): Result.003 file - promoters60/2105109
aaataaaa

SEQ ID NO: 125004 - DNA, 8 bp, Unknown
  misc_feature (1)..( 8): Result.003 file - promoters60/2105109
atataaat

SEQ ID NO: 125005 - DNA, 8 bp, Unknown
  misc_feature (1)..( 8): Result.003 file - promoters60/2105109
atataaaa

SEQ ID NO: 125006 - DNA, 8 bp, Unknown
  misc_feature (1)..( 8): Result.003 file - promoters60/2105109
caataaag

SEQ ID NO: 125007 - DNA, 8 bp, Unknown
  misc_feature (1)..( 8): Result.003 file - promoters60/2105109
tatatata

SEQ ID NO: 125008 - DNA, 8 bp, Unknown
  misc_feature (1)..( 8): Result.003 file - promoters60/2105109
tatataaa

SEQ ID NO: 125009 - DNA, 8 bp, Unknown
  misc_feature (1)..( 8): Result.003 file - promoters60/2105109
gatataaa

SEQ ID NO: 125010 - DNA, 8 bp, Unknown
  misc_feature (1)..( 8): Result.003 file - promoters60/2105109
aataaaaa

SEQ ID NO: 125011 - DNA, 8 bp, Unknown
  misc_feature (1)..( 8): Result.003 file - promoters60/2105109
aataaaga

SEQ ID NO: 125012 - DNA, 8 bp, Unknown
  misc_feature (1)..( 8): Result.003 file - promoters60/2105109
gatatggc

SEQ ID NO: 125013 - DNA, 8 bp, Unknown
  misc_feature (1)..( 8): Result.003 file - promoters60/2105109
gatttggt

SEQ ID NO: 125014 - DNA, 8 bp, Unknown
  misc_feature (1)..( 8): Result.003 file - promoters60/2105109
tattgggt

SEQ ID NO: 125015 - DNA, 8 bp, Unknown
  misc_feature (1)..( 8): Result.003 file - promoters60/2105109
tgtttggt

SEQ ID NO: 125016 - DNA, 6 bp, Unknown
  misc_feature (1)..( 6): Result.003 file - promoters60/2105141
aacaaa

SEQ ID NO: 125017 - DNA, 6 bp, Unknown
  misc_feature (1)..( 6): Result.003 file - promoters60/2105141
aacaaa

SEQ ID NO: 125018 - DNA, 7 bp, Unknown
  misc_feature (1)..( 7): Result.003 file - promoters60/2105141
tttttat

SEQ ID NO: 125019 - DNA, 7 bp, Unknown
  misc_feature (1)..( 7): Result.003 file - promoters60/2105141
tttttat

SEQ ID NO: 125020 - DNA, 8 bp, Unknown
  misc_feature (1)..( 8): Result.003 file - promoters60/2105141
tttatttt

SEQ ID NO: 125021 - DNA, 8 bp, Unknown
  misc_feature (1)..( 8): Result.003 file - promoters60/2105141
catatttt

SEQ ID NO: 125022 - DNA, 8 bp, Unknown
  misc_feature (1)..( 8): Result.003 file - promoters60/2105141
catattta

SEQ ID NO: 125023 - DNA, 7 bp, Unknown
  misc_feature (1)..( 7): Result.003 file - promoters60/2105141
taaataa

SEQ ID NO: 125024 - DNA, 7 bp, Unknown
  misc_feature (1)..( 7): Result.003 file - promoters60/2105141
taaataa

SEQ ID NO: 125025 - DNA, 8 bp, Unknown
  misc_feature (1)..( 8): Result.003 file - promoters60/2105141
ttttgaat

SEQ ID NO: 125026 - DNA, 8 bp, Unknown
  misc_feature (1)..( 8): Result.003 file - promoters60/2105141
ttttcaat

SEQ ID NO: 125027 - DNA, 7 bp, Unknown
  misc_feature (1)..( 7): Result.003 file - promoters60/2105141
taaatta

SEQ ID NO: 125028 - DNA, 7 bp, Unknown
  misc_feature (1)..( 7): Result.003 file - promoters60/2105141
taactta

SEQ ID NO: 125029 - DNA, 6 bp, Unknown
  misc_feature (1)..( 6): Result.003 file - promoters60/2105141
aacaca

SEQ ID NO: 125030 - DNA, 6 bp, Unknown
  misc_feature (1)..( 6): Result.003 file - promoters60/2105141
aacaca

SEQ ID NO: 125031 - DNA, 7 bp, Unknown
  misc_feature (1)..( 7): Result.003 file - promoters60/2105141
ataaaaa

SEQ ID NO: 125032 - DNA, 7 bp, Unknown
  misc_feature (1)..( 7): Result.003 file - promoters60/2105141
atataaa

SEQ ID NO: 125033 - DNA, 8 bp, Unknown
  misc_feature (1)..( 8): Result.003 file - promoters60/2105141
atgtttat

SEQ ID NO: 125034 - DNA, 8 bp, Unknown
  misc_feature (1)..( 8): Result.003 file - promoters60/2105141
atgtttat

SEQ ID NO: 125035 - DNA, 9 bp, Unknown
  misc_feature (1)..( 9): Result.003 file - promoters60/2105141
cacaaatca

SEQ ID NO: 125036 - DNA, 9 bp, Unknown
  misc_feature (1)..( 9): Result.003 file - promoters60/2105141
cactaatca

SEQ ID NO: 125037 - DNA, 7 bp, Unknown
  misc_feature (1)..( 7): Result.003 file - promoters60/2105141
aaaaccc

SEQ ID NO: 125038 - DNA, 7 bp, Unknown
  misc_feature (1)..( 7): Result.003 file - promoters60/2105141
aaatccc

SEQ ID NO: 125039 - DNA, 7 bp, Unknown
  misc_feature (1)..( 7): Result.003 file - promoters60/2105141
acctttt

SEQ ID NO: 125040 - DNA, 7 bp, Unknown
  misc_feature (1)..( 7): Result.003 file - promoters60/2105141
acccttt

SEQ ID NO: 125041 - DNA, 8 bp, Unknown
  misc_feature (1)..( 8): Result.003 file - promoters60/2105141
gtggtaaa

SEQ ID NO: 125042 - DNA, 8 bp, Unknown
  misc_feature (1)..( 8): Result.003 file - promoters60/2105141
gtgctaaa

SEQ ID NO: 125043 - DNA, 8 bp, Unknown
  misc_feature (1)..( 8): Result.003 file - promoters60/2105141
atgctaat

SEQ ID NO: 125044 - DNA, 6 bp, Unknown
  misc_feature (1)..( 6): Result.003 file - promoters60/2105141
aagaat

SEQ ID NO: 125045 - DNA, 6 bp, Unknown
  misc_feature (1)..( 6): Result.003 file - promoters60/2105141
aagaat

SEQ ID NO: 125046 - DNA, 8 bp, Unknown
  misc_feature (1)..( 8): Result.003 file - promoters60/2105141
aaaacaaa

SEQ ID NO: 125047 - DNA, 8 bp, Unknown
  misc_feature (1)..( 8): Result.003 file - promoters60/2105141
aaatcaaa

SEQ ID NO: 125048 - DNA, 6 bp, Unknown
  misc_feature (1)..( 6): Result.003 file - promoters60/2105141
gttttc

SEQ ID NO: 125049 - DNA, 6 bp, Unknown
  misc_feature (1)..( 6): Result.003 file - promoters60/2105141
gttttc

SEQ ID NO: 125050 - DNA, 7 bp, Unknown
  misc_feature (1)..( 7): Result.003 file - promoters60/2105141
ttattta

SEQ ID NO: 125051 - DNA, 7 bp, Unknown
  misc_feature (1)..( 7): Result.003 file - promoters60/2105141
ttattta

SEQ ID NO: 125052 - DNA, 6 bp, Unknown
  misc_feature (1)..( 6): Result.003 file - promoters60/2105141
cacaag

SEQ ID NO: 125053 - DNA, 6 bp, Unknown
  misc_feature (1)..( 6): Result.003 file - promoters60/2105141
cacaag

SEQ ID NO: 125054 - DNA, 6 bp, Unknown
  misc_feature (1)..( 6): Result.003 file - promoters60/2105141
tggcat

SEQ ID NO: 125055 - DNA, 6 bp, Unknown
  misc_feature (1)..( 6): Result.003 file - promoters60/2105141
tggcat

SEQ ID NO: 125056 - DNA, 9 bp, Unknown
  misc_feature (1)..( 9): Result.003 file - promoters60/2105398
caacaaagt

SEQ ID NO: 125057 - DNA, 9 bp, Unknown
  misc_feature (1)..( 9): Result.003 file - promoters60/2105398
aaacaaacg

SEQ ID NO: 125058 - DNA, 9 bp, Unknown
  misc_feature (1)..( 9): Result.003 file - promoters60/2105398
gaaaaaaaa

SEQ ID NO: 125059 - DNA, 9 bp, Unknown
  misc_feature (1)..( 9): Result.003 file - promoters60/2105398
taaaaaaag

SEQ ID NO: 125060 - DNA, 9 bp, Unknown
  misc_feature (1)..( 9): Result.003 file - promoters60/2105398
taaaaaata

SEQ ID NO: 125061 - DNA, 9 bp, Unknown
  misc_feature (1)..( 9): Result.003 file - promoters60/2105398
caaaaataa

SEQ ID NO: 125062 - DNA, 14 bp, Unknown
  misc_feature (1)..( 14): Result.003 file - promoters60/2105398
attgcatttttaaa

SEQ ID NO: 125063 - DNA, 14 bp, Unknown
  misc_feature (1)..( 14): Result.003 file - promoters60/2105398
atttcatatgtttc

SEQ ID NO: 125064 - DNA, 14 bp, Unknown
  misc_feature (1)..( 14): Result.003 file - promoters60/2105398
tttgaattttccta

SEQ ID NO: 125065 - DNA, 14 bp, Unknown
  misc_feature (1)..( 14): Result.003 file - promoters60/2105398
ccttcataaaatct

SEQ ID NO: 125066 - DNA, 14 bp, Unknown
  misc_feature (1)..( 14): Result.003 file - promoters60/2105398
attgcatttagtca

SEQ ID NO: 125067 - DNA, 14 bp, Unknown
  misc_feature (1)..( 14): Result.003 file - promoters60/2105398
agaaaatttaccta

SEQ ID NO: 125068 - DNA, 13 bp, Unknown
  misc_feature (1)..( 13): Result.003 file - promoters60/2105398
aattttggcaaat

SEQ ID NO: 125069 - DNA, 13 bp, Unknown
  misc_feature (1)..( 13): Result.003 file - promoters60/2105398
aattttgtaaatt

SEQ ID NO: 125070 - DNA, 13 bp, Unknown
  misc_feature (1)..( 13): Result.003 file - promoters60/2105398
ctttttataatca

SEQ ID NO: 125071 - DNA, 13 bp, Unknown
  misc_feature (1)..( 13): Result.003 file - promoters60/2105398
ttttttgtatcca

SEQ ID NO: 125072 - DNA, 13 bp, Unknown
  misc_feature (1)..( 13): Result.003 file - promoters60/2105398
tattttttaaatt

SEQ ID NO: 125073 - DNA, 13 bp, Unknown
  misc_feature (1)..( 13): Result.003 file - promoters60/2105398
gacattataaaat

SEQ ID NO: 125074 - DNA, 9 bp, Unknown
  misc_feature (1)..( 9): Result.003 file - promoters60/2105398
tttgatagg

SEQ ID NO: 125075 - DNA, 9 bp, Unknown
  misc_feature (1)..( 9): Result.003 file - promoters60/2105398
tttaataca

SEQ ID NO: 125076 - DNA, 10 bp, Unknown
  misc_feature (1)..( 10): Result.003 file - promoters60/2105398
tttagatgga

SEQ ID NO: 125077 - DNA, 10 bp, Unknown
  misc_feature (1)..( 10): Result.003 file - promoters60/2105398
tttagataaa

SEQ ID NO: 125078 - DNA, 10 bp, Unknown
  misc_feature (1)..( 10): Result.003 file - promoters60/2105398
tttagatatg

SEQ ID NO: 125079 - DNA, 10 bp, Unknown
  misc_feature (1)..( 10): Result.003 file - promoters60/2105398
caaagacaaa

SEQ ID NO: 125080 - DNA, 12 bp, Unknown
  misc_feature (1)..( 12): Result.003 file - promoters60/2105398
tggttagaattt

SEQ ID NO: 125081 - DNA, 12 bp, Unknown
  misc_feature (1)..( 12): Result.003 file - promoters60/2105398
tttttataatca

SEQ ID NO: 125082 - DNA, 12 bp, Unknown
  misc_feature (1)..( 12): Result.003 file - promoters60/2105398
attttgtaaatt

SEQ ID NO: 125083 - DNA, 12 bp, Unknown
  misc_feature (1)..( 12): Result.003 file - promoters60/2105398
tttttgtatcca

SEQ ID NO: 125084 - DNA, 12 bp, Unknown
  misc_feature (1)..( 12): Result.003 file - promoters60/2105398
attttttaaatt

SEQ ID NO: 125085 - DNA, 12 bp, Unknown
  misc_feature (1)..( 12): Result.003 file - promoters60/2105398
acattataaaat

SEQ ID NO: 125086 - DNA, 8 bp, Unknown
  misc_feature (1)..( 8): Result.003 file - promoters60/2105398
gtttgatt

SEQ ID NO: 125087 - DNA, 8 bp, Unknown
  misc_feature (1)..( 8): Result.003 file - promoters60/2105398
tttttatt

SEQ ID NO: 125088 - DNA, 8 bp, Unknown
  misc_feature (1)..( 8): Result.003 file - promoters60/2105398
gatttatt

SEQ ID NO: 125089 - DNA, 8 bp, Unknown
  misc_feature (1)..( 8): Result.003 file - promoters60/2105398
attttttt

SEQ ID NO: 125090 - DNA, 8 bp, Unknown
  misc_feature (1)..( 8): Result.003 file - promoters60/2105398
atttttac

SEQ ID NO: 125091 - DNA, 8 bp, Unknown
  misc_feature (1)..( 8): Result.003 file - promoters60/2105398
attgttta

SEQ ID NO: 125092 - DNA, 16 bp, Unknown
  misc_feature (1)..( 16): Result.003 file - promoters60/2105514
caatgggctgggccta

SEQ ID NO: 125093 - DNA, 16 bp, Unknown
  misc_feature (1)..( 16): Result.003 file - promoters60/2105514
aaataggcccaacaaa

SEQ ID NO: 125094 - DNA, 16 bp, Unknown
  misc_feature (1)..( 16): Result.003 file - promoters60/2105514
tgttgggcttttaatg

SEQ ID NO: 125095 - DNA, 16 bp, Unknown
  misc_feature (1)..( 16): Result.003 file - promoters60/2105514
aaaaaggcccattata

SEQ ID NO: 125096 - DNA, 16 bp, Unknown
  misc_feature (1)..( 16): Result.003 file - promoters60/2105514
aataaagcccattata

SEQ ID NO: 125097 - DNA, 16 bp, Unknown
  misc_feature (1)..( 16): Result.003 file - promoters60/2105514
ctaaaggcccaataac

SEQ ID NO: 125098 - DNA, 8 bp, Unknown
  misc_feature (1)..( 8): Result.003 file - promoters60/2105518
ggtgatgg

SEQ ID NO: 125099 - DNA, 8 bp, Unknown
  misc_feature (1)..( 8): Result.003 file - promoters60/2105518
ggttatgt

SEQ ID NO: 125100 - DNA, 8 bp, Unknown
  misc_feature (1)..( 8): Result.003 file - promoters60/2105518
ggttattt

SEQ ID NO: 125101 - DNA, 8 bp, Unknown
  misc_feature (1)..( 8): Result.003 file - promoters60/2105518
ggttttgt

SEQ ID NO: 125102 - DNA, 18 bp, Unknown
  misc_feature (1)..( 18): Result.003 file - promoters60/2105518
ttataccaaaattaaatg

SEQ ID NO: 125103 - DNA, 18 bp, Unknown
  misc_feature (1)..( 18): Result.003 file - promoters60/2105518
ctttactaaaatgaaatg

SEQ ID NO: 125104 - DNA, 18 bp, Unknown
  misc_feature (1)..( 18): Result.003 file - promoters60/2105518
tataataataataaaaaa

SEQ ID NO: 125105 - DNA, 18 bp, Unknown
  misc_feature (1)..( 18): Result.003 file - promoters60/2105518
ctttaccaaatatgcaaa

SEQ ID NO: 125106 - DNA, 9 bp, Unknown
  misc_feature (1)..( 9): Result.003 file - promoters60/2105533
ctaaaaaga

SEQ ID NO: 125107 - DNA, 9 bp, Unknown
  misc_feature (1)..( 9): Result.003 file - promoters60/2105533
ctaaagaga

SEQ ID NO: 125108 - DNA, 10 bp, Unknown
  misc_feature (1)..( 10): Result.003 file - promoters60/2105533
gtggactatt

SEQ ID NO: 125109 - DNA, 10 bp, Unknown
  misc_feature (1)..( 10): Result.003 file - promoters60/2105533
gtggactatt

SEQ ID NO: 125110 - DNA, 8 bp, Unknown
  misc_feature (1)..( 8): Result.003 file - promoters60/2105533
attgatag

SEQ ID NO: 125111 - DNA, 8 bp, Unknown
  misc_feature (1)..( 8): Result.003 file - promoters60/2105533
attgttag

SEQ ID NO: 125112 - DNA, 6 bp, Unknown
  misc_feature (1)..( 6): Result.003 file - promoters60/2105533
gttact

SEQ ID NO: 125113 - DNA, 6 bp, Unknown
  misc_feature (1)..( 6): Result.003 file - promoters60/2105533
gttact

SEQ ID NO: 125114 - DNA, 6 bp, Unknown
  misc_feature (1)..( 6): Result.003 file - promoters60/2105533
tttaac

SEQ ID NO: 125115 - DNA, 6 bp, Unknown
  misc_feature (1)..( 6): Result.003 file - promoters60/2105533
tttaac

SEQ ID NO: 125116 - DNA, 6 bp, Unknown
  misc_feature (1)..( 6): Result.003 file - promoters60/2105533
agtaaa

SEQ ID NO: 125117 - DNA, 6 bp, Unknown
  misc_feature (1)..( 6): Result.003 file - promoters60/2105533
agtaaa

SEQ ID NO: 125118 - DNA, 7 bp, Unknown
  misc_feature (1)..( 7): Result.003 file - promoters60/2105533
gattaaa

SEQ ID NO: 125119 - DNA, 7 bp, Unknown
  misc_feature (1)..( 7): Result.003 file - promoters60/2105533
gatgaaa

SEQ ID NO: 125120 - DNA, 7 bp, Unknown
  misc_feature (1)..( 7): Result.003 file - promoters60/2105533
gattaat

SEQ ID NO: 125121 - DNA, 9 bp, Unknown
  misc_feature (1)..( 9): Result.003 file - promoters60/2105533
aagacgttg

SEQ ID NO: 125122 - DNA, 9 bp, Unknown
  misc_feature (1)..( 9): Result.003 file - promoters60/2105533
aagaagtta

SEQ ID NO: 125123 - DNA, 9 bp, Unknown
  misc_feature (1)..( 9): Result.003 file - promoters60/2105533
ttgaattta

SEQ ID NO: 125124 - DNA, 8 bp, Unknown
  misc_feature (1)..( 8): Result.003 file - promoters60/2105533
aagttgtt

SEQ ID NO: 125125 - DNA, 8 bp, Unknown
  misc_feature (1)..( 8): Result.003 file - promoters60/2105533
aagctgtt

SEQ ID NO: 125126 - DNA, 8 bp, Unknown
  misc_feature (1)..( 8): Result.003 file - promoters60/2105533
tgtttaga

SEQ ID NO: 125127 - DNA, 8 bp, Unknown
  misc_feature (1)..( 8): Result.003 file - promoters60/2105533
tgttcaga

SEQ ID NO: 125128 - DNA, 6 bp, Unknown
  misc_feature (1)..( 6): Result.003 file - promoters60/2105533
ctcacc

SEQ ID NO: 125129 - DNA, 6 bp, Unknown
  misc_feature (1)..( 6): Result.003 file - promoters60/2105533
ctcacc

SEQ ID NO: 125130 - DNA, 6 bp, Unknown
  misc_feature (1)..( 6): Result.003 file - promoters60/2105533
acacgt

SEQ ID NO: 125131 - DNA, 6 bp, Unknown
  misc_feature (1)..( 6): Result.003 file - promoters60/2105533
acacgt

SEQ ID NO: 125132 - DNA, 6 bp, Unknown
  misc_feature (1)..( 6): Result.003 file - promoters60/2105533
ttaacc

SEQ ID NO: 125133 - DNA, 6 bp, Unknown
  misc_feature (1)..( 6): Result.003 file - promoters60/2105533
ttaacc

SEQ ID NO: 125134 - DNA, 7 bp, Unknown
  misc_feature (1)..( 7): Result.003 file - promoters60/2105533
caatttt

SEQ ID NO: 125135 - DNA, 7 bp, Unknown
  misc_feature (1)..( 7): Result.003 file - promoters60/2105533
caaattt

SEQ ID NO: 125136 - DNA, 8 bp, Unknown
  misc_feature (1)..( 8): Result.003 file - promoters60/2105533
ttttgaat

SEQ ID NO: 125137 - DNA, 8 bp, Unknown
  misc_feature (1)..( 8): Result.003 file - promoters60/2105533
tttggaaa

SEQ ID NO: 125138 - DNA, 8 bp, Unknown
  misc_feature (1)..( 8): Result.003 file - promoters60/2105533
ggtggaaa

SEQ ID NO: 125139 - DNA, 7 bp, Unknown
  misc_feature (1)..( 7): Result.003 file - promoters60/2105533
attaatt

SEQ ID NO: 125140 - DNA, 7 bp, Unknown
  misc_feature (1)..( 7): Result.003 file - promoters60/2105533
attaatt

SEQ ID NO: 125141 - DNA, 7 bp, Unknown
  misc_feature (1)..( 7): Result.003 file - promoters60/2105533
cttctgt

SEQ ID NO: 125142 - DNA, 7 bp, Unknown
  misc_feature (1)..( 7): Result.003 file - promoters60/2105533
cttatgt

SEQ ID NO: 125143 - DNA, 11 bp, Unknown
  misc_feature (1)..( 11): Result.003 file - promoters60/2105535
tcaaagaaaga

SEQ ID NO: 125144 - DNA, 11 bp, Unknown
  misc_feature (1)..( 11): Result.003 file - promoters60/2105535
tcaaacaaatc

SEQ ID NO: 125145 - DNA, 11 bp, Unknown
  misc_feature (1)..( 11): Result.003 file - promoters60/2105535
ccaaagaaagg

SEQ ID NO: 125146 - DNA, 11 bp, Unknown
  misc_feature (1)..( 11): Result.003 file - promoters60/2105535
acaaggaaaga

SEQ ID NO: 125147 - DNA, 11 bp, Unknown
  misc_feature (1)..( 11): Result.003 file - promoters60/2105535
acaacgaataa

SEQ ID NO: 125148 - DNA, 11 bp, Unknown
  misc_feature (1)..( 11): Result.003 file - promoters60/2105535
tcaaataaatt

SEQ ID NO: 125149 - DNA, 11 bp, Unknown
  misc_feature (1)..( 11): Result.003 file - promoters60/2105535
gacaatacatt

SEQ ID NO: 125150 - DNA, 11 bp, Unknown
  misc_feature (1)..( 11): Result.003 file - promoters60/2105912
tccagaaataa

SEQ ID NO: 125151 - DNA, 11 bp, Unknown
  misc_feature (1)..( 11): Result.003 file - promoters60/2105912
gttagaaataa

SEQ ID NO: 125152 - DNA, 11 bp, Unknown
  misc_feature (1)..( 11): Result.003 file - promoters60/2105912
accacaaaaca

SEQ ID NO: 125153 - DNA, 11 bp, Unknown
  misc_feature (1)..( 11): Result.003 file - promoters60/2105912
gttaaaaacta

SEQ ID NO: 125154 - DNA, 7 bp, Unknown
  misc_feature (1)..( 7): Result.003 file - promoters60/2105912
acagata

SEQ ID NO: 125155 - DNA, 7 bp, Unknown
  misc_feature (1)..( 7): Result.003 file - promoters60/2105912
gcagata

SEQ ID NO: 125156 - DNA, 7 bp, Unknown
  misc_feature (1)..( 7): Result.003 file - promoters60/2105912
acatata

SEQ ID NO: 125157 - DNA, 10 bp, Unknown
  misc_feature (1)..( 10): Result.003 file - promoters60/2105912
agatttgtta

SEQ ID NO: 125158 - DNA, 10 bp, Unknown
  misc_feature (1)..( 10): Result.003 file - promoters60/2105912
ctatttgtta

SEQ ID NO: 125159 - DNA, 10 bp, Unknown
  misc_feature (1)..( 10): Result.003 file - promoters60/2105912
agatttttta

SEQ ID NO: 125160 - DNA, 8 bp, Unknown
  misc_feature (1)..( 8): Result.003 file - promoters60/2105912
taacggtt

SEQ ID NO: 125161 - DNA, 8 bp, Unknown
  misc_feature (1)..( 8): Result.003 file - promoters60/2105912
aaacagtt

SEQ ID NO: 125162 - DNA, 8 bp, Unknown
  misc_feature (1)..( 8): Result.003 file - promoters60/2105912
aaacagag

SEQ ID NO: 125163 - DNA, 8 bp, Unknown
  misc_feature (1)..( 8): Result.003 file - promoters60/2105912
aaaaagag

SEQ ID NO: 125164 - DNA, 11 bp, Unknown
  misc_feature (1)..( 11): Result.003 file - promoters60/2105912
aaggagtgaca

SEQ ID NO: 125165 - DNA, 11 bp, Unknown
  misc_feature (1)..( 11): Result.003 file - promoters60/2105912
aaggaatgata

SEQ ID NO: 125166 - DNA, 11 bp, Unknown
  misc_feature (1)..( 11): Result.003 file - promoters60/2105912
acctaataata

SEQ ID NO: 125167 - DNA, 8 bp, Unknown
  misc_feature (1)..( 8): Result.003 file - promoters60/2105912
aaaaggag

SEQ ID NO: 125168 - DNA, 8 bp, Unknown
  misc_feature (1)..( 8): Result.003 file - promoters60/2105912
aaaaagag

SEQ ID NO: 125169 - DNA, 8 bp, Unknown
  misc_feature (1)..( 8): Result.003 file - promoters60/2105912
aaacagag

SEQ ID NO: 125170 - DNA, 7 bp, Unknown
  misc_feature (1)..( 7): Result.003 file - promoters60/2105912
ataattt

SEQ ID NO: 125171 - DNA, 7 bp, Unknown
  misc_feature (1)..( 7): Result.003 file - promoters60/2105912
ttaattt

SEQ ID NO: 125172 - DNA, 7 bp, Unknown
  misc_feature (1)..( 7): Result.003 file - promoters60/2105912
ttaatta

SEQ ID NO: 125173 - DNA, 8 bp, Unknown
  misc_feature (1)..( 8): Result.003 file - promoters60/2105912
ataaaaat

SEQ ID NO: 125174 - DNA, 8 bp, Unknown
  misc_feature (1)..( 8): Result.003 file - promoters60/2105912
ataaaaac

SEQ ID NO: 125175 - DNA, 8 bp, Unknown
  misc_feature (1)..( 8): Result.003 file - promoters60/2105912
acaaaaac

SEQ ID NO: 125176 - DNA, 8 bp, Unknown
  misc_feature (1)..( 8): Result.003 file - promoters60/2105912
aaacgaat

SEQ ID NO: 125177 - DNA, 8 bp, Unknown
  misc_feature (1)..( 8): Result.003 file - promoters60/2105912
aaactaat

SEQ ID NO: 125178 - DNA, 8 bp, Unknown
  misc_feature (1)..( 8): Result.003 file - promoters60/2105912
aaaagaaa

SEQ ID NO: 125179 - DNA, 9 bp, Unknown
  misc_feature (1)..( 9): Result.003 file - promoters60/2105912
gaaacagag

SEQ ID NO: 125180 - DNA, 9 bp, Unknown
  misc_feature (1)..( 9): Result.003 file - promoters60/2105912
gaatcagga

SEQ ID NO: 125181 - DNA, 9 bp, Unknown
  misc_feature (1)..( 9): Result.003 file - promoters60/2105912
aaaaaagag

SEQ ID NO: 125182 - DNA, 8 bp, Unknown
  misc_feature (1)..( 8): Result.003 file - promoters60/2105912
aatcatat

SEQ ID NO: 125183 - DNA, 8 bp, Unknown
  misc_feature (1)..( 8): Result.003 file - promoters60/2105912
aataatac

SEQ ID NO: 125184 - DNA, 8 bp, Unknown
  misc_feature (1)..( 8): Result.003 file - promoters60/2105912
acttataa

SEQ ID NO: 125185 - DNA, 6 bp, Unknown
  misc_feature (1)..( 6): Result.003 file - promoters60/2106027
gaaatt

SEQ ID NO: 125186 - DNA, 6 bp, Unknown
  misc_feature (1)..( 6): Result.003 file - promoters60/2106027
gaaatt

SEQ ID NO: 125187 - DNA, 8 bp, Unknown
  misc_feature (1)..( 8): Result.003 file - promoters60/2106027
gaagtgga

SEQ ID NO: 125188 - DNA, 8 bp, Unknown
  misc_feature (1)..( 8): Result.003 file - promoters60/2106027
gaagagga

SEQ ID NO: 125189 - DNA, 6 bp, Unknown
  misc_feature (1)..( 6): Result.003 file - promoters60/2106027
ataatc

SEQ ID NO: 125190 - DNA, 6 bp, Unknown
  misc_feature (1)..( 6): Result.003 file - promoters60/2106027
ataatc

SEQ ID NO: 125191 - DNA, 9 bp, Unknown
  misc_feature (1)..( 9): Result.003 file - promoters60/2106027
aaatattgt

SEQ ID NO: 125192 - DNA, 9 bp, Unknown
  misc_feature (1)..( 9): Result.003 file - promoters60/2106027
aaagattgt

SEQ ID NO: 125193 - DNA, 8 bp, Unknown
  misc_feature (1)..( 8): Result.003 file - promoters60/2106027
atatcttc

SEQ ID NO: 125194 - DNA, 8 bp, Unknown
  misc_feature (1)..( 8): Result.003 file - promoters60/2106027
atatcttc

SEQ ID NO: 125195 - DNA, 7 bp, Unknown
  misc_feature (1)..( 7): Result.003 file - promoters60/2106027
aggagat

SEQ ID NO: 125196 - DNA, 7 bp, Unknown
  misc_feature (1)..( 7): Result.003 file - promoters60/2106027
aggcgat

SEQ ID NO: 125197 - DNA, 7 bp, Unknown
  misc_feature (1)..( 7): Result.003 file - promoters60/2106027
attttca

SEQ ID NO: 125198 - DNA, 7 bp, Unknown
  misc_feature (1)..( 7): Result.003 file - promoters60/2106027
attctca

SEQ ID NO: 125199 - DNA, 8 bp, Unknown
  misc_feature (1)..( 8): Result.003 file - promoters60/2106027
tggaatcc

SEQ ID NO: 125200 - DNA, 8 bp, Unknown
  misc_feature (1)..( 8): Result.003 file - promoters60/2106027
tggtatcc

SEQ ID NO: 125201 - DNA, 7 bp, Unknown
  misc_feature (1)..( 7): Result.003 file - promoters60/2106027
atcatgc

SEQ ID NO: 125202 - DNA, 7 bp, Unknown
  misc_feature (1)..( 7): Result.003 file - promoters60/2106027
atcctgc

SEQ ID NO: 125203 - DNA, 9 bp, Unknown
  misc_feature (1)..( 9): Result.003 file - promoters60/2106076
aatatcaaa

SEQ ID NO: 125204 - DNA, 9 bp, Unknown
  misc_feature (1)..( 9): Result.003 file - promoters60/2106076
aagatcaaa

SEQ ID NO: 125205 - DNA, 9 bp, Unknown
  misc_feature (1)..( 9): Result.003 file - promoters60/2106076
aagaccaac

SEQ ID NO: 125206 - DNA, 6 bp, Unknown
  misc_feature (1)..( 6): Result.003 file - promoters60/2106109
tataat

SEQ ID NO: 125207 - DNA, 6 bp, Unknown
  misc_feature (1)..( 6): Result.003 file - promoters60/2106109
tataat

SEQ ID NO: 125208 - DNA, 6 bp, Unknown
  misc_feature (1)..( 6): Result.003 file - promoters60/2106109
ccacca

SEQ ID NO: 125209 - DNA, 6 bp, Unknown
  misc_feature (1)..( 6): Result.003 file - promoters60/2106109
ccacca

SEQ ID NO: 125210 - DNA, 9 bp, Unknown
  misc_feature (1)..( 9): Result.003 file - promoters60/2106109
gtatatatt

SEQ ID NO: 125211 - DNA, 9 bp, Unknown
  misc_feature (1)..( 9): Result.003 file - promoters60/2106109
gtagatatt

SEQ ID NO: 125212 - DNA, 6 bp, Unknown
  misc_feature (1)..( 6): Result.003 file - promoters60/2106109
aacatt

SEQ ID NO: 125213 - DNA, 6 bp, Unknown
  misc_feature (1)..( 6): Result.003 file - promoters60/2106109
aacatt

SEQ ID NO: 125214 - DNA, 7 bp, Unknown
  misc_feature (1)..( 7): Result.003 file - promoters60/2106109
ttgatga

SEQ ID NO: 125215 - DNA, 7 bp, Unknown
  misc_feature (1)..( 7): Result.003 file - promoters60/2106109
ttgatga

SEQ ID NO: 125216 - DNA, 8 bp, Unknown
  misc_feature (1)..( 8): Result.003 file - promoters60/2106109
ttagtcaa

SEQ ID NO: 125217 - DNA, 8 bp, Unknown
  misc_feature (1)..( 8): Result.003 file - promoters60/2106109
ttaatcaa

SEQ ID NO: 125218 - DNA, 8 bp, Unknown
  misc_feature (1)..( 8): Result.003 file - promoters60/2106109
aaaaggta

SEQ ID NO: 125219 - DNA, 8 bp, Unknown
  misc_feature (1)..( 8): Result.003 file - promoters60/2106109
aaatggtt

SEQ ID NO: 125220 - DNA, 8 bp, Unknown
  misc_feature (1)..( 8): Result.003 file - promoters60/2106109
taattgtt

SEQ ID NO: 125221 - DNA, 7 bp, Unknown
  misc_feature (1)..( 7): Result.003 file - promoters60/2106109
aatctct

SEQ ID NO: 125222 - DNA, 7 bp, Unknown
  misc_feature (1)..( 7): Result.003 file - promoters60/2106109
aatctct

SEQ ID NO: 125223 - DNA, 6 bp, Unknown
  misc_feature (1)..( 6): Result.003 file - promoters60/2106109
caaatt

SEQ ID NO: 125224 - DNA, 6 bp, Unknown
  misc_feature (1)..( 6): Result.003 file - promoters60/2106109
caaatt

SEQ ID NO: 125225 - DNA, 9 bp, Unknown
  misc_feature (1)..( 9): Result.003 file - promoters60/2106109
aatcataaa

SEQ ID NO: 125226 - DNA, 9 bp, Unknown
  misc_feature (1)..( 9): Result.003 file - promoters60/2106109
aatcaaaaa

SEQ ID NO: 125227 - DNA, 8 bp, Unknown
  misc_feature (1)..( 8): Result.003 file - promoters60/2106109
tatagtaa

SEQ ID NO: 125228 - DNA, 8 bp, Unknown
  misc_feature (1)..( 8): Result.003 file - promoters60/2106109
tattgtaa

SEQ ID NO: 125229 - DNA, 8 bp, Unknown
  misc_feature (1)..( 8): Result.003 file - promoters60/2106109
attgtttt

SEQ ID NO: 125230 - DNA, 8 bp, Unknown
  misc_feature (1)..( 8): Result.003 file - promoters60/2106109
attttttt

SEQ ID NO: 125231 - DNA, 8 bp, Unknown
  misc_feature (1)..( 8): Result.003 file - promoters60/2106109
atttttat

SEQ ID NO: 125232 - DNA, 6 bp, Unknown
  misc_feature (1)..( 6): Result.003 file - promoters60/2106109
tttgtt

SEQ ID NO: 125233 - DNA, 6 bp, Unknown
  misc_feature (1)..( 6): Result.003 file - promoters60/2106109
tttgtt

SEQ ID NO: 125234 - DNA, 6 bp, Unknown
  misc_feature (1)..( 6): Result.003 file - promoters60/2106109
tataac

SEQ ID NO: 125235 - DNA, 6 bp, Unknown
  misc_feature (1)..( 6): Result.003 file - promoters60/2106109
tataac

SEQ ID NO: 125236 - DNA, 8 bp, Unknown
  misc_feature (1)..( 8): Result.003 file - promoters60/2106109
gaagaaag

SEQ ID NO: 125237 - DNA, 8 bp, Unknown
  misc_feature (1)..( 8): Result.003 file - promoters60/2106109
gaacaaag

SEQ ID NO: 125238 - DNA, 8 bp, Unknown
  misc_feature (1)..( 8): Result.003 file - promoters60/2106109
tttaaatg

SEQ ID NO: 125239 - DNA, 8 bp, Unknown
  misc_feature (1)..( 8): Result.003 file - promoters60/2106109
tttatatg

SEQ ID NO: 125240 - DNA, 7 bp, Unknown
  misc_feature (1)..( 7): Result.003 file - promoters60/2106109
ccaaaca

SEQ ID NO: 125241 - DNA, 7 bp, Unknown
  misc_feature (1)..( 7): Result.003 file - promoters60/2106109
ccataca

SEQ ID NO: 125242 - DNA, 8 bp, Unknown
  misc_feature (1)..( 8): Result.003 file - promoters60/2106109
tacaaaaa

SEQ ID NO: 125243 - DNA, 8 bp, Unknown
  misc_feature (1)..( 8): Result.003 file - promoters60/2106109
tacaaaaa

SEQ ID NO: 125244 - DNA, 8 bp, Unknown
  misc_feature (1)..( 8): Result.003 file - promoters60/2106109
aaaaaaag

SEQ ID NO: 125245 - DNA, 8 bp, Unknown
  misc_feature (1)..( 8): Result.003 file - promoters60/2106109
aaacaaag

SEQ ID NO: 125246 - DNA, 8 bp, Unknown
  misc_feature (1)..( 8): Result.003 file - promoters60/2106109
aaccacct

SEQ ID NO: 125247 - DNA, 8 bp, Unknown
  misc_feature (1)..( 8): Result.003 file - promoters60/2106109
aacaacct

SEQ ID NO: 125248 - DNA, 7 bp, Unknown
  misc_feature (1)..( 7): Result.003 file - promoters60/2106659
tcttcat

SEQ ID NO: 125249 - DNA, 7 bp, Unknown
  misc_feature (1)..( 7): Result.003 file - promoters60/2106659
tcttcat

SEQ ID NO: 125250 - DNA, 6 bp, Unknown
  misc_feature (1)..( 6): Result.003 file - promoters60/2106659
taaaac

SEQ ID NO: 125251 - DNA, 6 bp, Unknown
  misc_feature (1)..( 6): Result.003 file - promoters60/2106659
taaaac

SEQ ID NO: 125252 - DNA, 7 bp, Unknown
  misc_feature (1)..( 7): Result.003 file - promoters60/2106659
tattctc

SEQ ID NO: 125253 - DNA, 7 bp, Unknown
  misc_feature (1)..( 7): Result.003 file - promoters60/2106659
tatcctc

SEQ ID NO: 125254 - DNA, 6 bp, Unknown
  misc_feature (1)..( 6): Result.003 file - promoters60/2106659
atttat

SEQ ID NO: 125255 - DNA, 6 bp, Unknown
  misc_feature (1)..( 6): Result.003 file - promoters60/2106659
atttat

SEQ ID NO: 125256 - DNA, 6 bp, Unknown
  misc_feature (1)..( 6): Result.003 file - promoters60/2106659
aaaacc

SEQ ID NO: 125257 - DNA, 6 bp, Unknown
  misc_feature (1)..( 6): Result.003 file - promoters60/2106659
aaaacc

SEQ ID NO: 125258 - DNA, 7 bp, Unknown
  misc_feature (1)..( 7): Result.003 file - promoters60/2106659
tcctaaa

SEQ ID NO: 125259 - DNA, 7 bp, Unknown
  misc_feature (1)..( 7): Result.003 file - promoters60/2106659
tccgaaa

SEQ ID NO: 125260 - DNA, 9 bp, Unknown
  misc_feature (1)..( 9): Result.003 file - promoters60/2106659
gttatatcg

SEQ ID NO: 125261 - DNA, 9 bp, Unknown
  misc_feature (1)..( 9): Result.003 file - promoters60/2106659
gttagatcg

SEQ ID NO: 125262 - DNA, 6 bp, Unknown
  misc_feature (1)..( 6): Result.003 file - promoters60/2106659
aaatct

SEQ ID NO: 125263 - DNA, 6 bp, Unknown
  misc_feature (1)..( 6): Result.003 file - promoters60/2106659
aaatct

SEQ ID NO: 125264 - DNA, 7 bp, Unknown
  misc_feature (1)..( 7): Result.003 file - promoters60/2106659
atgtttg

SEQ ID NO: 125265 - DNA, 7 bp, Unknown
  misc_feature (1)..( 7): Result.003 file - promoters60/2106659
atggttg

SEQ ID NO: 125266 - DNA, 6 bp, Unknown
  misc_feature (1)..( 6): Result.003 file - promoters60/2106659
tttgtt

SEQ ID NO: 125267 - DNA, 6 bp, Unknown
  misc_feature (1)..( 6): Result.003 file - promoters60/2106659
tttgtt

SEQ ID NO: 125268 - DNA, 8 bp, Unknown
  misc_feature (1)..( 8): Result.003 file - promoters60/2106659
ttatcaag

SEQ ID NO: 125269 - DNA, 8 bp, Unknown
  misc_feature (1)..( 8): Result.003 file - promoters60/2106659
ttattaag

SEQ ID NO: 125270 - DNA, 6 bp, Unknown
  misc_feature (1)..( 6): Result.003 file - promoters60/2106659
ttatct

SEQ ID NO: 125271 - DNA, 6 bp, Unknown
  misc_feature (1)..( 6): Result.003 file - promoters60/2106659
ttatct

SEQ ID NO: 125272 - DNA, 6 bp, Unknown
  misc_feature (1)..( 6): Result.003 file - promoters60/2106659
agtaaa

SEQ ID NO: 125273 - DNA, 6 bp, Unknown
  misc_feature (1)..( 6): Result.003 file - promoters60/2106659
agtaaa

SEQ ID NO: 125274 - DNA, 7 bp, Unknown
  misc_feature (1)..( 7): Result.003 file - promoters60/2106659
aatcggg

SEQ ID NO: 125275 - DNA, 7 bp, Unknown
  misc_feature (1)..( 7): Result.003 file - promoters60/2106659
aattggg

SEQ ID NO: 125276 - DNA, 8 bp, Unknown
  misc_feature (1)..( 8): Result.003 file - promoters60/2106659
gaaagaaa

SEQ ID NO: 125277 - DNA, 8 bp, Unknown
  misc_feature (1)..( 8): Result.003 file - promoters60/2106659
gaaacaaa

SEQ ID NO: 125278 - DNA, 10 bp, Unknown
  misc_feature (1)..( 10): Result.003 file - promoters60/2106659
ggaaaagaaa

SEQ ID NO: 125279 - DNA, 10 bp, Unknown
  misc_feature (1)..( 10): Result.003 file - promoters60/2106659
ggaaatgaaa

SEQ ID NO: 125280 - DNA, 7 bp, Unknown
  misc_feature (1)..( 7): Result.003 file - promoters60/2106659
cccacta

SEQ ID NO: 125281 - DNA, 7 bp, Unknown
  misc_feature (1)..( 7): Result.003 file - promoters60/2106659
cccacta

SEQ ID NO: 125282 - DNA, 9 bp, Unknown
  misc_feature (1)..( 9): Result.003 file - promoters60/2106659
aaagaaaag

SEQ ID NO: 125283 - DNA, 9 bp, Unknown
  misc_feature (1)..( 9): Result.003 file - promoters60/2106659
aaagtaaag

SEQ ID NO: 125284 - DNA, 7 bp, Unknown
  misc_feature (1)..( 7): Result.003 file - promoters60/2106659
gtatata

SEQ ID NO: 125285 - DNA, 7 bp, Unknown
  misc_feature (1)..( 7): Result.003 file - promoters60/2106659
gtatata

SEQ ID NO: 125286 - DNA, 9 bp, Unknown
  misc_feature (1)..( 9): Result.003 file - promoters60/2106682
tgagctgtt

SEQ ID NO: 125287 - DNA, 9 bp, Unknown
  misc_feature (1)..( 9): Result.003 file - promoters60/2106682
tgatctgtt

SEQ ID NO: 125288 - DNA, 8 bp, Unknown
  misc_feature (1)..( 8): Result.003 file - promoters60/2106682
attacttc

SEQ ID NO: 125289 - DNA, 8 bp, Unknown
  misc_feature (1)..( 8): Result.003 file - promoters60/2106682
atttcttc

SEQ ID NO: 125290 - DNA, 7 bp, Unknown
  misc_feature (1)..( 7): Result.003 file - promoters60/2106682
agcaaat

SEQ ID NO: 125291 - DNA, 7 bp, Unknown
  misc_feature (1)..( 7): Result.003 file - promoters60/2106682
agctaat

SEQ ID NO: 125292 - DNA, 9 bp, Unknown
  misc_feature (1)..( 9): Result.003 file - promoters60/2106682
aaataagct

SEQ ID NO: 125293 - DNA, 9 bp, Unknown
  misc_feature (1)..( 9): Result.003 file - promoters60/2106682
aaaaaagct

SEQ ID NO: 125294 - DNA, 7 bp, Unknown
  misc_feature (1)..( 7): Result.003 file - promoters60/2106682
taaaggg

SEQ ID NO: 125295 - DNA, 7 bp, Unknown
  misc_feature (1)..( 7): Result.003 file - promoters60/2106682
taaaggg

SEQ ID NO: 125296 - DNA, 6 bp, Unknown
  misc_feature (1)..( 6): Result.003 file - promoters60/2106682
tgtctc

SEQ ID NO: 125297 - DNA, 6 bp, Unknown
  misc_feature (1)..( 6): Result.003 file - promoters60/2106682
tgtctc

SEQ ID NO: 125298 - DNA, 6 bp, Unknown
  misc_feature (1)..( 6): Result.003 file - promoters60/2106682
cctctg

SEQ ID NO: 125299 - DNA, 6 bp, Unknown
  misc_feature (1)..( 6): Result.003 file - promoters60/2106682
cctctg

SEQ ID NO: 125300 - DNA, 7 bp, Unknown
  misc_feature (1)..( 7): Result.003 file - promoters60/2106682
gtgacat

SEQ ID NO: 125301 - DNA, 7 bp, Unknown
  misc_feature (1)..( 7): Result.003 file - promoters60/2106682
gtgacat

SEQ ID NO: 125302 - DNA, 7 bp, Unknown
  misc_feature (1)..( 7): Result.003 file - promoters60/2106682
taacaat

SEQ ID NO: 125303 - DNA, 7 bp, Unknown
  misc_feature (1)..( 7): Result.003 file - promoters60/2106682
taataat

SEQ ID NO: 125304 - DNA, 6 bp, Unknown
  misc_feature (1)..( 6): Result.003 file - promoters60/2106682
tgtttc

SEQ ID NO: 125305 - DNA, 6 bp, Unknown
  misc_feature (1)..( 6): Result.003 file - promoters60/2106682
tgtttc

SEQ ID NO: 125306 - DNA, 6 bp, Unknown
  misc_feature (1)..( 6): Result.003 file - promoters60/2106682
ggtccc

SEQ ID NO: 125307 - DNA, 6 bp, Unknown
  misc_feature (1)..( 6): Result.003 file - promoters60/2106682
ggtccc

SEQ ID NO: 125308 - DNA, 6 bp, Unknown
  misc_feature (1)..( 6): Result.003 file - promoters60/2106682
tattat

SEQ ID NO: 125309 - DNA, 6 bp, Unknown
  misc_feature (1)..( 6): Result.003 file - promoters60/2106682
tattat

SEQ ID NO: 125310 - DNA, 7 bp, Unknown
  misc_feature (1)..( 7): Result.003 file - promoters60/2106682
tacatat

SEQ ID NO: 125311 - DNA, 7 bp, Unknown
  misc_feature (1)..( 7): Result.003 file - promoters60/2106682
tacttat

SEQ ID NO: 125312 - DNA, 6 bp, Unknown
  misc_feature (1)..( 6): Result.003 file - promoters60/2106682
attctt

SEQ ID NO: 125313 - DNA, 6 bp, Unknown
  misc_feature (1)..( 6): Result.003 file - promoters60/2106682
attctt

SEQ ID NO: 125314 - DNA, 10 bp, Unknown
  misc_feature (1)..( 10): Result.003 file - promoters60/2106682
taataaaaat

SEQ ID NO: 125315 - DNA, 10 bp, Unknown
  misc_feature (1)..( 10): Result.003 file - promoters60/2106682
taataataat

SEQ ID NO: 125316 - DNA, 8 bp, Unknown
  misc_feature (1)..( 8): Result.003 file - promoters60/2106682
caaaacta

SEQ ID NO: 125317 - DNA, 8 bp, Unknown
  misc_feature (1)..( 8): Result.003 file - promoters60/2106682
caaaacta

SEQ ID NO: 125318 - DNA, 6 bp, Unknown
  misc_feature (1)..( 6): Result.003 file - promoters60/2106682
aacttc

SEQ ID NO: 125319 - DNA, 6 bp, Unknown
  misc_feature (1)..( 6): Result.003 file - promoters60/2106682
aacttc

SEQ ID NO: 125320 - DNA, 7 bp, Unknown
  misc_feature (1)..( 7): Result.003 file - promoters60/2106682
tcaaggt

SEQ ID NO: 125321 - DNA, 7 bp, Unknown
  misc_feature (1)..( 7): Result.003 file - promoters60/2106682
tcaaggt

SEQ ID NO: 125322 - DNA, 7 bp, Unknown
  misc_feature (1)..( 7): Result.003 file - promoters60/2106682
attttga

SEQ ID NO: 125323 - DNA, 7 bp, Unknown
  misc_feature (1)..( 7): Result.003 file - promoters60/2106682
attatga

SEQ ID NO: 125324 - DNA, 9 bp, Unknown
  misc_feature (1)..( 9): Result.003 file - promoters60/2107016
cttgttatt

SEQ ID NO: 125325 - DNA, 9 bp, Unknown
  misc_feature (1)..( 9): Result.003 file - promoters60/2107016
ctttttatt

SEQ ID NO: 125326 - DNA, 9 bp, Unknown
  misc_feature (1)..( 9): Result.003 file - promoters60/2107016
ggtttgatt

SEQ ID NO: 125327 - DNA, 9 bp, Unknown
  misc_feature (1)..( 9): Result.003 file - promoters60/2107016
ctcaaaaaa

SEQ ID NO: 125328 - DNA, 9 bp, Unknown
  misc_feature (1)..( 9): Result.003 file - promoters60/2107016
gtcaaaaaa

SEQ ID NO: 125329 - DNA, 9 bp, Unknown
  misc_feature (1)..( 9): Result.003 file - promoters60/2107016
gtcaaatcc

SEQ ID NO: 125330 - DNA, 10 bp, Unknown
  misc_feature (1)..( 10): Result.003 file - promoters60/2107065
ggaaaacaga

SEQ ID NO: 125331 - DNA, 10 bp, Unknown
  misc_feature (1)..( 10): Result.003 file - promoters60/2107065
acaaaacatc

SEQ ID NO: 125332 - DNA, 10 bp, Unknown
  misc_feature (1)..( 10): Result.003 file - promoters60/2107065
ggaaaacgaa

SEQ ID NO: 125333 - DNA, 10 bp, Unknown
  misc_feature (1)..( 10): Result.003 file - promoters60/2107065
ataaaacaaa

SEQ ID NO: 125334 - DNA, 10 bp, Unknown
  misc_feature (1)..( 10): Result.003 file - promoters60/2107065
agaatacaat

SEQ ID NO: 125335 - DNA, 10 bp, Unknown
  misc_feature (1)..( 10): Result.003 file - promoters60/2107065
tacaaatatc

SEQ ID NO: 125336 - DNA, 14 bp, Unknown
  misc_feature (1)..( 14): Result.003 file - promoters60/2107065
aaattgggcccaat

SEQ ID NO: 125337 - DNA, 14 bp, Unknown
  misc_feature (1)..( 14): Result.003 file - promoters60/2107065
taattgggcttttt

SEQ ID NO: 125338 - DNA, 14 bp, Unknown
  misc_feature (1)..( 14): Result.003 file - promoters60/2107065
tgattggggttaca

SEQ ID NO: 125339 - DNA, 14 bp, Unknown
  misc_feature (1)..( 14): Result.003 file - promoters60/2107065
gaattggaaatagg

SEQ ID NO: 125340 - DNA, 14 bp, Unknown
  misc_feature (1)..( 14): Result.003 file - promoters60/2107065
ttaatgggccgaat

SEQ ID NO: 125341 - DNA, 15 bp, Unknown
  misc_feature (1)..( 15): Result.003 file - promoters60/2107065
tgattgtggtaaaaa

SEQ ID NO: 125342 - DNA, 10 bp, Unknown
  misc_feature (1)..( 10): Result.003 file - promoters60/2107065
ccattatata

SEQ ID NO: 125343 - DNA, 10 bp, Unknown
  misc_feature (1)..( 10): Result.003 file - promoters60/2107065
actttatata

SEQ ID NO: 125344 - DNA, 10 bp, Unknown
  misc_feature (1)..( 10): Result.003 file - promoters60/2107065
ccactataaa

SEQ ID NO: 125345 - DNA, 10 bp, Unknown
  misc_feature (1)..( 10): Result.003 file - promoters60/2107065
cctttataaa

SEQ ID NO: 125346 - DNA, 10 bp, Unknown
  misc_feature (1)..( 10): Result.003 file - promoters60/2107065
aacctatatt

SEQ ID NO: 125347 - DNA, 10 bp, Unknown
  misc_feature (1)..( 10): Result.003 file - promoters60/2107065
acactatata

SEQ ID NO: 125348 - DNA, 9 bp, Unknown
  misc_feature (1)..( 9): Result.003 file - promoters60/2107065
caagggaag

SEQ ID NO: 125349 - DNA, 9 bp, Unknown
  misc_feature (1)..( 9): Result.003 file - promoters60/2107065
gaagggaaa

SEQ ID NO: 125350 - DNA, 9 bp, Unknown
  misc_feature (1)..( 9): Result.003 file - promoters60/2107065
caaggaaag

SEQ ID NO: 125351 - DNA, 9 bp, Unknown
  misc_feature (1)..( 9): Result.003 file - promoters60/2107065
taagaaaat

SEQ ID NO: 125352 - DNA, 9 bp, Unknown
  misc_feature (1)..( 9): Result.003 file - promoters60/2107065
caaagaaag

SEQ ID NO: 125353 - DNA, 9 bp, Unknown
  misc_feature (1)..( 9): Result.003 file - promoters60/2107065
caagtaaaa

SEQ ID NO: 125354 - DNA, 12 bp, Unknown
  misc_feature (1)..( 12): Result.003 file - promoters60/2107065
aaacataagaaa

SEQ ID NO: 125355 - DNA, 12 bp, Unknown
  misc_feature (1)..( 12): Result.003 file - promoters60/2107065
aaacacaagaag

SEQ ID NO: 125356 - DNA, 12 bp, Unknown
  misc_feature (1)..( 12): Result.003 file - promoters60/2107065
aaaccaaagaaa

SEQ ID NO: 125357 - DNA, 13 bp, Unknown
  misc_feature (1)..( 13): Result.003 file - promoters60/2107065
ttgtacaaggaaa

SEQ ID NO: 125358 - DNA, 13 bp, Unknown
  misc_feature (1)..( 13): Result.003 file - promoters60/2107065
cctatcaaacaaa

SEQ ID NO: 125359 - DNA, 12 bp, Unknown
  misc_feature (1)..( 12): Result.003 file - promoters60/2107065
gaacaaaaaaaa

SEQ ID NO: 125360 - DNA, 7 bp, Unknown
  misc_feature (1)..( 7): Result.003 file - promoters60/2107069
aagctgt

SEQ ID NO: 125361 - DNA, 7 bp, Unknown
  misc_feature (1)..( 7): Result.003 file - promoters60/2107069
aaggtgt

SEQ ID NO: 125362 - DNA, 7 bp, Unknown
  misc_feature (1)..( 7): Result.003 file - promoters60/2107069
gctaatg

SEQ ID NO: 125363 - DNA, 7 bp, Unknown
  misc_feature (1)..( 7): Result.003 file - promoters60/2107069
gctgatg

SEQ ID NO: 125364 - DNA, 6 bp, Unknown
  misc_feature (1)..( 6): Result.003 file - promoters60/2107069
ttgatt

SEQ ID NO: 125365 - DNA, 6 bp, Unknown
  misc_feature (1)..( 6): Result.003 file - promoters60/2107069
ttgatt

SEQ ID NO: 125366 - DNA, 6 bp, Unknown
  misc_feature (1)..( 6): Result.003 file - promoters60/2107069
gattct

SEQ ID NO: 125367 - DNA, 6 bp, Unknown
  misc_feature (1)..( 6): Result.003 file - promoters60/2107069
gattct

SEQ ID NO: 125368 - DNA, 7 bp, Unknown
  misc_feature (1)..( 7): Result.003 file - promoters60/2107069
gaactcc

SEQ ID NO: 125369 - DNA, 7 bp, Unknown
  misc_feature (1)..( 7): Result.003 file - promoters60/2107069
gaaatcc

SEQ ID NO: 125370 - DNA, 7 bp, Unknown
  misc_feature (1)..( 7): Result.003 file - promoters60/2107069
atgcaaa

SEQ ID NO: 125371 - DNA, 7 bp, Unknown
  misc_feature (1)..( 7): Result.003 file - promoters60/2107069
atggaaa

SEQ ID NO: 125372 - DNA, 6 bp, Unknown
  misc_feature (1)..( 6): Result.003 file - promoters60/2107069
ccattg

SEQ ID NO: 125373 - DNA, 6 bp, Unknown
  misc_feature (1)..( 6): Result.003 file - promoters60/2107069
ccattg

SEQ ID NO: 125374 - DNA, 7 bp, Unknown
  misc_feature (1)..( 7): Result.003 file - promoters60/2107069
ctttgaa

SEQ ID NO: 125375 - DNA, 7 bp, Unknown
  misc_feature (1)..( 7): Result.003 file - promoters60/2107069
cttcgaa

SEQ ID NO: 125376 - DNA, 6 bp, Unknown
  misc_feature (1)..( 6): Result.003 file - promoters60/2107069
gttgga

SEQ ID NO: 125377 - DNA, 6 bp, Unknown
  misc_feature (1)..( 6): Result.003 file - promoters60/2107069
gttgga

SEQ ID NO: 125378 - DNA, 8 bp, Unknown
  misc_feature (1)..( 8): Result.003 file - promoters60/2107069
tgatatct

SEQ ID NO: 125379 - DNA, 8 bp, Unknown
  misc_feature (1)..( 8): Result.003 file - promoters60/2107069
tgaaatct

SEQ ID NO: 125380 - DNA, 6 bp, Unknown
  misc_feature (1)..( 6): Result.003 file - promoters60/2107069
tacaac

SEQ ID NO: 125381 - DNA, 6 bp, Unknown
  misc_feature (1)..( 6): Result.003 file - promoters60/2107069
tacaac

SEQ ID NO: 125382 - DNA, 7 bp, Unknown
  misc_feature (1)..( 7): Result.003 file - promoters60/2107069
attcgac

SEQ ID NO: 125383 - DNA, 7 bp, Unknown
  misc_feature (1)..( 7): Result.003 file - promoters60/2107069
attcgac

SEQ ID NO: 125384 - DNA, 6 bp, Unknown
  misc_feature (1)..( 6): Result.003 file - promoters60/2107069
caaaac

SEQ ID NO: 125385 - DNA, 6 bp, Unknown
  misc_feature (1)..( 6): Result.003 file - promoters60/2107069
caaaac

SEQ ID NO: 125386 - DNA, 6 bp, Unknown
  misc_feature (1)..( 6): Result.003 file - promoters60/2107069
taccca

SEQ ID NO: 125387 - DNA, 6 bp, Unknown
  misc_feature (1)..( 6): Result.003 file - promoters60/2107069
taccca

SEQ ID NO: 125388 - DNA, 6 bp, Unknown
  misc_feature (1)..( 6): Result.003 file - promoters60/2107069
ggaaaa

SEQ ID NO: 125389 - DNA, 6 bp, Unknown
  misc_feature (1)..( 6): Result.003 file - promoters60/2107069
ggaaaa

SEQ ID NO: 125390 - DNA, 6 bp, Unknown
  misc_feature (1)..( 6): Result.003 file - promoters60/2107069
gatggt

SEQ ID NO: 125391 - DNA, 6 bp, Unknown
  misc_feature (1)..( 6): Result.003 file - promoters60/2107069
gatggt

SEQ ID NO: 125392 - DNA, 7 bp, Unknown
  misc_feature (1)..( 7): Result.003 file - promoters60/2107069
tctgttg

SEQ ID NO: 125393 - DNA, 7 bp, Unknown
  misc_feature (1)..( 7): Result.003 file - promoters60/2107069
tctcttg

SEQ ID NO: 125394 - DNA, 7 bp, Unknown
  misc_feature (1)..( 7): Result.003 file - promoters60/2107069
tttactc

SEQ ID NO: 125395 - DNA, 7 bp, Unknown
  misc_feature (1)..( 7): Result.003 file - promoters60/2107069
tttgctc

SEQ ID NO: 125396 - DNA, 7 bp, Unknown
  misc_feature (1)..( 7): Result.003 file - promoters60/2107069
ctgaaac

SEQ ID NO: 125397 - DNA, 7 bp, Unknown
  misc_feature (1)..( 7): Result.003 file - promoters60/2107069
ctgcaac

SEQ ID NO: 125398 - DNA, 12 bp, Unknown
  misc_feature (1)..( 12): Result.003 file - promoters60/2113269
ttcacttagtac

SEQ ID NO: 125399 - DNA, 12 bp, Unknown
  misc_feature (1)..( 12): Result.003 file - promoters60/2113269
atggtttattac

SEQ ID NO: 125400 - DNA, 12 bp, Unknown
  misc_feature (1)..( 12): Result.003 file - promoters60/2113269
ctttttttttaa

SEQ ID NO: 125401 - DNA, 12 bp, Unknown
  misc_feature (1)..( 12): Result.003 file - promoters60/2113269
aacatttttttc

SEQ ID NO: 125402 - DNA, 12 bp, Unknown
  misc_feature (1)..( 12): Result.003 file - promoters60/2113269
attggcttttaa

SEQ ID NO: 125403 - DNA, 10 bp, Unknown
  misc_feature (1)..( 10): Result.003 file - promoters60/2113269
aaactttttc

SEQ ID NO: 125404 - DNA, 10 bp, Unknown
  misc_feature (1)..( 10): Result.003 file - promoters60/2113269
ttacttttta

SEQ ID NO: 125405 - DNA, 10 bp, Unknown
  misc_feature (1)..( 10): Result.003 file - promoters60/2113269
aaactttttt

SEQ ID NO: 125406 - DNA, 10 bp, Unknown
  misc_feature (1)..( 10): Result.003 file - promoters60/2113269
catttttttc

SEQ ID NO: 125407 - DNA, 10 bp, Unknown
  misc_feature (1)..( 10): Result.003 file - promoters60/2113269
aaacttttga

SEQ ID NO: 125408 - DNA, 9 bp, Unknown
  misc_feature (1)..( 9): Result.003 file - promoters60/2113269
atataaaaa

SEQ ID NO: 125409 - DNA, 9 bp, Unknown
  misc_feature (1)..( 9): Result.003 file - promoters60/2113269
aaataaaaa

SEQ ID NO: 125410 - DNA, 10 bp, Unknown
  misc_feature (1)..( 10): Result.003 file - promoters60/2113269
ttttaacaaa

SEQ ID NO: 125411 - DNA, 10 bp, Unknown
  misc_feature (1)..( 10): Result.003 file - promoters60/2113269
gattataaac

SEQ ID NO: 125412 - DNA, 10 bp, Unknown
  misc_feature (1)..( 10): Result.003 file - promoters60/2113269
ttttaacatc

SEQ ID NO: 125413 - DNA, 9 bp, Unknown
  misc_feature (1)..( 9): Result.003 file - promoters60/2113269
gtaattttt

SEQ ID NO: 125414 - DNA, 9 bp, Unknown
  misc_feature (1)..( 9): Result.003 file - promoters60/2113269
ataactttg

SEQ ID NO: 125415 - DNA, 9 bp, Unknown
  misc_feature (1)..( 9): Result.003 file - promoters60/2113269
agtattttt

SEQ ID NO: 125416 - DNA, 9 bp, Unknown
  misc_feature (1)..( 9): Result.003 file - promoters60/2113269
gtattttaa

SEQ ID NO: 125417 - DNA, 15 bp, Unknown
  misc_feature (1)..( 15): Result.003 file - promoters60/2113269
cactcatcttcatat

SEQ ID NO: 125418 - DNA, 15 bp, Unknown
  misc_feature (1)..( 15): Result.003 file - promoters60/2113269
ttcctttctttataa

SEQ ID NO: 125419 - DNA, 15 bp, Unknown
  misc_feature (1)..( 15): Result.003 file - promoters60/2113269
taaatatctacatat

SEQ ID NO: 125420 - DNA, 15 bp, Unknown
  misc_feature (1)..( 15): Result.003 file - promoters60/2113269
ttcctttctttatat

SEQ ID NO: 125421 - DNA, 15 bp, Unknown
  misc_feature (1)..( 15): Result.003 file - promoters60/2113269
ccacctactatataa

SEQ ID NO: 125422 - DNA, 10 bp, Unknown
  misc_feature (1)..( 10): Result.003 file - promoters60/2113269
atataaataa

SEQ ID NO: 125423 - DNA, 10 bp, Unknown
  misc_feature (1)..( 10): Result.003 file - promoters60/2113269
ttataaataa

SEQ ID NO: 125424 - DNA, 10 bp, Unknown
  misc_feature (1)..( 10): Result.003 file - promoters60/2113269
atataaactc

SEQ ID NO: 125425 - DNA, 10 bp, Unknown
  misc_feature (1)..( 10): Result.003 file - promoters60/2113269
atctacatat

SEQ ID NO: 125426 - DNA, 10 bp, Unknown
  misc_feature (1)..( 10): Result.003 file - promoters60/2113269
ttatatagcc

SEQ ID NO: 125427 - DNA, 8 bp, Unknown
  misc_feature (1)..( 8): Result.003 file - promoters60/2113269
tgcataat

SEQ ID NO: 125428 - DNA, 8 bp, Unknown
  misc_feature (1)..( 8): Result.003 file - promoters60/2113269
agcataag

SEQ ID NO: 125429 - DNA, 8 bp, Unknown
  misc_feature (1)..( 8): Result.003 file - promoters60/2113269
tgcatatg

SEQ ID NO: 125430 - DNA, 8 bp, Unknown
  misc_feature (1)..( 8): Result.003 file - promoters60/2113269
tccataat

SEQ ID NO: 125431 - DNA, 10 bp, Unknown
  misc_feature (1)..( 10): Result.003 file - promoters60/2113269
cgaatctctt

SEQ ID NO: 125432 - DNA, 10 bp, Unknown
  misc_feature (1)..( 10): Result.003 file - promoters60/2113269
ggaatctctt

SEQ ID NO: 125433 - DNA, 10 bp, Unknown
  misc_feature (1)..( 10): Result.003 file - promoters60/2113269
tgaatctaag

SEQ ID NO: 125434 - DNA, 10 bp, Unknown
  misc_feature (1)..( 10): Result.003 file - promoters60/2113269
tgaacctacg

SEQ ID NO: 125435 - DNA, 10 bp, Unknown
  misc_feature (1)..( 10): Result.003 file - promoters60/2113269
ttatttaaaa

SEQ ID NO: 125436 - DNA, 10 bp, Unknown
  misc_feature (1)..( 10): Result.003 file - promoters60/2113269
acttttaaag

SEQ ID NO: 125437 - DNA, 10 bp, Unknown
  misc_feature (1)..( 10): Result.003 file - promoters60/2113269
tattttaaac

SEQ ID NO: 125438 - DNA, 10 bp, Unknown
  misc_feature (1)..( 10): Result.003 file - promoters60/2113269
ataattaaag

SEQ ID NO: 125439 - DNA, 12 bp, Unknown
  misc_feature (1)..( 12): Result.003 file - promoters60/2113269
agtgtttcatat

SEQ ID NO: 125440 - DNA, 12 bp, Unknown
  misc_feature (1)..( 12): Result.003 file - promoters60/2113269
agtttttgatat

SEQ ID NO: 125441 - DNA, 12 bp, Unknown
  misc_feature (1)..( 12): Result.003 file - promoters60/2113269
gccgtttgataa

SEQ ID NO: 125442 - DNA, 12 bp, Unknown
  misc_feature (1)..( 12): Result.003 file - promoters60/2113269
tcattttgacat

SEQ ID NO: 125443 - DNA, 12 bp, Unknown
  misc_feature (1)..( 12): Result.003 file - promoters60/2113269
aacttttgagag

SEQ ID NO: 125444 - DNA, 9 bp, Unknown
  misc_feature (1)..( 9): Result.003 file - promoters60/2113269
ttttcaatt

SEQ ID NO: 125445 - DNA, 9 bp, Unknown
  misc_feature (1)..( 9): Result.003 file - promoters60/2113269
gtttcaaca

SEQ ID NO: 125446 - DNA, 10 bp, Unknown
  misc_feature (1)..( 10): Result.003 file - promoters60/2113269
attgtcaaag

SEQ ID NO: 125447 - DNA, 10 bp, Unknown
  misc_feature (1)..( 10): Result.003 file - promoters60/2113269
actttaaaca

SEQ ID NO: 125448 - DNA, 8 bp, Unknown
  misc_feature (1)..( 8): Result.003 file - promoters60/2113269
ttttaaaa

SEQ ID NO: 125449 - DNA, 8 bp, Unknown
  misc_feature (1)..( 8): Result.003 file - promoters60/2113269
ttttaaca

SEQ ID NO: 125450 - DNA, 8 bp, Unknown
  misc_feature (1)..( 8): Result.003 file - promoters60/2113269
ttttaaag

SEQ ID NO: 125451 - DNA, 8 bp, Unknown
  misc_feature (1)..( 8): Result.003 file - promoters60/2113269
ttttaaca

SEQ ID NO: 125452 - DNA, 9 bp, Unknown
  misc_feature (1)..( 9): Result.003 file - promoters60/2113299
ttttgcata

SEQ ID NO: 125453 - DNA, 9 bp, Unknown
  misc_feature (1)..( 9): Result.003 file - promoters60/2113299
tgttgcata

SEQ ID NO: 125454 - DNA, 9 bp, Unknown
  misc_feature (1)..( 9): Result.003 file - promoters60/2113299
tgtcgcata

SEQ ID NO: 125455 - DNA, 6 bp, Unknown
  misc_feature (1)..( 6): Result.003 file - promoters60/2113299
tatttc

SEQ ID NO: 125456 - DNA, 6 bp, Unknown
  misc_feature (1)..( 6): Result.003 file - promoters60/2113299
tatttc

SEQ ID NO: 125457 - DNA, 7 bp, Unknown
  misc_feature (1)..( 7): Result.003 file - promoters60/2113299
cggcggt

SEQ ID NO: 125458 - DNA, 7 bp, Unknown
  misc_feature (1)..( 7): Result.003 file - promoters60/2113299
cggtggt

SEQ ID NO: 125459 - DNA, 8 bp, Unknown
  misc_feature (1)..( 8): Result.003 file - promoters60/2113299
taaagtca

SEQ ID NO: 125460 - DNA, 8 bp, Unknown
  misc_feature (1)..( 8): Result.003 file - promoters60/2113299
taaaatca

SEQ ID NO: 125461 - DNA, 8 bp, Unknown
  misc_feature (1)..( 8): Result.003 file - promoters60/2113299
gtgtttaa

SEQ ID NO: 125462 - DNA, 8 bp, Unknown
  misc_feature (1)..( 8): Result.003 file - promoters60/2113299
gtggttaa

SEQ ID NO: 125463 - DNA, 8 bp, Unknown
  misc_feature (1)..( 8): Result.003 file - promoters60/2113299
atattttc

SEQ ID NO: 125464 - DNA, 8 bp, Unknown
  misc_feature (1)..( 8): Result.003 file - promoters60/2113299
ataatttc

SEQ ID NO: 125465 - DNA, 7 bp, Unknown
  misc_feature (1)..( 7): Result.003 file - promoters60/2113299
aaccctt

SEQ ID NO: 125466 - DNA, 7 bp, Unknown
  misc_feature (1)..( 7): Result.003 file - promoters60/2113299
aacactt

SEQ ID NO: 125467 - DNA, 7 bp, Unknown
  misc_feature (1)..( 7): Result.003 file - promoters60/2113299
tataaat

SEQ ID NO: 125468 - DNA, 7 bp, Unknown
  misc_feature (1)..( 7): Result.003 file - promoters60/2113299
tataaat

SEQ ID NO: 125469 - DNA, 9 bp, Unknown
  misc_feature (1)..( 9): Result.003 file - promoters60/2113299
caaaaataa

SEQ ID NO: 125470 - DNA, 9 bp, Unknown
  misc_feature (1)..( 9): Result.003 file - promoters60/2113299
caaaaataa

SEQ ID NO: 125471 - DNA, 8 bp, Unknown
  misc_feature (1)..( 8): Result.003 file - promoters60/2113299
aacagtaa

SEQ ID NO: 125472 - DNA, 8 bp, Unknown
  misc_feature (1)..( 8): Result.003 file - promoters60/2113299
aacaataa

SEQ ID NO: 125473 - DNA, 6 bp, Unknown
  misc_feature (1)..( 6): Result.003 file - promoters60/2113299
gtaaaa

SEQ ID NO: 125474 - DNA, 6 bp, Unknown
  misc_feature (1)..( 6): Result.003 file - promoters60/2113299
gtaaaa

SEQ ID NO: 125475 - DNA, 8 bp, Unknown
  misc_feature (1)..( 8): Result.003 file - promoters60/2113299
tttccatt

SEQ ID NO: 125476 - DNA, 8 bp, Unknown
  misc_feature (1)..( 8): Result.003 file - promoters60/2113299
tttcgatt

SEQ ID NO: 125477 - DNA, 7 bp, Unknown
  misc_feature (1)..( 7): Result.003 file - promoters60/2113299
ttttttg

SEQ ID NO: 125478 - DNA, 7 bp, Unknown
  misc_feature (1)..( 7): Result.003 file - promoters60/2113299
tttattg

SEQ ID NO: 125479 - DNA, 7 bp, Unknown
  misc_feature (1)..( 7): Result.003 file - promoters60/2113315
atgcaat

SEQ ID NO: 125480 - DNA, 7 bp, Unknown
  misc_feature (1)..( 7): Result.003 file - promoters60/2113315
atgtaat

SEQ ID NO: 125481 - DNA, 8 bp, Unknown
  misc_feature (1)..( 8): Result.003 file - promoters60/2113315
gtgtaaat

SEQ ID NO: 125482 - DNA, 8 bp, Unknown
  misc_feature (1)..( 8): Result.003 file - promoters60/2113315
gtggaaat

SEQ ID NO: 125483 - DNA, 6 bp, Unknown
  misc_feature (1)..( 6): Result.003 file - promoters60/2113315
acatat

SEQ ID NO: 125484 - DNA, 6 bp, Unknown
  misc_feature (1)..( 6): Result.003 file - promoters60/2113315
acatat

SEQ ID NO: 125485 - DNA, 6 bp, Unknown
  misc_feature (1)..( 6): Result.003 file - promoters60/2113315
acatat

SEQ ID NO: 125486 - DNA, 6 bp, Unknown
  misc_feature (1)..( 6): Result.003 file - promoters60/2113315
atatgg

SEQ ID NO: 125487 - DNA, 6 bp, Unknown
  misc_feature (1)..( 6): Result.003 file - promoters60/2113315
atatgg

SEQ ID NO: 125488 - DNA, 6 bp, Unknown
  misc_feature (1)..( 6): Result.003 file - promoters60/2113315
ataata

SEQ ID NO: 125489 - DNA, 6 bp, Unknown
  misc_feature (1)..( 6): Result.003 file - promoters60/2113315
ataata

SEQ ID NO: 125490 - DNA, 8 bp, Unknown
  misc_feature (1)..( 8): Result.003 file - promoters60/2113315
ttggcaaa

SEQ ID NO: 125491 - DNA, 8 bp, Unknown
  misc_feature (1)..( 8): Result.003 file - promoters60/2113315
caggcaaa

SEQ ID NO: 125492 - DNA, 8 bp, Unknown
  misc_feature (1)..( 8): Result.003 file - promoters60/2113315
ttgtcaag

SEQ ID NO: 125493 - DNA, 7 bp, Unknown
  misc_feature (1)..( 7): Result.003 file - promoters60/2113315
ttacaaa

SEQ ID NO: 125494 - DNA, 7 bp, Unknown
  misc_feature (1)..( 7): Result.003 file - promoters60/2113315
ttataaa

SEQ ID NO: 125495 - DNA, 6 bp, Unknown
  misc_feature (1)..( 6): Result.003 file - promoters60/2113315
ttaatt

SEQ ID NO: 125496 - DNA, 6 bp, Unknown
  misc_feature (1)..( 6): Result.003 file - promoters60/2113315
ttaatt

SEQ ID NO: 125497 - DNA, 7 bp, Unknown
  misc_feature (1)..( 7): Result.003 file - promoters60/2113315
ataaaaa

SEQ ID NO: 125498 - DNA, 7 bp, Unknown
  misc_feature (1)..( 7): Result.003 file - promoters60/2113315
ataaaaa

SEQ ID NO: 125499 - DNA, 6 bp, Unknown
  misc_feature (1)..( 6): Result.003 file - promoters60/2113315
taaaat

SEQ ID NO: 125500 - DNA, 6 bp, Unknown
  misc_feature (1)..( 6): Result.003 file - promoters60/2113315
taaaat

SEQ ID NO: 125501 - DNA, 6 bp, Unknown
  misc_feature (1)..( 6): Result.003 file - promoters60/2113315
ctaaaa

SEQ ID NO: 125502 - DNA, 6 bp, Unknown
  misc_feature (1)..( 6): Result.003 file - promoters60/2113315
ctaaaa

SEQ ID NO: 125503 - DNA, 8 bp, Unknown
  misc_feature (1)..( 8): Result.003 file - promoters60/2113315
aaagtctt

SEQ ID NO: 125504 - DNA, 8 bp, Unknown
  misc_feature (1)..( 8): Result.003 file - promoters60/2113315
aaaatctc

SEQ ID NO: 125505 - DNA, 8 bp, Unknown
  misc_feature (1)..( 8): Result.003 file - promoters60/2113315
ctaatctc

SEQ ID NO: 125506 - DNA, 6 bp, Unknown
  misc_feature (1)..( 6): Result.003 file - promoters60/2113315
ttagtg

SEQ ID NO: 125507 - DNA, 6 bp, Unknown
  misc_feature (1)..( 6): Result.003 file - promoters60/2113315
ttagtg

SEQ ID NO: 125508 - DNA, 7 bp, Unknown
  misc_feature (1)..( 7): Result.003 file - promoters60/2113315
taagaag

SEQ ID NO: 125509 - DNA, 7 bp, Unknown
  misc_feature (1)..( 7): Result.003 file - promoters60/2113315
taataag

SEQ ID NO: 125510 - DNA, 6 bp, Unknown
  misc_feature (1)..( 6): Result.003 file - promoters60/2113315
aagtaa

SEQ ID NO: 125511 - DNA, 6 bp, Unknown
  misc_feature (1)..( 6): Result.003 file - promoters60/2113315
aagtaa

SEQ ID NO: 125512 - DNA, 6 bp, Unknown
  misc_feature (1)..( 6): Result.003 file - promoters60/2113315
ttaaaa

SEQ ID NO: 125513 - DNA, 6 bp, Unknown
  misc_feature (1)..( 6): Result.003 file - promoters60/2113315
ttaaaa

SEQ ID NO: 125514 - DNA, 6 bp, Unknown
  misc_feature (1)..( 6): Result.003 file - promoters60/2113315
aactct

SEQ ID NO: 125515 - DNA, 6 bp, Unknown
  misc_feature (1)..( 6): Result.003 file - promoters60/2113315
aactct

SEQ ID NO: 125516 - DNA, 7 bp, Unknown
  misc_feature (1)..( 7): Result.003 file - promoters60/2113315
attattt

SEQ ID NO: 125517 - DNA, 7 bp, Unknown
  misc_feature (1)..( 7): Result.003 file - promoters60/2113315
attattt

SEQ ID NO: 125518 - DNA, 8 bp, Unknown
  misc_feature (1)..( 8): Result.003 file - promoters60/2113315
aattataa

SEQ ID NO: 125519 - DNA, 8 bp, Unknown
  misc_feature (1)..( 8): Result.003 file - promoters60/2113315
aataataa

SEQ ID NO: 125520 - DNA, 7 bp, Unknown
  misc_feature (1)..( 7): Result.003 file - promoters60/2113315
ttcgtta

SEQ ID NO: 125521 - DNA, 7 bp, Unknown
  misc_feature (1)..( 7): Result.003 file - promoters60/2113315
ttcctta

SEQ ID NO: 125522 - DNA, 7 bp, Unknown
  misc_feature (1)..( 7): Result.003 file - promoters60/2113315
actctat

SEQ ID NO: 125523 - DNA, 7 bp, Unknown
  misc_feature (1)..( 7): Result.003 file - promoters60/2113315
actttat

SEQ ID NO: 125524 - DNA, 8 bp, Unknown
  misc_feature (1)..( 8): Result.003 file - promoters60/2113323
aaacaact

SEQ ID NO: 125525 - DNA, 8 bp, Unknown
  misc_feature (1)..( 8): Result.003 file - promoters60/2113323
caacaacc

SEQ ID NO: 125526 - DNA, 8 bp, Unknown
  misc_feature (1)..( 8): Result.003 file - promoters60/2113323
acacaact

SEQ ID NO: 125527 - DNA, 8 bp, Unknown
  misc_feature (1)..( 8): Result.003 file - promoters60/2113323
caacaaac

SEQ ID NO: 125528 - DNA, 9 bp, Unknown
  misc_feature (1)..( 9): Result.003 file - promoters60/2113323
tgtcaagta

SEQ ID NO: 125529 - DNA, 9 bp, Unknown
  misc_feature (1)..( 9): Result.003 file - promoters60/2113323
catcaagtc

SEQ ID NO: 125530 - DNA, 9 bp, Unknown
  misc_feature (1)..( 9): Result.003 file - promoters60/2113323
tgtcaagta

SEQ ID NO: 125531 - DNA, 9 bp, Unknown
  misc_feature (1)..( 9): Result.003 file - promoters60/2113323
caattattt

SEQ ID NO: 125532 - DNA, 9 bp, Unknown
  misc_feature (1)..( 9): Result.003 file - promoters60/2113323
atatttttt

SEQ ID NO: 125533 - DNA, 9 bp, Unknown
  misc_feature (1)..( 9): Result.003 file - promoters60/2113323
caaatattt

SEQ ID NO: 125534 - DNA, 8 bp, Unknown
  misc_feature (1)..( 8): Result.003 file - promoters60/2113323
gattgtaa

SEQ ID NO: 125535 - DNA, 8 bp, Unknown
  misc_feature (1)..( 8): Result.003 file - promoters60/2113323
gattgttt

SEQ ID NO: 125536 - DNA, 8 bp, Unknown
  misc_feature (1)..( 8): Result.003 file - promoters60/2113323
aattgttt

SEQ ID NO: 125537 - DNA, 14 bp, Unknown
  misc_feature (1)..( 14): Result.003 file - promoters60/2113323
ttttttatagatta

SEQ ID NO: 125538 - DNA, 14 bp, Unknown
  misc_feature (1)..( 14): Result.003 file - promoters60/2113323
ttttctataaatta

SEQ ID NO: 125539 - DNA, 14 bp, Unknown
  misc_feature (1)..( 14): Result.003 file - promoters60/2113323
agagctaaaaacgg

SEQ ID NO: 125540 - DNA, 7 bp, Unknown
  misc_feature (1)..( 7): Result.003 file - promoters60/2113454
cttctta

SEQ ID NO: 125541 - DNA, 7 bp, Unknown
  misc_feature (1)..( 7): Result.003 file - promoters60/2113454
cttttta

SEQ ID NO: 125542 - DNA, 7 bp, Unknown
  misc_feature (1)..( 7): Result.003 file - promoters60/2113454
tctgatc

SEQ ID NO: 125543 - DNA, 7 bp, Unknown
  misc_feature (1)..( 7): Result.003 file - promoters60/2113454
tctaatc

SEQ ID NO: 125544 - DNA, 6 bp, Unknown
  misc_feature (1)..( 6): Result.003 file - promoters60/2113454
aaataa

SEQ ID NO: 125545 - DNA, 6 bp, Unknown
  misc_feature (1)..( 6): Result.003 file - promoters60/2113454
aaataa

SEQ ID NO: 125546 - DNA, 6 bp, Unknown
  misc_feature (1)..( 6): Result.003 file - promoters60/2113454
aacaaa

SEQ ID NO: 125547 - DNA, 6 bp, Unknown
  misc_feature (1)..( 6): Result.003 file - promoters60/2113454
aacaaa

SEQ ID NO: 125548 - DNA, 8 bp, Unknown
  misc_feature (1)..( 8): Result.003 file - promoters60/2113454
aaatgtat

SEQ ID NO: 125549 - DNA, 8 bp, Unknown
  misc_feature (1)..( 8): Result.003 file - promoters60/2113454
aaatgtat

SEQ ID NO: 125550 - DNA, 6 bp, Unknown
  misc_feature (1)..( 6): Result.003 file - promoters60/2113454
ttttgt

SEQ ID NO: 125551 - DNA, 6 bp, Unknown
  misc_feature (1)..( 6): Result.003 file - promoters60/2113454
ttttgt

SEQ ID NO: 125552 - DNA, 7 bp, Unknown
  misc_feature (1)..( 7): Result.003 file - promoters60/2113454
tatacaa

SEQ ID NO: 125553 - DNA, 7 bp, Unknown
  misc_feature (1)..( 7): Result.003 file - promoters60/2113454
tatacaa

SEQ ID NO: 125554 - DNA, 8 bp, Unknown
  misc_feature (1)..( 8): Result.003 file - promoters60/2113454
aaatatct

SEQ ID NO: 125555 - DNA, 8 bp, Unknown
  misc_feature (1)..( 8): Result.003 file - promoters60/2113454
aaatttct

SEQ ID NO: 125556 - DNA, 6 bp, Unknown
  misc_feature (1)..( 6): Result.003 file - promoters60/2113454
tagtaa

SEQ ID NO: 125557 - DNA, 6 bp, Unknown
  misc_feature (1)..( 6): Result.003 file - promoters60/2113454
tagtaa

SEQ ID NO: 125558 - DNA, 8 bp, Unknown
  misc_feature (1)..( 8): Result.003 file - promoters60/2113454
ttgcaatg

SEQ ID NO: 125559 - DNA, 8 bp, Unknown
  misc_feature (1)..( 8): Result.003 file - promoters60/2113454
ttgaaatg

SEQ ID NO: 125560 - DNA, 8 bp, Unknown
  misc_feature (1)..( 8): Result.003 file - promoters60/2113454
tgattatt

SEQ ID NO: 125561 - DNA, 8 bp, Unknown
  misc_feature (1)..( 8): Result.003 file - promoters60/2113454
tgattatt

SEQ ID NO: 125562 - DNA, 7 bp, Unknown
  misc_feature (1)..( 7): Result.003 file - promoters60/2113454
aaataaa

SEQ ID NO: 125563 - DNA, 7 bp, Unknown
  misc_feature (1)..( 7): Result.003 file - promoters60/2113454
aaataaa

SEQ ID NO: 125564 - DNA, 7 bp, Unknown
  misc_feature (1)..( 7): Result.003 file - promoters60/2113454
atcatgt

SEQ ID NO: 125565 - DNA, 7 bp, Unknown
  misc_feature (1)..( 7): Result.003 file - promoters60/2113454
atcgtgt

SEQ ID NO: 125566 - DNA, 11 bp, Unknown
  misc_feature (1)..( 11): Result.003 file - promoters60/2113454
ttcctcaaaca

SEQ ID NO: 125567 - DNA, 11 bp, Unknown
  misc_feature (1)..( 11): Result.003 file - promoters60/2113454
ttcttcaaaca

SEQ ID NO: 125568 - DNA, 7 bp, Unknown
  misc_feature (1)..( 7): Result.003 file - promoters60/2113454
gttccaa

SEQ ID NO: 125569 - DNA, 7 bp, Unknown
  misc_feature (1)..( 7): Result.003 file - promoters60/2113454
gttacaa

SEQ ID NO: 125570 - DNA, 7 bp, Unknown
  misc_feature (1)..( 7): Result.003 file - promoters60/2113454
tccctca

SEQ ID NO: 125571 - DNA, 7 bp, Unknown
  misc_feature (1)..( 7): Result.003 file - promoters60/2113454
tccatca

SEQ ID NO: 125572 - DNA, 6 bp, Unknown
  misc_feature (1)..( 6): Result.003 file - promoters60/2113454
attcat

SEQ ID NO: 125573 - DNA, 6 bp, Unknown
  misc_feature (1)..( 6): Result.003 file - promoters60/2113454
attcat

SEQ ID NO: 125574 - DNA, 7 bp, Unknown
  misc_feature (1)..( 7): Result.003 file - promoters60/2113454
acctaat

SEQ ID NO: 125575 - DNA, 7 bp, Unknown
  misc_feature (1)..( 7): Result.003 file - promoters60/2113454
acctaat

SEQ ID NO: 125576 - DNA, 8 bp, Unknown
  misc_feature (1)..( 8): Result.003 file - promoters60/2113454
taatttat

SEQ ID NO: 125577 - DNA, 8 bp, Unknown
  misc_feature (1)..( 8): Result.003 file - promoters60/2113454
taagttat

SEQ ID NO: 125578 - DNA, 8 bp, Unknown
  misc_feature (1)..( 8): Result.003 file - promoters60/2113454
ttctggtt

SEQ ID NO: 125579 - DNA, 8 bp, Unknown
  misc_feature (1)..( 8): Result.003 file - promoters60/2113454
ttctagtt

SEQ ID NO: 125580 - DNA, 8 bp, Unknown
  misc_feature (1)..( 8): Result.003 file - promoters60/2113454
tttaccaa

SEQ ID NO: 125581 - DNA, 8 bp, Unknown
  misc_feature (1)..( 8): Result.003 file - promoters60/2113454
ttttccaa

SEQ ID NO: 125582 - DNA, 6 bp, Unknown
  misc_feature (1)..( 6): Result.003 file - promoters60/2113454
caactt

SEQ ID NO: 125583 - DNA, 6 bp, Unknown
  misc_feature (1)..( 6): Result.003 file - promoters60/2113454
caactt

SEQ ID NO: 125584 - DNA, 7 bp, Unknown
  misc_feature (1)..( 7): Result.003 file - promoters60/2113454
gtcaaaa

SEQ ID NO: 125585 - DNA, 7 bp, Unknown
  misc_feature (1)..( 7): Result.003 file - promoters60/2113454
gtcaaaa

SEQ ID NO: 125586 - DNA, 7 bp, Unknown
  misc_feature (1)..( 7): Result.003 file - promoters60/2113454
aaattga

SEQ ID NO: 125587 - DNA, 7 bp, Unknown
  misc_feature (1)..( 7): Result.003 file - promoters60/2113454
aaattga

SEQ ID NO: 125588 - DNA, 7 bp, Unknown
  misc_feature (1)..( 7): Result.003 file - promoters60/2113454
catcagg

SEQ ID NO: 125589 - DNA, 7 bp, Unknown
  misc_feature (1)..( 7): Result.003 file - promoters60/2113454
catgagg

SEQ ID NO: 125590 - DNA, 11 bp, Unknown
  misc_feature (1)..( 11): Result.003 file - promoters60/2113462
atcttcatata

SEQ ID NO: 125591 - DNA, 11 bp, Unknown
  misc_feature (1)..( 11): Result.003 file - promoters60/2113462
atcatcactta

SEQ ID NO: 125592 - DNA, 11 bp, Unknown
  misc_feature (1)..( 11): Result.003 file - promoters60/2113462
ttctacatagt

SEQ ID NO: 125593 - DNA, 11 bp, Unknown
  misc_feature (1)..( 11): Result.003 file - promoters60/2113462
aacttaatata

SEQ ID NO: 125594 - DNA, 11 bp, Unknown
  misc_feature (1)..( 11): Result.003 file - promoters60/2113462
ccctacatttt

SEQ ID NO: 125595 - DNA, 16 bp, Unknown
  misc_feature (1)..( 16): Result.003 file - promoters60/2113462
agggatggatgtaatc

SEQ ID NO: 125596 - DNA, 16 bp, Unknown
  misc_feature (1)..( 16): Result.003 file - promoters60/2113462
aaattaagatataaaa

SEQ ID NO: 125597 - DNA, 16 bp, Unknown
  misc_feature (1)..( 16): Result.003 file - promoters60/2113462
aaactaaaatatcaac

SEQ ID NO: 125598 - DNA, 16 bp, Unknown
  misc_feature (1)..( 16): Result.003 file - promoters60/2113462
acactaaagtataaaa

SEQ ID NO: 125599 - DNA, 16 bp, Unknown
  misc_feature (1)..( 16): Result.003 file - promoters60/2113462
tttaaaaaataatatt

SEQ ID NO: 125600 - DNA, 16 bp, Unknown
  misc_feature (1)..( 16): Result.003 file - promoters60/2113462
actttaaaatcacatc

SEQ ID NO: 125601 - DNA, 8 bp, Unknown
  misc_feature (1)..( 8): Result.003 file - promoters60/2113462
cttatttc

SEQ ID NO: 125602 - DNA, 8 bp, Unknown
  misc_feature (1)..( 8): Result.003 file - promoters60/2113462
cttttttt

SEQ ID NO: 125603 - DNA, 8 bp, Unknown
  misc_feature (1)..( 8): Result.003 file - promoters60/2113462
attagttc

SEQ ID NO: 125604 - DNA, 8 bp, Unknown
  misc_feature (1)..( 8): Result.003 file - promoters60/2113462
ctttttaa

SEQ ID NO: 125605 - DNA, 9 bp, Unknown
  misc_feature (1)..( 9): Result.003 file - promoters60/2113462
agatgaaat

SEQ ID NO: 125606 - DNA, 9 bp, Unknown
  misc_feature (1)..( 9): Result.003 file - promoters60/2113462
agatgagat

SEQ ID NO: 125607 - DNA, 9 bp, Unknown
  misc_feature (1)..( 9): Result.003 file - promoters60/2113462
agatgtaat

SEQ ID NO: 125608 - DNA, 9 bp, Unknown
  misc_feature (1)..( 9): Result.003 file - promoters60/2113462
gattgtaat

SEQ ID NO: 125609 - DNA, 9 bp, Unknown
  misc_feature (1)..( 9): Result.003 file - promoters60/2113462
aacttaatc

SEQ ID NO: 125610 - DNA, 9 bp, Unknown
  misc_feature (1)..( 9): Result.003 file - promoters60/2113462
aactaaatt

SEQ ID NO: 125611 - DNA, 9 bp, Unknown
  misc_feature (1)..( 9): Result.003 file - promoters60/2113462
ccctttatc

SEQ ID NO: 125612 - DNA, 9 bp, Unknown
  misc_feature (1)..( 9): Result.003 file - promoters60/2113462
cattttatc

SEQ ID NO: 125613 - DNA, 9 bp, Unknown
  misc_feature (1)..( 9): Result.003 file - promoters60/2113462
atttataac

SEQ ID NO: 125614 - DNA, 9 bp, Unknown
  misc_feature (1)..( 9): Result.003 file - promoters60/2113462
attgataat

SEQ ID NO: 125615 - DNA, 9 bp, Unknown
  misc_feature (1)..( 9): Result.003 file - promoters60/2113462
attaataat

SEQ ID NO: 125616 - DNA, 9 bp, Unknown
  misc_feature (1)..( 9): Result.003 file - promoters60/2113462
cgtgaaaat

SEQ ID NO: 125617 - DNA, 9 bp, Unknown
  misc_feature (1)..( 9): Result.003 file - promoters60/2113462
aaaatgaac

SEQ ID NO: 125618 - DNA, 9 bp, Unknown
  misc_feature (1)..( 9): Result.003 file - promoters60/2113462
aaaattaac

SEQ ID NO: 125619 - DNA, 9 bp, Unknown
  misc_feature (1)..( 9): Result.003 file - promoters60/2113462
aaaaagaac

SEQ ID NO: 125620 - DNA, 9 bp, Unknown
  misc_feature (1)..( 9): Result.003 file - promoters60/2113462
aaatttacc

SEQ ID NO: 125621 - DNA, 7 bp, Unknown
  misc_feature (1)..( 7): Result.003 file - promoters60/2113462
aaaatta

SEQ ID NO: 125622 - DNA, 7 bp, Unknown
  misc_feature (1)..( 7): Result.003 file - promoters60/2113462
taaatta

SEQ ID NO: 125623 - DNA, 7 bp, Unknown
  misc_feature (1)..( 7): Result.003 file - promoters60/2113462
aaaatta

SEQ ID NO: 125624 - DNA, 7 bp, Unknown
  misc_feature (1)..( 7): Result.003 file - promoters60/2113462
gaaatta

SEQ ID NO: 125625 - DNA, 7 bp, Unknown
  misc_feature (1)..( 7): Result.003 file - promoters60/2113462
taaattt

SEQ ID NO: 125626 - DNA, 8 bp, Unknown
  misc_feature (1)..( 8): Result.003 file - promoters60/2113462
aaattaac

SEQ ID NO: 125627 - DNA, 8 bp, Unknown
  misc_feature (1)..( 8): Result.003 file - promoters60/2113462
aaattatt

SEQ ID NO: 125628 - DNA, 8 bp, Unknown
  misc_feature (1)..( 8): Result.003 file - promoters60/2113462
aaatttaa

SEQ ID NO: 125629 - DNA, 8 bp, Unknown
  misc_feature (1)..( 8): Result.003 file - promoters60/2113462
aaattaca

SEQ ID NO: 125630 - DNA, 11 bp, Unknown
  misc_feature (1)..( 11): Result.003 file - promoters60/2113462
atccatatatg

SEQ ID NO: 125631 - DNA, 11 bp, Unknown
  misc_feature (1)..( 11): Result.003 file - promoters60/2113462
tctcatataca

SEQ ID NO: 125632 - DNA, 11 bp, Unknown
  misc_feature (1)..( 11): Result.003 file - promoters60/2113462
atccttataaa

SEQ ID NO: 125633 - DNA, 11 bp, Unknown
  misc_feature (1)..( 11): Result.003 file - promoters60/2113462
tttgataaaca

SEQ ID NO: 125634 - DNA, 11 bp, Unknown
  misc_feature (1)..( 11): Result.003 file - promoters60/2113466
tttataatttg

SEQ ID NO: 125635 - DNA, 11 bp, Unknown
  misc_feature (1)..( 11): Result.003 file - promoters60/2113466
catataatttg

SEQ ID NO: 125636 - DNA, 11 bp, Unknown
  misc_feature (1)..( 11): Result.003 file - promoters60/2113466
cataaaataaa

SEQ ID NO: 125637 - DNA, 6 bp, Unknown
  misc_feature (1)..( 6): Result.003 file - promoters60/2113466
attcat

SEQ ID NO: 125638 - DNA, 6 bp, Unknown
  misc_feature (1)..( 6): Result.003 file - promoters60/2113466
attcat

SEQ ID NO: 125639 - DNA, 7 bp, Unknown
  misc_feature (1)..( 7): Result.003 file - promoters60/2113466
ttagaat

SEQ ID NO: 125640 - DNA, 7 bp, Unknown
  misc_feature (1)..( 7): Result.003 file - promoters60/2113466
ttacaat

SEQ ID NO: 125641 - DNA, 9 bp, Unknown
  misc_feature (1)..( 9): Result.003 file - promoters60/2113466
agaatctat

SEQ ID NO: 125642 - DNA, 9 bp, Unknown
  misc_feature (1)..( 9): Result.003 file - promoters60/2113466
ataatatat

SEQ ID NO: 125643 - DNA, 9 bp, Unknown
  misc_feature (1)..( 9): Result.003 file - promoters60/2113466
ataaaatat

SEQ ID NO: 125644 - DNA, 9 bp, Unknown
  misc_feature (1)..( 9): Result.003 file - promoters60/2113466
gtttatgtt

SEQ ID NO: 125645 - DNA, 9 bp, Unknown
  misc_feature (1)..( 9): Result.003 file - promoters60/2113466
atttatgtt

SEQ ID NO: 125646 - DNA, 9 bp, Unknown
  misc_feature (1)..( 9): Result.003 file - promoters60/2113466
attcatgat

SEQ ID NO: 125647 - DNA, 6 bp, Unknown
  misc_feature (1)..( 6): Result.003 file - promoters60/2113466
taagtt

SEQ ID NO: 125648 - DNA, 6 bp, Unknown
  misc_feature (1)..( 6): Result.003 file - promoters60/2113466
taagtt

SEQ ID NO: 125649 - DNA, 12 bp, Unknown
  misc_feature (1)..( 12): Result.003 file - promoters60/2113466
cttgtaaccaca

SEQ ID NO: 125650 - DNA, 12 bp, Unknown
  misc_feature (1)..( 12): Result.003 file - promoters60/2113466
cttttaactaca

SEQ ID NO: 125651 - DNA, 8 bp, Unknown
  misc_feature (1)..( 8): Result.003 file - promoters60/2113466
ttaatatg

SEQ ID NO: 125652 - DNA, 8 bp, Unknown
  misc_feature (1)..( 8): Result.003 file - promoters60/2113466
ttaatagg

SEQ ID NO: 125653 - DNA, 8 bp, Unknown
  misc_feature (1)..( 8): Result.003 file - promoters60/2113466
ctaatatg

SEQ ID NO: 125654 - DNA, 7 bp, Unknown
  misc_feature (1)..( 7): Result.003 file - promoters60/2113466
tatatgt

SEQ ID NO: 125655 - DNA, 7 bp, Unknown
  misc_feature (1)..( 7): Result.003 file - promoters60/2113466
tatttgt

SEQ ID NO: 125656 - DNA, 9 bp, Unknown
  misc_feature (1)..( 9): Result.003 file - promoters60/2113466
ctaagaaac

SEQ ID NO: 125657 - DNA, 9 bp, Unknown
  misc_feature (1)..( 9): Result.003 file - promoters60/2113466
ctaaaaaac

SEQ ID NO: 125658 - DNA, 6 bp, Unknown
  misc_feature (1)..( 6): Result.003 file - promoters60/2113466
aaaaat

SEQ ID NO: 125659 - DNA, 6 bp, Unknown
  misc_feature (1)..( 6): Result.003 file - promoters60/2113466
aaaaat

SEQ ID NO: 125660 - DNA, 7 bp, Unknown
  misc_feature (1)..( 7): Result.003 file - promoters60/2113466
ttttgct

SEQ ID NO: 125661 - DNA, 7 bp, Unknown
  misc_feature (1)..( 7): Result.003 file - promoters60/2113466
ttttgct

SEQ ID NO: 125662 - DNA, 7 bp, Unknown
  misc_feature (1)..( 7): Result.003 file - promoters60/2113466
aagtttt

SEQ ID NO: 125663 - DNA, 7 bp, Unknown
  misc_feature (1)..( 7): Result.003 file - promoters60/2113466
aagtttt

SEQ ID NO: 125664 - DNA, 9 bp, Unknown
  misc_feature (1)..( 9): Result.003 file - promoters60/2113466
ataacaata

SEQ ID NO: 125665 - DNA, 9 bp, Unknown
  misc_feature (1)..( 9): Result.003 file - promoters60/2113466
ataaccata

SEQ ID NO: 125666 - DNA, 6 bp, Unknown
  misc_feature (1)..( 6): Result.003 file - promoters60/2113466
tttttg

SEQ ID NO: 125667 - DNA, 6 bp, Unknown
  misc_feature (1)..( 6): Result.003 file - promoters60/2113466
tttttg

SEQ ID NO: 125668 - DNA, 7 bp, Unknown
  misc_feature (1)..( 7): Result.003 file - promoters60/2113466
ttgcttg

SEQ ID NO: 125669 - DNA, 7 bp, Unknown
  misc_feature (1)..( 7): Result.003 file - promoters60/2113466
ttgattg

SEQ ID NO: 125670 - DNA, 9 bp, Unknown
  misc_feature (1)..( 9): Result.003 file - promoters60/2113466
acatacacc

SEQ ID NO: 125671 - DNA, 9 bp, Unknown
  misc_feature (1)..( 9): Result.003 file - promoters60/2113466
acataaacc

SEQ ID NO: 125672 - DNA, 6 bp, Unknown
  misc_feature (1)..( 6): Result.003 file - promoters60/2113466
aacctt

SEQ ID NO: 125673 - DNA, 6 bp, Unknown
  misc_feature (1)..( 6): Result.003 file - promoters60/2113466
aacctt

SEQ ID NO: 125674 - DNA, 6 bp, Unknown
  misc_feature (1)..( 6): Result.003 file - promoters60/2113466
tttgta

SEQ ID NO: 125675 - DNA, 6 bp, Unknown
  misc_feature (1)..( 6): Result.003 file - promoters60/2113466
tttgta

SEQ ID NO: 125676 - DNA, 7 bp, Unknown
  misc_feature (1)..( 7): Result.003 file - promoters60/2113466
caaaata

SEQ ID NO: 125677 - DNA, 7 bp, Unknown
  misc_feature (1)..( 7): Result.003 file - promoters60/2113466
caacata

SEQ ID NO: 125678 - DNA, 6 bp, Unknown
  misc_feature (1)..( 6): Result.003 file - promoters60/2113466
atatac

SEQ ID NO: 125679 - DNA, 6 bp, Unknown
  misc_feature (1)..( 6): Result.003 file - promoters60/2113466
atatac

SEQ ID NO: 125680 - DNA, 10 bp, Unknown
  misc_feature (1)..( 10): Result.003 file - promoters60/2113466
atatttgcat

SEQ ID NO: 125681 - DNA, 10 bp, Unknown
  misc_feature (1)..( 10): Result.003 file - promoters60/2113466
atatatgcat

SEQ ID NO: 125682 - DNA, 6 bp, Unknown
  misc_feature (1)..( 6): Result.003 file - promoters60/2113466
tatttt

SEQ ID NO: 125683 - DNA, 6 bp, Unknown
  misc_feature (1)..( 6): Result.003 file - promoters60/2113466
tatttt

SEQ ID NO: 125684 - DNA, 7 bp, Unknown
  misc_feature (1)..( 7): Result.003 file - promoters60/2113466
ttttttt

SEQ ID NO: 125685 - DNA, 7 bp, Unknown
  misc_feature (1)..( 7): Result.003 file - promoters60/2113466
tttgttt

SEQ ID NO: 125686 - DNA, 7 bp, Unknown
  misc_feature (1)..( 7): Result.003 file - promoters60/2113466
tttgatt

SEQ ID NO: 125687 - DNA, 7 bp, Unknown
  misc_feature (1)..( 7): Result.003 file - promoters60/2113466
tttaatt

SEQ ID NO: 125688 - DNA, 10 bp, Unknown
  misc_feature (1)..( 10): Result.003 file - promoters60/2113466
aattaaacct

SEQ ID NO: 125689 - DNA, 10 bp, Unknown
  misc_feature (1)..( 10): Result.003 file - promoters60/2113466
aatttaacct

SEQ ID NO: 125690 - DNA, 6 bp, Unknown
  misc_feature (1)..( 6): Result.003 file - promoters60/2113466
aaaaca

SEQ ID NO: 125691 - DNA, 6 bp, Unknown
  misc_feature (1)..( 6): Result.003 file - promoters60/2113466
aaaaca

SEQ ID NO: 125692 - DNA, 7 bp, Unknown
  misc_feature (1)..( 7): Result.003 file - promoters60/2113466
tttcaat

SEQ ID NO: 125693 - DNA, 7 bp, Unknown
  misc_feature (1)..( 7): Result.003 file - promoters60/2113466
ttttaat

SEQ ID NO: 125694 - DNA, 15 bp, Unknown
  misc_feature (1)..( 15): Result.003 file - promoters60/2113481
caaaagattcattgt

SEQ ID NO: 125695 - DNA, 15 bp, Unknown
  misc_feature (1)..( 15): Result.003 file - promoters60/2113481
caaatgatacatttg

SEQ ID NO: 125696 - DNA, 15 bp, Unknown
  misc_feature (1)..( 15): Result.003 file - promoters60/2113481
gtaaacataaatttg

SEQ ID NO: 125697 - DNA, 15 bp, Unknown
  misc_feature (1)..( 15): Result.003 file - promoters60/2113481
cgtattacacatttt

SEQ ID NO: 125698 - DNA, 15 bp, Unknown
  misc_feature (1)..( 15): Result.003 file - promoters60/2113481
tagtaactaaattag

SEQ ID NO: 125699 - DNA, 11 bp, Unknown
  misc_feature (1)..( 11): Result.003 file - promoters60/2113481
ttatataaagc

SEQ ID NO: 125700 - DNA, 11 bp, Unknown
  misc_feature (1)..( 11): Result.003 file - promoters60/2113481
ttaaataacaa

SEQ ID NO: 125701 - DNA, 11 bp, Unknown
  misc_feature (1)..( 11): Result.003 file - promoters60/2113481
tttaataactt

SEQ ID NO: 125702 - DNA, 11 bp, Unknown
  misc_feature (1)..( 11): Result.003 file - promoters60/2113481
tgtaataaacg

SEQ ID NO: 125703 - DNA, 11 bp, Unknown
  misc_feature (1)..( 11): Result.003 file - promoters60/2113481
atggataactt

SEQ ID NO: 125704 - DNA, 8 bp, Unknown
  misc_feature (1)..( 8): Result.003 file - promoters60/2113481
tataaata

SEQ ID NO: 125705 - DNA, 8 bp, Unknown
  misc_feature (1)..( 8): Result.003 file - promoters60/2113481
tataaata

SEQ ID NO: 125706 - DNA, 8 bp, Unknown
  misc_feature (1)..( 8): Result.003 file - promoters60/2113481
tataaata

SEQ ID NO: 125707 - DNA, 8 bp, Unknown
  misc_feature (1)..( 8): Result.003 file - promoters60/2113481
tataaact

SEQ ID NO: 125708 - DNA, 8 bp, Unknown
  misc_feature (1)..( 8): Result.003 file - promoters60/2113481
tagaaaaa

SEQ ID NO: 125709 - DNA, 8 bp, Unknown
  misc_feature (1)..( 8): Result.003 file - promoters60/2113481
tagtaaat

SEQ ID NO: 125710 - DNA, 8 bp, Unknown
  misc_feature (1)..( 8): Result.003 file - promoters60/2113481
aagaaaat

SEQ ID NO: 125711 - DNA, 8 bp, Unknown
  misc_feature (1)..( 8): Result.003 file - promoters60/2113481
aagataat

SEQ ID NO: 125712 - DNA, 10 bp, Unknown
  misc_feature (1)..( 10): Result.003 file - promoters60/2113481
agaatctaaa

SEQ ID NO: 125713 - DNA, 10 bp, Unknown
  misc_feature (1)..( 10): Result.003 file - promoters60/2113481
agaatttaat

SEQ ID NO: 125714 - DNA, 10 bp, Unknown
  misc_feature (1)..( 10): Result.003 file - promoters60/2113481
tcaatctaaa

SEQ ID NO: 125715 - DNA, 10 bp, Unknown
  misc_feature (1)..( 10): Result.003 file - promoters60/2113481
tagatttaaa

SEQ ID NO: 125716 - DNA, 12 bp, Unknown
  misc_feature (1)..( 12): Result.003 file - promoters60/2113481
cgttgtttatac

SEQ ID NO: 125717 - DNA, 12 bp, Unknown
  misc_feature (1)..( 12): Result.003 file - promoters60/2113481
attagttaatat

SEQ ID NO: 125718 - DNA, 12 bp, Unknown
  misc_feature (1)..( 12): Result.003 file - promoters60/2113481
atttgttaattt

SEQ ID NO: 125719 - DNA, 13 bp, Unknown
  misc_feature (1)..( 13): Result.003 file - promoters60/2113481
aattagtagataa

SEQ ID NO: 125720 - DNA, 11 bp, Unknown
  misc_feature (1)..( 11): Result.003 file - promoters60/2113481
aaaattatcat

SEQ ID NO: 125721 - DNA, 11 bp, Unknown
  misc_feature (1)..( 11): Result.003 file - promoters60/2113481
aacattaacat

SEQ ID NO: 125722 - DNA, 11 bp, Unknown
  misc_feature (1)..( 11): Result.003 file - promoters60/2113481
aactttaacga

SEQ ID NO: 125723 - DNA, 11 bp, Unknown
  misc_feature (1)..( 11): Result.003 file - promoters60/2113481
atggataactt

SEQ ID NO: 125724 - DNA, 9 bp, Unknown
  misc_feature (1)..( 9): Result.003 file - promoters60/2113481
atttaatat

SEQ ID NO: 125725 - DNA, 9 bp, Unknown
  misc_feature (1)..( 9): Result.003 file - promoters60/2113481
attcaataa

SEQ ID NO: 125726 - DNA, 9 bp, Unknown
  misc_feature (1)..( 9): Result.003 file - promoters60/2113481
ttataatat

SEQ ID NO: 125727 - DNA, 9 bp, Unknown
  misc_feature (1)..( 9): Result.003 file - promoters60/2113481
ataaaataa

SEQ ID NO: 125728 - DNA, 17 bp, Unknown
  misc_feature (1)..( 17): Result.003 file - promoters60/2113502
acaatgggctgggccta

SEQ ID NO: 125729 - DNA, 17 bp, Unknown
  misc_feature (1)..( 17): Result.003 file - promoters60/2113502
caaatgggcctaattat

SEQ ID NO: 125730 - DNA, 17 bp, Unknown
  misc_feature (1)..( 17): Result.003 file - promoters60/2113502
gaaataggcccaacaaa

SEQ ID NO: 125731 - DNA, 17 bp, Unknown
  misc_feature (1)..( 17): Result.003 file - promoters60/2113502
taaaaaggcccattata

SEQ ID NO: 125732 - DNA, 17 bp, Unknown
  misc_feature (1)..( 17): Result.003 file - promoters60/2113502
aaataaagcccattata

SEQ ID NO: 125733 - DNA, 17 bp, Unknown
  misc_feature (1)..( 17): Result.003 file - promoters60/2113502
taaaaaatatctgaaac

SEQ ID NO: 125734 - DNA, 6 bp, Unknown
  misc_feature (1)..( 6): Result.003 file - promoters60/2113592
taaaca

SEQ ID NO: 125735 - DNA, 6 bp, Unknown
  misc_feature (1)..( 6): Result.003 file - promoters60/2113592
taaaca

SEQ ID NO: 125736 - DNA, 10 bp, Unknown
  misc_feature (1)..( 10): Result.003 file - promoters60/2113592
tttttagatc

SEQ ID NO: 125737 - DNA, 10 bp, Unknown
  misc_feature (1)..( 10): Result.003 file - promoters60/2113592
cagttagatc

SEQ ID NO: 125738 - DNA, 10 bp, Unknown
  misc_feature (1)..( 10): Result.003 file - promoters60/2113592
tttatagatt

SEQ ID NO: 125739 - DNA, 9 bp, Unknown
  misc_feature (1)..( 9): Result.003 file - promoters60/2113592
agatcattt

SEQ ID NO: 125740 - DNA, 9 bp, Unknown
  misc_feature (1)..( 9): Result.003 file - promoters60/2113592
aaatctttt

SEQ ID NO: 125741 - DNA, 9 bp, Unknown
  misc_feature (1)..( 9): Result.003 file - promoters60/2113592
aaatgttta

SEQ ID NO: 125742 - DNA, 7 bp, Unknown
  misc_feature (1)..( 7): Result.003 file - promoters60/2113592
gatttat

SEQ ID NO: 125743 - DNA, 7 bp, Unknown
  misc_feature (1)..( 7): Result.003 file - promoters60/2113592
gatctat

SEQ ID NO: 125744 - DNA, 7 bp, Unknown
  misc_feature (1)..( 7): Result.003 file - promoters60/2113592
gatatat

SEQ ID NO: 125745 - DNA, 6 bp, Unknown
  misc_feature (1)..( 6): Result.003 file - promoters60/2113592
ttttca

SEQ ID NO: 125746 - DNA, 6 bp, Unknown
  misc_feature (1)..( 6): Result.003 file - promoters60/2113592
ttttca

SEQ ID NO: 125747 - DNA, 7 bp, Unknown
  misc_feature (1)..( 7): Result.003 file - promoters60/2113592
cgagcaa

SEQ ID NO: 125748 - DNA, 7 bp, Unknown
  misc_feature (1)..( 7): Result.003 file - promoters60/2113592
cgaacaa

SEQ ID NO: 125749 - DNA, 7 bp, Unknown
  misc_feature (1)..( 7): Result.003 file - promoters60/2113592
atatcta

SEQ ID NO: 125750 - DNA, 7 bp, Unknown
  misc_feature (1)..( 7): Result.003 file - promoters60/2113592
ttatcta

SEQ ID NO: 125751 - DNA, 7 bp, Unknown
  misc_feature (1)..( 7): Result.003 file - promoters60/2113592
atagcta

SEQ ID NO: 125752 - DNA, 9 bp, Unknown
  misc_feature (1)..( 9): Result.003 file - promoters60/2113592
ttattgttt

SEQ ID NO: 125753 - DNA, 9 bp, Unknown
  misc_feature (1)..( 9): Result.003 file - promoters60/2113592
ttactgttt

SEQ ID NO: 125754 - DNA, 10 bp, Unknown
  misc_feature (1)..( 10): Result.003 file - promoters60/2113592
attatttttt

SEQ ID NO: 125755 - DNA, 10 bp, Unknown
  misc_feature (1)..( 10): Result.003 file - promoters60/2113592
attacttttt

SEQ ID NO: 125756 - DNA, 7 bp, Unknown
  misc_feature (1)..( 7): Result.003 file - promoters60/2113592
tcaaaag

SEQ ID NO: 125757 - DNA, 7 bp, Unknown
  misc_feature (1)..( 7): Result.003 file - promoters60/2113592
acaaaag

SEQ ID NO: 125758 - DNA, 7 bp, Unknown
  misc_feature (1)..( 7): Result.003 file - promoters60/2113592
acaaaaa

SEQ ID NO: 125759 - DNA, 7 bp, Unknown
  misc_feature (1)..( 7): Result.003 file - promoters60/2113592
ttgggtt

SEQ ID NO: 125760 - DNA, 7 bp, Unknown
  misc_feature (1)..( 7): Result.003 file - promoters60/2113592
ttgagtt

SEQ ID NO: 125761 - DNA, 10 bp, Unknown
  misc_feature (1)..( 10): Result.003 file - promoters60/2113592
actatatata

SEQ ID NO: 125762 - DNA, 10 bp, Unknown
  misc_feature (1)..( 10): Result.003 file - promoters60/2113592
actctatata

SEQ ID NO: 125763 - DNA, 8 bp, Unknown
  misc_feature (1)..( 8): Result.003 file - promoters60/2113592
acatagga

SEQ ID NO: 125764 - DNA, 8 bp, Unknown
  misc_feature (1)..( 8): Result.003 file - promoters60/2113592
acattgga

SEQ ID NO: 125765 - DNA, 6 bp, Unknown
  misc_feature (1)..( 6): Result.003 file - promoters60/2113592
tcaaat

SEQ ID NO: 125766 - DNA, 6 bp, Unknown
  misc_feature (1)..( 6): Result.003 file - promoters60/2113592
tcaaat

SEQ ID NO: 125767 - DNA, 6 bp, Unknown
  misc_feature (1)..( 6): Result.003 file - promoters60/2113592
aaatta

SEQ ID NO: 125768 - DNA, 6 bp, Unknown
  misc_feature (1)..( 6): Result.003 file - promoters60/2113592
aaatta

SEQ ID NO: 125769 - DNA, 8 bp, Unknown
  misc_feature (1)..( 8): Result.003 file - promoters60/2113592
attattat

SEQ ID NO: 125770 - DNA, 8 bp, Unknown
  misc_feature (1)..( 8): Result.003 file - promoters60/2113592
attactat

SEQ ID NO: 125771 - DNA, 6 bp, Unknown
  misc_feature (1)..( 6): Result.003 file - promoters60/2113592
atcgaa

SEQ ID NO: 125772 - DNA, 6 bp, Unknown
  misc_feature (1)..( 6): Result.003 file - promoters60/2113592
atcgaa

SEQ ID NO: 125773 - DNA, 8 bp, Unknown
  misc_feature (1)..( 8): Result.003 file - promoters60/2113592
gaagtcac

SEQ ID NO: 125774 - DNA, 8 bp, Unknown
  misc_feature (1)..( 8): Result.003 file - promoters60/2113592
gaattcac

SEQ ID NO: 125775 - DNA, 7 bp, Unknown
  misc_feature (1)..( 7): Result.003 file - promoters60/2113592
aaataat

SEQ ID NO: 125776 - DNA, 7 bp, Unknown
  misc_feature (1)..( 7): Result.003 file - promoters60/2113592
aaataat

SEQ ID NO: 125777 - DNA, 8 bp, Unknown
  misc_feature (1)..( 8): Result.003 file - promoters60/2113620
gaaggaag

SEQ ID NO: 125778 - DNA, 8 bp, Unknown
  misc_feature (1)..( 8): Result.003 file - promoters60/2113620
aaagaaag

SEQ ID NO: 125779 - DNA, 8 bp, Unknown
  misc_feature (1)..( 8): Result.003 file - promoters60/2113620
gaatgaat

SEQ ID NO: 125780 - DNA, 7 bp, Unknown
  misc_feature (1)..( 7): Result.003 file - promoters60/2113620
caatgaa

SEQ ID NO: 125781 - DNA, 7 bp, Unknown
  misc_feature (1)..( 7): Result.003 file - promoters60/2113620
caaagaa

SEQ ID NO: 125782 - DNA, 7 bp, Unknown
  misc_feature (1)..( 7): Result.003 file - promoters60/2113620
atcgcag

SEQ ID NO: 125783 - DNA, 7 bp, Unknown
  misc_feature (1)..( 7): Result.003 file - promoters60/2113620
atcacag

SEQ ID NO: 125784 - DNA, 6 bp, Unknown
  misc_feature (1)..( 6): Result.003 file - promoters60/2113620
tagtga

SEQ ID NO: 125785 - DNA, 6 bp, Unknown
  misc_feature (1)..( 6): Result.003 file - promoters60/2113620
tagtga

SEQ ID NO: 125786 - DNA, 8 bp, Unknown
  misc_feature (1)..( 8): Result.003 file - promoters60/2113620
tgtgactt

SEQ ID NO: 125787 - DNA, 8 bp, Unknown
  misc_feature (1)..( 8): Result.003 file - promoters60/2113620
tgtgtctt

SEQ ID NO: 125788 - DNA, 6 bp, Unknown
  misc_feature (1)..( 6): Result.003 file - promoters60/2113620
ttgcaa

SEQ ID NO: 125789 - DNA, 6 bp, Unknown
  misc_feature (1)..( 6): Result.003 file - promoters60/2113620
ttgcaa

SEQ ID NO: 125790 - DNA, 6 bp, Unknown
  misc_feature (1)..( 6): Result.003 file - promoters60/2113620
attgtg

SEQ ID NO: 125791 - DNA, 6 bp, Unknown
  misc_feature (1)..( 6): Result.003 file - promoters60/2113620
attgtg

SEQ ID NO: 125792 - DNA, 7 bp, Unknown
  misc_feature (1)..( 7): Result.003 file - promoters60/2113620
tgcctgt

SEQ ID NO: 125793 - DNA, 7 bp, Unknown
  misc_feature (1)..( 7): Result.003 file - promoters60/2113620
tgcatgt

SEQ ID NO: 125794 - DNA, 8 bp, Unknown
  misc_feature (1)..( 8): Result.003 file - promoters60/2113620
caagttta

SEQ ID NO: 125795 - DNA, 8 bp, Unknown
  misc_feature (1)..( 8): Result.003 file - promoters60/2113620
caatttta

SEQ ID NO: 125796 - DNA, 9 bp, Unknown
  misc_feature (1)..( 9): Result.003 file - promoters60/2113620
accagtcaa

SEQ ID NO: 125797 - DNA, 9 bp, Unknown
  misc_feature (1)..( 9): Result.003 file - promoters60/2113620
accagccaa

SEQ ID NO: 125798 - DNA, 7 bp, Unknown
  misc_feature (1)..( 7): Result.003 file - promoters60/2113620
tgtcttg

SEQ ID NO: 125799 - DNA, 7 bp, Unknown
  misc_feature (1)..( 7): Result.003 file - promoters60/2113620
tgtattg

SEQ ID NO: 125800 - DNA, 6 bp, Unknown
  misc_feature (1)..( 6): Result.003 file - promoters60/2113620
atttgt

SEQ ID NO: 125801 - DNA, 6 bp, Unknown
  misc_feature (1)..( 6): Result.003 file - promoters60/2113620
atttgt

SEQ ID NO: 125802 - DNA, 7 bp, Unknown
  misc_feature (1)..( 7): Result.003 file - promoters60/2113620
tattact

SEQ ID NO: 125803 - DNA, 7 bp, Unknown
  misc_feature (1)..( 7): Result.003 file - promoters60/2113620
tatgact

SEQ ID NO: 125804 - DNA, 8 bp, Unknown
  misc_feature (1)..( 8): Result.003 file - promoters60/2113620
ggtgtgat

SEQ ID NO: 125805 - DNA, 8 bp, Unknown
  misc_feature (1)..( 8): Result.003 file - promoters60/2113620
ggtgggat

SEQ ID NO: 125806 - DNA, 6 bp, Unknown
  misc_feature (1)..( 6): Result.003 file - promoters60/2113620
tggaaa

SEQ ID NO: 125807 - DNA, 6 bp, Unknown
  misc_feature (1)..( 6): Result.003 file - promoters60/2113620
tggaaa

SEQ ID NO: 125808 - DNA, 8 bp, Unknown
  misc_feature (1)..( 8): Result.003 file - promoters60/2113620
caacacca

SEQ ID NO: 125809 - DNA, 8 bp, Unknown
  misc_feature (1)..( 8): Result.003 file - promoters60/2113620
caactcca

SEQ ID NO: 125810 - DNA, 7 bp, Unknown
  misc_feature (1)..( 7): Result.003 file - promoters60/2113620
ttacttg

SEQ ID NO: 125811 - DNA, 7 bp, Unknown
  misc_feature (1)..( 7): Result.003 file - promoters60/2113620
ttaattg

SEQ ID NO: 125812 - DNA, 8 bp, Unknown
  misc_feature (1)..( 8): Result.003 file - promoters60/2113620
actttata

SEQ ID NO: 125813 - DNA, 8 bp, Unknown
  misc_feature (1)..( 8): Result.003 file - promoters60/2113620
acttcata

SEQ ID NO: 125814 - DNA, 7 bp, Unknown
  misc_feature (1)..( 7): Result.003 file - promoters60/2113620
catttcc

SEQ ID NO: 125815 - DNA, 7 bp, Unknown
  misc_feature (1)..( 7): Result.003 file - promoters60/2113620
catatcc

SEQ ID NO: 125816 - DNA, 11 bp, Unknown
  misc_feature (1)..( 11): Result.003 file - promoters60/2113624
tgtacttagag

SEQ ID NO: 125817 - DNA, 11 bp, Unknown
  misc_feature (1)..( 11): Result.003 file - promoters60/2113624
tgtatttaact

SEQ ID NO: 125818 - DNA, 11 bp, Unknown
  misc_feature (1)..( 11): Result.003 file - promoters60/2113624
aatatttatac

SEQ ID NO: 125819 - DNA, 8 bp, Unknown
  misc_feature (1)..( 8): Result.003 file - promoters60/2113624
tctttaat

SEQ ID NO: 125820 - DNA, 8 bp, Unknown
  misc_feature (1)..( 8): Result.003 file - promoters60/2113624
aatttaat

SEQ ID NO: 125821 - DNA, 8 bp, Unknown
  misc_feature (1)..( 8): Result.003 file - promoters60/2113624
tctataaa

SEQ ID NO: 125822 - DNA, 12 bp, Unknown
  misc_feature (1)..( 12): Result.003 file - promoters60/2113624
ttgtcaaaaata

SEQ ID NO: 125823 - DNA, 12 bp, Unknown
  misc_feature (1)..( 12): Result.003 file - promoters60/2113624
ctttgaaacata

SEQ ID NO: 125824 - DNA, 12 bp, Unknown
  misc_feature (1)..( 12): Result.003 file - promoters60/2113624
taatcataaatc

SEQ ID NO: 125825 - DNA, 12 bp, Unknown
  misc_feature (1)..( 12): Result.003 file - promoters60/2113624
aaattaaaaaaa

SEQ ID NO: 125826 - DNA, 9 bp, Unknown
  misc_feature (1)..( 9): Result.003 file - promoters60/2113624
gtataaaac

SEQ ID NO: 125827 - DNA, 9 bp, Unknown
  misc_feature (1)..( 9): Result.003 file - promoters60/2113624
ttataaaac

SEQ ID NO: 125828 - DNA, 9 bp, Unknown
  misc_feature (1)..( 9): Result.003 file - promoters60/2113624
gtataaatt

SEQ ID NO: 125829 - DNA, 7 bp, Unknown
  misc_feature (1)..( 7): Result.003 file - promoters60/2113624
ttacaat

SEQ ID NO: 125830 - DNA, 7 bp, Unknown
  misc_feature (1)..( 7): Result.003 file - promoters60/2113624
ttacaaa

SEQ ID NO: 125831 - DNA, 7 bp, Unknown
  misc_feature (1)..( 7): Result.003 file - promoters60/2113624
ttacaat

SEQ ID NO: 125832 - DNA, 9 bp, Unknown
  misc_feature (1)..( 9): Result.003 file - promoters60/2113624
tcaatttac

SEQ ID NO: 125833 - DNA, 9 bp, Unknown
  misc_feature (1)..( 9): Result.003 file - promoters60/2113624
tcatttttt

SEQ ID NO: 125834 - DNA, 9 bp, Unknown
  misc_feature (1)..( 9): Result.003 file - promoters60/2113624
taatttttt

SEQ ID NO: 125835 - DNA, 9 bp, Unknown
  misc_feature (1)..( 9): Result.003 file - promoters60/2113631
gctttgttt

SEQ ID NO: 125836 - DNA, 9 bp, Unknown
  misc_feature (1)..( 9): Result.003 file - promoters60/2113631
gcttcgttt

SEQ ID NO: 125837 - DNA, 6 bp, Unknown
  misc_feature (1)..( 6): Result.003 file - promoters60/2113631
gacatt

SEQ ID NO: 125838 - DNA, 6 bp, Unknown
  misc_feature (1)..( 6): Result.003 file - promoters60/2113631
gacatt

SEQ ID NO: 125839 - DNA, 6 bp, Unknown
  misc_feature (1)..( 6): Result.003 file - promoters60/2113631
ttctaa

SEQ ID NO: 125840 - DNA, 6 bp, Unknown
  misc_feature (1)..( 6): Result.003 file - promoters60/2113631
ttctaa

SEQ ID NO: 125841 - DNA, 9 bp, Unknown
  misc_feature (1)..( 9): Result.003 file - promoters60/2113631
taacttcaa

SEQ ID NO: 125842 - DNA, 9 bp, Unknown
  misc_feature (1)..( 9): Result.003 file - promoters60/2113631
taacgtcaa

SEQ ID NO: 125843 - DNA, 7 bp, Unknown
  misc_feature (1)..( 7): Result.003 file - promoters60/2113631
acataat

SEQ ID NO: 125844 - DNA, 7 bp, Unknown
  misc_feature (1)..( 7): Result.003 file - promoters60/2113631
acaaaat

SEQ ID NO: 125845 - DNA, 7 bp, Unknown
  misc_feature (1)..( 7): Result.003 file - promoters60/2113631
aatctcc

SEQ ID NO: 125846 - DNA, 7 bp, Unknown
  misc_feature (1)..( 7): Result.003 file - promoters60/2113631
aatttcc

SEQ ID NO: 125847 - DNA, 8 bp, Unknown
  misc_feature (1)..( 8): Result.003 file - promoters60/2113631
aaaatctt

SEQ ID NO: 125848 - DNA, 8 bp, Unknown
  misc_feature (1)..( 8): Result.003 file - promoters60/2113631
aaaacctt

SEQ ID NO: 125849 - DNA, 8 bp, Unknown
  misc_feature (1)..( 8): Result.003 file - promoters60/2113631
atggataa

SEQ ID NO: 125850 - DNA, 8 bp, Unknown
  misc_feature (1)..( 8): Result.003 file - promoters60/2113631
atggataa

SEQ ID NO: 125851 - DNA, 9 bp, Unknown
  misc_feature (1)..( 9): Result.003 file - promoters60/2113631
caatgttgt

SEQ ID NO: 125852 - DNA, 9 bp, Unknown
  misc_feature (1)..( 9): Result.003 file - promoters60/2113631
caattttgt

SEQ ID NO: 125853 - DNA, 6 bp, Unknown
  misc_feature (1)..( 6): Result.003 file - promoters60/2113631
tccttg

SEQ ID NO: 125854 - DNA, 6 bp, Unknown
  misc_feature (1)..( 6): Result.003 file - promoters60/2113631
tccttg

SEQ ID NO: 125855 - DNA, 6 bp, Unknown
  misc_feature (1)..( 6): Result.003 file - promoters60/2113631
gttatt

SEQ ID NO: 125856 - DNA, 6 bp, Unknown
  misc_feature (1)..( 6): Result.003 file - promoters60/2113631
gttatt

SEQ ID NO: 125857 - DNA, 7 bp, Unknown
  misc_feature (1)..( 7): Result.003 file - promoters60/2113631
aaatcaa

SEQ ID NO: 125858 - DNA, 7 bp, Unknown
  misc_feature (1)..( 7): Result.003 file - promoters60/2113631
aaaccaa

SEQ ID NO: 125859 - DNA, 6 bp, Unknown
  misc_feature (1)..( 6): Result.003 file - promoters60/2113631
agtaaa

SEQ ID NO: 125860 - DNA, 6 bp, Unknown
  misc_feature (1)..( 6): Result.003 file - promoters60/2113631
agtaaa

SEQ ID NO: 125861 - DNA, 7 bp, Unknown
  misc_feature (1)..( 7): Result.003 file - promoters60/2113631
aatcggg

SEQ ID NO: 125862 - DNA, 7 bp, Unknown
  misc_feature (1)..( 7): Result.003 file - promoters60/2113631
aattggg

SEQ ID NO: 125863 - DNA, 8 bp, Unknown
  misc_feature (1)..( 8): Result.003 file - promoters60/2113631
gaaagaaa

SEQ ID NO: 125864 - DNA, 8 bp, Unknown
  misc_feature (1)..( 8): Result.003 file - promoters60/2113631
gaaacaaa

SEQ ID NO: 125865 - DNA, 10 bp, Unknown
  misc_feature (1)..( 10): Result.003 file - promoters60/2113631
ggaaaagaaa

SEQ ID NO: 125866 - DNA, 10 bp, Unknown
  misc_feature (1)..( 10): Result.003 file - promoters60/2113631
ggaaatgaaa

SEQ ID NO: 125867 - DNA, 7 bp, Unknown
  misc_feature (1)..( 7): Result.003 file - promoters60/2113631
cccacta

SEQ ID NO: 125868 - DNA, 7 bp, Unknown
  misc_feature (1)..( 7): Result.003 file - promoters60/2113631
cccacta

SEQ ID NO: 125869 - DNA, 9 bp, Unknown
  misc_feature (1)..( 9): Result.003 file - promoters60/2113631
aaagaaaag

SEQ ID NO: 125870 - DNA, 9 bp, Unknown
  misc_feature (1)..( 9): Result.003 file - promoters60/2113631
aaagtaaag

SEQ ID NO: 125871 - DNA, 7 bp, Unknown
  misc_feature (1)..( 7): Result.003 file - promoters60/2113631
gtatata

SEQ ID NO: 125872 - DNA, 7 bp, Unknown
  misc_feature (1)..( 7): Result.003 file - promoters60/2113631
gtatata

SEQ ID NO: 125873 - DNA, 10 bp, Unknown
  misc_feature (1)..( 10): Result.003 file - promoters60/2113640
ctaaactaaa

SEQ ID NO: 125874 - DNA, 10 bp, Unknown
  misc_feature (1)..( 10): Result.003 file - promoters60/2113640
ctatactcga

SEQ ID NO: 125875 - DNA, 10 bp, Unknown
  misc_feature (1)..( 10): Result.003 file - promoters60/2113640
taaaacgaaa

SEQ ID NO: 125876 - DNA, 9 bp, Unknown
  misc_feature (1)..( 9): Result.003 file - promoters60/2113640
tagatttta

SEQ ID NO: 125877 - DNA, 9 bp, Unknown
  misc_feature (1)..( 9): Result.003 file - promoters60/2113640
tagatttgt

SEQ ID NO: 125878 - DNA, 9 bp, Unknown
  misc_feature (1)..( 9): Result.003 file - promoters60/2113640
cggatttta

SEQ ID NO: 125879 - DNA, 9 bp, Unknown
  misc_feature (1)..( 9): Result.003 file - promoters60/2113640
aaaattaag

SEQ ID NO: 125880 - DNA, 9 bp, Unknown
  misc_feature (1)..( 9): Result.003 file - promoters60/2113640
aaaaataat

SEQ ID NO: 125881 - DNA, 9 bp, Unknown
  misc_feature (1)..( 9): Result.003 file - promoters60/2113640
ataatgaag

SEQ ID NO: 125882 - DNA, 9 bp, Unknown
  misc_feature (1)..( 9): Result.003 file - promoters60/2113640
taaaatatt

SEQ ID NO: 125883 - DNA, 7 bp, Unknown
  misc_feature (1)..( 7): Result.003 file - promoters60/2113640
aatatat

SEQ ID NO: 125884 - DNA, 7 bp, Unknown
  misc_feature (1)..( 7): Result.003 file - promoters60/2113640
tatatat

SEQ ID NO: 125885 - DNA, 7 bp, Unknown
  misc_feature (1)..( 7): Result.003 file - promoters60/2113640
aatataa

SEQ ID NO: 125886 - DNA, 7 bp, Unknown
  misc_feature (1)..( 7): Result.003 file - promoters60/2113640
ataaaca

SEQ ID NO: 125887 - DNA, 7 bp, Unknown
  misc_feature (1)..( 7): Result.003 file - promoters60/2113640
atataca

SEQ ID NO: 125888 - DNA, 7 bp, Unknown
  misc_feature (1)..( 7): Result.003 file - promoters60/2113640
gtaaaca

SEQ ID NO: 125889 - DNA, 9 bp, Unknown
  misc_feature (1)..( 9): Result.003 file - promoters60/2113640
ttacgaata

SEQ ID NO: 125890 - DNA, 9 bp, Unknown
  misc_feature (1)..( 9): Result.003 file - promoters60/2113640
aatcgaata

SEQ ID NO: 125891 - DNA, 9 bp, Unknown
  misc_feature (1)..( 9): Result.003 file - promoters60/2113640
aatcaaatg

SEQ ID NO: 125892 - DNA, 8 bp, Unknown
  misc_feature (1)..( 8): Result.003 file - promoters60/2113640
atttgtta

SEQ ID NO: 125893 - DNA, 8 bp, Unknown
  misc_feature (1)..( 8): Result.003 file - promoters60/2113640
atttatta

SEQ ID NO: 125894 - DNA, 8 bp, Unknown
  misc_feature (1)..( 8): Result.003 file - promoters60/2113640
ttttgtta

SEQ ID NO: 125895 - DNA, 9 bp, Unknown
  misc_feature (1)..( 9): Result.003 file - promoters60/2113640
aaaattaca

SEQ ID NO: 125896 - DNA, 9 bp, Unknown
  misc_feature (1)..( 9): Result.003 file - promoters60/2113640
aaaatttat

SEQ ID NO: 125897 - DNA, 9 bp, Unknown
  misc_feature (1)..( 9): Result.003 file - promoters60/2113640
aaaataaca

SEQ ID NO: 125898 - DNA, 9 bp, Unknown
  misc_feature (1)..( 9): Result.003 file - promoters60/2113660
ccaagaaaa

SEQ ID NO: 125899 - DNA, 9 bp, Unknown
  misc_feature (1)..( 9): Result.003 file - promoters60/2113660
agaagaaaa

SEQ ID NO: 125900 - DNA, 9 bp, Unknown
  misc_feature (1)..( 9): Result.003 file - promoters60/2113660
ccaacaaaa

SEQ ID NO: 125901 - DNA, 7 bp, Unknown
  misc_feature (1)..( 7): Result.003 file - promoters60/2113660
aaataaa

SEQ ID NO: 125902 - DNA, 7 bp, Unknown
  misc_feature (1)..( 7): Result.003 file - promoters60/2113660
aaataaa

SEQ ID NO: 125903 - DNA, 6 bp, Unknown
  misc_feature (1)..( 6): Result.003 file - promoters60/2113660
ataata

SEQ ID NO: 125904 - DNA, 6 bp, Unknown
  misc_feature (1)..( 6): Result.003 file - promoters60/2113660
ataata

SEQ ID NO: 125905 - DNA, 6 bp, Unknown
  misc_feature (1)..( 6): Result.003 file - promoters60/2113660
atttgc

SEQ ID NO: 125906 - DNA, 6 bp, Unknown
  misc_feature (1)..( 6): Result.003 file - promoters60/2113660
atttgc

SEQ ID NO: 125907 - DNA, 7 bp, Unknown
  misc_feature (1)..( 7): Result.003 file - promoters60/2113660
aaataaa

SEQ ID NO: 125908 - DNA, 7 bp, Unknown
  misc_feature (1)..( 7): Result.003 file - promoters60/2113660
aaataat

SEQ ID NO: 125909 - DNA, 7 bp, Unknown
  misc_feature (1)..( 7): Result.003 file - promoters60/2113660
aaataaa

SEQ ID NO: 125910 - DNA, 6 bp, Unknown
  misc_feature (1)..( 6): Result.003 file - promoters60/2113660
caagta

SEQ ID NO: 125911 - DNA, 6 bp, Unknown
  misc_feature (1)..( 6): Result.003 file - promoters60/2113660
caagta

SEQ ID NO: 125912 - DNA, 7 bp, Unknown
  misc_feature (1)..( 7): Result.003 file - promoters60/2113660
gaatgaa

SEQ ID NO: 125913 - DNA, 7 bp, Unknown
  misc_feature (1)..( 7): Result.003 file - promoters60/2113660
gaaagaa

SEQ ID NO: 125914 - DNA, 7 bp, Unknown
  misc_feature (1)..( 7): Result.003 file - promoters60/2113660
cacgaag

SEQ ID NO: 125915 - DNA, 7 bp, Unknown
  misc_feature (1)..( 7): Result.003 file - promoters60/2113660
cacaaag

SEQ ID NO: 125916 - DNA, 6 bp, Unknown
  misc_feature (1)..( 6): Result.003 file - promoters60/2113660
acataa

SEQ ID NO: 125917 - DNA, 6 bp, Unknown
  misc_feature (1)..( 6): Result.003 file - promoters60/2113660
acataa

SEQ ID NO: 125918 - DNA, 6 bp, Unknown
  misc_feature (1)..( 6): Result.003 file - promoters60/2113660
tcagta

SEQ ID NO: 125919 - DNA, 6 bp, Unknown
  misc_feature (1)..( 6): Result.003 file - promoters60/2113660
tcagta

SEQ ID NO: 125920 - DNA, 8 bp, Unknown
  misc_feature (1)..( 8): Result.003 file - promoters60/2113660
atagtaaa

SEQ ID NO: 125921 - DNA, 8 bp, Unknown
  misc_feature (1)..( 8): Result.003 file - promoters60/2113660
atattaaa

SEQ ID NO: 125922 - DNA, 6 bp, Unknown
  misc_feature (1)..( 6): Result.003 file - promoters60/2113660
aaattg

SEQ ID NO: 125923 - DNA, 6 bp, Unknown
  misc_feature (1)..( 6): Result.003 file - promoters60/2113660
aaattg

SEQ ID NO: 125924 - DNA, 8 bp, Unknown
  misc_feature (1)..( 8): Result.003 file - promoters60/2113660
tgaatttt

SEQ ID NO: 125925 - DNA, 8 bp, Unknown
  misc_feature (1)..( 8): Result.003 file - promoters60/2113660
agaaattt

SEQ ID NO: 125926 - DNA, 8 bp, Unknown
  misc_feature (1)..( 8): Result.003 file - promoters60/2113660
agatattt

SEQ ID NO: 125927 - DNA, 7 bp, Unknown
  misc_feature (1)..( 7): Result.003 file - promoters60/2113660
tttgaat

SEQ ID NO: 125928 - DNA, 7 bp, Unknown
  misc_feature (1)..( 7): Result.003 file - promoters60/2113660
tttgaat

SEQ ID NO: 125929 - DNA, 7 bp, Unknown
  misc_feature (1)..( 7): Result.003 file - promoters60/2113660
acttcaa

SEQ ID NO: 125930 - DNA, 7 bp, Unknown
  misc_feature (1)..( 7): Result.003 file - promoters60/2113660
acttcaa

SEQ ID NO: 125931 - DNA, 7 bp, Unknown
  misc_feature (1)..( 7): Result.003 file - promoters60/2113660
aattttg

SEQ ID NO: 125932 - DNA, 7 bp, Unknown
  misc_feature (1)..( 7): Result.003 file - promoters60/2113660
aatcttg

SEQ ID NO: 125933 - DNA, 6 bp, Unknown
  misc_feature (1)..( 6): Result.003 file - promoters60/2113660
gacaaa

SEQ ID NO: 125934 - DNA, 6 bp, Unknown
  misc_feature (1)..( 6): Result.003 file - promoters60/2113660
gacaaa

SEQ ID NO: 125935 - DNA, 7 bp, Unknown
  misc_feature (1)..( 7): Result.003 file - promoters60/2113660
attcttt

SEQ ID NO: 125936 - DNA, 7 bp, Unknown
  misc_feature (1)..( 7): Result.003 file - promoters60/2113660
attgttt

SEQ ID NO: 125937 - DNA, 6 bp, Unknown
  misc_feature (1)..( 6): Result.003 file - promoters60/2113660
taaatc

SEQ ID NO: 125938 - DNA, 6 bp, Unknown
  misc_feature (1)..( 6): Result.003 file - promoters60/2113660
taaatc

SEQ ID NO: 125939 - DNA, 8 bp, Unknown
  misc_feature (1)..( 8): Result.003 file - promoters60/2113675
gtagagaa

SEQ ID NO: 125940 - DNA, 8 bp, Unknown
  misc_feature (1)..( 8): Result.003 file - promoters60/2113675
gtagagaa

SEQ ID NO: 125941 - DNA, 8 bp, Unknown
  misc_feature (1)..( 8): Result.003 file - promoters60/2113675
gtggagaa

SEQ ID NO: 125942 - DNA, 8 bp, Unknown
  misc_feature (1)..( 8): Result.003 file - promoters60/2113675
gaaaaaat

SEQ ID NO: 125943 - DNA, 8 bp, Unknown
  misc_feature (1)..( 8): Result.003 file - promoters60/2113675
gaagaaat

SEQ ID NO: 125944 - DNA, 8 bp, Unknown
  misc_feature (1)..( 8): Result.003 file - promoters60/2113675
aaagaaag

SEQ ID NO: 125945 - DNA, 9 bp, Unknown
  misc_feature (1)..( 9): Result.003 file - promoters60/2113675
ctttataat

SEQ ID NO: 125946 - DNA, 9 bp, Unknown
  misc_feature (1)..( 9): Result.003 file - promoters60/2113675
cattaaaat

SEQ ID NO: 125947 - DNA, 10 bp, Unknown
  misc_feature (1)..( 10): Result.003 file - promoters60/2113675
acttcataga

SEQ ID NO: 125948 - DNA, 9 bp, Unknown
  misc_feature (1)..( 9): Result.003 file - promoters60/2113734
tgttagaga

SEQ ID NO: 125949 - DNA, 9 bp, Unknown
  misc_feature (1)..( 9): Result.003 file - promoters60/2113734
aattaaaga

SEQ ID NO: 125950 - DNA, 9 bp, Unknown
  misc_feature (1)..( 9): Result.003 file - promoters60/2113734
aattaaaaa

SEQ ID NO: 125951 - DNA, 11 bp, Unknown
  misc_feature (1)..( 11): Result.003 file - promoters60/2113734
tgctaagataa

SEQ ID NO: 125952 - DNA, 11 bp, Unknown
  misc_feature (1)..( 11): Result.003 file - promoters60/2113734
aattaaaataa

SEQ ID NO: 125953 - DNA, 11 bp, Unknown
  misc_feature (1)..( 11): Result.003 file - promoters60/2113734
aattaaaaaat

SEQ ID NO: 125954 - DNA, 9 bp, Unknown
  misc_feature (1)..( 9): Result.003 file - promoters60/2113734
aaagtttaa

SEQ ID NO: 125955 - DNA, 9 bp, Unknown
  misc_feature (1)..( 9): Result.003 file - promoters60/2113734
ggtgtttaa

SEQ ID NO: 125956 - DNA, 9 bp, Unknown
  misc_feature (1)..( 9): Result.003 file - promoters60/2113734
aaactttat

SEQ ID NO: 125957 - DNA, 15 bp, Unknown
  misc_feature (1)..( 15): Result.003 file - promoters60/2113738
tcagaattaatataa

SEQ ID NO: 125958 - DNA, 15 bp, Unknown
  misc_feature (1)..( 15): Result.003 file - promoters60/2113738
tcataattaataaac

SEQ ID NO: 125959 - DNA, 15 bp, Unknown
  misc_feature (1)..( 15): Result.003 file - promoters60/2113738
atataatgaatattt

SEQ ID NO: 125960 - DNA, 15 bp, Unknown
  misc_feature (1)..( 15): Result.003 file - promoters60/2113738
acatgatttgaataa

SEQ ID NO: 125961 - DNA, 15 bp, Unknown
  misc_feature (1)..( 15): Result.003 file - promoters60/2113738
ccataggaaatattt

SEQ ID NO: 125962 - DNA, 15 bp, Unknown
  misc_feature (1)..( 15): Result.003 file - promoters60/2113738
tgatgatgaatgtga

SEQ ID NO: 125963 - DNA, 10 bp, Unknown
  misc_feature (1)..( 10): Result.003 file - promoters60/2113738
taaatataaa

SEQ ID NO: 125964 - DNA, 10 bp, Unknown
  misc_feature (1)..( 10): Result.003 file - promoters60/2113738
gaaatatttt

SEQ ID NO: 125965 - DNA, 10 bp, Unknown
  misc_feature (1)..( 10): Result.003 file - promoters60/2113738
gaaataggtc

SEQ ID NO: 125966 - DNA, 10 bp, Unknown
  misc_feature (1)..( 10): Result.003 file - promoters60/2113738
tgaatatttg

SEQ ID NO: 125967 - DNA, 10 bp, Unknown
  misc_feature (1)..( 10): Result.003 file - promoters60/2113738
aaattatttg

SEQ ID NO: 125968 - DNA, 15 bp, Unknown
  misc_feature (1)..( 15): Result.003 file - promoters60/2113738
taactttatttctcc

SEQ ID NO: 125969 - DNA, 15 bp, Unknown
  misc_feature (1)..( 15): Result.003 file - promoters60/2113738
taatttttttttcct

SEQ ID NO: 125970 - DNA, 15 bp, Unknown
  misc_feature (1)..( 15): Result.003 file - promoters60/2113738
tataattatttttgg

SEQ ID NO: 125971 - DNA, 15 bp, Unknown
  misc_feature (1)..( 15): Result.003 file - promoters60/2113738
gtgaatcattgaaat

SEQ ID NO: 125972 - DNA, 15 bp, Unknown
  misc_feature (1)..( 15): Result.003 file - promoters60/2113738
tgactttgttccttc

SEQ ID NO: 125973 - DNA, 13 bp, Unknown
  misc_feature (1)..( 13): Result.003 file - promoters60/2113839
attcattaacaaa

SEQ ID NO: 125974 - DNA, 13 bp, Unknown
  misc_feature (1)..( 13): Result.003 file - promoters60/2113839
attcataaaaaaa

SEQ ID NO: 125975 - DNA, 13 bp, Unknown
  misc_feature (1)..( 13): Result.003 file - promoters60/2113839
atttataaagaaa

SEQ ID NO: 125976 - DNA, 13 bp, Unknown
  misc_feature (1)..( 13): Result.003 file - promoters60/2113839
cagaaaaaagaaa

SEQ ID NO: 125977 - DNA, 8 bp, Unknown
  misc_feature (1)..( 8): Result.003 file - promoters60/2113839
taacaaat

SEQ ID NO: 125978 - DNA, 8 bp, Unknown
  misc_feature (1)..( 8): Result.003 file - promoters60/2113839
taaaaaaa

SEQ ID NO: 125979 - DNA, 8 bp, Unknown
  misc_feature (1)..( 8): Result.003 file - promoters60/2113839
gaaccaat

SEQ ID NO: 125980 - DNA, 8 bp, Unknown
  misc_feature (1)..( 8): Result.003 file - promoters60/2113839
gaaaaaag

SEQ ID NO: 125981 - DNA, 12 bp, Unknown
  misc_feature (1)..( 12): Result.003 file - promoters60/2113839
aactaattcaat

SEQ ID NO: 125982 - DNA, 12 bp, Unknown
  misc_feature (1)..( 12): Result.003 file - promoters60/2113839
gactaatgcaat

SEQ ID NO: 125983 - DNA, 12 bp, Unknown
  misc_feature (1)..( 12): Result.003 file - promoters60/2113839
aaccaatggttg

SEQ ID NO: 125984 - DNA, 13 bp, Unknown
  misc_feature (1)..( 13): Result.003 file - promoters60/2113839
atttctacaaaac

SEQ ID NO: 125985 - DNA, 13 bp, Unknown
  misc_feature (1)..( 13): Result.003 file - promoters60/2113839
attcctaaaaaat

SEQ ID NO: 125986 - DNA, 13 bp, Unknown
  misc_feature (1)..( 13): Result.003 file - promoters60/2113839
atggtcaaaaaag

SEQ ID NO: 125987 - DNA, 13 bp, Unknown
  misc_feature (1)..( 13): Result.003 file - promoters60/2113839
taaaataaatata

SEQ ID NO: 125988 - DNA, 10 bp, Unknown
  misc_feature (1)..( 10): Result.003 file - promoters60/2113839
aaataaaaca

SEQ ID NO: 125989 - DNA, 10 bp, Unknown
  misc_feature (1)..( 10): Result.003 file - promoters60/2113839
aaagaaaaca

SEQ ID NO: 125990 - DNA, 10 bp, Unknown
  misc_feature (1)..( 10): Result.003 file - promoters60/2113839
aaagaaagaa

SEQ ID NO: 125991 - DNA, 10 bp, Unknown
  misc_feature (1)..( 10): Result.003 file - promoters60/2113839
aaaaaaatct

SEQ ID NO: 125992 - DNA, 9 bp, Unknown
  misc_feature (1)..( 9): Result.003 file - promoters60/2113839
caaaacaaa

SEQ ID NO: 125993 - DNA, 9 bp, Unknown
  misc_feature (1)..( 9): Result.003 file - promoters60/2113839
caaatcaaa

SEQ ID NO: 125994 - DNA, 9 bp, Unknown
  misc_feature (1)..( 9): Result.003 file - promoters60/2113839
taaaacaat

SEQ ID NO: 125995 - DNA, 7 bp, Unknown
  misc_feature (1)..( 7): Result.003 file - promoters60/2113839
tattttg

SEQ ID NO: 125996 - DNA, 7 bp, Unknown
  misc_feature (1)..( 7): Result.003 file - promoters60/2113839
aattttg

SEQ ID NO: 125997 - DNA, 7 bp, Unknown
  misc_feature (1)..( 7): Result.003 file - promoters60/2113839
aatcttg

SEQ ID NO: 125998 - DNA, 9 bp, Unknown
  misc_feature (1)..( 9): Result.003 file - promoters60/2113839
tcatgttta

SEQ ID NO: 125999 - DNA, 9 bp, Unknown
  misc_feature (1)..( 9): Result.003 file - promoters60/2113839
ttttgttta

SEQ ID NO: 126000 - DNA, 9 bp, Unknown
  misc_feature (1)..( 9): Result.003 file - promoters60/2113839
ttttgtttc

SEQ ID NO: 126001 - DNA, 9 bp, Unknown
  misc_feature (1)..( 9): Result.003 file - promoters60/2113839
ctttgatta

SEQ ID NO: 126002 - DNA, 8 bp, Unknown
  misc_feature (1)..( 8): Result.003 file - promoters60/2113839
ttgaaatc

SEQ ID NO: 126003 - DNA, 8 bp, Unknown
  misc_feature (1)..( 8): Result.003 file - promoters60/2113839
ttgagatc

SEQ ID NO: 126004 - DNA, 8 bp, Unknown
  misc_feature (1)..( 8): Result.003 file - promoters60/2113839
atgagatg

SEQ ID NO: 126005 - DNA, 9 bp, Unknown
  misc_feature (1)..( 9): Result.003 file - promoters60/2113839
gaaatgatg

SEQ ID NO: 126006 - DNA, 9 bp, Unknown
  misc_feature (1)..( 9): Result.003 file - promoters60/2113839
gaaatgaag

SEQ ID NO: 126007 - DNA, 9 bp, Unknown
  misc_feature (1)..( 9): Result.003 file - promoters60/2113839
ctaatcaag

SEQ ID NO: 126008 - DNA, 8 bp, Unknown
  misc_feature (1)..( 8): Result.003 file - promoters60/2113839
aaacatat

SEQ ID NO: 126009 - DNA, 8 bp, Unknown
  misc_feature (1)..( 8): Result.003 file - promoters60/2113839
aaatatat

SEQ ID NO: 126010 - DNA, 8 bp, Unknown
  misc_feature (1)..( 8): Result.003 file - promoters60/2113839
aaaaatag

SEQ ID NO: 126011 - DNA, 12 bp, Unknown
  misc_feature (1)..( 12): Result.003 file - promoters60/2113839
tcatattacaat

SEQ ID NO: 126012 - DNA, 12 bp, Unknown
  misc_feature (1)..( 12): Result.003 file - promoters60/2113839
ttttattaaaat

SEQ ID NO: 126013 - DNA, 12 bp, Unknown
  misc_feature (1)..( 12): Result.003 file - promoters60/2113839
ttttcttaagtc

SEQ ID NO: 126014 - DNA, 9 bp, Unknown
  misc_feature (1)..( 9): Result.003 file - promoters60/2113839
ctttcacaa

SEQ ID NO: 126015 - DNA, 9 bp, Unknown
  misc_feature (1)..( 9): Result.003 file - promoters60/2113839
ttttgacaa

SEQ ID NO: 126016 - DNA, 9 bp, Unknown
  misc_feature (1)..( 9): Result.003 file - promoters60/2113839
ctttcataa

SEQ ID NO: 126017 - DNA, 9 bp, Unknown
  misc_feature (1)..( 9): Result.003 file - promoters60/2113839
aaataaatt

SEQ ID NO: 126018 - DNA, 9 bp, Unknown
  misc_feature (1)..( 9): Result.003 file - promoters60/2113839
aaaaaaaag

SEQ ID NO: 126019 - DNA, 10 bp, Unknown
  misc_feature (1)..( 10): Result.003 file - promoters60/2113839
aaattaaatt

SEQ ID NO: 126020 - DNA, 7 bp, Unknown
  misc_feature (1)..( 7): Result.003 file - promoters60/2113839
atataaa

SEQ ID NO: 126021 - DNA, 7 bp, Unknown
  misc_feature (1)..( 7): Result.003 file - promoters60/2113839
ctataaa

SEQ ID NO: 126022 - DNA, 7 bp, Unknown
  misc_feature (1)..( 7): Result.003 file - promoters60/2113839
ctataag

SEQ ID NO: 126023 - DNA, 10 bp, Unknown
  misc_feature (1)..( 10): Result.003 file - promoters60/2113842
ttaatctttt

SEQ ID NO: 126024 - DNA, 10 bp, Unknown
  misc_feature (1)..( 10): Result.003 file - promoters60/2113842
ttaatttttt

SEQ ID NO: 126025 - DNA, 8 bp, Unknown
  misc_feature (1)..( 8): Result.003 file - promoters60/2113842
ttttatat

SEQ ID NO: 126026 - DNA, 8 bp, Unknown
  misc_feature (1)..( 8): Result.003 file - promoters60/2113842
ttttttat

SEQ ID NO: 126027 - DNA, 7 bp, Unknown
  misc_feature (1)..( 7): Result.003 file - promoters60/2113842
tttagat

SEQ ID NO: 126028 - DNA, 7 bp, Unknown
  misc_feature (1)..( 7): Result.003 file - promoters60/2113842
ttttgat

SEQ ID NO: 126029 - DNA, 6 bp, Unknown
  misc_feature (1)..( 6): Result.003 file - promoters60/2113842
ttatat

SEQ ID NO: 126030 - DNA, 6 bp, Unknown
  misc_feature (1)..( 6): Result.003 file - promoters60/2113842
ttatat

SEQ ID NO: 126031 - DNA, 10 bp, Unknown
  misc_feature (1)..( 10): Result.003 file - promoters60/2113842
cgtaaaaata

SEQ ID NO: 126032 - DNA, 10 bp, Unknown
  misc_feature (1)..( 10): Result.003 file - promoters60/2113842
cgtaaaaata

SEQ ID NO: 126033 - DNA, 10 bp, Unknown
  misc_feature (1)..( 10): Result.003 file - promoters60/2113842
cctatattaa

SEQ ID NO: 126034 - DNA, 10 bp, Unknown
  misc_feature (1)..( 10): Result.003 file - promoters60/2113842
aaaataataa

SEQ ID NO: 126035 - DNA, 10 bp, Unknown
  misc_feature (1)..( 10): Result.003 file - promoters60/2113842
aaaataatat

SEQ ID NO: 126036 - DNA, 7 bp, Unknown
  misc_feature (1)..( 7): Result.003 file - promoters60/2113842
aacgtta

SEQ ID NO: 126037 - DNA, 7 bp, Unknown
  misc_feature (1)..( 7): Result.003 file - promoters60/2113842
aacttta

SEQ ID NO: 126038 - DNA, 6 bp, Unknown
  misc_feature (1)..( 6): Result.003 file - promoters60/2113842
gtatca

SEQ ID NO: 126039 - DNA, 6 bp, Unknown
  misc_feature (1)..( 6): Result.003 file - promoters60/2113842
gtatca

SEQ ID NO: 126040 - DNA, 8 bp, Unknown
  misc_feature (1)..( 8): Result.003 file - promoters60/2113842
atcactat

SEQ ID NO: 126041 - DNA, 8 bp, Unknown
  misc_feature (1)..( 8): Result.003 file - promoters60/2113842
ctcaatat

SEQ ID NO: 126042 - DNA, 8 bp, Unknown
  misc_feature (1)..( 8): Result.003 file - promoters60/2113842
ctcaatat

SEQ ID NO: 126043 - DNA, 7 bp, Unknown
  misc_feature (1)..( 7): Result.003 file - promoters60/2113842
aaaatca

SEQ ID NO: 126044 - DNA, 7 bp, Unknown
  misc_feature (1)..( 7): Result.003 file - promoters60/2113842
aaaatca

SEQ ID NO: 126045 - DNA, 8 bp, Unknown
  misc_feature (1)..( 8): Result.003 file - promoters60/2113842
atttacat

SEQ ID NO: 126046 - DNA, 8 bp, Unknown
  misc_feature (1)..( 8): Result.003 file - promoters60/2113842
attcacat

SEQ ID NO: 126047 - DNA, 7 bp, Unknown
  misc_feature (1)..( 7): Result.003 file - promoters60/2113842
taaattt

SEQ ID NO: 126048 - DNA, 7 bp, Unknown
  misc_feature (1)..( 7): Result.003 file - promoters60/2113842
taagttt

SEQ ID NO: 126049 - DNA, 6 bp, Unknown
  misc_feature (1)..( 6): Result.003 file - promoters60/2113842
atattt

SEQ ID NO: 126050 - DNA, 6 bp, Unknown
  misc_feature (1)..( 6): Result.003 file - promoters60/2113842
atattt

SEQ ID NO: 126051 - DNA, 7 bp, Unknown
  misc_feature (1)..( 7): Result.003 file - promoters60/2113842
tcataaa

SEQ ID NO: 126052 - DNA, 7 bp, Unknown
  misc_feature (1)..( 7): Result.003 file - promoters60/2113842
tcaaaaa

SEQ ID NO: 126053 - DNA, 6 bp, Unknown
  misc_feature (1)..( 6): Result.003 file - promoters60/2113842
attgct

SEQ ID NO: 126054 - DNA, 6 bp, Unknown
  misc_feature (1)..( 6): Result.003 file - promoters60/2113842
attgct

SEQ ID NO: 126055 - DNA, 6 bp, Unknown
  misc_feature (1)..( 6): Result.003 file - promoters60/2113842
atctaa

SEQ ID NO: 126056 - DNA, 6 bp, Unknown
  misc_feature (1)..( 6): Result.003 file - promoters60/2113842
atctaa

SEQ ID NO: 126057 - DNA, 7 bp, Unknown
  misc_feature (1)..( 7): Result.003 file - promoters60/2113842
aaccacc

SEQ ID NO: 126058 - DNA, 7 bp, Unknown
  misc_feature (1)..( 7): Result.003 file - promoters60/2113842
aaccacc

SEQ ID NO: 126059 - DNA, 7 bp, Unknown
  misc_feature (1)..( 7): Result.003 file - promoters60/2113842
atggtca

SEQ ID NO: 126060 - DNA, 7 bp, Unknown
  misc_feature (1)..( 7): Result.003 file - promoters60/2113842
atggtca

SEQ ID NO: 126061 - DNA, 8 bp, Unknown
  misc_feature (1)..( 8): Result.003 file - promoters60/2113842
agaacaat

SEQ ID NO: 126062 - DNA, 8 bp, Unknown
  misc_feature (1)..( 8): Result.003 file - promoters60/2113842
agaccaat

SEQ ID NO: 126063 - DNA, 7 bp, Unknown
  misc_feature (1)..( 7): Result.003 file - promoters60/2113842
tatatat

SEQ ID NO: 126064 - DNA, 7 bp, Unknown
  misc_feature (1)..( 7): Result.003 file - promoters60/2113842
tatataa

SEQ ID NO: 126065 - DNA, 7 bp, Unknown
  misc_feature (1)..( 7): Result.003 file - promoters60/2113842
tatttaa

SEQ ID NO: 126066 - DNA, 6 bp, Unknown
  misc_feature (1)..( 6): Result.003 file - promoters60/2113842
atttta

SEQ ID NO: 126067 - DNA, 6 bp, Unknown
  misc_feature (1)..( 6): Result.003 file - promoters60/2113842
atttta

SEQ ID NO: 126068 - DNA, 8 bp, Unknown
  misc_feature (1)..( 8): Result.003 file - promoters60/2113842
ttatttga

SEQ ID NO: 126069 - DNA, 8 bp, Unknown
  misc_feature (1)..( 8): Result.003 file - promoters60/2113842
ttatttga

SEQ ID NO: 126070 - DNA, 6 bp, Unknown
  misc_feature (1)..( 6): Result.003 file - promoters60/2113842
ttttca

SEQ ID NO: 126071 - DNA, 6 bp, Unknown
  misc_feature (1)..( 6): Result.003 file - promoters60/2113842
ttttca

SEQ ID NO: 126072 - DNA, 7 bp, Unknown
  misc_feature (1)..( 7): Result.003 file - promoters60/2113842
aaggggt

SEQ ID NO: 126073 - DNA, 7 bp, Unknown
  misc_feature (1)..( 7): Result.003 file - promoters60/2113842
aagtggt

SEQ ID NO: 126074 - DNA, 10 bp, Unknown
  misc_feature (1)..( 10): Result.003 file - promoters60/2113842
aagtaaactt

SEQ ID NO: 126075 - DNA, 10 bp, Unknown
  misc_feature (1)..( 10): Result.003 file - promoters60/2113842
aagttaactt

SEQ ID NO: 126076 - DNA, 6 bp, Unknown
  misc_feature (1)..( 6): Result.003 file - promoters60/2113842
tcacaa

SEQ ID NO: 126077 - DNA, 6 bp, Unknown
  misc_feature (1)..( 6): Result.003 file - promoters60/2113842
tcacaa

SEQ ID NO: 126078 - DNA, 11 bp, Unknown
  misc_feature (1)..( 11): Result.003 file - promoters60/2113846
gttataattta

SEQ ID NO: 126079 - DNA, 11 bp, Unknown
  misc_feature (1)..( 11): Result.003 file - promoters60/2113846
actatcatttt

SEQ ID NO: 126080 - DNA, 11 bp, Unknown
  misc_feature (1)..( 11): Result.003 file - promoters60/2113846
gttagaattac

SEQ ID NO: 126081 - DNA, 11 bp, Unknown
  misc_feature (1)..( 11): Result.003 file - promoters60/2113846
agtatgattaa

SEQ ID NO: 126082 - DNA, 7 bp, Unknown
  misc_feature (1)..( 7): Result.003 file - promoters60/2113846
ccatttt

SEQ ID NO: 126083 - DNA, 9 bp, Unknown
  misc_feature (1)..( 9): Result.003 file - promoters60/2113846
aatttaacg

SEQ ID NO: 126084 - DNA, 9 bp, Unknown
  misc_feature (1)..( 9): Result.003 file - promoters60/2113846
tttttgacg

SEQ ID NO: 126085 - DNA, 9 bp, Unknown
  misc_feature (1)..( 9): Result.003 file - promoters60/2113846
aatttaatg

SEQ ID NO: 126086 - DNA, 9 bp, Unknown
  misc_feature (1)..( 9): Result.003 file - promoters60/2113846
tatttaaaa

SEQ ID NO: 126087 - DNA, 11 bp, Unknown
  misc_feature (1)..( 11): Result.003 file - promoters60/2113846
caaatttattt

SEQ ID NO: 126088 - DNA, 11 bp, Unknown
  misc_feature (1)..( 11): Result.003 file - promoters60/2113846
aaaaattagat

SEQ ID NO: 126089 - DNA, 11 bp, Unknown
  misc_feature (1)..( 11): Result.003 file - promoters60/2113846
tgtatttattt

SEQ ID NO: 126090 - DNA, 11 bp, Unknown
  misc_feature (1)..( 11): Result.003 file - promoters60/2113846
taaaagaatca

SEQ ID NO: 126091 - DNA, 7 bp, Unknown
  misc_feature (1)..( 7): Result.003 file - promoters60/2113846
ttagatc

SEQ ID NO: 126092 - DNA, 7 bp, Unknown
  misc_feature (1)..( 7): Result.003 file - promoters60/2113846
ttatatc

SEQ ID NO: 126093 - DNA, 7 bp, Unknown
  misc_feature (1)..( 7): Result.003 file - promoters60/2113846
ttatatc

SEQ ID NO: 126094 - DNA, 7 bp, Unknown
  misc_feature (1)..( 7): Result.003 file - promoters60/2113846
ttatatt

SEQ ID NO: 126095 - DNA, 10 bp, Unknown
  misc_feature (1)..( 10): Result.003 file - promoters60/2113889
cttgagttta

SEQ ID NO: 126096 - DNA, 10 bp, Unknown
  misc_feature (1)..( 10): Result.003 file - promoters60/2113889
tttgactttt

SEQ ID NO: 126097 - DNA, 10 bp, Unknown
  misc_feature (1)..( 10): Result.003 file - promoters60/2113889
gttgaatttt

SEQ ID NO: 126098 - DNA, 10 bp, Unknown
  misc_feature (1)..( 10): Result.003 file - promoters60/2113889
gttggcttct

SEQ ID NO: 126099 - DNA, 10 bp, Unknown
  misc_feature (1)..( 10): Result.003 file - promoters60/2113889
ttctaatttt

SEQ ID NO: 126100 - DNA, 10 bp, Unknown
  misc_feature (1)..( 10): Result.003 file - promoters60/2113889
gttaactttg

SEQ ID NO: 126101 - DNA, 10 bp, Unknown
  misc_feature (1)..( 10): Result.003 file - promoters60/2113889
gttgactggt

SEQ ID NO: 126102 - DNA, 10 bp, Unknown
  misc_feature (1)..( 10): Result.003 file - promoters60/2113889
gaaaaacaaa

SEQ ID NO: 126103 - DNA, 10 bp, Unknown
  misc_feature (1)..( 10): Result.003 file - promoters60/2113889
acggaacaaa

SEQ ID NO: 126104 - DNA, 10 bp, Unknown
  misc_feature (1)..( 10): Result.003 file - promoters60/2113889
gtcaaacaaa

SEQ ID NO: 126105 - DNA, 10 bp, Unknown
  misc_feature (1)..( 10): Result.003 file - promoters60/2113889
tttaaaaaaa

SEQ ID NO: 126106 - DNA, 10 bp, Unknown
  misc_feature (1)..( 10): Result.003 file - promoters60/2113889
tataagaaaa

SEQ ID NO: 126107 - DNA, 10 bp, Unknown
  misc_feature (1)..( 10): Result.003 file - promoters60/2113889
tatgagaaat

SEQ ID NO: 126108 - DNA, 10 bp, Unknown
  misc_feature (1)..( 10): Result.003 file - promoters60/2113889
aatgaaaaac

SEQ ID NO: 126109 - DNA, 10 bp, Unknown
  misc_feature (1)..( 10): Result.003 file - promoters60/2113889
aatgaaattc

SEQ ID NO: 126110 - DNA, 11 bp, Unknown
  misc_feature (1)..( 11): Result.003 file - promoters60/2113889
tatgagaaatc

SEQ ID NO: 126111 - DNA, 11 bp, Unknown
  misc_feature (1)..( 11): Result.003 file - promoters60/2113889
aatgatattcg

SEQ ID NO: 126112 - DNA, 11 bp, Unknown
  misc_feature (1)..( 11): Result.003 file - promoters60/2113889
aatgttatttt

SEQ ID NO: 126113 - DNA, 11 bp, Unknown
  misc_feature (1)..( 11): Result.003 file - promoters60/2113889
gattttatttt

SEQ ID NO: 126114 - DNA, 12 bp, Unknown
  misc_feature (1)..( 12): Result.003 file - promoters60/2113889
attaaccttgag

SEQ ID NO: 126115 - DNA, 12 bp, Unknown
  misc_feature (1)..( 12): Result.003 file - promoters60/2113889
gttaactttgta

SEQ ID NO: 126116 - DNA, 12 bp, Unknown
  misc_feature (1)..( 12): Result.003 file - promoters60/2113889
gttaatttttga

SEQ ID NO: 126117 - DNA, 12 bp, Unknown
  misc_feature (1)..( 12): Result.003 file - promoters60/2113889
catcacttggta

SEQ ID NO: 126118 - DNA, 12 bp, Unknown
  misc_feature (1)..( 12): Result.003 file - promoters60/2113889
tctaattttcta

SEQ ID NO: 126119 - DNA, 12 bp, Unknown
  misc_feature (1)..( 12): Result.003 file - promoters60/2113889
attaacttatag

SEQ ID NO: 126120 - DNA, 12 bp, Unknown
  misc_feature (1)..( 12): Result.003 file - promoters60/2113889
gttgactggttc

SEQ ID NO: 126121 - DNA, 12 bp, Unknown
  misc_feature (1)..( 12): Result.003 file - promoters60/2113889
gttaatttttga

SEQ ID NO: 126122 - DNA, 12 bp, Unknown
  misc_feature (1)..( 12): Result.003 file - promoters60/2113889
tctaattttcta

SEQ ID NO: 126123 - DNA, 12 bp, Unknown
  misc_feature (1)..( 12): Result.003 file - promoters60/2113889
ttgaattttttt

SEQ ID NO: 126124 - DNA, 12 bp, Unknown
  misc_feature (1)..( 12): Result.003 file - promoters60/2113889
gttaactttgta

SEQ ID NO: 126125 - DNA, 12 bp, Unknown
  misc_feature (1)..( 12): Result.003 file - promoters60/2113889
catcacttggta

SEQ ID NO: 126126 - DNA, 12 bp, Unknown
  misc_feature (1)..( 12): Result.003 file - promoters60/2113889
gttgactggttc

SEQ ID NO: 126127 - DNA, 18 bp, Unknown
  misc_feature (1)..( 18): Result.003 file - promoters60/2113928
aaaaattattaaagtata

SEQ ID NO: 126128 - DNA, 18 bp, Unknown
  misc_feature (1)..( 18): Result.003 file - promoters60/2113928
aaagattattaaattata

SEQ ID NO: 126129 - DNA, 16 bp, Unknown
  misc_feature (1)..( 16): Result.003 file - promoters60/2113928
cattgatcaaagttaa

SEQ ID NO: 126130 - DNA, 7 bp, Unknown
  misc_feature (1)..( 7): Result.003 file - promoters60/2113928
ttactaa

SEQ ID NO: 126131 - DNA, 7 bp, Unknown
  misc_feature (1)..( 7): Result.003 file - promoters60/2113928
ttattaa

SEQ ID NO: 126132 - DNA, 8 bp, Unknown
  misc_feature (1)..( 8): Result.003 file - promoters60/2113928
taatttta

SEQ ID NO: 126133 - DNA, 8 bp, Unknown
  misc_feature (1)..( 8): Result.003 file - promoters60/2113928
taatttta

SEQ ID NO: 126134 - DNA, 8 bp, Unknown
  misc_feature (1)..( 8): Result.003 file - promoters60/2113928
agtcggtc

SEQ ID NO: 126135 - DNA, 8 bp, Unknown
  misc_feature (1)..( 8): Result.003 file - promoters60/2113928
agtctgtc

SEQ ID NO: 126136 - DNA, 6 bp, Unknown
  misc_feature (1)..( 6): Result.003 file - promoters60/2113928
atttta

SEQ ID NO: 126137 - DNA, 6 bp, Unknown
  misc_feature (1)..( 6): Result.003 file - promoters60/2113928
atttta

SEQ ID NO: 126138 - DNA, 9 bp, Unknown
  misc_feature (1)..( 9): Result.003 file - promoters60/2113928
gaattcaaa

SEQ ID NO: 126139 - DNA, 9 bp, Unknown
  misc_feature (1)..( 9): Result.003 file - promoters60/2113928
gaattcctc

SEQ ID NO: 126140 - DNA, 9 bp, Unknown
  misc_feature (1)..( 9): Result.003 file - promoters60/2113928
gaatacaaa

SEQ ID NO: 126141 - DNA, 6 bp, Unknown
  misc_feature (1)..( 6): Result.003 file - promoters60/2113928
atattt

SEQ ID NO: 126142 - DNA, 6 bp, Unknown
  misc_feature (1)..( 6): Result.003 file - promoters60/2113928
atattt

SEQ ID NO: 126143 - DNA, 9 bp, Unknown
  misc_feature (1)..( 9): Result.003 file - promoters60/2113928
tgctaatat

SEQ ID NO: 126144 - DNA, 9 bp, Unknown
  misc_feature (1)..( 9): Result.003 file - promoters60/2113928
aaataatat

SEQ ID NO: 126145 - DNA, 9 bp, Unknown
  misc_feature (1)..( 9): Result.003 file - promoters60/2113928
aaaaaatat

SEQ ID NO: 126146 - DNA, 10 bp, Unknown
  misc_feature (1)..( 10): Result.003 file - promoters60/2113928
ctatatatat

SEQ ID NO: 126147 - DNA, 10 bp, Unknown
  misc_feature (1)..( 10): Result.003 file - promoters60/2113928
ttatttatat

SEQ ID NO: 126148 - DNA, 10 bp, Unknown
  misc_feature (1)..( 10): Result.003 file - promoters60/2113928
ctataaatag

SEQ ID NO: 126149 - DNA, 6 bp, Unknown
  misc_feature (1)..( 6): Result.003 file - promoters60/2113928
aaaaag

SEQ ID NO: 126150 - DNA, 6 bp, Unknown
  misc_feature (1)..( 6): Result.003 file - promoters60/2113928
aaaaag

SEQ ID NO: 126151 - DNA, 6 bp, Unknown
  misc_feature (1)..( 6): Result.003 file - promoters60/2113928
aacaat

SEQ ID NO: 126152 - DNA, 6 bp, Unknown
  misc_feature (1)..( 6): Result.003 file - promoters60/2113928
aacaat

SEQ ID NO: 126153 - DNA, 6 bp, Unknown
  misc_feature (1)..( 6): Result.003 file - promoters60/2113928
atttct

SEQ ID NO: 126154 - DNA, 6 bp, Unknown
  misc_feature (1)..( 6): Result.003 file - promoters60/2113928
atttct

SEQ ID NO: 126155 - DNA, 9 bp, Unknown
  misc_feature (1)..( 9): Result.003 file - promoters60/2113928
ctaacaaat

SEQ ID NO: 126156 - DNA, 9 bp, Unknown
  misc_feature (1)..( 9): Result.003 file - promoters60/2113928
aatacaaat

SEQ ID NO: 126157 - DNA, 9 bp, Unknown
  misc_feature (1)..( 9): Result.003 file - promoters60/2113928
aattcaaaa

SEQ ID NO: 126158 - DNA, 7 bp, Unknown
  misc_feature (1)..( 7): Result.003 file - promoters60/2113928
taacaca

SEQ ID NO: 126159 - DNA, 7 bp, Unknown
  misc_feature (1)..( 7): Result.003 file - promoters60/2113928
taaaaca

SEQ ID NO: 126160 - DNA, 7 bp, Unknown
  misc_feature (1)..( 7): Result.003 file - promoters60/2113928
tatatcc

SEQ ID NO: 126161 - DNA, 7 bp, Unknown
  misc_feature (1)..( 7): Result.003 file - promoters60/2113928
tatttcc

SEQ ID NO: 126162 - DNA, 7 bp, Unknown
  misc_feature (1)..( 7): Result.003 file - promoters60/2113928
aaagtat

SEQ ID NO: 126163 - DNA, 7 bp, Unknown
  misc_feature (1)..( 7): Result.003 file - promoters60/2113928
aaaatat

SEQ ID NO: 126164 - DNA, 6 bp, Unknown
  misc_feature (1)..( 6): Result.003 file - promoters60/2113928
caaaaa

SEQ ID NO: 126165 - DNA, 6 bp, Unknown
  misc_feature (1)..( 6): Result.003 file - promoters60/2113928
caaaaa

SEQ ID NO: 126166 - DNA, 6 bp, Unknown
  misc_feature (1)..( 6): Result.003 file - promoters60/2113928
taatat

SEQ ID NO: 126167 - DNA, 6 bp, Unknown
  misc_feature (1)..( 6): Result.003 file - promoters60/2113928
taatat

SEQ ID NO: 126168 - DNA, 6 bp, Unknown
  misc_feature (1)..( 6): Result.003 file - promoters60/2113928
aaaata

SEQ ID NO: 126169 - DNA, 6 bp, Unknown
  misc_feature (1)..( 6): Result.003 file - promoters60/2113928
aaaata

SEQ ID NO: 126170 - DNA, 7 bp, Unknown
  misc_feature (1)..( 7): Result.003 file - promoters60/2113928
aatcaaa

SEQ ID NO: 126171 - DNA, 7 bp, Unknown
  misc_feature (1)..( 7): Result.003 file - promoters60/2113928
aatgaaa

SEQ ID NO: 126172 - DNA, 10 bp, Unknown
  misc_feature (1)..( 10): Result.003 file - promoters60/2113928
ctaacaaata

SEQ ID NO: 126173 - DNA, 10 bp, Unknown
  misc_feature (1)..( 10): Result.003 file - promoters60/2113928
ctaaaaaata

SEQ ID NO: 126174 - DNA, 9 bp, Unknown
  misc_feature (1)..( 9): Result.003 file - promoters60/2113967
caattattt

SEQ ID NO: 126175 - DNA, 9 bp, Unknown
  misc_feature (1)..( 9): Result.003 file - promoters60/2113967
gcattgttt

SEQ ID NO: 126176 - DNA, 9 bp, Unknown
  misc_feature (1)..( 9): Result.003 file - promoters60/2113967
caaatataa

SEQ ID NO: 126177 - DNA, 9 bp, Unknown
  misc_feature (1)..( 9): Result.003 file - promoters60/2113967
aaaatattt

SEQ ID NO: 126178 - DNA, 11 bp, Unknown
  misc_feature (1)..( 11): Result.003 file - promoters60/2113967
tgttatattaa

SEQ ID NO: 126179 - DNA, 11 bp, Unknown
  misc_feature (1)..( 11): Result.003 file - promoters60/2113967
acttattttat

SEQ ID NO: 126180 - DNA, 11 bp, Unknown
  misc_feature (1)..( 11): Result.003 file - promoters60/2113967
aattattttaa

SEQ ID NO: 126181 - DNA, 11 bp, Unknown
  misc_feature (1)..( 11): Result.003 file - promoters60/2113967
acttgtttcaa

SEQ ID NO: 126182 - DNA, 11 bp, Unknown
  misc_feature (1)..( 11): Result.003 file - promoters60/2113967
ttttgaattca

SEQ ID NO: 126183 - DNA, 11 bp, Unknown
  misc_feature (1)..( 11): Result.003 file - promoters60/2113967
ttatgtattca

SEQ ID NO: 126184 - DNA, 11 bp, Unknown
  misc_feature (1)..( 11): Result.003 file - promoters60/2113967
ttaagtagatt

SEQ ID NO: 126185 - DNA, 11 bp, Unknown
  misc_feature (1)..( 11): Result.003 file - promoters60/2113967
ataattagttt

SEQ ID NO: 126186 - DNA, 11 bp, Unknown
  misc_feature (1)..( 11): Result.003 file - promoters60/2113967
cgaagaagatt

SEQ ID NO: 126187 - DNA, 8 bp, Unknown
  misc_feature (1)..( 8): Result.003 file - promoters60/2113967
gttcaatg

SEQ ID NO: 126188 - DNA, 8 bp, Unknown
  misc_feature (1)..( 8): Result.003 file - promoters60/2113967
tttcaata

SEQ ID NO: 126189 - DNA, 8 bp, Unknown
  misc_feature (1)..( 8): Result.003 file - promoters60/2113967
tttgaatt

SEQ ID NO: 126190 - DNA, 8 bp, Unknown
  misc_feature (1)..( 8): Result.003 file - promoters60/2113967
ttttaatt

SEQ ID NO: 126191 - DNA, 12 bp, Unknown
  misc_feature (1)..( 12): Result.003 file - promoters60/2113967
tcaaaatcattt

SEQ ID NO: 126192 - DNA, 12 bp, Unknown
  misc_feature (1)..( 12): Result.003 file - promoters60/2113967
aaaaaaacattg

SEQ ID NO: 126193 - DNA, 12 bp, Unknown
  misc_feature (1)..( 12): Result.003 file - promoters60/2113967
gattaatcatag

SEQ ID NO: 126194 - DNA, 12 bp, Unknown
  misc_feature (1)..( 12): Result.003 file - promoters60/2113967
aaataaaaattg

SEQ ID NO: 126195 - DNA, 8 bp, Unknown
  misc_feature (1)..( 8): Result.003 file - promoters60/2113975
ttttattc

SEQ ID NO: 126196 - DNA, 8 bp, Unknown
  misc_feature (1)..( 8): Result.003 file - promoters60/2113975
ttttcttc

SEQ ID NO: 126197 - DNA, 7 bp, Unknown
  misc_feature (1)..( 7): Result.003 file - promoters60/2113975
attacaa

SEQ ID NO: 126198 - DNA, 7 bp, Unknown
  misc_feature (1)..( 7): Result.003 file - promoters60/2113975
attccaa

SEQ ID NO: 126199 - DNA, 7 bp, Unknown
  misc_feature (1)..( 7): Result.003 file - promoters60/2113975
aaacttc

SEQ ID NO: 126200 - DNA, 7 bp, Unknown
  misc_feature (1)..( 7): Result.003 file - promoters60/2113975
aaagttc

SEQ ID NO: 126201 - DNA, 6 bp, Unknown
  misc_feature (1)..( 6): Result.003 file - promoters60/2113975
acttta

SEQ ID NO: 126202 - DNA, 6 bp, Unknown
  misc_feature (1)..( 6): Result.003 file - promoters60/2113975
acttta

SEQ ID NO: 126203 - DNA, 8 bp, Unknown
  misc_feature (1)..( 8): Result.003 file - promoters60/2113975
aaaaaatc

SEQ ID NO: 126204 - DNA, 8 bp, Unknown
  misc_feature (1)..( 8): Result.003 file - promoters60/2113975
aaataatc

SEQ ID NO: 126205 - DNA, 6 bp, Unknown
  misc_feature (1)..( 6): Result.003 file - promoters60/2113975
aaaaga

SEQ ID NO: 126206 - DNA, 6 bp, Unknown
  misc_feature (1)..( 6): Result.003 file - promoters60/2113975
aaaaga

SEQ ID NO: 126207 - DNA, 8 bp, Unknown
  misc_feature (1)..( 8): Result.003 file - promoters60/2113975
tatactag

SEQ ID NO: 126208 - DNA, 8 bp, Unknown
  misc_feature (1)..( 8): Result.003 file - promoters60/2113975
tataatag

SEQ ID NO: 126209 - DNA, 7 bp, Unknown
  misc_feature (1)..( 7): Result.003 file - promoters60/2113975
atttgtt

SEQ ID NO: 126210 - DNA, 7 bp, Unknown
  misc_feature (1)..( 7): Result.003 file - promoters60/2113975
attagtt

SEQ ID NO: 126211 - DNA, 8 bp, Unknown
  misc_feature (1)..( 8): Result.003 file - promoters60/2113975
caaactaa

SEQ ID NO: 126212 - DNA, 8 bp, Unknown
  misc_feature (1)..( 8): Result.003 file - promoters60/2113975
caatctaa

SEQ ID NO: 126213 - DNA, 10 bp, Unknown
  misc_feature (1)..( 10): Result.003 file - promoters60/2113975
aattgataac

SEQ ID NO: 126214 - DNA, 10 bp, Unknown
  misc_feature (1)..( 10): Result.003 file - promoters60/2113975
aatggataac

SEQ ID NO: 126215 - DNA, 6 bp, Unknown
  misc_feature (1)..( 6): Result.003 file - promoters60/2113975
taaaga

SEQ ID NO: 126216 - DNA, 6 bp, Unknown
  misc_feature (1)..( 6): Result.003 file - promoters60/2113975
taaaga

SEQ ID NO: 126217 - DNA, 7 bp, Unknown
  misc_feature (1)..( 7): Result.003 file - promoters60/2113975
aaaaagt

SEQ ID NO: 126218 - DNA, 7 bp, Unknown
  misc_feature (1)..( 7): Result.003 file - promoters60/2113975
aaaaagt

SEQ ID NO: 126219 - DNA, 8 bp, Unknown
  misc_feature (1)..( 8): Result.003 file - promoters60/2113975
aagacaaa

SEQ ID NO: 126220 - DNA, 8 bp, Unknown
  misc_feature (1)..( 8): Result.003 file - promoters60/2113975
aagaaaaa

SEQ ID NO: 126221 - DNA, 8 bp, Unknown
  misc_feature (1)..( 8): Result.003 file - promoters60/2113975
caaaaaaa

SEQ ID NO: 126222 - DNA, 8 bp, Unknown
  misc_feature (1)..( 8): Result.003 file - promoters60/2113975
caataaaa

SEQ ID NO: 126223 - DNA, 8 bp, Unknown
  misc_feature (1)..( 8): Result.003 file - promoters60/2113975
gaataaaa

SEQ ID NO: 126224 - DNA, 6 bp, Unknown
  misc_feature (1)..( 6): Result.003 file - promoters60/2113975
agtttc

SEQ ID NO: 126225 - DNA, 6 bp, Unknown
  misc_feature (1)..( 6): Result.003 file - promoters60/2113975
agtttc

SEQ ID NO: 126226 - DNA, 9 bp, Unknown
  misc_feature (1)..( 9): Result.003 file - promoters60/2113975
tttgaccag

SEQ ID NO: 126227 - DNA, 9 bp, Unknown
  misc_feature (1)..( 9): Result.003 file - promoters60/2113975
ttttaccag

SEQ ID NO: 126228 - DNA, 6 bp, Unknown
  misc_feature (1)..( 6): Result.003 file - promoters60/2113975
ttcacc

SEQ ID NO: 126229 - DNA, 6 bp, Unknown
  misc_feature (1)..( 6): Result.003 file - promoters60/2113975
ttcacc

SEQ ID NO: 126230 - DNA, 8 bp, Unknown
  misc_feature (1)..( 8): Result.003 file - promoters60/2113975
aaacaaaa

SEQ ID NO: 126231 - DNA, 8 bp, Unknown
  misc_feature (1)..( 8): Result.003 file - promoters60/2113975
aaagaaaa

SEQ ID NO: 126232 - DNA, 7 bp, Unknown
  misc_feature (1)..( 7): Result.003 file - promoters60/2113975
caattat

SEQ ID NO: 126233 - DNA, 7 bp, Unknown
  misc_feature (1)..( 7): Result.003 file - promoters60/2113975
caagtat

SEQ ID NO: 126234 - DNA, 6 bp, Unknown
  misc_feature (1)..( 6): Result.003 file - promoters60/2113975
ttattt

SEQ ID NO: 126235 - DNA, 6 bp, Unknown
  misc_feature (1)..( 6): Result.003 file - promoters60/2113975
ttattt

SEQ ID NO: 126236 - DNA, 6 bp, Unknown
  misc_feature (1)..( 6): Result.003 file - promoters60/2113975
aaaata

SEQ ID NO: 126237 - DNA, 6 bp, Unknown
  misc_feature (1)..( 6): Result.003 file - promoters60/2113975
aaaata

SEQ ID NO: 126238 - DNA, 7 bp, Unknown
  misc_feature (1)..( 7): Result.003 file - promoters60/2113975
atataat

SEQ ID NO: 126239 - DNA, 7 bp, Unknown
  misc_feature (1)..( 7): Result.003 file - promoters60/2113975
ataaaat

SEQ ID NO: 126240 - DNA, 8 bp, Unknown
  misc_feature (1)..( 8): Result.003 file - promoters60/2114005
ttttctta

SEQ ID NO: 126241 - DNA, 8 bp, Unknown
  misc_feature (1)..( 8): Result.003 file - promoters60/2114005
ttttgtta

SEQ ID NO: 126242 - DNA, 8 bp, Unknown
  misc_feature (1)..( 8): Result.003 file - promoters60/2114005
tttccttt

SEQ ID NO: 126243 - DNA, 8 bp, Unknown
  misc_feature (1)..( 8): Result.003 file - promoters60/2114005
aaaatcaa

SEQ ID NO: 126244 - DNA, 8 bp, Unknown
  misc_feature (1)..( 8): Result.003 file - promoters60/2114005
aaaaacaa

SEQ ID NO: 126245 - DNA, 7 bp, Unknown
  misc_feature (1)..( 7): Result.003 file - promoters60/2114005
attcaaa

SEQ ID NO: 126246 - DNA, 7 bp, Unknown
  misc_feature (1)..( 7): Result.003 file - promoters60/2114005
atttaaa

SEQ ID NO: 126247 - DNA, 7 bp, Unknown
  misc_feature (1)..( 7): Result.003 file - promoters60/2114005
aaaagat

SEQ ID NO: 126248 - DNA, 7 bp, Unknown
  misc_feature (1)..( 7): Result.003 file - promoters60/2114005
taaagat

SEQ ID NO: 126249 - DNA, 7 bp, Unknown
  misc_feature (1)..( 7): Result.003 file - promoters60/2114005
aaaagac

SEQ ID NO: 126250 - DNA, 7 bp, Unknown
  misc_feature (1)..( 7): Result.003 file - promoters60/2114005
ttaatca

SEQ ID NO: 126251 - DNA, 7 bp, Unknown
  misc_feature (1)..( 7): Result.003 file - promoters60/2114005
ttaatca

SEQ ID NO: 126252 - DNA, 7 bp, Unknown
  misc_feature (1)..( 7): Result.003 file - promoters60/2114005
ccaaagc

SEQ ID NO: 126253 - DNA, 7 bp, Unknown
  misc_feature (1)..( 7): Result.003 file - promoters60/2114005
ccacagc

SEQ ID NO: 126254 - DNA, 6 bp, Unknown
  misc_feature (1)..( 6): Result.003 file - promoters60/2114005
aaaaca

SEQ ID NO: 126255 - DNA, 6 bp, Unknown
  misc_feature (1)..( 6): Result.003 file - promoters60/2114005
aaaaca

SEQ ID NO: 126256 - DNA, 7 bp, Unknown
  misc_feature (1)..( 7): Result.003 file - promoters60/2114005
agtagga

SEQ ID NO: 126257 - DNA, 7 bp, Unknown
  misc_feature (1)..( 7): Result.003 file - promoters60/2114005
agtagga

SEQ ID NO: 126258 - DNA, 6 bp, Unknown
  misc_feature (1)..( 6): Result.003 file - promoters60/2114005
ttttta

SEQ ID NO: 126259 - DNA, 6 bp, Unknown
  misc_feature (1)..( 6): Result.003 file - promoters60/2114005
ttttta

SEQ ID NO: 126260 - DNA, 12 bp, Unknown
  misc_feature (1)..( 12): Result.003 file - promoters60/2114005
cggtatataatt

SEQ ID NO: 126261 - DNA, 12 bp, Unknown
  misc_feature (1)..( 12): Result.003 file - promoters60/2114005
caaaaaataatt

SEQ ID NO: 126262 - DNA, 12 bp, Unknown
  misc_feature (1)..( 12): Result.003 file - promoters60/2114005
caaaaaataatc

SEQ ID NO: 126263 - DNA, 7 bp, Unknown
  misc_feature (1)..( 7): Result.003 file - promoters60/2114005
aaaagac

SEQ ID NO: 126264 - DNA, 7 bp, Unknown
  misc_feature (1)..( 7): Result.003 file - promoters60/2114005
aaaagac

SEQ ID NO: 126265 - DNA, 6 bp, Unknown
  misc_feature (1)..( 6): Result.003 file - promoters60/2114005
aaactg

SEQ ID NO: 126266 - DNA, 6 bp, Unknown
  misc_feature (1)..( 6): Result.003 file - promoters60/2114005
aaactg

SEQ ID NO: 126267 - DNA, 15 bp, Unknown
  misc_feature (1)..( 15): Result.003 file - promoters60/2114005
aattccttatttata

SEQ ID NO: 126268 - DNA, 15 bp, Unknown
  misc_feature (1)..( 15): Result.003 file - promoters60/2114005
aatacctcatttata

SEQ ID NO: 126269 - DNA, 7 bp, Unknown
  misc_feature (1)..( 7): Result.003 file - promoters60/2114005
ttataaa

SEQ ID NO: 126270 - DNA, 7 bp, Unknown
  misc_feature (1)..( 7): Result.003 file - promoters60/2114005
ttaaaaa

SEQ ID NO: 126271 - DNA, 7 bp, Unknown
  misc_feature (1)..( 7): Result.003 file - promoters60/2114005
aaagttt

SEQ ID NO: 126272 - DNA, 7 bp, Unknown
  misc_feature (1)..( 7): Result.003 file - promoters60/2114005
aaaattt

SEQ ID NO: 126273 - DNA, 8 bp, Unknown
  misc_feature (1)..( 8): Result.003 file - promoters60/2114005
ttatgtat

SEQ ID NO: 126274 - DNA, 8 bp, Unknown
  misc_feature (1)..( 8): Result.003 file - promoters60/2114005
ttatatat

SEQ ID NO: 126275 - DNA, 11 bp, Unknown
  misc_feature (1)..( 11): Result.003 file - promoters60/2114005
ttaattgataa

SEQ ID NO: 126276 - DNA, 11 bp, Unknown
  misc_feature (1)..( 11): Result.003 file - promoters60/2114005
ttaagtgataa

SEQ ID NO: 126277 - DNA, 8 bp, Unknown
  misc_feature (1)..( 8): Result.003 file - promoters60/2114005
agagatta

SEQ ID NO: 126278 - DNA, 8 bp, Unknown
  misc_feature (1)..( 8): Result.003 file - promoters60/2114005
agatatta

SEQ ID NO: 126279 - DNA, 9 bp, Unknown
  misc_feature (1)..( 9): Result.003 file - promoters60/2114005
aaaaaaaca

SEQ ID NO: 126280 - DNA, 9 bp, Unknown
  misc_feature (1)..( 9): Result.003 file - promoters60/2114005
aaaaataca

SEQ ID NO: 126281 - DNA, 9 bp, Unknown
  misc_feature (1)..( 9): Result.003 file - promoters60/2114005
taacaaaaa

SEQ ID NO: 126282 - DNA, 9 bp, Unknown
  misc_feature (1)..( 9): Result.003 file - promoters60/2114005
taaaaaaaa

SEQ ID NO: 126283 - DNA, 7 bp, Unknown
  misc_feature (1)..( 7): Result.003 file - promoters60/2114012
aaaatta

SEQ ID NO: 126284 - DNA, 7 bp, Unknown
  misc_feature (1)..( 7): Result.003 file - promoters60/2114012
aaaattg

SEQ ID NO: 126285 - DNA, 7 bp, Unknown
  misc_feature (1)..( 7): Result.003 file - promoters60/2114012
taaatta

SEQ ID NO: 126286 - DNA, 8 bp, Unknown
  misc_feature (1)..( 8): Result.003 file - promoters60/2114012
aaaagtca

SEQ ID NO: 126287 - DNA, 8 bp, Unknown
  misc_feature (1)..( 8): Result.003 file - promoters60/2114012
aaaagttt

SEQ ID NO: 126288 - DNA, 8 bp, Unknown
  misc_feature (1)..( 8): Result.003 file - promoters60/2114012
taaagttt

SEQ ID NO: 126289 - DNA, 10 bp, Unknown
  misc_feature (1)..( 10): Result.003 file - promoters60/2114012
acaaatacga

SEQ ID NO: 126290 - DNA, 10 bp, Unknown
  misc_feature (1)..( 10): Result.003 file - promoters60/2114012
acaaagacga

SEQ ID NO: 126291 - DNA, 10 bp, Unknown
  misc_feature (1)..( 10): Result.003 file - promoters60/2114012
gagaagacag

SEQ ID NO: 126292 - DNA, 8 bp, Unknown
  misc_feature (1)..( 8): Result.003 file - promoters60/2114012
tttgttat

SEQ ID NO: 126293 - DNA, 8 bp, Unknown
  misc_feature (1)..( 8): Result.003 file - promoters60/2114012
tttattaa

SEQ ID NO: 126294 - DNA, 8 bp, Unknown
  misc_feature (1)..( 8): Result.003 file - promoters60/2114012
actattaa

SEQ ID NO: 126295 - DNA, 9 bp, Unknown
  misc_feature (1)..( 9): Result.003 file - promoters60/2114026
tatatatac

SEQ ID NO: 126296 - DNA, 9 bp, Unknown
  misc_feature (1)..( 9): Result.003 file - promoters60/2114026
tatatatac

SEQ ID NO: 126297 - DNA, 9 bp, Unknown
  misc_feature (1)..( 9): Result.003 file - promoters60/2114026
tatataata

SEQ ID NO: 126298 - DNA, 9 bp, Unknown
  misc_feature (1)..( 9): Result.003 file - promoters60/2114026
tatataatg

SEQ ID NO: 126299 - DNA, 9 bp, Unknown
  misc_feature (1)..( 9): Result.003 file - promoters60/2114026
aatataaaa

SEQ ID NO: 126300 - DNA, 9 bp, Unknown
  misc_feature (1)..( 9): Result.003 file - promoters60/2114026
accctcatt

SEQ ID NO: 126301 - DNA, 9 bp, Unknown
  misc_feature (1)..( 9): Result.003 file - promoters60/2114026
accgtcata

SEQ ID NO: 126302 - DNA, 9 bp, Unknown
  misc_feature (1)..( 9): Result.003 file - promoters60/2114026
ctcctcatc

SEQ ID NO: 126303 - DNA, 9 bp, Unknown
  misc_feature (1)..( 9): Result.003 file - promoters60/2114026
catgtcata

SEQ ID NO: 126304 - DNA, 13 bp, Unknown
  misc_feature (1)..( 13): Result.003 file - promoters60/2114026
atagtttcttttt

SEQ ID NO: 126305 - DNA, 13 bp, Unknown
  misc_feature (1)..( 13): Result.003 file - promoters60/2114026
ataatttcttact

SEQ ID NO: 126306 - DNA, 13 bp, Unknown
  misc_feature (1)..( 13): Result.003 file - promoters60/2114026
ttggtttctcatt

SEQ ID NO: 126307 - DNA, 13 bp, Unknown
  misc_feature (1)..( 13): Result.003 file - promoters60/2114026
tgtttttttcatt

SEQ ID NO: 126308 - DNA, 12 bp, Unknown
  misc_feature (1)..( 12): Result.003 file - promoters60/2114026
caagttttgatc

SEQ ID NO: 126309 - DNA, 12 bp, Unknown
  misc_feature (1)..( 12): Result.003 file - promoters60/2114026
gaagttttcgaa

SEQ ID NO: 126310 - DNA, 12 bp, Unknown
  misc_feature (1)..( 12): Result.003 file - promoters60/2114026
tgagtattgatc

SEQ ID NO: 126311 - DNA, 12 bp, Unknown
  misc_feature (1)..( 12): Result.003 file - promoters60/2114026
tcggaattgatt

SEQ ID NO: 126312 - DNA, 12 bp, Unknown
  misc_feature (1)..( 12): Result.003 file - promoters60/2114026
gaatttttttaa

SEQ ID NO: 126313 - DNA, 12 bp, Unknown
  misc_feature (1)..( 12): Result.003 file - promoters60/2114026
ctattctttatt

SEQ ID NO: 126314 - DNA, 8 bp, Unknown
  misc_feature (1)..( 8): Result.003 file - promoters60/2114026
caatcaaa

SEQ ID NO: 126315 - DNA, 8 bp, Unknown
  misc_feature (1)..( 8): Result.003 file - promoters60/2114026
taatcaaa

SEQ ID NO: 126316 - DNA, 8 bp, Unknown
  misc_feature (1)..( 8): Result.003 file - promoters60/2114026
caattaaa

SEQ ID NO: 126317 - DNA, 8 bp, Unknown
  misc_feature (1)..( 8): Result.003 file - promoters60/2114026
aaatcaat

SEQ ID NO: 126318 - DNA, 9 bp, Unknown
  misc_feature (1)..( 9): Result.003 file - promoters60/2114026
catttttag

SEQ ID NO: 126319 - DNA, 9 bp, Unknown
  misc_feature (1)..( 9): Result.003 file - promoters60/2114026
aatttttag

SEQ ID NO: 126320 - DNA, 9 bp, Unknown
  misc_feature (1)..( 9): Result.003 file - promoters60/2114026
cattttttt

SEQ ID NO: 126321 - DNA, 9 bp, Unknown
  misc_feature (1)..( 9): Result.003 file - promoters60/2114026
ttttttttc

SEQ ID NO: 126322 - DNA, 9 bp, Unknown
  misc_feature (1)..( 9): Result.003 file - promoters60/2114026
gattgtaag

SEQ ID NO: 126323 - DNA, 9 bp, Unknown
  misc_feature (1)..( 9): Result.003 file - promoters60/2114026
aattttaaa

SEQ ID NO: 126324 - DNA, 9 bp, Unknown
  misc_feature (1)..( 9): Result.003 file - promoters60/2114026
aatttttag

SEQ ID NO: 126325 - DNA, 9 bp, Unknown
  misc_feature (1)..( 9): Result.003 file - promoters60/2114026
tcgtttaaa

SEQ ID NO: 126326 - DNA, 7 bp, Unknown
  misc_feature (1)..( 7): Result.003 file - promoters60/2114026
gttatat

SEQ ID NO: 126327 - DNA, 7 bp, Unknown
  misc_feature (1)..( 7): Result.003 file - promoters60/2114026
tttatat

SEQ ID NO: 126328 - DNA, 8 bp, Unknown
  misc_feature (1)..( 8): Result.003 file - promoters60/2114026
tttaataa

SEQ ID NO: 126329 - DNA, 8 bp, Unknown
  misc_feature (1)..( 8): Result.003 file - promoters60/2114026
tttaatta

SEQ ID NO: 126330 - DNA, 21 bp, Unknown
  misc_feature (1)..( 21): Result.003 file - promoters60/2114030
atgcattcaaagaatgttgga

SEQ ID NO: 126331 - DNA, 21 bp, Unknown
  misc_feature (1)..( 21): Result.003 file - promoters60/2114030
aaatgctagaagaatgttgga

SEQ ID NO: 126332 - DNA, 21 bp, Unknown
  misc_feature (1)..( 21): Result.003 file - promoters60/2114030
ttcattataaaaaatttacaa

SEQ ID NO: 126333 - DNA, 21 bp, Unknown
  misc_feature (1)..( 21): Result.003 file - promoters60/2114030
gaaaatacaaatgatttgatt

SEQ ID NO: 126334 - DNA, 21 bp, Unknown
  misc_feature (1)..( 21): Result.003 file - promoters60/2114030
tgttcgtcaaaaaactttatt

SEQ ID NO: 126335 - DNA, 21 bp, Unknown
  misc_feature (1)..( 21): Result.003 file - promoters60/2114030
gaacatacaatgtaatgaata

SEQ ID NO: 126336 - DNA, 14 bp, Unknown
  misc_feature (1)..( 14): Result.003 file - promoters60/2114030
tccgaatagaattg

SEQ ID NO: 126337 - DNA, 14 bp, Unknown
  misc_feature (1)..( 14): Result.003 file - promoters60/2114030
aaacaataaaatta

SEQ ID NO: 126338 - DNA, 14 bp, Unknown
  misc_feature (1)..( 14): Result.003 file - promoters60/2114030
aaaaaatcaaaatc

SEQ ID NO: 126339 - DNA, 14 bp, Unknown
  misc_feature (1)..( 14): Result.003 file - promoters60/2114030
tttgatttaaatta

SEQ ID NO: 126340 - DNA, 14 bp, Unknown
  misc_feature (1)..( 14): Result.003 file - promoters60/2114030
tgttcgtcaaaaaa

SEQ ID NO: 126341 - DNA, 14 bp, Unknown
  misc_feature (1)..( 14): Result.003 file - promoters60/2114030
acttttgaaaaaac

SEQ ID NO: 126342 - DNA, 8 bp, Unknown
  misc_feature (1)..( 8): Result.003 file - promoters60/2114030
tataaata

SEQ ID NO: 126343 - DNA, 8 bp, Unknown
  misc_feature (1)..( 8): Result.003 file - promoters60/2114030
tatatata

SEQ ID NO: 126344 - DNA, 8 bp, Unknown
  misc_feature (1)..( 8): Result.003 file - promoters60/2114030
tatatata

SEQ ID NO: 126345 - DNA, 8 bp, Unknown
  misc_feature (1)..( 8): Result.003 file - promoters60/2114030
tataaata

SEQ ID NO: 126346 - DNA, 8 bp, Unknown
  misc_feature (1)..( 8): Result.003 file - promoters60/2114030
tatatata

SEQ ID NO: 126347 - DNA, 8 bp, Unknown
  misc_feature (1)..( 8): Result.003 file - promoters60/2114030
tataaact

SEQ ID NO: 126348 - DNA, 8 bp, Unknown
  misc_feature (1)..( 8): Result.003 file - promoters60/2114095
aaaatctt

SEQ ID NO: 126349 - DNA, 8 bp, Unknown
  misc_feature (1)..( 8): Result.003 file - promoters60/2114095
aaaatctt

SEQ ID NO: 126350 - DNA, 8 bp, Unknown
  misc_feature (1)..( 8): Result.003 file - promoters60/2114095
tcaatctt

SEQ ID NO: 126351 - DNA, 8 bp, Unknown
  misc_feature (1)..( 8): Result.003 file - promoters60/2114095
aaactctc

SEQ ID NO: 126352 - DNA, 8 bp, Unknown
  misc_feature (1)..( 8): Result.003 file - promoters60/2114095
caaatctt

SEQ ID NO: 126353 - DNA, 11 bp, Unknown
  misc_feature (1)..( 11): Result.003 file - promoters60/2114115
agagttttgtt

SEQ ID NO: 126354 - DNA, 11 bp, Unknown
  misc_feature (1)..( 11): Result.003 file - promoters60/2114115
taaattttgtt

SEQ ID NO: 126355 - DNA, 11 bp, Unknown
  misc_feature (1)..( 11): Result.003 file - promoters60/2114115
ttgcttttcga

SEQ ID NO: 126356 - DNA, 7 bp, Unknown
  misc_feature (1)..( 7): Result.003 file - promoters60/2114115
tattttt

SEQ ID NO: 126357 - DNA, 7 bp, Unknown
  misc_feature (1)..( 7): Result.003 file - promoters60/2114115
tattttt

SEQ ID NO: 126358 - DNA, 7 bp, Unknown
  misc_feature (1)..( 7): Result.003 file - promoters60/2114115
tattttt

SEQ ID NO: 126359 - DNA, 12 bp, Unknown
  misc_feature (1)..( 12): Result.003 file - promoters60/2114115
tcaaaagatatt

SEQ ID NO: 126360 - DNA, 12 bp, Unknown
  misc_feature (1)..( 12): Result.003 file - promoters60/2114115
agaaaatataat

SEQ ID NO: 126361 - DNA, 12 bp, Unknown
  misc_feature (1)..( 12): Result.003 file - promoters60/2114115
caaaaaaattat

SEQ ID NO: 126362 - DNA, 11 bp, Unknown
  misc_feature (1)..( 11): Result.003 file - promoters60/2114115
cgagcaatgct

SEQ ID NO: 126363 - DNA, 11 bp, Unknown
  misc_feature (1)..( 11): Result.003 file - promoters60/2114115
cgaacaaaagg

SEQ ID NO: 126364 - DNA, 11 bp, Unknown
  misc_feature (1)..( 11): Result.003 file - promoters60/2114115
ggaacaaaagg

SEQ ID NO: 126365 - DNA, 13 bp, Unknown
  misc_feature (1)..( 13): Result.003 file - promoters60/2114138
taatggatctaca

SEQ ID NO: 126366 - DNA, 13 bp, Unknown
  misc_feature (1)..( 13): Result.003 file - promoters60/2114138
taatagatttacg

SEQ ID NO: 126367 - DNA, 13 bp, Unknown
  misc_feature (1)..( 13): Result.003 file - promoters60/2114138
atcttgatgtaca

SEQ ID NO: 126368 - DNA, 13 bp, Unknown
  misc_feature (1)..( 13): Result.003 file - promoters60/2114138
aagtagattctag

SEQ ID NO: 126369 - DNA, 13 bp, Unknown
  misc_feature (1)..( 13): Result.003 file - promoters60/2114138
aaggagataagta

SEQ ID NO: 126370 - DNA, 8 bp, Unknown
  misc_feature (1)..( 8): Result.003 file - promoters60/2114138
ttttggga

SEQ ID NO: 126371 - DNA, 8 bp, Unknown
  misc_feature (1)..( 8): Result.003 file - promoters60/2114138
ttttggtt

SEQ ID NO: 126372 - DNA, 8 bp, Unknown
  misc_feature (1)..( 8): Result.003 file - promoters60/2114138
atttggtt

SEQ ID NO: 126373 - DNA, 8 bp, Unknown
  misc_feature (1)..( 8): Result.003 file - promoters60/2114138
ttttgggg

SEQ ID NO: 126374 - DNA, 16 bp, Unknown
  misc_feature (1)..( 16): Result.003 file - promoters60/2114145
ctttcgaccaataact

SEQ ID NO: 126375 - DNA, 16 bp, Unknown
  misc_feature (1)..( 16): Result.003 file - promoters60/2114145
agctaccggaattact

SEQ ID NO: 126376 - DNA, 16 bp, Unknown
  misc_feature (1)..( 16): Result.003 file - promoters60/2114145
ctttcgaccaataact

SEQ ID NO: 126377 - DNA, 7 bp, Unknown
  misc_feature (1)..( 7): Result.003 file - promoters60/2114145
tacggga

SEQ ID NO: 126378 - DNA, 7 bp, Unknown
  misc_feature (1)..( 7): Result.003 file - promoters60/2114145
taccgga

SEQ ID NO: 126379 - DNA, 6 bp, Unknown
  misc_feature (1)..( 6): Result.003 file - promoters60/2114145
atacaa

SEQ ID NO: 126380 - DNA, 6 bp, Unknown
  misc_feature (1)..( 6): Result.003 file - promoters60/2114145
atacaa

SEQ ID NO: 126381 - DNA, 6 bp, Unknown
  misc_feature (1)..( 6): Result.003 file - promoters60/2114145
atacaa

SEQ ID NO: 126382 - DNA, 7 bp, Unknown
  misc_feature (1)..( 7): Result.003 file - promoters60/2114145
aaatgat

SEQ ID NO: 126383 - DNA, 7 bp, Unknown
  misc_feature (1)..( 7): Result.003 file - promoters60/2114145
aaatgat

SEQ ID NO: 126384 - DNA, 7 bp, Unknown
  misc_feature (1)..( 7): Result.003 file - promoters60/2114145
aaatgat

SEQ ID NO: 126385 - DNA, 9 bp, Unknown
  misc_feature (1)..( 9): Result.003 file - promoters60/2114145
tctattcta

SEQ ID NO: 126386 - DNA, 9 bp, Unknown
  misc_feature (1)..( 9): Result.003 file - promoters60/2114145
atgattcta

SEQ ID NO: 126387 - DNA, 9 bp, Unknown
  misc_feature (1)..( 9): Result.003 file - promoters60/2114145
atgattctt

SEQ ID NO: 126388 - DNA, 7 bp, Unknown
  misc_feature (1)..( 7): Result.003 file - promoters60/2114145
atactat

SEQ ID NO: 126389 - DNA, 7 bp, Unknown
  misc_feature (1)..( 7): Result.003 file - promoters60/2114145
ataatat

SEQ ID NO: 126390 - DNA, 6 bp, Unknown
  misc_feature (1)..( 6): Result.003 file - promoters60/2114145
aaggca

SEQ ID NO: 126391 - DNA, 6 bp, Unknown
  misc_feature (1)..( 6): Result.003 file - promoters60/2114145
aaggca

SEQ ID NO: 126392 - DNA, 6 bp, Unknown
  misc_feature (1)..( 6): Result.003 file - promoters60/2114145
aaggca

SEQ ID NO: 126393 - DNA, 6 bp, Unknown
  misc_feature (1)..( 6): Result.003 file - promoters60/2114145
attata

SEQ ID NO: 126394 - DNA, 6 bp, Unknown
  misc_feature (1)..( 6): Result.003 file - promoters60/2114145
attata

SEQ ID NO: 126395 - DNA, 7 bp, Unknown
  misc_feature (1)..( 7): Result.003 file - promoters60/2114145
aaacttt

SEQ ID NO: 126396 - DNA, 7 bp, Unknown
  misc_feature (1)..( 7): Result.003 file - promoters60/2114145
aaaattt

SEQ ID NO: 126397 - DNA, 7 bp, Unknown
  misc_feature (1)..( 7): Result.003 file - promoters60/2114145
aaacttt

SEQ ID NO: 126398 - DNA, 7 bp, Unknown
  misc_feature (1)..( 7): Result.003 file - promoters60/2114145
tttatcc

SEQ ID NO: 126399 - DNA, 7 bp, Unknown
  misc_feature (1)..( 7): Result.003 file - promoters60/2114145
tttatcc

SEQ ID NO: 126400 - DNA, 7 bp, Unknown
  misc_feature (1)..( 7): Result.003 file - promoters60/2114145
tttatcc

SEQ ID NO: 126401 - DNA, 6 bp, Unknown
  misc_feature (1)..( 6): Result.003 file - promoters60/2114145
tttatt

SEQ ID NO: 126402 - DNA, 6 bp, Unknown
  misc_feature (1)..( 6): Result.003 file - promoters60/2114145
tttatt

SEQ ID NO: 126403 - DNA, 11 bp, Unknown
  misc_feature (1)..( 11): Result.003 file - promoters60/2114145
aaataaacaaa

SEQ ID NO: 126404 - DNA, 11 bp, Unknown
  misc_feature (1)..( 11): Result.003 file - promoters60/2114145
aaagaaataaa

SEQ ID NO: 126405 - DNA, 8 bp, Unknown
  misc_feature (1)..( 8): Result.003 file - promoters60/2114145
aaaaaaaa

SEQ ID NO: 126406 - DNA, 8 bp, Unknown
  misc_feature (1)..( 8): Result.003 file - promoters60/2114145
aaaaaaaa

SEQ ID NO: 126407 - DNA, 8 bp, Unknown
  misc_feature (1)..( 8): Result.003 file - promoters60/2114145
aaacaaaa

SEQ ID NO: 126408 - DNA, 6 bp, Unknown
  misc_feature (1)..( 6): Result.003 file - promoters60/2114145
tctctc

SEQ ID NO: 126409 - DNA, 6 bp, Unknown
  misc_feature (1)..( 6): Result.003 file - promoters60/2114145
tctctc

SEQ ID NO: 126410 - DNA, 6 bp, Unknown
  misc_feature (1)..( 6): Result.003 file - promoters60/2114145
taactt

SEQ ID NO: 126411 - DNA, 6 bp, Unknown
  misc_feature (1)..( 6): Result.003 file - promoters60/2114145
taactt

SEQ ID NO: 126412 - DNA, 6 bp, Unknown
  misc_feature (1)..( 6): Result.003 file - promoters60/2114145
tcctcc

SEQ ID NO: 126413 - DNA, 6 bp, Unknown
  misc_feature (1)..( 6): Result.003 file - promoters60/2114145
tcctcc

SEQ ID NO: 126414 - DNA, 6 bp, Unknown
  misc_feature (1)..( 6): Result.003 file - promoters60/2114145
atttta

SEQ ID NO: 126415 - DNA, 6 bp, Unknown
  misc_feature (1)..( 6): Result.003 file - promoters60/2114145
atttta

SEQ ID NO: 126416 - DNA, 21 bp, Unknown
  misc_feature (1)..( 21): Result.003 file - promoters60/2114175
acacccatcttttctcgctca

SEQ ID NO: 126417 - DNA, 21 bp, Unknown
  misc_feature (1)..( 21): Result.003 file - promoters60/2114175
acacccatctcttctcgctca

SEQ ID NO: 126418 - DNA, 25 bp, Unknown
  misc_feature (1)..( 25): Result.003 file - promoters60/2114175
ggaagctgttgccaattactcgttt

SEQ ID NO: 126419 - DNA, 25 bp, Unknown
  misc_feature (1)..( 25): Result.003 file - promoters60/2114175
ggaacctgttgtcaattactcgttt

SEQ ID NO: 126420 - DNA, 13 bp, Unknown
  misc_feature (1)..( 13): Result.003 file - promoters60/2114175
cattattgttttt

SEQ ID NO: 126421 - DNA, 13 bp, Unknown
  misc_feature (1)..( 13): Result.003 file - promoters60/2114175
ttttattggtttt

SEQ ID NO: 126422 - DNA, 13 bp, Unknown
  misc_feature (1)..( 13): Result.003 file - promoters60/2114175
gtttatgttggtc

SEQ ID NO: 126423 - DNA, 19 bp, Unknown
  misc_feature (1)..( 19): Result.003 file - promoters60/2114175
caactactctatcaattat

SEQ ID NO: 126424 - DNA, 19 bp, Unknown
  misc_feature (1)..( 19): Result.003 file - promoters60/2114175
caattactctatcaattat

SEQ ID NO: 126425 - DNA, 7 bp, Unknown
  misc_feature (1)..( 7): Result.003 file - promoters60/2114175
aaagaaa

SEQ ID NO: 126426 - DNA, 7 bp, Unknown
  misc_feature (1)..( 7): Result.003 file - promoters60/2114175
aaaaaaa

SEQ ID NO: 126427 - DNA, 9 bp, Unknown
  misc_feature (1)..( 9): Result.003 file - promoters60/2114175
aaataaaaa

SEQ ID NO: 126428 - DNA, 9 bp, Unknown
  misc_feature (1)..( 9): Result.003 file - promoters60/2114175
aaaaaaaaa

SEQ ID NO: 126429 - DNA, 9 bp, Unknown
  misc_feature (1)..( 9): Result.003 file - promoters60/2114175
aaagatggg

SEQ ID NO: 126430 - DNA, 38 bp, Unknown
  misc_feature (1)..( 38): Result.003 file - promoters60/2114175
tttactctataaattatttccgcaaactcaagttatac

SEQ ID NO: 126431 - DNA, 38 bp, Unknown
  misc_feature (1)..( 38): Result.003 file - promoters60/2114175
tttactctatatattatttccgcaaacacaaattatac

SEQ ID NO: 126432 - DNA, 10 bp, Unknown
  misc_feature (1)..( 10): Result.003 file - promoters60/2114175
acatcatcat

SEQ ID NO: 126433 - DNA, 10 bp, Unknown
  misc_feature (1)..( 10): Result.003 file - promoters60/2114175
acatcaacat

SEQ ID NO: 126434 - DNA, 23 bp, Unknown
  misc_feature (1)..( 23): Result.003 file - promoters60/2114175
tacatttttctactaatgtggaa

SEQ ID NO: 126435 - DNA, 23 bp, Unknown
  misc_feature (1)..( 23): Result.003 file - promoters60/2114175
tacatttttctagtaatgtagaa

SEQ ID NO: 126436 - DNA, 12 bp, Unknown
  misc_feature (1)..( 12): Result.003 file - promoters60/2114175
aacttcacagta

SEQ ID NO: 126437 - DNA, 12 bp, Unknown
  misc_feature (1)..( 12): Result.003 file - promoters60/2114175
aactttacagta

SEQ ID NO: 126438 - DNA, 6 bp, Unknown
  misc_feature (1)..( 6): Result.003 file - promoters60/2114175
caaaat

SEQ ID NO: 126439 - DNA, 6 bp, Unknown
  misc_feature (1)..( 6): Result.003 file - promoters60/2114175
caaaat

SEQ ID NO: 126440 - DNA, 7 bp, Unknown
  misc_feature (1)..( 7): Result.003 file - promoters60/2114175
acaagca

SEQ ID NO: 126441 - DNA, 7 bp, Unknown
  misc_feature (1)..( 7): Result.003 file - promoters60/2114175
acaagca

SEQ ID NO: 126442 - DNA, 7 bp, Unknown
  misc_feature (1)..( 7): Result.003 file - promoters60/2114175
gataata

SEQ ID NO: 126443 - DNA, 7 bp, Unknown
  misc_feature (1)..( 7): Result.003 file - promoters60/2114175
gataata

SEQ ID NO: 126444 - DNA, 6 bp, Unknown
  misc_feature (1)..( 6): Result.003 file - promoters60/2114175
aacaac

SEQ ID NO: 126445 - DNA, 6 bp, Unknown
  misc_feature (1)..( 6): Result.003 file - promoters60/2114175
aacaac

SEQ ID NO: 126446 - DNA, 13 bp, Unknown
  misc_feature (1)..( 13): Result.003 file - promoters60/2114175
acgccaaattcta

SEQ ID NO: 126447 - DNA, 13 bp, Unknown
  misc_feature (1)..( 13): Result.003 file - promoters60/2114175
acgccaaattcta

SEQ ID NO: 126448 - DNA, 6 bp, Unknown
  misc_feature (1)..( 6): Result.003 file - promoters60/2114175
agcaca

SEQ ID NO: 126449 - DNA, 6 bp, Unknown
  misc_feature (1)..( 6): Result.003 file - promoters60/2114175
agcaca

SEQ ID NO: 126450 - DNA, 32 bp, Unknown
  misc_feature (1)..( 32): Result.003 file - promoters60/2114175
cacagtctcaacgtgctctaaaaacgagtggt

SEQ ID NO: 126451 - DNA, 32 bp, Unknown; identical to SEQ ID NO: 54671
  misc_feature (1)..( 32): Result.003 file - promoters60/2114175

SEQ ID NO: 126452 - DNA, 8 bp, Unknown
  misc_feature (1)..( 8): Result.003 file - promoters60/2114175
aaaatatc

SEQ ID NO: 126453 - DNA, 8 bp, Unknown
  misc_feature (1)..( 8): Result.003 file - promoters60/2114175
aaaatatc

SEQ ID NO: 126454 - DNA, 13 bp, Unknown
  misc_feature (1)..( 13): Result.003 file - promoters60/2114175
cataatgggacca

SEQ ID NO: 126455 - DNA, 13 bp, Unknown
  misc_feature (1)..( 13): Result.003 file - promoters60/2114175
cattatgggacca

SEQ ID NO: 126456 - DNA, 13 bp, Unknown
  misc_feature (1)..( 13): Result.003 file - promoters60/2114175
ttccatgggaaag

SEQ ID NO: 126457 - DNA, 8 bp, Unknown
  misc_feature (1)..( 8): Result.003 file - promoters60/2114175
agcatttg

SEQ ID NO: 126458 - DNA, 8 bp, Unknown
  misc_feature (1)..( 8): Result.003 file - promoters60/2114175
agcatttg

SEQ ID NO: 126459 - DNA, 18 bp, Unknown
  misc_feature (1)..( 18): Result.003 file - promoters60/2114175
acacttatctccgcattt

SEQ ID NO: 126460 - DNA, 18 bp, Unknown
  misc_feature (1)..( 18): Result.003 file - promoters60/2114175
acacatatctcctcattt

SEQ ID NO: 126461 - DNA, 9 bp, Unknown
  misc_feature (1)..( 9): Result.003 file - promoters60/2114175
tttcccatc

SEQ ID NO: 126462 - DNA, 9 bp, Unknown
  misc_feature (1)..( 9): Result.003 file - promoters60/2114175
tttctcatc

SEQ ID NO: 126463 - DNA, 8 bp, Unknown
  misc_feature (1)..( 8): Result.003 file - promoters60/2114175
cttcataa

SEQ ID NO: 126464 - DNA, 8 bp, Unknown
  misc_feature (1)..( 8): Result.003 file - promoters60/2114175
cttcttaa

SEQ ID NO: 126465 - DNA, 6 bp, Unknown
  misc_feature (1)..( 6): Result.003 file - promoters60/2114175
taaccc

SEQ ID NO: 126466 - DNA, 6 bp, Unknown
  misc_feature (1)..( 6): Result.003 file - promoters60/2114175
taaccc

SEQ ID NO: 126467 - DNA, 14 bp, Unknown
  misc_feature (1)..( 14): Result.003 file - promoters60/2114175
cccacctcattata

SEQ ID NO: 126468 - DNA, 14 bp, Unknown
  misc_feature (1)..( 14): Result.003 file - promoters60/2114175
cccacctcattata

SEQ ID NO: 126469 - DNA, 14 bp, Unknown
  misc_feature (1)..( 14): Result.003 file - promoters60/2114175
aataccaccctttg

SEQ ID NO: 126470 - DNA, 14 bp, Unknown
  misc_feature (1)..( 14): Result.003 file - promoters60/2114175
aataccaccctttg

SEQ ID NO: 126471 - DNA, 6 bp, Unknown
  misc_feature (1)..( 6): Result.003 file - promoters60/2114175
gtttat

SEQ ID NO: 126472 - DNA, 6 bp, Unknown
  misc_feature (1)..( 6): Result.003 file - promoters60/2114175
gtttat

SEQ ID NO: 126473 - DNA, 6 bp, Unknown
  misc_feature (1)..( 6): Result.003 file - promoters60/2114175
agcgaa

SEQ ID NO: 126474 - DNA, 6 bp, Unknown
  misc_feature (1)..( 6): Result.003 file - promoters60/2114175
agcgaa

SEQ ID NO: 126475 - DNA, 6 bp, Unknown
  misc_feature (1)..( 6): Result.003 file - promoters60/2114175
gaaaca

SEQ ID NO: 126476 - DNA, 6 bp, Unknown
  misc_feature (1)..( 6): Result.003 file - promoters60/2114175
gaaaca

SEQ ID NO: 126477 - DNA, 7 bp, Unknown
  misc_feature (1)..( 7): Result.003 file - promoters60/2114175
aaactct

SEQ ID NO: 126478 - DNA, 7 bp, Unknown
  misc_feature (1)..( 7): Result.003 file - promoters60/2114175
aaagtct

SEQ ID NO: 126479 - DNA, 9 bp, Unknown
  misc_feature (1)..( 9): Result.003 file - promoters60/2114178
gtttcaaaa

SEQ ID NO: 126480 - DNA, 9 bp, Unknown
  misc_feature (1)..( 9): Result.003 file - promoters60/2114178
gtttcaaac

SEQ ID NO: 126481 - DNA, 9 bp, Unknown
  misc_feature (1)..( 9): Result.003 file - promoters60/2114178
caatcaaaa

SEQ ID NO: 126482 - DNA, 7 bp, Unknown
  misc_feature (1)..( 7): Result.003 file - promoters60/2114178
ttcaaaa

SEQ ID NO: 126483 - DNA, 7 bp, Unknown
  misc_feature (1)..( 7): Result.003 file - promoters60/2114178
ttcaaat

SEQ ID NO: 126484 - DNA, 7 bp, Unknown
  misc_feature (1)..( 7): Result.003 file - promoters60/2114178
atcaaaa

SEQ ID NO: 126485 - DNA, 13 bp, Unknown
  misc_feature (1)..( 13): Result.003 file - promoters60/2114178
ttgtaaaagatga

SEQ ID NO: 126486 - DNA, 13 bp, Unknown
  misc_feature (1)..( 13): Result.003 file - promoters60/2114178
ttgtaaaaaatag

SEQ ID NO: 126487 - DNA, 13 bp, Unknown
  misc_feature (1)..( 13): Result.003 file - promoters60/2114178
atttaaaatatga

SEQ ID NO: 126488 - DNA, 6 bp, Unknown
  misc_feature (1)..( 6): Result.003 file - promoters60/2114178
caataa

SEQ ID NO: 126489 - DNA, 6 bp, Unknown
  misc_feature (1)..( 6): Result.003 file - promoters60/2114178
caataa

SEQ ID NO: 126490 - DNA, 6 bp, Unknown
  misc_feature (1)..( 6): Result.003 file - promoters60/2114178
aattat

SEQ ID NO: 126491 - DNA, 6 bp, Unknown
  misc_feature (1)..( 6): Result.003 file - promoters60/2114178
aattat

SEQ ID NO: 126492 - DNA, 9 bp, Unknown
  misc_feature (1)..( 9): Result.003 file - promoters60/2114178
tgtattatt

SEQ ID NO: 126493 - DNA, 9 bp, Unknown
  misc_feature (1)..( 9): Result.003 file - promoters60/2114178
attattatt

SEQ ID NO: 126494 - DNA, 9 bp, Unknown
  misc_feature (1)..( 9): Result.003 file - promoters60/2114178
tgttttata

SEQ ID NO: 126495 - DNA, 14 bp, Unknown
  misc_feature (1)..( 14): Result.003 file - promoters60/2114178
tatagcaaaactcc

SEQ ID NO: 126496 - DNA, 14 bp, Unknown
  misc_feature (1)..( 14): Result.003 file - promoters60/2114178
aagtggaaaaatcc

SEQ ID NO: 126497 - DNA, 14 bp, Unknown
  misc_feature (1)..( 14): Result.003 file - promoters60/2114178
tatagtaaaacagc

SEQ ID NO: 126498 - DNA, 6 bp, Unknown
  misc_feature (1)..( 6): Result.003 file - promoters60/2114178
agaaaa

SEQ ID NO: 126499 - DNA, 6 bp, Unknown
  misc_feature (1)..( 6): Result.003 file - promoters60/2114178
agaaaa

SEQ ID NO: 126500 - DNA, 7 bp, Unknown
  misc_feature (1)..( 7): Result.003 file - promoters60/2114178
cttcctc

SEQ ID NO: 126501 - DNA, 7 bp, Unknown
  misc_feature (1)..( 7): Result.003 file - promoters60/2114178
cttcctc

SEQ ID NO: 126502 - DNA, 9 bp, Unknown
  misc_feature (1)..( 9): Result.003 file - promoters60/2114178
taggtcgta

SEQ ID NO: 126503 - DNA, 9 bp, Unknown
  misc_feature (1)..( 9): Result.003 file - promoters60/2114178
tagttcgta

SEQ ID NO: 126504 - DNA, 6 bp, Unknown
  misc_feature (1)..( 6): Result.003 file - promoters60/2114178
tttagt

SEQ ID NO: 126505 - DNA, 6 bp, Unknown
  misc_feature (1)..( 6): Result.003 file - promoters60/2114178
tttagt

SEQ ID NO: 126506 - DNA, 9 bp, Unknown
  misc_feature (1)..( 9): Result.003 file - promoters60/2114178
atcttcttc

SEQ ID NO: 126507 - DNA, 9 bp, Unknown
  misc_feature (1)..( 9): Result.003 file - promoters60/2114178
atctacttc

SEQ ID NO: 126508 - DNA, 8 bp, Unknown
  misc_feature (1)..( 8): Result.003 file - promoters60/2114178
aaaataac

SEQ ID NO: 126509 - DNA, 8 bp, Unknown
  misc_feature (1)..( 8): Result.003 file - promoters60/2114178
aaattaac

SEQ ID NO: 126510 - DNA, 6 bp, Unknown
  misc_feature (1)..( 6): Result.003 file - promoters60/2114178
agcaaa

SEQ ID NO: 126511 - DNA, 6 bp, Unknown
  misc_feature (1)..( 6): Result.003 file - promoters60/2114178
agcaaa

SEQ ID NO: 126512 - DNA, 7 bp, Unknown
  misc_feature (1)..( 7): Result.003 file - promoters60/2114178
ttcaaca

SEQ ID NO: 126513 - DNA, 7 bp, Unknown
  misc_feature (1)..( 7): Result.003 file - promoters60/2114178
ttctaca

SEQ ID NO: 126514 - DNA, 7 bp, Unknown
  misc_feature (1)..( 7): Result.003 file - promoters60/2114178
aaattaa

SEQ ID NO: 126515 - DNA, 7 bp, Unknown
  misc_feature (1)..( 7): Result.003 file - promoters60/2114178
aaaataa

SEQ ID NO: 126516 - DNA, 7 bp, Unknown
  misc_feature (1)..( 7): Result.003 file - promoters60/2114178
tttgtaa

SEQ ID NO: 126517 - DNA, 7 bp, Unknown
  misc_feature (1)..( 7): Result.003 file - promoters60/2114178
tttgtaa

SEQ ID NO: 126518 - DNA, 9 bp, Unknown
  misc_feature (1)..( 9): Result.003 file - promoters60/2114178
ttacctttt

SEQ ID NO: 126519 - DNA, 9 bp, Unknown
  misc_feature (1)..( 9): Result.003 file - promoters60/2114178
ttatctttt

SEQ ID NO: 126520 - DNA, 8 bp, Unknown
  misc_feature (1)..( 8): Result.003 file - promoters60/2114178
gttgtgtt

SEQ ID NO: 126521 - DNA, 8 bp, Unknown
  misc_feature (1)..( 8): Result.003 file - promoters60/2114178
gttttgtt

SEQ ID NO: 126522 - DNA, 12 bp, Unknown
  misc_feature (1)..( 12): Result.003 file - promoters60/2114200
atcgaattcaag

SEQ ID NO: 126523 - DNA, 12 bp, Unknown
  misc_feature (1)..( 12): Result.003 file - promoters60/2114200
aatgaattcttt

SEQ ID NO: 126524 - DNA, 12 bp, Unknown
  misc_feature (1)..( 12): Result.003 file - promoters60/2114200
taataattaaag

SEQ ID NO: 126525 - DNA, 12 bp, Unknown
  misc_feature (1)..( 12): Result.003 file - promoters60/2114200
catcaatgctta

SEQ ID NO: 126526 - DNA, 12 bp, Unknown
  misc_feature (1)..( 12): Result.003 file - promoters60/2114200
cattaatccttg

SEQ ID NO: 126527 - DNA, 12 bp, Unknown
  misc_feature (1)..( 12): Result.003 file - promoters60/2114200
attccatcctta

SEQ ID NO: 126528 - DNA, 8 bp, Unknown
  misc_feature (1)..( 8): Result.003 file - promoters60/2131829
atttaaaa

SEQ ID NO: 126529 - DNA, 8 bp, Unknown
  misc_feature (1)..( 8): Result.003 file - promoters60/2131829
tattaaaa

SEQ ID NO: 126530 - DNA, 9 bp, Unknown
  misc_feature (1)..( 9): Result.003 file - promoters60/2131829
tattgaaaa

SEQ ID NO: 126531 - DNA, 9 bp, Unknown
  misc_feature (1)..( 9): Result.003 file - promoters60/2131829
aattgaaac

SEQ ID NO: 126532 - DNA, 11 bp, Unknown
  misc_feature (1)..( 11): Result.003 file - promoters60/2169576
ttttttaaaaa

SEQ ID NO: 126533 - DNA, 11 bp, Unknown
  misc_feature (1)..( 11): Result.003 file - promoters60/2169576
attttgaaaaa

SEQ ID NO: 126534 - DNA, 12 bp, Unknown
  misc_feature (1)..( 12): Result.003 file - promoters60/2169576
attgtttaagat

SEQ ID NO: 126535 - DNA, 12 bp, Unknown
  misc_feature (1)..( 12): Result.003 file - promoters60/2169576
gttttcgaatct

SEQ ID NO: 126536 - DNA, 12 bp, Unknown
  misc_feature (1)..( 12): Result.003 file - promoters60/2169576
tttgtttctctt

SEQ ID NO: 126537 - DNA, 12 bp, Unknown
  misc_feature (1)..( 12): Result.003 file - promoters60/2169576
aatgtttctcca

SEQ ID NO: 126538 - DNA, 14 bp, Unknown
  misc_feature (1)..( 14): Result.003 file - promoters60/2169576
ctcatataaataca

SEQ ID NO: 126539 - DNA, 14 bp, Unknown
  misc_feature (1)..( 14): Result.003 file - promoters60/2169576
acaatataaacata

SEQ ID NO: 126540 - DNA, 14 bp, Unknown
  misc_feature (1)..( 14): Result.003 file - promoters60/2169576
atcacatattaaca

SEQ ID NO: 126541 - DNA, 14 bp, Unknown
  misc_feature (1)..( 14): Result.003 file - promoters60/2169576
ctcatatatatcac

SEQ ID NO: 126542 - DNA, 14 bp, Unknown
  misc_feature (1)..( 14): Result.003 file - promoters60/2169576
ctcatatatataca

SEQ ID NO: 126543 - DNA, 14 bp, Unknown
  misc_feature (1)..( 14): Result.003 file - promoters60/2169576
cgtatatataaaga

SEQ ID NO: 126544 - DNA, 13 bp, Unknown
  misc_feature (1)..( 13): Result.003 file - promoters60/2169576
ctctagattttta

SEQ ID NO: 126545 - DNA, 13 bp, Unknown
  misc_feature (1)..( 13): Result.003 file - promoters60/2169576
tgaacaatttttc

SEQ ID NO: 126546 - DNA, 13 bp, Unknown
  misc_feature (1)..( 13): Result.003 file - promoters60/2169576
atacgttttttta

SEQ ID NO: 126547 - DNA, 13 bp, Unknown
  misc_feature (1)..( 13): Result.003 file - promoters60/2169576
ggtgagatgtttg

SEQ ID NO: 126548 - DNA, 13 bp, Unknown
  misc_feature (1)..( 13): Result.003 file - promoters60/2169576
aactagagtttcc

SEQ ID NO: 126549 - DNA, 13 bp, Unknown
  misc_feature (1)..( 13): Result.003 file - promoters60/2169576
aactagacccgtt

SEQ ID NO: 126550 - DNA, 13 bp, Unknown
  misc_feature (1)..( 13): Result.003 file - promoters60/2169576
tcgtagtgttcat

SEQ ID NO: 126551 - DNA, 14 bp, Unknown
  misc_feature (1)..( 14): Result.003 file - promoters60/2169576
aaagttttgagcta

SEQ ID NO: 126552 - DNA, 14 bp, Unknown
  misc_feature (1)..( 14): Result.003 file - promoters60/2169576
aaattttttttcta

SEQ ID NO: 126553 - DNA, 14 bp, Unknown
  misc_feature (1)..( 14): Result.003 file - promoters60/2169576
aaactttttttaca

SEQ ID NO: 126554 - DNA, 14 bp, Unknown
  misc_feature (1)..( 14): Result.003 file - promoters60/2169576
ctagtttttcttat

SEQ ID NO: 126555 - DNA, 14 bp, Unknown
  misc_feature (1)..( 14): Result.003 file - promoters60/2169576
tgacttttctttct

SEQ ID NO: 126556 - DNA, 14 bp, Unknown
  misc_feature (1)..( 14): Result.003 file - promoters60/2169576
caatttttagtcat

SEQ ID NO: 126557 - DNA, 9 bp, Unknown
  misc_feature (1)..( 9): Result.003 file - promoters60/2185389
tgaagaaaa

SEQ ID NO: 126558 - DNA, 9 bp, Unknown
  misc_feature (1)..( 9): Result.003 file - promoters60/2185389
tgaagaaca

SEQ ID NO: 126559 - DNA, 9 bp, Unknown
  misc_feature (1)..( 9): Result.003 file - promoters60/2185389
aaaagaaaa

SEQ ID NO: 126560 - DNA, 9 bp, Unknown
  misc_feature (1)..( 9): Result.003 file - promoters60/2185389
tgatgaaac

SEQ ID NO: 126561 - DNA, 9 bp, Unknown
  misc_feature (1)..( 9): Result.003 file - promoters60/2185389
ctaagaaat

SEQ ID NO: 126562 - DNA, 9 bp, Unknown
  misc_feature (1)..( 9): Result.003 file - promoters60/2185389
ccaatagaa

SEQ ID NO: 126563 - DNA, 9 bp, Unknown
  misc_feature (1)..( 9): Result.003 file - promoters60/2185389
acaagagag

SEQ ID NO: 126564 - DNA, 9 bp, Unknown
  misc_feature (1)..( 9): Result.003 file - promoters60/2185389
acaaaagag

SEQ ID NO: 126565 - DNA, 9 bp, Unknown
  misc_feature (1)..( 9): Result.003 file - promoters60/2185389
acaaaaaca

SEQ ID NO: 126566 - DNA, 8 bp, Unknown
  misc_feature (1)..( 8): Result.003 file - promoters60/2185389
ttttcttc

SEQ ID NO: 126567 - DNA, 8 bp, Unknown
  misc_feature (1)..( 8): Result.003 file - promoters60/2185389
ttttcttt

SEQ ID NO: 126568 - DNA, 8 bp, Unknown
  misc_feature (1)..( 8): Result.003 file - promoters60/2185389
tcttcttc

SEQ ID NO: 126569 - DNA, 8 bp, Unknown
  misc_feature (1)..( 8): Result.003 file - promoters60/2185389
ctttcttc

SEQ ID NO: 126570 - DNA, 11 bp, Unknown
  misc_feature (1)..( 11): Result.003 file - promoters60/2185389
gaagaaaatga

SEQ ID NO: 126571 - DNA, 11 bp, Unknown
  misc_feature (1)..( 11): Result.003 file - promoters60/2185389
acataaagtga

SEQ ID NO: 126572 - DNA, 11 bp, Unknown
  misc_feature (1)..( 11): Result.003 file - promoters60/2185389
gaaaaaaatgg

SEQ ID NO: 126573 - DNA, 11 bp, Unknown
  misc_feature (1)..( 11): Result.003 file - promoters60/2185389
gtaaataatta

SEQ ID NO: 126574 - DNA, 10 bp, Unknown
  misc_feature (1)..( 10): Result.003 file - promoters60/2185389
gcagagacaa

SEQ ID NO: 126575 - DNA, 10 bp, Unknown
  misc_feature (1)..( 10): Result.003 file - promoters60/2185389
cttgagtcaa

SEQ ID NO: 126576 - DNA, 10 bp, Unknown
  misc_feature (1)..( 10): Result.003 file - promoters60/2185389
tttgaatcaa

SEQ ID NO: 126577 - DNA, 10 bp, Unknown
  misc_feature (1)..( 10): Result.003 file - promoters60/2185389
tttgtatcag

SEQ ID NO: 126578 - DNA, 11 bp, Unknown
  misc_feature (1)..( 11): Result.003 file - promoters60/2187156
ccagaattaag

SEQ ID NO: 126579 - DNA, 11 bp, Unknown
  misc_feature (1)..( 11): Result.003 file - promoters60/2187156
ccataattagt

SEQ ID NO: 126580 - DNA, 11 bp, Unknown
  misc_feature (1)..( 11): Result.003 file - promoters60/2187156
atgtaattaag

SEQ ID NO: 126581 - DNA, 11 bp, Unknown
  misc_feature (1)..( 11): Result.003 file - promoters60/2187156
aaatacttaag

SEQ ID NO: 126582 - DNA, 11 bp, Unknown
  misc_feature (1)..( 11): Result.003 file - promoters60/2187156
tcataattttg

SEQ ID NO: 126583 - DNA, 9 bp, Unknown
  misc_feature (1)..( 9): Result.003 file - promoters60/2187156
tgtaaaaat

SEQ ID NO: 126584 - DNA, 9 bp, Unknown
  misc_feature (1)..( 9): Result.003 file - promoters60/2187156
tgtaaataa

SEQ ID NO: 126585 - DNA, 9 bp, Unknown
  misc_feature (1)..( 9): Result.003 file - promoters60/2187156
agtaaaatt

SEQ ID NO: 126586 - DNA, 9 bp, Unknown
  misc_feature (1)..( 9): Result.003 file - promoters60/2187156
ggtacataa

SEQ ID NO: 126587 - DNA, 10 bp, Unknown
  misc_feature (1)..( 10): Result.003 file - promoters60/2217817
aaaagatagc

SEQ ID NO: 126588 - DNA, 10 bp, Unknown
  misc_feature (1)..( 10): Result.003 file - promoters60/2217817
gaaatatata

SEQ ID NO: 126589 - DNA, 10 bp, Unknown
  misc_feature (1)..( 10): Result.003 file - promoters60/2217817
gaaatagatt

SEQ ID NO: 126590 - DNA, 10 bp, Unknown
  misc_feature (1)..( 10): Result.003 file - promoters60/2217817
ttagtagatt

SEQ ID NO: 126591 - DNA, 10 bp, Unknown
  misc_feature (1)..( 10): Result.003 file - promoters60/2217817
ttaatttatt

SEQ ID NO: 126592 - DNA, 10 bp, Unknown
  misc_feature (1)..( 10): Result.003 file - promoters60/2217817
tgattacttt

SEQ ID NO: 126593 - DNA, 8 bp, Unknown
  misc_feature (1)..( 8): Result.003 file - promoters60/2217996
ctcatttt

SEQ ID NO: 126594 - DNA, 8 bp, Unknown
  misc_feature (1)..( 8): Result.003 file - promoters60/2217996
ctcagttt

SEQ ID NO: 126595 - DNA, 7 bp, Unknown
  misc_feature (1)..( 7): Result.003 file - promoters60/2217996
ccatttt

SEQ ID NO: 126596 - DNA, 8 bp, Unknown
  misc_feature (1)..( 8): Result.003 file - promoters60/2217996
tccagttt

SEQ ID NO: 126597 - DNA, 6 bp, Unknown
  misc_feature (1)..( 6): Result.003 file - promoters60/2218016
ttcaca

SEQ ID NO: 126598 - DNA, 6 bp, Unknown
  misc_feature (1)..( 6): Result.003 file - promoters60/2218016
ttcaca

SEQ ID NO: 126599 - DNA, 6 bp, Unknown
  misc_feature (1)..( 6): Result.003 file - promoters60/2218016
agcttt

SEQ ID NO: 126600 - DNA, 6 bp, Unknown
  misc_feature (1)..( 6): Result.003 file - promoters60/2218016
agcttt

SEQ ID NO: 126601 - DNA, 6 bp, Unknown
  misc_feature (1)..( 6): Result.003 file - promoters60/2218016
ttttca

SEQ ID NO: 126602 - DNA, 6 bp, Unknown
  misc_feature (1)..( 6): Result.003 file - promoters60/2218016
ttttca

SEQ ID NO: 126603 - DNA, 7 bp, Unknown
  misc_feature (1)..( 7): Result.003 file - promoters60/2218016
atataag

SEQ ID NO: 126604 - DNA, 7 bp, Unknown
  misc_feature (1)..( 7): Result.003 file - promoters60/2218016
atataag

SEQ ID NO: 126605 - DNA, 6 bp, Unknown
  misc_feature (1)..( 6): Result.003 file - promoters60/2218016
tcacta

SEQ ID NO: 126606 - DNA, 6 bp, Unknown
  misc_feature (1)..( 6): Result.003 file - promoters60/2218016
tcacta

SEQ ID NO: 126607 - DNA, 6 bp, Unknown
  misc_feature (1)..( 6): Result.003 file - promoters60/2218016
tcaatc

SEQ ID NO: 126608 - DNA, 6 bp, Unknown
  misc_feature (1)..( 6): Result.003 file - promoters60/2218016
tcaatc

SEQ ID NO: 126609 - DNA, 6 bp, Unknown
  misc_feature (1)..( 6): Result.003 file - promoters60/2218016
agtaag

SEQ ID NO: 126610 - DNA, 6 bp, Unknown
  misc_feature (1)..( 6): Result.003 file - promoters60/2218016
agtaag

SEQ ID NO: 126611 - DNA, 7 bp, Unknown
  misc_feature (1)..( 7): Result.003 file - promoters60/2218016
accaaac

SEQ ID NO: 126612 - DNA, 7 bp, Unknown
  misc_feature (1)..( 7): Result.003 file - promoters60/2218016
accaaac

SEQ ID NO: 126613 - DNA, 7 bp, Unknown
  misc_feature (1)..( 7): Result.003 file - promoters60/2218016
ttgctgt

SEQ ID NO: 126614 - DNA, 7 bp, Unknown
  misc_feature (1)..( 7): Result.003 file - promoters60/2218016
ttgatgt

SEQ ID NO: 126615 - DNA, 12 bp, Unknown
  misc_feature (1)..( 12): Result.003 file - promoters60/2218207
taatcttttggg

SEQ ID NO: 126616 - DNA, 12 bp, Unknown
  misc_feature (1)..( 12): Result.003 file - promoters60/2218207
taatgtttttct

SEQ ID NO: 126617 - DNA, 12 bp, Unknown
  misc_feature (1)..( 12): Result.003 file - promoters60/2218207
atttcttttcac

SEQ ID NO: 126618 - DNA, 12 bp, Unknown
  misc_feature (1)..( 12): Result.003 file - promoters60/2218207
aactcttttgag

SEQ ID NO: 126619 - DNA, 12 bp, Unknown
  misc_feature (1)..( 12): Result.003 file - promoters60/2218207
gtttctgttcac

SEQ ID NO: 126620 - DNA, 12 bp, Unknown
  misc_feature (1)..( 12): Result.003 file - promoters60/2218207
gattctgtgaag

SEQ ID NO: 126621 - DNA, 13 bp, Unknown
  misc_feature (1)..( 13): Result.003 file - promoters60/2218260
ggatagatagact

SEQ ID NO: 126622 - DNA, 13 bp, Unknown
  misc_feature (1)..( 13): Result.003 file - promoters60/2218260
ggaaagattgata

SEQ ID NO: 126623 - DNA, 13 bp, Unknown
  misc_feature (1)..( 13): Result.003 file - promoters60/2218260
caataaataataa

SEQ ID NO: 126624 - DNA, 14 bp, Unknown
  misc_feature (1)..( 14): Result.003 file - promoters60/2218260
cagtagcatacaaa

SEQ ID NO: 126625 - DNA, 14 bp, Unknown
  misc_feature (1)..( 14): Result.003 file - promoters60/2218260
aacaaaaattatac

SEQ ID NO: 126626 - DNA, 14 bp, Unknown
  misc_feature (1)..( 14): Result.003 file - promoters60/2218260
gtcgagaatacata

SEQ ID NO: 126627 - DNA, 12 bp, Unknown
  misc_feature (1)..( 12): Result.003 file - promoters60/2218260
acatatatactt

SEQ ID NO: 126628 - DNA, 12 bp, Unknown
  misc_feature (1)..( 12): Result.003 file - promoters60/2218260
gtatatatataa

SEQ ID NO: 126629 - DNA, 12 bp, Unknown
  misc_feature (1)..( 12): Result.003 file - promoters60/2218260
atttatatagat

SEQ ID NO: 126630 - DNA, 12 bp, Unknown
  misc_feature (1)..( 12): Result.003 file - promoters60/2218260
gtatttatattt

SEQ ID NO: 126631 - DNA, 12 bp, Unknown
  misc_feature (1)..( 12): Result.003 file - promoters60/2218260
agttaaatagca

SEQ ID NO: 126632 - DNA, 12 bp, Unknown
  misc_feature (1)..( 12): Result.003 file - promoters60/2218260
caataaaaagca

SEQ ID NO: 126633 - DNA, 6 bp, Unknown
  misc_feature (1)..( 6): Result.003 file - promoters60/2685725
tcaatg

SEQ ID NO: 126634 - DNA, 6 bp, Unknown
  misc_feature (1)..( 6): Result.003 file - promoters60/2685725
tcaatg

SEQ ID NO: 126635 - DNA, 8 bp, Unknown
  misc_feature (1)..( 8): Result.003 file - promoters60/2685725
gtcaaggt

SEQ ID NO: 126636 - DNA, 8 bp, Unknown
  misc_feature (1)..( 8): Result.003 file - promoters60/2685725
gtcatggt

SEQ ID NO: 126637 - DNA, 9 bp, Unknown
  misc_feature (1)..( 9): Result.003 file - promoters60/2685725
taatattgt

SEQ ID NO: 126638 - DNA, 9 bp, Unknown
  misc_feature (1)..( 9): Result.003 file - promoters60/2685725
taatcttgt

SEQ ID NO: 126639 - DNA, 7 bp, Unknown
  misc_feature (1)..( 7): Result.003 file - promoters60/2685725
aaggttc

SEQ ID NO: 126640 - DNA, 7 bp, Unknown
  misc_feature (1)..( 7): Result.003 file - promoters60/2685725
aaggttc

SEQ ID NO: 126641 - DNA, 6 bp, Unknown
  misc_feature (1)..( 6): Result.003 file - promoters60/2685725
gatacg

SEQ ID NO: 126642 - DNA, 6 bp, Unknown
  misc_feature (1)..( 6): Result.003 file - promoters60/2685725
gatacg

SEQ ID NO: 126643 - DNA, 8 bp, Unknown
  misc_feature (1)..( 8): Result.003 file - promoters60/2685725
tcatacac

SEQ ID NO: 126644 - DNA, 8 bp, Unknown
  misc_feature (1)..( 8): Result.003 file - promoters60/2685725
tcacacac

SEQ ID NO: 126645 - DNA, 7 bp, Unknown
  misc_feature (1)..( 7): Result.003 file - promoters60/2685725
ttaggta

SEQ ID NO: 126646 - DNA, 7 bp, Unknown
  misc_feature (1)..( 7): Result.003 file - promoters60/2685725
ttatgta

SEQ ID NO: 126647 - DNA, 7 bp, Unknown
  misc_feature (1)..( 7): Result.003 file - promoters60/2685725
tatcatg

SEQ ID NO: 126648 - DNA, 7 bp, Unknown
  misc_feature (1)..( 7): Result.003 file - promoters60/2685725
tataatg

SEQ ID NO: 126649 - DNA, 7 bp, Unknown
  misc_feature (1)..( 7): Result.003 file - promoters60/2685725
caaacga

SEQ ID NO: 126650 - DNA, 7 bp, Unknown
  misc_feature (1)..( 7): Result.003 file - promoters60/2685725
caaacga

SEQ ID NO: 126651 - DNA, 6 bp, Unknown
  misc_feature (1)..( 6): Result.003 file - promoters60/2685725
aataag

SEQ ID NO: 126652 - DNA, 6 bp, Unknown
  misc_feature (1)..( 6): Result.003 file - promoters60/2685725
aataag

SEQ ID NO: 126653 - DNA, 7 bp, Unknown
  misc_feature (1)..( 7): Result.003 file - promoters60/2685873
acctaat

SEQ ID NO: 126654 - DNA, 7 bp, Unknown
  misc_feature (1)..( 7): Result.003 file - promoters60/2685873
acccaat

SEQ ID NO: 126655 - DNA, 8 bp, Unknown
  misc_feature (1)..( 8): Result.003 file - promoters60/2685873
tctatctt

SEQ ID NO: 126656 - DNA, 8 bp, Unknown
  misc_feature (1)..( 8): Result.003 file - promoters60/2685873
tctgtctt

SEQ ID NO: 126657 - DNA, 6 bp, Unknown
  misc_feature (1)..( 6): Result.003 file - promoters60/2685873
caacaa

SEQ ID NO: 126658 - DNA, 6 bp, Unknown
  misc_feature (1)..( 6): Result.003 file - promoters60/2685873
caacaa

SEQ ID NO: 126659 - DNA, 8 bp, Unknown
  misc_feature (1)..( 8): Result.003 file - promoters60/2685873
aaatgtca

SEQ ID NO: 126660 - DNA, 8 bp, Unknown
  misc_feature (1)..( 8): Result.003 file - promoters60/2685873
aaatatca

SEQ ID NO: 126661 - DNA, 6 bp, Unknown
  misc_feature (1)..( 6): Result.003 file - promoters60/2685873
aaagaa

SEQ ID NO: 126662 - DNA, 6 bp, Unknown
  misc_feature (1)..( 6): Result.003 file - promoters60/2685873
aaagaa

SEQ ID NO: 126663 - DNA, 6 bp, Unknown
  misc_feature (1)..( 6): Result.003 file - promoters60/2685873
aaaaga

SEQ ID NO: 126664 - DNA, 6 bp, Unknown
  misc_feature (1)..( 6): Result.003 file - promoters60/2685873
aaaaga

SEQ ID NO: 126665 - DNA, 8 bp, Unknown
  misc_feature (1)..( 8): Result.003 file - promoters60/2685873
ttcttaga

SEQ ID NO: 126666 - DNA, 8 bp, Unknown
  misc_feature (1)..( 8): Result.003 file - promoters60/2685873
ttctaaga

SEQ ID NO: 126667 - DNA, 8 bp, Unknown
  misc_feature (1)..( 8): Result.003 file - promoters60/2685873
tttttttt

SEQ ID NO: 126668 - DNA, 8 bp, Unknown
  misc_feature (1)..( 8): Result.003 file - promoters60/2685873
tttttttt

SEQ ID NO: 126669 - DNA, 8 bp, Unknown
  misc_feature (1)..( 8): Result.003 file - promoters60/2685873
ttgtaatt

SEQ ID NO: 126670 - DNA, 8 bp, Unknown
  misc_feature (1)..( 8): Result.003 file - promoters60/2685873
ttgcaatt

SEQ ID NO: 126671 - DNA, 7 bp, Unknown
  misc_feature (1)..( 7): Result.003 file - promoters60/2685873
aacaatt

SEQ ID NO: 126672 - DNA, 7 bp, Unknown
  misc_feature (1)..( 7): Result.003 file - promoters60/2685873
aacaatt

SEQ ID NO: 126673 - DNA, 7 bp, Unknown
  misc_feature (1)..( 7): Result.003 file - promoters60/2685873
tctaaca

SEQ ID NO: 126674 - DNA, 7 bp, Unknown
  misc_feature (1)..( 7): Result.003 file - promoters60/2685873
tcttaca

SEQ ID NO: 126675 - DNA, 6 bp, Unknown
  misc_feature (1)..( 6): Result.003 file - promoters60/2685873
attcaa

SEQ ID NO: 126676 - DNA, 6 bp, Unknown
  misc_feature (1)..( 6): Result.003 file - promoters60/2685873
attcaa

SEQ ID NO: 126677 - DNA, 6 bp, Unknown
  misc_feature (1)..( 6): Result.003 file - promoters60/2685873
aaaaaa

SEQ ID NO: 126678 - DNA, 6 bp, Unknown
  misc_feature (1)..( 6): Result.003 file - promoters60/2685873
aaaaaa

SEQ ID NO: 126679 - DNA, 8 bp, Unknown
  misc_feature (1)..( 8): Result.003 file - promoters60/2685873
aaaatctt

SEQ ID NO: 126680 - DNA, 8 bp, Unknown
  misc_feature (1)..( 8): Result.003 file - promoters60/2685873
aaaacctt

SEQ ID NO: 126681 - DNA, 7 bp, Unknown
  misc_feature (1)..( 7): Result.003 file - promoters60/2685873
gaaagaa

SEQ ID NO: 126682 - DNA, 7 bp, Unknown
  misc_feature (1)..( 7): Result.003 file - promoters60/2685873
gaaagaa

SEQ ID NO: 126683 - DNA, 6 bp, Unknown
  misc_feature (1)..( 6): Result.003 file - promoters60/2685873
ttgatg

SEQ ID NO: 126684 - DNA, 6 bp, Unknown
  misc_feature (1)..( 6): Result.003 file - promoters60/2685873
ttgatg

SEQ ID NO: 126685 - DNA, 8 bp, Unknown
  misc_feature (1)..( 8): Result.003 file - promoters60/2685873
ttgagctt

SEQ ID NO: 126686 - DNA, 8 bp, Unknown
  misc_feature (1)..( 8): Result.003 file - promoters60/2685873
ttgatctt

SEQ ID NO: 126687 - DNA, 6 bp, Unknown
  misc_feature (1)..( 6): Result.003 file - promoters60/2685873
aatttg

SEQ ID NO: 126688 - DNA, 6 bp, Unknown
  misc_feature (1)..( 6): Result.003 file - promoters60/2685873
aatttg

SEQ ID NO: 126689 - DNA, 8 bp, Unknown
  misc_feature (1)..( 8): Result.003 file - promoters60/2685873
aaaccctt

SEQ ID NO: 126690 - DNA, 8 bp, Unknown
  misc_feature (1)..( 8): Result.003 file - promoters60/2685873
aaactctt

SEQ ID NO: 126691 - DNA, 6 bp, Unknown
  misc_feature (1)..( 6): Result.003 file - promoters60/2685873
aatcaa

SEQ ID NO: 126692 - DNA, 6 bp, Unknown
  misc_feature (1)..( 6): Result.003 file - promoters60/2685873
aatcaa

SEQ ID NO: 126693 - DNA, 8 bp, Unknown
  misc_feature (1)..( 8): Result.003 file - promoters60/2685873
cacctctc

SEQ ID NO: 126694 - DNA, 8 bp, Unknown
  misc_feature (1)..( 8): Result.003 file - promoters60/2685873
caccactc

SEQ ID NO: 126695 - DNA, 14 bp, Unknown
  misc_feature (1)..( 14): Result.003 file - promoters60/2685951
aagtttcaaataca

SEQ ID NO: 126696 - DNA, 14 bp, Unknown
  misc_feature (1)..( 14): Result.003 file - promoters60/2685951
ggagatcaaatagg

SEQ ID NO: 126697 - DNA, 14 bp, Unknown
  misc_feature (1)..( 14): Result.003 file - promoters60/2685951
ataaaaaaaaaaca

SEQ ID NO: 126698 - DNA, 14 bp, Unknown
  misc_feature (1)..( 14): Result.003 file - promoters60/2685951
tttgattaaattgg

SEQ ID NO: 126699 - DNA, 14 bp, Unknown
  misc_feature (1)..( 14): Result.003 file - promoters60/2685951
ctgcattaaacaac

SEQ ID NO: 126700 - DNA, 14 bp, Unknown
  misc_feature (1)..( 14): Result.003 file - promoters60/2685951
ttttattaccacta

SEQ ID NO: 126701 - DNA, 8 bp, Unknown
  misc_feature (1)..( 8): Result.003 file - promoters60/2685951
tttagtgt

SEQ ID NO: 126702 - DNA, 8 bp, Unknown
  misc_feature (1)..( 8): Result.003 file - promoters60/2685951
tttattgt

SEQ ID NO: 126703 - DNA, 8 bp, Unknown
  misc_feature (1)..( 8): Result.003 file - promoters60/2685951
tttatttc

SEQ ID NO: 126704 - DNA, 8 bp, Unknown
  misc_feature (1)..( 8): Result.003 file - promoters60/2685951
tttatttt

SEQ ID NO: 126705 - DNA, 8 bp, Unknown
  misc_feature (1)..( 8): Result.003 file - promoters60/2685951
tttttttt

SEQ ID NO: 126706 - DNA, 8 bp, Unknown
  misc_feature (1)..( 8): Result.003 file - promoters60/2685951
tttattac

SEQ ID NO: 126707 - DNA, 8 bp, Unknown
  misc_feature (1)..( 8): Result.003 file - promoters60/2685968
tgaaaata

SEQ ID NO: 126708 - DNA, 8 bp, Unknown
  misc_feature (1)..( 8): Result.003 file - promoters60/2685968
tgacaatt

SEQ ID NO: 126709 - DNA, 8 bp, Unknown
  misc_feature (1)..( 8): Result.003 file - promoters60/2685968
agaagata

SEQ ID NO: 126710 - DNA, 7 bp, Unknown
  misc_feature (1)..( 7): Result.003 file - promoters60/2685968
aagaaat

SEQ ID NO: 126711 - DNA, 7 bp, Unknown
  misc_feature (1)..( 7): Result.003 file - promoters60/2685968
aagaaat

SEQ ID NO: 126712 - DNA, 6 bp, Unknown
  misc_feature (1)..( 6): Result.003 file - promoters60/2685968
aattaa

SEQ ID NO: 126713 - DNA, 6 bp, Unknown
  misc_feature (1)..( 6): Result.003 file - promoters60/2685968
aattaa

SEQ ID NO: 126714 - DNA, 8 bp, Unknown
  misc_feature (1)..( 8): Result.003 file - promoters60/2685968
atatgaat

SEQ ID NO: 126715 - DNA, 8 bp, Unknown
  misc_feature (1)..( 8): Result.003 file - promoters60/2685968
atataaat

SEQ ID NO: 126716 - DNA, 8 bp, Unknown
  misc_feature (1)..( 8): Result.003 file - promoters60/2685968
aaaataaa

SEQ ID NO: 126717 - DNA, 8 bp, Unknown
  misc_feature (1)..( 8): Result.003 file - promoters60/2685968
aaaagaaa

SEQ ID NO: 126718 - DNA, 7 bp, Unknown
  misc_feature (1)..( 7): Result.003 file - promoters60/2685968
cattttt

SEQ ID NO: 126719 - DNA, 7 bp, Unknown
  misc_feature (1)..( 7): Result.003 file - promoters60/2685968
tattttt

SEQ ID NO: 126720 - DNA, 8 bp, Unknown
  misc_feature (1)..( 8): Result.003 file - promoters60/2685968
tattattt

SEQ ID NO: 126721 - DNA, 12 bp, Unknown
  misc_feature (1)..( 12): Result.003 file - promoters60/2685968
gaagaagaaaag

SEQ ID NO: 126722 - DNA, 12 bp, Unknown
  misc_feature (1)..( 12): Result.003 file - promoters60/2685968
gaaaaagataag

SEQ ID NO: 126723 - DNA, 6 bp, Unknown
  misc_feature (1)..( 6): Result.003 file - promoters60/2685968
cgtttt

SEQ ID NO: 126724 - DNA, 6 bp, Unknown
  misc_feature (1)..( 6): Result.003 file - promoters60/2685968
cgtttt

SEQ ID NO: 126725 - DNA, 8 bp, Unknown
  misc_feature (1)..( 8): Result.003 file - promoters60/2685968
tttgttca

SEQ ID NO: 126726 - DNA, 8 bp, Unknown
  misc_feature (1)..( 8): Result.003 file - promoters60/2685968
ttttttca

SEQ ID NO: 126727 - DNA, 7 bp, Unknown
  misc_feature (1)..( 7): Result.003 file - promoters60/2685968
agagaga

SEQ ID NO: 126728 - DNA, 7 bp, Unknown
  misc_feature (1)..( 7): Result.003 file - promoters60/2685968
agataga

SEQ ID NO: 126729 - DNA, 6 bp, Unknown
  misc_feature (1)..( 6): Result.003 file - promoters60/2685968
ttttaa

SEQ ID NO: 126730 - DNA, 6 bp, Unknown
  misc_feature (1)..( 6): Result.003 file - promoters60/2685968
ttttaa

SEQ ID NO: 126731 - DNA, 6 bp, Unknown
  misc_feature (1)..( 6): Result.003 file - promoters60/2685968
tttttt

SEQ ID NO: 126732 - DNA, 6 bp, Unknown
  misc_feature (1)..( 6): Result.003 file - promoters60/2685968
tttttt

SEQ ID NO: 126733 - DNA, 6 bp, Unknown
  misc_feature (1)..( 6): Result.003 file - promoters60/2685968
caaatt

SEQ ID NO: 126734 - DNA, 6 bp, Unknown
  misc_feature (1)..( 6): Result.003 file - promoters60/2685968
caaatt

SEQ ID NO: 126735 - DNA, 7 bp, Unknown
  misc_feature (1)..( 7): Result.003 file - promoters60/2685968
gaacaat

SEQ ID NO: 126736 - DNA, 7 bp, Unknown
  misc_feature (1)..( 7): Result.003 file - promoters60/2685968
gaacaaa

SEQ ID NO: 126737 - DNA, 7 bp, Unknown
  misc_feature (1)..( 7): Result.003 file - promoters60/2685968
aaacaaa

SEQ ID NO: 126738 - DNA, 10 bp, Unknown
  misc_feature (1)..( 10): Result.003 file - promoters60/2685968
aattatgtgt

SEQ ID NO: 126739 - DNA, 10 bp, Unknown
  misc_feature (1)..( 10): Result.003 file - promoters60/2685968
tattatttgt

SEQ ID NO: 126740 - DNA, 10 bp, Unknown
  misc_feature (1)..( 10): Result.003 file - promoters60/2685968
tattttttta

SEQ ID NO: 126741 - DNA, 6 bp, Unknown
  misc_feature (1)..( 6): Result.003 file - promoters60/2685968
attatc

SEQ ID NO: 126742 - DNA, 6 bp, Unknown
  misc_feature (1)..( 6): Result.003 file - promoters60/2685968
attatc

SEQ ID NO: 126743 - DNA, 9 bp, Unknown
  misc_feature (1)..( 9): Result.003 file - promoters60/2685968
tgttataaa

SEQ ID NO: 126744 - DNA, 9 bp, Unknown
  misc_feature (1)..( 9): Result.003 file - promoters60/2685968
ttttataaa

SEQ ID NO: 126745 - DNA, 9 bp, Unknown
  misc_feature (1)..( 9): Result.003 file - promoters60/2685968
ttttatagg

SEQ ID NO: 126746 - DNA, 7 bp, Unknown
  misc_feature (1)..( 7): Result.003 file - promoters60/2685968
ttcattt

SEQ ID NO: 126747 - DNA, 7 bp, Unknown
  misc_feature (1)..( 7): Result.003 file - promoters60/2685968
ttcattt

SEQ ID NO: 126748 - DNA, 6 bp, Unknown
  misc_feature (1)..( 6): Result.003 file - promoters60/2685968
ttgcat

SEQ ID NO: 126749 - DNA, 6 bp, Unknown
  misc_feature (1)..( 6): Result.003 file - promoters60/2685968
ttgcat

SEQ ID NO: 126750 - DNA, 8 bp, Unknown
  misc_feature (1)..( 8): Result.003 file - promoters60/2685968
aagctaat

SEQ ID NO: 126751 - DNA, 8 bp, Unknown
  misc_feature (1)..( 8): Result.003 file - promoters60/2685968
aagataat

SEQ ID NO: 126752 - DNA, 7 bp, Unknown
  misc_feature (1)..( 7): Result.003 file - promoters60/2685968
tgttaaa

SEQ ID NO: 126753 - DNA, 7 bp, Unknown
  misc_feature (1)..( 7): Result.003 file - promoters60/2685968
tgtcaaa

SEQ ID NO: 126754 - DNA, 6 bp, Unknown
  misc_feature (1)..( 6): Result.003 file - promoters60/2685968
caaaga

SEQ ID NO: 126755 - DNA, 6 bp, Unknown
  misc_feature (1)..( 6): Result.003 file - promoters60/2685968
caaaga

SEQ ID NO: 126756 - DNA, 7 bp, Unknown
  misc_feature (1)..( 7): Result.003 file - promoters60/2685968
aaaaact

SEQ ID NO: 126757 - DNA, 7 bp, Unknown
  misc_feature (1)..( 7): Result.003 file - promoters60/2685968
aaaaact

SEQ ID NO: 126758 - DNA, 6 bp, Unknown
  misc_feature (1)..( 6): Result.003 file - promoters60/2685968
acaaaa

SEQ ID NO: 126759 - DNA, 6 bp, Unknown
  misc_feature (1)..( 6): Result.003 file - promoters60/2685968
acaaaa

SEQ ID NO: 126760 - DNA, 10 bp, Unknown
  misc_feature (1)..( 10): Result.003 file - promoters60/2685968
aaaacaaaac

SEQ ID NO: 126761 - DNA, 10 bp, Unknown
  misc_feature (1)..( 10): Result.003 file - promoters60/2685968
aaaacagaac

SEQ ID NO: 126762 - DNA, 7 bp, Unknown
  misc_feature (1)..( 7): Result.003 file - promoters60/2685968
tttgatt

SEQ ID NO: 126763 - DNA, 7 bp, Unknown
  misc_feature (1)..( 7): Result.003 file - promoters60/2685968
tttgatt

SEQ ID NO: 126764 - DNA, 8 bp, Unknown
  misc_feature (1)..( 8): Result.003 file - promoters60/2685968
aaaaacaa

SEQ ID NO: 126765 - DNA, 8 bp, Unknown
  misc_feature (1)..( 8): Result.003 file - promoters60/2685968
aaaatcaa

SEQ ID NO: 126766 - DNA, 7 bp, Unknown
  misc_feature (1)..( 7): Result.003 file - promoters60/2685968
atttaaa

SEQ ID NO: 126767 - DNA, 7 bp, Unknown
  misc_feature (1)..( 7): Result.003 file - promoters60/2685968
attaaaa

SEQ ID NO: 126768 - DNA, 8 bp, Unknown
  misc_feature (1)..( 8): Result.003 file - promoters60/2686138
ataactta

SEQ ID NO: 126769 - DNA, 8 bp, Unknown
  misc_feature (1)..( 8): Result.003 file - promoters60/2686138
ataattta

SEQ ID NO: 126770 - DNA, 8 bp, Unknown
  misc_feature (1)..( 8): Result.003 file - promoters60/2686138
tataatta

SEQ ID NO: 126771 - DNA, 8 bp, Unknown
  misc_feature (1)..( 8): Result.003 file - promoters60/2686138
tatattta

SEQ ID NO: 126772 - DNA, 10 bp, Unknown
  misc_feature (1)..( 10): Result.003 file - promoters60/2686138
ggtcaaatat

SEQ ID NO: 126773 - DNA, 10 bp, Unknown
  misc_feature (1)..( 10): Result.003 file - promoters60/2686138
aaacaattat

SEQ ID NO: 126774 - DNA, 10 bp, Unknown
  misc_feature (1)..( 10): Result.003 file - promoters60/2686138
aaacgattcc

SEQ ID NO: 126775 - DNA, 8 bp, Unknown
  misc_feature (1)..( 8): Result.003 file - promoters60/2686138
ttgtgttt

SEQ ID NO: 126776 - DNA, 8 bp, Unknown
  misc_feature (1)..( 8): Result.003 file - promoters60/2686138
ttgtattt

SEQ ID NO: 126777 - DNA, 7 bp, Unknown
  misc_feature (1)..( 7): Result.003 file - promoters60/2686138
ataattt

SEQ ID NO: 126778 - DNA, 7 bp, Unknown
  misc_feature (1)..( 7): Result.003 file - promoters60/2686138
atatttt

SEQ ID NO: 126779 - DNA, 7 bp, Unknown
  misc_feature (1)..( 7): Result.003 file - promoters60/2686138
attttgt

SEQ ID NO: 126780 - DNA, 7 bp, Unknown
  misc_feature (1)..( 7): Result.003 file - promoters60/2686138
tttttgt

SEQ ID NO: 126781 - DNA, 7 bp, Unknown
  misc_feature (1)..( 7): Result.003 file - promoters60/2686138
attttgt

SEQ ID NO: 126782 - DNA, 6 bp, Unknown
  misc_feature (1)..( 6): Result.003 file - promoters60/2686138
attcat

SEQ ID NO: 126783 - DNA, 6 bp, Unknown
  misc_feature (1)..( 6): Result.003 file - promoters60/2686138
attcat

SEQ ID NO: 126784 - DNA, 9 bp, Unknown
  misc_feature (1)..( 9): Result.003 file - promoters60/2686138
tataattaa

SEQ ID NO: 126785 - DNA, 9 bp, Unknown
  misc_feature (1)..( 9): Result.003 file - promoters60/2686138
tatgatttc

SEQ ID NO: 126786 - DNA, 9 bp, Unknown
  misc_feature (1)..( 9): Result.003 file - promoters60/2686138
cttaactaa

SEQ ID NO: 126787 - DNA, 6 bp, Unknown
  misc_feature (1)..( 6): Result.003 file - promoters60/2686138
aaaaat

SEQ ID NO: 126788 - DNA, 6 bp, Unknown
  misc_feature (1)..( 6): Result.003 file - promoters60/2686138
aaaaat

SEQ ID NO: 126789 - DNA, 6 bp, Unknown
  misc_feature (1)..( 6): Result.003 file - promoters60/2686138
tgggtt

SEQ ID NO: 126790 - DNA, 6 bp, Unknown
  misc_feature (1)..( 6): Result.003 file - promoters60/2686138
tgggtt

SEQ ID NO: 126791 - DNA, 7 bp, Unknown
  misc_feature (1)..( 7): Result.003 file - promoters60/2686138
aaataaa

SEQ ID NO: 126792 - DNA, 7 bp, Unknown
  misc_feature (1)..( 7): Result.003 file - promoters60/2686138
aaataat

SEQ ID NO: 126793 - DNA, 7 bp, Unknown
  misc_feature (1)..( 7): Result.003 file - promoters60/2686138
taataat

SEQ ID NO: 126794 - DNA, 6 bp, Unknown
  misc_feature (1)..( 6): Result.003 file - promoters60/2686138
acaaaa

SEQ ID NO: 126795 - DNA, 6 bp, Unknown
  misc_feature (1)..( 6): Result.003 file - promoters60/2686138
acaaaa

SEQ ID NO: 126796 - DNA, 7 bp, Unknown
  misc_feature (1)..( 7): Result.003 file - promoters60/2686138
aaagtga

SEQ ID NO: 126797 - DNA, 7 bp, Unknown
  misc_feature (1)..( 7): Result.003 file - promoters60/2686138
aaattga

SEQ ID NO: 126798 - DNA, 8 bp, Unknown
  misc_feature (1)..( 8): Result.003 file - promoters60/2686138
taaataaa

SEQ ID NO: 126799 - DNA, 8 bp, Unknown
  misc_feature (1)..( 8): Result.003 file - promoters60/2686138
taaagaaa

SEQ ID NO: 126800 - DNA, 6 bp, Unknown
  misc_feature (1)..( 6): Result.003 file - promoters60/2686138
aaaaac

SEQ ID NO: 126801 - DNA, 6 bp, Unknown
  misc_feature (1)..( 6): Result.003 file - promoters60/2686138
aaaaac

SEQ ID NO: 126802 - DNA, 7 bp, Unknown
  misc_feature (1)..( 7): Result.003 file - promoters60/2686138
ctaaaat

SEQ ID NO: 126803 - DNA, 7 bp, Unknown
  misc_feature (1)..( 7): Result.003 file - promoters60/2686138
ctacaat

SEQ ID NO: 126804 - DNA, 7 bp, Unknown
  misc_feature (1)..( 7): Result.003 file - promoters60/2686138
ttagtaa

SEQ ID NO: 126805 - DNA, 7 bp, Unknown
  misc_feature (1)..( 7): Result.003 file - promoters60/2686138
ttattaa

SEQ ID NO: 126806 - DNA, 7 bp, Unknown
  misc_feature (1)..( 7): Result.003 file - promoters60/2686138
tcttttc

SEQ ID NO: 126807 - DNA, 7 bp, Unknown
  misc_feature (1)..( 7): Result.003 file - promoters60/2686138
tctgttc

SEQ ID NO: 126808 - DNA, 6 bp, Unknown
  misc_feature (1)..( 6): Result.003 file - promoters60/2724638
tgaaaa

SEQ ID NO: 126809 - DNA, 6 bp, Unknown
  misc_feature (1)..( 6): Result.003 file - promoters60/2724638
tgaaaa

SEQ ID NO: 126810 - DNA, 6 bp, Unknown
  misc_feature (1)..( 6): Result.003 file - promoters60/2724638
ataata

SEQ ID NO: 126811 - DNA, 6 bp, Unknown
  misc_feature (1)..( 6): Result.003 file - promoters60/2724638
ataata

SEQ ID NO: 126812 - DNA, 6 bp, Unknown
  misc_feature (1)..( 6): Result.003 file - promoters60/2724638
acagaa

SEQ ID NO: 126813 - DNA, 6 bp, Unknown
  misc_feature (1)..( 6): Result.003 file - promoters60/2724638
acagaa

SEQ ID NO: 126814 - DNA, 12 bp, Unknown
  misc_feature (1)..( 12): Result.003 file - promoters60/2724638
aaaaattgttgt

SEQ ID NO: 126815 - DNA, 12 bp, Unknown
  misc_feature (1)..( 12): Result.003 file - promoters60/2724638
aaatattggggc

SEQ ID NO: 126816 - DNA, 12 bp, Unknown
  misc_feature (1)..( 12): Result.003 file - promoters60/2724638
atatatttgggc

SEQ ID NO: 126817 - DNA, 7 bp, Unknown
  misc_feature (1)..( 7): Result.003 file - promoters60/2724638
gttaaaa

SEQ ID NO: 126818 - DNA, 7 bp, Unknown
  misc_feature (1)..( 7): Result.003 file - promoters60/2724638
gttgaaa

SEQ ID NO: 126819 - DNA, 9 bp, Unknown
  misc_feature (1)..( 9): Result.003 file - promoters60/2724638
agtgagaca

SEQ ID NO: 126820 - DNA, 9 bp, Unknown
  misc_feature (1)..( 9): Result.003 file - promoters60/2724638
agtgaaaca

SEQ ID NO: 126821 - DNA, 6 bp, Unknown
  misc_feature (1)..( 6): Result.003 file - promoters60/2724638
acaaaa

SEQ ID NO: 126822 - DNA, 6 bp, Unknown
  misc_feature (1)..( 6): Result.003 file - promoters60/2724638
acaaaa

SEQ ID NO: 126823 - DNA, 9 bp, Unknown
  misc_feature (1)..( 9): Result.003 file - promoters60/2724638
atattatat

SEQ ID NO: 126824 - DNA, 9 bp, Unknown
  misc_feature (1)..( 9): Result.003 file - promoters60/2724638
atagtatat

SEQ ID NO: 126825 - DNA, 19 bp, Unknown
  misc_feature (1)..( 19): Result.003 file - promoters60/2724699
aacaaactacaaaagttta

SEQ ID NO: 126826 - DNA, 13 bp, Unknown
  misc_feature (1)..( 13): Result.003 file - promoters60/2724699
cagaaaatgtttt

SEQ ID NO: 126827 - DNA, 19 bp, Unknown
  misc_feature (1)..( 19): Result.003 file - promoters60/2724699
agtttagggaaaatggatc

SEQ ID NO: 126828 - DNA, 19 bp, Unknown
  misc_feature (1)..( 19): Result.003 file - promoters60/2724699
ccaacacattcaatatttt

SEQ ID NO: 126829 - DNA, 15 bp, Unknown
  misc_feature (1)..( 15): Result.003 file - promoters60/2724699
atcactgatccaaca

SEQ ID NO: 126830 - DNA, 15 bp, Unknown
  misc_feature (1)..( 15): Result.003 file - promoters60/2724699
atcactgatccaaca

SEQ ID NO: 126831 - DNA, 15 bp, Unknown
  misc_feature (1)..( 15): Result.003 file - promoters60/2724699
atcactgatccaaca

SEQ ID NO: 126832 - DNA, 7 bp, Unknown
  misc_feature (1)..( 7): Result.003 file - promoters60/2724699
aattatc

SEQ ID NO: 126833 - DNA, 7 bp, Unknown
  misc_feature (1)..( 7): Result.003 file - promoters60/2724699
cattatc

SEQ ID NO: 126834 - DNA, 7 bp, Unknown
  misc_feature (1)..( 7): Result.003 file - promoters60/2724699
cattata

SEQ ID NO: 126835 - DNA, 7 bp, Unknown
  misc_feature (1)..( 7): Result.003 file - promoters60/2724699
aattatc

SEQ ID NO: 126836 - DNA, 10 bp, Unknown
  misc_feature (1)..( 10): Result.003 file - promoters60/2724703
tgtgttttct

SEQ ID NO: 126837 - DNA, 10 bp, Unknown
  misc_feature (1)..( 10): Result.003 file - promoters60/2724703
tgtgttttta

SEQ ID NO: 126838 - DNA, 10 bp, Unknown
  misc_feature (1)..( 10): Result.003 file - promoters60/2724703
attgttttta

SEQ ID NO: 126839 - DNA, 7 bp, Unknown
  misc_feature (1)..( 7): Result.003 file - promoters60/2724703
ctttggt

SEQ ID NO: 126840 - DNA, 7 bp, Unknown
  misc_feature (1)..( 7): Result.003 file - promoters60/2724703
ttttggt

SEQ ID NO: 126841 - DNA, 7 bp, Unknown
  misc_feature (1)..( 7): Result.003 file - promoters60/2724703
ttttgga

SEQ ID NO: 126842 - DNA, 8 bp, Unknown
  misc_feature (1)..( 8): Result.003 file - promoters60/2724703
ttatccca

SEQ ID NO: 126843 - DNA, 8 bp, Unknown
  misc_feature (1)..( 8): Result.003 file - promoters60/2724703
ttaaccca

SEQ ID NO: 126844 - DNA, 8 bp, Unknown
  misc_feature (1)..( 8): Result.003 file - promoters60/2724703
ataaccct

SEQ ID NO: 126845 - DNA, 7 bp, Unknown
  misc_feature (1)..( 7): Result.003 file - promoters60/2724703
agagatt

SEQ ID NO: 126846 - DNA, 7 bp, Unknown
  misc_feature (1)..( 7): Result.003 file - promoters60/2724703
agagata

SEQ ID NO: 126847 - DNA, 7 bp, Unknown
  misc_feature (1)..( 7): Result.003 file - promoters60/2724703
agatata

SEQ ID NO: 126848 - DNA, 9 bp, Unknown
  misc_feature (1)..( 9): Result.003 file - promoters60/2724703
tgatcacct

SEQ ID NO: 126849 - DNA, 9 bp, Unknown
  misc_feature (1)..( 9): Result.003 file - promoters60/2724703
tgataaccc

SEQ ID NO: 126850 - DNA, 9 bp, Unknown
  misc_feature (1)..( 9): Result.003 file - promoters60/2724703
gtttaaccc

SEQ ID NO: 126851 - DNA, 8 bp, Unknown
  misc_feature (1)..( 8): Result.003 file - promoters60/2724703
tctcagag

SEQ ID NO: 126852 - DNA, 8 bp, Unknown
  misc_feature (1)..( 8): Result.003 file - promoters60/2724703
tctaagat

SEQ ID NO: 126853 - DNA, 8 bp, Unknown
  misc_feature (1)..( 8): Result.003 file - promoters60/2724703
tatcagag

SEQ ID NO: 126854 - DNA, 12 bp, Unknown
  misc_feature (1)..( 12): Result.003 file - promoters60/2724703
tgtatcaaaacg

SEQ ID NO: 126855 - DNA, 12 bp, Unknown
  misc_feature (1)..( 12): Result.003 file - promoters60/2724703
aaaaacaaaaca

SEQ ID NO: 126856 - DNA, 12 bp, Unknown
  misc_feature (1)..( 12): Result.003 file - promoters60/2724703
aaacacaataca

SEQ ID NO: 126857 - DNA, 9 bp, Unknown
  misc_feature (1)..( 9): Result.003 file - promoters60/2724703
tatttaaaa

SEQ ID NO: 126858 - DNA, 9 bp, Unknown
  misc_feature (1)..( 9): Result.003 file - promoters60/2724703
tatttatcc

SEQ ID NO: 126859 - DNA, 9 bp, Unknown
  misc_feature (1)..( 9): Result.003 file - promoters60/2724703
aattaaaaa

SEQ ID NO: 126860 - DNA, 8 bp, Unknown
  misc_feature (1)..( 8): Result.003 file - promoters60/2724703
aaagactg

SEQ ID NO: 126861 - DNA, 8 bp, Unknown
  misc_feature (1)..( 8): Result.003 file - promoters60/2724703
aaaaacta

SEQ ID NO: 126862 - DNA, 8 bp, Unknown
  misc_feature (1)..( 8): Result.003 file - promoters60/2724703
aaaataag

SEQ ID NO: 126863 - DNA, 10 bp, Unknown
  misc_feature (1)..( 10): Result.003 file - promoters60/2724724
tatgacttga

SEQ ID NO: 126864 - DNA, 10 bp, Unknown
  misc_feature (1)..( 10): Result.003 file - promoters60/2724724
tatcacttgt

SEQ ID NO: 126865 - DNA, 10 bp, Unknown
  misc_feature (1)..( 10): Result.003 file - promoters60/2724724
gataacttga

SEQ ID NO: 126866 - DNA, 7 bp, Unknown
  misc_feature (1)..( 7): Result.003 file - promoters60/2724724
ttataca

SEQ ID NO: 126867 - DNA, 7 bp, Unknown
  misc_feature (1)..( 7): Result.003 file - promoters60/2724724
ttaaaca

SEQ ID NO: 126868 - DNA, 6 bp, Unknown
  misc_feature (1)..( 6): Result.003 file - promoters60/2724724
ctttat

SEQ ID NO: 126869 - DNA, 6 bp, Unknown
  misc_feature (1)..( 6): Result.003 file - promoters60/2724724
ctttat

SEQ ID NO: 126870 - DNA, 12 bp, Unknown
  misc_feature (1)..( 12): Result.003 file - promoters60/2724724
tcataaagaaat

SEQ ID NO: 126871 - DNA, 12 bp, Unknown
  misc_feature (1)..( 12): Result.003 file - promoters60/2724724
tcaaaaagcaat

SEQ ID NO: 126872 - DNA, 8 bp, Unknown
  misc_feature (1)..( 8): Result.003 file - promoters60/2724724
aaataaaa

SEQ ID NO: 126873 - DNA, 8 bp, Unknown
  misc_feature (1)..( 8): Result.003 file - promoters60/2724724
caataaaa

SEQ ID NO: 126874 - DNA, 8 bp, Unknown
  misc_feature (1)..( 8): Result.003 file - promoters60/2724724
aaacaaaa

SEQ ID NO: 126875 - DNA, 10 bp, Unknown
  misc_feature (1)..( 10): Result.003 file - promoters60/2724724
agcaaaaata

SEQ ID NO: 126876 - DNA, 10 bp, Unknown
  misc_feature (1)..( 10): Result.003 file - promoters60/2724724
aaagaaaata

SEQ ID NO: 126877 - DNA, 10 bp, Unknown
  misc_feature (1)..( 10): Result.003 file - promoters60/2724724
aaatgaaata

SEQ ID NO: 126878 - DNA, 9 bp, Unknown
  misc_feature (1)..( 9): Result.003 file - promoters60/2724724
aatattttc

SEQ ID NO: 126879 - DNA, 9 bp, Unknown
  misc_feature (1)..( 9): Result.003 file - promoters60/2724724
aatattttc

SEQ ID NO: 126880 - DNA, 8 bp, Unknown
  misc_feature (1)..( 8): Result.003 file - promoters60/2724724
tcataaaa

SEQ ID NO: 126881 - DNA, 8 bp, Unknown
  misc_feature (1)..( 8): Result.003 file - promoters60/2724724
tcacaaaa

SEQ ID NO: 126882 - DNA, 7 bp, Unknown
  misc_feature (1)..( 7): Result.003 file - promoters60/2724724
aaacgaa

SEQ ID NO: 126883 - DNA, 7 bp, Unknown
  misc_feature (1)..( 7): Result.003 file - promoters60/2724724
aaatgaa

SEQ ID NO: 126884 - DNA, 6 bp, Unknown
  misc_feature (1)..( 6): Result.003 file - promoters60/2724724
ctggtt

SEQ ID NO: 126885 - DNA, 6 bp, Unknown
  misc_feature (1)..( 6): Result.003 file - promoters60/2724724
ctggtt

SEQ ID NO: 126886 - DNA, 7 bp, Unknown
  misc_feature (1)..( 7): Result.003 file - promoters60/2724724
tatttga

SEQ ID NO: 126887 - DNA, 7 bp, Unknown
  misc_feature (1)..( 7): Result.003 file - promoters60/2724724
tatctga

SEQ ID NO: 126888 - DNA, 7 bp, Unknown
  misc_feature (1)..( 7): Result.003 file - promoters60/2724724
caaagag

SEQ ID NO: 126889 - DNA, 7 bp, Unknown
  misc_feature (1)..( 7): Result.003 file - promoters60/2724724
caaagag

SEQ ID NO: 126890 - DNA, 8 bp, Unknown
  misc_feature (1)..( 8): Result.003 file - promoters60/2724724
tttgaatt

SEQ ID NO: 126891 - DNA, 8 bp, Unknown
  misc_feature (1)..( 8): Result.003 file - promoters60/2724724
ttttaatt

SEQ ID NO: 126892 - DNA, 8 bp, Unknown
  misc_feature (1)..( 8): Result.003 file - promoters60/2724724
ttttattt

SEQ ID NO: 126893 - DNA, 8 bp, Unknown
  misc_feature (1)..( 8): Result.003 file - promoters60/2724724
ttttgttt

SEQ ID NO: 126894 - DNA, 6 bp, Unknown
  misc_feature (1)..( 6): Result.003 file - promoters60/2724724
actaaa

SEQ ID NO: 126895 - DNA, 6 bp, Unknown
  misc_feature (1)..( 6): Result.003 file - promoters60/2724724
actaaa

SEQ ID NO: 126896 - DNA, 8 bp, Unknown
  misc_feature (1)..( 8): Result.003 file - promoters60/2724724
accattaa

SEQ ID NO: 126897 - DNA, 8 bp, Unknown
  misc_feature (1)..( 8): Result.003 file - promoters60/2724724
cccactaa

SEQ ID NO: 126898 - DNA, 8 bp, Unknown
  misc_feature (1)..( 8): Result.003 file - promoters60/2724724
cccactag

SEQ ID NO: 126899 - DNA, 9 bp, Unknown
  misc_feature (1)..( 9): Result.003 file - promoters60/2724724
taacccaag

SEQ ID NO: 126900 - DNA, 9 bp, Unknown
  misc_feature (1)..( 9): Result.003 file - promoters60/2724724
taaaccaag

SEQ ID NO: 126901 - DNA, 6 bp, Unknown
  misc_feature (1)..( 6): Result.003 file - promoters60/2724724
actaaa

SEQ ID NO: 126902 - DNA, 6 bp, Unknown
  misc_feature (1)..( 6): Result.003 file - promoters60/2724724
actaaa

SEQ ID NO: 126903 - DNA, 6 bp, Unknown
  misc_feature (1)..( 6): Result.003 file - promoters60/2724724
agtaaa

SEQ ID NO: 126904 - DNA, 6 bp, Unknown
  misc_feature (1)..( 6): Result.003 file - promoters60/2724724
agtaaa

SEQ ID NO: 126905 - DNA, 7 bp, Unknown
  misc_feature (1)..( 7): Result.003 file - promoters60/2724724
aatcggg

SEQ ID NO: 126906 - DNA, 7 bp, Unknown
  misc_feature (1)..( 7): Result.003 file - promoters60/2724724
aattggg

SEQ ID NO: 126907 - DNA, 10 bp, Unknown
  misc_feature (1)..( 10): Result.003 file - promoters60/2724724
ggaaaagaaa

SEQ ID NO: 126908 - DNA, 10 bp, Unknown
  misc_feature (1)..( 10): Result.003 file - promoters60/2724724
ggaaatgaaa

SEQ ID NO: 126909 - DNA, 9 bp, Unknown
  misc_feature (1)..( 9): Result.003 file - promoters60/2724724
aaagaaaag

SEQ ID NO: 126910 - DNA, 9 bp, Unknown
  misc_feature (1)..( 9): Result.003 file - promoters60/2724724
aaagtaaag

SEQ ID NO: 126911 - DNA, 7 bp, Unknown
  misc_feature (1)..( 7): Result.003 file - promoters60/2724724
gtatata

SEQ ID NO: 126912 - DNA, 7 bp, Unknown
  misc_feature (1)..( 7): Result.003 file - promoters60/2724724
gtatata

SEQ ID NO: 126913 - DNA, 6 bp, Unknown
  misc_feature (1)..( 6): Result.003 file - promoters60/2724736
aagatt

SEQ ID NO: 126914 - DNA, 6 bp, Unknown
  misc_feature (1)..( 6): Result.003 file - promoters60/2724736
aagatt

SEQ ID NO: 126915 - DNA, 7 bp, Unknown
  misc_feature (1)..( 7): Result.003 file - promoters60/2724736
aaagatg

SEQ ID NO: 126916 - DNA, 7 bp, Unknown
  misc_feature (1)..( 7): Result.003 file - promoters60/2724736
aaaaatg

SEQ ID NO: 126917 - DNA, 7 bp, Unknown
  misc_feature (1)..( 7): Result.003 file - promoters60/2724736
caaattg

SEQ ID NO: 126918 - DNA, 7 bp, Unknown
  misc_feature (1)..( 7): Result.003 file - promoters60/2724736
caatttg

SEQ ID NO: 126919 - DNA, 8 bp, Unknown
  misc_feature (1)..( 8): Result.003 file - promoters60/2724736
tgattagg

SEQ ID NO: 126920 - DNA, 8 bp, Unknown
  misc_feature (1)..( 8): Result.003 file - promoters60/2724736
tgactagg

SEQ ID NO: 126921 - DNA, 6 bp, Unknown
  misc_feature (1)..( 6): Result.003 file - promoters60/2724736
aatcct

SEQ ID NO: 126922 - DNA, 6 bp, Unknown
  misc_feature (1)..( 6): Result.003 file - promoters60/2724736
aatcct

SEQ ID NO: 126923 - DNA, 7 bp, Unknown
  misc_feature (1)..( 7): Result.003 file - promoters60/2724736
cacgtgt

SEQ ID NO: 126924 - DNA, 7 bp, Unknown
  misc_feature (1)..( 7): Result.003 file - promoters60/2724736
cacgtgt

SEQ ID NO: 126925 - DNA, 7 bp, Unknown
  misc_feature (1)..( 7): Result.003 file - promoters60/2724736
aaaaaga

SEQ ID NO: 126926 - DNA, 7 bp, Unknown
  misc_feature (1)..( 7): Result.003 file - promoters60/2724736
aaataga

SEQ ID NO: 126927 - DNA, 6 bp, Unknown
  misc_feature (1)..( 6): Result.003 file - promoters60/2724736
agattc

SEQ ID NO: 126928 - DNA, 6 bp, Unknown
  misc_feature (1)..( 6): Result.003 file - promoters60/2724736
agattc

SEQ ID NO: 126929 - DNA, 7 bp, Unknown
  misc_feature (1)..( 7): Result.003 file - promoters60/2724736
aatccaa

SEQ ID NO: 126930 - DNA, 7 bp, Unknown
  misc_feature (1)..( 7): Result.003 file - promoters60/2724736
aatacaa

SEQ ID NO: 126931 - DNA, 7 bp, Unknown
  misc_feature (1)..( 7): Result.003 file - promoters60/2724736
ccatatg

SEQ ID NO: 126932 - DNA, 7 bp, Unknown
  misc_feature (1)..( 7): Result.003 file - promoters60/2724736
ccagatg

SEQ ID NO: 126933 - DNA, 7 bp, Unknown
  misc_feature (1)..( 7): Result.003 file - promoters60/2724736
gatcata

SEQ ID NO: 126934 - DNA, 7 bp, Unknown
  misc_feature (1)..( 7): Result.003 file - promoters60/2724736
gataata

SEQ ID NO: 126935 - DNA, 7 bp, Unknown
  misc_feature (1)..( 7): Result.003 file - promoters60/2724736
aaacttt

SEQ ID NO: 126936 - DNA, 7 bp, Unknown
  misc_feature (1)..( 7): Result.003 file - promoters60/2724736
aaaattt

SEQ ID NO: 126937 - DNA, 12 bp, Unknown
  misc_feature (1)..( 12): Result.003 file - promoters60/2724736
tttaacaataag

SEQ ID NO: 126938 - DNA, 12 bp, Unknown
  misc_feature (1)..( 12): Result.003 file - promoters60/2724736
tttagcaaaaag

SEQ ID NO: 126939 - DNA, 10 bp, Unknown
  misc_feature (1)..( 10): Result.003 file - promoters60/2724736
agatattatc

SEQ ID NO: 126940 - DNA, 10 bp, Unknown
  misc_feature (1)..( 10): Result.003 file - promoters60/2724736
agatatcatc

SEQ ID NO: 126941 - DNA, 7 bp, Unknown
  misc_feature (1)..( 7): Result.003 file - promoters60/2724736
caattaa

SEQ ID NO: 126942 - DNA, 7 bp, Unknown
  misc_feature (1)..( 7): Result.003 file - promoters60/2724736
caattaa

SEQ ID NO: 126943 - DNA, 7 bp, Unknown
  misc_feature (1)..( 7): Result.003 file - promoters60/2724736
cagccac

SEQ ID NO: 126944 - DNA, 7 bp, Unknown
  misc_feature (1)..( 7): Result.003 file - promoters60/2724736
cagccac

SEQ ID NO: 126945 - DNA, 11 bp, Unknown
  misc_feature (1)..( 11): Result.003 file - promoters60/2781251
tattcgtaaaa

SEQ ID NO: 126946 - DNA, 11 bp, Unknown
  misc_feature (1)..( 11): Result.003 file - promoters60/2781251
atatcgtaatc

SEQ ID NO: 126947 - DNA, 11 bp, Unknown
  misc_feature (1)..( 11): Result.003 file - promoters60/2781251
aaatcgaaatc

SEQ ID NO: 126948 - DNA, 11 bp, Unknown
  misc_feature (1)..( 11): Result.003 file - promoters60/2781251
gaatcgatagc

SEQ ID NO: 126949 - DNA, 11 bp, Unknown
  misc_feature (1)..( 11): Result.003 file - promoters60/2781251
aaatagatatc

SEQ ID NO: 126950 - DNA, 11 bp, Unknown
  misc_feature (1)..( 11): Result.003 file - promoters60/2781251
aaagagattaa

SEQ ID NO: 126951 - DNA, 10 bp, Unknown
  misc_feature (1)..( 10): Result.003 file - promoters60/2781251
cttctttagg

SEQ ID NO: 126952 - DNA, 10 bp, Unknown
  misc_feature (1)..( 10): Result.003 file - promoters60/2781251
cttcttctgc

SEQ ID NO: 126953 - DNA, 10 bp, Unknown
  misc_feature (1)..( 10): Result.003 file - promoters60/2781251
gttctctaga

SEQ ID NO: 126954 - DNA, 10 bp, Unknown
  misc_feature (1)..( 10): Result.003 file - promoters60/2781251
cttctttaac

SEQ ID NO: 126955 - DNA, 10 bp, Unknown
  misc_feature (1)..( 10): Result.003 file - promoters60/2781251
attcttcatc

SEQ ID NO: 126956 - DNA, 10 bp, Unknown
  misc_feature (1)..( 10): Result.003 file - promoters60/2781251
gttcttaaac

SEQ ID NO: 126957 - DNA, 9 bp, Unknown
  misc_feature (1)..( 9): Result.003 file - promoters60/2781786
taatgggat

SEQ ID NO: 126958 - DNA, 9 bp, Unknown
  misc_feature (1)..( 9): Result.003 file - promoters60/2781786
caattggat

SEQ ID NO: 126959 - DNA, 9 bp, Unknown
  misc_feature (1)..( 9): Result.003 file - promoters60/2781786
caattgaaa

SEQ ID NO: 126960 - DNA, 6 bp, Unknown
  misc_feature (1)..( 6): Result.003 file - promoters60/2781786
taagta

SEQ ID NO: 126961 - DNA, 6 bp, Unknown
  misc_feature (1)..( 6): Result.003 file - promoters60/2781786
taagta

SEQ ID NO: 126962 - DNA, 6 bp, Unknown
  misc_feature (1)..( 6): Result.003 file - promoters60/2781786
ctttgc

SEQ ID NO: 126963 - DNA, 6 bp, Unknown
  misc_feature (1)..( 6): Result.003 file - promoters60/2781786
ctttgc

SEQ ID NO: 126964 - DNA, 6 bp, Unknown
  misc_feature (1)..( 6): Result.003 file - promoters60/2781786
ggtgag

SEQ ID NO: 126965 - DNA, 6 bp, Unknown
  misc_feature (1)..( 6): Result.003 file - promoters60/2781786
ggtgag

SEQ ID NO: 126966 - DNA, 11 bp, Unknown
  misc_feature (1)..( 11): Result.003 file - promoters60/2781786
ctgaaaattta

SEQ ID NO: 126967 - DNA, 11 bp, Unknown
  misc_feature (1)..( 11): Result.003 file - promoters60/2781786
ctgaaacttta

SEQ ID NO: 126968 - DNA, 12 bp, Unknown
  misc_feature (1)..( 12): Result.003 file - promoters60/2785798
cctttcaatgag

SEQ ID NO: 126969 - DNA, 12 bp, Unknown
  misc_feature (1)..( 12): Result.003 file - promoters60/2785798
ttttttaatacg

SEQ ID NO: 126970 - DNA, 12 bp, Unknown
  misc_feature (1)..( 12): Result.003 file - promoters60/2785798
aagatcaaggag

SEQ ID NO: 126971 - DNA, 12 bp, Unknown
  misc_feature (1)..( 12): Result.003 file - promoters60/2785798
tttgttaaacta

SEQ ID NO: 126972 - DNA, 10 bp, Unknown
  misc_feature (1)..( 10): Result.003 file - promoters60/2785798
aatgaaaatt

SEQ ID NO: 126973 - DNA, 10 bp, Unknown
  misc_feature (1)..( 10): Result.003 file - promoters60/2785798
tatgcaaatc

SEQ ID NO: 126974 - DNA, 10 bp, Unknown
  misc_feature (1)..( 10): Result.003 file - promoters60/2785798
gttgacaatt

SEQ ID NO: 126975 - DNA, 10 bp, Unknown
  misc_feature (1)..( 10): Result.003 file - promoters60/2785798
tatccaaatt

SEQ ID NO: 126976 - DNA, 10 bp, Unknown
  misc_feature (1)..( 10): Result.003 file - promoters60/2785798
gttgacataa

SEQ ID NO: 126977 - DNA, 9 bp, Unknown
  misc_feature (1)..( 9): Result.003 file - promoters60/2785798
gttattttt

SEQ ID NO: 126978 - DNA, 9 bp, Unknown
  misc_feature (1)..( 9): Result.003 file - promoters60/2785798
aatatttta

SEQ ID NO: 126979 - DNA, 9 bp, Unknown
  misc_feature (1)..( 9): Result.003 file - promoters60/2785798
tttattttt

SEQ ID NO: 126980 - DNA, 9 bp, Unknown
  misc_feature (1)..( 9): Result.003 file - promoters60/2785798
cttaattta

SEQ ID NO: 126981 - DNA, 10 bp, Unknown
  misc_feature (1)..( 10): Result.003 file - promoters60/2785798
aagtaaaggg

SEQ ID NO: 126982 - DNA, 10 bp, Unknown
  misc_feature (1)..( 10): Result.003 file - promoters60/2785798
aagttaagtc

SEQ ID NO: 126983 - DNA, 10 bp, Unknown
  misc_feature (1)..( 10): Result.003 file - promoters60/2785798
tctttaagtc

SEQ ID NO: 126984 - DNA, 10 bp, Unknown
  misc_feature (1)..( 10): Result.003 file - promoters60/2785798
aagttaaaac

SEQ ID NO: 126985 - DNA, 7 bp, Unknown
  misc_feature (1)..( 7): Result.003 file - promoters60/2918658
aaaatat

SEQ ID NO: 126986 - DNA, 7 bp, Unknown
  misc_feature (1)..( 7): Result.003 file - promoters60/2918658
aaaataa

SEQ ID NO: 126987 - DNA, 8 bp, Unknown
  misc_feature (1)..( 8): Result.003 file - promoters60/2918658
aaacatat

SEQ ID NO: 126988 - DNA, 8 bp, Unknown
  misc_feature (1)..( 8): Result.003 file - promoters60/2918658
aaaaatct

SEQ ID NO: 126989 - DNA, 8 bp, Unknown
  misc_feature (1)..( 8): Result.003 file - promoters60/2918658
caaattaa

SEQ ID NO: 126990 - DNA, 8 bp, Unknown
  misc_feature (1)..( 8): Result.003 file - promoters60/2918658
taaaatat

SEQ ID NO: 126991 - DNA, 11 bp, Unknown
  misc_feature (1)..( 11): Result.003 file - promoters60/2918658
aaaacaaacgt

SEQ ID NO: 126992 - DNA, 11 bp, Unknown
  misc_feature (1)..( 11): Result.003 file - promoters60/2918658
aaaaaaaagac

SEQ ID NO: 126993 - DNA, 11 bp, Unknown
  misc_feature (1)..( 11): Result.003 file - promoters60/2918658
aaaaaaagaag

SEQ ID NO: 126994 - DNA, 11 bp, Unknown
  misc_feature (1)..( 11): Result.003 file - promoters60/2918658
taaataaattt

SEQ ID NO: 126995 - DNA, 11 bp, Unknown
  misc_feature (1)..( 11): Result.003 file - promoters60/2918658
attacaaatat

SEQ ID NO: 126996 - DNA, 11 bp, Unknown
  misc_feature (1)..( 11): Result.003 file - promoters60/2918658
gaaatgaattt

SEQ ID NO: 126997 - DNA, 10 bp, Unknown
  misc_feature (1)..( 10): Result.003 file - promoters60/2918658
ctacatattc

SEQ ID NO: 126998 - DNA, 10 bp, Unknown
  misc_feature (1)..( 10): Result.003 file - promoters60/2918658
aaacatattg

SEQ ID NO: 126999 - DNA, 10 bp, Unknown
  misc_feature (1)..( 10): Result.003 file - promoters60/2918658
aatcatattt

SEQ ID NO: 127000 - DNA, 10 bp, Unknown
  misc_feature (1)..( 10): Result.003 file - promoters60/2918658
taaaatattc

SEQ ID NO: 127001 - DNA, 10 bp, Unknown
  misc_feature (1)..( 10): Result.003 file - promoters60/2918658
aaaaataaga

SEQ ID NO: 127002 - DNA, 10 bp, Unknown
  misc_feature (1)..( 10): Result.003 file - promoters60/2918658
aaaaatctaa

SEQ ID NO: 127003 - DNA, 12 bp, Unknown
  misc_feature (1)..( 12): Result.003 file - promoters60/2918658
tttaacaaaaaa

SEQ ID NO: 127004 - DNA, 12 bp, Unknown
  misc_feature (1)..( 12): Result.003 file - promoters60/2918658
aaaaacaaactg

SEQ ID NO: 127005 - DNA, 12 bp, Unknown
  misc_feature (1)..( 12): Result.003 file - promoters60/2918658
cgtaataaaaaa

SEQ ID NO: 127006 - DNA, 12 bp, Unknown
  misc_feature (1)..( 12): Result.003 file - promoters60/2918658
aaagacaaaaaa

SEQ ID NO: 127007 - DNA, 12 bp, Unknown
  misc_feature (1)..( 12): Result.003 file - promoters60/2918658
ggaaacacttat

SEQ ID NO: 127008 - DNA, 13 bp, Unknown
  misc_feature (1)..( 13): Result.003 file - promoters60/2918658
cataattaaactc

SEQ ID NO: 127009 - DNA, 13 bp, Unknown
  misc_feature (1)..( 13): Result.003 file - promoters60/2918658
ttcaattaacttc

SEQ ID NO: 127010 - DNA, 9 bp, Unknown
  misc_feature (1)..( 9): Result.003 file - promoters60/2918658
aaatgtcaa

SEQ ID NO: 127011 - DNA, 9 bp, Unknown
  misc_feature (1)..( 9): Result.003 file - promoters60/2918658
taatctcac

SEQ ID NO: 127012 - DNA, 9 bp, Unknown
  misc_feature (1)..( 9): Result.003 file - promoters60/2918658
aaatgtagt

SEQ ID NO: 127013 - DNA, 9 bp, Unknown
  misc_feature (1)..( 9): Result.003 file - promoters60/2918658
aaatatcaa

SEQ ID NO: 127014 - DNA, 10 bp, Unknown
  misc_feature (1)..( 10): Result.003 file - promoters60/2918658
aaattgttta

SEQ ID NO: 127015 - DNA, 10 bp, Unknown
  misc_feature (1)..( 10): Result.003 file - promoters60/2918658
tttttattct

SEQ ID NO: 127016 - DNA, 8 bp, Unknown
  misc_feature (1)..( 8): Result.003 file - promoters60/2918658
atttattt

SEQ ID NO: 127017 - DNA, 8 bp, Unknown
  misc_feature (1)..( 8): Result.003 file - promoters60/2918658
attcattt

SEQ ID NO: 127018 - DNA, 8 bp, Unknown
  misc_feature (1)..( 8): Result.003 file - promoters60/2918658
gtttattt

SEQ ID NO: 127019 - DNA, 8 bp, Unknown
  misc_feature (1)..( 8): Result.003 file - promoters60/2918658
ttttattc

SEQ ID NO: 127020 - DNA, 8 bp, Unknown
  misc_feature (1)..( 8): Result.003 file - promoters60/2918658
attcatcc

SEQ ID NO: 127021 - DNA, 8 bp, Unknown
  misc_feature (1)..( 8): Result.003 file - promoters60/2918658
attaatct

SEQ ID NO: 127022 - DNA, 8 bp, Unknown
  misc_feature (1)..( 8): Result.003 file - promoters60/2918674
tcatttca

SEQ ID NO: 127023 - DNA, 8 bp, Unknown
  misc_feature (1)..( 8): Result.003 file - promoters60/2918674
tcattttc

SEQ ID NO: 127024 - DNA, 8 bp, Unknown
  misc_feature (1)..( 8): Result.003 file - promoters60/2918674
tcacttca

SEQ ID NO: 127025 - DNA, 8 bp, Unknown
  misc_feature (1)..( 8): Result.003 file - promoters60/2918674
tcaattcc

SEQ ID NO: 127026 - DNA, 8 bp, Unknown
  misc_feature (1)..( 8): Result.003 file - promoters60/2918674
gtaaaaat

SEQ ID NO: 127027 - DNA, 8 bp, Unknown
  misc_feature (1)..( 8): Result.003 file - promoters60/2918674
gtaaaagg

SEQ ID NO: 127028 - DNA, 8 bp, Unknown
  misc_feature (1)..( 8): Result.003 file - promoters60/2918674
ataaaaat

SEQ ID NO: 127029 - DNA, 12 bp, Unknown
  misc_feature (1)..( 12): Result.003 file - promoters60/2918680
tttatgggccgt

SEQ ID NO: 127030 - DNA, 12 bp, Unknown
  misc_feature (1)..( 12): Result.003 file - promoters60/2918680
caaatgggccta

SEQ ID NO: 127031 - DNA, 12 bp, Unknown
  misc_feature (1)..( 12): Result.003 file - promoters60/2918680
acaatgggctgg

SEQ ID NO: 127032 - DNA, 12 bp, Unknown
  misc_feature (1)..( 12): Result.003 file - promoters60/2918680
gaaataggccca

SEQ ID NO: 127033 - DNA, 12 bp, Unknown
  misc_feature (1)..( 12): Result.003 file - promoters60/2918680
taaaaaggccca

SEQ ID NO: 127034 - DNA, 12 bp, Unknown
  misc_feature (1)..( 12): Result.003 file - promoters60/2918680
taaaaaatatct

SEQ ID NO: 127035 - DNA, 15 bp, Unknown
  misc_feature (1)..( 15): Result.003 file - promoters60/2989991
aaatcatctcaatgc

SEQ ID NO: 127036 - DNA, 15 bp, Unknown
  misc_feature (1)..( 15): Result.003 file - promoters60/2989991
aaatcatctcaatgc

SEQ ID NO: 127037 - DNA, 7 bp, Unknown
  misc_feature (1)..( 7): Result.003 file - promoters60/2989991
catcata

SEQ ID NO: 127038 - DNA, 7 bp, Unknown
  misc_feature (1)..( 7): Result.003 file - promoters60/2989991
cataata

SEQ ID NO: 127039 - DNA, 8 bp, Unknown
  misc_feature (1)..( 8): Result.003 file - promoters60/2989991
caagaaca

SEQ ID NO: 127040 - DNA, 8 bp, Unknown
  misc_feature (1)..( 8): Result.003 file - promoters60/2989991
caataaca

SEQ ID NO: 127041 - DNA, 6 bp, Unknown
  misc_feature (1)..( 6): Result.003 file - promoters60/2989991
aattaa

SEQ ID NO: 127042 - DNA, 6 bp, Unknown
  misc_feature (1)..( 6): Result.003 file - promoters60/2989991
aattaa

SEQ ID NO: 127043 - DNA, 9 bp, Unknown
  misc_feature (1)..( 9): Result.003 file - promoters60/2989991
gatgaagaa

SEQ ID NO: 127044 - DNA, 9 bp, Unknown
  misc_feature (1)..( 9): Result.003 file - promoters60/2989991
attgatgaa

SEQ ID NO: 127045 - DNA, 9 bp, Unknown
  misc_feature (1)..( 9): Result.003 file - promoters60/2989991
gatgcagat

SEQ ID NO: 127046 - DNA, 6 bp, Unknown
  misc_feature (1)..( 6): Result.003 file - promoters60/2989991
ctctct

SEQ ID NO: 127047 - DNA, 6 bp, Unknown
  misc_feature (1)..( 6): Result.003 file - promoters60/2989991
ctctct

SEQ ID NO: 127048 - DNA, 7 bp, Unknown
  misc_feature (1)..( 7): Result.003 file - promoters60/2989991
tcgaatt

SEQ ID NO: 127049 - DNA, 7 bp, Unknown
  misc_feature (1)..( 7): Result.003 file - promoters60/2989991
tcgtatt

SEQ ID NO: 127050 - DNA, 9 bp, Unknown
  misc_feature (1)..( 9): Result.003 file - promoters60/2989991
aagctcgat

SEQ ID NO: 127051 - DNA, 9 bp, Unknown
  misc_feature (1)..( 9): Result.003 file - promoters60/2989991
aaggtcgat

SEQ ID NO: 127052 - DNA, 9 bp, Unknown
  misc_feature (1)..( 9): Result.003 file - promoters60/2989991
aagctcgat

SEQ ID NO: 127053 - DNA, 6 bp, Unknown
  misc_feature (1)..( 6): Result.003 file - promoters60/2989991
gaaaaa

SEQ ID NO: 127054 - DNA, 6 bp, Unknown
  misc_feature (1)..( 6): Result.003 file - promoters60/2989991
gaaaaa

SEQ ID NO: 127055 - DNA, 7 bp, Unknown
  misc_feature (1)..( 7): Result.003 file - promoters60/2989991
aaaaaat

SEQ ID NO: 127056 - DNA, 7 bp, Unknown
  misc_feature (1)..( 7): Result.003 file - promoters60/2989991
aaaaaat

SEQ ID NO: 127057 - DNA, 7 bp, Unknown
  misc_feature (1)..( 7): Result.003 file - promoters60/2989991
aaaaaaa

SEQ ID NO: 127058 - DNA, 7 bp, Unknown
  misc_feature (1)..( 7): Result.003 file - promoters60/2989991
atttgtt

SEQ ID NO: 127059 - DNA, 7 bp, Unknown
  misc_feature (1)..( 7): Result.003 file - promoters60/2989991
attggtt

SEQ ID NO: 127060 - DNA, 6 bp, Unknown
  misc_feature (1)..( 6): Result.003 file - promoters60/2989991
aaactt

SEQ ID NO: 127061 - DNA, 6 bp, Unknown
  misc_feature (1)..( 6): Result.003 file - promoters60/2989991
aaactt

SEQ ID NO: 127062 - DNA, 8 bp, Unknown
  misc_feature (1)..( 8): Result.003 file - promoters60/2989991
aaaattaa

SEQ ID NO: 127063 - DNA, 8 bp, Unknown
  misc_feature (1)..( 8): Result.003 file - promoters60/2989991
aaaattaa

SEQ ID NO: 127064 - DNA, 7 bp, Unknown
  misc_feature (1)..( 7): Result.003 file - promoters60/2989991
tactata

SEQ ID NO: 127065 - DNA, 7 bp, Unknown
  misc_feature (1)..( 7): Result.003 file - promoters60/2989991
tactata

SEQ ID NO: 127066 - DNA, 10 bp, Unknown
  misc_feature (1)..( 10): Result.003 file - promoters60/2990087
aaaactattt

SEQ ID NO: 127067 - DNA, 10 bp, Unknown
  misc_feature (1)..( 10): Result.003 file - promoters60/2990087
aaaaatataa

SEQ ID NO: 127068 - DNA, 10 bp, Unknown
  misc_feature (1)..( 10): Result.003 file - promoters60/2990087
tcaaccattt

SEQ ID NO: 127069 - DNA, 7 bp, Unknown
  misc_feature (1)..( 7): Result.003 file - promoters60/2990087
ttttctt

SEQ ID NO: 127070 - DNA, 7 bp, Unknown
  misc_feature (1)..( 7): Result.003 file - promoters60/2990087
ttttctt

SEQ ID NO: 127071 - DNA, 7 bp, Unknown
  misc_feature (1)..( 7): Result.003 file - promoters60/2990087
ttttttg

SEQ ID NO: 127072 - DNA, 7 bp, Unknown
  misc_feature (1)..( 7): Result.003 file - promoters60/2990087
tgtagtt

SEQ ID NO: 127073 - DNA, 7 bp, Unknown
  misc_feature (1)..( 7): Result.003 file - promoters60/2990087
tgtggtt

SEQ ID NO: 127074 - DNA, 6 bp, Unknown
  misc_feature (1)..( 6): Result.003 file - promoters60/2990087
tctaca

SEQ ID NO: 127075 - DNA, 6 bp, Unknown
  misc_feature (1)..( 6): Result.003 file - promoters60/2990087
tctaca

SEQ ID NO: 127076 - DNA, 6 bp, Unknown
  misc_feature (1)..( 6): Result.003 file - promoters60/2990087
ctaaaa

SEQ ID NO: 127077 - DNA, 6 bp, Unknown
  misc_feature (1)..( 6): Result.003 file - promoters60/2990087
ctaaaa

SEQ ID NO: 127078 - DNA, 8 bp, Unknown
  misc_feature (1)..( 8): Result.003 file - promoters60/2990087
attcatcc

SEQ ID NO: 127079 - DNA, 8 bp, Unknown
  misc_feature (1)..( 8): Result.003 file - promoters60/2990087
attcatcc

SEQ ID NO: 127080 - DNA, 7 bp, Unknown
  misc_feature (1)..( 7): Result.003 file - promoters60/2990087
ttcctta

SEQ ID NO: 127081 - DNA, 7 bp, Unknown
  misc_feature (1)..( 7): Result.003 file - promoters60/2990087
ttcatta

SEQ ID NO: 127082 - DNA, 7 bp, Unknown
  misc_feature (1)..( 7): Result.003 file - promoters60/2990087
aacaaag

SEQ ID NO: 127083 - DNA, 7 bp, Unknown
  misc_feature (1)..( 7): Result.003 file - promoters60/2990087
aactaag

SEQ ID NO: 127084 - DNA, 8 bp, Unknown
  misc_feature (1)..( 8): Result.003 file - promoters60/2990087
cttagaaa

SEQ ID NO: 127085 - DNA, 8 bp, Unknown
  misc_feature (1)..( 8): Result.003 file - promoters60/2990087
cttagaaa

SEQ ID NO: 127086 - DNA, 7 bp, Unknown
  misc_feature (1)..( 7): Result.003 file - promoters60/2990087
tatatat

SEQ ID NO: 127087 - DNA, 7 bp, Unknown
  misc_feature (1)..( 7): Result.003 file - promoters60/2990087
tatatat

SEQ ID NO: 127088 - DNA, 7 bp, Unknown
  misc_feature (1)..( 7): Result.003 file - promoters60/2990087
tatattc

SEQ ID NO: 127089 - DNA, 8 bp, Unknown
  misc_feature (1)..( 8): Result.003 file - promoters60/2990087
aataaaat

SEQ ID NO: 127090 - DNA, 8 bp, Unknown
  misc_feature (1)..( 8): Result.003 file - promoters60/2990087
aataaaat

SEQ ID NO: 127091 - DNA, 10 bp, Unknown
  misc_feature (1)..( 10): Result.003 file - promoters60/2990087
ttaatatttt

SEQ ID NO: 127092 - DNA, 10 bp, Unknown
  misc_feature (1)..( 10): Result.003 file - promoters60/2990087
ttaatttttt

SEQ ID NO: 127093 - DNA, 7 bp, Unknown
  misc_feature (1)..( 7): Result.003 file - promoters60/2990087
ttatttt

SEQ ID NO: 127094 - DNA, 7 bp, Unknown
  misc_feature (1)..( 7): Result.003 file - promoters60/2990087
ttatttt

SEQ ID NO: 127095 - DNA, 6 bp, Unknown
  misc_feature (1)..( 6): Result.003 file - promoters60/2990087
taacat

SEQ ID NO: 127096 - DNA, 6 bp, Unknown
  misc_feature (1)..( 6): Result.003 file - promoters60/2990087
taacat

SEQ ID NO: 127097 - DNA, 7 bp, Unknown
  misc_feature (1)..( 7): Result.003 file - promoters60/2990087
aatgtga

SEQ ID NO: 127098 - DNA, 7 bp, Unknown
  misc_feature (1)..( 7): Result.003 file - promoters60/2990087
aatttga

SEQ ID NO: 127099 - DNA, 8 bp, Unknown
  misc_feature (1)..( 8): Result.003 file - promoters60/2990087
aaaacaaa

SEQ ID NO: 127100 - DNA, 8 bp, Unknown
  misc_feature (1)..( 8): Result.003 file - promoters60/2990087
aaaaaaaa

SEQ ID NO: 127101 - DNA, 8 bp, Unknown
  misc_feature (1)..( 8): Result.003 file - promoters60/2990087
atttgatt

SEQ ID NO: 127102 - DNA, 8 bp, Unknown
  misc_feature (1)..( 8): Result.003 file - promoters60/2990087
atttgatt

SEQ ID NO: 127103 - DNA, 10 bp, Unknown
  misc_feature (1)..( 10): Result.003 file - promoters60/2990087
aaaaatactt

SEQ ID NO: 127104 - DNA, 10 bp, Unknown
  misc_feature (1)..( 10): Result.003 file - promoters60/2990087
aaaaaaactt

SEQ ID NO: 127105 - DNA, 7 bp, Unknown
  misc_feature (1)..( 7): Result.003 file - promoters60/2990087
cttaaga

SEQ ID NO: 127106 - DNA, 7 bp, Unknown
  misc_feature (1)..( 7): Result.003 file - promoters60/2990087
ctttaga

SEQ ID NO: 127107 - DNA, 6 bp, Unknown
  misc_feature (1)..( 6): Result.003 file - promoters60/2990087
aaacaa

SEQ ID NO: 127108 - DNA, 6 bp, Unknown
  misc_feature (1)..( 6): Result.003 file - promoters60/2990087
aaacaa

SEQ ID NO: 127109 - DNA, 10 bp, Unknown
  misc_feature (1)..( 10): Result.003 file - promoters60/2990087
ttgagagtac

SEQ ID NO: 127110 - DNA, 10 bp, Unknown
  misc_feature (1)..( 10): Result.003 file - promoters60/2990087
ttgaaagtac

SEQ ID NO: 127111 - DNA, 7 bp, Unknown
  misc_feature (1)..( 7): Result.003 file - promoters60/2990087
atatagg

SEQ ID NO: 127112 - DNA, 7 bp, Unknown
  misc_feature (1)..( 7): Result.003 file - promoters60/2990087
ataaagg

SEQ ID NO: 127113 - DNA, 7 bp, Unknown
  misc_feature (1)..( 7): Result.003 file - promoters60/2990087
ataaact

SEQ ID NO: 127114 - DNA, 7 bp, Unknown
  misc_feature (1)..( 7): Result.003 file - promoters60/2990087
atatact

SEQ ID NO: 127115 - DNA, 7 bp, Unknown
  misc_feature (1)..( 7): Result.003 file - promoters60/2990087
ttgatta

SEQ ID NO: 127116 - DNA, 7 bp, Unknown
  misc_feature (1)..( 7): Result.003 file - promoters60/2990087
ttgttta

SEQ ID NO: 127117 - DNA, 10 bp, Unknown
  misc_feature (1)..( 10): Result.003 file - promoters60/2990249
cgacaacttt

SEQ ID NO: 127118 - DNA, 10 bp, Unknown
  misc_feature (1)..( 10): Result.003 file - promoters60/2990249
cgacatcttt

SEQ ID NO: 127119 - DNA, 6 bp, Unknown
  misc_feature (1)..( 6): Result.003 file - promoters60/2990249
ttttct

SEQ ID NO: 127120 - DNA, 6 bp, Unknown
  misc_feature (1)..( 6): Result.003 file - promoters60/2990249
ttttct

SEQ ID NO: 127121 - DNA, 6 bp, Unknown
  misc_feature (1)..( 6): Result.003 file - promoters60/2990249
tatata

SEQ ID NO: 127122 - DNA, 6 bp, Unknown
  misc_feature (1)..( 6): Result.003 file - promoters60/2990249
tatata

SEQ ID NO: 127123 - DNA, 6 bp, Unknown
  misc_feature (1)..( 6): Result.003 file - promoters60/2990249
cactta

SEQ ID NO: 127124 - DNA, 6 bp, Unknown
  misc_feature (1)..( 6): Result.003 file - promoters60/2990249
cactta

SEQ ID NO: 127125 - DNA, 7 bp, Unknown
  misc_feature (1)..( 7): Result.003 file - promoters60/2990249
agaaaca

SEQ ID NO: 127126 - DNA, 7 bp, Unknown
  misc_feature (1)..( 7): Result.003 file - promoters60/2990249
agagaca

SEQ ID NO: 127127 - DNA, 9 bp, Unknown
  misc_feature (1)..( 9): Result.003 file - promoters60/2990249
caaccatat

SEQ ID NO: 127128 - DNA, 9 bp, Unknown
  misc_feature (1)..( 9): Result.003 file - promoters60/2990249
aaacaatat

SEQ ID NO: 127129 - DNA, 9 bp, Unknown
  misc_feature (1)..( 9): Result.003 file - promoters60/2990249
aaacaaaac

SEQ ID NO: 127130 - DNA, 6 bp, Unknown
  misc_feature (1)..( 6): Result.003 file - promoters60/2990249
aacaat

SEQ ID NO: 127131 - DNA, 6 bp, Unknown
  misc_feature (1)..( 6): Result.003 file - promoters60/2990249
aacaat

SEQ ID NO: 127132 - DNA, 9 bp, Unknown
  misc_feature (1)..( 9): Result.003 file - promoters60/2990249
tgagtacac

SEQ ID NO: 127133 - DNA, 9 bp, Unknown
  misc_feature (1)..( 9): Result.003 file - promoters60/2990249
tgagtccac

SEQ ID NO: 127134 - DNA, 6 bp, Unknown
  misc_feature (1)..( 6): Result.003 file - promoters60/2990249
aagtgg

SEQ ID NO: 127135 - DNA, 6 bp, Unknown
  misc_feature (1)..( 6): Result.003 file - promoters60/2990249
aagtgg

SEQ ID NO: 127136 - DNA, 6 bp, Unknown
  misc_feature (1)..( 6): Result.003 file - promoters60/2990249
gaataa

SEQ ID NO: 127137 - DNA, 6 bp, Unknown
  misc_feature (1)..( 6): Result.003 file - promoters60/2990249
gaataa

SEQ ID NO: 127138 - DNA, 6 bp, Unknown
  misc_feature (1)..( 6): Result.003 file - promoters60/2990249
tgtata

SEQ ID NO: 127139 - DNA, 6 bp, Unknown
  misc_feature (1)..( 6): Result.003 file - promoters60/2990249
tgtata

SEQ ID NO: 127140 - DNA, 9 bp, Unknown
  misc_feature (1)..( 9): Result.003 file - promoters60/2990249
caaaagcaa

SEQ ID NO: 127141 - DNA, 9 bp, Unknown
  misc_feature (1)..( 9): Result.003 file - promoters60/2990249
caaaatcaa

SEQ ID NO: 127142 - DNA, 7 bp, Unknown
  misc_feature (1)..( 7): Result.003 file - promoters60/2990249
aaaatct

SEQ ID NO: 127143 - DNA, 7 bp, Unknown
  misc_feature (1)..( 7): Result.003 file - promoters60/2990249
aaaatct

SEQ ID NO: 127144 - DNA, 7 bp, Unknown
  misc_feature (1)..( 7): Result.003 file - promoters60/2990249
ttctgtt

SEQ ID NO: 127145 - DNA, 7 bp, Unknown
  misc_feature (1)..( 7): Result.003 file - promoters60/2990249
ttctgtt

SEQ ID NO: 127146 - DNA, 7 bp, Unknown
  misc_feature (1)..( 7): Result.003 file - promoters60/2990249
gattttc

SEQ ID NO: 127147 - DNA, 7 bp, Unknown
  misc_feature (1)..( 7): Result.003 file - promoters60/2990249
gatgttc

SEQ ID NO: 127148 - DNA, 6 bp, Unknown
  misc_feature (1)..( 6): Result.003 file - promoters60/2990249
aaaaac

SEQ ID NO: 127149 - DNA, 6 bp, Unknown
  misc_feature (1)..( 6): Result.003 file - promoters60/2990249
aaaaac

SEQ ID NO: 127150 - DNA, 8 bp, Unknown
  misc_feature (1)..( 8): Result.003 file - promoters60/2990249
acaaaacg

SEQ ID NO: 127151 - DNA, 8 bp, Unknown
  misc_feature (1)..( 8): Result.003 file - promoters60/2990249
acaaaacg

SEQ ID NO: 127152 - DNA, 9 bp, Unknown
  misc_feature (1)..( 9): Result.003 file - promoters60/2990249
tacaccaaa

SEQ ID NO: 127153 - DNA, 9 bp, Unknown
  misc_feature (1)..( 9): Result.003 file - promoters60/2990249
tacacaaaa

SEQ ID NO: 127154 - DNA, 6 bp, Unknown
  misc_feature (1)..( 6): Result.003 file - promoters60/2990249
aattaa

SEQ ID NO: 127155 - DNA, 6 bp, Unknown
  misc_feature (1)..( 6): Result.003 file - promoters60/2990249
aattaa

SEQ ID NO: 127156 - DNA, 6 bp, Unknown
  misc_feature (1)..( 6): Result.003 file - promoters60/2990249
tctttt

SEQ ID NO: 127157 - DNA, 6 bp, Unknown
  misc_feature (1)..( 6): Result.003 file - promoters60/2990249
tctttt

SEQ ID NO: 127158 - DNA, 6 bp, Unknown
  misc_feature (1)..( 6): Result.003 file - promoters60/2990249
tatata

SEQ ID NO: 127159 - DNA, 6 bp, Unknown
  misc_feature (1)..( 6): Result.003 file - promoters60/2990249
tatata

SEQ ID NO: 127160 - DNA, 8 bp, Unknown
  misc_feature (1)..( 8): Result.003 file - promoters60/2990263
aatctaaa

SEQ ID NO: 127161 - DNA, 8 bp, Unknown
  misc_feature (1)..( 8): Result.003 file - promoters60/2990263
aatttaac

SEQ ID NO: 127162 - DNA, 8 bp, Unknown
  misc_feature (1)..( 8): Result.003 file - promoters60/2990263
tttttact

SEQ ID NO: 127163 - DNA, 8 bp, Unknown
  misc_feature (1)..( 8): Result.003 file - promoters60/2990263
tttttaca

SEQ ID NO: 127164 - DNA, 9 bp, Unknown
  misc_feature (1)..( 9): Result.003 file - promoters60/2990263
tatataata

SEQ ID NO: 127165 - DNA, 9 bp, Unknown
  misc_feature (1)..( 9): Result.003 file - promoters60/2990263
tataaaata

SEQ ID NO: 127166 - DNA, 9 bp, Unknown
  misc_feature (1)..( 9): Result.003 file - promoters60/2990263
tatttaatt

SEQ ID NO: 127167 - DNA, 9 bp, Unknown
  misc_feature (1)..( 9): Result.003 file - promoters60/2990263
tatgaaaca

SEQ ID NO: 127168 - DNA, 10 bp, Unknown
  misc_feature (1)..( 10): Result.003 file - promoters60/2990263
attcttataa

SEQ ID NO: 127169 - DNA, 10 bp, Unknown
  misc_feature (1)..( 10): Result.003 file - promoters60/2990263
atttttactc

SEQ ID NO: 127170 - DNA, 10 bp, Unknown
  misc_feature (1)..( 10): Result.003 file - promoters60/2990263
caatttaact

SEQ ID NO: 127171 - DNA, 10 bp, Unknown
  misc_feature (1)..( 10): Result.003 file - promoters60/2990263
ttttttacat

SEQ ID NO: 127172 - DNA, 12 bp, Unknown
  misc_feature (1)..( 12): Result.003 file - promoters60/2990263
caaattgaaacc

SEQ ID NO: 127173 - DNA, 12 bp, Unknown
  misc_feature (1)..( 12): Result.003 file - promoters60/2990263
aaatttgaaaaa

SEQ ID NO: 127174 - DNA, 12 bp, Unknown
  misc_feature (1)..( 12): Result.003 file - promoters60/2990263
caaatcgaagaa

SEQ ID NO: 127175 - DNA, 12 bp, Unknown
  misc_feature (1)..( 12): Result.003 file - promoters60/2990263
ggagtcgaagaa

SEQ ID NO: 127176 - DNA, 8 bp, Unknown
  misc_feature (1)..( 8): Result.003 file - promoters60/2990528
caaaccaa

SEQ ID NO: 127177 - DNA, 8 bp, Unknown
  misc_feature (1)..( 8): Result.003 file - promoters60/2990528
caaaacaa

SEQ ID NO: 127178 - DNA, 8 bp, Unknown
  misc_feature (1)..( 8): Result.003 file - promoters60/2990528
aaaaacaa

SEQ ID NO: 127179 - DNA, 8 bp, Unknown
  misc_feature (1)..( 8): Result.003 file - promoters60/2990528
taaaccaa

SEQ ID NO: 127180 - DNA, 8 bp, Unknown
  misc_feature (1)..( 8): Result.003 file - promoters60/2990528
tttcaatt

SEQ ID NO: 127181 - DNA, 8 bp, Unknown
  misc_feature (1)..( 8): Result.003 file - promoters60/2990528
attcaatg

SEQ ID NO: 127182 - DNA, 8 bp, Unknown
  misc_feature (1)..( 8): Result.003 file - promoters60/2990528
ttttaatt

SEQ ID NO: 127183 - DNA, 8 bp, Unknown
  misc_feature (1)..( 8): Result.003 file - promoters60/2990528
attcaact

SEQ ID NO: 127184 - DNA, 7 bp, Unknown
  misc_feature (1)..( 7): Result.003 file - promoters60/2990528
cttttct

SEQ ID NO: 127185 - DNA, 7 bp, Unknown
  misc_feature (1)..( 7): Result.003 file - promoters60/2990528
cttatct

SEQ ID NO: 127186 - DNA, 7 bp, Unknown
  misc_feature (1)..( 7): Result.003 file - promoters60/2990528
gttatct

SEQ ID NO: 127187 - DNA, 15 bp, Unknown
  misc_feature (1)..( 15): Result.003 file - promoters60/2990528
actaaaataactcac

SEQ ID NO: 127188 - DNA, 15 bp, Unknown
  misc_feature (1)..( 15): Result.003 file - promoters60/2990528
acagaaataaatcac

SEQ ID NO: 127189 - DNA, 15 bp, Unknown
  misc_feature (1)..( 15): Result.003 file - promoters60/2990528
acacaaatatgccaa

SEQ ID NO: 127190 - DNA, 9 bp, Unknown
  misc_feature (1)..( 9): Result.003 file - promoters60/2990544
ctttctttg

SEQ ID NO: 127191 - DNA, 9 bp, Unknown
  misc_feature (1)..( 9): Result.003 file - promoters60/2990544
cttcctttg

SEQ ID NO: 127192 - DNA, 9 bp, Unknown
  misc_feature (1)..( 9): Result.003 file - promoters60/2990544
atttatttc

SEQ ID NO: 127193 - DNA, 9 bp, Unknown
  misc_feature (1)..( 9): Result.003 file - promoters60/2990544
tcttatttt

SEQ ID NO: 127194 - DNA, 8 bp, Unknown
  misc_feature (1)..( 8): Result.003 file - promoters60/2990548
tattcatt

SEQ ID NO: 127195 - DNA, 8 bp, Unknown
  misc_feature (1)..( 8): Result.003 file - promoters60/2990548
gattcata

SEQ ID NO: 127196 - DNA, 8 bp, Unknown
  misc_feature (1)..( 8): Result.003 file - promoters60/2990548
tattcatt

SEQ ID NO: 127197 - DNA, 8 bp, Unknown
  misc_feature (1)..( 8): Result.003 file - promoters60/2990548
tattgatt

SEQ ID NO: 127198 - DNA, 7 bp, Unknown
  misc_feature (1)..( 7): Result.003 file - promoters60/2990548
gtttgtc

SEQ ID NO: 127199 - DNA, 7 bp, Unknown
  misc_feature (1)..( 7): Result.003 file - promoters60/2990548
gtttgtg

SEQ ID NO: 127200 - DNA, 7 bp, Unknown
  misc_feature (1)..( 7): Result.003 file - promoters60/2990548
ctttgtc

SEQ ID NO: 127201 - DNA, 7 bp, Unknown
  misc_feature (1)..( 7): Result.003 file - promoters60/2990548
gtttgtt

SEQ ID NO: 127202 - DNA, 10 bp, Unknown
  misc_feature (1)..( 10): Result.003 file - promoters60/2990548
gaacgcagaa

SEQ ID NO: 127203 - DNA, 10 bp, Unknown
  misc_feature (1)..( 10): Result.003 file - promoters60/2990548
gaactcagat

SEQ ID NO: 127204 - DNA, 10 bp, Unknown
  misc_feature (1)..( 10): Result.003 file - promoters60/2990548
agcagcagaa

SEQ ID NO: 127205 - DNA, 10 bp, Unknown
  misc_feature (1)..( 10): Result.003 file - promoters60/2990548
tcacgcagac

SEQ ID NO: 127206 - DNA, 8 bp, Unknown
  misc_feature (1)..( 8): Result.003 file - promoters60/2990548
tttctctg

SEQ ID NO: 127207 - DNA, 8 bp, Unknown
  misc_feature (1)..( 8): Result.003 file - promoters60/2990548
tttcactg

SEQ ID NO: 127208 - DNA, 8 bp, Unknown
  misc_feature (1)..( 8): Result.003 file - promoters60/2990548
cttcactt

SEQ ID NO: 127209 - DNA, 8 bp, Unknown
  misc_feature (1)..( 8): Result.003 file - promoters60/2990548
cttcaccc

SEQ ID NO: 127210 - DNA, 10 bp, Unknown
  misc_feature (1)..( 10): Result.003 file - promoters60/2990548
cttcactttg

SEQ ID NO: 127211 - DNA, 10 bp, Unknown
  misc_feature (1)..( 10): Result.003 file - promoters60/2990548
gttctctttt

SEQ ID NO: 127212 - DNA, 10 bp, Unknown
  misc_feature (1)..( 10): Result.003 file - promoters60/2990548
gtaaactttg

SEQ ID NO: 127213 - DNA, 10 bp, Unknown
  misc_feature (1)..( 10): Result.003 file - promoters60/2990548
cttcacccgg

SEQ ID NO: 127214 - DNA, 13 bp, Unknown
  misc_feature (1)..( 13): Result.003 file - promoters60/2990611
cgaaaaataaata

SEQ ID NO: 127215 - DNA, 13 bp, Unknown
  misc_feature (1)..( 13): Result.003 file - promoters60/2990611
ttaaacatatagt

SEQ ID NO: 127216 - DNA, 13 bp, Unknown
  misc_feature (1)..( 13): Result.003 file - promoters60/2990611
cgataaatttgct

SEQ ID NO: 127217 - DNA, 13 bp, Unknown
  misc_feature (1)..( 13): Result.003 file - promoters60/2990611
cacaaaataaagt

SEQ ID NO: 127218 - DNA, 13 bp, Unknown
  misc_feature (1)..( 13): Result.003 file - promoters60/2990611
tcaaaaaaacgtt

SEQ ID NO: 127219 - DNA, 13 bp, Unknown
  misc_feature (1)..( 13): Result.003 file - promoters60/2990611
ataatcatgctat

SEQ ID NO: 127220 - DNA, 13 bp, Unknown
  misc_feature (1)..( 13): Result.003 file - promoters60/2990611
atcataattttgc

SEQ ID NO: 127221 - DNA, 13 bp, Unknown
  misc_feature (1)..( 13): Result.003 file - promoters60/2990611
atattaaccttga

SEQ ID NO: 127222 - DNA, 13 bp, Unknown
  misc_feature (1)..( 13): Result.003 file - promoters60/2990611
aaattgaccctga

SEQ ID NO: 127223 - DNA, 13 bp, Unknown
  misc_feature (1)..( 13): Result.003 file - promoters60/2990611
taaataataaagt

SEQ ID NO: 127224 - DNA, 13 bp, Unknown
  misc_feature (1)..( 13): Result.003 file - promoters60/2990611
taatagacagctt

SEQ ID NO: 127225 - DNA, 13 bp, Unknown
  misc_feature (1)..( 13): Result.003 file - promoters60/2990611
aaactgacaagaa

SEQ ID NO: 127226 - DNA, 13 bp, Unknown
  misc_feature (1)..( 13): Result.003 file - promoters60/2990611
aaattgatctctc

SEQ ID NO: 127227 - DNA, 10 bp, Unknown
  misc_feature (1)..( 10): Result.003 file - promoters60/2990611
aaatgaaaaa

SEQ ID NO: 127228 - DNA, 10 bp, Unknown
  misc_feature (1)..( 10): Result.003 file - promoters60/2990611
ctatgagaaa

SEQ ID NO: 127229 - DNA, 10 bp, Unknown
  misc_feature (1)..( 10): Result.003 file - promoters60/2990611
gaataacaat

SEQ ID NO: 127230 - DNA, 10 bp, Unknown
  misc_feature (1)..( 10): Result.003 file - promoters60/2990611
tattaataat

SEQ ID NO: 127231 - DNA, 10 bp, Unknown
  misc_feature (1)..( 10): Result.003 file - promoters60/2990611
aatttatatg

SEQ ID NO: 127232 - DNA, 10 bp, Unknown
  misc_feature (1)..( 10): Result.003 file - promoters60/2990611
aatttagatg

SEQ ID NO: 127233 - DNA, 8 bp, Unknown
  misc_feature (1)..( 8): Result.003 file - promoters60/2990611
tatgtttt

SEQ ID NO: 127234 - DNA, 8 bp, Unknown
  misc_feature (1)..( 8): Result.003 file - promoters60/2990611
tttgtttt

SEQ ID NO: 127235 - DNA, 8 bp, Unknown
  misc_feature (1)..( 8): Result.003 file - promoters60/2990611
attgttta

SEQ ID NO: 127236 - DNA, 8 bp, Unknown
  misc_feature (1)..( 8): Result.003 file - promoters60/2990611
aatgttta

SEQ ID NO: 127237 - DNA, 8 bp, Unknown
  misc_feature (1)..( 8): Result.003 file - promoters60/2990611
attgttta

SEQ ID NO: 127238 - DNA, 8 bp, Unknown
  misc_feature (1)..( 8): Result.003 file - promoters60/2990611
tttattta

SEQ ID NO: 127239 - DNA, 14 bp, Unknown
  misc_feature (1)..( 14): Result.003 file - promoters60/2990611
cgacaggaaaatgg

SEQ ID NO: 127240 - DNA, 14 bp, Unknown
  misc_feature (1)..( 14): Result.003 file - promoters60/2990611
aaaaaggaaagaat

SEQ ID NO: 127241 - DNA, 14 bp, Unknown
  misc_feature (1)..( 14): Result.003 file - promoters60/2990611
aaaaaagaaataaa

SEQ ID NO: 127242 - DNA, 14 bp, Unknown
  misc_feature (1)..( 14): Result.003 file - promoters60/2990611
ataaagcaaacaat

SEQ ID NO: 127243 - DNA, 14 bp, Unknown
  misc_feature (1)..( 14): Result.003 file - promoters60/2990611
aaaaaacaaagacg

SEQ ID NO: 127244 - DNA, 14 bp, Unknown
  misc_feature (1)..( 14): Result.003 file - promoters60/2990611
taaaaacttaatca

SEQ ID NO: 127245 - DNA, 7 bp, Unknown
  misc_feature (1)..( 7): Result.003 file - promoters60/2990616
ttaataa

SEQ ID NO: 127246 - DNA, 7 bp, Unknown
  misc_feature (1)..( 7): Result.003 file - promoters60/2990616
ttactaa

SEQ ID NO: 127247 - DNA, 6 bp, Unknown
  misc_feature (1)..( 6): Result.003 file - promoters60/2990616
caaaac

SEQ ID NO: 127248 - DNA, 6 bp, Unknown
  misc_feature (1)..( 6): Result.003 file - promoters60/2990616
caaaac

SEQ ID NO: 127249 - DNA, 7 bp, Unknown
  misc_feature (1)..( 7): Result.003 file - promoters60/2990616
tgtgttg

SEQ ID NO: 127250 - DNA, 7 bp, Unknown
  misc_feature (1)..( 7): Result.003 file - promoters60/2990616
tgttttg

SEQ ID NO: 127251 - DNA, 7 bp, Unknown
  misc_feature (1)..( 7): Result.003 file - promoters60/2990616
aaagtta

SEQ ID NO: 127252 - DNA, 7 bp, Unknown
  misc_feature (1)..( 7): Result.003 file - promoters60/2990616
aaattta

SEQ ID NO: 127253 - DNA, 7 bp, Unknown
  misc_feature (1)..( 7): Result.003 file - promoters60/2990616
agagaaa

SEQ ID NO: 127254 - DNA, 7 bp, Unknown
  misc_feature (1)..( 7): Result.003 file - promoters60/2990616
agaaaaa

SEQ ID NO: 127255 - DNA, 7 bp, Unknown
  misc_feature (1)..( 7): Result.003 file - promoters60/2990616
atttaca

SEQ ID NO: 127256 - DNA, 7 bp, Unknown
  misc_feature (1)..( 7): Result.003 file - promoters60/2990616
attcaca

SEQ ID NO: 127257 - DNA, 7 bp, Unknown
  misc_feature (1)..( 7): Result.003 file - promoters60/2990616
aaataag

SEQ ID NO: 127258 - DNA, 7 bp, Unknown
  misc_feature (1)..( 7): Result.003 file - promoters60/2990616
aaataag

SEQ ID NO: 127259 - DNA, 6 bp, Unknown
  misc_feature (1)..( 6): Result.003 file - promoters60/2990616
tttatg

SEQ ID NO: 127260 - DNA, 6 bp, Unknown
  misc_feature (1)..( 6): Result.003 file - promoters60/2990616
tttatg

SEQ ID NO: 127261 - DNA, 7 bp, Unknown
  misc_feature (1)..( 7): Result.003 file - promoters60/2990616
taaccta

SEQ ID NO: 127262 - DNA, 7 bp, Unknown
  misc_feature (1)..( 7): Result.003 file - promoters60/2990616
taaacta

SEQ ID NO: 127263 - DNA, 7 bp, Unknown
  misc_feature (1)..( 7): Result.003 file - promoters60/2990616
ctggact

SEQ ID NO: 127264 - DNA, 7 bp, Unknown
  misc_feature (1)..( 7): Result.003 file - promoters60/2990616
ctggact

SEQ ID NO: 127265 - DNA, 6 bp, Unknown
  misc_feature (1)..( 6): Result.003 file - promoters60/2990616
aaggta

SEQ ID NO: 127266 - DNA, 6 bp, Unknown
  misc_feature (1)..( 6): Result.003 file - promoters60/2990616
aaggta

SEQ ID NO: 127267 - DNA, 10 bp, Unknown
  misc_feature (1)..( 10): Result.003 file - promoters60/2990616
taatttatga

SEQ ID NO: 127268 - DNA, 10 bp, Unknown
  misc_feature (1)..( 10): Result.003 file - promoters60/2990616
taatctatga

SEQ ID NO: 127269 - DNA, 7 bp, Unknown
  misc_feature (1)..( 7): Result.003 file - promoters60/2990616
tattgtt

SEQ ID NO: 127270 - DNA, 7 bp, Unknown
  misc_feature (1)..( 7): Result.003 file - promoters60/2990616
tatagtt

SEQ ID NO: 127271 - DNA, 11 bp, Unknown
  misc_feature (1)..( 11): Result.003 file - promoters60/2990616
aaacttcatct

SEQ ID NO: 127272 - DNA, 11 bp, Unknown
  misc_feature (1)..( 11): Result.003 file - promoters60/2990616
aaagttcatct

SEQ ID NO: 127273 - DNA, 7 bp, Unknown
  misc_feature (1)..( 7): Result.003 file - promoters60/2990616
tatatgt

SEQ ID NO: 127274 - DNA, 7 bp, Unknown
  misc_feature (1)..( 7): Result.003 file - promoters60/2990616
tatgtgt

SEQ ID NO: 127275 - DNA, 7 bp, Unknown
  misc_feature (1)..( 7): Result.003 file - promoters60/2990616
taagatt

SEQ ID NO: 127276 - DNA, 7 bp, Unknown
  misc_feature (1)..( 7): Result.003 file - promoters60/2990616
taagatt

SEQ ID NO: 127277 - DNA, 7 bp, Unknown
  misc_feature (1)..( 7): Result.003 file - promoters60/2990616
tggttat

SEQ ID NO: 127278 - DNA, 7 bp, Unknown
  misc_feature (1)..( 7): Result.003 file - promoters60/2990616
tggatat

SEQ ID NO: 127279 - DNA, 8 bp, Unknown
  misc_feature (1)..( 8): Result.003 file - promoters60/2990616
attgtttt

SEQ ID NO: 127280 - DNA, 8 bp, Unknown
  misc_feature (1)..( 8): Result.003 file - promoters60/2990616
attttttt

SEQ ID NO: 127281 - DNA, 8 bp, Unknown
  misc_feature (1)..( 8): Result.003 file - promoters60/2990659
ttaaaaaa

SEQ ID NO: 127282 - DNA, 8 bp, Unknown
  misc_feature (1)..( 8): Result.003 file - promoters60/2990659
ttacaaaa

SEQ ID NO: 127283 - DNA, 8 bp, Unknown
  misc_feature (1)..( 8): Result.003 file - promoters60/2990659
ttaaaatc

SEQ ID NO: 127284 - DNA, 8 bp, Unknown
  misc_feature (1)..( 8): Result.003 file - promoters60/2990659
aaaatggt

SEQ ID NO: 127285 - DNA, 8 bp, Unknown
  misc_feature (1)..( 8): Result.003 file - promoters60/2990659
aaaatgaa

SEQ ID NO: 127286 - DNA, 8 bp, Unknown
  misc_feature (1)..( 8): Result.003 file - promoters60/2990659
aaattgtc

SEQ ID NO: 127287 - DNA, 7 bp, Unknown
  misc_feature (1)..( 7): Result.003 file - promoters60/2990659
atcattg

SEQ ID NO: 127288 - DNA, 7 bp, Unknown
  misc_feature (1)..( 7): Result.003 file - promoters60/2990659
atctttg

SEQ ID NO: 127289 - DNA, 8 bp, Unknown
  misc_feature (1)..( 8): Result.003 file - promoters60/2990659
aattcata

SEQ ID NO: 127290 - DNA, 8 bp, Unknown
  misc_feature (1)..( 8): Result.003 file - promoters60/2990659
aatttata

SEQ ID NO: 127291 - DNA, 10 bp, Unknown
  misc_feature (1)..( 10): Result.003 file - promoters60/2990659
tttttcacat

SEQ ID NO: 127292 - DNA, 10 bp, Unknown
  misc_feature (1)..( 10): Result.003 file - promoters60/2990659
ttttttacat

SEQ ID NO: 127293 - DNA, 7 bp, Unknown
  misc_feature (1)..( 7): Result.003 file - promoters60/2990659
acatttt

SEQ ID NO: 127294 - DNA, 7 bp, Unknown
  misc_feature (1)..( 7): Result.003 file - promoters60/2990659
acatttt

SEQ ID NO: 127295 - DNA, 8 bp, Unknown
  misc_feature (1)..( 8): Result.003 file - promoters60/2990659
aaagattt

SEQ ID NO: 127296 - DNA, 8 bp, Unknown
  misc_feature (1)..( 8): Result.003 file - promoters60/2990659
aaatattt

SEQ ID NO: 127297 - DNA, 7 bp, Unknown
  misc_feature (1)..( 7): Result.003 file - promoters60/2990659
tttattt

SEQ ID NO: 127298 - DNA, 7 bp, Unknown
  misc_feature (1)..( 7): Result.003 file - promoters60/2990659
tttattt

SEQ ID NO: 127299 - DNA, 7 bp, Unknown
  misc_feature (1)..( 7): Result.003 file - promoters60/2990659
tttaatt

SEQ ID NO: 127300 - DNA, 7 bp, Unknown
  misc_feature (1)..( 7): Result.003 file - promoters60/2990659
tttcatt

SEQ ID NO: 127301 - DNA, 7 bp, Unknown
  misc_feature (1)..( 7): Result.003 file - promoters60/2990659
taatgta

SEQ ID NO: 127302 - DNA, 7 bp, Unknown
  misc_feature (1)..( 7): Result.003 file - promoters60/2990659
taatgta

SEQ ID NO: 127303 - DNA, 6 bp, Unknown
  misc_feature (1)..( 6): Result.003 file - promoters60/2990659
acgatt

SEQ ID NO: 127304 - DNA, 6 bp, Unknown
  misc_feature (1)..( 6): Result.003 file - promoters60/2990659
acgatt

SEQ ID NO: 127305 - DNA, 7 bp, Unknown
  misc_feature (1)..( 7): Result.003 file - promoters60/2990659
tcacaca

SEQ ID NO: 127306 - DNA, 7 bp, Unknown
  misc_feature (1)..( 7): Result.003 file - promoters60/2990659
tcaaaca

SEQ ID NO: 127307 - DNA, 8 bp, Unknown
  misc_feature (1)..( 8): Result.003 file - promoters60/2990659
atataact

SEQ ID NO: 127308 - DNA, 8 bp, Unknown
  misc_feature (1)..( 8): Result.003 file - promoters60/2990659
atattact

SEQ ID NO: 127309 - DNA, 6 bp, Unknown
  misc_feature (1)..( 6): Result.003 file - promoters60/2990659
tgtttt

SEQ ID NO: 127310 - DNA, 6 bp, Unknown
  misc_feature (1)..( 6): Result.003 file - promoters60/2990659
tgtttt

SEQ ID NO: 127311 - DNA, 8 bp, Unknown
  misc_feature (1)..( 8): Result.003 file - promoters60/2990659
taatctat

SEQ ID NO: 127312 - DNA, 8 bp, Unknown
  misc_feature (1)..( 8): Result.003 file - promoters60/2990659
taatgtat

SEQ ID NO: 127313 - DNA, 9 bp, Unknown
  misc_feature (1)..( 9): Result.003 file - promoters60/2990659
tcaatgcat

SEQ ID NO: 127314 - DNA, 9 bp, Unknown
  misc_feature (1)..( 9): Result.003 file - promoters60/2990659
tcaatgcat

SEQ ID NO: 127315 - DNA, 13 bp, Unknown
  misc_feature (1)..( 13): Result.003 file - promoters60/2990659
ataggattcacat

SEQ ID NO: 127316 - DNA, 13 bp, Unknown
  misc_feature (1)..( 13): Result.003 file - promoters60/2990659
ataagattcacat

SEQ ID NO: 127317 - DNA, 7 bp, Unknown
  misc_feature (1)..( 7): Result.003 file - promoters60/2990659
tcattta

SEQ ID NO: 127318 - DNA, 7 bp, Unknown
  misc_feature (1)..( 7): Result.003 file - promoters60/2990659
tcactta

SEQ ID NO: 127319 - DNA, 7 bp, Unknown
  misc_feature (1)..( 7): Result.003 file - promoters60/2990659
ctaccaa

SEQ ID NO: 127320 - DNA, 7 bp, Unknown
  misc_feature (1)..( 7): Result.003 file - promoters60/2990659
ctaccaa

SEQ ID NO: 127321 - DNA, 8 bp, Unknown
  misc_feature (1)..( 8): Result.003 file - promoters60/2990659
aaaataag

SEQ ID NO: 127322 - DNA, 8 bp, Unknown
  misc_feature (1)..( 8): Result.003 file - promoters60/2990659
aaactaag

SEQ ID NO: 127323 - DNA, 6 bp, Unknown
  misc_feature (1)..( 6): Result.003 file - promoters60/2990659
atagat

SEQ ID NO: 127324 - DNA, 6 bp, Unknown
  misc_feature (1)..( 6): Result.003 file - promoters60/2990659
atagat

SEQ ID NO: 127325 - DNA, 7 bp, Unknown
  misc_feature (1)..( 7): Result.003 file - promoters60/2990659
agatata

SEQ ID NO: 127326 - DNA, 7 bp, Unknown
  misc_feature (1)..( 7): Result.003 file - promoters60/2990659
agagata

SEQ ID NO: 127327 - DNA, 6 bp, Unknown
  misc_feature (1)..( 6): Result.003 file - promoters60/2990659
ttttgg

SEQ ID NO: 127328 - DNA, 6 bp, Unknown
  misc_feature (1)..( 6): Result.003 file - promoters60/2990659
ttttgg

SEQ ID NO: 127329 - DNA, 6 bp, Unknown
  misc_feature (1)..( 6): Result.003 file - promoters60/2990659
taagat

SEQ ID NO: 127330 - DNA, 6 bp, Unknown
  misc_feature (1)..( 6): Result.003 file - promoters60/2990659
taagat

SEQ ID NO: 127331 - DNA, 6 bp, Unknown
  misc_feature (1)..( 6): Result.003 file - promoters60/2990659
aaagaa

SEQ ID NO: 127332 - DNA, 6 bp, Unknown
  misc_feature (1)..( 6): Result.003 file - promoters60/2990659
aaagaa

SEQ ID NO: 127333 - DNA, 12 bp, Unknown
  misc_feature (1)..( 12): Result.003 file - promoters60/2990659
aaaaacaaaaca

SEQ ID NO: 127334 - DNA, 12 bp, Unknown
  misc_feature (1)..( 12): Result.003 file - promoters60/2990659
aaacacaataca

SEQ ID NO: 127335 - DNA, 6 bp, Unknown
  misc_feature (1)..( 6): Result.003 file - promoters60/2990659
aaaaat

SEQ ID NO: 127336 - DNA, 6 bp, Unknown
  misc_feature (1)..( 6): Result.003 file - promoters60/2990659
aaaaat

SEQ ID NO: 127337 - DNA, 6 bp, Unknown
  misc_feature (1)..( 6): Result.003 file - promoters60/2990659
taaccc

SEQ ID NO: 127338 - DNA, 6 bp, Unknown
  misc_feature (1)..( 6): Result.003 file - promoters60/2990659
taaccc

SEQ ID NO: 127339 - DNA, 7 bp, Unknown
  misc_feature (1)..( 7): Result.003 file - promoters60/2990777
atttttc

SEQ ID NO: 127340 - DNA, 7 bp, Unknown
  misc_feature (1)..( 7): Result.003 file - promoters60/2990777
attcttc

SEQ ID NO: 127341 - DNA, 6 bp, Unknown
  misc_feature (1)..( 6): Result.003 file - promoters60/2990777
agagag

SEQ ID NO: 127342 - DNA, 6 bp, Unknown
  misc_feature (1)..( 6): Result.003 file - promoters60/2990777
agagag

SEQ ID NO: 127343 - DNA, 7 bp, Unknown
  misc_feature (1)..( 7): Result.003 file - promoters60/2990777
attcaaa

SEQ ID NO: 127344 - DNA, 7 bp, Unknown
  misc_feature (1)..( 7): Result.003 file - promoters60/2990777
attcaac

SEQ ID NO: 127345 - DNA, 8 bp, Unknown
  misc_feature (1)..( 8): Result.003 file - promoters60/2990777
tttcgaaa

SEQ ID NO: 127346 - DNA, 8 bp, Unknown
  misc_feature (1)..( 8): Result.003 file - promoters60/2990777
tttgtgtt

SEQ ID NO: 127347 - DNA, 8 bp, Unknown
  misc_feature (1)..( 8): Result.003 file - promoters60/2990777
tttatgtt

SEQ ID NO: 127348 - DNA, 6 bp, Unknown
  misc_feature (1)..( 6): Result.003 file - promoters60/2990777
aaaaag

SEQ ID NO: 127349 - DNA, 6 bp, Unknown
  misc_feature (1)..( 6): Result.003 file - promoters60/2990777
aaaaag

SEQ ID NO: 127350 - DNA, 6 bp, Unknown
  misc_feature (1)..( 6): Result.003 file - promoters60/2990777
tataaa

SEQ ID NO: 127351 - DNA, 6 bp, Unknown
  misc_feature (1)..( 6): Result.003 file - promoters60/2990777
tataaa

SEQ ID NO: 127352 - DNA, 7 bp, Unknown
  misc_feature (1)..( 7): Result.003 file - promoters60/2990777
tcgtgaa

SEQ ID NO: 127353 - DNA, 7 bp, Unknown
  misc_feature (1)..( 7): Result.003 file - promoters60/2990777
tcgcgaa

SEQ ID NO: 127354 - DNA, 7 bp, Unknown
  misc_feature (1)..( 7): Result.003 file - promoters60/2990777
agccggt

SEQ ID NO: 127355 - DNA, 7 bp, Unknown
  misc_feature (1)..( 7): Result.003 file - promoters60/2990777
agctggt

SEQ ID NO: 127356 - DNA, 8 bp, Unknown
  misc_feature (1)..( 8): Result.003 file - promoters60/2990777
aaaaatat

SEQ ID NO: 127357 - DNA, 8 bp, Unknown
  misc_feature (1)..( 8): Result.003 file - promoters60/2990777
aaaaatat

SEQ ID NO: 127358 - DNA, 6 bp, Unknown
  misc_feature (1)..( 6): Result.003 file - promoters60/2990777
atctga

SEQ ID NO: 127359 - DNA, 6 bp, Unknown
  misc_feature (1)..( 6): Result.003 file - promoters60/2990777
atctga

SEQ ID NO: 127360 - DNA, 6 bp, Unknown
  misc_feature (1)..( 6): Result.003 file - promoters60/2990777
ccaaag

SEQ ID NO: 127361 - DNA, 6 bp, Unknown
  misc_feature (1)..( 6): Result.003 file - promoters60/2990777
ccaaag

SEQ ID NO: 127362 - DNA, 10 bp, Unknown
  misc_feature (1)..( 10): Result.003 file - promoters60/2990777
ctcaatctaa

SEQ ID NO: 127363 - DNA, 10 bp, Unknown
  misc_feature (1)..( 10): Result.003 file - promoters60/2990777
ctcagtctaa

SEQ ID NO: 127364 - DNA, 6 bp, Unknown
  misc_feature (1)..( 6): Result.003 file - promoters60/2990777
gcgcag

SEQ ID NO: 127365 - DNA, 6 bp, Unknown
  misc_feature (1)..( 6): Result.003 file - promoters60/2990777
gcgcag

SEQ ID NO: 127366 - DNA, 9 bp, Unknown
  misc_feature (1)..( 9): Result.003 file - promoters60/2990777
aaagtacaa

SEQ ID NO: 127367 - DNA, 9 bp, Unknown
  misc_feature (1)..( 9): Result.003 file - promoters60/2990777
aaagtaaag

SEQ ID NO: 127368 - DNA, 9 bp, Unknown
  misc_feature (1)..( 9): Result.003 file - promoters60/2990777
aaagaaaag

SEQ ID NO: 127369 - DNA, 6 bp, Unknown
  misc_feature (1)..( 6): Result.003 file - promoters60/2990777
agtaaa

SEQ ID NO: 127370 - DNA, 6 bp, Unknown
  misc_feature (1)..( 6): Result.003 file - promoters60/2990777
agtaaa

SEQ ID NO: 127371 - DNA, 7 bp, Unknown
  misc_feature (1)..( 7): Result.003 file - promoters60/2990777
aatcggg

SEQ ID NO: 127372 - DNA, 7 bp, Unknown
  misc_feature (1)..( 7): Result.003 file - promoters60/2990777
aattggg

SEQ ID NO: 127373 - DNA, 8 bp, Unknown
  misc_feature (1)..( 8): Result.003 file - promoters60/2990777
gaaagaaa

SEQ ID NO: 127374 - DNA, 8 bp, Unknown
  misc_feature (1)..( 8): Result.003 file - promoters60/2990777
gaaacaaa

SEQ ID NO: 127375 - DNA, 10 bp, Unknown
  misc_feature (1)..( 10): Result.003 file - promoters60/2990777
ggaaaagaaa

SEQ ID NO: 127376 - DNA, 10 bp, Unknown
  misc_feature (1)..( 10): Result.003 file - promoters60/2990777
ggaaatgaaa

SEQ ID NO: 127377 - DNA, 7 bp, Unknown
  misc_feature (1)..( 7): Result.003 file - promoters60/2990777
cccacta

SEQ ID NO: 127378 - DNA, 7 bp, Unknown
  misc_feature (1)..( 7): Result.003 file - promoters60/2990777
cccacta

SEQ ID NO: 127379 - DNA, 7 bp, Unknown
  misc_feature (1)..( 7): Result.003 file - promoters60/2990777
gtatata

SEQ ID NO: 127380 - DNA, 7 bp, Unknown
  misc_feature (1)..( 7): Result.003 file - promoters60/2990777
gtatata

SEQ ID NO: 127381 - DNA, 7 bp, Unknown
  misc_feature (1)..( 7): Result.003 file - promoters60/2991101
tcttttt

SEQ ID NO: 127382 - DNA, 7 bp, Unknown
  misc_feature (1)..( 7): Result.003 file - promoters60/2991101
tctattt

SEQ ID NO: 127383 - DNA, 12 bp, Unknown
  misc_feature (1)..( 12): Result.003 file - promoters60/2991101
ggtttctttttg

SEQ ID NO: 127384 - DNA, 12 bp, Unknown
  misc_feature (1)..( 12): Result.003 file - promoters60/2991101
ggtttatttata

SEQ ID NO: 127385 - DNA, 12 bp, Unknown
  misc_feature (1)..( 12): Result.003 file - promoters60/2991101
gatttttttata

SEQ ID NO: 127386 - DNA, 9 bp, Unknown
  misc_feature (1)..( 9): Result.003 file - promoters60/2991101
tctttttcc

SEQ ID NO: 127387 - DNA, 9 bp, Unknown
  misc_feature (1)..( 9): Result.003 file - promoters60/2991101
gttttttcc

SEQ ID NO: 127388 - DNA, 9 bp, Unknown
  misc_feature (1)..( 9): Result.003 file - promoters60/2991101
tctttttct

SEQ ID NO: 127389 - DNA, 6 bp, Unknown
  misc_feature (1)..( 6): Result.003 file - promoters60/2991101
taaact

SEQ ID NO: 127390 - DNA, 6 bp, Unknown
  misc_feature (1)..( 6): Result.003 file - promoters60/2991101
taaact

SEQ ID NO: 127391 - DNA, 6 bp, Unknown
  misc_feature (1)..( 6): Result.003 file - promoters60/2991101
tattcc

SEQ ID NO: 127392 - DNA, 6 bp, Unknown
  misc_feature (1)..( 6): Result.003 file - promoters60/2991101
tattcc

SEQ ID NO: 127393 - DNA, 6 bp, Unknown
  misc_feature (1)..( 6): Result.003 file - promoters60/2991101
agaaaa

SEQ ID NO: 127394 - DNA, 6 bp, Unknown
  misc_feature (1)..( 6): Result.003 file - promoters60/2991101
agaaaa

SEQ ID NO: 127395 - DNA, 8 bp, Unknown
  misc_feature (1)..( 8): Result.003 file - promoters60/2991101
aaaaggta

SEQ ID NO: 127396 - DNA, 8 bp, Unknown
  misc_feature (1)..( 8): Result.003 file - promoters60/2991101
aaatggta

SEQ ID NO: 127397 - DNA, 10 bp, Unknown
  misc_feature (1)..( 10): Result.003 file - promoters60/2991101
tttgtttcga

SEQ ID NO: 127398 - DNA, 10 bp, Unknown
  misc_feature (1)..( 10): Result.003 file - promoters60/2991101
tttttttata

SEQ ID NO: 127399 - DNA, 10 bp, Unknown
  misc_feature (1)..( 10): Result.003 file - promoters60/2991101
tttatttata

SEQ ID NO: 127400 - DNA, 7 bp, Unknown
  misc_feature (1)..( 7): Result.003 file - promoters60/2991101
aaatata

SEQ ID NO: 127401 - DNA, 7 bp, Unknown
  misc_feature (1)..( 7): Result.003 file - promoters60/2991101
aaatata

SEQ ID NO: 127402 - DNA, 7 bp, Unknown
  misc_feature (1)..( 7): Result.003 file - promoters60/2991101
atgttga

SEQ ID NO: 127403 - DNA, 7 bp, Unknown
  misc_feature (1)..( 7): Result.003 file - promoters60/2991101
atgatga

SEQ ID NO: 127404 - DNA, 8 bp, Unknown
  misc_feature (1)..( 8): Result.003 file - promoters60/2991101
attgtttt

SEQ ID NO: 127405 - DNA, 8 bp, Unknown
  misc_feature (1)..( 8): Result.003 file - promoters60/2991101
attttttt

SEQ ID NO: 127406 - DNA, 8 bp, Unknown
  misc_feature (1)..( 8): Result.003 file - promoters60/2991101
tgattatt

SEQ ID NO: 127407 - DNA, 8 bp, Unknown
  misc_feature (1)..( 8): Result.003 file - promoters60/2991101
tgagtatt

SEQ ID NO: 127408 - DNA, 8 bp, Unknown
  misc_feature (1)..( 8): Result.003 file - promoters60/2991101
aagatgat

SEQ ID NO: 127409 - DNA, 8 bp, Unknown
  misc_feature (1)..( 8): Result.003 file - promoters60/2991101
aagaggat

SEQ ID NO: 127410 - DNA, 7 bp, Unknown
  misc_feature (1)..( 7): Result.003 file - promoters60/2991101
tcttaaa

SEQ ID NO: 127411 - DNA, 7 bp, Unknown
  misc_feature (1)..( 7): Result.003 file - promoters60/2991101
tctaaaa

SEQ ID NO: 127412 - DNA, 6 bp, Unknown
  misc_feature (1)..( 6): Result.003 file - promoters60/2991122
aaccta

SEQ ID NO: 127413 - DNA, 6 bp, Unknown
  misc_feature (1)..( 6): Result.003 file - promoters60/2991122
aaccta

SEQ ID NO: 127414 - DNA, 6 bp, Unknown
  misc_feature (1)..( 6): Result.003 file - promoters60/2991122
ggagac

SEQ ID NO: 127415 - DNA, 6 bp, Unknown
  misc_feature (1)..( 6): Result.003 file - promoters60/2991122
ggagac

SEQ ID NO: 127416 - DNA, 8 bp, Unknown
  misc_feature (1)..( 8): Result.003 file - promoters60/2991122
ttggctgc

SEQ ID NO: 127417 - DNA, 8 bp, Unknown
  misc_feature (1)..( 8): Result.003 file - promoters60/2991122
ttgggtgc

SEQ ID NO: 127418 - DNA, 7 bp, Unknown
  misc_feature (1)..( 7): Result.003 file - promoters60/2991122
ggtggta

SEQ ID NO: 127419 - DNA, 7 bp, Unknown
  misc_feature (1)..( 7): Result.003 file - promoters60/2991122
ggtggta

SEQ ID NO: 127420 - DNA, 7 bp, Unknown
  misc_feature (1)..( 7): Result.003 file - promoters60/2991122
aggtcag

SEQ ID NO: 127421 - DNA, 7 bp, Unknown
  misc_feature (1)..( 7): Result.003 file - promoters60/2991122
aggacag

SEQ ID NO: 127422 - DNA, 6 bp, Unknown
  misc_feature (1)..( 6): Result.003 file - promoters60/2991122
tgtgaa

SEQ ID NO: 127423 - DNA, 6 bp, Unknown
  misc_feature (1)..( 6): Result.003 file - promoters60/2991122
tgtgaa

SEQ ID NO: 127424 - DNA, 7 bp, Unknown
  misc_feature (1)..( 7): Result.003 file - promoters60/2991122
tagtaac

SEQ ID NO: 127425 - DNA, 7 bp, Unknown
  misc_feature (1)..( 7): Result.003 file - promoters60/2991122
tagcaac

SEQ ID NO: 127426 - DNA, 8 bp, Unknown
  misc_feature (1)..( 8): Result.003 file - promoters60/2991122
caagtgaa

SEQ ID NO: 127427 - DNA, 8 bp, Unknown
  misc_feature (1)..( 8): Result.003 file - promoters60/2991122
caaatgaa

SEQ ID NO: 127428 - DNA, 6 bp, Unknown
  misc_feature (1)..( 6): Result.003 file - promoters60/2991122
ggctga

SEQ ID NO: 127429 - DNA, 6 bp, Unknown
  misc_feature (1)..( 6): Result.003 file - promoters60/2991122
ggctga

SEQ ID NO: 127430 - DNA, 11 bp, Unknown
  misc_feature (1)..( 11): Result.003 file - promoters60/2991122
aggttctcaga

SEQ ID NO: 127431 - DNA, 11 bp, Unknown
  misc_feature (1)..( 11): Result.003 file - promoters60/2991122
agggtctgaga

SEQ ID NO: 127432 - DNA, 6 bp, Unknown
  misc_feature (1)..( 6): Result.003 file - promoters60/2991122
agattt

SEQ ID NO: 127433 - DNA, 6 bp, Unknown
  misc_feature (1)..( 6): Result.003 file - promoters60/2991122
agattt

SEQ ID NO: 127434 - DNA, 9 bp, Unknown
  misc_feature (1)..( 9): Result.003 file - promoters60/2991235
catggaggt

SEQ ID NO: 127435 - DNA, 9 bp, Unknown
  misc_feature (1)..( 9): Result.003 file - promoters60/2991235
catagagaa

SEQ ID NO: 127436 - DNA, 9 bp, Unknown
  misc_feature (1)..( 9): Result.003 file - promoters60/2991235
agtagagaa

SEQ ID NO: 127437 - DNA, 7 bp, Unknown
  misc_feature (1)..( 7): Result.003 file - promoters60/2991235
gataaca

SEQ ID NO: 127438 - DNA, 7 bp, Unknown
  misc_feature (1)..( 7): Result.003 file - promoters60/2991235
gataaca

SEQ ID NO: 127439 - DNA, 8 bp, Unknown
  misc_feature (1)..( 8): Result.003 file - promoters60/2991235
ttgattat

SEQ ID NO: 127440 - DNA, 8 bp, Unknown
  misc_feature (1)..( 8): Result.003 file - promoters60/2991235
ttgcttat

SEQ ID NO: 127441 - DNA, 7 bp, Unknown
  misc_feature (1)..( 7): Result.003 file - promoters60/2991235
tcaacaa

SEQ ID NO: 127442 - DNA, 7 bp, Unknown
  misc_feature (1)..( 7): Result.003 file - promoters60/2991235
gcaacaa

SEQ ID NO: 127443 - DNA, 7 bp, Unknown
  misc_feature (1)..( 7): Result.003 file - promoters60/2991235
tcaacac

SEQ ID NO: 127444 - DNA, 8 bp, Unknown
  misc_feature (1)..( 8): Result.003 file - promoters60/2991235
aaacccaa

SEQ ID NO: 127445 - DNA, 8 bp, Unknown
  misc_feature (1)..( 8): Result.003 file - promoters60/2991235
caacacaa

SEQ ID NO: 127446 - DNA, 8 bp, Unknown
  misc_feature (1)..( 8): Result.003 file - promoters60/2991235
caacacca

SEQ ID NO: 127447 - DNA, 8 bp, Unknown
  misc_feature (1)..( 8): Result.003 file - promoters60/2991235
gaaaaaac

SEQ ID NO: 127448 - DNA, 8 bp, Unknown
  misc_feature (1)..( 8): Result.003 file - promoters60/2991235
gaagaaac

SEQ ID NO: 127449 - DNA, 6 bp, Unknown
  misc_feature (1)..( 6): Result.003 file - promoters60/2991235
gaagat

SEQ ID NO: 127450 - DNA, 6 bp, Unknown
  misc_feature (1)..( 6): Result.003 file - promoters60/2991235
gaagat

SEQ ID NO: 127451 - DNA, 13 bp, Unknown
  misc_feature (1)..( 13): Result.003 file - promoters60/2991235
gaagcatttagta

SEQ ID NO: 127452 - DNA, 13 bp, Unknown
  misc_feature (1)..( 13): Result.003 file - promoters60/2991235
gaagcacgaatgt

SEQ ID NO: 127453 - DNA, 13 bp, Unknown
  misc_feature (1)..( 13): Result.003 file - promoters60/2991235
gaagtagcattta

SEQ ID NO: 127454 - DNA, 7 bp, Unknown
  misc_feature (1)..( 7): Result.003 file - promoters60/2991235
cgttcat

SEQ ID NO: 127455 - DNA, 7 bp, Unknown
  misc_feature (1)..( 7): Result.003 file - promoters60/2991235
cgtacat

SEQ ID NO: 127456 - DNA, 8 bp, Unknown
  misc_feature (1)..( 8): Result.003 file - promoters60/2991235
gtagagtg

SEQ ID NO: 127457 - DNA, 8 bp, Unknown
  misc_feature (1)..( 8): Result.003 file - promoters60/2991235
gtagagaa

SEQ ID NO: 127458 - DNA, 8 bp, Unknown
  misc_feature (1)..( 8): Result.003 file - promoters60/2991235
atagagaa

SEQ ID NO: 127459 - DNA, 7 bp, Unknown
  misc_feature (1)..( 7): Result.003 file - promoters60/2991235
acaggta

SEQ ID NO: 127460 - DNA, 7 bp, Unknown
  misc_feature (1)..( 7): Result.003 file - promoters60/2991235
acaggta

SEQ ID NO: 127461 - DNA, 7 bp, Unknown
  misc_feature (1)..( 7): Result.003 file - promoters60/2991235
tttccag

SEQ ID NO: 127462 - DNA, 7 bp, Unknown
  misc_feature (1)..( 7): Result.003 file - promoters60/2991235
ttttcag

SEQ ID NO: 127463 - DNA, 6 bp, Unknown
  misc_feature (1)..( 6): Result.003 file - promoters60/2991235
gattct

SEQ ID NO: 127464 - DNA, 6 bp, Unknown
  misc_feature (1)..( 6): Result.003 file - promoters60/2991235
gattct

SEQ ID NO: 127465 - DNA, 8 bp, Unknown
  misc_feature (1)..( 8): Result.003 file - promoters60/2991235
attgtaga

SEQ ID NO: 127466 - DNA, 8 bp, Unknown
  misc_feature (1)..( 8): Result.003 file - promoters60/2991235
attgcaga

SEQ ID NO: 127467 - DNA, 7 bp, Unknown
  misc_feature (1)..( 7): Result.003 file - promoters60/2991235
agactgg

SEQ ID NO: 127468 - DNA, 7 bp, Unknown
  misc_feature (1)..( 7): Result.003 file - promoters60/2991235
agaatgg

SEQ ID NO: 127469 - DNA, 9 bp, Unknown
  misc_feature (1)..( 9): Result.003 file - promoters60/2991235
gactctact

SEQ ID NO: 127470 - DNA, 9 bp, Unknown
  misc_feature (1)..( 9): Result.003 file - promoters60/2991235
gactttact

SEQ ID NO: 127471 - DNA, 6 bp, Unknown
  misc_feature (1)..( 6): Result.003 file - promoters60/2991235
aaagaa

SEQ ID NO: 127472 - DNA, 6 bp, Unknown
  misc_feature (1)..( 6): Result.003 file - promoters60/2991235
aaagaa

SEQ ID NO: 127473 - DNA, 8 bp, Unknown
  misc_feature (1)..( 8): Result.003 file - promoters60/2991235
aaggagaa

SEQ ID NO: 127474 - DNA, 8 bp, Unknown
  misc_feature (1)..( 8): Result.003 file - promoters60/2991235
aagaagaa

SEQ ID NO: 127475 - DNA, 6 bp, Unknown
  misc_feature (1)..( 6): Result.003 file - promoters60/2991235
caaaag

SEQ ID NO: 127476 - DNA, 6 bp, Unknown
  misc_feature (1)..( 6): Result.003 file - promoters60/2991235
caaaag

SEQ ID NO: 127477 - DNA, 6 bp, Unknown
  misc_feature (1)..( 6): Result.003 file - promoters60/2991235
ttgaag

SEQ ID NO: 127478 - DNA, 6 bp, Unknown
  misc_feature (1)..( 6): Result.003 file - promoters60/2991235
ttgaag

SEQ ID NO: 127479 - DNA, 7 bp, Unknown
  misc_feature (1)..( 7): Result.003 file - promoters60/2991235
ctctatt

SEQ ID NO: 127480 - DNA, 7 bp, Unknown
  misc_feature (1)..( 7): Result.003 file - promoters60/2991235
ctccatt

SEQ ID NO: 127481 - DNA, 10 bp, Unknown
  misc_feature (1)..( 10): Result.003 file - promoters60/2991239
ttaaaaaaaa

SEQ ID NO: 127482 - DNA, 10 bp, Unknown
  misc_feature (1)..( 10): Result.003 file - promoters60/2991239
caaaacaaaa

SEQ ID NO: 127483 - DNA, 10 bp, Unknown
  misc_feature (1)..( 10): Result.003 file - promoters60/2991239
acaaaaaaaa

SEQ ID NO: 127484 - DNA, 10 bp, Unknown
  misc_feature (1)..( 10): Result.003 file - promoters60/2991239
ttaaaaaagg

SEQ ID NO: 127485 - DNA, 9 bp, Unknown
  misc_feature (1)..( 9): Result.003 file - promoters60/2991239
ctaatctaa

SEQ ID NO: 127486 - DNA, 9 bp, Unknown
  misc_feature (1)..( 9): Result.003 file - promoters60/2991239
ctagtctca

SEQ ID NO: 127487 - DNA, 9 bp, Unknown
  misc_feature (1)..( 9): Result.003 file - promoters60/2991239
ataatataa

SEQ ID NO: 127488 - DNA, 10 bp, Unknown
  misc_feature (1)..( 10): Result.003 file - promoters60/2991239
aaaaatgctc

SEQ ID NO: 127489 - DNA, 10 bp, Unknown
  misc_feature (1)..( 10): Result.003 file - promoters60/2991239
aaaaatgcaa

SEQ ID NO: 127490 - DNA, 10 bp, Unknown
  misc_feature (1)..( 10): Result.003 file - promoters60/2991239
gtaaatacaa

SEQ ID NO: 127491 - DNA, 8 bp, Unknown
  misc_feature (1)..( 8): Result.003 file - promoters60/2991239
aaatatag

SEQ ID NO: 127492 - DNA, 8 bp, Unknown
  misc_feature (1)..( 8): Result.003 file - promoters60/2991239
aaatattt

SEQ ID NO: 127493 - DNA, 8 bp, Unknown
  misc_feature (1)..( 8): Result.003 file - promoters60/2991239
taatttag

SEQ ID NO: 127494 - DNA, 34 bp, Unknown; identical to SEQ ID NO: 76977
  misc_feature (1)..( 34): Result.003 file - promoters60/2991239

SEQ ID NO: 127495 - DNA, 34 bp, Unknown; identical to SEQ ID NO: 104971
  misc_feature (1)..( 34): Result.003 file - promoters60/2991239

SEQ ID NO: 127496 - DNA, 34 bp, Unknown; identical to SEQ ID NO: 104972
  misc_feature (1)..( 34): Result.003 file - promoters60/2991239

SEQ ID NO: 127497 - DNA, 34 bp, Unknown; identical to SEQ ID NO: 76979
  misc_feature (1)..( 34): Result.003 file - promoters60/2991239

SEQ ID NO: 127498 - DNA, 14 bp, Unknown
  misc_feature (1)..( 14): Result.003 file - promoters60/2991239
attatatatgtgat

SEQ ID NO: 127499 - DNA, 14 bp, Unknown
  misc_feature (1)..( 14): Result.003 file - promoters60/2991239
tcaataaatggaaa

SEQ ID NO: 127500 - DNA, 14 bp, Unknown
  misc_feature (1)..( 14): Result.003 file - promoters60/2991239
agccaaaatggaaa

SEQ ID NO: 127501 - DNA, 14 bp, Unknown
  misc_feature (1)..( 14): Result.003 file - promoters60/2991239
tcattaaaaatcaa

SEQ ID NO: 127502 - DNA, 34 bp, Unknown; identical to SEQ ID NO: 76977
  misc_feature (1)..( 34): Result.003 file - promoters60/2991239

SEQ ID NO: 127503 - DNA, 34 bp, Unknown; identical to SEQ ID NO: 76981
  misc_feature (1)..( 34): Result.003 file - promoters60/2991239

SEQ ID NO: 127504 - DNA, 34 bp, Unknown; identical to SEQ ID NO: 76979
  misc_feature (1)..( 34): Result.003 file - promoters60/2991239

SEQ ID NO: 127505 - DNA, 9 bp, Unknown
  misc_feature (1)..( 9): Result.003 file - promoters60/2991239
taattacag

SEQ ID NO: 127506 - DNA, 9 bp, Unknown
  misc_feature (1)..( 9): Result.003 file - promoters60/2991239
taaatacaa

SEQ ID NO: 127507 - DNA, 9 bp, Unknown
  misc_feature (1)..( 9): Result.003 file - promoters60/2991239
aaaatgcaa

SEQ ID NO: 127508 - DNA, 8 bp, Unknown
  misc_feature (1)..( 8): Result.003 file - promoters60/2991239
gaatccaa

SEQ ID NO: 127509 - DNA, 8 bp, Unknown
  misc_feature (1)..( 8): Result.003 file - promoters60/2991239
taatacaa

SEQ ID NO: 127510 - DNA, 8 bp, Unknown
  misc_feature (1)..( 8): Result.003 file - promoters60/2991239
taaaacac

SEQ ID NO: 127511 - DNA, 15 bp, Unknown
  misc_feature (1)..( 15): Result.003 file - promoters60/2991239
attgaagacttttca

SEQ ID NO: 127512 - DNA, 15 bp, Unknown
  misc_feature (1)..( 15): Result.003 file - promoters60/2991239
attgaagacttttca

SEQ ID NO: 127513 - DNA, 15 bp, Unknown
  misc_feature (1)..( 15): Result.003 file - promoters60/2991239
gtagaagaccatata

SEQ ID NO: 127514 - DNA, 13 bp, Unknown
  misc_feature (1)..( 13): Result.003 file - promoters60/2991239
ctataagctttaa

SEQ ID NO: 127515 - DNA, 13 bp, Unknown
  misc_feature (1)..( 13): Result.003 file - promoters60/2991239
ctataagctttta

SEQ ID NO: 127516 - DNA, 14 bp, Unknown
  misc_feature (1)..( 14): Result.003 file - promoters60/2991239
aagacagcatttaa

SEQ ID NO: 127517 - DNA, 29 bp, Unknown
  misc_feature (1)..( 29): Result.003 file - promoters60/2991239
aagctttaagtctatcgctagactgtcca

SEQ ID NO: 127518 - DNA, 29 bp, Unknown
  misc_feature (1)..( 29): Result.003 file - promoters60/2991239
agcttttaagtctctcgctagactgtcca

SEQ ID NO: 127519 - DNA, 29 bp, Unknown
  misc_feature (1)..( 29): Result.003 file - promoters60/2991239
agcatttaatgatgataacgatttggaag

SEQ ID NO: 127520 - DNA, 12 bp, Unknown
  misc_feature (1)..( 12): Result.003 file - promoters60/2991239
ctttctaataaa

SEQ ID NO: 127521 - DNA, 12 bp, Unknown
  misc_feature (1)..( 12): Result.003 file - promoters60/2991239
ctttcaaataaa

SEQ ID NO: 127522 - DNA, 12 bp, Unknown
  misc_feature (1)..( 12): Result.003 file - promoters60/2991239
tcataaaataag

SEQ ID NO: 127523 - DNA, 9 bp, Unknown
  misc_feature (1)..( 9): Result.003 file - promoters60/2991281
atttgagag

SEQ ID NO: 127524 - DNA, 9 bp, Unknown
  misc_feature (1)..( 9): Result.003 file - promoters60/2991281
ttttgagtg

SEQ ID NO: 127525 - DNA, 9 bp, Unknown
  misc_feature (1)..( 9): Result.003 file - promoters60/2991281
atttgaaat

SEQ ID NO: 127526 - DNA, 9 bp, Unknown
  misc_feature (1)..( 9): Result.003 file - promoters60/2991281
acttgggag

SEQ ID NO: 127527 - DNA, 9 bp, Unknown
  misc_feature (1)..( 9): Result.003 file - promoters60/2991281
atttgagcc

SEQ ID NO: 127528 - DNA, 9 bp, Unknown
  misc_feature (1)..( 9): Result.003 file - promoters60/2991281
atttgattc

SEQ ID NO: 127529 - DNA, 9 bp, Unknown
  misc_feature (1)..( 9): Result.003 file - promoters60/2991281
gttttagag

SEQ ID NO: 127530 - DNA, 9 bp, Unknown
  misc_feature (1)..( 9): Result.003 file - promoters60/2991281
ataaaaatt

SEQ ID NO: 127531 - DNA, 9 bp, Unknown
  misc_feature (1)..( 9): Result.003 file - promoters60/2991281
taaaatatt

SEQ ID NO: 127532 - DNA, 9 bp, Unknown
  misc_feature (1)..( 9): Result.003 file - promoters60/2991281
accaatatt

SEQ ID NO: 127533 - DNA, 10 bp, Unknown
  misc_feature (1)..( 10): Result.003 file - promoters60/2991281
aaaaactata

SEQ ID NO: 127534 - DNA, 10 bp, Unknown
  misc_feature (1)..( 10): Result.003 file - promoters60/2991281
aaaagctaat

SEQ ID NO: 127535 - DNA, 10 bp, Unknown
  misc_feature (1)..( 10): Result.003 file - promoters60/2991281
taaagcttca

SEQ ID NO: 127536 - DNA, 9 bp, Unknown
  misc_feature (1)..( 9): Result.003 file - promoters60/2991281
gtgaaattc

SEQ ID NO: 127537 - DNA, 9 bp, Unknown
  misc_feature (1)..( 9): Result.003 file - promoters60/2991281
atgaaatgt

SEQ ID NO: 127538 - DNA, 9 bp, Unknown
  misc_feature (1)..( 9): Result.003 file - promoters60/2991281
ctgaaattt

SEQ ID NO: 127539 - DNA, 9 bp, Unknown
  misc_feature (1)..( 9): Result.003 file - promoters60/2991281
atgaaatca

SEQ ID NO: 127540 - DNA, 9 bp, Unknown
  misc_feature (1)..( 9): Result.003 file - promoters60/2991281
ttgatattt

SEQ ID NO: 127541 - DNA, 9 bp, Unknown
  misc_feature (1)..( 9): Result.003 file - promoters60/2991281
ctgcaattg

SEQ ID NO: 127542 - DNA, 6 bp, Unknown
  misc_feature (1)..( 6): Result.003 file - promoters60/2991333
ctaaat

SEQ ID NO: 127543 - DNA, 6 bp, Unknown
  misc_feature (1)..( 6): Result.003 file - promoters60/2991333
ctaaat

SEQ ID NO: 127544 - DNA, 7 bp, Unknown
  misc_feature (1)..( 7): Result.003 file - promoters60/2991333
aatcaag

SEQ ID NO: 127545 - DNA, 7 bp, Unknown
  misc_feature (1)..( 7): Result.003 file - promoters60/2991333
aataaag

SEQ ID NO: 127546 - DNA, 7 bp, Unknown
  misc_feature (1)..( 7): Result.003 file - promoters60/2991333
aataaat

SEQ ID NO: 127547 - DNA, 6 bp, Unknown
  misc_feature (1)..( 6): Result.003 file - promoters60/2991333
tgaaaa

SEQ ID NO: 127548 - DNA, 6 bp, Unknown
  misc_feature (1)..( 6): Result.003 file - promoters60/2991333
tgaaaa

SEQ ID NO: 127549 - DNA, 6 bp, Unknown
  misc_feature (1)..( 6): Result.003 file - promoters60/2991333
attaag

SEQ ID NO: 127550 - DNA, 6 bp, Unknown
  misc_feature (1)..( 6): Result.003 file - promoters60/2991333
attaag

SEQ ID NO: 127551 - DNA, 6 bp, Unknown
  misc_feature (1)..( 6): Result.003 file - promoters60/2991333
aaaatg

SEQ ID NO: 127552 - DNA, 6 bp, Unknown
  misc_feature (1)..( 6): Result.003 file - promoters60/2991333
aaaatg

SEQ ID NO: 127553 - DNA, 7 bp, Unknown
  misc_feature (1)..( 7): Result.003 file - promoters60/2991333
ttcttct

SEQ ID NO: 127554 - DNA, 7 bp, Unknown
  misc_feature (1)..( 7): Result.003 file - promoters60/2991333
ttcctct

SEQ ID NO: 127555 - DNA, 6 bp, Unknown
  misc_feature (1)..( 6): Result.003 file - promoters60/2991333
tcaaat

SEQ ID NO: 127556 - DNA, 6 bp, Unknown
  misc_feature (1)..( 6): Result.003 file - promoters60/2991333
tcaaat

SEQ ID NO: 127557 - DNA, 7 bp, Unknown
  misc_feature (1)..( 7): Result.003 file - promoters60/2991333
aacgaat

SEQ ID NO: 127558 - DNA, 7 bp, Unknown
  misc_feature (1)..( 7): Result.003 file - promoters60/2991333
aactaat

SEQ ID NO: 127559 - DNA, 8 bp, Unknown
  misc_feature (1)..( 8): Result.003 file - promoters60/2991333
aaaagaaa

SEQ ID NO: 127560 - DNA, 8 bp, Unknown
  misc_feature (1)..( 8): Result.003 file - promoters60/2991333
aaaataaa

SEQ ID NO: 127561 - DNA, 8 bp, Unknown
  misc_feature (1)..( 8): Result.003 file - promoters60/2991333
gtaataaa

SEQ ID NO: 127562 - DNA, 7 bp, Unknown
  misc_feature (1)..( 7): Result.003 file - promoters60/2991333
gaaaaaa

SEQ ID NO: 127563 - DNA, 7 bp, Unknown
  misc_feature (1)..( 7): Result.003 file - promoters60/2991333
gaaaaaa

SEQ ID NO: 127564 - DNA, 7 bp, Unknown
  misc_feature (1)..( 7): Result.003 file - promoters60/2991333
accacac

SEQ ID NO: 127565 - DNA, 7 bp, Unknown
  misc_feature (1)..( 7): Result.003 file - promoters60/2991333
accacac

SEQ ID NO: 127566 - DNA, 6 bp, Unknown
  misc_feature (1)..( 6): Result.003 file - promoters60/2991333
aaacac

SEQ ID NO: 127567 - DNA, 6 bp, Unknown
  misc_feature (1)..( 6): Result.003 file - promoters60/2991333
aaacac

SEQ ID NO: 127568 - DNA, 6 bp, Unknown
  misc_feature (1)..( 6): Result.003 file - promoters60/2991333
cttctc

SEQ ID NO: 127569 - DNA, 6 bp, Unknown
  misc_feature (1)..( 6): Result.003 file - promoters60/2991333
cttctc

SEQ ID NO: 127570 - DNA, 8 bp, Unknown
  misc_feature (1)..( 8): Result.003 file - promoters60/2991333
tctccaaa

SEQ ID NO: 127571 - DNA, 8 bp, Unknown
  misc_feature (1)..( 8): Result.003 file - promoters60/2991333
tctccaaa

SEQ ID NO: 127572 - DNA, 8 bp, Unknown
  misc_feature (1)..( 8): Result.003 file - promoters60/2991333
attgaaga

SEQ ID NO: 127573 - DNA, 8 bp, Unknown
  misc_feature (1)..( 8): Result.003 file - promoters60/2991333
attaaaga

SEQ ID NO: 127574 - DNA, 6 bp, Unknown
  misc_feature (1)..( 6): Result.003 file - promoters60/2991333
aaattt

SEQ ID NO: 127575 - DNA, 6 bp, Unknown
  misc_feature (1)..( 6): Result.003 file - promoters60/2991333
aaattt

SEQ ID NO: 127576 - DNA, 6 bp, Unknown
  misc_feature (1)..( 6): Result.003 file - promoters60/2991333
aaggat

SEQ ID NO: 127577 - DNA, 6 bp, Unknown
  misc_feature (1)..( 6): Result.003 file - promoters60/2991333
aaggat

SEQ ID NO: 127578 - DNA, 10 bp, Unknown
  misc_feature (1)..( 10): Result.003 file - promoters60/2991466
atactaattg

SEQ ID NO: 127579 - DNA, 10 bp, Unknown
  misc_feature (1)..( 10): Result.003 file - promoters60/2991466
atactatttg

SEQ ID NO: 127580 - DNA, 10 bp, Unknown
  misc_feature (1)..( 10): Result.003 file - promoters60/2991466
ttcaatgtag

SEQ ID NO: 127581 - DNA, 10 bp, Unknown
  misc_feature (1)..( 10): Result.003 file - promoters60/2991466
ttcaatttta

SEQ ID NO: 127582 - DNA, 10 bp, Unknown
  misc_feature (1)..( 10): Result.003 file - promoters60/2991466
atcattttta

SEQ ID NO: 127583 - DNA, 7 bp, Unknown
  misc_feature (1)..( 7): Result.003 file - promoters60/2991466
caatgta

SEQ ID NO: 127584 - DNA, 7 bp, Unknown
  misc_feature (1)..( 7): Result.003 file - promoters60/2991466
caaagta

SEQ ID NO: 127585 - DNA, 7 bp, Unknown
  misc_feature (1)..( 7): Result.003 file - promoters60/2991466
ttgccac

SEQ ID NO: 127586 - DNA, 7 bp, Unknown
  misc_feature (1)..( 7): Result.003 file - promoters60/2991466
ttgtcac

SEQ ID NO: 127587 - DNA, 10 bp, Unknown
  misc_feature (1)..( 10): Result.003 file - promoters60/2991466
atttttcaaa

SEQ ID NO: 127588 - DNA, 10 bp, Unknown
  misc_feature (1)..( 10): Result.003 file - promoters60/2991466
atttttggaa

SEQ ID NO: 127589 - DNA, 10 bp, Unknown
  misc_feature (1)..( 10): Result.003 file - promoters60/2991466
attattcaaa

SEQ ID NO: 127590 - DNA, 6 bp, Unknown
  misc_feature (1)..( 6): Result.003 file - promoters60/2991466
caaaac

SEQ ID NO: 127591 - DNA, 6 bp, Unknown
  misc_feature (1)..( 6): Result.003 file - promoters60/2991466
caaaac

SEQ ID NO: 127592 - DNA, 7 bp, Unknown
  misc_feature (1)..( 7): Result.003 file - promoters60/2991466
aatgatc

SEQ ID NO: 127593 - DNA, 7 bp, Unknown
  misc_feature (1)..( 7): Result.003 file - promoters60/2991466
aattatc

SEQ ID NO: 127594 - DNA, 7 bp, Unknown
  misc_feature (1)..( 7): Result.003 file - promoters60/2991466
aatcttg

SEQ ID NO: 127595 - DNA, 7 bp, Unknown
  misc_feature (1)..( 7): Result.003 file - promoters60/2991466
aattttg

SEQ ID NO: 127596 - DNA, 8 bp, Unknown
  misc_feature (1)..( 8): Result.003 file - promoters60/2991466
acaaagaa

SEQ ID NO: 127597 - DNA, 8 bp, Unknown
  misc_feature (1)..( 8): Result.003 file - promoters60/2991466
acagagaa

SEQ ID NO: 127598 - DNA, 6 bp, Unknown
  misc_feature (1)..( 6): Result.003 file - promoters60/2991466
aaaaaa

SEQ ID NO: 127599 - DNA, 6 bp, Unknown
  misc_feature (1)..( 6): Result.003 file - promoters60/2991466
aaaaaa

SEQ ID NO: 127600 - DNA, 6 bp, Unknown
  misc_feature (1)..( 6): Result.003 file - promoters60/2991466
aaaaat

SEQ ID NO: 127601 - DNA, 7 bp, Unknown
  misc_feature (1)..( 7): Result.003 file - promoters60/2991466
tactccc

SEQ ID NO: 127602 - DNA, 7 bp, Unknown
  misc_feature (1)..( 7): Result.003 file - promoters60/2991466
tacaccc

SEQ ID NO: 127603 - DNA, 9 bp, Unknown
  misc_feature (1)..( 9): Result.003 file - promoters60/2991466
tcattatta

SEQ ID NO: 127604 - DNA, 9 bp, Unknown
  misc_feature (1)..( 9): Result.003 file - promoters60/2991466
tcattttta

SEQ ID NO: 127605 - DNA, 9 bp, Unknown
  misc_feature (1)..( 9): Result.003 file - promoters60/2991466
tcaatttta

SEQ ID NO: 127606 - DNA, 6 bp, Unknown
  misc_feature (1)..( 6): Result.003 file - promoters60/2991466
agaaaa

SEQ ID NO: 127607 - DNA, 6 bp, Unknown
  misc_feature (1)..( 6): Result.003 file - promoters60/2991466
agaaaa

SEQ ID NO: 127608 - DNA, 9 bp, Unknown
  misc_feature (1)..( 9): Result.003 file - promoters60/2991466
agaactaat

SEQ ID NO: 127609 - DNA, 9 bp, Unknown
  misc_feature (1)..( 9): Result.003 file - promoters60/2991466
agaacaaat

SEQ ID NO: 127610 - DNA, 7 bp, Unknown
  misc_feature (1)..( 7): Result.003 file - promoters60/2991466
ttatatt

SEQ ID NO: 127611 - DNA, 7 bp, Unknown
  misc_feature (1)..( 7): Result.003 file - promoters60/2991466
ttagatt

SEQ ID NO: 127612 - DNA, 6 bp, Unknown
  misc_feature (1)..( 6): Result.003 file - promoters60/2991466
aaccaa

SEQ ID NO: 127613 - DNA, 6 bp, Unknown
  misc_feature (1)..( 6): Result.003 file - promoters60/2991466
aaccaa

SEQ ID NO: 127614 - DNA, 7 bp, Unknown
  misc_feature (1)..( 7): Result.003 file - promoters60/2991466
atagtac

SEQ ID NO: 127615 - DNA, 7 bp, Unknown
  misc_feature (1)..( 7): Result.003 file - promoters60/2991466
ataatac

SEQ ID NO: 127616 - DNA, 9 bp, Unknown
  misc_feature (1)..( 9): Result.003 file - promoters60/2991466
gaaacaaat

SEQ ID NO: 127617 - DNA, 9 bp, Unknown
  misc_feature (1)..( 9): Result.003 file - promoters60/2991466
aaaataaat

SEQ ID NO: 127618 - DNA, 9 bp, Unknown
  misc_feature (1)..( 9): Result.003 file - promoters60/2991466
taactaaca

SEQ ID NO: 127619 - DNA, 7 bp, Unknown
  misc_feature (1)..( 7): Result.003 file - promoters60/2991466
aaaaaga

SEQ ID NO: 127620 - DNA, 7 bp, Unknown
  misc_feature (1)..( 7): Result.003 file - promoters60/2991466
aaaaaga

SEQ ID NO: 127621 - DNA, 6 bp, Unknown
  misc_feature (1)..( 6): Result.003 file - promoters60/2991466
tgaatt

SEQ ID NO: 127622 - DNA, 6 bp, Unknown
  misc_feature (1)..( 6): Result.003 file - promoters60/2991466
tgaatt

SEQ ID NO: 127623 - DNA, 6 bp, Unknown
  misc_feature (1)..( 6): Result.003 file - promoters60/2991466
aaaaat

SEQ ID NO: 127624 - DNA, 6 bp, Unknown
  misc_feature (1)..( 6): Result.003 file - promoters60/2991466
aaaaat

SEQ ID NO: 127625 - DNA, 12 bp, Unknown
  misc_feature (1)..( 12): Result.003 file - promoters60/2991489
acaatgggctgg

SEQ ID NO: 127626 - DNA, 12 bp, Unknown
  misc_feature (1)..( 12): Result.003 file - promoters60/2991489
caaatgggccta

SEQ ID NO: 127627 - DNA, 12 bp, Unknown
  misc_feature (1)..( 12): Result.003 file - promoters60/2991489
gaaataggccca

SEQ ID NO: 127628 - DNA, 12 bp, Unknown
  misc_feature (1)..( 12): Result.003 file - promoters60/2991489
taaaaaggccca

SEQ ID NO: 127629 - DNA, 12 bp, Unknown
  misc_feature (1)..( 12): Result.003 file - promoters60/2991489
taaaaaatatct

SEQ ID NO: 127630 - DNA, 12 bp, Unknown
  misc_feature (1)..( 12): Result.003 file - promoters60/2991489
cctaaaggccca

SEQ ID NO: 127631 - DNA, 7 bp, Unknown
  misc_feature (1)..( 7): Result.003 file - promoters60/2991507
aaattta

SEQ ID NO: 127632 - DNA, 7 bp, Unknown
  misc_feature (1)..( 7): Result.003 file - promoters60/2991507
aaagtta

SEQ ID NO: 127633 - DNA, 7 bp, Unknown
  misc_feature (1)..( 7): Result.003 file - promoters60/2991507
tcaatat

SEQ ID NO: 127634 - DNA, 7 bp, Unknown
  misc_feature (1)..( 7): Result.003 file - promoters60/2991507
tcattat

SEQ ID NO: 127635 - DNA, 8 bp, Unknown
  misc_feature (1)..( 8): Result.003 file - promoters60/2991507
tcattttt

SEQ ID NO: 127636 - DNA, 8 bp, Unknown
  misc_feature (1)..( 8): Result.003 file - promoters60/2991507
tcattttt

SEQ ID NO: 127637 - DNA, 8 bp, Unknown
  misc_feature (1)..( 8): Result.003 file - promoters60/2991507
tgttttta

SEQ ID NO: 127638 - DNA, 8 bp, Unknown
  misc_feature (1)..( 8): Result.003 file - promoters60/2991507
tgtttttt

SEQ ID NO: 127639 - DNA, 9 bp, Unknown
  misc_feature (1)..( 9): Result.003 file - promoters60/2991507
gatttatta

SEQ ID NO: 127640 - DNA, 14 bp, Unknown
  misc_feature (1)..( 14): Result.003 file - promoters60/2991507
atcaactaattttc

SEQ ID NO: 127641 - DNA, 14 bp, Unknown
  misc_feature (1)..( 14): Result.003 file - promoters60/2991507
ttttactaactttc

SEQ ID NO: 127642 - DNA, 14 bp, Unknown
  misc_feature (1)..( 14): Result.003 file - promoters60/2991507
ttttaataacagga

SEQ ID NO: 127643 - DNA, 7 bp, Unknown
  misc_feature (1)..( 7): Result.003 file - promoters60/2991507
taaaatt

SEQ ID NO: 127644 - DNA, 7 bp, Unknown
  misc_feature (1)..( 7): Result.003 file - promoters60/2991507
taaaatc

SEQ ID NO: 127645 - DNA, 7 bp, Unknown
  misc_feature (1)..( 7): Result.003 file - promoters60/2991507
caaaatc

SEQ ID NO: 127646 - DNA, 6 bp, Unknown
  misc_feature (1)..( 6): Result.003 file - promoters60/2991507
tagtta

SEQ ID NO: 127647 - DNA, 6 bp, Unknown
  misc_feature (1)..( 6): Result.003 file - promoters60/2991507
tagtta

SEQ ID NO: 127648 - DNA, 7 bp, Unknown
  misc_feature (1)..( 7): Result.003 file - promoters60/2991507
tttcaca

SEQ ID NO: 127649 - DNA, 7 bp, Unknown
  misc_feature (1)..( 7): Result.003 file - promoters60/2991507
ttttaca

SEQ ID NO: 127650 - DNA, 7 bp, Unknown
  misc_feature (1)..( 7): Result.003 file - promoters60/2991507
tttcact

SEQ ID NO: 127651 - DNA, 7 bp, Unknown
  misc_feature (1)..( 7): Result.003 file - promoters60/2991507
attttgg

SEQ ID NO: 127652 - DNA, 7 bp, Unknown
  misc_feature (1)..( 7): Result.003 file - promoters60/2991507
attgtgg

SEQ ID NO: 127653 - DNA, 7 bp, Unknown
  misc_feature (1)..( 7): Result.003 file - promoters60/2991507
tttaatc

SEQ ID NO: 127654 - DNA, 7 bp, Unknown
  misc_feature (1)..( 7): Result.003 file - promoters60/2991507
tttaatc

SEQ ID NO: 127655 - DNA, 8 bp, Unknown
  misc_feature (1)..( 8): Result.003 file - promoters60/2991507
acttgata

SEQ ID NO: 127656 - DNA, 8 bp, Unknown
  misc_feature (1)..( 8): Result.003 file - promoters60/2991507
acttcata

SEQ ID NO: 127657 - DNA, 7 bp, Unknown
  misc_feature (1)..( 7): Result.003 file - promoters60/2991507
gatcgag

SEQ ID NO: 127658 - DNA, 7 bp, Unknown
  misc_feature (1)..( 7): Result.003 file - promoters60/2991507
gatcgat

SEQ ID NO: 127659 - DNA, 7 bp, Unknown
  misc_feature (1)..( 7): Result.003 file - promoters60/2991507
gatggat

SEQ ID NO: 127660 - DNA, 6 bp, Unknown
  misc_feature (1)..( 6): Result.003 file - promoters60/2991507
tgataa

SEQ ID NO: 127661 - DNA, 6 bp, Unknown
  misc_feature (1)..( 6): Result.003 file - promoters60/2991507
tgataa

SEQ ID NO: 127662 - DNA, 10 bp, Unknown
  misc_feature (1)..( 10): Result.003 file - promoters60/2991507
gcgatgaatg

SEQ ID NO: 127663 - DNA, 10 bp, Unknown
  misc_feature (1)..( 10): Result.003 file - promoters60/2991507
gcggtgaatg

SEQ ID NO: 127664 - DNA, 7 bp, Unknown
  misc_feature (1)..( 7): Result.003 file - promoters60/2991507
ttatgtc

SEQ ID NO: 127665 - DNA, 7 bp, Unknown
  misc_feature (1)..( 7): Result.003 file - promoters60/2991507
ttatgtc

SEQ ID NO: 127666 - DNA, 7 bp, Unknown
  misc_feature (1)..( 7): Result.003 file - promoters60/2991507
attggta

SEQ ID NO: 127667 - DNA, 7 bp, Unknown
  misc_feature (1)..( 7): Result.003 file - promoters60/2991507
attagta

SEQ ID NO: 127668 - DNA, 7 bp, Unknown
  misc_feature (1)..( 7): Result.003 file - promoters60/2991507
gattcag

SEQ ID NO: 127669 - DNA, 7 bp, Unknown
  misc_feature (1)..( 7): Result.003 file - promoters60/2991507
gattcag

SEQ ID NO: 127670 - DNA, 11 bp, Unknown
  misc_feature (1)..( 11): Result.003 file - promoters60/2991515
atgttttgttg

SEQ ID NO: 127671 - DNA, 11 bp, Unknown
  misc_feature (1)..( 11): Result.003 file - promoters60/2991515
ctttttttttg

SEQ ID NO: 127672 - DNA, 12 bp, Unknown
  misc_feature (1)..( 12): Result.003 file - promoters60/2991515
tctttttatttg

SEQ ID NO: 127673 - DNA, 8 bp, Unknown
  misc_feature (1)..( 8): Result.003 file - promoters60/2991515
ttttttgt

SEQ ID NO: 127674 - DNA, 8 bp, Unknown
  misc_feature (1)..( 8): Result.003 file - promoters60/2991515
ccttttgt

SEQ ID NO: 127675 - DNA, 8 bp, Unknown
  misc_feature (1)..( 8): Result.003 file - promoters60/2991515
ttttttgc

SEQ ID NO: 127676 - DNA, 8 bp, Unknown
  misc_feature (1)..( 8): Result.003 file - promoters60/2991515
gtttatgc

SEQ ID NO: 127677 - DNA, 7 bp, Unknown
  misc_feature (1)..( 7): Result.003 file - promoters60/2991515
tttaatt

SEQ ID NO: 127678 - DNA, 7 bp, Unknown
  misc_feature (1)..( 7): Result.003 file - promoters60/2991515
tttaata

SEQ ID NO: 127679 - DNA, 7 bp, Unknown
  misc_feature (1)..( 7): Result.003 file - promoters60/2991515
tttgata

SEQ ID NO: 127680 - DNA, 8 bp, Unknown
  misc_feature (1)..( 8): Result.003 file - promoters60/2991515
gaaacatt

SEQ ID NO: 127681 - DNA, 8 bp, Unknown
  misc_feature (1)..( 8): Result.003 file - promoters60/2991515
caaaaatt

SEQ ID NO: 127682 - DNA, 8 bp, Unknown
  misc_feature (1)..( 8): Result.003 file - promoters60/2991515
gaatcata

SEQ ID NO: 127683 - DNA, 11 bp, Unknown
  misc_feature (1)..( 11): Result.003 file - promoters60/2991515
aataaaaaact

SEQ ID NO: 127684 - DNA, 11 bp, Unknown
  misc_feature (1)..( 11): Result.003 file - promoters60/2991515
aattaaaagaa

SEQ ID NO: 127685 - DNA, 11 bp, Unknown
  misc_feature (1)..( 11): Result.003 file - promoters60/2991515
aattaaatact

SEQ ID NO: 127686 - DNA, 9 bp, Unknown
  misc_feature (1)..( 9): Result.003 file - promoters60/2991515
tcatgttct

SEQ ID NO: 127687 - DNA, 9 bp, Unknown
  misc_feature (1)..( 9): Result.003 file - promoters60/2991515
tcaagttcg

SEQ ID NO: 127688 - DNA, 9 bp, Unknown
  misc_feature (1)..( 9): Result.003 file - promoters60/2991515
tcttgttct

SEQ ID NO: 127689 - DNA, 8 bp, Unknown
  misc_feature (1)..( 8): Result.003 file - promoters60/2991515
tatagttt

SEQ ID NO: 127690 - DNA, 8 bp, Unknown
  misc_feature (1)..( 8): Result.003 file - promoters60/2991515
tatggttt

SEQ ID NO: 127691 - DNA, 8 bp, Unknown
  misc_feature (1)..( 8): Result.003 file - promoters60/2991515
aatggttg

SEQ ID NO: 127692 - DNA, 7 bp, Unknown
  misc_feature (1)..( 7): Result.003 file - promoters60/2991515
aaacagt

SEQ ID NO: 127693 - DNA, 7 bp, Unknown
  misc_feature (1)..( 7): Result.003 file - promoters60/2991515
aaaaagt

SEQ ID NO: 127694 - DNA, 7 bp, Unknown
  misc_feature (1)..( 7): Result.003 file - promoters60/2991515
aaacagt

SEQ ID NO: 127695 - DNA, 9 bp, Unknown
  misc_feature (1)..( 9): Result.003 file - promoters60/2991515
aaattaatt

SEQ ID NO: 127696 - DNA, 9 bp, Unknown
  misc_feature (1)..( 9): Result.003 file - promoters60/2991515
aaattcatt

SEQ ID NO: 127697 - DNA, 9 bp, Unknown
  misc_feature (1)..( 9): Result.003 file - promoters60/2991515
aaattcata

SEQ ID NO: 127698 - DNA, 10 bp, Unknown
  misc_feature (1)..( 10): Result.003 file - promoters60/2991774
taatgataat

SEQ ID NO: 127699 - DNA, 10 bp, Unknown
  misc_feature (1)..( 10): Result.003 file - promoters60/2991774
aaattataag

SEQ ID NO: 127700 - DNA, 10 bp, Unknown
  misc_feature (1)..( 10): Result.003 file - promoters60/2991774
cccggataat

SEQ ID NO: 127701 - DNA, 10 bp, Unknown
  misc_feature (1)..( 10): Result.003 file - promoters60/2991774
aaactatata

SEQ ID NO: 127702 - DNA, 10 bp, Unknown
  misc_feature (1)..( 10): Result.003 file - promoters60/2991774
aaattaaaaa

SEQ ID NO: 127703 - DNA, 6 bp, Unknown
  misc_feature (1)..( 6): Result.003 file - promoters60/2992000
ttctaa

SEQ ID NO: 127704 - DNA, 6 bp, Unknown
  misc_feature (1)..( 6): Result.003 file - promoters60/2992000
ttctaa

SEQ ID NO: 127705 - DNA, 9 bp, Unknown
  misc_feature (1)..( 9): Result.003 file - promoters60/2992000
atttgaaag

SEQ ID NO: 127706 - DNA, 9 bp, Unknown
  misc_feature (1)..( 9): Result.003 file - promoters60/2992000
attggaaag

SEQ ID NO: 127707 - DNA, 6 bp, Unknown
  misc_feature (1)..( 6): Result.003 file - promoters60/2992000
aataat

SEQ ID NO: 127708 - DNA, 6 bp, Unknown
  misc_feature (1)..( 6): Result.003 file - promoters60/2992000
aataat

SEQ ID NO: 127709 - DNA, 7 bp, Unknown
  misc_feature (1)..( 7): Result.003 file - promoters60/2992000
cccaaaa

SEQ ID NO: 127710 - DNA, 7 bp, Unknown
  misc_feature (1)..( 7): Result.003 file - promoters60/2992000
cccaaaa

SEQ ID NO: 127711 - DNA, 6 bp, Unknown
  misc_feature (1)..( 6): Result.003 file - promoters60/2992000
aatcat

SEQ ID NO: 127712 - DNA, 6 bp, Unknown
  misc_feature (1)..( 6): Result.003 file - promoters60/2992000
aatcat

SEQ ID NO: 127713 - DNA, 10 bp, Unknown
  misc_feature (1)..( 10): Result.003 file - promoters60/2992000
tatgatatat

SEQ ID NO: 127714 - DNA, 10 bp, Unknown
  misc_feature (1)..( 10): Result.003 file - promoters60/2992000
tattatatat

SEQ ID NO: 127715 - DNA, 6 bp, Unknown
  misc_feature (1)..( 6): Result.003 file - promoters60/2992000
aaatta

SEQ ID NO: 127716 - DNA, 6 bp, Unknown
  misc_feature (1)..( 6): Result.003 file - promoters60/2992000
aaatta

SEQ ID NO: 127717 - DNA, 7 bp, Unknown
  misc_feature (1)..( 7): Result.003 file - promoters60/2992000
attacaa

SEQ ID NO: 127718 - DNA, 7 bp, Unknown
  misc_feature (1)..( 7): Result.003 file - promoters60/2992000
atttcaa

SEQ ID NO: 127719 - DNA, 7 bp, Unknown
  misc_feature (1)..( 7): Result.003 file - promoters60/2992000
tatcact

SEQ ID NO: 127720 - DNA, 7 bp, Unknown
  misc_feature (1)..( 7): Result.003 file - promoters60/2992000
tattact

SEQ ID NO: 127721 - DNA, 6 bp, Unknown
  misc_feature (1)..( 6): Result.003 file - promoters60/2992101
ttccca

SEQ ID NO: 127722 - DNA, 6 bp, Unknown
  misc_feature (1)..( 6): Result.003 file - promoters60/2992101
ttccca

SEQ ID NO: 127723 - DNA, 8 bp, Unknown
  misc_feature (1)..( 8): Result.003 file - promoters60/2992101
ccgtatct

SEQ ID NO: 127724 - DNA, 8 bp, Unknown
  misc_feature (1)..( 8): Result.003 file - promoters60/2992101
ccgtttct

SEQ ID NO: 127725 - DNA, 9 bp, Unknown
  misc_feature (1)..( 9): Result.003 file - promoters60/2992101
cttcatatg

SEQ ID NO: 127726 - DNA, 9 bp, Unknown
  misc_feature (1)..( 9): Result.003 file - promoters60/2992101
tttcttatg

SEQ ID NO: 127727 - DNA, 10 bp, Unknown
  misc_feature (1)..( 10): Result.003 file - promoters60/2992101
tttacttctg

SEQ ID NO: 127728 - DNA, 6 bp, Unknown
  misc_feature (1)..( 6): Result.003 file - promoters60/2992101
tcaaac

SEQ ID NO: 127729 - DNA, 6 bp, Unknown
  misc_feature (1)..( 6): Result.003 file - promoters60/2992101
tcaaac

SEQ ID NO: 127730 - DNA, 9 bp, Unknown
  misc_feature (1)..( 9): Result.003 file - promoters60/2992101
ttagggttt

SEQ ID NO: 127731 - DNA, 9 bp, Unknown
  misc_feature (1)..( 9): Result.003 file - promoters60/2992101
ttaggattt

SEQ ID NO: 127732 - DNA, 7 bp, Unknown
  misc_feature (1)..( 7): Result.003 file - promoters60/2992101
tgaattg

SEQ ID NO: 127733 - DNA, 7 bp, Unknown
  misc_feature (1)..( 7): Result.003 file - promoters60/2992101
tgagttg

SEQ ID NO: 127734 - DNA, 6 bp, Unknown
  misc_feature (1)..( 6): Result.003 file - promoters60/2992101
aaaaaa

SEQ ID NO: 127735 - DNA, 6 bp, Unknown
  misc_feature (1)..( 6): Result.003 file - promoters60/2992101
aaaaaa

SEQ ID NO: 127736 - DNA, 6 bp, Unknown
  misc_feature (1)..( 6): Result.003 file - promoters60/2992101
ttgact

SEQ ID NO: 127737 - DNA, 6 bp, Unknown
  misc_feature (1)..( 6): Result.003 file - promoters60/2992101
ttgact

SEQ ID NO: 127738 - DNA, 8 bp, Unknown
  misc_feature (1)..( 8): Result.003 file - promoters60/2992101
tctcttct

SEQ ID NO: 127739 - DNA, 8 bp, Unknown
  misc_feature (1)..( 8): Result.003 file - promoters60/2992101
tcttttct

SEQ ID NO: 127740 - DNA, 8 bp, Unknown
  misc_feature (1)..( 8): Result.003 file - promoters60/2992101
gcttatct

SEQ ID NO: 127741 - DNA, 7 bp, Unknown
  misc_feature (1)..( 7): Result.003 file - promoters60/2992101
tggattt

SEQ ID NO: 127742 - DNA, 7 bp, Unknown
  misc_feature (1)..( 7): Result.003 file - promoters60/2992101
tggattt

SEQ ID NO: 127743 - DNA, 7 bp, Unknown
  misc_feature (1)..( 7): Result.003 file - promoters60/2992101
ttgctta

SEQ ID NO: 127744 - DNA, 7 bp, Unknown
  misc_feature (1)..( 7): Result.003 file - promoters60/2992101
ttgatta

SEQ ID NO: 127745 - DNA, 6 bp, Unknown
  misc_feature (1)..( 6): Result.003 file - promoters60/2992101
ttagtc

SEQ ID NO: 127746 - DNA, 6 bp, Unknown
  misc_feature (1)..( 6): Result.003 file - promoters60/2992101
ttagtc

SEQ ID NO: 127747 - DNA, 6 bp, Unknown
  misc_feature (1)..( 6): Result.003 file - promoters60/2992101
gatgtg

SEQ ID NO: 127748 - DNA, 6 bp, Unknown
  misc_feature (1)..( 6): Result.003 file - promoters60/2992101
gatgtg

SEQ ID NO: 127749 - DNA, 7 bp, Unknown
  misc_feature (1)..( 7): Result.003 file - promoters60/2992101
caaaaaa

SEQ ID NO: 127750 - DNA, 7 bp, Unknown
  misc_feature (1)..( 7): Result.003 file - promoters60/2992101
caaaaaa

SEQ ID NO: 127751 - DNA, 11 bp, Unknown
  misc_feature (1)..( 11): Result.003 file - promoters60/2992247
gacaaagatat

SEQ ID NO: 127752 - DNA, 11 bp, Unknown
  misc_feature (1)..( 11): Result.003 file - promoters60/2992247
agcttagatat

SEQ ID NO: 127753 - DNA, 11 bp, Unknown
  misc_feature (1)..( 11): Result.003 file - promoters60/2992247
ctgaaacatat

SEQ ID NO: 127754 - DNA, 11 bp, Unknown
  misc_feature (1)..( 11): Result.003 file - promoters60/2992247
cttaaatattt

SEQ ID NO: 127755 - DNA, 10 bp, Unknown
  misc_feature (1)..( 10): Result.003 file - promoters60/2992247
aaatccaaaa

SEQ ID NO: 127756 - DNA, 10 bp, Unknown
  misc_feature (1)..( 10): Result.003 file - promoters60/2992247
aaatcaaaaa

SEQ ID NO: 127757 - DNA, 11 bp, Unknown
  misc_feature (1)..( 11): Result.003 file - promoters60/2992247
gtgatcaaatc

SEQ ID NO: 127758 - DNA, 11 bp, Unknown
  misc_feature (1)..( 11): Result.003 file - promoters60/2992247
aaagtcacaag

SEQ ID NO: 127759 - DNA, 17 bp, Unknown
  misc_feature (1)..( 17): Result.003 file - promoters60/2992281
gtacaatgggctgggcc

SEQ ID NO: 127760 - DNA, 17 bp, Unknown
  misc_feature (1)..( 17): Result.003 file - promoters60/2992281
tacaaatgggcctaatt

SEQ ID NO: 127761 - DNA, 17 bp, Unknown
  misc_feature (1)..( 17): Result.003 file - promoters60/2992281
cttaaatgggccaatat

SEQ ID NO: 127762 - DNA, 17 bp, Unknown
  misc_feature (1)..( 17): Result.003 file - promoters60/2992281
ttttaatgggccgaatt

SEQ ID NO: 127763 - DNA, 17 bp, Unknown
  misc_feature (1)..( 17): Result.003 file - promoters60/2992281
gcccaatagtggaagtc

SEQ ID NO: 127764 - DNA, 10 bp, Unknown
  misc_feature (1)..( 10): Result.003 file - promoters60/2992349
tttcttaaac

SEQ ID NO: 127765 - DNA, 10 bp, Unknown
  misc_feature (1)..( 10): Result.003 file - promoters60/2992349
ccccttaaaa

SEQ ID NO: 127766 - DNA, 10 bp, Unknown
  misc_feature (1)..( 10): Result.003 file - promoters60/2992349
cttctgaaac

SEQ ID NO: 127767 - DNA, 10 bp, Unknown
  misc_feature (1)..( 10): Result.003 file - promoters60/2992349
cttcagaaag

SEQ ID NO: 127768 - DNA, 11 bp, Unknown
  misc_feature (1)..( 11): Result.003 file - promoters60/2992349
cattatatata

SEQ ID NO: 127769 - DNA, 11 bp, Unknown
  misc_feature (1)..( 11): Result.003 file - promoters60/2992349
tattaaatacg

SEQ ID NO: 127770 - DNA, 11 bp, Unknown
  misc_feature (1)..( 11): Result.003 file - promoters60/2992349
tataaaaagtt

SEQ ID NO: 127771 - DNA, 11 bp, Unknown
  misc_feature (1)..( 11): Result.003 file - promoters60/2992349
cattatataaa

SEQ ID NO: 127772 - DNA, 9 bp, Unknown
  misc_feature (1)..( 9): Result.003 file - promoters60/2992349
aacaaaaaa

SEQ ID NO: 127773 - DNA, 9 bp, Unknown
  misc_feature (1)..( 9): Result.003 file - promoters60/2992349
aactaaagt

SEQ ID NO: 127774 - DNA, 9 bp, Unknown
  misc_feature (1)..( 9): Result.003 file - promoters60/2992349
aactaaaaa

SEQ ID NO: 127775 - DNA, 9 bp, Unknown
  misc_feature (1)..( 9): Result.003 file - promoters60/2992349
aacaaaacc

SEQ ID NO: 127776 - DNA, 6 bp, Unknown
  misc_feature (1)..( 6): Result.003 file - promoters60/2992373
ttcaaa

SEQ ID NO: 127777 - DNA, 6 bp, Unknown
  misc_feature (1)..( 6): Result.003 file - promoters60/2992373
ttcaaa

SEQ ID NO: 127778 - DNA, 6 bp, Unknown
  misc_feature (1)..( 6): Result.003 file - promoters60/2992373
ggtgtt

SEQ ID NO: 127779 - DNA, 6 bp, Unknown
  misc_feature (1)..( 6): Result.003 file - promoters60/2992373
ggtgtt

SEQ ID NO: 127780 - DNA, 8 bp, Unknown
  misc_feature (1)..( 8): Result.003 file - promoters60/2992373
acccccta

SEQ ID NO: 127781 - DNA, 8 bp, Unknown
  misc_feature (1)..( 8): Result.003 file - promoters60/2992373
acccgcta

SEQ ID NO: 127782 - DNA, 6 bp, Unknown
  misc_feature (1)..( 6): Result.003 file - promoters60/2992373
atccga

SEQ ID NO: 127783 - DNA, 6 bp, Unknown
  misc_feature (1)..( 6): Result.003 file - promoters60/2992373
atccga

SEQ ID NO: 127784 - DNA, 8 bp, Unknown
  misc_feature (1)..( 8): Result.003 file - promoters60/2992373
ttgggctg

SEQ ID NO: 127785 - DNA, 8 bp, Unknown
  misc_feature (1)..( 8): Result.003 file - promoters60/2992373
ttgggctg

SEQ ID NO: 127786 - DNA, 8 bp, Unknown
  misc_feature (1)..( 8): Result.003 file - promoters60/2992373
cattcgga

SEQ ID NO: 127787 - DNA, 8 bp, Unknown
  misc_feature (1)..( 8): Result.003 file - promoters60/2992373
catttgga

SEQ ID NO: 127788 - DNA, 7 bp, Unknown
  misc_feature (1)..( 7): Result.003 file - promoters60/2992373
accttaa

SEQ ID NO: 127789 - DNA, 7 bp, Unknown
  misc_feature (1)..( 7): Result.003 file - promoters60/2992373
accataa

SEQ ID NO: 127790 - DNA, 7 bp, Unknown
  misc_feature (1)..( 7): Result.003 file - promoters60/2992373
caataaa

SEQ ID NO: 127791 - DNA, 7 bp, Unknown
  misc_feature (1)..( 7): Result.003 file - promoters60/2992373
caacaaa

SEQ ID NO: 127792 - DNA, 6 bp, Unknown
  misc_feature (1)..( 6): Result.003 file - promoters60/2992373
gaatgg

SEQ ID NO: 127793 - DNA, 6 bp, Unknown
  misc_feature (1)..( 6): Result.003 file - promoters60/2992373
gaatgg

SEQ ID NO: 127794 - DNA, 7 bp, Unknown
  misc_feature (1)..( 7): Result.003 file - promoters60/2992373
aaatgaa

SEQ ID NO: 127795 - DNA, 7 bp, Unknown
  misc_feature (1)..( 7): Result.003 file - promoters60/2992373
aaaggaa

SEQ ID NO: 127796 - DNA, 6 bp, Unknown
  misc_feature (1)..( 6): Result.003 file - promoters60/2992373
tgtttt

SEQ ID NO: 127797 - DNA, 6 bp, Unknown
  misc_feature (1)..( 6): Result.003 file - promoters60/2992373
tgtttt

SEQ ID NO: 127798 - DNA, 6 bp, Unknown
  misc_feature (1)..( 6): Result.003 file - promoters60/2992373
ttttga

SEQ ID NO: 127799 - DNA, 6 bp, Unknown
  misc_feature (1)..( 6): Result.003 file - promoters60/2992373
ttttga

SEQ ID NO: 127800 - DNA, 10 bp, Unknown
  misc_feature (1)..( 10): Result.003 file - promoters60/2992373
tttaatgaag

SEQ ID NO: 127801 - DNA, 10 bp, Unknown
  misc_feature (1)..( 10): Result.003 file - promoters60/2992373
tttaaggaag

SEQ ID NO: 127802 - DNA, 7 bp, Unknown
  misc_feature (1)..( 7): Result.003 file - promoters60/2992373
gatgtat

SEQ ID NO: 127803 - DNA, 7 bp, Unknown
  misc_feature (1)..( 7): Result.003 file - promoters60/2992373
gatctat

SEQ ID NO: 127804 - DNA, 10 bp, Unknown
  misc_feature (1)..( 10): Result.003 file - promoters60/2992373
caaggtaaat

SEQ ID NO: 127805 - DNA, 10 bp, Unknown
  misc_feature (1)..( 10): Result.003 file - promoters60/2992373
caaggtaaat

SEQ ID NO: 127806 - DNA, 6 bp, Unknown
  misc_feature (1)..( 6): Result.003 file - promoters60/2992373
tcttaa

SEQ ID NO: 127807 - DNA, 6 bp, Unknown
  misc_feature (1)..( 6): Result.003 file - promoters60/2992373
tcttaa

SEQ ID NO: 127808 - DNA, 8 bp, Unknown
  misc_feature (1)..( 8): Result.003 file - promoters60/2992373
actctaaa

SEQ ID NO: 127809 - DNA, 8 bp, Unknown
  misc_feature (1)..( 8): Result.003 file - promoters60/2992373
actctaaa

SEQ ID NO: 127810 - DNA, 10 bp, Unknown
  misc_feature (1)..( 10): Result.003 file - promoters60/2992722
aaaagatagc

SEQ ID NO: 127811 - DNA, 10 bp, Unknown
  misc_feature (1)..( 10): Result.003 file - promoters60/2992722
gaaatatata

SEQ ID NO: 127812 - DNA, 10 bp, Unknown
  misc_feature (1)..( 10): Result.003 file - promoters60/2992722
gaaatagatt

SEQ ID NO: 127813 - DNA, 10 bp, Unknown
  misc_feature (1)..( 10): Result.003 file - promoters60/2992722
ttagtagatt

SEQ ID NO: 127814 - DNA, 10 bp, Unknown
  misc_feature (1)..( 10): Result.003 file - promoters60/2992722
ttaatttatt

SEQ ID NO: 127815 - DNA, 10 bp, Unknown
  misc_feature (1)..( 10): Result.003 file - promoters60/2992722
tgattacttt

SEQ ID NO: 127816 - DNA, 16 bp, Unknown
  misc_feature (1)..( 16): Result.003 file - promoters60/2993642
tcataagaatttgaaa

SEQ ID NO: 127817 - DNA, 16 bp, Unknown
  misc_feature (1)..( 16): Result.003 file - promoters60/2993642
tatcgtctatttaaaa

SEQ ID NO: 127818 - DNA, 16 bp, Unknown
  misc_feature (1)..( 16): Result.003 file - promoters60/2993642
aataaagtatttaaac

SEQ ID NO: 127819 - DNA, 16 bp, Unknown
  misc_feature (1)..( 16): Result.003 file - promoters60/2993642
acaaaaaaattgaaac

SEQ ID NO: 127820 - DNA, 16 bp, Unknown
  misc_feature (1)..( 16): Result.003 file - promoters60/2993642
aataaaatatttaaat

SEQ ID NO: 127821 - DNA, 16 bp, Unknown
  misc_feature (1)..( 16): Result.003 file - promoters60/2993642
aaaaaactattggggt

SEQ ID NO: 127822 - DNA, 16 bp, Unknown
  misc_feature (1)..( 16): Result.003 file - promoters60/2993642
agaaaaagattgtgtt

SEQ ID NO: 127823 - DNA, 15 bp, Unknown
  misc_feature (1)..( 15): Result.003 file - promoters60/2993642
tttatatatttttaa

SEQ ID NO: 127824 - DNA, 15 bp, Unknown
  misc_feature (1)..( 15): Result.003 file - promoters60/2993642
aactaggattcttac

SEQ ID NO: 127825 - DNA, 15 bp, Unknown
  misc_feature (1)..( 15): Result.003 file - promoters60/2993642
tttatatattttgtc

SEQ ID NO: 127826 - DNA, 15 bp, Unknown
  misc_feature (1)..( 15): Result.003 file - promoters60/2993642
ttataggatttttct

SEQ ID NO: 127827 - DNA, 15 bp, Unknown
  misc_feature (1)..( 15): Result.003 file - promoters60/2993642
aagagagattctttg

SEQ ID NO: 127828 - DNA, 15 bp, Unknown
  misc_feature (1)..( 15): Result.003 file - promoters60/2993642
aaagatcattcgtac

SEQ ID NO: 127829 - DNA, 15 bp, Unknown
  misc_feature (1)..( 15): Result.003 file - promoters60/2993642
aatctttgttctttt

SEQ ID NO: 127830 - DNA, 9 bp, Unknown
  misc_feature (1)..( 9): Result.003 file - promoters60/2993705
ttacgaaag

SEQ ID NO: 127831 - DNA, 9 bp, Unknown
  misc_feature (1)..( 9): Result.003 file - promoters60/2993705
ttacggaag

SEQ ID NO: 127832 - DNA, 7 bp, Unknown
  misc_feature (1)..( 7): Result.003 file - promoters60/2993705
acaaaga

SEQ ID NO: 127833 - DNA, 7 bp, Unknown
  misc_feature (1)..( 7): Result.003 file - promoters60/2993705
acagaga

SEQ ID NO: 127834 - DNA, 7 bp, Unknown
  misc_feature (1)..( 7): Result.003 file - promoters60/2993705
tatatat

SEQ ID NO: 127835 - DNA, 7 bp, Unknown
  misc_feature (1)..( 7): Result.003 file - promoters60/2993705
tatatat

SEQ ID NO: 127836 - DNA, 6 bp, Unknown
  misc_feature (1)..( 6): Result.003 file - promoters60/2993705
tcataa

SEQ ID NO: 127837 - DNA, 6 bp, Unknown
  misc_feature (1)..( 6): Result.003 file - promoters60/2993705
tcataa

SEQ ID NO: 127838 - DNA, 6 bp, Unknown
  misc_feature (1)..( 6): Result.003 file - promoters60/2993705
catttc

SEQ ID NO: 127839 - DNA, 6 bp, Unknown
  misc_feature (1)..( 6): Result.003 file - promoters60/2993705
catttc

SEQ ID NO: 127840 - DNA, 7 bp, Unknown
  misc_feature (1)..( 7): Result.003 file - promoters60/2993705
catatgt

SEQ ID NO: 127841 - DNA, 7 bp, Unknown
  misc_feature (1)..( 7): Result.003 file - promoters60/2993705
catatgt

SEQ ID NO: 127842 - DNA, 6 bp, Unknown
  misc_feature (1)..( 6): Result.003 file - promoters60/2993705
caagtc

SEQ ID NO: 127843 - DNA, 6 bp, Unknown
  misc_feature (1)..( 6): Result.003 file - promoters60/2993705
caagtc

SEQ ID NO: 127844 - DNA, 9 bp, Unknown
  misc_feature (1)..( 9): Result.003 file - promoters60/2993705
attaaatat

SEQ ID NO: 127845 - DNA, 9 bp, Unknown
  misc_feature (1)..( 9): Result.003 file - promoters60/2993705
attatatat

SEQ ID NO: 127846 - DNA, 7 bp, Unknown
  misc_feature (1)..( 7): Result.003 file - promoters60/2993705
gattcat

SEQ ID NO: 127847 - DNA, 7 bp, Unknown
  misc_feature (1)..( 7): Result.003 file - promoters60/2993705
gatacat

SEQ ID NO: 127848 - DNA, 8 bp, Unknown
  misc_feature (1)..( 8): Result.003 file - promoters60/2993705
gtcgctct

SEQ ID NO: 127849 - DNA, 8 bp, Unknown
  misc_feature (1)..( 8): Result.003 file - promoters60/2993705
gtcgatct

SEQ ID NO: 127850 - DNA, 6 bp, Unknown
  misc_feature (1)..( 6): Result.003 file - promoters60/2993705
taaact

SEQ ID NO: 127851 - DNA, 6 bp, Unknown
  misc_feature (1)..( 6): Result.003 file - promoters60/2993705
taaact

SEQ ID NO: 127852 - DNA, 8 bp, Unknown
  misc_feature (1)..( 8): Result.003 file - promoters60/2993705
aatggtgt

SEQ ID NO: 127853 - DNA, 8 bp, Unknown
  misc_feature (1)..( 8): Result.003 file - promoters60/2993705
aatgttgt

SEQ ID NO: 127854 - DNA, 6 bp, Unknown
  misc_feature (1)..( 6): Result.003 file - promoters60/2993705
aatgtt

SEQ ID NO: 127855 - DNA, 6 bp, Unknown
  misc_feature (1)..( 6): Result.003 file - promoters60/2993705
aatgtt

SEQ ID NO: 127856 - DNA, 7 bp, Unknown
  misc_feature (1)..( 7): Result.003 file - promoters60/2993705
tgttcat

SEQ ID NO: 127857 - DNA, 7 bp, Unknown
  misc_feature (1)..( 7): Result.003 file - promoters60/2993705
tgtacat

SEQ ID NO: 127858 - DNA, 6 bp, Unknown
  misc_feature (1)..( 6): Result.003 file - promoters60/2993705
tatgag

SEQ ID NO: 127859 - DNA, 6 bp, Unknown
  misc_feature (1)..( 6): Result.003 file - promoters60/2993705
tatgag

SEQ ID NO: 127860 - DNA, 8 bp, Unknown
  misc_feature (1)..( 8): Result.003 file - promoters60/2993705
gatgtttc

SEQ ID NO: 127861 - DNA, 8 bp, Unknown
  misc_feature (1)..( 8): Result.003 file - promoters60/2993705
gatgtttc

SEQ ID NO: 127862 - DNA, 10 bp, Unknown
  misc_feature (1)..( 10): Result.003 file - promoters60/2994916
tttttctaat

SEQ ID NO: 127863 - DNA, 10 bp, Unknown
  misc_feature (1)..( 10): Result.003 file - promoters60/2994916
tttctctaat

SEQ ID NO: 127864 - DNA, 18 bp, Unknown
  misc_feature (1)..( 18): Result.003 file - promoters60/2994916
agatattttttttaacaa

SEQ ID NO: 127865 - DNA, 18 bp, Unknown
  misc_feature (1)..( 18): Result.003 file - promoters60/2994916
agatattttgtttcacaa

SEQ ID NO: 127866 - DNA, 6 bp, Unknown
  misc_feature (1)..( 6): Result.003 file - promoters60/2994916
tctttt

SEQ ID NO: 127867 - DNA, 6 bp, Unknown
  misc_feature (1)..( 6): Result.003 file - promoters60/2994916
tctttt

SEQ ID NO: 127868 - DNA, 6 bp, Unknown
  misc_feature (1)..( 6): Result.003 file - promoters60/2994916
ttaact

SEQ ID NO: 127869 - DNA, 6 bp, Unknown
  misc_feature (1)..( 6): Result.003 file - promoters60/2994916
ttaact

SEQ ID NO: 127870 - DNA, 7 bp, Unknown
  misc_feature (1)..( 7): Result.003 file - promoters60/2994916
tgaattc

SEQ ID NO: 127871 - DNA, 7 bp, Unknown
  misc_feature (1)..( 7): Result.003 file - promoters60/2994916
tgaattc

SEQ ID NO: 127872 - DNA, 6 bp, Unknown
  misc_feature (1)..( 6): Result.003 file - promoters60/2994916
aaaaca

SEQ ID NO: 127873 - DNA, 6 bp, Unknown
  misc_feature (1)..( 6): Result.003 file - promoters60/2994916
aaaaca

SEQ ID NO: 127874 - DNA, 6 bp, Unknown
  misc_feature (1)..( 6): Result.003 file - promoters60/2994916
tcatca

SEQ ID NO: 127875 - DNA, 6 bp, Unknown
  misc_feature (1)..( 6): Result.003 file - promoters60/2994916
tcatca

SEQ ID NO: 127876 - DNA, 9 bp, Unknown
  misc_feature (1)..( 9): Result.003 file - promoters60/2994916
aggttccta

SEQ ID NO: 127877 - DNA, 9 bp, Unknown
  misc_feature (1)..( 9): Result.003 file - promoters60/2994916
aggttacta

SEQ ID NO: 127878 - DNA, 6 bp, Unknown
  misc_feature (1)..( 6): Result.003 file - promoters60/2994916
aacaaa

SEQ ID NO: 127879 - DNA, 6 bp, Unknown
  misc_feature (1)..( 6): Result.003 file - promoters60/2994916
aacaaa

SEQ ID NO: 127880 - DNA, 8 bp, Unknown
  misc_feature (1)..( 8): Result.003 file - promoters60/2994916
cggtcaag

SEQ ID NO: 127881 - DNA, 8 bp, Unknown
  misc_feature (1)..( 8): Result.003 file - promoters60/2994916
cggttaag

SEQ ID NO: 127882 - DNA, 6 bp, Unknown
  misc_feature (1)..( 6): Result.003 file - promoters60/2994916
aaacta

SEQ ID NO: 127883 - DNA, 6 bp, Unknown
  misc_feature (1)..( 6): Result.003 file - promoters60/2994916
aaacta

SEQ ID NO: 127884 - DNA, 6 bp, Unknown
  misc_feature (1)..( 6): Result.003 file - promoters60/2995898
tcgtcg

SEQ ID NO: 127885 - DNA, 6 bp, Unknown
  misc_feature (1)..( 6): Result.003 file - promoters60/2995898
tcgtcg

SEQ ID NO: 127886 - DNA, 7 bp, Unknown
  misc_feature (1)..( 7): Result.003 file - promoters60/2995898
agagaaa

SEQ ID NO: 127887 - DNA, 7 bp, Unknown
  misc_feature (1)..( 7): Result.003 file - promoters60/2995898
agagaaa

SEQ ID NO: 127888 - DNA, 7 bp, Unknown
  misc_feature (1)..( 7): Result.003 file - promoters60/2995898
agagaag

SEQ ID NO: 127889 - DNA, 7 bp, Unknown
  misc_feature (1)..( 7): Result.003 file - promoters60/2995898
aaattcg

SEQ ID NO: 127890 - DNA, 7 bp, Unknown
  misc_feature (1)..( 7): Result.003 file - promoters60/2995898
aaattcg

SEQ ID NO: 127891 - DNA, 11 bp, Unknown
  misc_feature (1)..( 11): Result.003 file - promoters60/2995898
cgccggcgatt

SEQ ID NO: 127892 - DNA, 11 bp, Unknown
  misc_feature (1)..( 11): Result.003 file - promoters60/2995898
cgccggagatt

SEQ ID NO: 127893 - DNA, 8 bp, Unknown
  misc_feature (1)..( 8): Result.003 file - promoters60/2995898
acgaagaa

SEQ ID NO: 127894 - DNA, 8 bp, Unknown
  misc_feature (1)..( 8): Result.003 file - promoters60/2995898
acgatgaa

SEQ ID NO: 127895 - DNA, 7 bp, Unknown
  misc_feature (1)..( 7): Result.003 file - promoters60/2995898
gtttgtg

SEQ ID NO: 127896 - DNA, 7 bp, Unknown
  misc_feature (1)..( 7): Result.003 file - promoters60/2995898
gttagtg

SEQ ID NO: 127897 - DNA, 8 bp, Unknown
  misc_feature (1)..( 8): Result.003 file - promoters60/2995898
gatagttt

SEQ ID NO: 127898 - DNA, 8 bp, Unknown
  misc_feature (1)..( 8): Result.003 file - promoters60/2995898
gataattt

SEQ ID NO: 127899 - DNA, 8 bp, Unknown
  misc_feature (1)..( 8): Result.003 file - promoters60/2995898
attaattt

SEQ ID NO: 127900 - DNA, 8 bp, Unknown
  misc_feature (1)..( 8): Result.003 file - promoters60/2995898
ttaaaaaa

SEQ ID NO: 127901 - DNA, 8 bp, Unknown
  misc_feature (1)..( 8): Result.003 file - promoters60/2995898
ttaacaaa

SEQ ID NO: 127902 - DNA, 6 bp, Unknown
  misc_feature (1)..( 6): Result.003 file - promoters60/2995898
gaaaat

SEQ ID NO: 127903 - DNA, 6 bp, Unknown
  misc_feature (1)..( 6): Result.003 file - promoters60/2995898
gaaaat

SEQ ID NO: 127904 - DNA, 7 bp, Unknown
  misc_feature (1)..( 7): Result.003 file - promoters60/2995898
gtgaaat

SEQ ID NO: 127905 - DNA, 7 bp, Unknown
  misc_feature (1)..( 7): Result.003 file - promoters60/2995898
gtgaaat

SEQ ID NO: 127906 - DNA, 6 bp, Unknown
  misc_feature (1)..( 6): Result.003 file - promoters60/2995898
gagtga

SEQ ID NO: 127907 - DNA, 6 bp, Unknown
  misc_feature (1)..( 6): Result.003 file - promoters60/2995898
gagtga

SEQ ID NO: 127908 - DNA, 6 bp, Unknown
  misc_feature (1)..( 6): Result.003 file - promoters60/2995898
ttttta

SEQ ID NO: 127909 - DNA, 6 bp, Unknown
  misc_feature (1)..( 6): Result.003 file - promoters60/2995898
ttttta

SEQ ID NO: 127910 - DNA, 6 bp, Unknown
  misc_feature (1)..( 6): Result.003 file - promoters60/2995898
attttt

SEQ ID NO: 127911 - DNA, 6 bp, Unknown
  misc_feature (1)..( 6): Result.003 file - promoters60/2995898
attttt

SEQ ID NO: 127912 - DNA, 8 bp, Unknown
  misc_feature (1)..( 8): Result.003 file - promoters60/2995898
aaatattt

SEQ ID NO: 127913 - DNA, 8 bp, Unknown
  misc_feature (1)..( 8): Result.003 file - promoters60/2995898
aaagattt

SEQ ID NO: 127914 - DNA, 6 bp, Unknown
  misc_feature (1)..( 6): Result.003 file - promoters60/2995898
atttac

SEQ ID NO: 127915 - DNA, 6 bp, Unknown
  misc_feature (1)..( 6): Result.003 file - promoters60/2995898
atttac

SEQ ID NO: 127916 - DNA, 7 bp, Unknown
  misc_feature (1)..( 7): Result.003 file - promoters60/2995898
caaagaa

SEQ ID NO: 127917 - DNA, 7 bp, Unknown
  misc_feature (1)..( 7): Result.003 file - promoters60/2995898
caaagaa

SEQ ID NO: 127918 - DNA, 6 bp, Unknown
  misc_feature (1)..( 6): Result.003 file - promoters60/2995898
tttcaa

SEQ ID NO: 127919 - DNA, 6 bp, Unknown
  misc_feature (1)..( 6): Result.003 file - promoters60/2995898
tttcaa

SEQ ID NO: 127920 - DNA, 7 bp, Unknown
  misc_feature (1)..( 7): Result.003 file - promoters60/2995898
taacgtt

SEQ ID NO: 127921 - DNA, 7 bp, Unknown
  misc_feature (1)..( 7): Result.003 file - promoters60/2995898
taatgtt

SEQ ID NO: 127922 - DNA, 6 bp, Unknown
  misc_feature (1)..( 6): Result.003 file - promoters60/2995898
cttctt

SEQ ID NO: 127923 - DNA, 6 bp, Unknown
  misc_feature (1)..( 6): Result.003 file - promoters60/2995898
cttctt

SEQ ID NO: 127924 - DNA, 7 bp, Unknown
  misc_feature (1)..( 7): Result.003 file - promoters60/2995898
agattgt

SEQ ID NO: 127925 - DNA, 7 bp, Unknown
  misc_feature (1)..( 7): Result.003 file - promoters60/2995898
agattgt

SEQ ID NO: 127926 - DNA, 7 bp, Unknown
  misc_feature (1)..( 7): Result.003 file - promoters60/2995898
atataat

SEQ ID NO: 127927 - DNA, 7 bp, Unknown
  misc_feature (1)..( 7): Result.003 file - promoters60/2995898
atataat

SEQ ID NO: 127928 - DNA, 7 bp, Unknown
  misc_feature (1)..( 7): Result.003 file - promoters60/2995898
tccaaaa

SEQ ID NO: 127929 - DNA, 7 bp, Unknown
  misc_feature (1)..( 7): Result.003 file - promoters60/2995898
tccaaaa

SEQ ID NO: 127930 - DNA, 6 bp, Unknown
  misc_feature (1)..( 6): Result.003 file - promoters60/2995898
aaaatt

SEQ ID NO: 127931 - DNA, 6 bp, Unknown
  misc_feature (1)..( 6): Result.003 file - promoters60/2995898
aaaatt

SEQ ID NO: 127932 - DNA, 6 bp, Unknown
  misc_feature (1)..( 6): Result.003 file - promoters60/2995898
ggtatt

SEQ ID NO: 127933 - DNA, 6 bp, Unknown
  misc_feature (1)..( 6): Result.003 file - promoters60/2995898
ggtatt

SEQ ID NO: 127934 - DNA, 11 bp, Unknown
  misc_feature (1)..( 11): Result.003 file - promoters60/2995898
tttaagttttt

SEQ ID NO: 127935 - DNA, 11 bp, Unknown
  misc_feature (1)..( 11): Result.003 file - promoters60/2995898
tttaacttttt

SEQ ID NO: 127936 - DNA, 10 bp, Unknown
  misc_feature (1)..( 10): Result.003 file - promoters60/2995898
tttttaagtg

SEQ ID NO: 127937 - DNA, 10 bp, Unknown
  misc_feature (1)..( 10): Result.003 file - promoters60/2995898
tttttcagtg

SEQ ID NO: 127938 - DNA, 6 bp, Unknown
  misc_feature (1)..( 6): Result.003 file - promoters60/2995898
agaata

SEQ ID NO: 127939 - DNA, 6 bp, Unknown
  misc_feature (1)..( 6): Result.003 file - promoters60/2995898
agaata

SEQ ID NO: 127940 - DNA, 7 bp, Unknown
  misc_feature (1)..( 7): Result.003 file - promoters60/2996054
acaaaaa

SEQ ID NO: 127941 - DNA, 7 bp, Unknown
  misc_feature (1)..( 7): Result.003 file - promoters60/2996054
acaaaaa

SEQ ID NO: 127942 - DNA, 7 bp, Unknown
  misc_feature (1)..( 7): Result.003 file - promoters60/2996054
tcaaaaa

SEQ ID NO: 127943 - DNA, 10 bp, Unknown
  misc_feature (1)..( 10): Result.003 file - promoters60/2996054
tgttttcact

SEQ ID NO: 127944 - DNA, 10 bp, Unknown
  misc_feature (1)..( 10): Result.003 file - promoters60/2996054
taattttact

SEQ ID NO: 127945 - DNA, 10 bp, Unknown
  misc_feature (1)..( 10): Result.003 file - promoters60/2996054
tgtattcacc

SEQ ID NO: 127946 - DNA, 9 bp, Unknown
  misc_feature (1)..( 9): Result.003 file - promoters60/2996054
aactcttta

SEQ ID NO: 127947 - DNA, 9 bp, Unknown
  misc_feature (1)..( 9): Result.003 file - promoters60/2996054
aactttttt

SEQ ID NO: 127948 - DNA, 10 bp, Unknown
  misc_feature (1)..( 10): Result.003 file - promoters60/2996054
tgttttatta

SEQ ID NO: 127949 - DNA, 7 bp, Unknown
  misc_feature (1)..( 7): Result.003 file - promoters60/2996054
tttattg

SEQ ID NO: 127950 - DNA, 7 bp, Unknown
  misc_feature (1)..( 7): Result.003 file - promoters60/2996054
tttatta

SEQ ID NO: 127951 - DNA, 7 bp, Unknown
  misc_feature (1)..( 7): Result.003 file - promoters60/2996054
tttttta

SEQ ID NO: 127952 - DNA, 9 bp, Unknown
  misc_feature (1)..( 9): Result.003 file - promoters60/2996054
ctgtcatta

SEQ ID NO: 127953 - DNA, 9 bp, Unknown
  misc_feature (1)..( 9): Result.003 file - promoters60/2996054
ctgtcaaag

SEQ ID NO: 127954 - DNA, 9 bp, Unknown
  misc_feature (1)..( 9): Result.003 file - promoters60/2996054
ttgtctaag

SEQ ID NO: 127955 - DNA, 6 bp, Unknown
  misc_feature (1)..( 6): Result.003 file - promoters60/2996080
gtgaga

SEQ ID NO: 127956 - DNA, 6 bp, Unknown
  misc_feature (1)..( 6): Result.003 file - promoters60/2996080
gtgaga

SEQ ID NO: 127957 - DNA, 8 bp, Unknown
  misc_feature (1)..( 8): Result.003 file - promoters60/2996080
ctgtctat

SEQ ID NO: 127958 - DNA, 8 bp, Unknown
  misc_feature (1)..( 8): Result.003 file - promoters60/2996080
ctggctat

SEQ ID NO: 127959 - DNA, 7 bp, Unknown
  misc_feature (1)..( 7): Result.003 file - promoters60/2996080
tttcgag

SEQ ID NO: 127960 - DNA, 7 bp, Unknown
  misc_feature (1)..( 7): Result.003 file - promoters60/2996080
tttggag

SEQ ID NO: 127961 - DNA, 6 bp, Unknown
  misc_feature (1)..( 6): Result.003 file - promoters60/2996080
tgcttt

SEQ ID NO: 127962 - DNA, 6 bp, Unknown
  misc_feature (1)..( 6): Result.003 file - promoters60/2996080
tgcttt

SEQ ID NO: 127963 - DNA, 6 bp, Unknown
  misc_feature (1)..( 6): Result.003 file - promoters60/2996080
tttatt

SEQ ID NO: 127964 - DNA, 6 bp, Unknown
  misc_feature (1)..( 6): Result.003 file - promoters60/2996080
tttatt

SEQ ID NO: 127965 - DNA, 6 bp, Unknown
  misc_feature (1)..( 6): Result.003 file - promoters60/2996080
caacaa

SEQ ID NO: 127966 - DNA, 6 bp, Unknown
  misc_feature (1)..( 6): Result.003 file - promoters60/2996080
caacaa

SEQ ID NO: 127967 - DNA, 6 bp, Unknown
  misc_feature (1)..( 6): Result.003 file - promoters60/2996080
gaaaca

SEQ ID NO: 127968 - DNA, 6 bp, Unknown
  misc_feature (1)..( 6): Result.003 file - promoters60/2996080
gaaaca

SEQ ID NO: 127969 - DNA, 8 bp, Unknown
  misc_feature (1)..( 8): Result.003 file - promoters60/2996080
aaaataag

SEQ ID NO: 127970 - DNA, 8 bp, Unknown
  misc_feature (1)..( 8): Result.003 file - promoters60/2996080
aaattaag

SEQ ID NO: 127971 - DNA, 6 bp, Unknown
  misc_feature (1)..( 6): Result.003 file - promoters60/2996080
tttgat

SEQ ID NO: 127972 - DNA, 6 bp, Unknown
  misc_feature (1)..( 6): Result.003 file - promoters60/2996080
tttgat

SEQ ID NO: 127973 - DNA, 6 bp, Unknown
  misc_feature (1)..( 6): Result.003 file - promoters60/2996080
ggtgga

SEQ ID NO: 127974 - DNA, 6 bp, Unknown
  misc_feature (1)..( 6): Result.003 file - promoters60/2996080
ggtgga

SEQ ID NO: 127975 - DNA, 8 bp, Unknown
  misc_feature (1)..( 8): Result.003 file - promoters60/2996080
cttcaggt

SEQ ID NO: 127976 - DNA, 8 bp, Unknown
  misc_feature (1)..( 8): Result.003 file - promoters60/2996080
ctttaggt

SEQ ID NO: 127977 - DNA, 7 bp, Unknown
  misc_feature (1)..( 7): Result.003 file - promoters60/2996080
gacgacg

SEQ ID NO: 127978 - DNA, 7 bp, Unknown
  misc_feature (1)..( 7): Result.003 file - promoters60/2996080
gacgacg

SEQ ID NO: 127979 - DNA, 7 bp, Unknown
  misc_feature (1)..( 7): Result.003 file - promoters60/2996080
tatcatc

SEQ ID NO: 127980 - DNA, 7 bp, Unknown
  misc_feature (1)..( 7): Result.003 file - promoters60/2996080
tattatc

SEQ ID NO: 127981 - DNA, 8 bp, Unknown
  misc_feature (1)..( 8): Result.003 file - promoters60/2996080
ctcaaaaa

SEQ ID NO: 127982 - DNA, 8 bp, Unknown
  misc_feature (1)..( 8): Result.003 file - promoters60/2996080
ctcagaaa

SEQ ID NO: 127983 - DNA, 8 bp, Unknown
  misc_feature (1)..( 8): Result.003 file - promoters60/2996109
attttttt

SEQ ID NO: 127984 - DNA, 8 bp, Unknown
  misc_feature (1)..( 8): Result.003 file - promoters60/2996109
attatttg

SEQ ID NO: 127985 - DNA, 8 bp, Unknown
  misc_feature (1)..( 8): Result.003 file - promoters60/2996109
attgtttt

SEQ ID NO: 127986 - DNA, 13 bp, Unknown
  misc_feature (1)..( 13): Result.003 file - promoters60/2996109
taattaaacataa

SEQ ID NO: 127987 - DNA, 13 bp, Unknown
  misc_feature (1)..( 13): Result.003 file - promoters60/2996109
taattatgttttg

SEQ ID NO: 127988 - DNA, 13 bp, Unknown
  misc_feature (1)..( 13): Result.003 file - promoters60/2996109
caattaaaaaagg

SEQ ID NO: 127989 - DNA, 13 bp, Unknown
  misc_feature (1)..( 13): Result.003 file - promoters60/2996109
taataaaatataa

SEQ ID NO: 127990 - DNA, 13 bp, Unknown
  misc_feature (1)..( 13): Result.003 file - promoters60/2996109
taattaaacataa

SEQ ID NO: 127991 - DNA, 13 bp, Unknown
  misc_feature (1)..( 13): Result.003 file - promoters60/2996109
gcttccaacttaa

SEQ ID NO: 127992 - DNA, 13 bp, Unknown
  misc_feature (1)..( 13): Result.003 file - promoters60/2996109
taataaaatataa

SEQ ID NO: 127993 - DNA, 7 bp, Unknown
  misc_feature (1)..( 7): Result.003 file - promoters60/2996109
aaacatc

SEQ ID NO: 127994 - DNA, 7 bp, Unknown
  misc_feature (1)..( 7): Result.003 file - promoters60/2996109
aaacatt

SEQ ID NO: 127995 - DNA, 7 bp, Unknown
  misc_feature (1)..( 7): Result.003 file - promoters60/2996109
taacatc

SEQ ID NO: 127996 - DNA, 8 bp, Unknown
  misc_feature (1)..( 8): Result.003 file - promoters60/2996109
ttttctat

SEQ ID NO: 127997 - DNA, 8 bp, Unknown
  misc_feature (1)..( 8): Result.003 file - promoters60/2996109
ttttgtat

SEQ ID NO: 127998 - DNA, 8 bp, Unknown
  misc_feature (1)..( 8): Result.003 file - promoters60/2996109
atttgtaa

SEQ ID NO: 127999 - DNA, 13 bp, Unknown
  misc_feature (1)..( 13): Result.003 file - promoters60/2996109
aacaatcaaatgt

SEQ ID NO: 128000 - DNA, 13 bp, Unknown
  misc_feature (1)..( 13): Result.003 file - promoters60/2996109
tcaggtcaaatcc

SEQ ID NO: 128001 - DNA, 13 bp, Unknown
  misc_feature (1)..( 13): Result.003 file - promoters60/2996109
aacagtcaaaaaa

SEQ ID NO: 128002 - DNA, 13 bp, Unknown
  misc_feature (1)..( 13): Result.003 file - promoters60/2996109
aaatctcaaaaaa

SEQ ID NO: 128003 - DNA, 8 bp, Unknown
  misc_feature (1)..( 8): Result.003 file - promoters60/2996109
aatatacc

SEQ ID NO: 128004 - DNA, 8 bp, Unknown
  misc_feature (1)..( 8): Result.003 file - promoters60/2996109
aatatata

SEQ ID NO: 128005 - DNA, 8 bp, Unknown
  misc_feature (1)..( 8): Result.003 file - promoters60/2996109
catagata

SEQ ID NO: 128006 - DNA, 7 bp, Unknown
  misc_feature (1)..( 7): Result.003 file - promoters60/2996109
tataata

SEQ ID NO: 128007 - DNA, 7 bp, Unknown
  misc_feature (1)..( 7): Result.003 file - promoters60/2996109
tattata

SEQ ID NO: 128008 - DNA, 7 bp, Unknown
  misc_feature (1)..( 7): Result.003 file - promoters60/2996109
tattatg

SEQ ID NO: 128009 - DNA, 7 bp, Unknown
  misc_feature (1)..( 7): Result.003 file - promoters60/2996109
caaaaag

SEQ ID NO: 128010 - DNA, 7 bp, Unknown
  misc_feature (1)..( 7): Result.003 file - promoters60/2996109
aaaaaag

SEQ ID NO: 128011 - DNA, 7 bp, Unknown
  misc_feature (1)..( 7): Result.003 file - promoters60/2996109
aaaaaag

SEQ ID NO: 128012 - DNA, 9 bp, Unknown
  misc_feature (1)..( 9): Result.003 file - promoters60/2996119
aaaaaacga

SEQ ID NO: 128013 - DNA, 9 bp, Unknown
  misc_feature (1)..( 9): Result.003 file - promoters60/2996119
aaacaacga

SEQ ID NO: 128014 - DNA, 9 bp, Unknown
  misc_feature (1)..( 9): Result.003 file - promoters60/2996119
aaataacat

SEQ ID NO: 128015 - DNA, 8 bp, Unknown
  misc_feature (1)..( 8): Result.003 file - promoters60/2996119
aatgtgtt

SEQ ID NO: 128016 - DNA, 8 bp, Unknown
  misc_feature (1)..( 8): Result.003 file - promoters60/2996119
aatatgtt

SEQ ID NO: 128017 - DNA, 9 bp, Unknown
  misc_feature (1)..( 9): Result.003 file - promoters60/2996119
ttggtgagt

SEQ ID NO: 128018 - DNA, 9 bp, Unknown
  misc_feature (1)..( 9): Result.003 file - promoters60/2996119
ttggttagt

SEQ ID NO: 128019 - DNA, 6 bp, Unknown
  misc_feature (1)..( 6): Result.003 file - promoters60/2996119
atactg

SEQ ID NO: 128020 - DNA, 6 bp, Unknown
  misc_feature (1)..( 6): Result.003 file - promoters60/2996119
atactg

SEQ ID NO: 128021 - DNA, 6 bp, Unknown
  misc_feature (1)..( 6): Result.003 file - promoters60/2996119
aggaaa

SEQ ID NO: 128022 - DNA, 6 bp, Unknown
  misc_feature (1)..( 6): Result.003 file - promoters60/2996119
aggaaa

SEQ ID NO: 128023 - DNA, 6 bp, Unknown
  misc_feature (1)..( 6): Result.003 file - promoters60/2996119
aaaaac

SEQ ID NO: 128024 - DNA, 6 bp, Unknown
  misc_feature (1)..( 6): Result.003 file - promoters60/2996119
aaaaac

SEQ ID NO: 128025 - DNA, 6 bp, Unknown
  misc_feature (1)..( 6): Result.003 file - promoters60/2996119
gataaa

SEQ ID NO: 128026 - DNA, 6 bp, Unknown
  misc_feature (1)..( 6): Result.003 file - promoters60/2996119
gataaa

SEQ ID NO: 128027 - DNA, 8 bp, Unknown
  misc_feature (1)..( 8): Result.003 file - promoters60/2996119
aaaatcac

SEQ ID NO: 128028 - DNA, 8 bp, Unknown
  misc_feature (1)..( 8): Result.003 file - promoters60/2996119
aaaatcac

SEQ ID NO: 128029 - DNA, 7 bp, Unknown
  misc_feature (1)..( 7): Result.003 file - promoters60/2996119
gatgaaa

SEQ ID NO: 128030 - DNA, 7 bp, Unknown
  misc_feature (1)..( 7): Result.003 file - promoters60/2996119
gataaaa

SEQ ID NO: 128031 - DNA, 7 bp, Unknown
  misc_feature (1)..( 7): Result.003 file - promoters60/2996119
aatttat

SEQ ID NO: 128032 - DNA, 7 bp, Unknown
  misc_feature (1)..( 7): Result.003 file - promoters60/2996119
aatttat

SEQ ID NO: 128033 - DNA, 9 bp, Unknown
  misc_feature (1)..( 9): Result.003 file - promoters60/2996119
aagaaaaat

SEQ ID NO: 128034 - DNA, 9 bp, Unknown
  misc_feature (1)..( 9): Result.003 file - promoters60/2996119
aaggaaaat

SEQ ID NO: 128035 - DNA, 7 bp, Unknown
  misc_feature (1)..( 7): Result.003 file - promoters60/2996119
tttcttg

SEQ ID NO: 128036 - DNA, 7 bp, Unknown
  misc_feature (1)..( 7): Result.003 file - promoters60/2996119
ttttttg

SEQ ID NO: 128037 - DNA, 6 bp, Unknown
  misc_feature (1)..( 6): Result.003 file - promoters60/2996119
atttta

SEQ ID NO: 128038 - DNA, 6 bp, Unknown
  misc_feature (1)..( 6): Result.003 file - promoters60/2996119
atttta

SEQ ID NO: 128039 - DNA, 6 bp, Unknown
  misc_feature (1)..( 6): Result.003 file - promoters60/2996119
tttttg

SEQ ID NO: 128040 - DNA, 6 bp, Unknown
  misc_feature (1)..( 6): Result.003 file - promoters60/2996119
tttttg

SEQ ID NO: 128041 - DNA, 7 bp, Unknown
  misc_feature (1)..( 7): Result.003 file - promoters60/2996119
tgtggtt

SEQ ID NO: 128042 - DNA, 7 bp, Unknown
  misc_feature (1)..( 7): Result.003 file - promoters60/2996119
tgtggtt

SEQ ID NO: 128043 - DNA, 13 bp, Unknown
  misc_feature (1)..( 13): Result.003 file - promoters60/2996222
acggaattcctcc

SEQ ID NO: 128044 - DNA, 13 bp, Unknown
  misc_feature (1)..( 13): Result.003 file - promoters60/2996222
aaagaatttctcc

SEQ ID NO: 128045 - DNA, 13 bp, Unknown
  misc_feature (1)..( 13): Result.003 file - promoters60/2996222
aaataattgataa

SEQ ID NO: 128046 - DNA, 13 bp, Unknown
  misc_feature (1)..( 13): Result.003 file - promoters60/2996222
tatcaatgtctaa

SEQ ID NO: 128047 - DNA, 10 bp, Unknown
  misc_feature (1)..( 10): Result.003 file - promoters60/2996222
tttactaata

SEQ ID NO: 128048 - DNA, 10 bp, Unknown
  misc_feature (1)..( 10): Result.003 file - promoters60/2996222
attattaaag

SEQ ID NO: 128049 - DNA, 10 bp, Unknown
  misc_feature (1)..( 10): Result.003 file - promoters60/2996222
tttgctatac

SEQ ID NO: 128050 - DNA, 10 bp, Unknown
  misc_feature (1)..( 10): Result.003 file - promoters60/2996222
tataataatt

SEQ ID NO: 128051 - DNA, 10 bp, Unknown
  misc_feature (1)..( 10): Result.003 file - promoters60/2996222
tataatttta

SEQ ID NO: 128052 - DNA, 10 bp, Unknown
  misc_feature (1)..( 10): Result.003 file - promoters60/2996222
tctaatttta

SEQ ID NO: 128053 - DNA, 10 bp, Unknown
  misc_feature (1)..( 10): Result.003 file - promoters60/2996222
aataattatt

SEQ ID NO: 128054 - DNA, 10 bp, Unknown
  misc_feature (1)..( 10): Result.003 file - promoters60/2996222
aataatagta

SEQ ID NO: 128055 - DNA, 11 bp, Unknown
  misc_feature (1)..( 11): Result.003 file - promoters60/2996222
cattttacttt

SEQ ID NO: 128056 - DNA, 11 bp, Unknown
  misc_feature (1)..( 11): Result.003 file - promoters60/2996222
tattttagtcg

SEQ ID NO: 128057 - DNA, 11 bp, Unknown
  misc_feature (1)..( 11): Result.003 file - promoters60/2996222
aattttagcaa

SEQ ID NO: 128058 - DNA, 11 bp, Unknown
  misc_feature (1)..( 11): Result.003 file - promoters60/2996222
atctttaacaa

SEQ ID NO: 128059 - DNA, 11 bp, Unknown
  misc_feature (1)..( 11): Result.003 file - promoters60/2996222
tatttttactc

SEQ ID NO: 128060 - DNA, 10 bp, Unknown
  misc_feature (1)..( 10): Result.003 file - promoters60/2996222
ctatatatat

SEQ ID NO: 128061 - DNA, 10 bp, Unknown
  misc_feature (1)..( 10): Result.003 file - promoters60/2996222
ttatttatat

SEQ ID NO: 128062 - DNA, 10 bp, Unknown
  misc_feature (1)..( 10): Result.003 file - promoters60/2996222
gtatatataa

SEQ ID NO: 128063 - DNA, 10 bp, Unknown
  misc_feature (1)..( 10): Result.003 file - promoters60/2996222
ctatataaac

SEQ ID NO: 128064 - DNA, 10 bp, Unknown
  misc_feature (1)..( 10): Result.003 file - promoters60/2996222
ctataaaaaa

SEQ ID NO: 128065 - DNA, 11 bp, Unknown
  misc_feature (1)..( 11): Result.003 file - promoters60/2996222
aaacaatcatt

SEQ ID NO: 128066 - DNA, 11 bp, Unknown
  misc_feature (1)..( 11): Result.003 file - promoters60/2996222
aaaaaataatt

SEQ ID NO: 128067 - DNA, 11 bp, Unknown
  misc_feature (1)..( 11): Result.003 file - promoters60/2996222
aaaaaattgat

SEQ ID NO: 128068 - DNA, 11 bp, Unknown
  misc_feature (1)..( 11): Result.003 file - promoters60/2996222
aaagaatttct

SEQ ID NO: 128069 - DNA, 9 bp, Unknown
  misc_feature (1)..( 9): Result.003 file - promoters60/2996222
cttttgtta

SEQ ID NO: 128070 - DNA, 9 bp, Unknown
  misc_feature (1)..( 9): Result.003 file - promoters60/2996222
gatttctta

SEQ ID NO: 128071 - DNA, 9 bp, Unknown
  misc_feature (1)..( 9): Result.003 file - promoters60/2996222
aatttctcc

SEQ ID NO: 128072 - DNA, 9 bp, Unknown
  misc_feature (1)..( 9): Result.003 file - promoters60/2996222
aatgtctaa

SEQ ID NO: 128073 - DNA, 9 bp, Unknown
  misc_feature (1)..( 9): Result.003 file - promoters60/2996222
caaagaatt

SEQ ID NO: 128074 - DNA, 9 bp, Unknown
  misc_feature (1)..( 9): Result.003 file - promoters60/2996222
caaacaatc

SEQ ID NO: 128075 - DNA, 9 bp, Unknown
  misc_feature (1)..( 9): Result.003 file - promoters60/2996222
aaaataatt

SEQ ID NO: 128076 - DNA, 9 bp, Unknown
  misc_feature (1)..( 9): Result.003 file - promoters60/2996222
ataacaata

SEQ ID NO: 128077 - DNA, 9 bp, Unknown
  misc_feature (1)..( 9): Result.003 file - promoters60/2996222
ttaaagatc

SEQ ID NO: 128078 - DNA, 9 bp, Unknown
  misc_feature (1)..( 9): Result.003 file - promoters60/2996222
ttaaggatg

SEQ ID NO: 128079 - DNA, 9 bp, Unknown
  misc_feature (1)..( 9): Result.003 file - promoters60/2996222
ttaaagtag

SEQ ID NO: 128080 - DNA, 9 bp, Unknown
  misc_feature (1)..( 9): Result.003 file - promoters60/2996222
aaaaaaatc

SEQ ID NO: 128081 - DNA, 7 bp, Unknown
  misc_feature (1)..( 7): Result.003 file - promoters60/2996290
aaaacaa

SEQ ID NO: 128082 - DNA, 7 bp, Unknown
  misc_feature (1)..( 7): Result.003 file - promoters60/2996290
aaagcaa

SEQ ID NO: 128083 - DNA, 7 bp, Unknown
  misc_feature (1)..( 7): Result.003 file - promoters60/2996290
aactttg

SEQ ID NO: 128084 - DNA, 7 bp, Unknown
  misc_feature (1)..( 7): Result.003 file - promoters60/2996290
aactttg

SEQ ID NO: 128085 - DNA, 11 bp, Unknown
  misc_feature (1)..( 11): Result.003 file - promoters60/2996290
gtaaattattt

SEQ ID NO: 128086 - DNA, 11 bp, Unknown
  misc_feature (1)..( 11): Result.003 file - promoters60/2996290
gtaaatagtaa

SEQ ID NO: 128087 - DNA, 11 bp, Unknown
  misc_feature (1)..( 11): Result.003 file - promoters60/2996290
ataaatactaa

SEQ ID NO: 128088 - DNA, 6 bp, Unknown
  misc_feature (1)..( 6): Result.003 file - promoters60/2996290
ccaaaa

SEQ ID NO: 128089 - DNA, 6 bp, Unknown
  misc_feature (1)..( 6): Result.003 file - promoters60/2996290
ccaaaa

SEQ ID NO: 128090 - DNA, 7 bp, Unknown
  misc_feature (1)..( 7): Result.003 file - promoters60/2996290
aaaataa

SEQ ID NO: 128091 - DNA, 7 bp, Unknown
  misc_feature (1)..( 7): Result.003 file - promoters60/2996290
aaaataa

SEQ ID NO: 128092 - DNA, 6 bp, Unknown
  misc_feature (1)..( 6): Result.003 file - promoters60/2996290
atagaa

SEQ ID NO: 128093 - DNA, 6 bp, Unknown
  misc_feature (1)..( 6): Result.003 file - promoters60/2996290
atagaa

SEQ ID NO: 128094 - DNA, 11 bp, Unknown
  misc_feature (1)..( 11): Result.003 file - promoters60/2996290
aaacataataa

SEQ ID NO: 128095 - DNA, 11 bp, Unknown
  misc_feature (1)..( 11): Result.003 file - promoters60/2996290
aaaaatagtaa

SEQ ID NO: 128096 - DNA, 7 bp, Unknown
  misc_feature (1)..( 7): Result.003 file - promoters60/2996290
aaataat

SEQ ID NO: 128097 - DNA, 7 bp, Unknown
  misc_feature (1)..( 7): Result.003 file - promoters60/2996290
aaataat

SEQ ID NO: 128098 - DNA, 7 bp, Unknown
  misc_feature (1)..( 7): Result.003 file - promoters60/2996290
attcata

SEQ ID NO: 128099 - DNA, 7 bp, Unknown
  misc_feature (1)..( 7): Result.003 file - promoters60/2996290
atttata

SEQ ID NO: 128100 - DNA, 6 bp, Unknown
  misc_feature (1)..( 6): Result.003 file - promoters60/2996290
aaatct

SEQ ID NO: 128101 - DNA, 6 bp, Unknown
  misc_feature (1)..( 6): Result.003 file - promoters60/2996290
aaatct

SEQ ID NO: 128102 - DNA, 6 bp, Unknown
  misc_feature (1)..( 6): Result.003 file - promoters60/2996290
ttttaa

SEQ ID NO: 128103 - DNA, 6 bp, Unknown
  misc_feature (1)..( 6): Result.003 file - promoters60/2996290
ttttaa

SEQ ID NO: 128104 - DNA, 8 bp, Unknown
  misc_feature (1)..( 8): Result.003 file - promoters60/2996290
aatggaac

SEQ ID NO: 128105 - DNA, 8 bp, Unknown
  misc_feature (1)..( 8): Result.003 file - promoters60/2996290
aatgtaac

SEQ ID NO: 128106 - DNA, 6 bp, Unknown
  misc_feature (1)..( 6): Result.003 file - promoters60/2996290
cttttt

SEQ ID NO: 128107 - DNA, 6 bp, Unknown
  misc_feature (1)..( 6): Result.003 file - promoters60/2996290
cttttt

SEQ ID NO: 128108 - DNA, 7 bp, Unknown
  misc_feature (1)..( 7): Result.003 file - promoters60/2996290
aagatct

SEQ ID NO: 128109 - DNA, 7 bp, Unknown
  misc_feature (1)..( 7): Result.003 file - promoters60/2996290
aagatct

SEQ ID NO: 128110 - DNA, 6 bp, Unknown
  misc_feature (1)..( 6): Result.003 file - promoters60/2996290
cactct

SEQ ID NO: 128111 - DNA, 6 bp, Unknown
  misc_feature (1)..( 6): Result.003 file - promoters60/2996290
cactct

SEQ ID NO: 128112 - DNA, 11 bp, Unknown
  misc_feature (1)..( 11): Result.003 file - promoters60/2997951
gctaaaatatc

SEQ ID NO: 128113 - DNA, 11 bp, Unknown
  misc_feature (1)..( 11): Result.003 file - promoters60/2997951
aataaagtata

SEQ ID NO: 128114 - DNA, 11 bp, Unknown
  misc_feature (1)..( 11): Result.003 file - promoters60/2997951
tgcaaaaaacg

SEQ ID NO: 128115 - DNA, 11 bp, Unknown
  misc_feature (1)..( 11): Result.003 file - promoters60/2997951
ataatagtata

SEQ ID NO: 128116 - DNA, 11 bp, Unknown
  misc_feature (1)..( 11): Result.003 file - promoters60/2997951
tttaaaatatt

SEQ ID NO: 128117 - DNA, 11 bp, Unknown
  misc_feature (1)..( 11): Result.003 file - promoters60/2997951
caaaaaacatt

SEQ ID NO: 128118 - DNA, 6 bp, Unknown
  misc_feature (1)..( 6): Result.003 file - promoters60/3003010
caaacc

SEQ ID NO: 128119 - DNA, 6 bp, Unknown
  misc_feature (1)..( 6): Result.003 file - promoters60/3003010
caaacc

SEQ ID NO: 128120 - DNA, 7 bp, Unknown
  misc_feature (1)..( 7): Result.003 file - promoters60/3003010
tttaggt

SEQ ID NO: 128121 - DNA, 7 bp, Unknown
  misc_feature (1)..( 7): Result.003 file - promoters60/3003010
ttttggt

SEQ ID NO: 128122 - DNA, 6 bp, Unknown
  misc_feature (1)..( 6): Result.003 file - promoters60/3003010
ttcagt

SEQ ID NO: 128123 - DNA, 6 bp, Unknown
  misc_feature (1)..( 6): Result.003 file - promoters60/3003010
ttcagt

SEQ ID NO: 128124 - DNA, 6 bp, Unknown
  misc_feature (1)..( 6): Result.003 file - promoters60/3003010
aatttt

SEQ ID NO: 128125 - DNA, 6 bp, Unknown
  misc_feature (1)..( 6): Result.003 file - promoters60/3003010
aatttt

SEQ ID NO: 128126 - DNA, 7 bp, Unknown
  misc_feature (1)..( 7): Result.003 file - promoters60/3003010
taaaaat

SEQ ID NO: 128127 - DNA, 7 bp, Unknown
  misc_feature (1)..( 7): Result.003 file - promoters60/3003010
taataat

SEQ ID NO: 128128 - DNA, 7 bp, Unknown
  misc_feature (1)..( 7): Result.003 file - promoters60/3003010
caaaatt

SEQ ID NO: 128129 - DNA, 7 bp, Unknown
  misc_feature (1)..( 7): Result.003 file - promoters60/3003010
caatatt

SEQ ID NO: 128130 - DNA, 7 bp, Unknown
  misc_feature (1)..( 7): Result.003 file - promoters60/3003010
caatatg

SEQ ID NO: 128131 - DNA, 8 bp, Unknown
  misc_feature (1)..( 8): Result.003 file - promoters60/3003010
aattatat

SEQ ID NO: 128132 - DNA, 8 bp, Unknown
  misc_feature (1)..( 8): Result.003 file - promoters60/3003010
aattgtat

SEQ ID NO: 128133 - DNA, 6 bp, Unknown
  misc_feature (1)..( 6): Result.003 file - promoters60/3003010
aataaa

SEQ ID NO: 128134 - DNA, 6 bp, Unknown
  misc_feature (1)..( 6): Result.003 file - promoters60/3003010
aataaa

SEQ ID NO: 128135 - DNA, 7 bp, Unknown
  misc_feature (1)..( 7): Result.003 file - promoters60/3003010
tacagta

SEQ ID NO: 128136 - DNA, 7 bp, Unknown
  misc_feature (1)..( 7): Result.003 file - promoters60/3003010
tactgta

SEQ ID NO: 128137 - DNA, 8 bp, Unknown
  misc_feature (1)..( 8): Result.003 file - promoters60/3003010
aaaaaaat

SEQ ID NO: 128138 - DNA, 8 bp, Unknown
  misc_feature (1)..( 8): Result.003 file - promoters60/3003010
aaaataat

SEQ ID NO: 128139 - DNA, 6 bp, Unknown
  misc_feature (1)..( 6): Result.003 file - promoters60/3011901
ataaaa

SEQ ID NO: 128140 - DNA, 6 bp, Unknown
  misc_feature (1)..( 6): Result.003 file - promoters60/3011901
ataaaa

SEQ ID NO: 128141 - DNA, 6 bp, Unknown
  misc_feature (1)..( 6): Result.003 file - promoters60/3011901
aaaaca

SEQ ID NO: 128142 - DNA, 6 bp, Unknown
  misc_feature (1)..( 6): Result.003 file - promoters60/3011901
aaaaca

SEQ ID NO: 128143 - DNA, 6 bp, Unknown
  misc_feature (1)..( 6): Result.003 file - promoters60/3011901
agtgca

SEQ ID NO: 128144 - DNA, 6 bp, Unknown
  misc_feature (1)..( 6): Result.003 file - promoters60/3011901
agtgca

SEQ ID NO: 128145 - DNA, 6 bp, Unknown
  misc_feature (1)..( 6): Result.003 file - promoters60/3011901
ttaaaa

SEQ ID NO: 128146 - DNA, 6 bp, Unknown
  misc_feature (1)..( 6): Result.003 file - promoters60/3011901
ttaaaa

SEQ ID NO: 128147 - DNA, 6 bp, Unknown
  misc_feature (1)..( 6): Result.003 file - promoters60/3011901
agaaaa

SEQ ID NO: 128148 - DNA, 6 bp, Unknown
  misc_feature (1)..( 6): Result.003 file - promoters60/3011901
agaaaa

SEQ ID NO: 128149 - DNA, 6 bp, Unknown
  misc_feature (1)..( 6): Result.003 file - promoters60/3011901
gaagag

SEQ ID NO: 128150 - DNA, 6 bp, Unknown
  misc_feature (1)..( 6): Result.003 file - promoters60/3011901
gaagag

SEQ ID NO: 128151 - DNA, 7 bp, Unknown
  misc_feature (1)..( 7): Result.003 file - promoters60/3011901
aaaactt

SEQ ID NO: 128152 - DNA, 7 bp, Unknown
  misc_feature (1)..( 7): Result.003 file - promoters60/3011901
aaaactt

SEQ ID NO: 128153 - DNA, 9 bp, Unknown
  misc_feature (1)..( 9): Result.003 file - promoters60/3011901
aattcgtaa

SEQ ID NO: 128154 - DNA, 9 bp, Unknown
  misc_feature (1)..( 9): Result.003 file - promoters60/3011901
aattcataa

SEQ ID NO: 128155 - DNA, 6 bp, Unknown
  misc_feature (1)..( 6): Result.003 file - promoters60/3011901
gttaac

SEQ ID NO: 128156 - DNA, 6 bp, Unknown
  misc_feature (1)..( 6): Result.003 file - promoters60/3011901
gttaac

SEQ ID NO: 128157 - DNA, 9 bp, Unknown
  misc_feature (1)..( 9): Result.003 file - promoters60/3011901
agagaatat

SEQ ID NO: 128158 - DNA, 9 bp, Unknown
  misc_feature (1)..( 9): Result.003 file - promoters60/3011901
agagaatat

SEQ ID NO: 128159 - DNA, 7 bp, Unknown
  misc_feature (1)..( 7): Result.003 file - promoters60/3011901
aaaccaa

SEQ ID NO: 128160 - DNA, 7 bp, Unknown
  misc_feature (1)..( 7): Result.003 file - promoters60/3011901
aaaccaa

SEQ ID NO: 128161 - DNA, 6 bp, Unknown
  misc_feature (1)..( 6): Result.003 file - promoters60/3011901
ccaatg

SEQ ID NO: 128162 - DNA, 6 bp, Unknown
  misc_feature (1)..( 6): Result.003 file - promoters60/3011901
ccaatg

SEQ ID NO: 128163 - DNA, 7 bp, Unknown
  misc_feature (1)..( 7): Result.003 file - promoters60/3011901
cattaga

SEQ ID NO: 128164 - DNA, 7 bp, Unknown
  misc_feature (1)..( 7): Result.003 file - promoters60/3011901
cataaga

SEQ ID NO: 128165 - DNA, 7 bp, Unknown
  misc_feature (1)..( 7): Result.003 file - promoters60/3011901
ggcacat

SEQ ID NO: 128166 - DNA, 7 bp, Unknown
  misc_feature (1)..( 7): Result.003 file - promoters60/3011901
ggcccat

SEQ ID NO: 128167 - DNA, 7 bp, Unknown
  misc_feature (1)..( 7): Result.003 file - promoters60/3011901
taaataa

SEQ ID NO: 128168 - DNA, 7 bp, Unknown
  misc_feature (1)..( 7): Result.003 file - promoters60/3011901
taaataa

SEQ ID NO: 128169 - DNA, 11 bp, Unknown
  misc_feature (1)..( 11): Result.003 file - promoters60/3014276
taatgataatc

SEQ ID NO: 128170 - DNA, 11 bp, Unknown
  misc_feature (1)..( 11): Result.003 file - promoters60/3014276
gggtgagaatc

SEQ ID NO: 128171 - DNA, 11 bp, Unknown
  misc_feature (1)..( 11): Result.003 file - promoters60/3014276
taacgatatcc

SEQ ID NO: 128172 - DNA, 9 bp, Unknown
  misc_feature (1)..( 9): Result.003 file - promoters60/3014276
ctcgtcttc

SEQ ID NO: 128173 - DNA, 9 bp, Unknown
  misc_feature (1)..( 9): Result.003 file - promoters60/3014276
ctcgacttt

SEQ ID NO: 128174 - DNA, 9 bp, Unknown
  misc_feature (1)..( 9): Result.003 file - promoters60/3014276
ctcgttttc

SEQ ID NO: 128175 - DNA, 9 bp, Unknown
  misc_feature (1)..( 9): Result.003 file - promoters60/3014276
tgttcaaaa

SEQ ID NO: 128176 - DNA, 9 bp, Unknown
  misc_feature (1)..( 9): Result.003 file - promoters60/3014276
tgtttaaaa

SEQ ID NO: 128177 - DNA, 9 bp, Unknown
  misc_feature (1)..( 9): Result.003 file - promoters60/3014276
ttttttttg

SEQ ID NO: 128178 - DNA, 7 bp, Unknown
  misc_feature (1)..( 7): Result.003 file - promoters60/3014276
atctctt

SEQ ID NO: 128179 - DNA, 7 bp, Unknown
  misc_feature (1)..( 7): Result.003 file - promoters60/3014276
atctctc

SEQ ID NO: 128180 - DNA, 7 bp, Unknown
  misc_feature (1)..( 7): Result.003 file - promoters60/3014276
gtctctc

SEQ ID NO: 128181 - DNA, 7 bp, Unknown
  misc_feature (1)..( 7): Result.003 file - promoters60/3043322
attatat

SEQ ID NO: 128182 - DNA, 7 bp, Unknown
  misc_feature (1)..( 7): Result.003 file - promoters60/3043322
attgtat

SEQ ID NO: 128183 - DNA, 11 bp, Unknown
  misc_feature (1)..( 11): Result.003 file - promoters60/3043322
tgtgaatctac

SEQ ID NO: 128184 - DNA, 11 bp, Unknown
  misc_feature (1)..( 11): Result.003 file - promoters60/3043322
tgtcaatcttg

SEQ ID NO: 128185 - DNA, 11 bp, Unknown
  misc_feature (1)..( 11): Result.003 file - promoters60/3043322
aacaaatttga

SEQ ID NO: 128186 - DNA, 7 bp, Unknown
  misc_feature (1)..( 7): Result.003 file - promoters60/3043322
acgttta

SEQ ID NO: 128187 - DNA, 7 bp, Unknown
  misc_feature (1)..( 7): Result.003 file - promoters60/3043322
acgatta

SEQ ID NO: 128188 - DNA, 7 bp, Unknown
  misc_feature (1)..( 7): Result.003 file - promoters60/3043322
atcattc

SEQ ID NO: 128189 - DNA, 7 bp, Unknown
  misc_feature (1)..( 7): Result.003 file - promoters60/3043322
atctttc

SEQ ID NO: 128190 - DNA, 6 bp, Unknown
  misc_feature (1)..( 6): Result.003 file - promoters60/3043322
aaagtc

SEQ ID NO: 128191 - DNA, 6 bp, Unknown
  misc_feature (1)..( 6): Result.003 file - promoters60/3043322
aaagtc

SEQ ID NO: 128192 - DNA, 6 bp, Unknown
  misc_feature (1)..( 6): Result.003 file - promoters60/3043322
catatt

SEQ ID NO: 128193 - DNA, 6 bp, Unknown
  misc_feature (1)..( 6): Result.003 file - promoters60/3043322
catatt

SEQ ID NO: 128194 - DNA, 8 bp, Unknown
  misc_feature (1)..( 8): Result.003 file - promoters60/3043322
atttgatt

SEQ ID NO: 128195 - DNA, 8 bp, Unknown
  misc_feature (1)..( 8): Result.003 file - promoters60/3043322
atttgata

SEQ ID NO: 128196 - DNA, 8 bp, Unknown
  misc_feature (1)..( 8): Result.003 file - promoters60/3043322
atttgatt

SEQ ID NO: 128197 - DNA, 8 bp, Unknown
  misc_feature (1)..( 8): Result.003 file - promoters60/3043322
aactattt

SEQ ID NO: 128198 - DNA, 8 bp, Unknown
  misc_feature (1)..( 8): Result.003 file - promoters60/3043322
aaccattt

SEQ ID NO: 128199 - DNA, 9 bp, Unknown
  misc_feature (1)..( 9): Result.003 file - promoters60/3043322
aataaaatt

SEQ ID NO: 128200 - DNA, 9 bp, Unknown
  misc_feature (1)..( 9): Result.003 file - promoters60/3043322
aataaaatc

SEQ ID NO: 128201 - DNA, 9 bp, Unknown
  misc_feature (1)..( 9): Result.003 file - promoters60/3043322
tctaaaatc

SEQ ID NO: 128202 - DNA, 10 bp, Unknown
  misc_feature (1)..( 10): Result.003 file - promoters60/3043322
ttaatatttt

SEQ ID NO: 128203 - DNA, 10 bp, Unknown
  misc_feature (1)..( 10): Result.003 file - promoters60/3043322
ttaatttttt

SEQ ID NO: 128204 - DNA, 7 bp, Unknown
  misc_feature (1)..( 7): Result.003 file - promoters60/3043322
ttatttt

SEQ ID NO: 128205 - DNA, 7 bp, Unknown
  misc_feature (1)..( 7): Result.003 file - promoters60/3043322
ttatttt

SEQ ID NO: 128206 - DNA, 6 bp, Unknown
  misc_feature (1)..( 6): Result.003 file - promoters60/3043322
taacat

SEQ ID NO: 128207 - DNA, 6 bp, Unknown
  misc_feature (1)..( 6): Result.003 file - promoters60/3043322
taacat

SEQ ID NO: 128208 - DNA, 6 bp, Unknown
  misc_feature (1)..( 6): Result.003 file - promoters60/3043322
taacat

SEQ ID NO: 128209 - DNA, 8 bp, Unknown
  misc_feature (1)..( 8): Result.003 file - promoters60/3043322
aaaacaaa

SEQ ID NO: 128210 - DNA, 8 bp, Unknown
  misc_feature (1)..( 8): Result.003 file - promoters60/3043322
aaaaaaaa

SEQ ID NO: 128211 - DNA, 10 bp, Unknown
  misc_feature (1)..( 10): Result.003 file - promoters60/3043322
aaaaatactt

SEQ ID NO: 128212 - DNA, 10 bp, Unknown
  misc_feature (1)..( 10): Result.003 file - promoters60/3043322
aaaaaaactt

SEQ ID NO: 128213 - DNA, 6 bp, Unknown
  misc_feature (1)..( 6): Result.003 file - promoters60/3043322
tatatt

SEQ ID NO: 128214 - DNA, 6 bp, Unknown
  misc_feature (1)..( 6): Result.003 file - promoters60/3043322
tatatt

SEQ ID NO: 128215 - DNA, 8 bp, Unknown
  misc_feature (1)..( 8): Result.003 file - promoters60/3043322
tctataga

SEQ ID NO: 128216 - DNA, 8 bp, Unknown
  misc_feature (1)..( 8): Result.003 file - promoters60/3043322
tctttaga

SEQ ID NO: 128217 - DNA, 7 bp, Unknown
  misc_feature (1)..( 7): Result.003 file - promoters60/3043322
tttgtta

SEQ ID NO: 128218 - DNA, 7 bp, Unknown
  misc_feature (1)..( 7): Result.003 file - promoters60/3043322
tttttta

SEQ ID NO: 128219 - DNA, 7 bp, Unknown
  misc_feature (1)..( 7): Result.003 file - promoters60/3043322
aacaaaa

SEQ ID NO: 128220 - DNA, 7 bp, Unknown
  misc_feature (1)..( 7): Result.003 file - promoters60/3043322
aactaaa

SEQ ID NO: 128221 - DNA, 6 bp, Unknown
  misc_feature (1)..( 6): Result.003 file - promoters60/3043322
ttctta

SEQ ID NO: 128222 - DNA, 6 bp, Unknown
  misc_feature (1)..( 6): Result.003 file - promoters60/3043322
ttctta

SEQ ID NO: 128223 - DNA, 8 bp, Unknown
  misc_feature (1)..( 8): Result.003 file - promoters60/3043322
ttttttta

SEQ ID NO: 128224 - DNA, 8 bp, Unknown
  misc_feature (1)..( 8): Result.003 file - promoters60/3043322
tttgttta

SEQ ID NO: 128225 - DNA, 9 bp, Unknown
  misc_feature (1)..( 9): Result.003 file - promoters60/3043962
tttttttaa

SEQ ID NO: 128226 - DNA, 9 bp, Unknown
  misc_feature (1)..( 9): Result.003 file - promoters60/3043962
tttttttgg

SEQ ID NO: 128227 - DNA, 9 bp, Unknown
  misc_feature (1)..( 9): Result.003 file - promoters60/3043962
tttatttgt

SEQ ID NO: 128228 - DNA, 9 bp, Unknown
  misc_feature (1)..( 9): Result.003 file - promoters60/3043962
tatatctgt

SEQ ID NO: 128229 - DNA, 9 bp, Unknown
  misc_feature (1)..( 9): Result.003 file - promoters60/3043962
tcttgattc

SEQ ID NO: 128230 - DNA, 9 bp, Unknown
  misc_feature (1)..( 9): Result.003 file - promoters60/3043962
gtttgattg

SEQ ID NO: 128231 - DNA, 9 bp, Unknown
  misc_feature (1)..( 9): Result.003 file - promoters60/3043962
atttgtttg

SEQ ID NO: 128232 - DNA, 9 bp, Unknown
  misc_feature (1)..( 9): Result.003 file - promoters60/3043962
atttgtata

SEQ ID NO: 128233 - DNA, 11 bp, Unknown
  misc_feature (1)..( 11): Result.003 file - promoters60/3043962
aaactatttaa

SEQ ID NO: 128234 - DNA, 11 bp, Unknown
  misc_feature (1)..( 11): Result.003 file - promoters60/3043962
cttctatataa

SEQ ID NO: 128235 - DNA, 11 bp, Unknown
  misc_feature (1)..( 11): Result.003 file - promoters60/3043962
tgactattatc

SEQ ID NO: 128236 - DNA, 11 bp, Unknown
  misc_feature (1)..( 11): Result.003 file - promoters60/3043962
aacctagttac

SEQ ID NO: 128237 - DNA, 11 bp, Unknown
  misc_feature (1)..( 11): Result.003 file - promoters60/3043962
tgattatcctt

SEQ ID NO: 128238 - DNA, 6 bp, Unknown
  misc_feature (1)..( 6): Result.003 file - promoters60/3100782
tttgta

SEQ ID NO: 128239 - DNA, 6 bp, Unknown
  misc_feature (1)..( 6): Result.003 file - promoters60/3100782
tttgta

SEQ ID NO: 128240 - DNA, 7 bp, Unknown
  misc_feature (1)..( 7): Result.003 file - promoters60/3100782
atctttt

SEQ ID NO: 128241 - DNA, 7 bp, Unknown
  misc_feature (1)..( 7): Result.003 file - promoters60/3100782
atcattt

SEQ ID NO: 128242 - DNA, 8 bp, Unknown
  misc_feature (1)..( 8): Result.003 file - promoters60/3100782
aactgaaa

SEQ ID NO: 128243 - DNA, 8 bp, Unknown
  misc_feature (1)..( 8): Result.003 file - promoters60/3100782
aacagaaa

SEQ ID NO: 128244 - DNA, 7 bp, Unknown
  misc_feature (1)..( 7): Result.003 file - promoters60/3100782
ataaaat

SEQ ID NO: 128245 - DNA, 7 bp, Unknown
  misc_feature (1)..( 7): Result.003 file - promoters60/3100782
ataaaat

SEQ ID NO: 128246 - DNA, 8 bp, Unknown
  misc_feature (1)..( 8): Result.003 file - promoters60/3100782
aaatagaa

SEQ ID NO: 128247 - DNA, 8 bp, Unknown
  misc_feature (1)..( 8): Result.003 file - promoters60/3100782
aaaaagaa

SEQ ID NO: 128248 - DNA, 7 bp, Unknown
  misc_feature (1)..( 7): Result.003 file - promoters60/3100782
ccaccat

SEQ ID NO: 128249 - DNA, 7 bp, Unknown
  misc_feature (1)..( 7): Result.003 file - promoters60/3100782
ccaacat

SEQ ID NO: 128250 - DNA, 7 bp, Unknown
  misc_feature (1)..( 7): Result.003 file - promoters60/3100782
caattct

SEQ ID NO: 128251 - DNA, 7 bp, Unknown
  misc_feature (1)..( 7): Result.003 file - promoters60/3100782
caattct

SEQ ID NO: 128252 - DNA, 6 bp, Unknown
  misc_feature (1)..( 6): Result.003 file - promoters60/3100782
ttctgg

SEQ ID NO: 128253 - DNA, 6 bp, Unknown
  misc_feature (1)..( 6): Result.003 file - promoters60/3100782
ttctgg

SEQ ID NO: 128254 - DNA, 7 bp, Unknown
  misc_feature (1)..( 7): Result.003 file - promoters60/3100782
cataact

SEQ ID NO: 128255 - DNA, 7 bp, Unknown
  misc_feature (1)..( 7): Result.003 file - promoters60/3100782
cattact

SEQ ID NO: 128256 - DNA, 8 bp, Unknown
  misc_feature (1)..( 8): Result.003 file - promoters60/3100782
attcttac

SEQ ID NO: 128257 - DNA, 8 bp, Unknown
  misc_feature (1)..( 8): Result.003 file - promoters60/3100782
atttttac

SEQ ID NO: 128258 - DNA, 7 bp, Unknown
  misc_feature (1)..( 7): Result.003 file - promoters60/3100782
tttgaga

SEQ ID NO: 128259 - DNA, 7 bp, Unknown
  misc_feature (1)..( 7): Result.003 file - promoters60/3100782
tttgaga

SEQ ID NO: 128260 - DNA, 6 bp, Unknown
  misc_feature (1)..( 6): Result.003 file - promoters60/3238306
tttatt

SEQ ID NO: 128261 - DNA, 6 bp, Unknown
  misc_feature (1)..( 6): Result.003 file - promoters60/3238306
tttatt

SEQ ID NO: 128262 - DNA, 8 bp, Unknown
  misc_feature (1)..( 8): Result.003 file - promoters60/3238306
caagtcca

SEQ ID NO: 128263 - DNA, 8 bp, Unknown
  misc_feature (1)..( 8): Result.003 file - promoters60/3238306
caactcca

SEQ ID NO: 128264 - DNA, 8 bp, Unknown
  misc_feature (1)..( 8): Result.003 file - promoters60/3238306
taaattat

SEQ ID NO: 128265 - DNA, 8 bp, Unknown
  misc_feature (1)..( 8): Result.003 file - promoters60/3238306
aaaaatat

SEQ ID NO: 128266 - DNA, 8 bp, Unknown
  misc_feature (1)..( 8): Result.003 file - promoters60/3238306
aaaaatcc

SEQ ID NO: 128267 - DNA, 8 bp, Unknown
  misc_feature (1)..( 8): Result.003 file - promoters60/3238306
caaatcaa

SEQ ID NO: 128268 - DNA, 8 bp, Unknown
  misc_feature (1)..( 8): Result.003 file - promoters60/3238306
caagtcaa

SEQ ID NO: 128269 - DNA, 6 bp, Unknown
  misc_feature (1)..( 6): Result.003 file - promoters60/3238306
ttatat

SEQ ID NO: 128270 - DNA, 6 bp, Unknown
  misc_feature (1)..( 6): Result.003 file - promoters60/3238306
ttatat

SEQ ID NO: 128271 - DNA, 7 bp, Unknown
  misc_feature (1)..( 7): Result.003 file - promoters60/3238306
gattaat

SEQ ID NO: 128272 - DNA, 7 bp, Unknown
  misc_feature (1)..( 7): Result.003 file - promoters60/3238306
gatcaat

SEQ ID NO: 128273 - DNA, 9 bp, Unknown
  misc_feature (1)..( 9): Result.003 file - promoters60/3238306
acatacaca

SEQ ID NO: 128274 - DNA, 9 bp, Unknown
  misc_feature (1)..( 9): Result.003 file - promoters60/3238306
acaaacaca

SEQ ID NO: 128275 - DNA, 6 bp, Unknown
  misc_feature (1)..( 6): Result.003 file - promoters60/3238306
acaata

SEQ ID NO: 128276 - DNA, 6 bp, Unknown
  misc_feature (1)..( 6): Result.003 file - promoters60/3238306
acaata

SEQ ID NO: 128277 - DNA, 9 bp, Unknown
  misc_feature (1)..( 9): Result.003 file - promoters60/3238306
gttttggcg

SEQ ID NO: 128278 - DNA, 9 bp, Unknown
  misc_feature (1)..( 9): Result.003 file - promoters60/3238306
gtttgggcg

SEQ ID NO: 128279 - DNA, 7 bp, Unknown
  misc_feature (1)..( 7): Result.003 file - promoters60/3238306
atagcaa

SEQ ID NO: 128280 - DNA, 7 bp, Unknown
  misc_feature (1)..( 7): Result.003 file - promoters60/3238306
ataccaa

SEQ ID NO: 128281 - DNA, 6 bp, Unknown
  misc_feature (1)..( 6): Result.003 file - promoters60/3238306
gtctaa

SEQ ID NO: 128282 - DNA, 6 bp, Unknown
  misc_feature (1)..( 6): Result.003 file - promoters60/3238306
gtctaa

SEQ ID NO: 128283 - DNA, 6 bp, Unknown
  misc_feature (1)..( 6): Result.003 file - promoters60/3238306
aatgtc

SEQ ID NO: 128284 - DNA, 6 bp, Unknown
  misc_feature (1)..( 6): Result.003 file - promoters60/3238306
aatgtc

SEQ ID NO: 128285 - DNA, 6 bp, Unknown
  misc_feature (1)..( 6): Result.003 file - promoters60/3238306
acgtaa

SEQ ID NO: 128286 - DNA, 6 bp, Unknown
  misc_feature (1)..( 6): Result.003 file - promoters60/3238306
acgtaa

SEQ ID NO: 128287 - DNA, 6 bp, Unknown
  misc_feature (1)..( 6): Result.003 file - promoters60/3238306
agattc

SEQ ID NO: 128288 - DNA, 6 bp, Unknown
  misc_feature (1)..( 6): Result.003 file - promoters60/3238306
agattc

SEQ ID NO: 128289 - DNA, 8 bp, Unknown
  misc_feature (1)..( 8): Result.003 file - promoters60/3238306
gagaagga

SEQ ID NO: 128290 - DNA, 8 bp, Unknown
  misc_feature (1)..( 8): Result.003 file - promoters60/3238306
gagaagga

SEQ ID NO: 128291 - DNA, 6 bp, Unknown
  misc_feature (1)..( 6): Result.003 file - promoters60/3239163
gccaat

SEQ ID NO: 128292 - DNA, 6 bp, Unknown
  misc_feature (1)..( 6): Result.003 file - promoters60/3239163
gccaat

SEQ ID NO: 128293 - DNA, 6 bp, Unknown
  misc_feature (1)..( 6): Result.003 file - promoters60/3239163
gcagag

SEQ ID NO: 128294 - DNA, 6 bp, Unknown
  misc_feature (1)..( 6): Result.003 file - promoters60/3239163
gcagag

SEQ ID NO: 128295 - DNA, 6 bp, Unknown
  misc_feature (1)..( 6): Result.003 file - promoters60/3239163
ttaaag

SEQ ID NO: 128296 - DNA, 6 bp, Unknown
  misc_feature (1)..( 6): Result.003 file - promoters60/3239163
ttaaag

SEQ ID NO: 128297 - DNA, 8 bp, Unknown
  misc_feature (1)..( 8): Result.003 file - promoters60/3239163
aattctaa

SEQ ID NO: 128298 - DNA, 8 bp, Unknown
  misc_feature (1)..( 8): Result.003 file - promoters60/3239163
aattttaa

SEQ ID NO: 128299 - DNA, 7 bp, Unknown
  misc_feature (1)..( 7): Result.003 file - promoters60/3239163
aatcgga

SEQ ID NO: 128300 - DNA, 7 bp, Unknown
  misc_feature (1)..( 7): Result.003 file - promoters60/3239163
aatcgga

SEQ ID NO: 128301 - DNA, 11 bp, Unknown
  misc_feature (1)..( 11): Result.003 file - promoters60/3239163
agagagtgaag

SEQ ID NO: 128302 - DNA, 11 bp, Unknown
  misc_feature (1)..( 11): Result.003 file - promoters60/3239163
agacagtgaag

SEQ ID NO: 128303 - DNA, 6 bp, Unknown
  misc_feature (1)..( 6): Result.003 file - promoters60/3239163
aagtgt

SEQ ID NO: 128304 - DNA, 6 bp, Unknown
  misc_feature (1)..( 6): Result.003 file - promoters60/3239163
aagtgt

SEQ ID NO: 128305 - DNA, 6 bp, Unknown
  misc_feature (1)..( 6): Result.003 file - promoters60/3239163
atatat

SEQ ID NO: 128306 - DNA, 6 bp, Unknown
  misc_feature (1)..( 6): Result.003 file - promoters60/3239163
atatat

SEQ ID NO: 128307 - DNA, 7 bp, Unknown
  misc_feature (1)..( 7): Result.003 file - promoters60/3239163
acaatac

SEQ ID NO: 128308 - DNA, 7 bp, Unknown
  misc_feature (1)..( 7): Result.003 file - promoters60/3239163
acaatac

SEQ ID NO: 128309 - DNA, 9 bp, Unknown
  misc_feature (1)..( 9): Result.003 file - promoters60/3239163
atacaaata

SEQ ID NO: 128310 - DNA, 9 bp, Unknown
  misc_feature (1)..( 9): Result.003 file - promoters60/3239163
atacacata

SEQ ID NO: 128311 - DNA, 6 bp, Unknown
  misc_feature (1)..( 6): Result.003 file - promoters60/3239163
tcaaat

SEQ ID NO: 128312 - DNA, 6 bp, Unknown
  misc_feature (1)..( 6): Result.003 file - promoters60/3239163
tcaaat

SEQ ID NO: 128313 - DNA, 6 bp, Unknown
  misc_feature (1)..( 6): Result.003 file - promoters60/3239163
gagcag

SEQ ID NO: 128314 - DNA, 6 bp, Unknown
  misc_feature (1)..( 6): Result.003 file - promoters60/3239163
gagcag

SEQ ID NO: 128315 - DNA, 7 bp, Unknown
  misc_feature (1)..( 7): Result.003 file - promoters60/3239163
gaattaa

SEQ ID NO: 128316 - DNA, 7 bp, Unknown
  misc_feature (1)..( 7): Result.003 file - promoters60/3239163
gaaataa

SEQ ID NO: 128317 - DNA, 6 bp, Unknown
  misc_feature (1)..( 6): Result.003 file - promoters60/3239175
aaggat

SEQ ID NO: 128318 - DNA, 6 bp, Unknown
  misc_feature (1)..( 6): Result.003 file - promoters60/3239175
aaggat

SEQ ID NO: 128319 - DNA, 8 bp, Unknown
  misc_feature (1)..( 8): Result.003 file - promoters60/3239175
aatgcttt

SEQ ID NO: 128320 - DNA, 8 bp, Unknown
  misc_feature (1)..( 8): Result.003 file - promoters60/3239175
aatgcttt

SEQ ID NO: 128321 - DNA, 8 bp, Unknown
  misc_feature (1)..( 8): Result.003 file - promoters60/3239175
gaaagaca

SEQ ID NO: 128322 - DNA, 8 bp, Unknown
  misc_feature (1)..( 8): Result.003 file - promoters60/3239175
gaaagaaa

SEQ ID NO: 128323 - DNA, 8 bp, Unknown
  misc_feature (1)..( 8): Result.003 file - promoters60/3239175
caaaaaca

SEQ ID NO: 128324 - DNA, 7 bp, Unknown
  misc_feature (1)..( 7): Result.003 file - promoters60/3239175
atagttg

SEQ ID NO: 128325 - DNA, 7 bp, Unknown
  misc_feature (1)..( 7): Result.003 file - promoters60/3239175
atatttg

SEQ ID NO: 128326 - DNA, 6 bp, Unknown
  misc_feature (1)..( 6): Result.003 file - promoters60/3239175
taaaaa

SEQ ID NO: 128327 - DNA, 6 bp, Unknown
  misc_feature (1)..( 6): Result.003 file - promoters60/3239175
taaaaa

SEQ ID NO: 128328 - DNA, 9 bp, Unknown
  misc_feature (1)..( 9): Result.003 file - promoters60/3239175
aaaggaaga

SEQ ID NO: 128329 - DNA, 9 bp, Unknown
  misc_feature (1)..( 9): Result.003 file - promoters60/3239175
aaaagaaaa

SEQ ID NO: 128330 - DNA, 9 bp, Unknown
  misc_feature (1)..( 9): Result.003 file - promoters60/3239175
aaagtaaag

SEQ ID NO: 128331 - DNA, 9 bp, Unknown
  misc_feature (1)..( 9): Result.003 file - promoters60/3239175
gagaataac

SEQ ID NO: 128332 - DNA, 9 bp, Unknown
  misc_feature (1)..( 9): Result.003 file - promoters60/3239175
gagtatata

SEQ ID NO: 128333 - DNA, 9 bp, Unknown
  misc_feature (1)..( 9): Result.003 file - promoters60/3239175
ttgtatata

SEQ ID NO: 128334 - DNA, 7 bp, Unknown
  misc_feature (1)..( 7): Result.003 file - promoters60/3239175
tggctag

SEQ ID NO: 128335 - DNA, 7 bp, Unknown
  misc_feature (1)..( 7): Result.003 file - promoters60/3239175
tggttag

SEQ ID NO: 128336 - DNA, 6 bp, Unknown
  misc_feature (1)..( 6): Result.003 file - promoters60/3239175
agagta

SEQ ID NO: 128337 - DNA, 6 bp, Unknown
  misc_feature (1)..( 6): Result.003 file - promoters60/3239175
agagta

SEQ ID NO: 128338 - DNA, 8 bp, Unknown
  misc_feature (1)..( 8): Result.003 file - promoters60/3239175
ttgtactc

SEQ ID NO: 128339 - DNA, 8 bp, Unknown
  misc_feature (1)..( 8): Result.003 file - promoters60/3239175
ttgaactc

SEQ ID NO: 128340 - DNA, 7 bp, Unknown
  misc_feature (1)..( 7): Result.003 file - promoters60/3239175
tggattt

SEQ ID NO: 128341 - DNA, 7 bp, Unknown
  misc_feature (1)..( 7): Result.003 file - promoters60/3239175
tgggttt

SEQ ID NO: 128342 - DNA, 8 bp, Unknown
  misc_feature (1)..( 8): Result.003 file - promoters60/3239175
tctagtgt

SEQ ID NO: 128343 - DNA, 8 bp, Unknown
  misc_feature (1)..( 8): Result.003 file - promoters60/3239175
tctattgt

SEQ ID NO: 128344 - DNA, 7 bp, Unknown
  misc_feature (1)..( 7): Result.003 file - promoters60/3239175
actttag

SEQ ID NO: 128345 - DNA, 7 bp, Unknown
  misc_feature (1)..( 7): Result.003 file - promoters60/3239175
actttag

SEQ ID NO: 128346 - DNA, 6 bp, Unknown
  misc_feature (1)..( 6): Result.003 file - promoters60/3239175
ttaaag

SEQ ID NO: 128347 - DNA, 6 bp, Unknown
  misc_feature (1)..( 6): Result.003 file - promoters60/3239175
ttaaag

SEQ ID NO: 128348 - DNA, 6 bp, Unknown
  misc_feature (1)..( 6): Result.003 file - promoters60/3239175
agtaaa

SEQ ID NO: 128349 - DNA, 6 bp, Unknown
  misc_feature (1)..( 6): Result.003 file - promoters60/3239175
agtaaa

SEQ ID NO: 128350 - DNA, 7 bp, Unknown
  misc_feature (1)..( 7): Result.003 file - promoters60/3239175
aatcggg

SEQ ID NO: 128351 - DNA, 7 bp, Unknown
  misc_feature (1)..( 7): Result.003 file - promoters60/3239175
aattggg

SEQ ID NO: 128352 - DNA, 10 bp, Unknown
  misc_feature (1)..( 10): Result.003 file - promoters60/3239175
ggaaaagaaa

SEQ ID NO: 128353 - DNA, 10 bp, Unknown
  misc_feature (1)..( 10): Result.003 file - promoters60/3239175
ggaaatgaaa

SEQ ID NO: 128354 - DNA, 7 bp, Unknown
  misc_feature (1)..( 7): Result.003 file - promoters60/3239175
cccacta

SEQ ID NO: 128355 - DNA, 7 bp, Unknown
  misc_feature (1)..( 7): Result.003 file - promoters60/3239175
cccacta

SEQ ID NO: 128356 - DNA, 7 bp, Unknown
  misc_feature (1)..( 7): Result.003 file - promoters60/3239193
aattgat

SEQ ID NO: 128357 - DNA, 7 bp, Unknown
  misc_feature (1)..( 7): Result.003 file - promoters60/3239193
aattgaa

SEQ ID NO: 128358 - DNA, 7 bp, Unknown
  misc_feature (1)..( 7): Result.003 file - promoters60/3239193
gattgaa

SEQ ID NO: 128359 - DNA, 7 bp, Unknown
  misc_feature (1)..( 7): Result.003 file - promoters60/3239193
gaatagt

SEQ ID NO: 128360 - DNA, 7 bp, Unknown
  misc_feature (1)..( 7): Result.003 file - promoters60/3239193
gaataga

SEQ ID NO: 128361 - DNA, 7 bp, Unknown
  misc_feature (1)..( 7): Result.003 file - promoters60/3239193
gaaaaga

SEQ ID NO: 128362 - DNA, 9 bp, Unknown
  misc_feature (1)..( 9): Result.003 file - promoters60/3239193
gttataaaa

SEQ ID NO: 128363 - DNA, 9 bp, Unknown
  misc_feature (1)..( 9): Result.003 file - promoters60/3239193
ttgataaaa

SEQ ID NO: 128364 - DNA, 9 bp, Unknown
  misc_feature (1)..( 9): Result.003 file - promoters60/3239193
tatataaat

SEQ ID NO: 128365 - DNA, 7 bp, Unknown
  misc_feature (1)..( 7): Result.003 file - promoters60/3239193
cttgaag

SEQ ID NO: 128366 - DNA, 7 bp, Unknown
  misc_feature (1)..( 7): Result.003 file - promoters60/3239193
attgaag

SEQ ID NO: 128367 - DNA, 7 bp, Unknown
  misc_feature (1)..( 7): Result.003 file - promoters60/3239193
attgaac

SEQ ID NO: 128368 - DNA, 9 bp, Unknown
  misc_feature (1)..( 9): Result.003 file - promoters60/3239193
tgaaagaag

SEQ ID NO: 128369 - DNA, 9 bp, Unknown
  misc_feature (1)..( 9): Result.003 file - promoters60/3239193
aaaaataag

SEQ ID NO: 128370 - DNA, 9 bp, Unknown
  misc_feature (1)..( 9): Result.003 file - promoters60/3239193
aaaaatact

SEQ ID NO: 128371 - DNA, 7 bp, Unknown
  misc_feature (1)..( 7): Result.003 file - promoters60/3408983
tatatat

SEQ ID NO: 128372 - DNA, 7 bp, Unknown
  misc_feature (1)..( 7): Result.003 file - promoters60/3408983
tatctat

SEQ ID NO: 128373 - DNA, 6 bp, Unknown
  misc_feature (1)..( 6): Result.003 file - promoters60/3408983
agaatc

SEQ ID NO: 128374 - DNA, 6 bp, Unknown
  misc_feature (1)..( 6): Result.003 file - promoters60/3408983
agaatc

SEQ ID NO: 128375 - DNA, 7 bp, Unknown
  misc_feature (1)..( 7): Result.003 file - promoters60/3408983
tgtcata

SEQ ID NO: 128376 - DNA, 7 bp, Unknown
  misc_feature (1)..( 7): Result.003 file - promoters60/3408983
tgtaata

SEQ ID NO: 128377 - DNA, 7 bp, Unknown
  misc_feature (1)..( 7): Result.003 file - promoters60/3408983
gatggaa

SEQ ID NO: 128378 - DNA, 7 bp, Unknown
  misc_feature (1)..( 7): Result.003 file - promoters60/3408983
gattgaa

SEQ ID NO: 128379 - DNA, 8 bp, Unknown
  misc_feature (1)..( 8): Result.003 file - promoters60/3408983
aaatatga

SEQ ID NO: 128380 - DNA, 8 bp, Unknown
  misc_feature (1)..( 8): Result.003 file - promoters60/3408983
gaatgtga

SEQ ID NO: 128381 - DNA, 8 bp, Unknown
  misc_feature (1)..( 8): Result.003 file - promoters60/3408983
aaatattc

SEQ ID NO: 128382 - DNA, 8 bp, Unknown
  misc_feature (1)..( 8): Result.003 file - promoters60/3408983
aaggtata

SEQ ID NO: 128383 - DNA, 8 bp, Unknown
  misc_feature (1)..( 8): Result.003 file - promoters60/3408983
aagctata

SEQ ID NO: 128384 - DNA, 7 bp, Unknown
  misc_feature (1)..( 7): Result.003 file - promoters60/3408983
aaataaa

SEQ ID NO: 128385 - DNA, 7 bp, Unknown
  misc_feature (1)..( 7): Result.003 file - promoters60/3408983
aaataaa

SEQ ID NO: 128386 - DNA, 6 bp, Unknown
  misc_feature (1)..( 6): Result.003 file - promoters60/3408983
cataat

SEQ ID NO: 128387 - DNA, 6 bp, Unknown
  misc_feature (1)..( 6): Result.003 file - promoters60/3408983
cataat

SEQ ID NO: 128388 - DNA, 7 bp, Unknown
  misc_feature (1)..( 7): Result.003 file - promoters60/3408983
aaataaa

SEQ ID NO: 128389 - DNA, 7 bp, Unknown
  misc_feature (1)..( 7): Result.003 file - promoters60/3408983
aaaaaaa

SEQ ID NO: 128390 - DNA, 6 bp, Unknown
  misc_feature (1)..( 6): Result.003 file - promoters60/3408983
aaaata

SEQ ID NO: 128391 - DNA, 6 bp, Unknown
  misc_feature (1)..( 6): Result.003 file - promoters60/3408983
aaaata

SEQ ID NO: 128392 - DNA, 8 bp, Unknown
  misc_feature (1)..( 8): Result.003 file - promoters60/3408983
tttaaatt

SEQ ID NO: 128393 - DNA, 8 bp, Unknown
  misc_feature (1)..( 8): Result.003 file - promoters60/3408983
tttaaatt

SEQ ID NO: 128394 - DNA, 7 bp, Unknown
  misc_feature (1)..( 7): Result.003 file - promoters60/3408983
ttacttt

SEQ ID NO: 128395 - DNA, 7 bp, Unknown
  misc_feature (1)..( 7): Result.003 file - promoters60/3408983
ttaattt

SEQ ID NO: 128396 - DNA, 7 bp, Unknown
  misc_feature (1)..( 7): Result.003 file - promoters60/3408983
ttactaa

SEQ ID NO: 128397 - DNA, 7 bp, Unknown
  misc_feature (1)..( 7): Result.003 file - promoters60/3408983
ttattaa

SEQ ID NO: 128398 - DNA, 6 bp, Unknown
  misc_feature (1)..( 6): Result.003 file - promoters60/3408983
aattta

SEQ ID NO: 128399 - DNA, 6 bp, Unknown
  misc_feature (1)..( 6): Result.003 file - promoters60/3408983
aattta

SEQ ID NO: 128400 - DNA, 9 bp, Unknown
  misc_feature (1)..( 9): Result.003 file - promoters60/3408983
tctttctct

SEQ ID NO: 128401 - DNA, 9 bp, Unknown
  misc_feature (1)..( 9): Result.003 file - promoters60/3408983
tctctctct

SEQ ID NO: 128402 - DNA, 6 bp, Unknown
  misc_feature (1)..( 6): Result.003 file - promoters60/3408983
cgagaa

SEQ ID NO: 128403 - DNA, 6 bp, Unknown
  misc_feature (1)..( 6): Result.003 file - promoters60/3408983
cgagaa

SEQ ID NO: 128404 - DNA, 8 bp, Unknown
  misc_feature (1)..( 8): Result.003 file - promoters60/3408983
caacaaaa

SEQ ID NO: 128405 - DNA, 8 bp, Unknown
  misc_feature (1)..( 8): Result.003 file - promoters60/3408983
caacaaaa

SEQ ID NO: 128406 - DNA, 6 bp, Unknown
  misc_feature (1)..( 6): Result.003 file - promoters60/3408983
gagttt

SEQ ID NO: 128407 - DNA, 6 bp, Unknown
  misc_feature (1)..( 6): Result.003 file - promoters60/3408983
gagttt

SEQ ID NO: 128408 - DNA, 8 bp, Unknown
  misc_feature (1)..( 8): Result.003 file - promoters60/3409161
attttttt

SEQ ID NO: 128409 - DNA, 8 bp, Unknown
  misc_feature (1)..( 8): Result.003 file - promoters60/3409161
attttttt

SEQ ID NO: 128410 - DNA, 6 bp, Unknown
  misc_feature (1)..( 6): Result.003 file - promoters60/3409161
agtctt

SEQ ID NO: 128411 - DNA, 6 bp, Unknown
  misc_feature (1)..( 6): Result.003 file - promoters60/3409161
agtctt

SEQ ID NO: 128412 - DNA, 6 bp, Unknown
  misc_feature (1)..( 6): Result.003 file - promoters60/3409161
tctttt

SEQ ID NO: 128413 - DNA, 6 bp, Unknown
  misc_feature (1)..( 6): Result.003 file - promoters60/3409161
tctttt

SEQ ID NO: 128414 - DNA, 8 bp, Unknown
  misc_feature (1)..( 8): Result.003 file - promoters60/3409161
ttttgttt

SEQ ID NO: 128415 - DNA, 8 bp, Unknown
  misc_feature (1)..( 8): Result.003 file - promoters60/3409161
tttcgttt

SEQ ID NO: 128416 - DNA, 6 bp, Unknown
  misc_feature (1)..( 6): Result.003 file - promoters60/3409161
tttatt

SEQ ID NO: 128417 - DNA, 6 bp, Unknown
  misc_feature (1)..( 6): Result.003 file - promoters60/3409161
tttatt

SEQ ID NO: 128418 - DNA, 6 bp, Unknown
  misc_feature (1)..( 6): Result.003 file - promoters60/3409161
aaacag

SEQ ID NO: 128419 - DNA, 6 bp, Unknown
  misc_feature (1)..( 6): Result.003 file - promoters60/3409161
aaacag

SEQ ID NO: 128420 - DNA, 8 bp, Unknown
  misc_feature (1)..( 8): Result.003 file - promoters60/3409161
aaagtaca

SEQ ID NO: 128421 - DNA, 8 bp, Unknown
  misc_feature (1)..( 8): Result.003 file - promoters60/3409161
aaagaaca

SEQ ID NO: 128422 - DNA, 7 bp, Unknown
  misc_feature (1)..( 7): Result.003 file - promoters60/3409161
cagtgga

SEQ ID NO: 128423 - DNA, 7 bp, Unknown
  misc_feature (1)..( 7): Result.003 file - promoters60/3409161
cagagga

SEQ ID NO: 128424 - DNA, 8 bp, Unknown
  misc_feature (1)..( 8): Result.003 file - promoters60/3409161
ctaaggaa

SEQ ID NO: 128425 - DNA, 8 bp, Unknown
  misc_feature (1)..( 8): Result.003 file - promoters60/3409161
ctaacgaa

SEQ ID NO: 128426 - DNA, 7 bp, Unknown
  misc_feature (1)..( 7): Result.003 file - promoters60/3409161
ctcaaaa

SEQ ID NO: 128427 - DNA, 7 bp, Unknown
  misc_feature (1)..( 7): Result.003 file - promoters60/3409161
ctcaaaa

SEQ ID NO: 128428 - DNA, 6 bp, Unknown
  misc_feature (1)..( 6): Result.003 file - promoters60/3409161
caatgc

SEQ ID NO: 128429 - DNA, 6 bp, Unknown
  misc_feature (1)..( 6): Result.003 file - promoters60/3409161
caatgc

SEQ ID NO: 128430 - DNA, 6 bp, Unknown
  misc_feature (1)..( 6): Result.003 file - promoters60/3409161
catttc

SEQ ID NO: 128431 - DNA, 6 bp, Unknown
  misc_feature (1)..( 6): Result.003 file - promoters60/3409161
catttc

SEQ ID NO: 128432 - DNA, 6 bp, Unknown
  misc_feature (1)..( 6): Result.003 file - promoters60/3409161
ccccca

SEQ ID NO: 128433 - DNA, 6 bp, Unknown
  misc_feature (1)..( 6): Result.003 file - promoters60/3409161
ccccca

SEQ ID NO: 128434 - DNA, 6 bp, Unknown
  misc_feature (1)..( 6): Result.003 file - promoters60/3409161
gagata

SEQ ID NO: 128435 - DNA, 6 bp, Unknown
  misc_feature (1)..( 6): Result.003 file - promoters60/3409161
gagata

SEQ ID NO: 128436 - DNA, 10 bp, Unknown
  misc_feature (1)..( 10): Result.003 file - promoters60/3409165
acaacaaagt

SEQ ID NO: 128437 - DNA, 10 bp, Unknown
  misc_feature (1)..( 10): Result.003 file - promoters60/3409165
aaaacaaacg

SEQ ID NO: 128438 - DNA, 10 bp, Unknown
  misc_feature (1)..( 10): Result.003 file - promoters60/3409165
ggaaaaaaaa

SEQ ID NO: 128439 - DNA, 10 bp, Unknown
  misc_feature (1)..( 10): Result.003 file - promoters60/3409165
ttaaaaaaag

SEQ ID NO: 128440 - DNA, 10 bp, Unknown
  misc_feature (1)..( 10): Result.003 file - promoters60/3409165
aaaacaattc

SEQ ID NO: 128441 - DNA, 10 bp, Unknown
  misc_feature (1)..( 10): Result.003 file - promoters60/3409165
caaacaaatg

SEQ ID NO: 128442 - DNA, 10 bp, Unknown
  misc_feature (1)..( 10): Result.003 file - promoters60/3409165
ataaaaaata

SEQ ID NO: 128443 - DNA, 10 bp, Unknown
  misc_feature (1)..( 10): Result.003 file - promoters60/3409165
ccactatata

SEQ ID NO: 128444 - DNA, 10 bp, Unknown
  misc_feature (1)..( 10): Result.003 file - promoters60/3409165
ccattatata

SEQ ID NO: 128445 - DNA, 10 bp, Unknown
  misc_feature (1)..( 10): Result.003 file - promoters60/3409165
cttttatata

SEQ ID NO: 128446 - DNA, 10 bp, Unknown
  misc_feature (1)..( 10): Result.003 file - promoters60/3409165
cttgtatata

SEQ ID NO: 128447 - DNA, 10 bp, Unknown
  misc_feature (1)..( 10): Result.003 file - promoters60/3409165
cgcctatata

SEQ ID NO: 128448 - DNA, 10 bp, Unknown
  misc_feature (1)..( 10): Result.003 file - promoters60/3409165
tccctataaa

SEQ ID NO: 128449 - DNA, 11 bp, Unknown
  misc_feature (1)..( 11): Result.003 file - promoters60/3409165
aacgaaaaata

SEQ ID NO: 128450 - DNA, 11 bp, Unknown
  misc_feature (1)..( 11): Result.003 file - promoters60/3409165
attataaaata

SEQ ID NO: 128451 - DNA, 11 bp, Unknown
  misc_feature (1)..( 11): Result.003 file - promoters60/3409165
tataaaaaatt

SEQ ID NO: 128452 - DNA, 11 bp, Unknown
  misc_feature (1)..( 11): Result.003 file - promoters60/3409165
attagaaaatt

SEQ ID NO: 128453 - DNA, 11 bp, Unknown
  misc_feature (1)..( 11): Result.003 file - promoters60/3409165
aggagataata

SEQ ID NO: 128454 - DNA, 11 bp, Unknown
  misc_feature (1)..( 11): Result.003 file - promoters60/3409165
catctaacata

SEQ ID NO: 128455 - DNA, 12 bp, Unknown
  misc_feature (1)..( 12): Result.003 file - promoters60/3409165
taaataaaagca

SEQ ID NO: 128456 - DNA, 12 bp, Unknown
  misc_feature (1)..( 12): Result.003 file - promoters60/3409165
attataaaatac

SEQ ID NO: 128457 - DNA, 12 bp, Unknown
  misc_feature (1)..( 12): Result.003 file - promoters60/3409165
attagaaaattt

SEQ ID NO: 128458 - DNA, 12 bp, Unknown
  misc_feature (1)..( 12): Result.003 file - promoters60/3409165
tttacaaacttt

SEQ ID NO: 128459 - DNA, 12 bp, Unknown
  misc_feature (1)..( 12): Result.003 file - promoters60/3409165
aggagataatat

SEQ ID NO: 128460 - DNA, 12 bp, Unknown
  misc_feature (1)..( 12): Result.003 file - promoters60/3409165
ctaacataggca

SEQ ID NO: 128461 - DNA, 8 bp, Unknown
  misc_feature (1)..( 8): Result.003 file - promoters60/3409214
cccaaaga

SEQ ID NO: 128462 - DNA, 8 bp, Unknown
  misc_feature (1)..( 8): Result.003 file - promoters60/3409214
agcaaaga

SEQ ID NO: 128463 - DNA, 8 bp, Unknown
  misc_feature (1)..( 8): Result.003 file - promoters60/3409214
aaaaaagc

SEQ ID NO: 128464 - DNA, 8 bp, Unknown
  misc_feature (1)..( 8): Result.003 file - promoters60/3409214
gatccttt

SEQ ID NO: 128465 - DNA, 8 bp, Unknown
  misc_feature (1)..( 8): Result.003 file - promoters60/3409214
tttccttt

SEQ ID NO: 128466 - DNA, 8 bp, Unknown
  misc_feature (1)..( 8): Result.003 file - promoters60/3409214
ttttctta

SEQ ID NO: 128467 - DNA, 9 bp, Unknown
  misc_feature (1)..( 9): Result.003 file - promoters60/3409214
acttttgtt

SEQ ID NO: 128468 - DNA, 9 bp, Unknown
  misc_feature (1)..( 9): Result.003 file - promoters60/3409214
ttctttgtt

SEQ ID NO: 128469 - DNA, 9 bp, Unknown
  misc_feature (1)..( 9): Result.003 file - promoters60/3409214
ttcttcgtt

SEQ ID NO: 128470 - DNA, 7 bp, Unknown
  misc_feature (1)..( 7): Result.003 file - promoters60/3409390
cacttca

SEQ ID NO: 128471 - DNA, 7 bp, Unknown
  misc_feature (1)..( 7): Result.003 file - promoters60/3409390
cacctca

SEQ ID NO: 128472 - DNA, 6 bp, Unknown
  misc_feature (1)..( 6): Result.003 file - promoters60/3409390
cttttc

SEQ ID NO: 128473 - DNA, 6 bp, Unknown
  misc_feature (1)..( 6): Result.003 file - promoters60/3409390
cttttc

SEQ ID NO: 128474 - DNA, 6 bp, Unknown
  misc_feature (1)..( 6): Result.003 file - promoters60/3409390
aaaatt

SEQ ID NO: 128475 - DNA, 6 bp, Unknown
  misc_feature (1)..( 6): Result.003 file - promoters60/3409390
aaaatt

SEQ ID NO: 128476 - DNA, 9 bp, Unknown
  misc_feature (1)..( 9): Result.003 file - promoters60/3409390
acataaata

SEQ ID NO: 128477 - DNA, 9 bp, Unknown
  misc_feature (1)..( 9): Result.003 file - promoters60/3409390
tcatcaata

SEQ ID NO: 128478 - DNA, 9 bp, Unknown
  misc_feature (1)..( 9): Result.003 file - promoters60/3409390
acacaaatc

SEQ ID NO: 128479 - DNA, 9 bp, Unknown
  misc_feature (1)..( 9): Result.003 file - promoters60/3409390
ttattcaat

SEQ ID NO: 128480 - DNA, 9 bp, Unknown
  misc_feature (1)..( 9): Result.003 file - promoters60/3409390
ttatacaat

SEQ ID NO: 128481 - DNA, 7 bp, Unknown
  misc_feature (1)..( 7): Result.003 file - promoters60/3409390
ataaggt

SEQ ID NO: 128482 - DNA, 7 bp, Unknown
  misc_feature (1)..( 7): Result.003 file - promoters60/3409390
ataaggt

SEQ ID NO: 128483 - DNA, 9 bp, Unknown
  misc_feature (1)..( 9): Result.003 file - promoters60/3409390
tttatttta

SEQ ID NO: 128484 - DNA, 9 bp, Unknown
  misc_feature (1)..( 9): Result.003 file - promoters60/3409390
tttattttt

SEQ ID NO: 128485 - DNA, 9 bp, Unknown
  misc_feature (1)..( 9): Result.003 file - promoters60/3409390
aacattttt

SEQ ID NO: 128486 - DNA, 6 bp, Unknown
  misc_feature (1)..( 6): Result.003 file - promoters60/3409390
tttttt

SEQ ID NO: 128487 - DNA, 6 bp, Unknown
  misc_feature (1)..( 6): Result.003 file - promoters60/3409390
tttttt

SEQ ID NO: 128488 - DNA, 7 bp, Unknown
  misc_feature (1)..( 7): Result.003 file - promoters60/3409390
aaaaaaa

SEQ ID NO: 128489 - DNA, 7 bp, Unknown
  misc_feature (1)..( 7): Result.003 file - promoters60/3409390
aaataaa

SEQ ID NO: 128490 - DNA, 7 bp, Unknown
  misc_feature (1)..( 7): Result.003 file - promoters60/3409390
aaaaaca

SEQ ID NO: 128491 - DNA, 7 bp, Unknown
  misc_feature (1)..( 7): Result.003 file - promoters60/3409390
aaacaca

SEQ ID NO: 128492 - DNA, 6 bp, Unknown
  misc_feature (1)..( 6): Result.003 file - promoters60/3409390
acaaaa

SEQ ID NO: 128493 - DNA, 6 bp, Unknown
  misc_feature (1)..( 6): Result.003 file - promoters60/3409390
acaaaa

SEQ ID NO: 128494 - DNA, 6 bp, Unknown
  misc_feature (1)..( 6): Result.003 file - promoters60/3409390
aagaaa

SEQ ID NO: 128495 - DNA, 6 bp, Unknown
  misc_feature (1)..( 6): Result.003 file - promoters60/3409390
aagaaa

SEQ ID NO: 128496 - DNA, 6 bp, Unknown
  misc_feature (1)..( 6): Result.003 file - promoters60/3409390
cgtggc

SEQ ID NO: 128497 - DNA, 6 bp, Unknown
  misc_feature (1)..( 6): Result.003 file - promoters60/3409390
cgtggc

SEQ ID NO: 128498 - DNA, 7 bp, Unknown
  misc_feature (1)..( 7): Result.003 file - promoters60/3409390
agttttt

SEQ ID NO: 128499 - DNA, 7 bp, Unknown
  misc_feature (1)..( 7): Result.003 file - promoters60/3409390
agtattt

SEQ ID NO: 128500 - DNA, 7 bp, Unknown
  misc_feature (1)..( 7): Result.003 file - promoters60/3409390
tttgctg

SEQ ID NO: 128501 - DNA, 7 bp, Unknown
  misc_feature (1)..( 7): Result.003 file - promoters60/3409390
ttttctg

SEQ ID NO: 128502 - DNA, 8 bp, Unknown
  misc_feature (1)..( 8): Result.003 file - promoters60/3409390
attttttt

SEQ ID NO: 128503 - DNA, 8 bp, Unknown
  misc_feature (1)..( 8): Result.003 file - promoters60/3409390
attttttt

SEQ ID NO: 128504 - DNA, 6 bp, Unknown
  misc_feature (1)..( 6): Result.003 file - promoters60/3409390
ggttag

SEQ ID NO: 128505 - DNA, 6 bp, Unknown
  misc_feature (1)..( 6): Result.003 file - promoters60/3409390
ggttag

SEQ ID NO: 128506 - DNA, 6 bp, Unknown
  misc_feature (1)..( 6): Result.003 file - promoters60/3409390
tcaatc

SEQ ID NO: 128507 - DNA, 6 bp, Unknown
  misc_feature (1)..( 6): Result.003 file - promoters60/3409390
tcaatc

SEQ ID NO: 128508 - DNA, 6 bp, Unknown
  misc_feature (1)..( 6): Result.003 file - promoters60/3409390
aagcta

SEQ ID NO: 128509 - DNA, 6 bp, Unknown
  misc_feature (1)..( 6): Result.003 file - promoters60/3409390
aagcta

SEQ ID NO: 128510 - DNA, 7 bp, Unknown
  misc_feature (1)..( 7): Result.003 file - promoters60/3409637
tttgtta

SEQ ID NO: 128511 - DNA, 7 bp, Unknown
  misc_feature (1)..( 7): Result.003 file - promoters60/3409637
tttgtta

SEQ ID NO: 128512 - DNA, 7 bp, Unknown
  misc_feature (1)..( 7): Result.003 file - promoters60/3409637
tttatta

SEQ ID NO: 128513 - DNA, 8 bp, Unknown
  misc_feature (1)..( 8): Result.003 file - promoters60/3409637
catggata

SEQ ID NO: 128514 - DNA, 8 bp, Unknown
  misc_feature (1)..( 8): Result.003 file - promoters60/3409637
catggatt

SEQ ID NO: 128515 - DNA, 8 bp, Unknown
  misc_feature (1)..( 8): Result.003 file - promoters60/3409637
tatgaatt

SEQ ID NO: 128516 - DNA, 8 bp, Unknown
  misc_feature (1)..( 8): Result.003 file - promoters60/3409637
tttgaatt

SEQ ID NO: 128517 - DNA, 8 bp, Unknown
  misc_feature (1)..( 8): Result.003 file - promoters60/3409637
caatatct

SEQ ID NO: 128518 - DNA, 8 bp, Unknown
  misc_feature (1)..( 8): Result.003 file - promoters60/3409637
aaatttct

SEQ ID NO: 128519 - DNA, 9 bp, Unknown
  misc_feature (1)..( 9): Result.003 file - promoters60/3409637
taactttta

SEQ ID NO: 128520 - DNA, 9 bp, Unknown
  misc_feature (1)..( 9): Result.003 file - promoters60/3409637
ggtatttct

SEQ ID NO: 128521 - DNA, 11 bp, Unknown
  misc_feature (1)..( 11): Result.003 file - promoters60/3409637
aattttttgaa

SEQ ID NO: 128522 - DNA, 11 bp, Unknown
  misc_feature (1)..( 11): Result.003 file - promoters60/3409637
aatttttttct

SEQ ID NO: 128523 - DNA, 11 bp, Unknown
  misc_feature (1)..( 11): Result.003 file - promoters60/3409637
agtttatgaat

SEQ ID NO: 128524 - DNA, 8 bp, Unknown
  misc_feature (1)..( 8): Result.003 file - promoters60/3409637
ttttgttt

SEQ ID NO: 128525 - DNA, 8 bp, Unknown
  misc_feature (1)..( 8): Result.003 file - promoters60/3409637
tttggttt

SEQ ID NO: 128526 - DNA, 8 bp, Unknown
  misc_feature (1)..( 8): Result.003 file - promoters60/3409637
cttggttg

SEQ ID NO: 128527 - DNA, 7 bp, Unknown
  misc_feature (1)..( 7): Result.003 file - promoters60/3409637
ttttacc

SEQ ID NO: 128528 - DNA, 7 bp, Unknown
  misc_feature (1)..( 7): Result.003 file - promoters60/3409637
tttgacc

SEQ ID NO: 128529 - DNA, 7 bp, Unknown
  misc_feature (1)..( 7): Result.003 file - promoters60/3409637
tttaacc

SEQ ID NO: 128530 - DNA, 13 bp, Unknown
  misc_feature (1)..( 13): Result.003 file - promoters60/3433703
aaagaatttctcc

SEQ ID NO: 128531 - DNA, 13 bp, Unknown
  misc_feature (1)..( 13): Result.003 file - promoters60/3433703
acggaattcctcc

SEQ ID NO: 128532 - DNA, 13 bp, Unknown
  misc_feature (1)..( 13): Result.003 file - promoters60/3433703
aaataattgataa

SEQ ID NO: 128533 - DNA, 13 bp, Unknown
  misc_feature (1)..( 13): Result.003 file - promoters60/3433703
ggtcgatttcttg

SEQ ID NO: 128534 - DNA, 13 bp, Unknown
  misc_feature (1)..( 13): Result.003 file - promoters60/3433703
tataaatatatct

SEQ ID NO: 128535 - DNA, 12 bp, Unknown
  misc_feature (1)..( 12): Result.003 file - promoters60/3433703
caaagaatttct

SEQ ID NO: 128536 - DNA, 12 bp, Unknown
  misc_feature (1)..( 12): Result.003 file - promoters60/3433703
caaacaatcatt

SEQ ID NO: 128537 - DNA, 12 bp, Unknown
  misc_feature (1)..( 12): Result.003 file - promoters60/3433703
aaaataattgat

SEQ ID NO: 128538 - DNA, 12 bp, Unknown
  misc_feature (1)..( 12): Result.003 file - promoters60/3433703
caaacaatcatt

SEQ ID NO: 128539 - DNA, 12 bp, Unknown
  misc_feature (1)..( 12): Result.003 file - promoters60/3433703
taaatatatctt

SEQ ID NO: 128540 - DNA, 9 bp, Unknown
  misc_feature (1)..( 9): Result.003 file - promoters60/3433703
aaatcaatc

SEQ ID NO: 128541 - DNA, 9 bp, Unknown
  misc_feature (1)..( 9): Result.003 file - promoters60/3433703
caatcaaat

SEQ ID NO: 128542 - DNA, 9 bp, Unknown
  misc_feature (1)..( 9): Result.003 file - promoters60/3433703
aaaacaatg

SEQ ID NO: 128543 - DNA, 9 bp, Unknown
  misc_feature (1)..( 9): Result.003 file - promoters60/3433703
taaacaaca

SEQ ID NO: 128544 - DNA, 9 bp, Unknown
  misc_feature (1)..( 9): Result.003 file - promoters60/3433703
aaaacattt

SEQ ID NO: 128545 - DNA, 12 bp, Unknown
  misc_feature (1)..( 12): Result.003 file - promoters60/3433703
tctataaaaaaa

SEQ ID NO: 128546 - DNA, 12 bp, Unknown
  misc_feature (1)..( 12): Result.003 file - promoters60/3433703
catataaatctc

SEQ ID NO: 128547 - DNA, 12 bp, Unknown
  misc_feature (1)..( 12): Result.003 file - promoters60/3433703
tatataaatagt

SEQ ID NO: 128548 - DNA, 12 bp, Unknown
  misc_feature (1)..( 12): Result.003 file - promoters60/3433703
tatatatatctc

SEQ ID NO: 128549 - DNA, 12 bp, Unknown
  misc_feature (1)..( 12): Result.003 file - promoters60/3433703
tatttatatgtt

SEQ ID NO: 128550 - DNA, 12 bp, Unknown
  misc_feature (1)..( 12): Result.003 file - promoters60/3433703
gctataaaagga

SEQ ID NO: 128551 - DNA, 12 bp, Unknown
  misc_feature (1)..( 12): Result.003 file - promoters60/3433703
tatatatatctc

SEQ ID NO: 128552 - DNA, 12 bp, Unknown
  misc_feature (1)..( 12): Result.003 file - promoters60/3433703
tatttatatgtt

SEQ ID NO: 128553 - DNA, 12 bp, Unknown
  misc_feature (1)..( 12): Result.003 file - promoters60/3433703
catataaatctc

SEQ ID NO: 128554 - DNA, 12 bp, Unknown
  misc_feature (1)..( 12): Result.003 file - promoters60/3433703
tatatataaata

SEQ ID NO: 128555 - DNA, 12 bp, Unknown
  misc_feature (1)..( 12): Result.003 file - promoters60/3433703
gctataaaagga

SEQ ID NO: 128556 - DNA, 11 bp, Unknown
  misc_feature (1)..( 11): Result.003 file - promoters60/3433703
aatcattttac

SEQ ID NO: 128557 - DNA, 11 bp, Unknown
  misc_feature (1)..( 11): Result.003 file - promoters60/3433703
aattattacga

SEQ ID NO: 128558 - DNA, 11 bp, Unknown
  misc_feature (1)..( 11): Result.003 file - promoters60/3433703
aatgatttctt

SEQ ID NO: 128559 - DNA, 11 bp, Unknown
  misc_feature (1)..( 11): Result.003 file - promoters60/3433703
tatcatttttg

SEQ ID NO: 128560 - DNA, 11 bp, Unknown
  misc_feature (1)..( 11): Result.003 file - promoters60/3433703
gtcgatttctt

SEQ ID NO: 128561 - DNA, 12 bp, Unknown
  misc_feature (1)..( 12): Result.003 file - promoters60/3433799
gattgataacag

SEQ ID NO: 128562 - DNA, 12 bp, Unknown
  misc_feature (1)..( 12): Result.003 file - promoters60/3433799
gattgttaacag

SEQ ID NO: 128563 - DNA, 12 bp, Unknown
  misc_feature (1)..( 12): Result.003 file - promoters60/3433799
tattaataatcg

SEQ ID NO: 128564 - DNA, 7 bp, Unknown
  misc_feature (1)..( 7): Result.003 file - promoters60/3433799
tggcaaa

SEQ ID NO: 128565 - DNA, 7 bp, Unknown
  misc_feature (1)..( 7): Result.003 file - promoters60/3433799
tggaaaa

SEQ ID NO: 128566 - DNA, 7 bp, Unknown
  misc_feature (1)..( 7): Result.003 file - promoters60/3433799
tggaaac

SEQ ID NO: 128567 - DNA, 9 bp, Unknown
  misc_feature (1)..( 9): Result.003 file - promoters60/3433799
aaatcattg

SEQ ID NO: 128568 - DNA, 9 bp, Unknown
  misc_feature (1)..( 9): Result.003 file - promoters60/3433799
aaaccattt

SEQ ID NO: 128569 - DNA, 9 bp, Unknown
  misc_feature (1)..( 9): Result.003 file - promoters60/3433799
tatccattt

SEQ ID NO: 128570 - DNA, 9 bp, Unknown
  misc_feature (1)..( 9): Result.003 file - promoters60/3433799
ctttataat

SEQ ID NO: 128571 - DNA, 9 bp, Unknown
  misc_feature (1)..( 9): Result.003 file - promoters60/3433799
cattaaaat

SEQ ID NO: 128572 - DNA, 10 bp, Unknown
  misc_feature (1)..( 10): Result.003 file - promoters60/3433799
acttcataga

SEQ ID NO: 128573 - DNA, 8 bp, Unknown
  misc_feature (1)..( 8): Result.003 file - promoters60/3433831
ttgcattt

SEQ ID NO: 128574 - DNA, 8 bp, Unknown
  misc_feature (1)..( 8): Result.003 file - promoters60/3433831
ttgcattt

SEQ ID NO: 128575 - DNA, 8 bp, Unknown
  misc_feature (1)..( 8): Result.003 file - promoters60/3433831
ataaaaaa

SEQ ID NO: 128576 - DNA, 8 bp, Unknown
  misc_feature (1)..( 8): Result.003 file - promoters60/3433831
ataaaaaa

SEQ ID NO: 128577 - DNA, 7 bp, Unknown
  misc_feature (1)..( 7): Result.003 file - promoters60/3433831
taagaaa

SEQ ID NO: 128578 - DNA, 7 bp, Unknown
  misc_feature (1)..( 7): Result.003 file - promoters60/3433831
taacaaa

SEQ ID NO: 128579 - DNA, 7 bp, Unknown
  misc_feature (1)..( 7): Result.003 file - promoters60/3433831
agaatta

SEQ ID NO: 128580 - DNA, 7 bp, Unknown
  misc_feature (1)..( 7): Result.003 file - promoters60/3433831
agactta

SEQ ID NO: 128581 - DNA, 9 bp, Unknown
  misc_feature (1)..( 9): Result.003 file - promoters60/3433831
attcgataa

SEQ ID NO: 128582 - DNA, 9 bp, Unknown
  misc_feature (1)..( 9): Result.003 file - promoters60/3433831
attagataa

SEQ ID NO: 128583 - DNA, 7 bp, Unknown
  misc_feature (1)..( 7): Result.003 file - promoters60/3433831
ttaagaa

SEQ ID NO: 128584 - DNA, 7 bp, Unknown
  misc_feature (1)..( 7): Result.003 file - promoters60/3433831
ttatgaa

SEQ ID NO: 128585 - DNA, 6 bp, Unknown
  misc_feature (1)..( 6): Result.003 file - promoters60/3433831
ataatt

SEQ ID NO: 128586 - DNA, 6 bp, Unknown
  misc_feature (1)..( 6): Result.003 file - promoters60/3433831
ataatt

SEQ ID NO: 128587 - DNA, 6 bp, Unknown
  misc_feature (1)..( 6): Result.003 file - promoters60/3433831
tttaat

SEQ ID NO: 128588 - DNA, 6 bp, Unknown
  misc_feature (1)..( 6): Result.003 file - promoters60/3433831
tttaat

SEQ ID NO: 128589 - DNA, 7 bp, Unknown
  misc_feature (1)..( 7): Result.003 file - promoters60/3433831
gagagat

SEQ ID NO: 128590 - DNA, 7 bp, Unknown
  misc_feature (1)..( 7): Result.003 file - promoters60/3433831
gagtgat

SEQ ID NO: 128591 - DNA, 8 bp, Unknown
  misc_feature (1)..( 8): Result.003 file - promoters60/3433831
cacaattg

SEQ ID NO: 128592 - DNA, 8 bp, Unknown
  misc_feature (1)..( 8): Result.003 file - promoters60/3433831
cacgattg

SEQ ID NO: 128593 - DNA, 7 bp, Unknown
  misc_feature (1)..( 7): Result.003 file - promoters60/3433831
atgacaa

SEQ ID NO: 128594 - DNA, 7 bp, Unknown
  misc_feature (1)..( 7): Result.003 file - promoters60/3433831
atgtcaa

SEQ ID NO: 128595 - DNA, 6 bp, Unknown
  misc_feature (1)..( 6): Result.003 file - promoters60/3433831
tcatat

SEQ ID NO: 128596 - DNA, 6 bp, Unknown
  misc_feature (1)..( 6): Result.003 file - promoters60/3433831
tcatat

SEQ ID NO: 128597 - DNA, 7 bp, Unknown
  misc_feature (1)..( 7): Result.003 file - promoters60/3433831
ttaggtg

SEQ ID NO: 128598 - DNA, 7 bp, Unknown
  misc_feature (1)..( 7): Result.003 file - promoters60/3433831
ttatgtg

SEQ ID NO: 128599 - DNA, 8 bp, Unknown
  misc_feature (1)..( 8): Result.003 file - promoters60/3433831
atatatac

SEQ ID NO: 128600 - DNA, 8 bp, Unknown
  misc_feature (1)..( 8): Result.003 file - promoters60/3433831
atacatac

SEQ ID NO: 128601 - DNA, 6 bp, Unknown
  misc_feature (1)..( 6): Result.003 file - promoters60/3433831
ttcaaa

SEQ ID NO: 128602 - DNA, 6 bp, Unknown
  misc_feature (1)..( 6): Result.003 file - promoters60/3433831
ttcaaa

SEQ ID NO: 128603 - DNA, 11 bp, Unknown
  misc_feature (1)..( 11): Result.003 file - promoters60/3433904
agtaaaccaac

SEQ ID NO: 128604 - DNA, 11 bp, Unknown
  misc_feature (1)..( 11): Result.003 file - promoters60/3433904
atcaaaccaga

SEQ ID NO: 128605 - DNA, 11 bp, Unknown
  misc_feature (1)..( 11): Result.003 file - promoters60/3433904
cgtagaccaag

SEQ ID NO: 128606 - DNA, 11 bp, Unknown
  misc_feature (1)..( 11): Result.003 file - promoters60/3433904
ctgtaacaaac

SEQ ID NO: 128607 - DNA, 11 bp, Unknown
  misc_feature (1)..( 11): Result.003 file - promoters60/3433904
agtagactctc

SEQ ID NO: 128608 - DNA, 11 bp, Unknown
  misc_feature (1)..( 11): Result.003 file - promoters60/3433904
agtagaacgca

SEQ ID NO: 128609 - DNA, 10 bp, Unknown
  misc_feature (1)..( 10): Result.003 file - promoters60/3433926
attcttagaa

SEQ ID NO: 128610 - DNA, 10 bp, Unknown
  misc_feature (1)..( 10): Result.003 file - promoters60/3433926
catcttagca

SEQ ID NO: 128611 - DNA, 10 bp, Unknown
  misc_feature (1)..( 10): Result.003 file - promoters60/3433926
attgttaacg

SEQ ID NO: 128612 - DNA, 10 bp, Unknown
  misc_feature (1)..( 10): Result.003 file - promoters60/3433926
aatcttggca

SEQ ID NO: 128613 - DNA, 10 bp, Unknown
  misc_feature (1)..( 10): Result.003 file - promoters60/3433926
tatcttggag

SEQ ID NO: 128614 - DNA, 10 bp, Unknown
  misc_feature (1)..( 10): Result.003 file - promoters60/3433926
attgttccct

SEQ ID NO: 128615 - DNA, 8 bp, Unknown
  misc_feature (1)..( 8): Result.003 file - promoters60/3433926
aattctta

SEQ ID NO: 128616 - DNA, 8 bp, Unknown
  misc_feature (1)..( 8): Result.003 file - promoters60/3433926
aattcttt

SEQ ID NO: 128617 - DNA, 8 bp, Unknown
  misc_feature (1)..( 8): Result.003 file - promoters60/3433926
cattgtta

SEQ ID NO: 128618 - DNA, 8 bp, Unknown
  misc_feature (1)..( 8): Result.003 file - promoters60/3433926
gattcttg

SEQ ID NO: 128619 - DNA, 8 bp, Unknown
  misc_feature (1)..( 8): Result.003 file - promoters60/3433926
ccttcttt

SEQ ID NO: 128620 - DNA, 8 bp, Unknown
  misc_feature (1)..( 8): Result.003 file - promoters60/3433926
tattgttc

SEQ ID NO: 128621 - DNA, 9 bp, Unknown
  misc_feature (1)..( 9): Result.003 file - promoters60/3433978
caatgaaac

SEQ ID NO: 128622 - DNA, 9 bp, Unknown
  misc_feature (1)..( 9): Result.003 file - promoters60/3433978
aaataaaaa

SEQ ID NO: 128623 - DNA, 9 bp, Unknown
  misc_feature (1)..( 9): Result.003 file - promoters60/3433978
aaataaagt

SEQ ID NO: 128624 - DNA, 9 bp, Unknown
  misc_feature (1)..( 9): Result.003 file - promoters60/3433978
caatagagt

SEQ ID NO: 128625 - DNA, 8 bp, Unknown
  misc_feature (1)..( 8): Result.003 file - promoters60/3433978
ttttgttc

SEQ ID NO: 128626 - DNA, 8 bp, Unknown
  misc_feature (1)..( 8): Result.003 file - promoters60/3433978
ttttcttc

SEQ ID NO: 128627 - DNA, 8 bp, Unknown
  misc_feature (1)..( 8): Result.003 file - promoters60/3433978
ttttgttg

SEQ ID NO: 128628 - DNA, 8 bp, Unknown
  misc_feature (1)..( 8): Result.003 file - promoters60/3433978
tgttgttg

SEQ ID NO: 128629 - DNA, 9 bp, Unknown
  misc_feature (1)..( 9): Result.003 file - promoters60/3433978
aaaattata

SEQ ID NO: 128630 - DNA, 9 bp, Unknown
  misc_feature (1)..( 9): Result.003 file - promoters60/3433978
aaacttata

SEQ ID NO: 128631 - DNA, 9 bp, Unknown
  misc_feature (1)..( 9): Result.003 file - promoters60/3433978
aaagttata

SEQ ID NO: 128632 - DNA, 9 bp, Unknown
  misc_feature (1)..( 9): Result.003 file - promoters60/3433978
gaagtcata

SEQ ID NO: 128633 - DNA, 8 bp, Unknown
  misc_feature (1)..( 8): Result.003 file - promoters60/3433978
ttattaaa

SEQ ID NO: 128634 - DNA, 8 bp, Unknown
  misc_feature (1)..( 8): Result.003 file - promoters60/3433978
ttattaat

SEQ ID NO: 128635 - DNA, 9 bp, Unknown
  misc_feature (1)..( 9): Result.003 file - promoters60/3433978
caattcaag

SEQ ID NO: 128636 - DNA, 9 bp, Unknown
  misc_feature (1)..( 9): Result.003 file - promoters60/3433978
ttattatat

SEQ ID NO: 128637 - DNA, 8 bp, Unknown
  misc_feature (1)..( 8): Result.003 file - promoters60/3433998
acatatct

SEQ ID NO: 128638 - DNA, 8 bp, Unknown
  misc_feature (1)..( 8): Result.003 file - promoters60/3433998
ccatctct

SEQ ID NO: 128639 - DNA, 8 bp, Unknown
  misc_feature (1)..( 8): Result.003 file - promoters60/3433998
acatatct

SEQ ID NO: 128640 - DNA, 7 bp, Unknown
  misc_feature (1)..( 7): Result.003 file - promoters60/3433998
caaaaaa

SEQ ID NO: 128641 - DNA, 7 bp, Unknown
  misc_feature (1)..( 7): Result.003 file - promoters60/3433998
caagaaa

SEQ ID NO: 128642 - DNA, 7 bp, Unknown
  misc_feature (1)..( 7): Result.003 file - promoters60/3433998
caaaaac

SEQ ID NO: 128643 - DNA, 8 bp, Unknown
  misc_feature (1)..( 8): Result.003 file - promoters60/3433998
aaaaattc

SEQ ID NO: 128644 - DNA, 8 bp, Unknown
  misc_feature (1)..( 8): Result.003 file - promoters60/3433998
caaagttc

SEQ ID NO: 128645 - DNA, 8 bp, Unknown
  misc_feature (1)..( 8): Result.003 file - promoters60/3433998
caaagtga

SEQ ID NO: 128646 - DNA, 8 bp, Unknown
  misc_feature (1)..( 8): Result.003 file - promoters60/3433998
gtttaaaa

SEQ ID NO: 128647 - DNA, 8 bp, Unknown
  misc_feature (1)..( 8): Result.003 file - promoters60/3433998
ttttaaaa

SEQ ID NO: 128648 - DNA, 9 bp, Unknown
  misc_feature (1)..( 9): Result.003 file - promoters60/3433998
ttttataaa

SEQ ID NO: 128649 - DNA, 8 bp, Unknown
  misc_feature (1)..( 8): Result.003 file - promoters60/3433998
tcttatct

SEQ ID NO: 128650 - DNA, 8 bp, Unknown
  misc_feature (1)..( 8): Result.003 file - promoters60/3433998
gcttctct

SEQ ID NO: 128651 - DNA, 8 bp, Unknown
  misc_feature (1)..( 8): Result.003 file - promoters60/3433998
tcttatga

SEQ ID NO: 128652 - DNA, 9 bp, Unknown
  misc_feature (1)..( 9): Result.003 file - promoters60/3433998
cacatatcc

SEQ ID NO: 128653 - DNA, 9 bp, Unknown
  misc_feature (1)..( 9): Result.003 file - promoters60/3433998
cacatatct

SEQ ID NO: 128654 - DNA, 9 bp, Unknown
  misc_feature (1)..( 9): Result.003 file - promoters60/3433998
aaaatatcc

SEQ ID NO: 128655 - DNA, 7 bp, Unknown
  misc_feature (1)..( 7): Result.003 file - promoters60/3433998
atataat

SEQ ID NO: 128656 - DNA, 7 bp, Unknown
  misc_feature (1)..( 7): Result.003 file - promoters60/3433998
ataaaat

SEQ ID NO: 128657 - DNA, 7 bp, Unknown
  misc_feature (1)..( 7): Result.003 file - promoters60/3433998
ataaaaa

SEQ ID NO: 128658 - DNA, 7 bp, Unknown
  misc_feature (1)..( 7): Result.003 file - promoters60/3433998
aaaaaaa

SEQ ID NO: 128659 - DNA, 7 bp, Unknown
  misc_feature (1)..( 7): Result.003 file - promoters60/3433998
aaaaaaa

SEQ ID NO: 128660 - DNA, 7 bp, Unknown
  misc_feature (1)..( 7): Result.003 file - promoters60/3433998
aaaaaaa

SEQ ID NO: 128661 - DNA, 6 bp, Unknown
  misc_feature (1)..( 6): Result.003 file - promoters60/3433998
aaaaaa

SEQ ID NO: 128662 - DNA, 6 bp, Unknown
  misc_feature (1)..( 6): Result.003 file - promoters60/3433998
aaaaaa

SEQ ID NO: 128663 - DNA, 6 bp, Unknown
  misc_feature (1)..( 6): Result.003 file - promoters60/3433998
aaaaaa

SEQ ID NO: 128664 - DNA, 11 bp, Unknown
  misc_feature (1)..( 11): Result.003 file - promoters60/3434028
atcgaatcaat

SEQ ID NO: 128665 - DNA, 11 bp, Unknown
  misc_feature (1)..( 11): Result.003 file - promoters60/3434028
tccgattcaat

SEQ ID NO: 128666 - DNA, 11 bp, Unknown
  misc_feature (1)..( 11): Result.003 file - promoters60/3434028
ttaaaatcaat

SEQ ID NO: 128667 - DNA, 11 bp, Unknown
  misc_feature (1)..( 11): Result.003 file - promoters60/3434028
aaaaaatgaat

SEQ ID NO: 128668 - DNA, 11 bp, Unknown
  misc_feature (1)..( 11): Result.003 file - promoters60/3434028
ctcgattaaat

SEQ ID NO: 128669 - DNA, 11 bp, Unknown
  misc_feature (1)..( 11): Result.003 file - promoters60/3434028
ttcgattgtgt

SEQ ID NO: 128670 - DNA, 9 bp, Unknown
  misc_feature (1)..( 9): Result.003 file - promoters60/3434028
taatgtttg

SEQ ID NO: 128671 - DNA, 9 bp, Unknown
  misc_feature (1)..( 9): Result.003 file - promoters60/3434028
taaggttag

SEQ ID NO: 128672 - DNA, 9 bp, Unknown
  misc_feature (1)..( 9): Result.003 file - promoters60/3434028
ttatgtttt

SEQ ID NO: 128673 - DNA, 9 bp, Unknown
  misc_feature (1)..( 9): Result.003 file - promoters60/3434028
tgatgattg

SEQ ID NO: 128674 - DNA, 9 bp, Unknown
  misc_feature (1)..( 9): Result.003 file - promoters60/3434028
gaagcttaa

SEQ ID NO: 128675 - DNA, 9 bp, Unknown
  misc_feature (1)..( 9): Result.003 file - promoters60/3434028
caagattat

SEQ ID NO: 128676 - DNA, 8 bp, Unknown
  misc_feature (1)..( 8): Result.003 file - promoters60/3434036
ggtgggat

SEQ ID NO: 128677 - DNA, 8 bp, Unknown
  misc_feature (1)..( 8): Result.003 file - promoters60/3434036
ggtgtgat

SEQ ID NO: 128678 - DNA, 7 bp, Unknown
  misc_feature (1)..( 7): Result.003 file - promoters60/3434036
cttgatt

SEQ ID NO: 128679 - DNA, 7 bp, Unknown
  misc_feature (1)..( 7): Result.003 file - promoters60/3434036
cttgatt

SEQ ID NO: 128680 - DNA, 7 bp, Unknown
  misc_feature (1)..( 7): Result.003 file - promoters60/3434036
atctgtt

SEQ ID NO: 128681 - DNA, 7 bp, Unknown
  misc_feature (1)..( 7): Result.003 file - promoters60/3434036
atctgtt

SEQ ID NO: 128682 - DNA, 7 bp, Unknown
  misc_feature (1)..( 7): Result.003 file - promoters60/3434036
aagatca

SEQ ID NO: 128683 - DNA, 7 bp, Unknown
  misc_feature (1)..( 7): Result.003 file - promoters60/3434036
aaggtca

SEQ ID NO: 128684 - DNA, 6 bp, Unknown
  misc_feature (1)..( 6): Result.003 file - promoters60/3434036
ctttac

SEQ ID NO: 128685 - DNA, 6 bp, Unknown
  misc_feature (1)..( 6): Result.003 file - promoters60/3434036
ctttac

SEQ ID NO: 128686 - DNA, 9 bp, Unknown
  misc_feature (1)..( 9): Result.003 file - promoters60/3434036
ctttttttt

SEQ ID NO: 128687 - DNA, 9 bp, Unknown
  misc_feature (1)..( 9): Result.003 file - promoters60/3434036
ctttgtttt

SEQ ID NO: 128688 - DNA, 7 bp, Unknown
  misc_feature (1)..( 7): Result.003 file - promoters60/3434036
acgcgag

SEQ ID NO: 128689 - DNA, 7 bp, Unknown
  misc_feature (1)..( 7): Result.003 file - promoters60/3434036
acgagag

SEQ ID NO: 128690 - DNA, 7 bp, Unknown
  misc_feature (1)..( 7): Result.003 file - promoters60/3434036
gttagga

SEQ ID NO: 128691 - DNA, 7 bp, Unknown
  misc_feature (1)..( 7): Result.003 file - promoters60/3434036
gttggga

SEQ ID NO: 128692 - DNA, 6 bp, Unknown
  misc_feature (1)..( 6): Result.003 file - promoters60/3434036
gatcgg

SEQ ID NO: 128693 - DNA, 6 bp, Unknown
  misc_feature (1)..( 6): Result.003 file - promoters60/3434036
gatcgg

SEQ ID NO: 128694 - DNA, 7 bp, Unknown
  misc_feature (1)..( 7): Result.003 file - promoters60/3434036
gatcgga

SEQ ID NO: 128695 - DNA, 7 bp, Unknown
  misc_feature (1)..( 7): Result.003 file - promoters60/3434036
gattgga

SEQ ID NO: 128696 - DNA, 6 bp, Unknown
  misc_feature (1)..( 6): Result.003 file - promoters60/3434036
acgcga

SEQ ID NO: 128697 - DNA, 6 bp, Unknown
  misc_feature (1)..( 6): Result.003 file - promoters60/3434036
acgcga

SEQ ID NO: 128698 - DNA, 9 bp, Unknown
  misc_feature (1)..( 9): Result.003 file - promoters60/3434036
aatccaaga

SEQ ID NO: 128699 - DNA, 9 bp, Unknown
  misc_feature (1)..( 9): Result.003 file - promoters60/3434036
aatccgaga

SEQ ID NO: 128700 - DNA, 7 bp, Unknown
  misc_feature (1)..( 7): Result.003 file - promoters60/3434036
agataaa

SEQ ID NO: 128701 - DNA, 7 bp, Unknown
  misc_feature (1)..( 7): Result.003 file - promoters60/3434036
agacaaa

SEQ ID NO: 128702 - DNA, 7 bp, Unknown
  misc_feature (1)..( 7): Result.003 file - promoters60/3434036
ttaaaaa

SEQ ID NO: 128703 - DNA, 7 bp, Unknown
  misc_feature (1)..( 7): Result.003 file - promoters60/3434036
ttagaaa

SEQ ID NO: 128704 - DNA, 8 bp, Unknown
  misc_feature (1)..( 8): Result.003 file - promoters60/3434036
gtagagaa

SEQ ID NO: 128705 - DNA, 8 bp, Unknown
  misc_feature (1)..( 8): Result.003 file - promoters60/3434036
gtagagaa

SEQ ID NO: 128706 - DNA, 6 bp, Unknown
  misc_feature (1)..( 6): Result.003 file - promoters60/3434036
agaaga

SEQ ID NO: 128707 - DNA, 6 bp, Unknown
  misc_feature (1)..( 6): Result.003 file - promoters60/3434036
agaaga

SEQ ID NO: 128708 - DNA, 6 bp, Unknown
  misc_feature (1)..( 6): Result.003 file - promoters60/3434036
gtgatt

SEQ ID NO: 128709 - DNA, 6 bp, Unknown
  misc_feature (1)..( 6): Result.003 file - promoters60/3434036
gtgatt

SEQ ID NO: 128710 - DNA, 11 bp, Unknown
  misc_feature (1)..( 11): Result.003 file - promoters60/3434044
gaaacaagttc

SEQ ID NO: 128711 - DNA, 11 bp, Unknown
  misc_feature (1)..( 11): Result.003 file - promoters60/3434044
gaaacaaaatc

SEQ ID NO: 128712 - DNA, 11 bp, Unknown
  misc_feature (1)..( 11): Result.003 file - promoters60/3434044
aaaataaggat

SEQ ID NO: 128713 - DNA, 11 bp, Unknown
  misc_feature (1)..( 11): Result.003 file - promoters60/3434044
aaaataaataa

SEQ ID NO: 128714 - DNA, 11 bp, Unknown
  misc_feature (1)..( 11): Result.003 file - promoters60/3434044
atcataattaa

SEQ ID NO: 128715 - DNA, 11 bp, Unknown
  misc_feature (1)..( 11): Result.003 file - promoters60/3434044
caattaaatgt

SEQ ID NO: 128716 - DNA, 12 bp, Unknown
  misc_feature (1)..( 12): Result.003 file - promoters60/3434044
tataatatttcc

SEQ ID NO: 128717 - DNA, 12 bp, Unknown
  misc_feature (1)..( 12): Result.003 file - promoters60/3434044
cttaatgtttgc

SEQ ID NO: 128718 - DNA, 12 bp, Unknown
  misc_feature (1)..( 12): Result.003 file - promoters60/3434044
gagtttgtttgt

SEQ ID NO: 128719 - DNA, 12 bp, Unknown
  misc_feature (1)..( 12): Result.003 file - promoters60/3434044
ttatttatttta

SEQ ID NO: 128720 - DNA, 12 bp, Unknown
  misc_feature (1)..( 12): Result.003 file - promoters60/3434044
ataacgatttat

SEQ ID NO: 128721 - DNA, 12 bp, Unknown
  misc_feature (1)..( 12): Result.003 file - promoters60/3434044
gagattgattgc

SEQ ID NO: 128722 - DNA, 12 bp, Unknown
  misc_feature (1)..( 12): Result.003 file - promoters60/3434044
gttattgatttc

SEQ ID NO: 128723 - DNA, 15 bp, Unknown
  misc_feature (1)..( 15): Result.003 file - promoters60/3434044
caagtagaagaaaga

SEQ ID NO: 128724 - DNA, 15 bp, Unknown
  misc_feature (1)..( 15): Result.003 file - promoters60/3434044
caagaagaaaaaaat

SEQ ID NO: 128725 - DNA, 15 bp, Unknown
  misc_feature (1)..( 15): Result.003 file - promoters60/3434044
atgacggaaaaaaaa

SEQ ID NO: 128726 - DNA, 15 bp, Unknown
  misc_feature (1)..( 15): Result.003 file - promoters60/3434044
gtctaacaaaaaaac

SEQ ID NO: 128727 - DNA, 15 bp, Unknown
  misc_feature (1)..( 15): Result.003 file - promoters60/3434044
gaagaaaaaaaaaat

SEQ ID NO: 128728 - DNA, 15 bp, Unknown
  misc_feature (1)..( 15): Result.003 file - promoters60/3434044
tatgaaaaaaaaagt

SEQ ID NO: 128729 - DNA, 11 bp, Unknown
  misc_feature (1)..( 11): Result.003 file - promoters60/3434044
cgaacatgata

SEQ ID NO: 128730 - DNA, 11 bp, Unknown
  misc_feature (1)..( 11): Result.003 file - promoters60/3434044
ataacattata

SEQ ID NO: 128731 - DNA, 11 bp, Unknown
  misc_feature (1)..( 11): Result.003 file - promoters60/3434044
ccttaatgata

SEQ ID NO: 128732 - DNA, 11 bp, Unknown
  misc_feature (1)..( 11): Result.003 file - promoters60/3434044
taggaatgatt

SEQ ID NO: 128733 - DNA, 11 bp, Unknown
  misc_feature (1)..( 11): Result.003 file - promoters60/3434044
ataaaatttca

SEQ ID NO: 128734 - DNA, 11 bp, Unknown
  misc_feature (1)..( 11): Result.003 file - promoters60/3434044
atcaaataata

SEQ ID NO: 128735 - DNA, 14 bp, Unknown
  misc_feature (1)..( 14): Result.003 file - promoters60/3434044
aagaaagaaacctc

SEQ ID NO: 128736 - DNA, 14 bp, Unknown
  misc_feature (1)..( 14): Result.003 file - promoters60/3434044
aacaaaaaaacatt

SEQ ID NO: 128737 - DNA, 14 bp, Unknown
  misc_feature (1)..( 14): Result.003 file - promoters60/3434044
cggaaaaaaaaact

SEQ ID NO: 128738 - DNA, 14 bp, Unknown
  misc_feature (1)..( 14): Result.003 file - promoters60/3434044
aagaaaaaaattgt

SEQ ID NO: 128739 - DNA, 14 bp, Unknown
  misc_feature (1)..( 14): Result.003 file - promoters60/3434044
aagaaaaaaaaaat

SEQ ID NO: 128740 - DNA, 14 bp, Unknown
  misc_feature (1)..( 14): Result.003 file - promoters60/3434044
atgaaaaaaaaagt

SEQ ID NO: 128741 - DNA, 8 bp, Unknown
  misc_feature (1)..( 8): Result.003 file - promoters60/3434044
aatgaaaa

SEQ ID NO: 128742 - DNA, 8 bp, Unknown
  misc_feature (1)..( 8): Result.003 file - promoters60/3434044
tatgcaaa

SEQ ID NO: 128743 - DNA, 8 bp, Unknown
  misc_feature (1)..( 8): Result.003 file - promoters60/3434044
aattaaat

SEQ ID NO: 128744 - DNA, 8 bp, Unknown
  misc_feature (1)..( 8): Result.003 file - promoters60/3434044
gattaaaa

SEQ ID NO: 128745 - DNA, 8 bp, Unknown
  misc_feature (1)..( 8): Result.003 file - promoters60/3434044
cattaaag

SEQ ID NO: 128746 - DNA, 8 bp, Unknown
  misc_feature (1)..( 8): Result.003 file - promoters60/3434044
aattaaat

SEQ ID NO: 128747 - DNA, 10 bp, Unknown
  misc_feature (1)..( 10): Result.003 file - promoters60/3434044
agaatatctt

SEQ ID NO: 128748 - DNA, 10 bp, Unknown
  misc_feature (1)..( 10): Result.003 file - promoters60/3434044
atcatatctt

SEQ ID NO: 128749 - DNA, 10 bp, Unknown
  misc_feature (1)..( 10): Result.003 file - promoters60/3434044
agaaaatcat

SEQ ID NO: 128750 - DNA, 10 bp, Unknown
  misc_feature (1)..( 10): Result.003 file - promoters60/3434044
tgaaaatcag

SEQ ID NO: 128751 - DNA, 10 bp, Unknown
  misc_feature (1)..( 10): Result.003 file - promoters60/3434044
agaaaaaaat

SEQ ID NO: 128752 - DNA, 10 bp, Unknown
  misc_feature (1)..( 10): Result.003 file - promoters60/3434044
aaaaaaacat

SEQ ID NO: 128753 - DNA, 8 bp, Unknown
  misc_feature (1)..( 8): Result.003 file - promoters60/3434074
aaagtcat

SEQ ID NO: 128754 - DNA, 8 bp, Unknown
  misc_feature (1)..( 8): Result.003 file - promoters60/3434074
aaattcat

SEQ ID NO: 128755 - DNA, 6 bp, Unknown
  misc_feature (1)..( 6): Result.003 file - promoters60/3434074
ttgaag

SEQ ID NO: 128756 - DNA, 6 bp, Unknown
  misc_feature (1)..( 6): Result.003 file - promoters60/3434074
ttgaag

SEQ ID NO: 128757 - DNA, 10 bp, Unknown
  misc_feature (1)..( 10): Result.003 file - promoters60/3434074
gataacttta

SEQ ID NO: 128758 - DNA, 10 bp, Unknown
  misc_feature (1)..( 10): Result.003 file - promoters60/3434074
gataacctta

SEQ ID NO: 128759 - DNA, 9 bp, Unknown
  misc_feature (1)..( 9): Result.003 file - promoters60/3434074
aacattttg

SEQ ID NO: 128760 - DNA, 9 bp, Unknown
  misc_feature (1)..( 9): Result.003 file - promoters60/3434074
aacgttttg

SEQ ID NO: 128761 - DNA, 6 bp, Unknown
  misc_feature (1)..( 6): Result.003 file - promoters60/3434074
ctgatt

SEQ ID NO: 128762 - DNA, 6 bp, Unknown
  misc_feature (1)..( 6): Result.003 file - promoters60/3434074
ctgatt

SEQ ID NO: 128763 - DNA, 6 bp, Unknown
  misc_feature (1)..( 6): Result.003 file - promoters60/3434074
ggctga

SEQ ID NO: 128764 - DNA, 6 bp, Unknown
  misc_feature (1)..( 6): Result.003 file - promoters60/3434074
ggctga

SEQ ID NO: 128765 - DNA, 11 bp, Unknown
  misc_feature (1)..( 11): Result.003 file - promoters60/3434074
aggttctcaga

SEQ ID NO: 128766 - DNA, 11 bp, Unknown
  misc_feature (1)..( 11): Result.003 file - promoters60/3434074
agggtctgaga

SEQ ID NO: 128767 - DNA, 6 bp, Unknown
  misc_feature (1)..( 6): Result.003 file - promoters60/3434074
agattt

SEQ ID NO: 128768 - DNA, 6 bp, Unknown
  misc_feature (1)..( 6): Result.003 file - promoters60/3434074
agattt

SEQ ID NO: 128769 - DNA, 6 bp, Unknown
  misc_feature (1)..( 6): Result.003 file - promoters60/3434112
taaaaa

SEQ ID NO: 128770 - DNA, 6 bp, Unknown
  misc_feature (1)..( 6): Result.003 file - promoters60/3434112
taaaaa

SEQ ID NO: 128771 - DNA, 9 bp, Unknown
  misc_feature (1)..( 9): Result.003 file - promoters60/3434112
tcatataat

SEQ ID NO: 128772 - DNA, 9 bp, Unknown
  misc_feature (1)..( 9): Result.003 file - promoters60/3434112
tcatacaat

SEQ ID NO: 128773 - DNA, 7 bp, Unknown
  misc_feature (1)..( 7): Result.003 file - promoters60/3434112
tataccg

SEQ ID NO: 128774 - DNA, 7 bp, Unknown
  misc_feature (1)..( 7): Result.003 file - promoters60/3434112
tataccg

SEQ ID NO: 128775 - DNA, 6 bp, Unknown
  misc_feature (1)..( 6): Result.003 file - promoters60/3434112
tctcca

SEQ ID NO: 128776 - DNA, 6 bp, Unknown
  misc_feature (1)..( 6): Result.003 file - promoters60/3434112
tctcca

SEQ ID NO: 128777 - DNA, 7 bp, Unknown
  misc_feature (1)..( 7): Result.003 file - promoters60/3434112
atttctc

SEQ ID NO: 128778 - DNA, 7 bp, Unknown
  misc_feature (1)..( 7): Result.003 file - promoters60/3434112
atttctc

SEQ ID NO: 128779 - DNA, 7 bp, Unknown
  misc_feature (1)..( 7): Result.003 file - promoters60/3434112
tgtgata

SEQ ID NO: 128780 - DNA, 7 bp, Unknown
  misc_feature (1)..( 7): Result.003 file - promoters60/3434112
tgttata

SEQ ID NO: 128781 - DNA, 8 bp, Unknown
  misc_feature (1)..( 8): Result.003 file - promoters60/3434112
aaacagat

SEQ ID NO: 128782 - DNA, 8 bp, Unknown
  misc_feature (1)..( 8): Result.003 file - promoters60/3434112
aaagagat

SEQ ID NO: 128783 - DNA, 8 bp, Unknown
  misc_feature (1)..( 8): Result.003 file - promoters60/3434112
ctcttcgt

SEQ ID NO: 128784 - DNA, 8 bp, Unknown
  misc_feature (1)..( 8): Result.003 file - promoters60/3434112
ctcgtcgt

SEQ ID NO: 128785 - DNA, 11 bp, Unknown
  misc_feature (1)..( 11): Result.003 file - promoters60/3434112
ctgagaagaag

SEQ ID NO: 128786 - DNA, 11 bp, Unknown
  misc_feature (1)..( 11): Result.003 file - promoters60/3434112
ctgagaagaag

SEQ ID NO: 128787 - DNA, 7 bp, Unknown
  misc_feature (1)..( 7): Result.003 file - promoters60/3434112
ttgaatt

SEQ ID NO: 128788 - DNA, 7 bp, Unknown
  misc_feature (1)..( 7): Result.003 file - promoters60/3434112
ttggatt

SEQ ID NO: 128789 - DNA, 6 bp, Unknown
  misc_feature (1)..( 6): Result.003 file - promoters60/3434112
atttga

SEQ ID NO: 128790 - DNA, 6 bp, Unknown
  misc_feature (1)..( 6): Result.003 file - promoters60/3434112
atttga

SEQ ID NO: 128791 - DNA, 6 bp, Unknown
  misc_feature (1)..( 6): Result.003 file - promoters60/3434112
actatt

SEQ ID NO: 128792 - DNA, 6 bp, Unknown
  misc_feature (1)..( 6): Result.003 file - promoters60/3434112
actatt

SEQ ID NO: 128793 - DNA, 6 bp, Unknown
  misc_feature (1)..( 6): Result.003 file - promoters60/3434147
tcaaaa

SEQ ID NO: 128794 - DNA, 6 bp, Unknown
  misc_feature (1)..( 6): Result.003 file - promoters60/3434147
tcaaaa

SEQ ID NO: 128795 - DNA, 8 bp, Unknown
  misc_feature (1)..( 8): Result.003 file - promoters60/3434147
aaatcata

SEQ ID NO: 128796 - DNA, 8 bp, Unknown
  misc_feature (1)..( 8): Result.003 file - promoters60/3434147
aaataata

SEQ ID NO: 128797 - DNA, 7 bp, Unknown
  misc_feature (1)..( 7): Result.003 file - promoters60/3434147
taggtaa

SEQ ID NO: 128798 - DNA, 7 bp, Unknown
  misc_feature (1)..( 7): Result.003 file - promoters60/3434147
tagataa

SEQ ID NO: 128799 - DNA, 12 bp, Unknown
  misc_feature (1)..( 12): Result.003 file - promoters60/3434147
ctgaaatatatt

SEQ ID NO: 128800 - DNA, 12 bp, Unknown
  misc_feature (1)..( 12): Result.003 file - promoters60/3434147
ctgaaataaatt

SEQ ID NO: 128801 - DNA, 6 bp, Unknown
  misc_feature (1)..( 6): Result.003 file - promoters60/3434147
ttatgt

SEQ ID NO: 128802 - DNA, 6 bp, Unknown
  misc_feature (1)..( 6): Result.003 file - promoters60/3434147
ttatgt

SEQ ID NO: 128803 - DNA, 11 bp, Unknown
  misc_feature (1)..( 11): Result.003 file - promoters60/3434147
tttgtaaacaa

SEQ ID NO: 128804 - DNA, 11 bp, Unknown
  misc_feature (1)..( 11): Result.003 file - promoters60/3434147
tttgtatacaa

SEQ ID NO: 128805 - DNA, 9 bp, Unknown
  misc_feature (1)..( 9): Result.003 file - promoters60/3434147
tatattatt

SEQ ID NO: 128806 - DNA, 9 bp, Unknown
  misc_feature (1)..( 9): Result.003 file - promoters60/3434147
tattttatt

SEQ ID NO: 128807 - DNA, 9 bp, Unknown
  misc_feature (1)..( 9): Result.003 file - promoters60/3434147
attaaaatt

SEQ ID NO: 128808 - DNA, 9 bp, Unknown
  misc_feature (1)..( 9): Result.003 file - promoters60/3434147
attaatatt

SEQ ID NO: 128809 - DNA, 7 bp, Unknown
  misc_feature (1)..( 7): Result.003 file - promoters60/3434147
gaccaaa

SEQ ID NO: 128810 - DNA, 7 bp, Unknown
  misc_feature (1)..( 7): Result.003 file - promoters60/3434147
gacaaaa

SEQ ID NO: 128811 - DNA, 7 bp, Unknown
  misc_feature (1)..( 7): Result.003 file - promoters60/3434147
ttcaata

SEQ ID NO: 128812 - DNA, 7 bp, Unknown
  misc_feature (1)..( 7): Result.003 file - promoters60/3434147
ttccata

SEQ ID NO: 128813 - DNA, 8 bp, Unknown
  misc_feature (1)..( 8): Result.003 file - promoters60/3434147
atttcaca

SEQ ID NO: 128814 - DNA, 8 bp, Unknown
  misc_feature (1)..( 8): Result.003 file - promoters60/3434147
attttaca

SEQ ID NO: 128815 - DNA, 6 bp, Unknown
  misc_feature (1)..( 6): Result.003 file - promoters60/3434147
tattta

SEQ ID NO: 128816 - DNA, 6 bp, Unknown
  misc_feature (1)..( 6): Result.003 file - promoters60/3434147
tattta

SEQ ID NO: 128817 - DNA, 6 bp, Unknown
  misc_feature (1)..( 6): Result.003 file - promoters60/3434147
taaaac

SEQ ID NO: 128818 - DNA, 6 bp, Unknown
  misc_feature (1)..( 6): Result.003 file - promoters60/3434147
taaaac

SEQ ID NO: 128819 - DNA, 6 bp, Unknown
  misc_feature (1)..( 6): Result.003 file - promoters60/3434147
cccaat

SEQ ID NO: 128820 - DNA, 6 bp, Unknown
  misc_feature (1)..( 6): Result.003 file - promoters60/3434147
cccaat

SEQ ID NO: 128821 - DNA, 11 bp, Unknown
  misc_feature (1)..( 11): Result.003 file - promoters60/3434147
aagcaaagagg

SEQ ID NO: 128822 - DNA, 11 bp, Unknown
  misc_feature (1)..( 11): Result.003 file - promoters60/3434147
aaggaaacagg

SEQ ID NO: 128823 - DNA, 9 bp, Unknown
  misc_feature (1)..( 9): Result.003 file - promoters60/3434233
tattgaaaa

SEQ ID NO: 128824 - DNA, 9 bp, Unknown
  misc_feature (1)..( 9): Result.003 file - promoters60/3434233
ctttgtaaa

SEQ ID NO: 128825 - DNA, 9 bp, Unknown
  misc_feature (1)..( 9): Result.003 file - promoters60/3434233
tatttaaaa

SEQ ID NO: 128826 - DNA, 9 bp, Unknown
  misc_feature (1)..( 9): Result.003 file - promoters60/3434233
tattgaaaa

SEQ ID NO: 128827 - DNA, 9 bp, Unknown
  misc_feature (1)..( 9): Result.003 file - promoters60/3434233
aattgaaac

SEQ ID NO: 128828 - DNA, 9 bp, Unknown
  misc_feature (1)..( 9): Result.003 file - promoters60/3434233
tcttgtaac

SEQ ID NO: 128829 - DNA, 9 bp, Unknown
  misc_feature (1)..( 9): Result.003 file - promoters60/3434233
aatcgaagg

SEQ ID NO: 128830 - DNA, 15 bp, Unknown
  misc_feature (1)..( 15): Result.003 file - promoters60/3434256
gttggcttctatttc

SEQ ID NO: 128831 - DNA, 15 bp, Unknown
  misc_feature (1)..( 15): Result.003 file - promoters60/3434256
ttttgcttcttattt

SEQ ID NO: 128832 - DNA, 15 bp, Unknown
  misc_feature (1)..( 15): Result.003 file - promoters60/3434256
tttttcttcttcttt

SEQ ID NO: 128833 - DNA, 15 bp, Unknown
  misc_feature (1)..( 15): Result.003 file - promoters60/3434256
gtgaaattctgtttg

SEQ ID NO: 128834 - DNA, 15 bp, Unknown
  misc_feature (1)..( 15): Result.003 file - promoters60/3434256
ttaattttctcattg

SEQ ID NO: 128835 - DNA, 15 bp, Unknown
  misc_feature (1)..( 15): Result.003 file - promoters60/3434256
attcctttcttcaca

SEQ ID NO: 128836 - DNA, 10 bp, Unknown
  misc_feature (1)..( 10): Result.003 file - promoters60/3434256
ctttgttatt

SEQ ID NO: 128837 - DNA, 10 bp, Unknown
  misc_feature (1)..( 10): Result.003 file - promoters60/3434256
tcttgttaac

SEQ ID NO: 128838 - DNA, 10 bp, Unknown
  misc_feature (1)..( 10): Result.003 file - promoters60/3434256
atatgttatc

SEQ ID NO: 128839 - DNA, 10 bp, Unknown
  misc_feature (1)..( 10): Result.003 file - promoters60/3434256
tgttcttaga

SEQ ID NO: 128840 - DNA, 10 bp, Unknown
  misc_feature (1)..( 10): Result.003 file - promoters60/3434256
ttttatttta

SEQ ID NO: 128841 - DNA, 13 bp, Unknown
  misc_feature (1)..( 13): Result.003 file - promoters60/3434256
ctatatataaaac

SEQ ID NO: 128842 - DNA, 13 bp, Unknown
  misc_feature (1)..( 13): Result.003 file - promoters60/3434256
gtatttattaaac

SEQ ID NO: 128843 - DNA, 13 bp, Unknown
  misc_feature (1)..( 13): Result.003 file - promoters60/3434256
ctatataaaccag

SEQ ID NO: 128844 - DNA, 13 bp, Unknown
  misc_feature (1)..( 13): Result.003 file - promoters60/3434256
atatataaacaac

SEQ ID NO: 128845 - DNA, 13 bp, Unknown
  misc_feature (1)..( 13): Result.003 file - promoters60/3434256
gtataaataaagc

SEQ ID NO: 128846 - DNA, 13 bp, Unknown
  misc_feature (1)..( 13): Result.003 file - promoters60/3434256
atagatataaaga

SEQ ID NO: 128847 - DNA, 12 bp, Unknown
  misc_feature (1)..( 12): Result.003 file - promoters60/3434256
accgttaaaaat

SEQ ID NO: 128848 - DNA, 12 bp, Unknown
  misc_feature (1)..( 12): Result.003 file - promoters60/3434256
tttattaaaaaa

SEQ ID NO: 128849 - DNA, 12 bp, Unknown
  misc_feature (1)..( 12): Result.003 file - promoters60/3434256
atcaacaaaaat

SEQ ID NO: 128850 - DNA, 13 bp, Unknown
  misc_feature (1)..( 13): Result.003 file - promoters60/3434256
gttgataataaag

SEQ ID NO: 128851 - DNA, 13 bp, Unknown
  misc_feature (1)..( 13): Result.003 file - promoters60/3434256
gttgttaataaat

SEQ ID NO: 128852 - DNA, 13 bp, Unknown
  misc_feature (1)..( 13): Result.003 file - promoters60/3434256
tttattaaaaaaa

SEQ ID NO: 128853 - DNA, 13 bp, Unknown
  misc_feature (1)..( 13): Result.003 file - promoters60/3434256
gtgtttaataaac

SEQ ID NO: 128854 - DNA, 12 bp, Unknown
  misc_feature (1)..( 12): Result.003 file - promoters60/3434256
aaccgttggctt

SEQ ID NO: 128855 - DNA, 12 bp, Unknown
  misc_feature (1)..( 12): Result.003 file - promoters60/3434256
atctgtttgcta

SEQ ID NO: 128856 - DNA, 12 bp, Unknown
  misc_feature (1)..( 12): Result.003 file - promoters60/3434256
cgcgttttgctt

SEQ ID NO: 128857 - DNA, 12 bp, Unknown
  misc_feature (1)..( 12): Result.003 file - promoters60/3434256
attaattttctt

SEQ ID NO: 128858 - DNA, 12 bp, Unknown
  misc_feature (1)..( 12): Result.003 file - promoters60/3434256
attaattttctc

SEQ ID NO: 128859 - DNA, 12 bp, Unknown
  misc_feature (1)..( 12): Result.003 file - promoters60/3434256
cgcgttttgctt

SEQ ID NO: 128860 - DNA, 12 bp, Unknown
  misc_feature (1)..( 12): Result.003 file - promoters60/3434256
cttgttgtgctt

SEQ ID NO: 128861 - DNA, 12 bp, Unknown
  misc_feature (1)..( 12): Result.003 file - promoters60/3434256
atctgtttgcta

SEQ ID NO: 128862 - DNA, 12 bp, Unknown
  misc_feature (1)..( 12): Result.003 file - promoters60/3434256
attaattttctt

SEQ ID NO: 128863 - DNA, 12 bp, Unknown
  misc_feature (1)..( 12): Result.003 file - promoters60/3434256
attaattttctc

SEQ ID NO: 128864 - DNA, 14 bp, Unknown
  misc_feature (1)..( 14): Result.003 file - promoters60/3434256
gagaattatgccta

SEQ ID NO: 128865 - DNA, 14 bp, Unknown
  misc_feature (1)..( 14): Result.003 file - promoters60/3434256
ttaatttattccta

SEQ ID NO: 128866 - DNA, 14 bp, Unknown
  misc_feature (1)..( 14): Result.003 file - promoters60/3434256
ttaatttatttatt

SEQ ID NO: 128867 - DNA, 14 bp, Unknown
  misc_feature (1)..( 14): Result.003 file - promoters60/3434256
ttggtttttttccg

SEQ ID NO: 128868 - DNA, 14 bp, Unknown
  misc_feature (1)..( 14): Result.003 file - promoters60/3434256
acaatgtattcaac

SEQ ID NO: 128869 - DNA, 14 bp, Unknown
  misc_feature (1)..( 14): Result.003 file - promoters60/3434256
aagatttgtttttt

SEQ ID NO: 128870 - DNA, 16 bp, Unknown
  misc_feature (1)..( 16): Result.003 file - promoters60/3434256
aaatattaagtacttt

SEQ ID NO: 128871 - DNA, 16 bp, Unknown
  misc_feature (1)..( 16): Result.003 file - promoters60/3434256
agtgattaaatactac

SEQ ID NO: 128872 - DNA, 16 bp, Unknown
  misc_feature (1)..( 16): Result.003 file - promoters60/3434256
tgactttaagtcagaa

SEQ ID NO: 128873 - DNA, 16 bp, Unknown
  misc_feature (1)..( 16): Result.003 file - promoters60/3434256
ctagatatagttcttt

SEQ ID NO: 128874 - DNA, 16 bp, Unknown
  misc_feature (1)..( 16): Result.003 file - promoters60/3434256
agtgataaaaagtttt

SEQ ID NO: 128875 - DNA, 10 bp, Unknown
  misc_feature (1)..( 10): Result.003 file - promoters60/3434256
tgattaattt

SEQ ID NO: 128876 - DNA, 10 bp, Unknown
  misc_feature (1)..( 10): Result.003 file - promoters60/3434256
aaattaatgt

SEQ ID NO: 128877 - DNA, 10 bp, Unknown
  misc_feature (1)..( 10): Result.003 file - promoters60/3434256
aaataaatca

SEQ ID NO: 128878 - DNA, 10 bp, Unknown
  misc_feature (1)..( 10): Result.003 file - promoters60/3434256
tactaaatat

SEQ ID NO: 128879 - DNA, 10 bp, Unknown
  misc_feature (1)..( 10): Result.003 file - promoters60/3434256
atattgatgt

SEQ ID NO: 128880 - DNA, 12 bp, Unknown
  misc_feature (1)..( 12): Result.003 file - promoters60/3434256
taaaacatttat

SEQ ID NO: 128881 - DNA, 12 bp, Unknown
  misc_feature (1)..( 12): Result.003 file - promoters60/3434256
taaaacaaaact

SEQ ID NO: 128882 - DNA, 12 bp, Unknown
  misc_feature (1)..( 12): Result.003 file - promoters60/3434256
tgaaatattttt

SEQ ID NO: 128883 - DNA, 12 bp, Unknown
  misc_feature (1)..( 12): Result.003 file - promoters60/3434256
aaaaagaaatga

SEQ ID NO: 128884 - DNA, 12 bp, Unknown
  misc_feature (1)..( 12): Result.003 file - promoters60/3434256
tagaatgttttt

SEQ ID NO: 128885 - DNA, 16 bp, Unknown
  misc_feature (1)..( 16): Result.003 file - promoters60/3434256
tttaatttattcctat

SEQ ID NO: 128886 - DNA, 16 bp, Unknown
  misc_feature (1)..( 16): Result.003 file - promoters60/3434256
tttaataaacaaaacg

SEQ ID NO: 128887 - DNA, 16 bp, Unknown
  misc_feature (1)..( 16): Result.003 file - promoters60/3434256
tttattaaaaaaaaaa

SEQ ID NO: 128888 - DNA, 16 bp, Unknown
  misc_feature (1)..( 16): Result.003 file - promoters60/3434256
gttaataaatttatta

SEQ ID NO: 128889 - DNA, 16 bp, Unknown
  misc_feature (1)..( 16): Result.003 file - promoters60/3434256
atcaataaattcatta

SEQ ID NO: 128890 - DNA, 11 bp, Unknown
  misc_feature (1)..( 11): Result.003 file - promoters60/3434279
cttgtttatat

SEQ ID NO: 128891 - DNA, 11 bp, Unknown
  misc_feature (1)..( 11): Result.003 file - promoters60/3434279
tttggttacaa

SEQ ID NO: 128892 - DNA, 11 bp, Unknown
  misc_feature (1)..( 11): Result.003 file - promoters60/3434279
cgagtttattt

SEQ ID NO: 128893 - DNA, 11 bp, Unknown
  misc_feature (1)..( 11): Result.003 file - promoters60/3434279
cttgtttactg

SEQ ID NO: 128894 - DNA, 11 bp, Unknown
  misc_feature (1)..( 11): Result.003 file - promoters60/3434279
acggtttgctg

SEQ ID NO: 128895 - DNA, 11 bp, Unknown
  misc_feature (1)..( 11): Result.003 file - promoters60/3434279
attttttttat

SEQ ID NO: 128896 - DNA, 9 bp, Unknown
  misc_feature (1)..( 9): Result.003 file - promoters60/3434299
catataaag

SEQ ID NO: 128897 - DNA, 9 bp, Unknown
  misc_feature (1)..( 9): Result.003 file - promoters60/3434299
catatatac

SEQ ID NO: 128898 - DNA, 9 bp, Unknown
  misc_feature (1)..( 9): Result.003 file - promoters60/3434299
aataaaaag

SEQ ID NO: 128899 - DNA, 9 bp, Unknown
  misc_feature (1)..( 9): Result.003 file - promoters60/3434299
tatatatat

SEQ ID NO: 128900 - DNA, 9 bp, Unknown
  misc_feature (1)..( 9): Result.003 file - promoters60/3434299
tatagataa

SEQ ID NO: 128901 - DNA, 9 bp, Unknown
  misc_feature (1)..( 9): Result.003 file - promoters60/3434299
tataaaacc

SEQ ID NO: 128902 - DNA, 9 bp, Unknown
  misc_feature (1)..( 9): Result.003 file - promoters60/3434311
atcagaatc

SEQ ID NO: 128903 - DNA, 9 bp, Unknown
  misc_feature (1)..( 9): Result.003 file - promoters60/3434311
ttcaaaatt

SEQ ID NO: 128904 - DNA, 9 bp, Unknown
  misc_feature (1)..( 9): Result.003 file - promoters60/3434311
atcagaccg

SEQ ID NO: 128905 - DNA, 9 bp, Unknown
  misc_feature (1)..( 9): Result.003 file - promoters60/3434311
tccaaaatg

SEQ ID NO: 128906 - DNA, 9 bp, Unknown
  misc_feature (1)..( 9): Result.003 file - promoters60/3434311
ttccaaatg

SEQ ID NO: 128907 - DNA, 9 bp, Unknown
  misc_feature (1)..( 9): Result.003 file - promoters60/3434311
gagaaaatg

SEQ ID NO: 128908 - DNA, 9 bp, Unknown
  misc_feature (1)..( 9): Result.003 file - promoters60/3434311
atccgaccg

SEQ ID NO: 128909 - DNA, 11 bp, Unknown
  misc_feature (1)..( 11): Result.003 file - promoters60/3434311
tttcaaaatgt

SEQ ID NO: 128910 - DNA, 11 bp, Unknown
  misc_feature (1)..( 11): Result.003 file - promoters60/3434311
attccaaatgt

SEQ ID NO: 128911 - DNA, 11 bp, Unknown
  misc_feature (1)..( 11): Result.003 file - promoters60/3434311
gttcaaaattt

SEQ ID NO: 128912 - DNA, 11 bp, Unknown
  misc_feature (1)..( 11): Result.003 file - promoters60/3434311
gtttaaatcag

SEQ ID NO: 128913 - DNA, 11 bp, Unknown
  misc_feature (1)..( 11): Result.003 file - promoters60/3434311
ctttaaacgat

SEQ ID NO: 128914 - DNA, 11 bp, Unknown
  misc_feature (1)..( 11): Result.003 file - promoters60/3434311
ttttgaatcga

SEQ ID NO: 128915 - DNA, 7 bp, Unknown
  misc_feature (1)..( 7): Result.003 file - promoters60/3434381
aaagcac

SEQ ID NO: 128916 - DNA, 7 bp, Unknown
  misc_feature (1)..( 7): Result.003 file - promoters60/3434381
aaaacac

SEQ ID NO: 128917 - DNA, 6 bp, Unknown
  misc_feature (1)..( 6): Result.003 file - promoters60/3434381
accact

SEQ ID NO: 128918 - DNA, 6 bp, Unknown
  misc_feature (1)..( 6): Result.003 file - promoters60/3434381
accact

SEQ ID NO: 128919 - DNA, 6 bp, Unknown
  misc_feature (1)..( 6): Result.003 file - promoters60/3434381
aaacta

SEQ ID NO: 128920 - DNA, 6 bp, Unknown
  misc_feature (1)..( 6): Result.003 file - promoters60/3434381
aaacta

SEQ ID NO: 128921 - DNA, 7 bp, Unknown
  misc_feature (1)..( 7): Result.003 file - promoters60/3434381
taatcca

SEQ ID NO: 128922 - DNA, 7 bp, Unknown
  misc_feature (1)..( 7): Result.003 file - promoters60/3434381
taatcca

SEQ ID NO: 128923 - DNA, 7 bp, Unknown
  misc_feature (1)..( 7): Result.003 file - promoters60/3434381
gatgaca

SEQ ID NO: 128924 - DNA, 7 bp, Unknown
  misc_feature (1)..( 7): Result.003 file - promoters60/3434381
gatgaca

SEQ ID NO: 128925 - DNA, 7 bp, Unknown
  misc_feature (1)..( 7): Result.003 file - promoters60/3434381
ttggttt

SEQ ID NO: 128926 - DNA, 7 bp, Unknown
  misc_feature (1)..( 7): Result.003 file - promoters60/3434381
ttgtttt

SEQ ID NO: 128927 - DNA, 12 bp, Unknown
  misc_feature (1)..( 12): Result.003 file - promoters60/3434381
ttgaagtgaaaa

SEQ ID NO: 128928 - DNA, 12 bp, Unknown
  misc_feature (1)..( 12): Result.003 file - promoters60/3434381
ttgaaatgaaaa

SEQ ID NO: 128929 - DNA, 12 bp, Unknown
  misc_feature (1)..( 12): Result.003 file - promoters60/3434381
tacaaatgagtg

SEQ ID NO: 128930 - DNA, 6 bp, Unknown
  misc_feature (1)..( 6): Result.003 file - promoters60/3434381
aaaaga

SEQ ID NO: 128931 - DNA, 6 bp, Unknown
  misc_feature (1)..( 6): Result.003 file - promoters60/3434381
aaaaga

SEQ ID NO: 128932 - DNA, 6 bp, Unknown
  misc_feature (1)..( 6): Result.003 file - promoters60/3434381
tgtgat

SEQ ID NO: 128933 - DNA, 6 bp, Unknown
  misc_feature (1)..( 6): Result.003 file - promoters60/3434381
tgtgat

SEQ ID NO: 128934 - DNA, 8 bp, Unknown
  misc_feature (1)..( 8): Result.003 file - promoters60/3434381
acattaac

SEQ ID NO: 128935 - DNA, 8 bp, Unknown
  misc_feature (1)..( 8): Result.003 file - promoters60/3434381
acataaac

SEQ ID NO: 128936 - DNA, 6 bp, Unknown
  misc_feature (1)..( 6): Result.003 file - promoters60/3434381
cttctt

SEQ ID NO: 128937 - DNA, 6 bp, Unknown
  misc_feature (1)..( 6): Result.003 file - promoters60/3434381
cttctt

SEQ ID NO: 128938 - DNA, 7 bp, Unknown
  misc_feature (1)..( 7): Result.003 file - promoters60/3434381
atttgaa

SEQ ID NO: 128939 - DNA, 7 bp, Unknown
  misc_feature (1)..( 7): Result.003 file - promoters60/3434381
atttgaa

SEQ ID NO: 128940 - DNA, 6 bp, Unknown
  misc_feature (1)..( 6): Result.003 file - promoters60/3434381
ttaaaa

SEQ ID NO: 128941 - DNA, 6 bp, Unknown
  misc_feature (1)..( 6): Result.003 file - promoters60/3434381
ttaaaa

SEQ ID NO: 128942 - DNA, 6 bp, Unknown
  misc_feature (1)..( 6): Result.003 file - promoters60/3434381
atattg

SEQ ID NO: 128943 - DNA, 6 bp, Unknown
  misc_feature (1)..( 6): Result.003 file - promoters60/3434381
atattg

SEQ ID NO: 128944 - DNA, 8 bp, Unknown
  misc_feature (1)..( 8): Result.003 file - promoters60/3434381
attatatt

SEQ ID NO: 128945 - DNA, 8 bp, Unknown
  misc_feature (1)..( 8): Result.003 file - promoters60/3434381
attaaatt

SEQ ID NO: 128946 - DNA, 6 bp, Unknown
  misc_feature (1)..( 6): Result.003 file - promoters60/3434381
ggttga

SEQ ID NO: 128947 - DNA, 6 bp, Unknown
  misc_feature (1)..( 6): Result.003 file - promoters60/3434381
ggttga

SEQ ID NO: 128948 - DNA, 7 bp, Unknown
  misc_feature (1)..( 7): Result.003 file - promoters60/3434381
caaattg

SEQ ID NO: 128949 - DNA, 7 bp, Unknown
  misc_feature (1)..( 7): Result.003 file - promoters60/3434381
caatttg

SEQ ID NO: 128950 - DNA, 7 bp, Unknown
  misc_feature (1)..( 7): Result.003 file - promoters60/3434381
attcata

SEQ ID NO: 128951 - DNA, 7 bp, Unknown
  misc_feature (1)..( 7): Result.003 file - promoters60/3434381
atttata

SEQ ID NO: 128952 - DNA, 7 bp, Unknown
  misc_feature (1)..( 7): Result.003 file - promoters60/3434381
ataaata

SEQ ID NO: 128953 - DNA, 7 bp, Unknown
  misc_feature (1)..( 7): Result.003 file - promoters60/3434381
atatata

SEQ ID NO: 128954 - DNA, 7 bp, Unknown
  misc_feature (1)..( 7): Result.003 file - promoters60/3434381
taattaa

SEQ ID NO: 128955 - DNA, 7 bp, Unknown
  misc_feature (1)..( 7): Result.003 file - promoters60/3434381
taagtaa

SEQ ID NO: 128956 - DNA, 8 bp, Unknown
  misc_feature (1)..( 8): Result.003 file - promoters60/3434381
aaacaaaa

SEQ ID NO: 128957 - DNA, 8 bp, Unknown
  misc_feature (1)..( 8): Result.003 file - promoters60/3434381
aaataaaa

SEQ ID NO: 128958 - DNA, 7 bp, Unknown
  misc_feature (1)..( 7): Result.003 file - promoters60/3434381
aaactag

SEQ ID NO: 128959 - DNA, 7 bp, Unknown
  misc_feature (1)..( 7): Result.003 file - promoters60/3434381
aaaatag

SEQ ID NO: 128960 - DNA, 7 bp, Unknown
  misc_feature (1)..( 7): Result.003 file - promoters60/3434400
cagaaaa

SEQ ID NO: 128961 - DNA, 7 bp, Unknown
  misc_feature (1)..( 7): Result.003 file - promoters60/3434400
cagaaaa

SEQ ID NO: 128962 - DNA, 7 bp, Unknown
  misc_feature (1)..( 7): Result.003 file - promoters60/3434400
gagaaaa

SEQ ID NO: 128963 - DNA, 8 bp, Unknown
  misc_feature (1)..( 8): Result.003 file - promoters60/3434400
tagagaaa

SEQ ID NO: 128964 - DNA, 9 bp, Unknown
  misc_feature (1)..( 9): Result.003 file - promoters60/3434400
ttgaagaaa

SEQ ID NO: 128965 - DNA, 10 bp, Unknown
  misc_feature (1)..( 10): Result.003 file - promoters60/3434400
tggtttaatt

SEQ ID NO: 128966 - DNA, 10 bp, Unknown
  misc_feature (1)..( 10): Result.003 file - promoters60/3434400
ttttttaatt

SEQ ID NO: 128967 - DNA, 11 bp, Unknown
  misc_feature (1)..( 11): Result.003 file - promoters60/3434400
actttataatg

SEQ ID NO: 128968 - DNA, 11 bp, Unknown
  misc_feature (1)..( 11): Result.003 file - promoters60/3434400
acattaaaatc

SEQ ID NO: 128969 - DNA, 11 bp, Unknown
  misc_feature (1)..( 11): Result.003 file - promoters60/3434400
acttcatagag

SEQ ID NO: 128970 - DNA, 11 bp, Unknown
  misc_feature (1)..( 11): Result.003 file - promoters60/3434400
ccagaaaaaaa

SEQ ID NO: 128971 - DNA, 11 bp, Unknown
  misc_feature (1)..( 11): Result.003 file - promoters60/3434400
ctgcaaagaaa

SEQ ID NO: 128972 - DNA, 11 bp, Unknown
  misc_feature (1)..( 11): Result.003 file - promoters60/3434400
ttttgaagaaa

SEQ ID NO: 128973 - DNA, 9 bp, Unknown
  misc_feature (1)..( 9): Result.003 file - promoters60/3434400
gcatagaac

SEQ ID NO: 128974 - DNA, 11 bp, Unknown
  misc_feature (1)..( 11): Result.003 file - promoters60/3434400
tttcgaagaat

SEQ ID NO: 128975 - DNA, 11 bp, Unknown
  misc_feature (1)..( 11): Result.003 file - promoters60/3434471
acaaacatgtt

SEQ ID NO: 128976 - DNA, 12 bp, Unknown
  misc_feature (1)..( 12): Result.003 file - promoters60/3434471
accaaacacaag

SEQ ID NO: 128977 - DNA, 12 bp, Unknown
  misc_feature (1)..( 12): Result.003 file - promoters60/3434471
caaaaatacatt

SEQ ID NO: 128978 - DNA, 12 bp, Unknown
  misc_feature (1)..( 12): Result.003 file - promoters60/3434471
tataaatatata

SEQ ID NO: 128979 - DNA, 12 bp, Unknown
  misc_feature (1)..( 12): Result.003 file - promoters60/3434471
tgcgtatagatt

SEQ ID NO: 128980 - DNA, 12 bp, Unknown
  misc_feature (1)..( 12): Result.003 file - promoters60/3434471
accaaactctca

SEQ ID NO: 128981 - DNA, 6 bp, Unknown
  misc_feature (1)..( 6): Result.003 file - promoters60/3434496
actttt

SEQ ID NO: 128982 - DNA, 6 bp, Unknown
  misc_feature (1)..( 6): Result.003 file - promoters60/3434496
actttt

SEQ ID NO: 128983 - DNA, 6 bp, Unknown
  misc_feature (1)..( 6): Result.003 file - promoters60/3434496
attctc

SEQ ID NO: 128984 - DNA, 6 bp, Unknown
  misc_feature (1)..( 6): Result.003 file - promoters60/3434496
attctc

SEQ ID NO: 128985 - DNA, 7 bp, Unknown
  misc_feature (1)..( 7): Result.003 file - promoters60/3434496
aatttga

SEQ ID NO: 128986 - DNA, 7 bp, Unknown
  misc_feature (1)..( 7): Result.003 file - promoters60/3434496
aatttgg

SEQ ID NO: 128987 - DNA, 7 bp, Unknown
  misc_feature (1)..( 7): Result.003 file - promoters60/3434496
aatttga

SEQ ID NO: 128988 - DNA, 9 bp, Unknown
  misc_feature (1)..( 9): Result.003 file - promoters60/3434496
gattgcaaa

SEQ ID NO: 128989 - DNA, 9 bp, Unknown
  misc_feature (1)..( 9): Result.003 file - promoters60/3434496
gatggcaaa

SEQ ID NO: 128990 - DNA, 7 bp, Unknown
  misc_feature (1)..( 7): Result.003 file - promoters60/3434496
tgggctc

SEQ ID NO: 128991 - DNA, 7 bp, Unknown
  misc_feature (1)..( 7): Result.003 file - promoters60/3434496
tgggctc

SEQ ID NO: 128992 - DNA, 6 bp, Unknown
  misc_feature (1)..( 6): Result.003 file - promoters60/3434496
gattca

SEQ ID NO: 128993 - DNA, 6 bp, Unknown
  misc_feature (1)..( 6): Result.003 file - promoters60/3434496
gattca

SEQ ID NO: 128994 - DNA, 7 bp, Unknown
  misc_feature (1)..( 7): Result.003 file - promoters60/3434496
gcaacaa

SEQ ID NO: 128995 - DNA, 7 bp, Unknown
  misc_feature (1)..( 7): Result.003 file - promoters60/3434496
gcagcaa

SEQ ID NO: 128996 - DNA, 8 bp, Unknown
  misc_feature (1)..( 8): Result.003 file - promoters60/3434496
caaaaaac

SEQ ID NO: 128997 - DNA, 8 bp, Unknown
  misc_feature (1)..( 8): Result.003 file - promoters60/3434496
caaagaac

SEQ ID NO: 128998 - DNA, 6 bp, Unknown
  misc_feature (1)..( 6): Result.003 file - promoters60/3434496
atagat

SEQ ID NO: 128999 - DNA, 6 bp, Unknown
  misc_feature (1)..( 6): Result.003 file - promoters60/3434496
atagat

SEQ ID NO: 129000 - DNA, 9 bp, Unknown
  misc_feature (1)..( 9): Result.003 file - promoters60/3434496
tttccaatt

SEQ ID NO: 129001 - DNA, 9 bp, Unknown
  misc_feature (1)..( 9): Result.003 file - promoters60/3434496
ttttcaatt

SEQ ID NO: 129002 - DNA, 6 bp, Unknown
  misc_feature (1)..( 6): Result.003 file - promoters60/3434496
aatttc

SEQ ID NO: 129003 - DNA, 6 bp, Unknown
  misc_feature (1)..( 6): Result.003 file - promoters60/3434496
aatttc

SEQ ID NO: 129004 - DNA, 6 bp, Unknown
  misc_feature (1)..( 6): Result.003 file - promoters60/3434496
aaactg

SEQ ID NO: 129005 - DNA, 6 bp, Unknown
  misc_feature (1)..( 6): Result.003 file - promoters60/3434496
aaactg

SEQ ID NO: 129006 - DNA, 10 bp, Unknown
  misc_feature (1)..( 10): Result.003 file - promoters60/3434496
aaatcaaaga

SEQ ID NO: 129007 - DNA, 10 bp, Unknown
  misc_feature (1)..( 10): Result.003 file - promoters60/3434496
aaaccaattt

SEQ ID NO: 129008 - DNA, 10 bp, Unknown
  misc_feature (1)..( 10): Result.003 file - promoters60/3434496
tgaccatttt

SEQ ID NO: 129009 - DNA, 7 bp, Unknown
  misc_feature (1)..( 7): Result.003 file - promoters60/3434496
aaattat

SEQ ID NO: 129010 - DNA, 7 bp, Unknown
  misc_feature (1)..( 7): Result.003 file - promoters60/3434496
aaactat

SEQ ID NO: 129011 - DNA, 9 bp, Unknown
  misc_feature (1)..( 9): Result.003 file - promoters60/3434496
atcaaaccg

SEQ ID NO: 129012 - DNA, 9 bp, Unknown
  misc_feature (1)..( 9): Result.003 file - promoters60/3434496
atcgaaccg

SEQ ID NO: 129013 - DNA, 7 bp, Unknown
  misc_feature (1)..( 7): Result.003 file - promoters60/3434496
cgagatt

SEQ ID NO: 129014 - DNA, 7 bp, Unknown
  misc_feature (1)..( 7): Result.003 file - promoters60/3434496
cgatatt

SEQ ID NO: 129015 - DNA, 7 bp, Unknown
  misc_feature (1)..( 7): Result.003 file - promoters60/3434496
aagcttg

SEQ ID NO: 129016 - DNA, 7 bp, Unknown
  misc_feature (1)..( 7): Result.003 file - promoters60/3434496
aaggttg

SEQ ID NO: 129017 - DNA, 6 bp, Unknown
  misc_feature (1)..( 6): Result.003 file - promoters60/3434496
gctgat

SEQ ID NO: 129018 - DNA, 6 bp, Unknown
  misc_feature (1)..( 6): Result.003 file - promoters60/3434496
gctgat

SEQ ID NO: 129019 - DNA, 6 bp, Unknown
  misc_feature (1)..( 6): Result.003 file - promoters60/3434496
tgtaat

SEQ ID NO: 129020 - DNA, 6 bp, Unknown
  misc_feature (1)..( 6): Result.003 file - promoters60/3434496
tgtaat

SEQ ID NO: 129021 - DNA, 11 bp, Unknown
  misc_feature (1)..( 11): Result.003 file - promoters60/3434563
caagacctaaa

SEQ ID NO: 129022 - DNA, 11 bp, Unknown
  misc_feature (1)..( 11): Result.003 file - promoters60/3434563
caaaaccaaag

SEQ ID NO: 129023 - DNA, 11 bp, Unknown
  misc_feature (1)..( 11): Result.003 file - promoters60/3434563
taaaactaaaa

SEQ ID NO: 129024 - DNA, 11 bp, Unknown
  misc_feature (1)..( 11): Result.003 file - promoters60/3434563
agtaactaaaa

SEQ ID NO: 129025 - DNA, 9 bp, Unknown
  misc_feature (1)..( 9): Result.003 file - promoters60/3434563
gaacaaaaa

SEQ ID NO: 129026 - DNA, 11 bp, Unknown
  misc_feature (1)..( 11): Result.003 file - promoters60/3434563
acaaatcaaat

SEQ ID NO: 129027 - DNA, 8 bp, Unknown
  misc_feature (1)..( 8): Result.003 file - promoters60/3434648
tcttcatc

SEQ ID NO: 129028 - DNA, 8 bp, Unknown
  misc_feature (1)..( 8): Result.003 file - promoters60/3434648
tctccatc

SEQ ID NO: 129029 - DNA, 9 bp, Unknown
  misc_feature (1)..( 9): Result.003 file - promoters60/3434648
cttgtctga

SEQ ID NO: 129030 - DNA, 9 bp, Unknown
  misc_feature (1)..( 9): Result.003 file - promoters60/3434648
cttgtcata

SEQ ID NO: 129031 - DNA, 9 bp, Unknown
  misc_feature (1)..( 9): Result.003 file - promoters60/3434648
attgttata

SEQ ID NO: 129032 - DNA, 8 bp, Unknown
  misc_feature (1)..( 8): Result.003 file - promoters60/3434648
gtatccat

SEQ ID NO: 129033 - DNA, 8 bp, Unknown
  misc_feature (1)..( 8): Result.003 file - promoters60/3434648
gtattcat

SEQ ID NO: 129034 - DNA, 6 bp, Unknown
  misc_feature (1)..( 6): Result.003 file - promoters60/3434648
gatttg

SEQ ID NO: 129035 - DNA, 6 bp, Unknown
  misc_feature (1)..( 6): Result.003 file - promoters60/3434648
gatttg

SEQ ID NO: 129036 - DNA, 9 bp, Unknown
  misc_feature (1)..( 9): Result.003 file - promoters60/3434648
atgtctcag

SEQ ID NO: 129037 - DNA, 9 bp, Unknown
  misc_feature (1)..( 9): Result.003 file - promoters60/3434648
ttgtatcag

SEQ ID NO: 129038 - DNA, 9 bp, Unknown
  misc_feature (1)..( 9): Result.003 file - promoters60/3434648
atgtttcaa

SEQ ID NO: 129039 - DNA, 7 bp, Unknown
  misc_feature (1)..( 7): Result.003 file - promoters60/3434648
ctaaatc

SEQ ID NO: 129040 - DNA, 7 bp, Unknown
  misc_feature (1)..( 7): Result.003 file - promoters60/3434648
ctaaatc

SEQ ID NO: 129041 - DNA, 27 bp, Unknown
  misc_feature (1)..( 27): Result.003 file - promoters60/3434648
atttatacccacatgatcatgtcttct

SEQ ID NO: 129042 - DNA, 27 bp, Unknown
  misc_feature (1)..( 27): Result.003 file - promoters60/3434648
attcatactcacatggtcatgtcttct

SEQ ID NO: 129043 - DNA, 9 bp, Unknown
  misc_feature (1)..( 9): Result.003 file - promoters60/3434648
ttctaacca

SEQ ID NO: 129044 - DNA, 9 bp, Unknown
  misc_feature (1)..( 9): Result.003 file - promoters60/3434648
ttctcacca

SEQ ID NO: 129045 - DNA, 12 bp, Unknown
  misc_feature (1)..( 12): Result.003 file - promoters60/3434648
tccactagttga

SEQ ID NO: 129046 - DNA, 12 bp, Unknown
  misc_feature (1)..( 12): Result.003 file - promoters60/3434648
tccacaagttga

SEQ ID NO: 129047 - DNA, 7 bp, Unknown
  misc_feature (1)..( 7): Result.003 file - promoters60/3434648
attgatt

SEQ ID NO: 129048 - DNA, 7 bp, Unknown
  misc_feature (1)..( 7): Result.003 file - promoters60/3434648
attgatt

SEQ ID NO: 129049 - DNA, 11 bp, Unknown
  misc_feature (1)..( 11): Result.003 file - promoters60/3434648
aacttgggacc

SEQ ID NO: 129050 - DNA, 11 bp, Unknown
  misc_feature (1)..( 11): Result.003 file - promoters60/3434648
aacttgggacc

SEQ ID NO: 129051 - DNA, 31 bp, Unknown
  misc_feature (1)..( 31): Result.003 file - promoters60/3434648
taatagtttctccttctatataatgaaacaa

SEQ ID NO: 129052 - DNA, 31 bp, Unknown; identical to SEQ ID NO: 55685
  misc_feature (1)..( 31): Result.003 file - promoters60/3434648

SEQ ID NO: 129053 - DNA, 7 bp, Unknown
  misc_feature (1)..( 7): Result.003 file - promoters60/3434648
taaccac

SEQ ID NO: 129054 - DNA, 7 bp, Unknown
  misc_feature (1)..( 7): Result.003 file - promoters60/3434648
taatcac

SEQ ID NO: 129055 - DNA, 10 bp, Unknown
  misc_feature (1)..( 10): Result.003 file - promoters60/3434648
atatatattt

SEQ ID NO: 129056 - DNA, 10 bp, Unknown
  misc_feature (1)..( 10): Result.003 file - promoters60/3434648
atatatgttt

SEQ ID NO: 129057 - DNA, 10 bp, Unknown
  misc_feature (1)..( 10): Result.003 file - promoters60/3434648
taataagttg

SEQ ID NO: 129058 - DNA, 6 bp, Unknown
  misc_feature (1)..( 6): Result.003 file - promoters60/3434648
atagat

SEQ ID NO: 129059 - DNA, 6 bp, Unknown
  misc_feature (1)..( 6): Result.003 file - promoters60/3434648
atagat

SEQ ID NO: 129060 - DNA, 6 bp, Unknown
  misc_feature (1)..( 6): Result.003 file - promoters60/3434648
ttttaa

SEQ ID NO: 129061 - DNA, 6 bp, Unknown
  misc_feature (1)..( 6): Result.003 file - promoters60/3434648
ttttaa

SEQ ID NO: 129062 - DNA, 6 bp, Unknown
  misc_feature (1)..( 6): Result.003 file - promoters60/3434648
aaaaca

SEQ ID NO: 129063 - DNA, 6 bp, Unknown
  misc_feature (1)..( 6): Result.003 file - promoters60/3434648
aaaaca

SEQ ID NO: 129064 - DNA, 7 bp, Unknown
  misc_feature (1)..( 7): Result.003 file - promoters60/3434652
gttcttt

SEQ ID NO: 129065 - DNA, 7 bp, Unknown
  misc_feature (1)..( 7): Result.003 file - promoters60/3434652
gttcttt

SEQ ID NO: 129066 - DNA, 8 bp, Unknown
  misc_feature (1)..( 8): Result.003 file - promoters60/3434652
aaaattaa

SEQ ID NO: 129067 - DNA, 8 bp, Unknown
  misc_feature (1)..( 8): Result.003 file - promoters60/3434652
aaagttaa

SEQ ID NO: 129068 - DNA, 8 bp, Unknown
  misc_feature (1)..( 8): Result.003 file - promoters60/3434652
gatcaaaa

SEQ ID NO: 129069 - DNA, 8 bp, Unknown
  misc_feature (1)..( 8): Result.003 file - promoters60/3434652
gataaaaa

SEQ ID NO: 129070 - DNA, 11 bp, Unknown
  misc_feature (1)..( 11): Result.003 file - promoters60/3434652
attttttaagc

SEQ ID NO: 129071 - DNA, 11 bp, Unknown
  misc_feature (1)..( 11): Result.003 file - promoters60/3434652
attttttcagc

SEQ ID NO: 129072 - DNA, 11 bp, Unknown
  misc_feature (1)..( 11): Result.003 file - promoters60/3434652
gttttttttac

SEQ ID NO: 129073 - DNA, 9 bp, Unknown
  misc_feature (1)..( 9): Result.003 file - promoters60/3434652
taaggttgt

SEQ ID NO: 129074 - DNA, 9 bp, Unknown
  misc_feature (1)..( 9): Result.003 file - promoters60/3434652
taaagttgt

SEQ ID NO: 129075 - DNA, 7 bp, Unknown
  misc_feature (1)..( 7): Result.003 file - promoters60/3434652
atctaaa

SEQ ID NO: 129076 - DNA, 7 bp, Unknown
  misc_feature (1)..( 7): Result.003 file - promoters60/3434652
atctaaa

SEQ ID NO: 129077 - DNA, 8 bp, Unknown
  misc_feature (1)..( 8): Result.003 file - promoters60/3434652
tgttttat

SEQ ID NO: 129078 - DNA, 8 bp, Unknown
  misc_feature (1)..( 8): Result.003 file - promoters60/3434652
tgtattat

SEQ ID NO: 129079 - DNA, 10 bp, Unknown
  misc_feature (1)..( 10): Result.003 file - promoters60/3434652
tttaactata

SEQ ID NO: 129080 - DNA, 10 bp, Unknown
  misc_feature (1)..( 10): Result.003 file - promoters60/3434652
tttaattata

SEQ ID NO: 129081 - DNA, 6 bp, Unknown
  misc_feature (1)..( 6): Result.003 file - promoters60/3434652
agtcaa

SEQ ID NO: 129082 - DNA, 6 bp, Unknown
  misc_feature (1)..( 6): Result.003 file - promoters60/3434652
agtcaa

SEQ ID NO: 129083 - DNA, 6 bp, Unknown
  misc_feature (1)..( 6): Result.003 file - promoters60/3434652
taacca

SEQ ID NO: 129084 - DNA, 6 bp, Unknown
  misc_feature (1)..( 6): Result.003 file - promoters60/3434652
taacca

SEQ ID NO: 129085 - DNA, 6 bp, Unknown
  misc_feature (1)..( 6): Result.003 file - promoters60/3434652
tataaa

SEQ ID NO: 129086 - DNA, 6 bp, Unknown
  misc_feature (1)..( 6): Result.003 file - promoters60/3434652
tataaa

SEQ ID NO: 129087 - DNA, 7 bp, Unknown
  misc_feature (1)..( 7): Result.003 file - promoters60/3434652
actttag

SEQ ID NO: 129088 - DNA, 7 bp, Unknown
  misc_feature (1)..( 7): Result.003 file - promoters60/3434652
actatag

SEQ ID NO: 129089 - DNA, 6 bp, Unknown
  misc_feature (1)..( 6): Result.003 file - promoters60/3434652
ttttgt

SEQ ID NO: 129090 - DNA, 6 bp, Unknown
  misc_feature (1)..( 6): Result.003 file - promoters60/3434652
ttttgt

SEQ ID NO: 129091 - DNA, 7 bp, Unknown
  misc_feature (1)..( 7): Result.003 file - promoters60/3434652
tttctta

SEQ ID NO: 129092 - DNA, 7 bp, Unknown
  misc_feature (1)..( 7): Result.003 file - promoters60/3434652
tttatta

SEQ ID NO: 129093 - DNA, 7 bp, Unknown
  misc_feature (1)..( 7): Result.003 file - promoters60/3434652
acaactt

SEQ ID NO: 129094 - DNA, 7 bp, Unknown
  misc_feature (1)..( 7): Result.003 file - promoters60/3434652
acaactt

SEQ ID NO: 129095 - DNA, 6 bp, Unknown
  misc_feature (1)..( 6): Result.003 file - promoters60/3434652
aacagc

SEQ ID NO: 129096 - DNA, 6 bp, Unknown
  misc_feature (1)..( 6): Result.003 file - promoters60/3434652
aacagc

SEQ ID NO: 129097 - DNA, 7 bp, Unknown
  misc_feature (1)..( 7): Result.003 file - promoters60/3434652
acttgta

SEQ ID NO: 129098 - DNA, 7 bp, Unknown
  misc_feature (1)..( 7): Result.003 file - promoters60/3434652
acttgta

SEQ ID NO: 129099 - DNA, 6 bp, Unknown
  misc_feature (1)..( 6): Result.003 file - promoters60/3434652
ccaatc

SEQ ID NO: 129100 - DNA, 6 bp, Unknown
  misc_feature (1)..( 6): Result.003 file - promoters60/3434652
ccaatc

SEQ ID NO: 129101 - DNA, 8 bp, Unknown
  misc_feature (1)..( 8): Result.003 file - promoters60/3434652
aataagac

SEQ ID NO: 129102 - DNA, 8 bp, Unknown
  misc_feature (1)..( 8): Result.003 file - promoters60/3434652
aatcagac

SEQ ID NO: 129103 - DNA, 7 bp, Unknown
  misc_feature (1)..( 7): Result.003 file - promoters60/3434652
aaacata

SEQ ID NO: 129104 - DNA, 7 bp, Unknown
  misc_feature (1)..( 7): Result.003 file - promoters60/3434652
aaatata

SEQ ID NO: 129105 - DNA, 8 bp, Unknown
  misc_feature (1)..( 8): Result.003 file - promoters60/3434652
ttaaaatg

SEQ ID NO: 129106 - DNA, 8 bp, Unknown
  misc_feature (1)..( 8): Result.003 file - promoters60/3434652
ctaaaatt

SEQ ID NO: 129107 - DNA, 8 bp, Unknown
  misc_feature (1)..( 8): Result.003 file - promoters60/3434652
ctaatatt

SEQ ID NO: 129108 - DNA, 6 bp, Unknown
  misc_feature (1)..( 6): Result.003 file - promoters60/3434652
attaaa

SEQ ID NO: 129109 - DNA, 6 bp, Unknown
  misc_feature (1)..( 6): Result.003 file - promoters60/3434652
attaaa

SEQ ID NO: 129110 - DNA, 6 bp, Unknown
  misc_feature (1)..( 6): Result.003 file - promoters60/3434652
aaaaag

SEQ ID NO: 129111 - DNA, 6 bp, Unknown
  misc_feature (1)..( 6): Result.003 file - promoters60/3434652
aaaaag

SEQ ID NO: 129112 - DNA, 7 bp, Unknown
  misc_feature (1)..( 7): Result.003 file - promoters60/3434652
tttataa

SEQ ID NO: 129113 - DNA, 7 bp, Unknown
  misc_feature (1)..( 7): Result.003 file - promoters60/3434652
tttctaa

SEQ ID NO: 129114 - DNA, 6 bp, Unknown
  misc_feature (1)..( 6): Result.003 file - promoters60/3434652
tcagct

SEQ ID NO: 129115 - DNA, 6 bp, Unknown
  misc_feature (1)..( 6): Result.003 file - promoters60/3434652
tcagct

SEQ ID NO: 129116 - DNA, 6 bp, Unknown
  misc_feature (1)..( 6): Result.003 file - promoters60/3434652
ctattc

SEQ ID NO: 129117 - DNA, 6 bp, Unknown
  misc_feature (1)..( 6): Result.003 file - promoters60/3434652
ctattc

SEQ ID NO: 129118 - DNA, 6 bp, Unknown
  misc_feature (1)..( 6): Result.003 file - promoters60/3434652
attttt

SEQ ID NO: 129119 - DNA, 6 bp, Unknown
  misc_feature (1)..( 6): Result.003 file - promoters60/3434652
attttt

SEQ ID NO: 129120 - DNA, 7 bp, Unknown
  misc_feature (1)..( 7): Result.003 file - promoters60/3434652
aaatttt

SEQ ID NO: 129121 - DNA, 7 bp, Unknown
  misc_feature (1)..( 7): Result.003 file - promoters60/3434652
aaagttt

SEQ ID NO: 129122 - DNA, 6 bp, Unknown
  misc_feature (1)..( 6): Result.003 file - promoters60/3434836
ttcaaa

SEQ ID NO: 129123 - DNA, 6 bp, Unknown
  misc_feature (1)..( 6): Result.003 file - promoters60/3434836
ttcaaa

SEQ ID NO: 129124 - DNA, 7 bp, Unknown
  misc_feature (1)..( 7): Result.003 file - promoters60/3434836
caaaaaa

SEQ ID NO: 129125 - DNA, 7 bp, Unknown
  misc_feature (1)..( 7): Result.003 file - promoters60/3434836
caacaaa

SEQ ID NO: 129126 - DNA, 7 bp, Unknown
  misc_feature (1)..( 7): Result.003 file - promoters60/3434836
ggtgttt

SEQ ID NO: 129127 - DNA, 7 bp, Unknown
  misc_feature (1)..( 7): Result.003 file - promoters60/3434836
ggttttt

SEQ ID NO: 129128 - DNA, 7 bp, Unknown
  misc_feature (1)..( 7): Result.003 file - promoters60/3434836
aacaaaa

SEQ ID NO: 129129 - DNA, 7 bp, Unknown
  misc_feature (1)..( 7): Result.003 file - promoters60/3434836
aacaaaa

SEQ ID NO: 129130 - DNA, 7 bp, Unknown
  misc_feature (1)..( 7): Result.003 file - promoters60/3434836
ttagtat

SEQ ID NO: 129131 - DNA, 7 bp, Unknown
  misc_feature (1)..( 7): Result.003 file - promoters60/3434836
ttattat

SEQ ID NO: 129132 - DNA, 8 bp, Unknown
  misc_feature (1)..( 8): Result.003 file - promoters60/3434836
tattcgtc

SEQ ID NO: 129133 - DNA, 8 bp, Unknown
  misc_feature (1)..( 8): Result.003 file - promoters60/3434836
tattagtc

SEQ ID NO: 129134 - DNA, 8 bp, Unknown
  misc_feature (1)..( 8): Result.003 file - promoters60/3434836
aaaagtgt

SEQ ID NO: 129135 - DNA, 8 bp, Unknown
  misc_feature (1)..( 8): Result.003 file - promoters60/3434836
aaaagtgt

SEQ ID NO: 129136 - DNA, 7 bp, Unknown
  misc_feature (1)..( 7): Result.003 file - promoters60/3434836
ttttttg

SEQ ID NO: 129137 - DNA, 7 bp, Unknown
  misc_feature (1)..( 7): Result.003 file - promoters60/3434836
tttattg

SEQ ID NO: 129138 - DNA, 7 bp, Unknown
  misc_feature (1)..( 7): Result.003 file - promoters60/3434836
tttggtt

SEQ ID NO: 129139 - DNA, 7 bp, Unknown
  misc_feature (1)..( 7): Result.003 file - promoters60/3434836
ttttgtt

SEQ ID NO: 129140 - DNA, 8 bp, Unknown
  misc_feature (1)..( 8): Result.003 file - promoters60/3434836
caaatcag

SEQ ID NO: 129141 - DNA, 8 bp, Unknown
  misc_feature (1)..( 8): Result.003 file - promoters60/3434836
caactcag

SEQ ID NO: 129142 - DNA, 6 bp, Unknown
  misc_feature (1)..( 6): Result.003 file - promoters60/3434836
atcaga

SEQ ID NO: 129143 - DNA, 6 bp, Unknown
  misc_feature (1)..( 6): Result.003 file - promoters60/3434836
atcaga

SEQ ID NO: 129144 - DNA, 6 bp, Unknown
  misc_feature (1)..( 6): Result.003 file - promoters60/3434836
gataga

SEQ ID NO: 129145 - DNA, 6 bp, Unknown
  misc_feature (1)..( 6): Result.003 file - promoters60/3434836
gataga

SEQ ID NO: 129146 - DNA, 6 bp, Unknown
  misc_feature (1)..( 6): Result.003 file - promoters60/3434836
agatct

SEQ ID NO: 129147 - DNA, 6 bp, Unknown
  misc_feature (1)..( 6): Result.003 file - promoters60/3434836
agatct

SEQ ID NO: 129148 - DNA, 9 bp, Unknown
  misc_feature (1)..( 9): Result.003 file - promoters60/3434836
attgaaaga

SEQ ID NO: 129149 - DNA, 9 bp, Unknown
  misc_feature (1)..( 9): Result.003 file - promoters60/3434836
attaaaaga

SEQ ID NO: 129150 - DNA, 10 bp, Unknown
  misc_feature (1)..( 10): Result.003 file - promoters60/3434836
tctctgatca

SEQ ID NO: 129151 - DNA, 10 bp, Unknown
  misc_feature (1)..( 10): Result.003 file - promoters60/3434836
tctttgatca

SEQ ID NO: 129152 - DNA, 8 bp, Unknown
  misc_feature (1)..( 8): Result.003 file - promoters60/3434909
tatatctt

SEQ ID NO: 129153 - DNA, 8 bp, Unknown
  misc_feature (1)..( 8): Result.003 file - promoters60/3434909
gataactt

SEQ ID NO: 129154 - DNA, 8 bp, Unknown
  misc_feature (1)..( 8): Result.003 file - promoters60/3434909
tatatcca

SEQ ID NO: 129155 - DNA, 9 bp, Unknown
  misc_feature (1)..( 9): Result.003 file - promoters60/3434909
aaggatata

SEQ ID NO: 129156 - DNA, 9 bp, Unknown
  misc_feature (1)..( 9): Result.003 file - promoters60/3434909
aaggagata

SEQ ID NO: 129157 - DNA, 7 bp, Unknown
  misc_feature (1)..( 7): Result.003 file - promoters60/3434909
atcagaa

SEQ ID NO: 129158 - DNA, 7 bp, Unknown
  misc_feature (1)..( 7): Result.003 file - promoters60/3434909
atctgaa

SEQ ID NO: 129159 - DNA, 6 bp, Unknown
  misc_feature (1)..( 6): Result.003 file - promoters60/3434909
taaaaa

SEQ ID NO: 129160 - DNA, 6 bp, Unknown
  misc_feature (1)..( 6): Result.003 file - promoters60/3434909
taaaaa

SEQ ID NO: 129161 - DNA, 11 bp, Unknown
  misc_feature (1)..( 11): Result.003 file - promoters60/3434909
caacatgaaat

SEQ ID NO: 129162 - DNA, 11 bp, Unknown
  misc_feature (1)..( 11): Result.003 file - promoters60/3434909
gctaatggaat

SEQ ID NO: 129163 - DNA, 11 bp, Unknown
  misc_feature (1)..( 11): Result.003 file - promoters60/3434909
caacaagaacc

SEQ ID NO: 129164 - DNA, 8 bp, Unknown
  misc_feature (1)..( 8): Result.003 file - promoters60/3434909
taatttta

SEQ ID NO: 129165 - DNA, 8 bp, Unknown
  misc_feature (1)..( 8): Result.003 file - promoters60/3434909
taatgtta

SEQ ID NO: 129166 - DNA, 10 bp, Unknown
  misc_feature (1)..( 10): Result.003 file - promoters60/3434909
cccataaaaa

SEQ ID NO: 129167 - DNA, 10 bp, Unknown
  misc_feature (1)..( 10): Result.003 file - promoters60/3434909
cccatataaa

SEQ ID NO: 129168 - DNA, 6 bp, Unknown
  misc_feature (1)..( 6): Result.003 file - promoters60/3434909
tccatt

SEQ ID NO: 129169 - DNA, 6 bp, Unknown
  misc_feature (1)..( 6): Result.003 file - promoters60/3434909
tccatt

SEQ ID NO: 129170 - DNA, 6 bp, Unknown
  misc_feature (1)..( 6): Result.003 file - promoters60/3434909
tcaaca

SEQ ID NO: 129171 - DNA, 6 bp, Unknown
  misc_feature (1)..( 6): Result.003 file - promoters60/3434909
tcaaca

SEQ ID NO: 129172 - DNA, 8 bp, Unknown
  misc_feature (1)..( 8): Result.003 file - promoters60/3434909
atgtcata

SEQ ID NO: 129173 - DNA, 8 bp, Unknown
  misc_feature (1)..( 8): Result.003 file - promoters60/3434909
atgtaata

SEQ ID NO: 129174 - DNA, 9 bp, Unknown
  misc_feature (1)..( 9): Result.003 file - promoters60/3434909
atcaaatct

SEQ ID NO: 129175 - DNA, 9 bp, Unknown
  misc_feature (1)..( 9): Result.003 file - promoters60/3434909
atcacatct

SEQ ID NO: 129176 - DNA, 6 bp, Unknown
  misc_feature (1)..( 6): Result.003 file - promoters60/3434909
ttccgc

SEQ ID NO: 129177 - DNA, 6 bp, Unknown
  misc_feature (1)..( 6): Result.003 file - promoters60/3434909
ttccgc

SEQ ID NO: 129178 - DNA, 9 bp, Unknown
  misc_feature (1)..( 9): Result.003 file - promoters60/3435057
aaatatata

SEQ ID NO: 129179 - DNA, 9 bp, Unknown
  misc_feature (1)..( 9): Result.003 file - promoters60/3435057
aaatatctg

SEQ ID NO: 129180 - DNA, 10 bp, Unknown
  misc_feature (1)..( 10): Result.003 file - promoters60/3435057
aaactatata

SEQ ID NO: 129181 - DNA, 11 bp, Unknown
  misc_feature (1)..( 11): Result.003 file - promoters60/3435057
aaaatatatat

SEQ ID NO: 129182 - DNA, 11 bp, Unknown
  misc_feature (1)..( 11): Result.003 file - promoters60/3435057
tctaaatatat

SEQ ID NO: 129183 - DNA, 11 bp, Unknown
  misc_feature (1)..( 11): Result.003 file - promoters60/3435057
aaactatataa

SEQ ID NO: 129184 - DNA, 6 bp, Unknown
  misc_feature (1)..( 6): Result.003 file - promoters60/3435057
cataaa

SEQ ID NO: 129185 - DNA, 6 bp, Unknown
  misc_feature (1)..( 6): Result.003 file - promoters60/3435057
cataaa

SEQ ID NO: 129186 - DNA, 7 bp, Unknown
  misc_feature (1)..( 7): Result.003 file - promoters60/3435057
cattaaa

SEQ ID NO: 129187 - DNA, 9 bp, Unknown
  misc_feature (1)..( 9): Result.003 file - promoters60/3435057
ccataaaaa

SEQ ID NO: 129188 - DNA, 9 bp, Unknown
  misc_feature (1)..( 9): Result.003 file - promoters60/3435057
cggtaaaaa

SEQ ID NO: 129189 - DNA, 9 bp, Unknown
  misc_feature (1)..( 9): Result.003 file - promoters60/3435057
cattaaatc

SEQ ID NO: 129190 - DNA, 14 bp, Unknown
  misc_feature (1)..( 14): Result.003 file - promoters60/3435057
actatatgtttttc

SEQ ID NO: 129191 - DNA, 14 bp, Unknown
  misc_feature (1)..( 14): Result.003 file - promoters60/3435057
agactgtgttttta

SEQ ID NO: 129192 - DNA, 14 bp, Unknown
  misc_feature (1)..( 14): Result.003 file - promoters60/3435057
tattagtctttttc

SEQ ID NO: 129193 - DNA, 14 bp, Unknown
  misc_feature (1)..( 14): Result.003 file - promoters60/3435057
tttacttctcttta

SEQ ID NO: 129194 - DNA, 8 bp, Unknown
  misc_feature (1)..( 8): Result.003 file - promoters60/3435057
aaaaatta

SEQ ID NO: 129195 - DNA, 8 bp, Unknown
  misc_feature (1)..( 8): Result.003 file - promoters60/3435057
aaaaatta

SEQ ID NO: 129196 - DNA, 8 bp, Unknown
  misc_feature (1)..( 8): Result.003 file - promoters60/3435057
aaacatta

SEQ ID NO: 129197 - DNA, 10 bp, Unknown
  misc_feature (1)..( 10): Result.003 file - promoters60/3435057
aattttgttt

SEQ ID NO: 129198 - DNA, 10 bp, Unknown
  misc_feature (1)..( 10): Result.003 file - promoters60/3435057
ctttttattt

SEQ ID NO: 129199 - DNA, 10 bp, Unknown
  misc_feature (1)..( 10): Result.003 file - promoters60/3435057
ctttttaact

SEQ ID NO: 129200 - DNA, 9 bp, Unknown
  misc_feature (1)..( 9): Result.003 file - promoters60/3435057
ttttaattt

SEQ ID NO: 129201 - DNA, 9 bp, Unknown
  misc_feature (1)..( 9): Result.003 file - promoters60/3435057
gtttaattt

SEQ ID NO: 129202 - DNA, 9 bp, Unknown
  misc_feature (1)..( 9): Result.003 file - promoters60/3435057
gtttaaacc

SEQ ID NO: 129203 - DNA, 7 bp, Unknown
  misc_feature (1)..( 7): Result.003 file - promoters60/3435057
ttatatt

SEQ ID NO: 129204 - DNA, 7 bp, Unknown
  misc_feature (1)..( 7): Result.003 file - promoters60/3435057
atatatt

SEQ ID NO: 129205 - DNA, 7 bp, Unknown
  misc_feature (1)..( 7): Result.003 file - promoters60/3435057
atatatg

SEQ ID NO: 129206 - DNA, 9 bp, Unknown
  misc_feature (1)..( 9): Result.003 file - promoters60/3435057
gttatcata

SEQ ID NO: 129207 - DNA, 9 bp, Unknown
  misc_feature (1)..( 9): Result.003 file - promoters60/3435057
gttataata

SEQ ID NO: 129208 - DNA, 9 bp, Unknown
  misc_feature (1)..( 9): Result.003 file - promoters60/3435057
taaatcata

SEQ ID NO: 129209 - DNA, 9 bp, Unknown
  misc_feature (1)..( 9): Result.003 file - promoters60/3435057
ctatttata

SEQ ID NO: 129210 - DNA, 9 bp, Unknown
  misc_feature (1)..( 9): Result.003 file - promoters60/3435057
atatatata

SEQ ID NO: 129211 - DNA, 9 bp, Unknown
  misc_feature (1)..( 9): Result.003 file - promoters60/3435057
ccatctata

SEQ ID NO: 129212 - DNA, 8 bp, Unknown
  misc_feature (1)..( 8): Result.003 file - promoters60/3435091
tctttttt

SEQ ID NO: 129213 - DNA, 8 bp, Unknown
  misc_feature (1)..( 8): Result.003 file - promoters60/3435091
tcttcttt

SEQ ID NO: 129214 - DNA, 8 bp, Unknown
  misc_feature (1)..( 8): Result.003 file - promoters60/3435091
tcttcttt

SEQ ID NO: 129215 - DNA, 8 bp, Unknown
  misc_feature (1)..( 8): Result.003 file - promoters60/3435091
tctttttg

SEQ ID NO: 129216 - DNA, 9 bp, Unknown
  misc_feature (1)..( 9): Result.003 file - promoters60/3435091
tatttgttt

SEQ ID NO: 129217 - DNA, 9 bp, Unknown
  misc_feature (1)..( 9): Result.003 file - promoters60/3435091
tcttttctt

SEQ ID NO: 129218 - DNA, 24 bp, Unknown
  misc_feature (1)..( 24): Result.003 file - promoters60/3435091
tttcataaaaattctcaaatatta

SEQ ID NO: 129219 - DNA, 24 bp, Unknown
  misc_feature (1)..( 24): Result.003 file - promoters60/3435091
gttcatcactggtggaaaatgtta

SEQ ID NO: 129220 - DNA, 24 bp, Unknown
  misc_feature (1)..( 24): Result.003 file - promoters60/3435091
tttttaatttcttttcacatatat

SEQ ID NO: 129221 - DNA, 24 bp, Unknown
  misc_feature (1)..( 24): Result.003 file - promoters60/3435091
ttttataaatattttcaactattt

SEQ ID NO: 129222 - DNA, 24 bp, Unknown
  misc_feature (1)..( 24): Result.003 file - promoters60/3435091
tttttctaattttgtcaaatgatg

SEQ ID NO: 129223 - DNA, 24 bp, Unknown
  misc_feature (1)..( 24): Result.003 file - promoters60/3435091
agtggatgtttttgttaactatat

SEQ ID NO: 129224 - DNA, 24 bp, Unknown
  misc_feature (1)..( 24): Result.003 file - promoters60/3435091
ccaagtccaacgaaacgattatat

SEQ ID NO: 129225 - DNA, 10 bp, Unknown
  misc_feature (1)..( 10): Result.003 file - promoters60/3435091
gtatttatat

SEQ ID NO: 129226 - DNA, 10 bp, Unknown
  misc_feature (1)..( 10): Result.003 file - promoters60/3435091
gtatatatat

SEQ ID NO: 129227 - DNA, 10 bp, Unknown
  misc_feature (1)..( 10): Result.003 file - promoters60/3435091
ttatttagtt

SEQ ID NO: 129228 - DNA, 10 bp, Unknown
  misc_feature (1)..( 10): Result.003 file - promoters60/3435091
gtatataaat

SEQ ID NO: 129229 - DNA, 10 bp, Unknown
  misc_feature (1)..( 10): Result.003 file - promoters60/3435091
ttatataaat

SEQ ID NO: 129230 - DNA, 10 bp, Unknown
  misc_feature (1)..( 10): Result.003 file - promoters60/3435091
taatataaag

SEQ ID NO: 129231 - DNA, 11 bp, Unknown
  misc_feature (1)..( 11): Result.003 file - promoters60/3435091
caactttgttt

SEQ ID NO: 129232 - DNA, 11 bp, Unknown
  misc_feature (1)..( 11): Result.003 file - promoters60/3435091
caaccttgtaa

SEQ ID NO: 129233 - DNA, 11 bp, Unknown
  misc_feature (1)..( 11): Result.003 file - promoters60/3435091
caactttgaaa

SEQ ID NO: 129234 - DNA, 11 bp, Unknown
  misc_feature (1)..( 11): Result.003 file - promoters60/3435091
ttcctttgaca

SEQ ID NO: 129235 - DNA, 11 bp, Unknown
  misc_feature (1)..( 11): Result.003 file - promoters60/3435091
atacttttaat

SEQ ID NO: 129236 - DNA, 11 bp, Unknown
  misc_feature (1)..( 11): Result.003 file - promoters60/3435091
aaacattgaga

SEQ ID NO: 129237 - DNA, 8 bp, Unknown
  misc_feature (1)..( 8): Result.003 file - promoters60/3435091
attattga

SEQ ID NO: 129238 - DNA, 8 bp, Unknown
  misc_feature (1)..( 8): Result.003 file - promoters60/3435091
tttaatga

SEQ ID NO: 129239 - DNA, 8 bp, Unknown
  misc_feature (1)..( 8): Result.003 file - promoters60/3435091
attcataa

SEQ ID NO: 129240 - DNA, 8 bp, Unknown
  misc_feature (1)..( 8): Result.003 file - promoters60/3435091
atttttgg

SEQ ID NO: 129241 - DNA, 8 bp, Unknown
  misc_feature (1)..( 8): Result.003 file - promoters60/3435091
tttaatcg

SEQ ID NO: 129242 - DNA, 8 bp, Unknown
  misc_feature (1)..( 8): Result.003 file - promoters60/3435091
tttaatta

SEQ ID NO: 129243 - DNA, 8 bp, Unknown
  misc_feature (1)..( 8): Result.003 file - promoters60/3435091
ctttttgt

SEQ ID NO: 129244 - DNA, 10 bp, Unknown
  misc_feature (1)..( 10): Result.003 file - promoters60/3435091
tggttttaaa

SEQ ID NO: 129245 - DNA, 10 bp, Unknown
  misc_feature (1)..( 10): Result.003 file - promoters60/3435091
aagttttagc

SEQ ID NO: 129246 - DNA, 10 bp, Unknown
  misc_feature (1)..( 10): Result.003 file - promoters60/3435091
cggttttaaa

SEQ ID NO: 129247 - DNA, 10 bp, Unknown
  misc_feature (1)..( 10): Result.003 file - promoters60/3435091
aactttgaaa

SEQ ID NO: 129248 - DNA, 10 bp, Unknown
  misc_feature (1)..( 10): Result.003 file - promoters60/3435091
tcctttgaca

SEQ ID NO: 129249 - DNA, 10 bp, Unknown
  misc_feature (1)..( 10): Result.003 file - promoters60/3435091
aacattgaga

SEQ ID NO: 129250 - DNA, 9 bp, Unknown
  misc_feature (1)..( 9): Result.003 file - promoters60/3435091
agttataaa

SEQ ID NO: 129251 - DNA, 9 bp, Unknown
  misc_feature (1)..( 9): Result.003 file - promoters60/3435091
ccttataat

SEQ ID NO: 129252 - DNA, 9 bp, Unknown
  misc_feature (1)..( 9): Result.003 file - promoters60/3435091
ttttagaaa

SEQ ID NO: 129253 - DNA, 9 bp, Unknown
  misc_feature (1)..( 9): Result.003 file - promoters60/3435091
ccttatact

SEQ ID NO: 129254 - DNA, 9 bp, Unknown
  misc_feature (1)..( 9): Result.003 file - promoters60/3435091
aattaaaat

SEQ ID NO: 129255 - DNA, 9 bp, Unknown
  misc_feature (1)..( 9): Result.003 file - promoters60/3435091
gattataaa

SEQ ID NO: 129256 - DNA, 13 bp, Unknown
  misc_feature (1)..( 13): Result.003 file - promoters60/3435133
ctaaaatagtaaa

SEQ ID NO: 129257 - DNA, 13 bp, Unknown
  misc_feature (1)..( 13): Result.003 file - promoters60/3435133
aaataattgtata

SEQ ID NO: 129258 - DNA, 13 bp, Unknown
  misc_feature (1)..( 13): Result.003 file - promoters60/3435133
tcatatttgtata

SEQ ID NO: 129259 - DNA, 13 bp, Unknown
  misc_feature (1)..( 13): Result.003 file - promoters60/3435133
aaagaattgaaca

SEQ ID NO: 129260 - DNA, 10 bp, Unknown
  misc_feature (1)..( 10): Result.003 file - promoters60/3435133
gaaaaagata

SEQ ID NO: 129261 - DNA, 10 bp, Unknown
  misc_feature (1)..( 10): Result.003 file - promoters60/3435133
gaaatagatt

SEQ ID NO: 129262 - DNA, 10 bp, Unknown
  misc_feature (1)..( 10): Result.003 file - promoters60/3435133
ttagtagatt

SEQ ID NO: 129263 - DNA, 10 bp, Unknown
  misc_feature (1)..( 10): Result.003 file - promoters60/3435133
tatataaatt

SEQ ID NO: 129264 - DNA, 10 bp, Unknown
  misc_feature (1)..( 10): Result.003 file - promoters60/3435133
ttactaaaat

SEQ ID NO: 129265 - DNA, 10 bp, Unknown
  misc_feature (1)..( 10): Result.003 file - promoters60/3435133
ttattaattt

SEQ ID NO: 129266 - DNA, 11 bp, Unknown
  misc_feature (1)..( 11): Result.003 file - promoters60/3435133
gaactgaaaga

SEQ ID NO: 129267 - DNA, 11 bp, Unknown
  misc_feature (1)..( 11): Result.003 file - promoters60/3435133
ttgtataaatt

SEQ ID NO: 129268 - DNA, 6 bp, Unknown
  misc_feature (1)..( 6): Result.003 file - promoters60/3435213
agtcgt

SEQ ID NO: 129269 - DNA, 6 bp, Unknown
  misc_feature (1)..( 6): Result.003 file - promoters60/3435213
agtcgt

SEQ ID NO: 129270 - DNA, 7 bp, Unknown
  misc_feature (1)..( 7): Result.003 file - promoters60/3435213
tcttgct

SEQ ID NO: 129271 - DNA, 7 bp, Unknown
  misc_feature (1)..( 7): Result.003 file - promoters60/3435213
tctagct

SEQ ID NO: 129272 - DNA, 6 bp, Unknown
  misc_feature (1)..( 6): Result.003 file - promoters60/3435213
cttgta

SEQ ID NO: 129273 - DNA, 6 bp, Unknown
  misc_feature (1)..( 6): Result.003 file - promoters60/3435213
cttgta

SEQ ID NO: 129274 - DNA, 7 bp, Unknown
  misc_feature (1)..( 7): Result.003 file - promoters60/3435213
tttttgt

SEQ ID NO: 129275 - DNA, 7 bp, Unknown
  misc_feature (1)..( 7): Result.003 file - promoters60/3435213
tttctgt

SEQ ID NO: 129276 - DNA, 7 bp, Unknown
  misc_feature (1)..( 7): Result.003 file - promoters60/3435213
tttatca

SEQ ID NO: 129277 - DNA, 7 bp, Unknown
  misc_feature (1)..( 7): Result.003 file - promoters60/3435213
tttttca

SEQ ID NO: 129278 - DNA, 8 bp, Unknown
  misc_feature (1)..( 8): Result.003 file - promoters60/3435213
tttcttct

SEQ ID NO: 129279 - DNA, 8 bp, Unknown
  misc_feature (1)..( 8): Result.003 file - promoters60/3435213
tgtagtca

SEQ ID NO: 129280 - DNA, 8 bp, Unknown
  misc_feature (1)..( 8): Result.003 file - promoters60/3435213
tgtcgtca

SEQ ID NO: 129281 - DNA, 7 bp, Unknown
  misc_feature (1)..( 7): Result.003 file - promoters60/3435213
aacgaaa

SEQ ID NO: 129282 - DNA, 7 bp, Unknown
  misc_feature (1)..( 7): Result.003 file - promoters60/3435213
aaccaaa

SEQ ID NO: 129283 - DNA, 6 bp, Unknown
  misc_feature (1)..( 6): Result.003 file - promoters60/3435213
aaacag

SEQ ID NO: 129284 - DNA, 6 bp, Unknown
  misc_feature (1)..( 6): Result.003 file - promoters60/3435213
aaacag

SEQ ID NO: 129285 - DNA, 8 bp, Unknown
  misc_feature (1)..( 8): Result.003 file - promoters60/3435213
tcctcttt

SEQ ID NO: 129286 - DNA, 8 bp, Unknown
  misc_feature (1)..( 8): Result.003 file - promoters60/3435213
tccttttt

SEQ ID NO: 129287 - DNA, 8 bp, Unknown
  misc_feature (1)..( 8): Result.003 file - promoters60/3435213
tctcctgc

SEQ ID NO: 129288 - DNA, 8 bp, Unknown
  misc_feature (1)..( 8): Result.003 file - promoters60/3435213
tctcctgc

SEQ ID NO: 129289 - DNA, 6 bp, Unknown
  misc_feature (1)..( 6): Result.003 file - promoters60/3435213
tagagt

SEQ ID NO: 129290 - DNA, 6 bp, Unknown
  misc_feature (1)..( 6): Result.003 file - promoters60/3435213
tagagt

SEQ ID NO: 129291 - DNA, 11 bp, Unknown
  misc_feature (1)..( 11): Result.003 file - promoters60/3435239
gacgattttgt

SEQ ID NO: 129292 - DNA, 11 bp, Unknown
  misc_feature (1)..( 11): Result.003 file - promoters60/3435239
gacgattttgt

SEQ ID NO: 129293 - DNA, 11 bp, Unknown
  misc_feature (1)..( 11): Result.003 file - promoters60/3435239
gacaattagat

SEQ ID NO: 129294 - DNA, 8 bp, Unknown
  misc_feature (1)..( 8): Result.003 file - promoters60/3435239
attcgtat

SEQ ID NO: 129295 - DNA, 8 bp, Unknown
  misc_feature (1)..( 8): Result.003 file - promoters60/3435239
atttgtat

SEQ ID NO: 129296 - DNA, 8 bp, Unknown
  misc_feature (1)..( 8): Result.003 file - promoters60/3435239
gttcttat

SEQ ID NO: 129297 - DNA, 16 bp, Unknown
  misc_feature (1)..( 16): Result.003 file - promoters60/3435239
aattgtttattactgg

SEQ ID NO: 129298 - DNA, 16 bp, Unknown
  misc_feature (1)..( 16): Result.003 file - promoters60/3435239
tctcgttttttattgg

SEQ ID NO: 129299 - DNA, 16 bp, Unknown
  misc_feature (1)..( 16): Result.003 file - promoters60/3435239
ctttcttttttttgtt

SEQ ID NO: 129300 - DNA, 16 bp, Unknown
  misc_feature (1)..( 16): Result.003 file - promoters60/3435239
tcttgttttcttgaga

SEQ ID NO: 129301 - DNA, 8 bp, Unknown
  misc_feature (1)..( 8): Result.003 file - promoters60/3435239
aattgttt

SEQ ID NO: 129302 - DNA, 8 bp, Unknown
  misc_feature (1)..( 8): Result.003 file - promoters60/3435239
ttttgttt

SEQ ID NO: 129303 - DNA, 8 bp, Unknown
  misc_feature (1)..( 8): Result.003 file - promoters60/3435239
tcttgttt

SEQ ID NO: 129304 - DNA, 8 bp, Unknown
  misc_feature (1)..( 8): Result.003 file - promoters60/3435239
tctcgttt

SEQ ID NO: 129305 - DNA, 8 bp, Unknown
  misc_feature (1)..( 8): Result.003 file - promoters60/3435239
atttgtta

SEQ ID NO: 129306 - DNA, 8 bp, Unknown
  misc_feature (1)..( 8): Result.003 file - promoters60/3435239
atttgttt

SEQ ID NO: 129307 - DNA, 8 bp, Unknown
  misc_feature (1)..( 8): Result.003 file - promoters60/3435239
gtttcttt

SEQ ID NO: 129308 - DNA, 9 bp, Unknown
  misc_feature (1)..( 9): Result.003 file - promoters60/3435239
ttttatttt

SEQ ID NO: 129309 - DNA, 9 bp, Unknown
  misc_feature (1)..( 9): Result.003 file - promoters60/3435239
ctttctttt

SEQ ID NO: 129310 - DNA, 9 bp, Unknown
  misc_feature (1)..( 9): Result.003 file - promoters60/3435239
tcttgtttc

SEQ ID NO: 129311 - DNA, 9 bp, Unknown
  misc_feature (1)..( 9): Result.003 file - promoters60/3435239
aaaagaaga

SEQ ID NO: 129312 - DNA, 9 bp, Unknown
  misc_feature (1)..( 9): Result.003 file - promoters60/3435239
aaaagtaga

SEQ ID NO: 129313 - DNA, 9 bp, Unknown
  misc_feature (1)..( 9): Result.003 file - promoters60/3435239
tgaagtagt

SEQ ID NO: 129314 - DNA, 10 bp, Unknown
  misc_feature (1)..( 10): Result.003 file - promoters60/3435274
atgaaaatag

SEQ ID NO: 129315 - DNA, 10 bp, Unknown
  misc_feature (1)..( 10): Result.003 file - promoters60/3435274
atgaagatag

SEQ ID NO: 129316 - DNA, 7 bp, Unknown
  misc_feature (1)..( 7): Result.003 file - promoters60/3435274
aataaca

SEQ ID NO: 129317 - DNA, 7 bp, Unknown
  misc_feature (1)..( 7): Result.003 file - promoters60/3435274
aatcaca

SEQ ID NO: 129318 - DNA, 6 bp, Unknown
  misc_feature (1)..( 6): Result.003 file - promoters60/3435274
agtcaa

SEQ ID NO: 129319 - DNA, 6 bp, Unknown
  misc_feature (1)..( 6): Result.003 file - promoters60/3435274
agtcaa

SEQ ID NO: 129320 - DNA, 7 bp, Unknown
  misc_feature (1)..( 7): Result.003 file - promoters60/3435274
agaagga

SEQ ID NO: 129321 - DNA, 7 bp, Unknown
  misc_feature (1)..( 7): Result.003 file - promoters60/3435274
agatgga

SEQ ID NO: 129322 - DNA, 6 bp, Unknown
  misc_feature (1)..( 6): Result.003 file - promoters60/3435274
aaacaa

SEQ ID NO: 129323 - DNA, 6 bp, Unknown
  misc_feature (1)..( 6): Result.003 file - promoters60/3435274
aaacaa

SEQ ID NO: 129324 - DNA, 6 bp, Unknown
  misc_feature (1)..( 6): Result.003 file - promoters60/3435274
aatcaa

SEQ ID NO: 129325 - DNA, 6 bp, Unknown
  misc_feature (1)..( 6): Result.003 file - promoters60/3435274
aatcaa

SEQ ID NO: 129326 - DNA, 12 bp, Unknown
  misc_feature (1)..( 12): Result.003 file - promoters60/3435274
caggattgattt

SEQ ID NO: 129327 - DNA, 12 bp, Unknown
  misc_feature (1)..( 12): Result.003 file - promoters60/3435274
caggatttatta

SEQ ID NO: 129328 - DNA, 12 bp, Unknown
  misc_feature (1)..( 12): Result.003 file - promoters60/3435274
agttgtttttta

SEQ ID NO: 129329 - DNA, 7 bp, Unknown
  misc_feature (1)..( 7): Result.003 file - promoters60/3435274
acttgtg

SEQ ID NO: 129330 - DNA, 7 bp, Unknown
  misc_feature (1)..( 7): Result.003 file - promoters60/3435274
acttgtg

SEQ ID NO: 129331 - DNA, 7 bp, Unknown
  misc_feature (1)..( 7): Result.003 file - promoters60/3435274
ttatgtc

SEQ ID NO: 129332 - DNA, 7 bp, Unknown
  misc_feature (1)..( 7): Result.003 file - promoters60/3435274
ttatgtc

SEQ ID NO: 129333 - DNA, 10 bp, Unknown
  misc_feature (1)..( 10): Result.003 file - promoters60/3435274
ttttactaac

SEQ ID NO: 129334 - DNA, 10 bp, Unknown
  misc_feature (1)..( 10): Result.003 file - promoters60/3435274
ttttaataac

SEQ ID NO: 129335 - DNA, 7 bp, Unknown
  misc_feature (1)..( 7): Result.003 file - promoters60/3435274
attggta

SEQ ID NO: 129336 - DNA, 7 bp, Unknown
  misc_feature (1)..( 7): Result.003 file - promoters60/3435274
attagta

SEQ ID NO: 129337 - DNA, 6 bp, Unknown
  misc_feature (1)..( 6): Result.003 file - promoters60/3435274
aaaatc

SEQ ID NO: 129338 - DNA, 6 bp, Unknown
  misc_feature (1)..( 6): Result.003 file - promoters60/3435274
aaaatc

SEQ ID NO: 129339 - DNA, 7 bp, Unknown
  misc_feature (1)..( 7): Result.003 file - promoters60/3435274
gattcag

SEQ ID NO: 129340 - DNA, 7 bp, Unknown
  misc_feature (1)..( 7): Result.003 file - promoters60/3435274
gattcag

SEQ ID NO: 129341 - DNA, 7 bp, Unknown
  misc_feature (1)..( 7): Result.003 file - promoters60/3435274
gatggat

SEQ ID NO: 129342 - DNA, 7 bp, Unknown
  misc_feature (1)..( 7): Result.003 file - promoters60/3435274
gatcgat

SEQ ID NO: 129343 - DNA, 7 bp, Unknown
  misc_feature (1)..( 7): Result.003 file - promoters60/3435282
agaaata

SEQ ID NO: 129344 - DNA, 7 bp, Unknown
  misc_feature (1)..( 7): Result.003 file - promoters60/3435282
agaaata

SEQ ID NO: 129345 - DNA, 7 bp, Unknown
  misc_feature (1)..( 7): Result.003 file - promoters60/3435282
tgactta

SEQ ID NO: 129346 - DNA, 7 bp, Unknown
  misc_feature (1)..( 7): Result.003 file - promoters60/3435282
tgaatta

SEQ ID NO: 129347 - DNA, 7 bp, Unknown
  misc_feature (1)..( 7): Result.003 file - promoters60/3435282
gttgatt

SEQ ID NO: 129348 - DNA, 7 bp, Unknown
  misc_feature (1)..( 7): Result.003 file - promoters60/3435282
gtttatt

SEQ ID NO: 129349 - DNA, 7 bp, Unknown
  misc_feature (1)..( 7): Result.003 file - promoters60/3435282
tgtcggc

SEQ ID NO: 129350 - DNA, 7 bp, Unknown
  misc_feature (1)..( 7): Result.003 file - promoters60/3435282
tgttggc

SEQ ID NO: 129351 - DNA, 6 bp, Unknown
  misc_feature (1)..( 6): Result.003 file - promoters60/3435282
ttataa

SEQ ID NO: 129352 - DNA, 6 bp, Unknown
  misc_feature (1)..( 6): Result.003 file - promoters60/3435282
ttataa

SEQ ID NO: 129353 - DNA, 6 bp, Unknown
  misc_feature (1)..( 6): Result.003 file - promoters60/3435282
ttatgt

SEQ ID NO: 129354 - DNA, 6 bp, Unknown
  misc_feature (1)..( 6): Result.003 file - promoters60/3435282
ttatgt

SEQ ID NO: 129355 - DNA, 9 bp, Unknown
  misc_feature (1)..( 9): Result.003 file - promoters60/3435282
ttgtatctc

SEQ ID NO: 129356 - DNA, 9 bp, Unknown
  misc_feature (1)..( 9): Result.003 file - promoters60/3435282
ttgtgtctc

SEQ ID NO: 129357 - DNA, 7 bp, Unknown
  misc_feature (1)..( 7): Result.003 file - promoters60/3435282
tatcttt

SEQ ID NO: 129358 - DNA, 7 bp, Unknown
  misc_feature (1)..( 7): Result.003 file - promoters60/3435282
tattttt

SEQ ID NO: 129359 - DNA, 6 bp, Unknown
  misc_feature (1)..( 6): Result.003 file - promoters60/3435282
agcatc

SEQ ID NO: 129360 - DNA, 6 bp, Unknown
  misc_feature (1)..( 6): Result.003 file - promoters60/3435282
agcatc

SEQ ID NO: 129361 - DNA, 6 bp, Unknown
  misc_feature (1)..( 6): Result.003 file - promoters60/3435282
cttttc

SEQ ID NO: 129362 - DNA, 6 bp, Unknown
  misc_feature (1)..( 6): Result.003 file - promoters60/3435282
cttttc

SEQ ID NO: 129363 - DNA, 6 bp, Unknown
  misc_feature (1)..( 6): Result.003 file - promoters60/3435282
tttgga

SEQ ID NO: 129364 - DNA, 6 bp, Unknown
  misc_feature (1)..( 6): Result.003 file - promoters60/3435282
tttgga

SEQ ID NO: 129365 - DNA, 6 bp, Unknown
  misc_feature (1)..( 6): Result.003 file - promoters60/3435282
aaccaa

SEQ ID NO: 129366 - DNA, 6 bp, Unknown
  misc_feature (1)..( 6): Result.003 file - promoters60/3435282
aaccaa

SEQ ID NO: 129367 - DNA, 7 bp, Unknown
  misc_feature (1)..( 7): Result.003 file - promoters60/3435282
aaagatt

SEQ ID NO: 129368 - DNA, 7 bp, Unknown
  misc_feature (1)..( 7): Result.003 file - promoters60/3435282
aaatatt

SEQ ID NO: 129369 - DNA, 7 bp, Unknown
  misc_feature (1)..( 7): Result.003 file - promoters60/3435282
aaaaaag

SEQ ID NO: 129370 - DNA, 7 bp, Unknown
  misc_feature (1)..( 7): Result.003 file - promoters60/3435282
aaagaag

SEQ ID NO: 129371 - DNA, 7 bp, Unknown
  misc_feature (1)..( 7): Result.003 file - promoters60/3435282
atattat

SEQ ID NO: 129372 - DNA, 7 bp, Unknown
  misc_feature (1)..( 7): Result.003 file - promoters60/3435282
ataatat

SEQ ID NO: 129373 - DNA, 8 bp, Unknown
  misc_feature (1)..( 8): Result.003 file - promoters60/3435282
tttagaag

SEQ ID NO: 129374 - DNA, 8 bp, Unknown
  misc_feature (1)..( 8): Result.003 file - promoters60/3435282
tttacaag

SEQ ID NO: 129375 - DNA, 9 bp, Unknown
  misc_feature (1)..( 9): Result.003 file - promoters60/3435282
aatacaaaa

SEQ ID NO: 129376 - DNA, 9 bp, Unknown
  misc_feature (1)..( 9): Result.003 file - promoters60/3435282
aatagaaaa

SEQ ID NO: 129377 - DNA, 6 bp, Unknown
  misc_feature (1)..( 6): Result.003 file - promoters60/3435282
taaaaa

SEQ ID NO: 129378 - DNA, 6 bp, Unknown
  misc_feature (1)..( 6): Result.003 file - promoters60/3435282
taaaaa

SEQ ID NO: 129379 - DNA, 6 bp, Unknown
  misc_feature (1)..( 6): Result.003 file - promoters60/3435282
attttg

SEQ ID NO: 129380 - DNA, 6 bp, Unknown
  misc_feature (1)..( 6): Result.003 file - promoters60/3435282
attttg

SEQ ID NO: 129381 - DNA, 8 bp, Unknown
  misc_feature (1)..( 8): Result.003 file - promoters60/3435341
tttggttt

SEQ ID NO: 129382 - DNA, 8 bp, Unknown
  misc_feature (1)..( 8): Result.003 file - promoters60/3435341
attggttt

SEQ ID NO: 129383 - DNA, 8 bp, Unknown
  misc_feature (1)..( 8): Result.003 file - promoters60/3435341
attggtaa

SEQ ID NO: 129384 - DNA, 7 bp, Unknown
  misc_feature (1)..( 7): Result.003 file - promoters60/3435341
gaagtta

SEQ ID NO: 129385 - DNA, 7 bp, Unknown
  misc_feature (1)..( 7): Result.003 file - promoters60/3435341
gaactta

SEQ ID NO: 129386 - DNA, 7 bp, Unknown
  misc_feature (1)..( 7): Result.003 file - promoters60/3435341
tgataag

SEQ ID NO: 129387 - DNA, 7 bp, Unknown
  misc_feature (1)..( 7): Result.003 file - promoters60/3435341
tgacaag

SEQ ID NO: 129388 - DNA, 6 bp, Unknown
  misc_feature (1)..( 6): Result.003 file - promoters60/3435341
aatttt

SEQ ID NO: 129389 - DNA, 6 bp, Unknown
  misc_feature (1)..( 6): Result.003 file - promoters60/3435341
aatttt

SEQ ID NO: 129390 - DNA, 6 bp, Unknown
  misc_feature (1)..( 6): Result.003 file - promoters60/3435341
ttttga

SEQ ID NO: 129391 - DNA, 6 bp, Unknown
  misc_feature (1)..( 6): Result.003 file - promoters60/3435341
ttttga

SEQ ID NO: 129392 - DNA, 7 bp, Unknown
  misc_feature (1)..( 7): Result.003 file - promoters60/3435341
agttata

SEQ ID NO: 129393 - DNA, 7 bp, Unknown
  misc_feature (1)..( 7): Result.003 file - promoters60/3435341
agtaata

SEQ ID NO: 129394 - DNA, 7 bp, Unknown
  misc_feature (1)..( 7): Result.003 file - promoters60/3435341
aatgtgt

SEQ ID NO: 129395 - DNA, 7 bp, Unknown
  misc_feature (1)..( 7): Result.003 file - promoters60/3435341
aatttgt

SEQ ID NO: 129396 - DNA, 6 bp, Unknown
  misc_feature (1)..( 6): Result.003 file - promoters60/3435341
ggtttg

SEQ ID NO: 129397 - DNA, 6 bp, Unknown
  misc_feature (1)..( 6): Result.003 file - promoters60/3435341
ggtttg

SEQ ID NO: 129398 - DNA, 6 bp, Unknown
  misc_feature (1)..( 6): Result.003 file - promoters60/3435341
ttcaat

SEQ ID NO: 129399 - DNA, 6 bp, Unknown
  misc_feature (1)..( 6): Result.003 file - promoters60/3435341
ttcaat

SEQ ID NO: 129400 - DNA, 6 bp, Unknown
  misc_feature (1)..( 6): Result.003 file - promoters60/3435341
aagtta

SEQ ID NO: 129401 - DNA, 6 bp, Unknown
  misc_feature (1)..( 6): Result.003 file - promoters60/3435341
aagtta

SEQ ID NO: 129402 - DNA, 7 bp, Unknown
  misc_feature (1)..( 7): Result.003 file - promoters60/3435341
gagcaat

SEQ ID NO: 129403 - DNA, 7 bp, Unknown
  misc_feature (1)..( 7): Result.003 file - promoters60/3435341
gaggaat

SEQ ID NO: 129404 - DNA, 8 bp, Unknown
  misc_feature (1)..( 8): Result.003 file - promoters60/3435341
ttggaatt

SEQ ID NO: 129405 - DNA, 8 bp, Unknown
  misc_feature (1)..( 8): Result.003 file - promoters60/3435341
ttgcaatt

SEQ ID NO: 129406 - DNA, 6 bp, Unknown
  misc_feature (1)..( 6): Result.003 file - promoters60/3435341
tttctt

SEQ ID NO: 129407 - DNA, 6 bp, Unknown
  misc_feature (1)..( 6): Result.003 file - promoters60/3435341
tttctt

SEQ ID NO: 129408 - DNA, 10 bp, Unknown
  misc_feature (1)..( 10): Result.003 file - promoters60/3435341
ttacttatag

SEQ ID NO: 129409 - DNA, 10 bp, Unknown
  misc_feature (1)..( 10): Result.003 file - promoters60/3435341
ttactgatag

SEQ ID NO: 129410 - DNA, 7 bp, Unknown
  misc_feature (1)..( 7): Result.003 file - promoters60/3435341
tttcatc

SEQ ID NO: 129411 - DNA, 7 bp, Unknown
  misc_feature (1)..( 7): Result.003 file - promoters60/3435341
tttaatc

SEQ ID NO: 129412 - DNA, 6 bp, Unknown
  misc_feature (1)..( 6): Result.003 file - promoters60/3435341
gggacc

SEQ ID NO: 129413 - DNA, 6 bp, Unknown
  misc_feature (1)..( 6): Result.003 file - promoters60/3435341
gggacc

SEQ ID NO: 129414 - DNA, 8 bp, Unknown
  misc_feature (1)..( 8): Result.003 file - promoters60/3435341
cctaactt

SEQ ID NO: 129415 - DNA, 8 bp, Unknown
  misc_feature (1)..( 8): Result.003 file - promoters60/3435341
cctagctt

SEQ ID NO: 129416 - DNA, 8 bp, Unknown
  misc_feature (1)..( 8): Result.003 file - promoters60/3435341
ctttattg

SEQ ID NO: 129417 - DNA, 8 bp, Unknown
  misc_feature (1)..( 8): Result.003 file - promoters60/3435341
cttgattg

SEQ ID NO: 129418 - DNA, 6 bp, Unknown
  misc_feature (1)..( 6): Result.003 file - promoters60/3435341
tctttg

SEQ ID NO: 129419 - DNA, 6 bp, Unknown
  misc_feature (1)..( 6): Result.003 file - promoters60/3435341
tctttg

SEQ ID NO: 129420 - DNA, 6 bp, Unknown
  misc_feature (1)..( 6): Result.003 file - promoters60/3435341
gaggaa

SEQ ID NO: 129421 - DNA, 6 bp, Unknown
  misc_feature (1)..( 6): Result.003 file - promoters60/3435341
gaggaa

SEQ ID NO: 129422 - DNA, 6 bp, Unknown
  misc_feature (1)..( 6): Result.003 file - promoters60/3435341
tttttg

SEQ ID NO: 129423 - DNA, 6 bp, Unknown
  misc_feature (1)..( 6): Result.003 file - promoters60/3435341
tttttg

SEQ ID NO: 129424 - DNA, 10 bp, Unknown
  misc_feature (1)..( 10): Result.003 file - promoters60/3435411
ctcatcttct

SEQ ID NO: 129425 - DNA, 10 bp, Unknown
  misc_feature (1)..( 10): Result.003 file - promoters60/3435411
ctcttcttct

SEQ ID NO: 129426 - DNA, 10 bp, Unknown
  misc_feature (1)..( 10): Result.003 file - promoters60/3435411
agcttcgtcc

SEQ ID NO: 129427 - DNA, 9 bp, Unknown
  misc_feature (1)..( 9): Result.003 file - promoters60/3435411
gctaatatc

SEQ ID NO: 129428 - DNA, 9 bp, Unknown
  misc_feature (1)..( 9): Result.003 file - promoters60/3435411
tctaaaatc

SEQ ID NO: 129429 - DNA, 9 bp, Unknown
  misc_feature (1)..( 9): Result.003 file - promoters60/3435411
tctaaattg

SEQ ID NO: 129430 - DNA, 8 bp, Unknown
  misc_feature (1)..( 8): Result.003 file - promoters60/3435411
gaaggaaa

SEQ ID NO: 129431 - DNA, 8 bp, Unknown
  misc_feature (1)..( 8): Result.003 file - promoters60/3435411
gaagaaaa

SEQ ID NO: 129432 - DNA, 7 bp, Unknown
  misc_feature (1)..( 7): Result.003 file - promoters60/3435411
aaatatt

SEQ ID NO: 129433 - DNA, 7 bp, Unknown
  misc_feature (1)..( 7): Result.003 file - promoters60/3435411
aaaaatt

SEQ ID NO: 129434 - DNA, 10 bp, Unknown
  misc_feature (1)..( 10): Result.003 file - promoters60/3435411
agatagaaca

SEQ ID NO: 129435 - DNA, 10 bp, Unknown
  misc_feature (1)..( 10): Result.003 file - promoters60/3435411
agagagaaca

SEQ ID NO: 129436 - DNA, 7 bp, Unknown
  misc_feature (1)..( 7): Result.003 file - promoters60/3435411
aacaaag

SEQ ID NO: 129437 - DNA, 7 bp, Unknown
  misc_feature (1)..( 7): Result.003 file - promoters60/3435411
cacaaag

SEQ ID NO: 129438 - DNA, 7 bp, Unknown
  misc_feature (1)..( 7): Result.003 file - promoters60/3435411
aacaaaa

SEQ ID NO: 129439 - DNA, 6 bp, Unknown
  misc_feature (1)..( 6): Result.003 file - promoters60/3435411
gttttc

SEQ ID NO: 129440 - DNA, 6 bp, Unknown
  misc_feature (1)..( 6): Result.003 file - promoters60/3435411
gttttc

SEQ ID NO: 129441 - DNA, 6 bp, Unknown
  misc_feature (1)..( 6): Result.003 file - promoters60/3435411
agcttc

SEQ ID NO: 129442 - DNA, 6 bp, Unknown
  misc_feature (1)..( 6): Result.003 file - promoters60/3435411
agcttc

SEQ ID NO: 129443 - DNA, 9 bp, Unknown
  misc_feature (1)..( 9): Result.003 file - promoters60/3435411
atcttgact

SEQ ID NO: 129444 - DNA, 9 bp, Unknown
  misc_feature (1)..( 9): Result.003 file - promoters60/3435411
atcttaact

SEQ ID NO: 129445 - DNA, 6 bp, Unknown
  misc_feature (1)..( 6): Result.003 file - promoters60/3435411
ataatt

SEQ ID NO: 129446 - DNA, 6 bp, Unknown
  misc_feature (1)..( 6): Result.003 file - promoters60/3435411
ataatt

SEQ ID NO: 129447 - DNA, 6 bp, Unknown
  misc_feature (1)..( 6): Result.003 file - promoters60/3435411
tttagg

SEQ ID NO: 129448 - DNA, 6 bp, Unknown
  misc_feature (1)..( 6): Result.003 file - promoters60/3435411
tttagg

SEQ ID NO: 129449 - DNA, 9 bp, Unknown
  misc_feature (1)..( 9): Result.003 file - promoters60/3435411
gagcctgat

SEQ ID NO: 129450 - DNA, 9 bp, Unknown
  misc_feature (1)..( 9): Result.003 file - promoters60/3435411
gagtctgat

SEQ ID NO: 129451 - DNA, 6 bp, Unknown
  misc_feature (1)..( 6): Result.003 file - promoters60/3435411
aattgc

SEQ ID NO: 129452 - DNA, 6 bp, Unknown
  misc_feature (1)..( 6): Result.003 file - promoters60/3435411
aattgc

SEQ ID NO: 129453 - DNA, 6 bp, Unknown
  misc_feature (1)..( 6): Result.003 file - promoters60/3435411
tccaaa

SEQ ID NO: 129454 - DNA, 6 bp, Unknown
  misc_feature (1)..( 6): Result.003 file - promoters60/3435411
tccaaa

SEQ ID NO: 129455 - DNA, 6 bp, Unknown
  misc_feature (1)..( 6): Result.003 file - promoters60/3435411
aaacga

SEQ ID NO: 129456 - DNA, 6 bp, Unknown
  misc_feature (1)..( 6): Result.003 file - promoters60/3435411
aaacga

SEQ ID NO: 129457 - DNA, 6 bp, Unknown
  misc_feature (1)..( 6): Result.003 file - promoters60/3435411
ttgact

SEQ ID NO: 129458 - DNA, 6 bp, Unknown
  misc_feature (1)..( 6): Result.003 file - promoters60/3435411
ttgact

SEQ ID NO: 129459 - DNA, 8 bp, Unknown
  misc_feature (1)..( 8): Result.003 file - promoters60/3435411
ccaagacg

SEQ ID NO: 129460 - DNA, 8 bp, Unknown
  misc_feature (1)..( 8): Result.003 file - promoters60/3435411
ccaagacg

SEQ ID NO: 129461 - DNA, 7 bp, Unknown
  misc_feature (1)..( 7): Result.003 file - promoters60/3435411
aggccca

SEQ ID NO: 129462 - DNA, 7 bp, Unknown
  misc_feature (1)..( 7): Result.003 file - promoters60/3435411
aggccca

SEQ ID NO: 129463 - DNA, 8 bp, Unknown
  misc_feature (1)..( 8): Result.003 file - promoters60/3435452
attttctt

SEQ ID NO: 129464 - DNA, 8 bp, Unknown
  misc_feature (1)..( 8): Result.003 file - promoters60/3435452
ggtttctt

SEQ ID NO: 129465 - DNA, 8 bp, Unknown
  misc_feature (1)..( 8): Result.003 file - promoters60/3435452
tttttctt

SEQ ID NO: 129466 - DNA, 8 bp, Unknown
  misc_feature (1)..( 8): Result.003 file - promoters60/3435452
attgtctc

SEQ ID NO: 129467 - DNA, 8 bp, Unknown
  misc_feature (1)..( 8): Result.003 file - promoters60/3435452
ggtttcta

SEQ ID NO: 129468 - DNA, 8 bp, Unknown
  misc_feature (1)..( 8): Result.003 file - promoters60/3435452
actttctt

SEQ ID NO: 129469 - DNA, 11 bp, Unknown
  misc_feature (1)..( 11): Result.003 file - promoters60/3435469
ttttttaaaaa

SEQ ID NO: 129470 - DNA, 11 bp, Unknown
  misc_feature (1)..( 11): Result.003 file - promoters60/3435469
attttgaaaaa

SEQ ID NO: 129471 - DNA, 12 bp, Unknown
  misc_feature (1)..( 12): Result.003 file - promoters60/3435469
attgtttaagat

SEQ ID NO: 129472 - DNA, 12 bp, Unknown
  misc_feature (1)..( 12): Result.003 file - promoters60/3435469
gttttcgaatct

SEQ ID NO: 129473 - DNA, 12 bp, Unknown
  misc_feature (1)..( 12): Result.003 file - promoters60/3435469
tttgtttctctt

SEQ ID NO: 129474 - DNA, 12 bp, Unknown
  misc_feature (1)..( 12): Result.003 file - promoters60/3435469
aatgtttctcca

SEQ ID NO: 129475 - DNA, 14 bp, Unknown
  misc_feature (1)..( 14): Result.003 file - promoters60/3435469
ctcatataaataca

SEQ ID NO: 129476 - DNA, 14 bp, Unknown
  misc_feature (1)..( 14): Result.003 file - promoters60/3435469
acaatataaacata

SEQ ID NO: 129477 - DNA, 14 bp, Unknown
  misc_feature (1)..( 14): Result.003 file - promoters60/3435469
ctcatatatatcac

SEQ ID NO: 129478 - DNA, 14 bp, Unknown
  misc_feature (1)..( 14): Result.003 file - promoters60/3435469
ctcatatatataca

SEQ ID NO: 129479 - DNA, 14 bp, Unknown
  misc_feature (1)..( 14): Result.003 file - promoters60/3435469
cgtatatataaaga

SEQ ID NO: 129480 - DNA, 11 bp, Unknown
  misc_feature (1)..( 11): Result.003 file - promoters60/3435469
ctagattttta

SEQ ID NO: 129481 - DNA, 11 bp, Unknown
  misc_feature (1)..( 11): Result.003 file - promoters60/3435469
aacaatttttc

SEQ ID NO: 129482 - DNA, 11 bp, Unknown
  misc_feature (1)..( 11): Result.003 file - promoters60/3435469
acgttttttta

SEQ ID NO: 129483 - DNA, 11 bp, Unknown
  misc_feature (1)..( 11): Result.003 file - promoters60/3435469
tgagatgtttg

SEQ ID NO: 129484 - DNA, 11 bp, Unknown
  misc_feature (1)..( 11): Result.003 file - promoters60/3435469
ctagagtttcc

SEQ ID NO: 129485 - DNA, 11 bp, Unknown
  misc_feature (1)..( 11): Result.003 file - promoters60/3435469
tcgtagtgttc

SEQ ID NO: 129486 - DNA, 14 bp, Unknown
  misc_feature (1)..( 14): Result.003 file - promoters60/3435469
aaagttttgagcta

SEQ ID NO: 129487 - DNA, 14 bp, Unknown
  misc_feature (1)..( 14): Result.003 file - promoters60/3435469
aaattttttttcta

SEQ ID NO: 129488 - DNA, 14 bp, Unknown
  misc_feature (1)..( 14): Result.003 file - promoters60/3435469
aaactttttttaca

SEQ ID NO: 129489 - DNA, 14 bp, Unknown
  misc_feature (1)..( 14): Result.003 file - promoters60/3435469
ctagtttttcttat

SEQ ID NO: 129490 - DNA, 14 bp, Unknown
  misc_feature (1)..( 14): Result.003 file - promoters60/3435469
tgacttttctttct

SEQ ID NO: 129491 - DNA, 14 bp, Unknown
  misc_feature (1)..( 14): Result.003 file - promoters60/3435469
caatttttagtcat

SEQ ID NO: 129492 - DNA, 8 bp, Unknown
  misc_feature (1)..( 8): Result.003 file - promoters60/3435469
cttttttt

SEQ ID NO: 129493 - DNA, 8 bp, Unknown
  misc_feature (1)..( 8): Result.003 file - promoters60/3435469
tttttttt

SEQ ID NO: 129494 - DNA, 8 bp, Unknown
  misc_feature (1)..( 8): Result.003 file - promoters60/3435469
cttttttt

SEQ ID NO: 129495 - DNA, 8 bp, Unknown
  misc_feature (1)..( 8): Result.003 file - promoters60/3435469
gtttttct

SEQ ID NO: 129496 - DNA, 8 bp, Unknown
  misc_feature (1)..( 8): Result.003 file - promoters60/3435469
atttttag

SEQ ID NO: 129497 - DNA, 13 bp, Unknown
  misc_feature (1)..( 13): Result.003 file - promoters60/3435534
caaaaaaatgggt

SEQ ID NO: 129498 - DNA, 13 bp, Unknown
  misc_feature (1)..( 13): Result.003 file - promoters60/3435534
tagaaaaatgtaa

SEQ ID NO: 129499 - DNA, 13 bp, Unknown
  misc_feature (1)..( 13): Result.003 file - promoters60/3435534
acaaaaaataaat

SEQ ID NO: 129500 - DNA, 13 bp, Unknown
  misc_feature (1)..( 13): Result.003 file - promoters60/3435534
ggcccaaatgttt

SEQ ID NO: 129501 - DNA, 13 bp, Unknown
  misc_feature (1)..( 13): Result.003 file - promoters60/3435534
acacgaaatattt

SEQ ID NO: 129502 - DNA, 13 bp, Unknown
  misc_feature (1)..( 13): Result.003 file - promoters60/3435534
cgaagaaattttt

SEQ ID NO: 129503 - DNA, 13 bp, Unknown
  misc_feature (1)..( 13): Result.003 file - promoters60/3435534
acacaaaaggaga

SEQ ID NO: 129504 - DNA, 11 bp, Unknown
  misc_feature (1)..( 11): Result.003 file - promoters60/3435534
tcccaaaaaaa

SEQ ID NO: 129505 - DNA, 11 bp, Unknown
  misc_feature (1)..( 11): Result.003 file - promoters60/3435534
agacaaaaaat

SEQ ID NO: 129506 - DNA, 11 bp, Unknown
  misc_feature (1)..( 11): Result.003 file - promoters60/3435534
gtttaaataat

SEQ ID NO: 129507 - DNA, 11 bp, Unknown
  misc_feature (1)..( 11): Result.003 file - promoters60/3435534
ccacacaaaag

SEQ ID NO: 129508 - DNA, 11 bp, Unknown
  misc_feature (1)..( 11): Result.003 file - promoters60/3435534
agacacgaaat

SEQ ID NO: 129509 - DNA, 11 bp, Unknown
  misc_feature (1)..( 11): Result.003 file - promoters60/3435534
agagacgaaga

SEQ ID NO: 129510 - DNA, 12 bp, Unknown
  misc_feature (1)..( 12): Result.003 file - promoters60/3435534
aaaatgtaaata

SEQ ID NO: 129511 - DNA, 12 bp, Unknown
  misc_feature (1)..( 12): Result.003 file - promoters60/3435534
aatgtttaaata

SEQ ID NO: 129512 - DNA, 12 bp, Unknown
  misc_feature (1)..( 12): Result.003 file - promoters60/3435534
agacaaaaaata

SEQ ID NO: 129513 - DNA, 12 bp, Unknown
  misc_feature (1)..( 12): Result.003 file - promoters60/3435534
ccacacaaaagg

SEQ ID NO: 129514 - DNA, 12 bp, Unknown
  misc_feature (1)..( 12): Result.003 file - promoters60/3435534
agacacgaaata

SEQ ID NO: 129515 - DNA, 12 bp, Unknown
  misc_feature (1)..( 12): Result.003 file - promoters60/3435534
agagacgaagaa

SEQ ID NO: 129516 - DNA, 6 bp, Unknown
  misc_feature (1)..( 6): Result.003 file - promoters60/3435578
tatcaa

SEQ ID NO: 129517 - DNA, 6 bp, Unknown
  misc_feature (1)..( 6): Result.003 file - promoters60/3435578
tatcaa

SEQ ID NO: 129518 - DNA, 6 bp, Unknown
  misc_feature (1)..( 6): Result.003 file - promoters60/3435578
tatcaa

SEQ ID NO: 129519 - DNA, 12 bp, Unknown
  misc_feature (1)..( 12): Result.003 file - promoters60/3435578
ttgacattatat

SEQ ID NO: 129520 - DNA, 12 bp, Unknown
  misc_feature (1)..( 12): Result.003 file - promoters60/3435578
ttgaaattacca

SEQ ID NO: 129521 - DNA, 12 bp, Unknown
  misc_feature (1)..( 12): Result.003 file - promoters60/3435578
tgcacattcgac

SEQ ID NO: 129522 - DNA, 7 bp, Unknown
  misc_feature (1)..( 7): Result.003 file - promoters60/3435578
tgtgttt

SEQ ID NO: 129523 - DNA, 7 bp, Unknown
  misc_feature (1)..( 7): Result.003 file - promoters60/3435578
tgtgttt

SEQ ID NO: 129524 - DNA, 8 bp, Unknown
  misc_feature (1)..( 8): Result.003 file - promoters60/3435578
ttaggaag

SEQ ID NO: 129525 - DNA, 8 bp, Unknown
  misc_feature (1)..( 8): Result.003 file - promoters60/3435578
ttagcaag

SEQ ID NO: 129526 - DNA, 7 bp, Unknown
  misc_feature (1)..( 7): Result.003 file - promoters60/3435578
aggtgaa

SEQ ID NO: 129527 - DNA, 7 bp, Unknown
  misc_feature (1)..( 7): Result.003 file - promoters60/3435578
aggagaa

SEQ ID NO: 129528 - DNA, 7 bp, Unknown
  misc_feature (1)..( 7): Result.003 file - promoters60/3435578
attaggt

SEQ ID NO: 129529 - DNA, 7 bp, Unknown
  misc_feature (1)..( 7): Result.003 file - promoters60/3435578
attcggt

SEQ ID NO: 129530 - DNA, 8 bp, Unknown
  misc_feature (1)..( 8): Result.003 file - promoters60/3435578
ttcacaca

SEQ ID NO: 129531 - DNA, 8 bp, Unknown
  misc_feature (1)..( 8): Result.003 file - promoters60/3435578
ttcacaaa

SEQ ID NO: 129532 - DNA, 8 bp, Unknown
  misc_feature (1)..( 8): Result.003 file - promoters60/3435578
ttcaaaaa

SEQ ID NO: 129533 - DNA, 10 bp, Unknown
  misc_feature (1)..( 10): Result.003 file - promoters60/3435578
cacacacact

SEQ ID NO: 129534 - DNA, 10 bp, Unknown
  misc_feature (1)..( 10): Result.003 file - promoters60/3435578
ttcacaaact

SEQ ID NO: 129535 - DNA, 10 bp, Unknown
  misc_feature (1)..( 10): Result.003 file - promoters60/3435578
ttcaaaaaat

SEQ ID NO: 129536 - DNA, 7 bp, Unknown
  misc_feature (1)..( 7): Result.003 file - promoters60/3435578
tcttctt

SEQ ID NO: 129537 - DNA, 7 bp, Unknown
  misc_feature (1)..( 7): Result.003 file - promoters60/3435578
tcttctt

SEQ ID NO: 129538 - DNA, 6 bp, Unknown
  misc_feature (1)..( 6): Result.003 file - promoters60/3435578
taacca

SEQ ID NO: 129539 - DNA, 6 bp, Unknown
  misc_feature (1)..( 6): Result.003 file - promoters60/3435578
taacca

SEQ ID NO: 129540 - DNA, 6 bp, Unknown
  misc_feature (1)..( 6): Result.003 file - promoters60/3435578
aacttt

SEQ ID NO: 129541 - DNA, 6 bp, Unknown
  misc_feature (1)..( 6): Result.003 file - promoters60/3435578
aacttt

SEQ ID NO: 129542 - DNA, 7 bp, Unknown
  misc_feature (1)..( 7): Result.003 file - promoters60/3435578
tatacaa

SEQ ID NO: 129543 - DNA, 7 bp, Unknown
  misc_feature (1)..( 7): Result.003 file - promoters60/3435578
tatacaa

SEQ ID NO: 129544 - DNA, 8 bp, Unknown
  misc_feature (1)..( 8): Result.003 file - promoters60/3435578
aacaaaca

SEQ ID NO: 129545 - DNA, 8 bp, Unknown
  misc_feature (1)..( 8): Result.003 file - promoters60/3435578
aactaaca

SEQ ID NO: 129546 - DNA, 6 bp, Unknown
  misc_feature (1)..( 6): Result.003 file - promoters60/3435578
atttca

SEQ ID NO: 129547 - DNA, 6 bp, Unknown
  misc_feature (1)..( 6): Result.003 file - promoters60/3435578
atttca

SEQ ID NO: 129548 - DNA, 8 bp, Unknown
  misc_feature (1)..( 8): Result.003 file - promoters60/3435578
cagctatt

SEQ ID NO: 129549 - DNA, 8 bp, Unknown
  misc_feature (1)..( 8): Result.003 file - promoters60/3435578
cagttatt

SEQ ID NO: 129550 - DNA, 7 bp, Unknown
  misc_feature (1)..( 7): Result.003 file - promoters60/3435578
attgttg

SEQ ID NO: 129551 - DNA, 7 bp, Unknown
  misc_feature (1)..( 7): Result.003 file - promoters60/3435578
atttttg

SEQ ID NO: 129552 - DNA, 8 bp, Unknown
  misc_feature (1)..( 8): Result.003 file - promoters60/3435578
catataaa

SEQ ID NO: 129553 - DNA, 8 bp, Unknown
  misc_feature (1)..( 8): Result.003 file - promoters60/3435578
cataaaaa

SEQ ID NO: 129554 - DNA, 7 bp, Unknown
  misc_feature (1)..( 7): Result.003 file - promoters60/3435578
acagatt

SEQ ID NO: 129555 - DNA, 7 bp, Unknown
  misc_feature (1)..( 7): Result.003 file - promoters60/3435578
acatatt

SEQ ID NO: 129556 - DNA, 7 bp, Unknown
  misc_feature (1)..( 7): Result.003 file - promoters60/3435578
tttagtt

SEQ ID NO: 129557 - DNA, 7 bp, Unknown
  misc_feature (1)..( 7): Result.003 file - promoters60/3435578
ttttgtt

SEQ ID NO: 129558 - DNA, 12 bp, Unknown
  misc_feature (1)..( 12): Result.003 file - promoters60/3435605
agtaatttaatg

SEQ ID NO: 129559 - DNA, 12 bp, Unknown
  misc_feature (1)..( 12): Result.003 file - promoters60/3435605
tctaattttcta

SEQ ID NO: 129560 - DNA, 12 bp, Unknown
  misc_feature (1)..( 12): Result.003 file - promoters60/3435605
agtagtttccac

SEQ ID NO: 129561 - DNA, 12 bp, Unknown
  misc_feature (1)..( 12): Result.003 file - promoters60/3435605
tcaaattaaatc

SEQ ID NO: 129562 - DNA, 12 bp, Unknown
  misc_feature (1)..( 12): Result.003 file - promoters60/3435605
taaaatttttgt

SEQ ID NO: 129563 - DNA, 12 bp, Unknown
  misc_feature (1)..( 12): Result.003 file - promoters60/3435605
gttaattgtctc

SEQ ID NO: 129564 - DNA, 12 bp, Unknown
  misc_feature (1)..( 12): Result.003 file - promoters60/3435605
tagatttaaatc

SEQ ID NO: 129565 - DNA, 12 bp, Unknown
  misc_feature (1)..( 12): Result.003 file - promoters60/3435605
aaattttaatct

SEQ ID NO: 129566 - DNA, 12 bp, Unknown
  misc_feature (1)..( 12): Result.003 file - promoters60/3435605
acattataaaat

SEQ ID NO: 129567 - DNA, 12 bp, Unknown
  misc_feature (1)..( 12): Result.003 file - promoters60/3435605
catttttattct

SEQ ID NO: 129568 - DNA, 12 bp, Unknown
  misc_feature (1)..( 12): Result.003 file - promoters60/3435605
gaattctaaaat

SEQ ID NO: 129569 - DNA, 13 bp, Unknown
  misc_feature (1)..( 13): Result.003 file - promoters60/3435605
aaggtatcaaaca

SEQ ID NO: 129570 - DNA, 13 bp, Unknown
  misc_feature (1)..( 13): Result.003 file - promoters60/3435605
acattaaaaaaat

SEQ ID NO: 129571 - DNA, 13 bp, Unknown
  misc_feature (1)..( 13): Result.003 file - promoters60/3435605
gtattctaaaaag

SEQ ID NO: 129572 - DNA, 13 bp, Unknown
  misc_feature (1)..( 13): Result.003 file - promoters60/3435605
aactttttacggc

SEQ ID NO: 129573 - DNA, 10 bp, Unknown
  misc_feature (1)..( 10): Result.003 file - promoters60/3435605
tttaattttg

SEQ ID NO: 129574 - DNA, 10 bp, Unknown
  misc_feature (1)..( 10): Result.003 file - promoters60/3435605
tttaatgaaa

SEQ ID NO: 129575 - DNA, 10 bp, Unknown
  misc_feature (1)..( 10): Result.003 file - promoters60/3435605
ttttattcta

SEQ ID NO: 129576 - DNA, 10 bp, Unknown
  misc_feature (1)..( 10): Result.003 file - promoters60/3435605
gttaatgtct

SEQ ID NO: 129577 - DNA, 10 bp, Unknown
  misc_feature (1)..( 10): Result.003 file - promoters60/3435605
attaatctca

SEQ ID NO: 129578 - DNA, 10 bp, Unknown
  misc_feature (1)..( 10): Result.003 file - promoters60/3435605
taaaatatca

SEQ ID NO: 129579 - DNA, 12 bp, Unknown
  misc_feature (1)..( 12): Result.003 file - promoters60/3435605
gacaaattacct

SEQ ID NO: 129580 - DNA, 12 bp, Unknown
  misc_feature (1)..( 12): Result.003 file - promoters60/3435605
cacaaattgttt

SEQ ID NO: 129581 - DNA, 12 bp, Unknown
  misc_feature (1)..( 12): Result.003 file - promoters60/3435605
tacaaatatgaa

SEQ ID NO: 129582 - DNA, 12 bp, Unknown
  misc_feature (1)..( 12): Result.003 file - promoters60/3435605
cacaaatttgtt

SEQ ID NO: 129583 - DNA, 12 bp, Unknown
  misc_feature (1)..( 12): Result.003 file - promoters60/3435605
attaaatatgtt

SEQ ID NO: 129584 - DNA, 12 bp, Unknown
  misc_feature (1)..( 12): Result.003 file - promoters60/3435605
ctaaaatatcaa

SEQ ID NO: 129585 - DNA, 8 bp, Unknown
  misc_feature (1)..( 8): Result.003 file - promoters60/3435605
tttcaatt

SEQ ID NO: 129586 - DNA, 8 bp, Unknown
  misc_feature (1)..( 8): Result.003 file - promoters60/3435605
gttccatt

SEQ ID NO: 129587 - DNA, 8 bp, Unknown
  misc_feature (1)..( 8): Result.003 file - promoters60/3435605
tttaaatc

SEQ ID NO: 129588 - DNA, 8 bp, Unknown
  misc_feature (1)..( 8): Result.003 file - promoters60/3435605
attaaatc

SEQ ID NO: 129589 - DNA, 8 bp, Unknown
  misc_feature (1)..( 8): Result.003 file - promoters60/3435605
attcaaac

SEQ ID NO: 129590 - DNA, 8 bp, Unknown
  misc_feature (1)..( 8): Result.003 file - promoters60/3435605
aataaatc

SEQ ID NO: 129591 - DNA, 12 bp, Unknown
  misc_feature (1)..( 12): Result.003 file - promoters60/3435605
tttaaattttaa

SEQ ID NO: 129592 - DNA, 12 bp, Unknown
  misc_feature (1)..( 12): Result.003 file - promoters60/3435605
cacaaatttgtt

SEQ ID NO: 129593 - DNA, 12 bp, Unknown
  misc_feature (1)..( 12): Result.003 file - promoters60/3435605
tatgaattctaa

SEQ ID NO: 129594 - DNA, 12 bp, Unknown
  misc_feature (1)..( 12): Result.003 file - promoters60/3435605
cacaaattgttt

SEQ ID NO: 129595 - DNA, 12 bp, Unknown
  misc_feature (1)..( 12): Result.003 file - promoters60/3435605
aaaaaatgtagt

SEQ ID NO: 129596 - DNA, 12 bp, Unknown
  misc_feature (1)..( 12): Result.003 file - promoters60/3435605
attaaatatgtt

SEQ ID NO: 129597 - DNA, 12 bp, Unknown
  misc_feature (1)..( 12): Result.003 file - promoters60/3435605
aaatgaaaaatg

SEQ ID NO: 129598 - DNA, 12 bp, Unknown
  misc_feature (1)..( 12): Result.003 file - promoters60/3435605
aaaagaaattat

SEQ ID NO: 129599 - DNA, 12 bp, Unknown
  misc_feature (1)..( 12): Result.003 file - promoters60/3435605
aaatcaaattta

SEQ ID NO: 129600 - DNA, 12 bp, Unknown
  misc_feature (1)..( 12): Result.003 file - promoters60/3435605
tctagaaattct

SEQ ID NO: 129601 - DNA, 12 bp, Unknown
  misc_feature (1)..( 12): Result.003 file - promoters60/3435605
ctatcaaaatta

SEQ ID NO: 129602 - DNA, 12 bp, Unknown
  misc_feature (1)..( 12): Result.003 file - promoters60/3435605
atcttaaattta

SEQ ID NO: 129603 - DNA, 9 bp, Unknown
  misc_feature (1)..( 9): Result.003 file - promoters60/3435620
tcataaagc

SEQ ID NO: 129604 - DNA, 9 bp, Unknown
  misc_feature (1)..( 9): Result.003 file - promoters60/3435620
tcataacta

SEQ ID NO: 129605 - DNA, 9 bp, Unknown
  misc_feature (1)..( 9): Result.003 file - promoters60/3435620
tcatagagc

SEQ ID NO: 129606 - DNA, 10 bp, Unknown
  misc_feature (1)..( 10): Result.003 file - promoters60/3435620
ttagttataa

SEQ ID NO: 129607 - DNA, 10 bp, Unknown
  misc_feature (1)..( 10): Result.003 file - promoters60/3435620
ttagttctaa

SEQ ID NO: 129608 - DNA, 10 bp, Unknown
  misc_feature (1)..( 10): Result.003 file - promoters60/3435620
ttagttccca

SEQ ID NO: 129609 - DNA, 7 bp, Unknown
  misc_feature (1)..( 7): Result.003 file - promoters60/3435620
gaaaaaa

SEQ ID NO: 129610 - DNA, 7 bp, Unknown
  misc_feature (1)..( 7): Result.003 file - promoters60/3435620
caaaaaa

SEQ ID NO: 129611 - DNA, 7 bp, Unknown
  misc_feature (1)..( 7): Result.003 file - promoters60/3435620
gaacaaa

SEQ ID NO: 129612 - DNA, 7 bp, Unknown
  misc_feature (1)..( 7): Result.003 file - promoters60/3435620
aaaaaac

SEQ ID NO: 129613 - DNA, 7 bp, Unknown
  misc_feature (1)..( 7): Result.003 file - promoters60/3435620
caaaaac

SEQ ID NO: 129614 - DNA, 7 bp, Unknown
  misc_feature (1)..( 7): Result.003 file - promoters60/3435620
caaaaaa

SEQ ID NO: 129615 - DNA, 10 bp, Unknown
  misc_feature (1)..( 10): Result.003 file - promoters60/3435620
tcatttttat

SEQ ID NO: 129616 - DNA, 10 bp, Unknown
  misc_feature (1)..( 10): Result.003 file - promoters60/3435620
tcatttgtat

SEQ ID NO: 129617 - DNA, 10 bp, Unknown
  misc_feature (1)..( 10): Result.003 file - promoters60/3435620
tcatgtgtta

SEQ ID NO: 129618 - DNA, 9 bp, Unknown
  misc_feature (1)..( 9): Result.003 file - promoters60/3435620
ataacatac

SEQ ID NO: 129619 - DNA, 9 bp, Unknown
  misc_feature (1)..( 9): Result.003 file - promoters60/3435620
ctaacgtac

SEQ ID NO: 129620 - DNA, 9 bp, Unknown
  misc_feature (1)..( 9): Result.003 file - promoters60/3435620
atatcattg

SEQ ID NO: 129621 - DNA, 14 bp, Unknown
  misc_feature (1)..( 14): Result.003 file - promoters60/3435632
ggaacaaaatcttc

SEQ ID NO: 129622 - DNA, 14 bp, Unknown
  misc_feature (1)..( 14): Result.003 file - promoters60/3435632
gaaacaaaatccaa

SEQ ID NO: 129623 - DNA, 14 bp, Unknown
  misc_feature (1)..( 14): Result.003 file - promoters60/3435632
agaaaaaaagaata

SEQ ID NO: 129624 - DNA, 14 bp, Unknown
  misc_feature (1)..( 14): Result.003 file - promoters60/3435632
tatacaaaagcttc

SEQ ID NO: 129625 - DNA, 14 bp, Unknown
  misc_feature (1)..( 14): Result.003 file - promoters60/3435632
gaaacaagttccga

SEQ ID NO: 129626 - DNA, 15 bp, Unknown
  misc_feature (1)..( 15): Result.003 file - promoters60/3435632
taaacataaaagcat

SEQ ID NO: 129627 - DNA, 15 bp, Unknown
  misc_feature (1)..( 15): Result.003 file - promoters60/3435632
acaatataaaggaac

SEQ ID NO: 129628 - DNA, 9 bp, Unknown
  misc_feature (1)..( 9): Result.003 file - promoters60/3435632
tgtgaatgt

SEQ ID NO: 129629 - DNA, 9 bp, Unknown
  misc_feature (1)..( 9): Result.003 file - promoters60/3435632
aatgaatgg

SEQ ID NO: 129630 - DNA, 9 bp, Unknown
  misc_feature (1)..( 9): Result.003 file - promoters60/3435632
tttgattgt

SEQ ID NO: 129631 - DNA, 9 bp, Unknown
  misc_feature (1)..( 9): Result.003 file - promoters60/3435632
ttttatttt

SEQ ID NO: 129632 - DNA, 9 bp, Unknown
  misc_feature (1)..( 9): Result.003 file - promoters60/3435632
atttatatt

SEQ ID NO: 129633 - DNA, 9 bp, Unknown
  misc_feature (1)..( 9): Result.003 file - promoters60/3435632
gatgagtgg

SEQ ID NO: 129634 - DNA, 9 bp, Unknown
  misc_feature (1)..( 9): Result.003 file - promoters60/3435646
tttagggaa

SEQ ID NO: 129635 - DNA, 7 bp, Unknown
  misc_feature (1)..( 7): Result.003 file - promoters60/3435646
aagggaa

SEQ ID NO: 129636 - DNA, 9 bp, Unknown
  misc_feature (1)..( 9): Result.003 file - promoters60/3435646
attatggat

SEQ ID NO: 129637 - DNA, 9 bp, Unknown
  misc_feature (1)..( 9): Result.003 file - promoters60/3435646
attgtggga

SEQ ID NO: 129638 - DNA, 7 bp, Unknown
  misc_feature (1)..( 7): Result.003 file - promoters60/3435683
cttatca

SEQ ID NO: 129639 - DNA, 7 bp, Unknown
  misc_feature (1)..( 7): Result.003 file - promoters60/3435683
cttttca

SEQ ID NO: 129640 - DNA, 7 bp, Unknown
  misc_feature (1)..( 7): Result.003 file - promoters60/3435683
caaatac

SEQ ID NO: 129641 - DNA, 7 bp, Unknown
  misc_feature (1)..( 7): Result.003 file - promoters60/3435683
caagtac

SEQ ID NO: 129642 - DNA, 8 bp, Unknown
  misc_feature (1)..( 8): Result.003 file - promoters60/3435683
ccaaaaac

SEQ ID NO: 129643 - DNA, 8 bp, Unknown
  misc_feature (1)..( 8): Result.003 file - promoters60/3435683
ccaagaac

SEQ ID NO: 129644 - DNA, 8 bp, Unknown
  misc_feature (1)..( 8): Result.003 file - promoters60/3435683
acaaagtg

SEQ ID NO: 129645 - DNA, 8 bp, Unknown
  misc_feature (1)..( 8): Result.003 file - promoters60/3435683
acaaggtg

SEQ ID NO: 129646 - DNA, 9 bp, Unknown
  misc_feature (1)..( 9): Result.003 file - promoters60/3435683
aatttgaaa

SEQ ID NO: 129647 - DNA, 9 bp, Unknown
  misc_feature (1)..( 9): Result.003 file - promoters60/3435683
aatttcaaa

SEQ ID NO: 129648 - DNA, 6 bp, Unknown
  misc_feature (1)..( 6): Result.003 file - promoters60/3435683
tgtaat

SEQ ID NO: 129649 - DNA, 6 bp, Unknown
  misc_feature (1)..( 6): Result.003 file - promoters60/3435683
tgtaat

SEQ ID NO: 129650 - DNA, 6 bp, Unknown
  misc_feature (1)..( 6): Result.003 file - promoters60/3435683
aattta

SEQ ID NO: 129651 - DNA, 6 bp, Unknown
  misc_feature (1)..( 6): Result.003 file - promoters60/3435683
aattta

SEQ ID NO: 129652 - DNA, 9 bp, Unknown
  misc_feature (1)..( 9): Result.003 file - promoters60/3435683
tgttaaaat

SEQ ID NO: 129653 - DNA, 9 bp, Unknown
  misc_feature (1)..( 9): Result.003 file - promoters60/3435683
tgttagaat

SEQ ID NO: 129654 - DNA, 7 bp, Unknown
  misc_feature (1)..( 7): Result.003 file - promoters60/3435683
tatatat

SEQ ID NO: 129655 - DNA, 7 bp, Unknown
  misc_feature (1)..( 7): Result.003 file - promoters60/3435683
tatctat

SEQ ID NO: 129656 - DNA, 6 bp, Unknown
  misc_feature (1)..( 6): Result.003 file - promoters60/3435683
ggctga

SEQ ID NO: 129657 - DNA, 6 bp, Unknown
  misc_feature (1)..( 6): Result.003 file - promoters60/3435683
ggctga

SEQ ID NO: 129658 - DNA, 11 bp, Unknown
  misc_feature (1)..( 11): Result.003 file - promoters60/3435683
aggttctcaga

SEQ ID NO: 129659 - DNA, 11 bp, Unknown
  misc_feature (1)..( 11): Result.003 file - promoters60/3435683
agggtctgaga

SEQ ID NO: 129660 - DNA, 6 bp, Unknown
  misc_feature (1)..( 6): Result.003 file - promoters60/3435683
agattt

SEQ ID NO: 129661 - DNA, 6 bp, Unknown
  misc_feature (1)..( 6): Result.003 file - promoters60/3435683
agattt

SEQ ID NO: 129662 - DNA, 12 bp, Unknown
  misc_feature (1)..( 12): Result.003 file - promoters60/3435761
caatgggctggg

SEQ ID NO: 129663 - DNA, 12 bp, Unknown
  misc_feature (1)..( 12): Result.003 file - promoters60/3435761
aaatgggcctaa

SEQ ID NO: 129664 - DNA, 12 bp, Unknown
  misc_feature (1)..( 12): Result.003 file - promoters60/3435761
aaataggcccaa

SEQ ID NO: 129665 - DNA, 12 bp, Unknown
  misc_feature (1)..( 12): Result.003 file - promoters60/3435761
tgttgggctttt

SEQ ID NO: 129666 - DNA, 12 bp, Unknown
  misc_feature (1)..( 12): Result.003 file - promoters60/3435761
aattgggctttt

SEQ ID NO: 129667 - DNA, 12 bp, Unknown
  misc_feature (1)..( 12): Result.003 file - promoters60/3435761
aaaaaggcccat

SEQ ID NO: 129668 - DNA, 6 bp, Unknown
  misc_feature (1)..( 6): Result.003 file - promoters60/3435765
ttaaac

SEQ ID NO: 129669 - DNA, 6 bp, Unknown
  misc_feature (1)..( 6): Result.003 file - promoters60/3435765
ttaaac

SEQ ID NO: 129670 - DNA, 7 bp, Unknown
  misc_feature (1)..( 7): Result.003 file - promoters60/3435765
tgttttt

SEQ ID NO: 129671 - DNA, 7 bp, Unknown
  misc_feature (1)..( 7): Result.003 file - promoters60/3435765
tgtttta

SEQ ID NO: 129672 - DNA, 7 bp, Unknown
  misc_feature (1)..( 7): Result.003 file - promoters60/3435765
agttttt

SEQ ID NO: 129673 - DNA, 9 bp, Unknown
  misc_feature (1)..( 9): Result.003 file - promoters60/3435765
gtttttaaa

SEQ ID NO: 129674 - DNA, 9 bp, Unknown
  misc_feature (1)..( 9): Result.003 file - promoters60/3435765
ttttataaa

SEQ ID NO: 129675 - DNA, 9 bp, Unknown
  misc_feature (1)..( 9): Result.003 file - promoters60/3435765
gtttttctt

SEQ ID NO: 129676 - DNA, 9 bp, Unknown
  misc_feature (1)..( 9): Result.003 file - promoters60/3435765
atacaataa

SEQ ID NO: 129677 - DNA, 9 bp, Unknown
  misc_feature (1)..( 9): Result.003 file - promoters60/3435765
ataaaataa

SEQ ID NO: 129678 - DNA, 7 bp, Unknown
  misc_feature (1)..( 7): Result.003 file - promoters60/3435765
ataagga

SEQ ID NO: 129679 - DNA, 7 bp, Unknown
  misc_feature (1)..( 7): Result.003 file - promoters60/3435765
ataggga

SEQ ID NO: 129680 - DNA, 7 bp, Unknown
  misc_feature (1)..( 7): Result.003 file - promoters60/3435765
atatatg

SEQ ID NO: 129681 - DNA, 7 bp, Unknown
  misc_feature (1)..( 7): Result.003 file - promoters60/3435765
ataaatg

SEQ ID NO: 129682 - DNA, 6 bp, Unknown
  misc_feature (1)..( 6): Result.003 file - promoters60/3435765
tatatg

SEQ ID NO: 129683 - DNA, 6 bp, Unknown
  misc_feature (1)..( 6): Result.003 file - promoters60/3435765
tatatg

SEQ ID NO: 129684 - DNA, 6 bp, Unknown
  misc_feature (1)..( 6): Result.003 file - promoters60/3435765
aaacat

SEQ ID NO: 129685 - DNA, 6 bp, Unknown
  misc_feature (1)..( 6): Result.003 file - promoters60/3435765
aaacat

SEQ ID NO: 129686 - DNA, 7 bp, Unknown
  misc_feature (1)..( 7): Result.003 file - promoters60/3435765
ttatgat

SEQ ID NO: 129687 - DNA, 7 bp, Unknown
  misc_feature (1)..( 7): Result.003 file - promoters60/3435765
ttatgat

SEQ ID NO: 129688 - DNA, 6 bp, Unknown
  misc_feature (1)..( 6): Result.003 file - promoters60/3435765
acatgt

SEQ ID NO: 129689 - DNA, 6 bp, Unknown
  misc_feature (1)..( 6): Result.003 file - promoters60/3435765
acatgt

SEQ ID NO: 129690 - DNA, 9 bp, Unknown
  misc_feature (1)..( 9): Result.003 file - promoters60/3435765
agacgatta

SEQ ID NO: 129691 - DNA, 9 bp, Unknown
  misc_feature (1)..( 9): Result.003 file - promoters60/3435765
agaagatta

SEQ ID NO: 129692 - DNA, 6 bp, Unknown
  misc_feature (1)..( 6): Result.003 file - promoters60/3435765
aatgct

SEQ ID NO: 129693 - DNA, 6 bp, Unknown
  misc_feature (1)..( 6): Result.003 file - promoters60/3435765
aatgct

SEQ ID NO: 129694 - DNA, 6 bp, Unknown
  misc_feature (1)..( 6): Result.003 file - promoters60/3435765
aatatg

SEQ ID NO: 129695 - DNA, 6 bp, Unknown
  misc_feature (1)..( 6): Result.003 file - promoters60/3435765
aatatg

SEQ ID NO: 129696 - DNA, 6 bp, Unknown
  misc_feature (1)..( 6): Result.003 file - promoters60/3435765
gagttc

SEQ ID NO: 129697 - DNA, 6 bp, Unknown
  misc_feature (1)..( 6): Result.003 file - promoters60/3435765
gagttc

SEQ ID NO: 129698 - DNA, 6 bp, Unknown
  misc_feature (1)..( 6): Result.003 file - promoters60/3435765
ccattt

SEQ ID NO: 129699 - DNA, 6 bp, Unknown
  misc_feature (1)..( 6): Result.003 file - promoters60/3435765
ccattt

SEQ ID NO: 129700 - DNA, 6 bp, Unknown
  misc_feature (1)..( 6): Result.003 file - promoters60/3435765
tgaaaa

SEQ ID NO: 129701 - DNA, 6 bp, Unknown
  misc_feature (1)..( 6): Result.003 file - promoters60/3435765
tgaaaa

SEQ ID NO: 129702 - DNA, 8 bp, Unknown
  misc_feature (1)..( 8): Result.003 file - promoters60/3435765
atgatcat

SEQ ID NO: 129703 - DNA, 8 bp, Unknown
  misc_feature (1)..( 8): Result.003 file - promoters60/3435765
atgaacat

SEQ ID NO: 129704 - DNA, 7 bp, Unknown
  misc_feature (1)..( 7): Result.003 file - promoters60/3435765
tattttg

SEQ ID NO: 129705 - DNA, 7 bp, Unknown
  misc_feature (1)..( 7): Result.003 file - promoters60/3435765
tatgttg

SEQ ID NO: 129706 - DNA, 7 bp, Unknown
  misc_feature (1)..( 7): Result.003 file - promoters60/3435765
attaaga

SEQ ID NO: 129707 - DNA, 7 bp, Unknown
  misc_feature (1)..( 7): Result.003 file - promoters60/3435765
attaaga

SEQ ID NO: 129708 - DNA, 7 bp, Unknown
  misc_feature (1)..( 7): Result.003 file - promoters60/3435765
tctcttt

SEQ ID NO: 129709 - DNA, 7 bp, Unknown
  misc_feature (1)..( 7): Result.003 file - promoters60/3435765
tctcttt

SEQ ID NO: 129710 - DNA, 7 bp, Unknown
  misc_feature (1)..( 7): Result.003 file - promoters60/3435765
aaagaaa

SEQ ID NO: 129711 - DNA, 7 bp, Unknown
  misc_feature (1)..( 7): Result.003 file - promoters60/3435765
aaacaaa

SEQ ID NO: 129712 - DNA, 6 bp, Unknown
  misc_feature (1)..( 6): Result.003 file - promoters60/3435765
tcttaa

SEQ ID NO: 129713 - DNA, 6 bp, Unknown
  misc_feature (1)..( 6): Result.003 file - promoters60/3435765
tcttaa

SEQ ID NO: 129714 - DNA, 14 bp, Unknown
  misc_feature (1)..( 14): Result.003 file - promoters60/3435819
atcggagatttgtt

SEQ ID NO: 129715 - DNA, 14 bp, Unknown
  misc_feature (1)..( 14): Result.003 file - promoters60/3435819
atcggaaattttca

SEQ ID NO: 129716 - DNA, 14 bp, Unknown
  misc_feature (1)..( 14): Result.003 file - promoters60/3435819
gatgtagattagtt

SEQ ID NO: 129717 - DNA, 9 bp, Unknown
  misc_feature (1)..( 9): Result.003 file - promoters60/3435819
cgaaagaca

SEQ ID NO: 129718 - DNA, 9 bp, Unknown
  misc_feature (1)..( 9): Result.003 file - promoters60/3435819
cgagagaat

SEQ ID NO: 129719 - DNA, 9 bp, Unknown
  misc_feature (1)..( 9): Result.003 file - promoters60/3435819
ataaaaaca

SEQ ID NO: 129720 - DNA, 10 bp, Unknown
  misc_feature (1)..( 10): Result.003 file - promoters60/3435819
acgttttagt

SEQ ID NO: 129721 - DNA, 10 bp, Unknown
  misc_feature (1)..( 10): Result.003 file - promoters60/3435819
cgatttaagt

SEQ ID NO: 129722 - DNA, 10 bp, Unknown
  misc_feature (1)..( 10): Result.003 file - promoters60/3435819
acgttatagc

SEQ ID NO: 129723 - DNA, 7 bp, Unknown
  misc_feature (1)..( 7): Result.003 file - promoters60/3435819
atttttt

SEQ ID NO: 129724 - DNA, 7 bp, Unknown
  misc_feature (1)..( 7): Result.003 file - promoters60/3435819
ctttttt

SEQ ID NO: 129725 - DNA, 7 bp, Unknown
  misc_feature (1)..( 7): Result.003 file - promoters60/3435819
atttttt

SEQ ID NO: 129726 - DNA, 11 bp, Unknown
  misc_feature (1)..( 11): Result.003 file - promoters60/3435819
ataattggttc

SEQ ID NO: 129727 - DNA, 11 bp, Unknown
  misc_feature (1)..( 11): Result.003 file - promoters60/3435819
ttaatgggttc

SEQ ID NO: 129728 - DNA, 11 bp, Unknown
  misc_feature (1)..( 11): Result.003 file - promoters60/3435819
ttaatgaaatt

SEQ ID NO: 129729 - DNA, 9 bp, Unknown
  misc_feature (1)..( 9): Result.003 file - promoters60/3435829
gaatacata

SEQ ID NO: 129730 - DNA, 9 bp, Unknown
  misc_feature (1)..( 9): Result.003 file - promoters60/3435829
gaacacaca

SEQ ID NO: 129731 - DNA, 9 bp, Unknown
  misc_feature (1)..( 9): Result.003 file - promoters60/3435829
gtatatata

SEQ ID NO: 129732 - DNA, 8 bp, Unknown
  misc_feature (1)..( 8): Result.003 file - promoters60/3435829
aatgataa

SEQ ID NO: 129733 - DNA, 8 bp, Unknown
  misc_feature (1)..( 8): Result.003 file - promoters60/3435829
aattatat

SEQ ID NO: 129734 - DNA, 8 bp, Unknown
  misc_feature (1)..( 8): Result.003 file - promoters60/3435829
aattgtat

SEQ ID NO: 129735 - DNA, 8 bp, Unknown
  misc_feature (1)..( 8): Result.003 file - promoters60/3435829
tcaaaata

SEQ ID NO: 129736 - DNA, 8 bp, Unknown
  misc_feature (1)..( 8): Result.003 file - promoters60/3435829
tcaaaatt

SEQ ID NO: 129737 - DNA, 8 bp, Unknown
  misc_feature (1)..( 8): Result.003 file - promoters60/3435829
acaatatt

SEQ ID NO: 129738 - DNA, 8 bp, Unknown
  misc_feature (1)..( 8): Result.003 file - promoters60/3435829
ataagata

SEQ ID NO: 129739 - DNA, 8 bp, Unknown
  misc_feature (1)..( 8): Result.003 file - promoters60/3435829
ctaaaata

SEQ ID NO: 129740 - DNA, 8 bp, Unknown
  misc_feature (1)..( 8): Result.003 file - promoters60/3435829
ctacaatt

SEQ ID NO: 129741 - DNA, 8 bp, Unknown
  misc_feature (1)..( 8): Result.003 file - promoters60/3435829
attaacta

SEQ ID NO: 129742 - DNA, 8 bp, Unknown
  misc_feature (1)..( 8): Result.003 file - promoters60/3435829
tctaacta

SEQ ID NO: 129743 - DNA, 8 bp, Unknown
  misc_feature (1)..( 8): Result.003 file - promoters60/3435829
attgactc

SEQ ID NO: 129744 - DNA, 11 bp, Unknown
  misc_feature (1)..( 11): Result.003 file - promoters60/3435833
ttgagaaaagt

SEQ ID NO: 129745 - DNA, 11 bp, Unknown
  misc_feature (1)..( 11): Result.003 file - promoters60/3435833
atgaaaaaata

SEQ ID NO: 129746 - DNA, 11 bp, Unknown
  misc_feature (1)..( 11): Result.003 file - promoters60/3435833
atgaaagacta

SEQ ID NO: 129747 - DNA, 11 bp, Unknown
  misc_feature (1)..( 11): Result.003 file - promoters60/3435833
attaaatataa

SEQ ID NO: 129748 - DNA, 11 bp, Unknown
  misc_feature (1)..( 11): Result.003 file - promoters60/3435833
tattaataaaa

SEQ ID NO: 129749 - DNA, 11 bp, Unknown
  misc_feature (1)..( 11): Result.003 file - promoters60/3435833
acacaatatac

SEQ ID NO: 129750 - DNA, 17 bp, Unknown
  misc_feature (1)..( 17): Result.003 file - promoters60/3435833
aaatgttaaaccggttt

SEQ ID NO: 129751 - DNA, 17 bp, Unknown
  misc_feature (1)..( 17): Result.003 file - promoters60/3435833
ttttgtcaaatgatgaa

SEQ ID NO: 129752 - DNA, 17 bp, Unknown
  misc_feature (1)..( 17): Result.003 file - promoters60/3435833
gcccattaaaccatttt

SEQ ID NO: 129753 - DNA, 17 bp, Unknown
  misc_feature (1)..( 17): Result.003 file - promoters60/3435833
catgattaaattgaaca

SEQ ID NO: 129754 - DNA, 17 bp, Unknown
  misc_feature (1)..( 17): Result.003 file - promoters60/3435833
aaagattaaacaaacga

SEQ ID NO: 129755 - DNA, 17 bp, Unknown
  misc_feature (1)..( 17): Result.003 file - promoters60/3435833
ttttatcaaaaaaacac

SEQ ID NO: 129756 - DNA, 17 bp, Unknown
  misc_feature (1)..( 17): Result.003 file - promoters60/3435833
gaacacaaaagaataaa

SEQ ID NO: 129757 - DNA, 13 bp, Unknown
  misc_feature (1)..( 13): Result.003 file - promoters60/3435833
gagtgacaaaggt

SEQ ID NO: 129758 - DNA, 13 bp, Unknown
  misc_feature (1)..( 13): Result.003 file - promoters60/3435833
aattgacaaaaac

SEQ ID NO: 129759 - DNA, 13 bp, Unknown
  misc_feature (1)..( 13): Result.003 file - promoters60/3435833
ttatgaaaaaaaa

SEQ ID NO: 129760 - DNA, 13 bp, Unknown
  misc_feature (1)..( 13): Result.003 file - promoters60/3435833
atatgataaaaaa

SEQ ID NO: 129761 - DNA, 13 bp, Unknown
  misc_feature (1)..( 13): Result.003 file - promoters60/3435833
ttaggaaagccag

SEQ ID NO: 129762 - DNA, 13 bp, Unknown
  misc_feature (1)..( 13): Result.003 file - promoters60/3435833
ctttgacaatgat

SEQ ID NO: 129763 - DNA, 13 bp, Unknown
  misc_feature (1)..( 13): Result.003 file - promoters60/3435833
ttccaaaaataaa

SEQ ID NO: 129764 - DNA, 11 bp, Unknown
  misc_feature (1)..( 11): Result.003 file - promoters60/3435833
catgattaaat

SEQ ID NO: 129765 - DNA, 11 bp, Unknown
  misc_feature (1)..( 11): Result.003 file - promoters60/3435833
gttgatttaat

SEQ ID NO: 129766 - DNA, 11 bp, Unknown
  misc_feature (1)..( 11): Result.003 file - promoters60/3435833
aatgatgaaat

SEQ ID NO: 129767 - DNA, 11 bp, Unknown
  misc_feature (1)..( 11): Result.003 file - promoters60/3435833
gcccattaaac

SEQ ID NO: 129768 - DNA, 11 bp, Unknown
  misc_feature (1)..( 11): Result.003 file - promoters60/3435833
aaagattaaac

SEQ ID NO: 129769 - DNA, 11 bp, Unknown
  misc_feature (1)..( 11): Result.003 file - promoters60/3435833
aaagaataaat

SEQ ID NO: 129770 - DNA, 10 bp, Unknown
  misc_feature (1)..( 10): Result.003 file - promoters60/3435833
aaattttcat

SEQ ID NO: 129771 - DNA, 10 bp, Unknown
  misc_feature (1)..( 10): Result.003 file - promoters60/3435833
ttttttgcat

SEQ ID NO: 129772 - DNA, 10 bp, Unknown
  misc_feature (1)..( 10): Result.003 file - promoters60/3435833
cctttttcat

SEQ ID NO: 129773 - DNA, 10 bp, Unknown
  misc_feature (1)..( 10): Result.003 file - promoters60/3435833
aaatcttcta

SEQ ID NO: 129774 - DNA, 10 bp, Unknown
  misc_feature (1)..( 10): Result.003 file - promoters60/3435833
catttttcta

SEQ ID NO: 129775 - DNA, 10 bp, Unknown
  misc_feature (1)..( 10): Result.003 file - promoters60/3435833
aatttttgct

SEQ ID NO: 129776 - DNA, 8 bp, Unknown
  misc_feature (1)..( 8): Result.003 file - promoters60/3435891
aattcaac

SEQ ID NO: 129777 - DNA, 8 bp, Unknown
  misc_feature (1)..( 8): Result.003 file - promoters60/3435891
aatgcaac

SEQ ID NO: 129778 - DNA, 6 bp, Unknown
  misc_feature (1)..( 6): Result.003 file - promoters60/3435891
aaattt

SEQ ID NO: 129779 - DNA, 6 bp, Unknown
  misc_feature (1)..( 6): Result.003 file - promoters60/3435891
aaattt

SEQ ID NO: 129780 - DNA, 10 bp, Unknown
  misc_feature (1)..( 10): Result.003 file - promoters60/3435891
tgttttcact

SEQ ID NO: 129781 - DNA, 10 bp, Unknown
  misc_feature (1)..( 10): Result.003 file - promoters60/3435891
taattttact

SEQ ID NO: 129782 - DNA, 10 bp, Unknown
  misc_feature (1)..( 10): Result.003 file - promoters60/3435891
tgtattcacc

SEQ ID NO: 129783 - DNA, 7 bp, Unknown
  misc_feature (1)..( 7): Result.003 file - promoters60/3435891
gttaata

SEQ ID NO: 129784 - DNA, 7 bp, Unknown
  misc_feature (1)..( 7): Result.003 file - promoters60/3435891
gttaata

SEQ ID NO: 129785 - DNA, 9 bp, Unknown
  misc_feature (1)..( 9): Result.003 file - promoters60/3435891
aactcttta

SEQ ID NO: 129786 - DNA, 9 bp, Unknown
  misc_feature (1)..( 9): Result.003 file - promoters60/3435891
aactttttt

SEQ ID NO: 129787 - DNA, 10 bp, Unknown
  misc_feature (1)..( 10): Result.003 file - promoters60/3435891
tgttttatta

SEQ ID NO: 129788 - DNA, 6 bp, Unknown
  misc_feature (1)..( 6): Result.003 file - promoters60/3435891
caaaaa

SEQ ID NO: 129789 - DNA, 6 bp, Unknown
  misc_feature (1)..( 6): Result.003 file - promoters60/3435891
caaaaa

SEQ ID NO: 129790 - DNA, 7 bp, Unknown
  misc_feature (1)..( 7): Result.003 file - promoters60/3435891
tttattg

SEQ ID NO: 129791 - DNA, 7 bp, Unknown
  misc_feature (1)..( 7): Result.003 file - promoters60/3435891
tttatta

SEQ ID NO: 129792 - DNA, 7 bp, Unknown
  misc_feature (1)..( 7): Result.003 file - promoters60/3435891
tttttta

SEQ ID NO: 129793 - DNA, 7 bp, Unknown
  misc_feature (1)..( 7): Result.003 file - promoters60/3435891
tgaaatt

SEQ ID NO: 129794 - DNA, 7 bp, Unknown
  misc_feature (1)..( 7): Result.003 file - promoters60/3435891
tgatatt

SEQ ID NO: 129795 - DNA, 6 bp, Unknown
  misc_feature (1)..( 6): Result.003 file - promoters60/3435891
aagttg

SEQ ID NO: 129796 - DNA, 6 bp, Unknown
  misc_feature (1)..( 6): Result.003 file - promoters60/3435891
aagttg

SEQ ID NO: 129797 - DNA, 8 bp, Unknown
  misc_feature (1)..( 8): Result.003 file - promoters60/3435891
attactat

SEQ ID NO: 129798 - DNA, 8 bp, Unknown
  misc_feature (1)..( 8): Result.003 file - promoters60/3435891
attgctat

SEQ ID NO: 129799 - DNA, 6 bp, Unknown
  misc_feature (1)..( 6): Result.003 file - promoters60/3435891
taattc

SEQ ID NO: 129800 - DNA, 6 bp, Unknown
  misc_feature (1)..( 6): Result.003 file - promoters60/3435891
taattc

SEQ ID NO: 129801 - DNA, 8 bp, Unknown
  misc_feature (1)..( 8): Result.003 file - promoters60/3435891
tgtctaag

SEQ ID NO: 129802 - DNA, 8 bp, Unknown
  misc_feature (1)..( 8): Result.003 file - promoters60/3435891
tgtcaaag

SEQ ID NO: 129803 - DNA, 7 bp, Unknown
  misc_feature (1)..( 7): Result.003 file - promoters60/3435891
aaaaaaa

SEQ ID NO: 129804 - DNA, 7 bp, Unknown
  misc_feature (1)..( 7): Result.003 file - promoters60/3435891
aaacaaa

SEQ ID NO: 129805 - DNA, 6 bp, Unknown
  misc_feature (1)..( 6): Result.003 file - promoters60/3435891
tgtcga

SEQ ID NO: 129806 - DNA, 6 bp, Unknown
  misc_feature (1)..( 6): Result.003 file - promoters60/3435891
tgtcga

SEQ ID NO: 129807 - DNA, 7 bp, Unknown
  misc_feature (1)..( 7): Result.003 file - promoters60/3435891
tttactt

SEQ ID NO: 129808 - DNA, 7 bp, Unknown
  misc_feature (1)..( 7): Result.003 file - promoters60/3435891
tttgctt

SEQ ID NO: 129809 - DNA, 6 bp, Unknown
  misc_feature (1)..( 6): Result.003 file - promoters60/3435891
ttgtac

SEQ ID NO: 129810 - DNA, 6 bp, Unknown
  misc_feature (1)..( 6): Result.003 file - promoters60/3435891
ttgtac

SEQ ID NO: 129811 - DNA, 10 bp, Unknown
  misc_feature (1)..( 10): Result.003 file - promoters60/3435902
attgctaata

SEQ ID NO: 129812 - DNA, 10 bp, Unknown
  misc_feature (1)..( 10): Result.003 file - promoters60/3435902
attgcaaata

SEQ ID NO: 129813 - DNA, 6 bp, Unknown
  misc_feature (1)..( 6): Result.003 file - promoters60/3435902
tcttcc

SEQ ID NO: 129814 - DNA, 6 bp, Unknown
  misc_feature (1)..( 6): Result.003 file - promoters60/3435902
tcttcc

SEQ ID NO: 129815 - DNA, 6 bp, Unknown
  misc_feature (1)..( 6): Result.003 file - promoters60/3435902
aagaaa

SEQ ID NO: 129816 - DNA, 6 bp, Unknown
  misc_feature (1)..( 6): Result.003 file - promoters60/3435902
aagaaa

SEQ ID NO: 129817 - DNA, 6 bp, Unknown
  misc_feature (1)..( 6): Result.003 file - promoters60/3435902
ttgcta

SEQ ID NO: 129818 - DNA, 6 bp, Unknown
  misc_feature (1)..( 6): Result.003 file - promoters60/3435902
ttgcta

SEQ ID NO: 129819 - DNA, 6 bp, Unknown
  misc_feature (1)..( 6): Result.003 file - promoters60/3435902
tctgta

SEQ ID NO: 129820 - DNA, 6 bp, Unknown
  misc_feature (1)..( 6): Result.003 file - promoters60/3435902
tctgta

SEQ ID NO: 129821 - DNA, 8 bp, Unknown
  misc_feature (1)..( 8): Result.003 file - promoters60/3435902
acattttt

SEQ ID NO: 129822 - DNA, 8 bp, Unknown
  misc_feature (1)..( 8): Result.003 file - promoters60/3435902
acatcttt

SEQ ID NO: 129823 - DNA, 6 bp, Unknown
  misc_feature (1)..( 6): Result.003 file - promoters60/3435902
atagta

SEQ ID NO: 129824 - DNA, 6 bp, Unknown
  misc_feature (1)..( 6): Result.003 file - promoters60/3435902
atagta

SEQ ID NO: 129825 - DNA, 9 bp, Unknown
  misc_feature (1)..( 9): Result.003 file - promoters60/3435902
tattcgcat

SEQ ID NO: 129826 - DNA, 9 bp, Unknown
  misc_feature (1)..( 9): Result.003 file - promoters60/3435902
tattcccat

SEQ ID NO: 129827 - DNA, 6 bp, Unknown
  misc_feature (1)..( 6): Result.003 file - promoters60/3435902
tgcaat

SEQ ID NO: 129828 - DNA, 6 bp, Unknown
  misc_feature (1)..( 6): Result.003 file - promoters60/3435902
tgcaat

SEQ ID NO: 129829 - DNA, 8 bp, Unknown
  misc_feature (1)..( 8): Result.003 file - promoters60/3435902
taatttac

SEQ ID NO: 129830 - DNA, 8 bp, Unknown
  misc_feature (1)..( 8): Result.003 file - promoters60/3435902
taaattac

SEQ ID NO: 129831 - DNA, 6 bp, Unknown
  misc_feature (1)..( 6): Result.003 file - promoters60/3435902
aaatat

SEQ ID NO: 129832 - DNA, 6 bp, Unknown
  misc_feature (1)..( 6): Result.003 file - promoters60/3435902
aaatat

SEQ ID NO: 129833 - DNA, 9 bp, Unknown
  misc_feature (1)..( 9): Result.003 file - promoters60/3435902
ataattttt

SEQ ID NO: 129834 - DNA, 9 bp, Unknown
  misc_feature (1)..( 9): Result.003 file - promoters60/3435902
ataatgttt

SEQ ID NO: 129835 - DNA, 7 bp, Unknown
  misc_feature (1)..( 7): Result.003 file - promoters60/3435902
atagata

SEQ ID NO: 129836 - DNA, 7 bp, Unknown
  misc_feature (1)..( 7): Result.003 file - promoters60/3435902
atatata

SEQ ID NO: 129837 - DNA, 7 bp, Unknown
  misc_feature (1)..( 7): Result.003 file - promoters60/3435902
atgtaat

SEQ ID NO: 129838 - DNA, 7 bp, Unknown
  misc_feature (1)..( 7): Result.003 file - promoters60/3435902
atggaat

SEQ ID NO: 129839 - DNA, 7 bp, Unknown
  misc_feature (1)..( 7): Result.003 file - promoters60/3435902
acctaat

SEQ ID NO: 129840 - DNA, 7 bp, Unknown
  misc_feature (1)..( 7): Result.003 file - promoters60/3435902
accaaat

SEQ ID NO: 129841 - DNA, 6 bp, Unknown
  misc_feature (1)..( 6): Result.003 file - promoters60/3435902
tattat

SEQ ID NO: 129842 - DNA, 6 bp, Unknown
  misc_feature (1)..( 6): Result.003 file - promoters60/3435902
tattat

SEQ ID NO: 129843 - DNA, 6 bp, Unknown
  misc_feature (1)..( 6): Result.003 file - promoters60/3435902
aaaaaa

SEQ ID NO: 129844 - DNA, 6 bp, Unknown
  misc_feature (1)..( 6): Result.003 file - promoters60/3435902
aaaaaa

SEQ ID NO: 129845 - DNA, 6 bp, Unknown
  misc_feature (1)..( 6): Result.003 file - promoters60/3435902
gtcaaa

SEQ ID NO: 129846 - DNA, 6 bp, Unknown
  misc_feature (1)..( 6): Result.003 file - promoters60/3435902
gtcaaa

SEQ ID NO: 129847 - DNA, 6 bp, Unknown
  misc_feature (1)..( 6): Result.003 file - promoters60/3435902
ggcgag

SEQ ID NO: 129848 - DNA, 6 bp, Unknown
  misc_feature (1)..( 6): Result.003 file - promoters60/3435902
ggcgag

SEQ ID NO: 129849 - DNA, 6 bp, Unknown
  misc_feature (1)..( 6): Result.003 file - promoters60/3436121
tttaag

SEQ ID NO: 129850 - DNA, 6 bp, Unknown
  misc_feature (1)..( 6): Result.003 file - promoters60/3436121
tttaag

SEQ ID NO: 129851 - DNA, 6 bp, Unknown
  misc_feature (1)..( 6): Result.003 file - promoters60/3436121
ttcttt

SEQ ID NO: 129852 - DNA, 6 bp, Unknown
  misc_feature (1)..( 6): Result.003 file - promoters60/3436121
ttcttt

SEQ ID NO: 129853 - DNA, 7 bp, Unknown
  misc_feature (1)..( 7): Result.003 file - promoters60/3436121
tctttat

SEQ ID NO: 129854 - DNA, 7 bp, Unknown
  misc_feature (1)..( 7): Result.003 file - promoters60/3436121
tctctat

SEQ ID NO: 129855 - DNA, 6 bp, Unknown
  misc_feature (1)..( 6): Result.003 file - promoters60/3436121
ctgtgt

SEQ ID NO: 129856 - DNA, 6 bp, Unknown
  misc_feature (1)..( 6): Result.003 file - promoters60/3436121
ctgtgt

SEQ ID NO: 129857 - DNA, 6 bp, Unknown
  misc_feature (1)..( 6): Result.003 file - promoters60/3436121
gagaag

SEQ ID NO: 129858 - DNA, 6 bp, Unknown
  misc_feature (1)..( 6): Result.003 file - promoters60/3436121
gagaag

SEQ ID NO: 129859 - DNA, 6 bp, Unknown
  misc_feature (1)..( 6): Result.003 file - promoters60/3436121
aagaaa

SEQ ID NO: 129860 - DNA, 6 bp, Unknown
  misc_feature (1)..( 6): Result.003 file - promoters60/3436121
aagaaa

SEQ ID NO: 129861 - DNA, 8 bp, Unknown
  misc_feature (1)..( 8): Result.003 file - promoters60/3436121
cacataaa

SEQ ID NO: 129862 - DNA, 8 bp, Unknown
  misc_feature (1)..( 8): Result.003 file - promoters60/3436121
cacgtaaa

SEQ ID NO: 129863 - DNA, 7 bp, Unknown
  misc_feature (1)..( 7): Result.003 file - promoters60/3436121
tcttttt

SEQ ID NO: 129864 - DNA, 7 bp, Unknown
  misc_feature (1)..( 7): Result.003 file - promoters60/3436121
tctgttt

SEQ ID NO: 129865 - DNA, 6 bp, Unknown
  misc_feature (1)..( 6): Result.003 file - promoters60/3436121
atgtct

SEQ ID NO: 129866 - DNA, 6 bp, Unknown
  misc_feature (1)..( 6): Result.003 file - promoters60/3436121
atgtct

SEQ ID NO: 129867 - DNA, 7 bp, Unknown
  misc_feature (1)..( 7): Result.003 file - promoters60/3436121
ttggaga

SEQ ID NO: 129868 - DNA, 7 bp, Unknown
  misc_feature (1)..( 7): Result.003 file - promoters60/3436121
ttggaga

SEQ ID NO: 129869 - DNA, 6 bp, Unknown
  misc_feature (1)..( 6): Result.003 file - promoters60/3436121
gaagat

SEQ ID NO: 129870 - DNA, 6 bp, Unknown
  misc_feature (1)..( 6): Result.003 file - promoters60/3436121
gaagat

SEQ ID NO: 129871 - DNA, 6 bp, Unknown
  misc_feature (1)..( 6): Result.003 file - promoters60/3436121
gatcga

SEQ ID NO: 129872 - DNA, 6 bp, Unknown
  misc_feature (1)..( 6): Result.003 file - promoters60/3436121
gatcga

SEQ ID NO: 129873 - DNA, 6 bp, Unknown
  misc_feature (1)..( 6): Result.003 file - promoters60/3436121
aaatgc

SEQ ID NO: 129874 - DNA, 6 bp, Unknown
  misc_feature (1)..( 6): Result.003 file - promoters60/3436121
aaatgc

SEQ ID NO: 129875 - DNA, 8 bp, Unknown
  misc_feature (1)..( 8): Result.003 file - promoters60/3436121
ggatttgt

SEQ ID NO: 129876 - DNA, 8 bp, Unknown
  misc_feature (1)..( 8): Result.003 file - promoters60/3436121
ggacttgt

SEQ ID NO: 129877 - DNA, 10 bp, Unknown
  misc_feature (1)..( 10): Result.003 file - promoters60/3436196
cccaaaaata

SEQ ID NO: 129878 - DNA, 10 bp, Unknown
  misc_feature (1)..( 10): Result.003 file - promoters60/3436196
ctaaaaaatc

SEQ ID NO: 129879 - DNA, 10 bp, Unknown
  misc_feature (1)..( 10): Result.003 file - promoters60/3436196
aataaacata

SEQ ID NO: 129880 - DNA, 10 bp, Unknown
  misc_feature (1)..( 10): Result.003 file - promoters60/3436196
cccacaaaca

SEQ ID NO: 129881 - DNA, 10 bp, Unknown
  misc_feature (1)..( 10): Result.003 file - promoters60/3436196
cattaaaata

SEQ ID NO: 129882 - DNA, 11 bp, Unknown
  misc_feature (1)..( 11): Result.003 file - promoters60/3436196
cggaaactata

SEQ ID NO: 129883 - DNA, 10 bp, Unknown
  misc_feature (1)..( 10): Result.003 file - promoters60/3436196
taagattagt

SEQ ID NO: 129884 - DNA, 10 bp, Unknown
  misc_feature (1)..( 10): Result.003 file - promoters60/3436196
taaaattccc

SEQ ID NO: 129885 - DNA, 10 bp, Unknown
  misc_feature (1)..( 10): Result.003 file - promoters60/3436196
taaaattttt

SEQ ID NO: 129886 - DNA, 10 bp, Unknown
  misc_feature (1)..( 10): Result.003 file - promoters60/3436196
agaaattctc

SEQ ID NO: 129887 - DNA, 10 bp, Unknown
  misc_feature (1)..( 10): Result.003 file - promoters60/3436196
caaaattgac

SEQ ID NO: 129888 - DNA, 10 bp, Unknown
  misc_feature (1)..( 10): Result.003 file - promoters60/3436196
aacaattcta

SEQ ID NO: 129889 - DNA, 10 bp, Unknown
  misc_feature (1)..( 10): Result.003 file - promoters60/3436196
cgaaatggac

SEQ ID NO: 129890 - DNA, 9 bp, Unknown
  misc_feature (1)..( 9): Result.003 file - promoters60/3436196
gatttattt

SEQ ID NO: 129891 - DNA, 9 bp, Unknown
  misc_feature (1)..( 9): Result.003 file - promoters60/3436196
aattcattt

SEQ ID NO: 129892 - DNA, 10 bp, Unknown
  misc_feature (1)..( 10): Result.003 file - promoters60/3436196
aaccttattt

SEQ ID NO: 129893 - DNA, 9 bp, Unknown
  misc_feature (1)..( 9): Result.003 file - promoters60/3436196
tttttattc

SEQ ID NO: 129894 - DNA, 9 bp, Unknown
  misc_feature (1)..( 9): Result.003 file - promoters60/3436196
cattcatcc

SEQ ID NO: 129895 - DNA, 10 bp, Unknown
  misc_feature (1)..( 10): Result.003 file - promoters60/3436196
tattctattt

SEQ ID NO: 129896 - DNA, 10 bp, Unknown
  misc_feature (1)..( 10): Result.003 file - promoters60/3436196
tcgtttattt

SEQ ID NO: 129897 - DNA, 8 bp, Unknown
  misc_feature (1)..( 8): Result.003 file - promoters60/3436265
taaacttt

SEQ ID NO: 129898 - DNA, 8 bp, Unknown
  misc_feature (1)..( 8): Result.003 file - promoters60/3436265
taaacttc

SEQ ID NO: 129899 - DNA, 8 bp, Unknown
  misc_feature (1)..( 8): Result.003 file - promoters60/3436265
caaacttt

SEQ ID NO: 129900 - DNA, 8 bp, Unknown
  misc_feature (1)..( 8): Result.003 file - promoters60/3436265
gaaagttt

SEQ ID NO: 129901 - DNA, 10 bp, Unknown
  misc_feature (1)..( 10): Result.003 file - promoters60/3436265
ttttttattt

SEQ ID NO: 129902 - DNA, 10 bp, Unknown
  misc_feature (1)..( 10): Result.003 file - promoters60/3436265
tcaattattt

SEQ ID NO: 129903 - DNA, 10 bp, Unknown
  misc_feature (1)..( 10): Result.003 file - promoters60/3436265
tcaattattg

SEQ ID NO: 129904 - DNA, 9 bp, Unknown
  misc_feature (1)..( 9): Result.003 file - promoters60/3436265
atttataaa

SEQ ID NO: 129905 - DNA, 9 bp, Unknown
  misc_feature (1)..( 9): Result.003 file - promoters60/3436265
attaataat

SEQ ID NO: 129906 - DNA, 9 bp, Unknown
  misc_feature (1)..( 9): Result.003 file - promoters60/3436265
ctcaataat

SEQ ID NO: 129907 - DNA, 9 bp, Unknown
  misc_feature (1)..( 9): Result.003 file - promoters60/3436265
cttttttaa

SEQ ID NO: 129908 - DNA, 9 bp, Unknown
  misc_feature (1)..( 9): Result.003 file - promoters60/3436265
cttctttgt

SEQ ID NO: 129909 - DNA, 9 bp, Unknown
  misc_feature (1)..( 9): Result.003 file - promoters60/3436265
attctatgt

SEQ ID NO: 129910 - DNA, 12 bp, Unknown
  misc_feature (1)..( 12): Result.003 file - promoters60/3436265
tatcaaatttta

SEQ ID NO: 129911 - DNA, 12 bp, Unknown
  misc_feature (1)..( 12): Result.003 file - promoters60/3436265
taagaaatatta

SEQ ID NO: 129912 - DNA, 12 bp, Unknown
  misc_feature (1)..( 12): Result.003 file - promoters60/3436265
taaaaaatatct

SEQ ID NO: 129913 - DNA, 8 bp, Unknown
  misc_feature (1)..( 8): Result.003 file - promoters60/3436265
tatagtat

SEQ ID NO: 129914 - DNA, 8 bp, Unknown
  misc_feature (1)..( 8): Result.003 file - promoters60/3436265
aataatat

SEQ ID NO: 129915 - DNA, 8 bp, Unknown
  misc_feature (1)..( 8): Result.003 file - promoters60/3436265
aataatgt

SEQ ID NO: 129916 - DNA, 13 bp, Unknown
  misc_feature (1)..( 13): Result.003 file - promoters60/3436267
gttcttatcactg

SEQ ID NO: 129917 - DNA, 13 bp, Unknown
  misc_feature (1)..( 13): Result.003 file - promoters60/3436267
attcttaatttca

SEQ ID NO: 129918 - DNA, 13 bp, Unknown
  misc_feature (1)..( 13): Result.003 file - promoters60/3436267
atttttattttca

SEQ ID NO: 129919 - DNA, 14 bp, Unknown
  misc_feature (1)..( 14): Result.003 file - promoters60/3436267
gatcttgatttaga

SEQ ID NO: 129920 - DNA, 6 bp, Unknown
  misc_feature (1)..( 6): Result.003 file - promoters60/3436412
ttgtat

SEQ ID NO: 129921 - DNA, 6 bp, Unknown
  misc_feature (1)..( 6): Result.003 file - promoters60/3436412
ttgtat

SEQ ID NO: 129922 - DNA, 7 bp, Unknown
  misc_feature (1)..( 7): Result.003 file - promoters60/3436412
cactgtc

SEQ ID NO: 129923 - DNA, 7 bp, Unknown
  misc_feature (1)..( 7): Result.003 file - promoters60/3436412
cacggtc

SEQ ID NO: 129924 - DNA, 6 bp, Unknown
  misc_feature (1)..( 6): Result.003 file - promoters60/3436412
tctgaa

SEQ ID NO: 129925 - DNA, 6 bp, Unknown
  misc_feature (1)..( 6): Result.003 file - promoters60/3436412
tctgaa

SEQ ID NO: 129926 - DNA, 6 bp, Unknown
  misc_feature (1)..( 6): Result.003 file - promoters60/3436412
ggttta

SEQ ID NO: 129927 - DNA, 6 bp, Unknown
  misc_feature (1)..( 6): Result.003 file - promoters60/3436412
ggttta

SEQ ID NO: 129928 - DNA, 6 bp, Unknown
  misc_feature (1)..( 6): Result.003 file - promoters60/3436412
ttgact

SEQ ID NO: 129929 - DNA, 6 bp, Unknown
  misc_feature (1)..( 6): Result.003 file - promoters60/3436412
ttgact

SEQ ID NO: 129930 - DNA, 6 bp, Unknown
  misc_feature (1)..( 6): Result.003 file - promoters60/3436412
ggctgt

SEQ ID NO: 129931 - DNA, 6 bp, Unknown
  misc_feature (1)..( 6): Result.003 file - promoters60/3436412
ggctgt

SEQ ID NO: 129932 - DNA, 7 bp, Unknown
  misc_feature (1)..( 7): Result.003 file - promoters60/3436412
attgaaa

SEQ ID NO: 129933 - DNA, 7 bp, Unknown
  misc_feature (1)..( 7): Result.003 file - promoters60/3436412
attaaaa

SEQ ID NO: 129934 - DNA, 6 bp, Unknown
  misc_feature (1)..( 6): Result.003 file - promoters60/3436412
tgaatt

SEQ ID NO: 129935 - DNA, 6 bp, Unknown
  misc_feature (1)..( 6): Result.003 file - promoters60/3436412
tgaatt

SEQ ID NO: 129936 - DNA, 7 bp, Unknown
  misc_feature (1)..( 7): Result.003 file - promoters60/3436412
aaagcta

SEQ ID NO: 129937 - DNA, 7 bp, Unknown
  misc_feature (1)..( 7): Result.003 file - promoters60/3436412
aaatcta

SEQ ID NO: 129938 - DNA, 7 bp, Unknown
  misc_feature (1)..( 7): Result.003 file - promoters60/3436412
gatgaac

SEQ ID NO: 129939 - DNA, 7 bp, Unknown
  misc_feature (1)..( 7): Result.003 file - promoters60/3436412
gatcaac

SEQ ID NO: 129940 - DNA, 7 bp, Unknown
  misc_feature (1)..( 7): Result.003 file - promoters60/3436412
atacaat

SEQ ID NO: 129941 - DNA, 7 bp, Unknown
  misc_feature (1)..( 7): Result.003 file - promoters60/3436412
atataat

SEQ ID NO: 129942 - DNA, 16 bp, Unknown
  misc_feature (1)..( 16): Result.003 file - promoters60/3436412
agaaaacgaattaaat

SEQ ID NO: 129943 - DNA, 16 bp, Unknown
  misc_feature (1)..( 16): Result.003 file - promoters60/3436412
agaaaactaattaaat

SEQ ID NO: 129944 - DNA, 7 bp, Unknown
  misc_feature (1)..( 7): Result.003 file - promoters60/3436412
attgtat

SEQ ID NO: 129945 - DNA, 7 bp, Unknown
  misc_feature (1)..( 7): Result.003 file - promoters60/3436412
attttat

SEQ ID NO: 129946 - DNA, 6 bp, Unknown
  misc_feature (1)..( 6): Result.003 file - promoters60/3436412
aaccac

SEQ ID NO: 129947 - DNA, 6 bp, Unknown
  misc_feature (1)..( 6): Result.003 file - promoters60/3436412
aaccac

SEQ ID NO: 129948 - DNA, 8 bp, Unknown
  misc_feature (1)..( 8): Result.003 file - promoters60/3436412
cctggatt

SEQ ID NO: 129949 - DNA, 8 bp, Unknown
  misc_feature (1)..( 8): Result.003 file - promoters60/3436412
ccttgatt

SEQ ID NO: 129950 - DNA, 7 bp, Unknown
  misc_feature (1)..( 7): Result.003 file - promoters60/3436412
aaatgat

SEQ ID NO: 129951 - DNA, 7 bp, Unknown
  misc_feature (1)..( 7): Result.003 file - promoters60/3436412
aaaagat

SEQ ID NO: 129952 - DNA, 14 bp, Unknown
  misc_feature (1)..( 14): Result.003 file - promoters60/3436481
cacatacaaacgca

SEQ ID NO: 129953 - DNA, 14 bp, Unknown
  misc_feature (1)..( 14): Result.003 file - promoters60/3436481
tacatacagatcca

SEQ ID NO: 129954 - DNA, 14 bp, Unknown
  misc_feature (1)..( 14): Result.003 file - promoters60/3436481
gtcatagaaaaatt

SEQ ID NO: 129955 - DNA, 14 bp, Unknown
  misc_feature (1)..( 14): Result.003 file - promoters60/3436481
aacacacagaatcc

SEQ ID NO: 129956 - DNA, 14 bp, Unknown
  misc_feature (1)..( 14): Result.003 file - promoters60/3436481
tacataattgtcta

SEQ ID NO: 129957 - DNA, 14 bp, Unknown
  misc_feature (1)..( 14): Result.003 file - promoters60/3436481
ggtgaagaagaatt

SEQ ID NO: 129958 - DNA, 11 bp, Unknown
  misc_feature (1)..( 11): Result.003 file - promoters60/3436481
tatataaaaaa

SEQ ID NO: 129959 - DNA, 11 bp, Unknown
  misc_feature (1)..( 11): Result.003 file - promoters60/3436481
tttataaatgt

SEQ ID NO: 129960 - DNA, 11 bp, Unknown
  misc_feature (1)..( 11): Result.003 file - promoters60/3436481
acaataacaaa

SEQ ID NO: 129961 - DNA, 11 bp, Unknown
  misc_feature (1)..( 11): Result.003 file - promoters60/3436481
tatatacaaaa

SEQ ID NO: 129962 - DNA, 11 bp, Unknown
  misc_feature (1)..( 11): Result.003 file - promoters60/3436481
agaataaaaac

SEQ ID NO: 129963 - DNA, 11 bp, Unknown
  misc_feature (1)..( 11): Result.003 file - promoters60/3436481
tatttactttg

SEQ ID NO: 129964 - DNA, 9 bp, Unknown
  misc_feature (1)..( 9): Result.003 file - promoters60/3436481
aactaaaac

SEQ ID NO: 129965 - DNA, 9 bp, Unknown
  misc_feature (1)..( 9): Result.003 file - promoters60/3436481
aacaaaaaa

SEQ ID NO: 129966 - DNA, 9 bp, Unknown
  misc_feature (1)..( 9): Result.003 file - promoters60/3436481
cactaaaaa

SEQ ID NO: 129967 - DNA, 9 bp, Unknown
  misc_feature (1)..( 9): Result.003 file - promoters60/3436481
cacacaaag

SEQ ID NO: 129968 - DNA, 9 bp, Unknown
  misc_feature (1)..( 9): Result.003 file - promoters60/3436481
tacaaaata

SEQ ID NO: 129969 - DNA, 9 bp, Unknown
  misc_feature (1)..( 9): Result.003 file - promoters60/3436481
tgctaaaaa

SEQ ID NO: 129970 - DNA, 8 bp, Unknown
  misc_feature (1)..( 8): Result.003 file - promoters60/3436529
cttacaaa

SEQ ID NO: 129971 - DNA, 8 bp, Unknown
  misc_feature (1)..( 8): Result.003 file - promoters60/3436529
cttccaaa

SEQ ID NO: 129972 - DNA, 8 bp, Unknown
  misc_feature (1)..( 8): Result.003 file - promoters60/3436529
gatccaaa

SEQ ID NO: 129973 - DNA, 10 bp, Unknown
  misc_feature (1)..( 10): Result.003 file - promoters60/3436529
aaactaaaac

SEQ ID NO: 129974 - DNA, 10 bp, Unknown
  misc_feature (1)..( 10): Result.003 file - promoters60/3436529
aaactacaac

SEQ ID NO: 129975 - DNA, 10 bp, Unknown
  misc_feature (1)..( 10): Result.003 file - promoters60/3436529
aaactactta

SEQ ID NO: 129976 - DNA, 10 bp, Unknown
  misc_feature (1)..( 10): Result.003 file - promoters60/3436529
aaacgtgaaa

SEQ ID NO: 129977 - DNA, 10 bp, Unknown
  misc_feature (1)..( 10): Result.003 file - promoters60/3436529
aaacgtaaaa

SEQ ID NO: 129978 - DNA, 10 bp, Unknown
  misc_feature (1)..( 10): Result.003 file - promoters60/3436529
taacgtggca

SEQ ID NO: 129979 - DNA, 11 bp, Unknown
  misc_feature (1)..( 11): Result.003 file - promoters60/3436529
acaatataaac

SEQ ID NO: 129980 - DNA, 11 bp, Unknown
  misc_feature (1)..( 11): Result.003 file - promoters60/3436529
tatatataaag

SEQ ID NO: 129981 - DNA, 11 bp, Unknown
  misc_feature (1)..( 11): Result.003 file - promoters60/3436529
tatatataaag

SEQ ID NO: 129982 - DNA, 12 bp, Unknown
  misc_feature (1)..( 12): Result.003 file - promoters60/3436529
cctaatcagaaa

SEQ ID NO: 129983 - DNA, 12 bp, Unknown
  misc_feature (1)..( 12): Result.003 file - promoters60/3436529
actaattagaaa

SEQ ID NO: 129984 - DNA, 12 bp, Unknown
  misc_feature (1)..( 12): Result.003 file - promoters60/3436529
actaattaacac

SEQ ID NO: 129985 - DNA, 9 bp, Unknown
  misc_feature (1)..( 9): Result.003 file - promoters60/3436529
tgaagatta

SEQ ID NO: 129986 - DNA, 9 bp, Unknown
  misc_feature (1)..( 9): Result.003 file - promoters60/3436529
tgaatatta

SEQ ID NO: 129987 - DNA, 9 bp, Unknown
  misc_feature (1)..( 9): Result.003 file - promoters60/3436529
gtaatattg

SEQ ID NO: 129988 - DNA, 7 bp, Unknown
  misc_feature (1)..( 7): Result.003 file - promoters60/3436655
tccaatg

SEQ ID NO: 129989 - DNA, 7 bp, Unknown
  misc_feature (1)..( 7): Result.003 file - promoters60/3436655
tccgatg

SEQ ID NO: 129990 - DNA, 6 bp, Unknown
  misc_feature (1)..( 6): Result.003 file - promoters60/3436655
atggtt

SEQ ID NO: 129991 - DNA, 6 bp, Unknown
  misc_feature (1)..( 6): Result.003 file - promoters60/3436655
atggtt

SEQ ID NO: 129992 - DNA, 10 bp, Unknown
  misc_feature (1)..( 10): Result.003 file - promoters60/3436655
ttttgtttct

SEQ ID NO: 129993 - DNA, 10 bp, Unknown
  misc_feature (1)..( 10): Result.003 file - promoters60/3436655
ttttttttct

SEQ ID NO: 129994 - DNA, 6 bp, Unknown
  misc_feature (1)..( 6): Result.003 file - promoters60/3436655
tgcaaa

SEQ ID NO: 129995 - DNA, 6 bp, Unknown
  misc_feature (1)..( 6): Result.003 file - promoters60/3436655
tgcaaa

SEQ ID NO: 129996 - DNA, 6 bp, Unknown
  misc_feature (1)..( 6): Result.003 file - promoters60/3436655
atcaga

SEQ ID NO: 129997 - DNA, 6 bp, Unknown
  misc_feature (1)..( 6): Result.003 file - promoters60/3436655
atcaga

SEQ ID NO: 129998 - DNA, 9 bp, Unknown
  misc_feature (1)..( 9): Result.003 file - promoters60/3436655
aaagggacc

SEQ ID NO: 129999 - DNA, 9 bp, Unknown
  misc_feature (1)..( 9): Result.003 file - promoters60/3436655
aaatggaat

SEQ ID NO: 130000 - DNA, 9 bp, Unknown
  misc_feature (1)..( 9): Result.003 file - promoters60/3436655
atatgtaat

SEQ ID NO: 130001 - DNA, 6 bp, Unknown
  misc_feature (1)..( 6): Result.003 file - promoters60/3436655
agagtc

SEQ ID NO: 130002 - DNA, 6 bp, Unknown
  misc_feature (1)..( 6): Result.003 file - promoters60/3436655
agagtc

SEQ ID NO: 130003 - DNA, 6 bp, Unknown
  misc_feature (1)..( 6): Result.003 file - promoters60/3436655
taaaaa

SEQ ID NO: 130004 - DNA, 6 bp, Unknown
  misc_feature (1)..( 6): Result.003 file - promoters60/3436655
taaaaa

SEQ ID NO: 130005 - DNA, 9 bp, Unknown
  misc_feature (1)..( 9): Result.003 file - promoters60/3436655
ataattttt

SEQ ID NO: 130006 - DNA, 9 bp, Unknown
  misc_feature (1)..( 9): Result.003 file - promoters60/3436655
ataatgttt

SEQ ID NO: 130007 - DNA, 7 bp, Unknown
  misc_feature (1)..( 7): Result.003 file - promoters60/3436655
atagata

SEQ ID NO: 130008 - DNA, 7 bp, Unknown
  misc_feature (1)..( 7): Result.003 file - promoters60/3436655
atatata

SEQ ID NO: 130009 - DNA, 7 bp, Unknown
  misc_feature (1)..( 7): Result.003 file - promoters60/3436655
acctaat

SEQ ID NO: 130010 - DNA, 7 bp, Unknown
  misc_feature (1)..( 7): Result.003 file - promoters60/3436655
accaaat

SEQ ID NO: 130011 - DNA, 6 bp, Unknown
  misc_feature (1)..( 6): Result.003 file - promoters60/3436655
tattat

SEQ ID NO: 130012 - DNA, 6 bp, Unknown
  misc_feature (1)..( 6): Result.003 file - promoters60/3436655
tattat

SEQ ID NO: 130013 - DNA, 6 bp, Unknown
  misc_feature (1)..( 6): Result.003 file - promoters60/3436655
aaaaaa

SEQ ID NO: 130014 - DNA, 6 bp, Unknown
  misc_feature (1)..( 6): Result.003 file - promoters60/3436655
aaaaaa

SEQ ID NO: 130015 - DNA, 6 bp, Unknown
  misc_feature (1)..( 6): Result.003 file - promoters60/3436655
gtcaaa

SEQ ID NO: 130016 - DNA, 6 bp, Unknown
  misc_feature (1)..( 6): Result.003 file - promoters60/3436655
gtcaaa

SEQ ID NO: 130017 - DNA, 6 bp, Unknown
  misc_feature (1)..( 6): Result.003 file - promoters60/3436655
ggcgag

SEQ ID NO: 130018 - DNA, 6 bp, Unknown
  misc_feature (1)..( 6): Result.003 file - promoters60/3436655
ggcgag

SEQ ID NO: 130019 - DNA, 8 bp, Unknown
  misc_feature (1)..( 8): Result.003 file - promoters60/3436701
gtcgttct

SEQ ID NO: 130020 - DNA, 8 bp, Unknown
  misc_feature (1)..( 8): Result.003 file - promoters60/3436701
gtccttct

SEQ ID NO: 130021 - DNA, 6 bp, Unknown
  misc_feature (1)..( 6): Result.003 file - promoters60/3436701
acatta

SEQ ID NO: 130022 - DNA, 6 bp, Unknown
  misc_feature (1)..( 6): Result.003 file - promoters60/3436701
acatta

SEQ ID NO: 130023 - DNA, 7 bp, Unknown
  misc_feature (1)..( 7): Result.003 file - promoters60/3436701
tcagcat

SEQ ID NO: 130024 - DNA, 7 bp, Unknown
  misc_feature (1)..( 7): Result.003 file - promoters60/3436701
tcatcat

SEQ ID NO: 130025 - DNA, 7 bp, Unknown
  misc_feature (1)..( 7): Result.003 file - promoters60/3436701
tctaatt

SEQ ID NO: 130026 - DNA, 7 bp, Unknown
  misc_feature (1)..( 7): Result.003 file - promoters60/3436701
tcttatt

SEQ ID NO: 130027 - DNA, 6 bp, Unknown
  misc_feature (1)..( 6): Result.003 file - promoters60/3436701
agatca

SEQ ID NO: 130028 - DNA, 6 bp, Unknown
  misc_feature (1)..( 6): Result.003 file - promoters60/3436701
agatca

SEQ ID NO: 130029 - DNA, 9 bp, Unknown
  misc_feature (1)..( 9): Result.003 file - promoters60/3436701
caccactat

SEQ ID NO: 130030 - DNA, 9 bp, Unknown
  misc_feature (1)..( 9): Result.003 file - promoters60/3436701
cacaactat

SEQ ID NO: 130031 - DNA, 8 bp, Unknown
  misc_feature (1)..( 8): Result.003 file - promoters60/3436701
ggactttg

SEQ ID NO: 130032 - DNA, 8 bp, Unknown
  misc_feature (1)..( 8): Result.003 file - promoters60/3436701
ggacgttg

SEQ ID NO: 130033 - DNA, 7 bp, Unknown
  misc_feature (1)..( 7): Result.003 file - promoters60/3436701
ttcgttt

SEQ ID NO: 130034 - DNA, 7 bp, Unknown
  misc_feature (1)..( 7): Result.003 file - promoters60/3436701
ttcattt

SEQ ID NO: 130035 - DNA, 6 bp, Unknown
  misc_feature (1)..( 6): Result.003 file - promoters60/3436701
aaattg

SEQ ID NO: 130036 - DNA, 6 bp, Unknown
  misc_feature (1)..( 6): Result.003 file - promoters60/3436701
aaattg

SEQ ID NO: 130037 - DNA, 7 bp, Unknown
  misc_feature (1)..( 7): Result.003 file - promoters60/3436701
tgatgaa

SEQ ID NO: 130038 - DNA, 7 bp, Unknown
  misc_feature (1)..( 7): Result.003 file - promoters60/3436701
tgaggaa

SEQ ID NO: 130039 - DNA, 6 bp, Unknown
  misc_feature (1)..( 6): Result.003 file - promoters60/3436701
gaagag

SEQ ID NO: 130040 - DNA, 6 bp, Unknown
  misc_feature (1)..( 6): Result.003 file - promoters60/3436701
gaagag

SEQ ID NO: 130041 - DNA, 7 bp, Unknown
  misc_feature (1)..( 7): Result.003 file - promoters60/3436701
aaaggag

SEQ ID NO: 130042 - DNA, 7 bp, Unknown
  misc_feature (1)..( 7): Result.003 file - promoters60/3436701
aaaagag

SEQ ID NO: 130043 - DNA, 10 bp, Unknown
  misc_feature (1)..( 10): Result.003 file - promoters60/3437072
tttgtttttc

SEQ ID NO: 130044 - DNA, 10 bp, Unknown
  misc_feature (1)..( 10): Result.003 file - promoters60/3437072
tttttttttc

SEQ ID NO: 130045 - DNA, 7 bp, Unknown
  misc_feature (1)..( 7): Result.003 file - promoters60/3437072
tttgtta

SEQ ID NO: 130046 - DNA, 7 bp, Unknown
  misc_feature (1)..( 7): Result.003 file - promoters60/3437072
tttatta

SEQ ID NO: 130047 - DNA, 6 bp, Unknown
  misc_feature (1)..( 6): Result.003 file - promoters60/3437072
taaacc

SEQ ID NO: 130048 - DNA, 6 bp, Unknown
  misc_feature (1)..( 6): Result.003 file - promoters60/3437072
taaacc

SEQ ID NO: 130049 - DNA, 6 bp, Unknown
  misc_feature (1)..( 6): Result.003 file - promoters60/3437072
tttccc

SEQ ID NO: 130050 - DNA, 6 bp, Unknown
  misc_feature (1)..( 6): Result.003 file - promoters60/3437072
tttccc

SEQ ID NO: 130051 - DNA, 6 bp, Unknown
  misc_feature (1)..( 6): Result.003 file - promoters60/3437072
taaatt

SEQ ID NO: 130052 - DNA, 6 bp, Unknown
  misc_feature (1)..( 6): Result.003 file - promoters60/3437072
taaatt

SEQ ID NO: 130053 - DNA, 8 bp, Unknown
  misc_feature (1)..( 8): Result.003 file - promoters60/3437072
caaccaag

SEQ ID NO: 130054 - DNA, 8 bp, Unknown
  misc_feature (1)..( 8): Result.003 file - promoters60/3437072
caaacaag

SEQ ID NO: 130055 - DNA, 6 bp, Unknown
  misc_feature (1)..( 6): Result.003 file - promoters60/3437072
actttt

SEQ ID NO: 130056 - DNA, 6 bp, Unknown
  misc_feature (1)..( 6): Result.003 file - promoters60/3437072
actttt

SEQ ID NO: 130057 - DNA, 8 bp, Unknown
  misc_feature (1)..( 8): Result.003 file - promoters60/3437072
ttaaatta

SEQ ID NO: 130058 - DNA, 8 bp, Unknown
  misc_feature (1)..( 8): Result.003 file - promoters60/3437072
ttaattta

SEQ ID NO: 130059 - DNA, 6 bp, Unknown
  misc_feature (1)..( 6): Result.003 file - promoters60/3437072
atttgt

SEQ ID NO: 130060 - DNA, 6 bp, Unknown
  misc_feature (1)..( 6): Result.003 file - promoters60/3437072
atttgt

SEQ ID NO: 130061 - DNA, 6 bp, Unknown
  misc_feature (1)..( 6): Result.003 file - promoters60/3437072
tctttt

SEQ ID NO: 130062 - DNA, 6 bp, Unknown
  misc_feature (1)..( 6): Result.003 file - promoters60/3437072
tctttt

SEQ ID NO: 130063 - DNA, 7 bp, Unknown
  misc_feature (1)..( 7): Result.003 file - promoters60/3437072
ttctttt

SEQ ID NO: 130064 - DNA, 7 bp, Unknown
  misc_feature (1)..( 7): Result.003 file - promoters60/3437072
ttccttt

SEQ ID NO: 130065 - DNA, 8 bp, Unknown
  misc_feature (1)..( 8): Result.003 file - promoters60/3437072
agagaaat

SEQ ID NO: 130066 - DNA, 8 bp, Unknown
  misc_feature (1)..( 8): Result.003 file - promoters60/3437072
agagcaat

SEQ ID NO: 130067 - DNA, 9 bp, Unknown
  misc_feature (1)..( 9): Result.003 file - promoters60/3437072
aatcaattt

SEQ ID NO: 130068 - DNA, 9 bp, Unknown
  misc_feature (1)..( 9): Result.003 file - promoters60/3437072
aataaattt

SEQ ID NO: 130069 - DNA, 10 bp, Unknown
  misc_feature (1)..( 10): Result.003 file - promoters60/3437072
cgattttaac

SEQ ID NO: 130070 - DNA, 10 bp, Unknown
  misc_feature (1)..( 10): Result.003 file - promoters60/3437072
cgaatttaac

SEQ ID NO: 130071 - DNA, 8 bp, Unknown
  misc_feature (1)..( 8): Result.003 file - promoters60/3437072
ttgttgtt

SEQ ID NO: 130072 - DNA, 8 bp, Unknown
  misc_feature (1)..( 8): Result.003 file - promoters60/3437072
ttgatgtt

SEQ ID NO: 130073 - DNA, 9 bp, Unknown
  misc_feature (1)..( 9): Result.003 file - promoters60/3437087
tgaaagtga

SEQ ID NO: 130074 - DNA, 9 bp, Unknown
  misc_feature (1)..( 9): Result.003 file - promoters60/3437087
agaacgtga

SEQ ID NO: 130075 - DNA, 9 bp, Unknown
  misc_feature (1)..( 9): Result.003 file - promoters60/3437087
tgaaagata

SEQ ID NO: 130076 - DNA, 9 bp, Unknown
  misc_feature (1)..( 9): Result.003 file - promoters60/3437087
atggttgaa

SEQ ID NO: 130077 - DNA, 9 bp, Unknown
  misc_feature (1)..( 9): Result.003 file - promoters60/3437087
atggctgaa

SEQ ID NO: 130078 - DNA, 9 bp, Unknown
  misc_feature (1)..( 9): Result.003 file - promoters60/3437087
atggttgaa

SEQ ID NO: 130079 - DNA, 8 bp, Unknown
  misc_feature (1)..( 8): Result.003 file - promoters60/3437150
ggaatagt

SEQ ID NO: 130080 - DNA, 8 bp, Unknown
  misc_feature (1)..( 8): Result.003 file - promoters60/3437150
ggattagc

SEQ ID NO: 130081 - DNA, 8 bp, Unknown
  misc_feature (1)..( 8): Result.003 file - promoters60/3437150
agaataga

SEQ ID NO: 130082 - DNA, 8 bp, Unknown
  misc_feature (1)..( 8): Result.003 file - promoters60/3437150
tgaaaaga

SEQ ID NO: 130083 - DNA, 9 bp, Unknown
  misc_feature (1)..( 9): Result.003 file - promoters60/3437150
aaagaagag

SEQ ID NO: 130084 - DNA, 9 bp, Unknown
  misc_feature (1)..( 9): Result.003 file - promoters60/3437150
tttgaagag

SEQ ID NO: 130085 - DNA, 9 bp, Unknown
  misc_feature (1)..( 9): Result.003 file - promoters60/3437150
aaacaagac

SEQ ID NO: 130086 - DNA, 9 bp, Unknown
  misc_feature (1)..( 9): Result.003 file - promoters60/3437150
aaataagta

SEQ ID NO: 130087 - DNA, 8 bp, Unknown
  misc_feature (1)..( 8): Result.003 file - promoters60/3437150
aaagaaga

SEQ ID NO: 130088 - DNA, 8 bp, Unknown
  misc_feature (1)..( 8): Result.003 file - promoters60/3437150
aaaaaagg

SEQ ID NO: 130089 - DNA, 8 bp, Unknown
  misc_feature (1)..( 8): Result.003 file - promoters60/3437150
aaacaaga

SEQ ID NO: 130090 - DNA, 8 bp, Unknown
  misc_feature (1)..( 8): Result.003 file - promoters60/3437150
aaataagt

SEQ ID NO: 130091 - DNA, 8 bp, Unknown
  misc_feature (1)..( 8): Result.003 file - promoters60/3437150
aaaaatac

SEQ ID NO: 130092 - DNA, 9 bp, Unknown
  misc_feature (1)..( 9): Result.003 file - promoters60/3437150
gttataaaa

SEQ ID NO: 130093 - DNA, 9 bp, Unknown
  misc_feature (1)..( 9): Result.003 file - promoters60/3437150
atcataaaa

SEQ ID NO: 130094 - DNA, 9 bp, Unknown
  misc_feature (1)..( 9): Result.003 file - promoters60/3437150
ttgataaaa

SEQ ID NO: 130095 - DNA, 9 bp, Unknown
  misc_feature (1)..( 9): Result.003 file - promoters60/3437150
tatataaat

SEQ ID NO: 130096 - DNA, 15 bp, Unknown
  misc_feature (1)..( 15): Result.003 file - promoters60/3437150
tggattttgaatttt

SEQ ID NO: 130097 - DNA, 15 bp, Unknown
  misc_feature (1)..( 15): Result.003 file - promoters60/3437150
gtttatttgaattaa

SEQ ID NO: 130098 - DNA, 15 bp, Unknown
  misc_feature (1)..( 15): Result.003 file - promoters60/3437150
gagaacttgacttaa

SEQ ID NO: 130099 - DNA, 15 bp, Unknown
  misc_feature (1)..( 15): Result.003 file - promoters60/3437150
gtttatttgaacaaa

SEQ ID NO: 130100 - DNA, 9 bp, Unknown
  misc_feature (1)..( 9): Result.003 file - promoters60/3437193
ttgagttta

SEQ ID NO: 130101 - DNA, 9 bp, Unknown
  misc_feature (1)..( 9): Result.003 file - promoters60/3437193
ttgactttt

SEQ ID NO: 130102 - DNA, 10 bp, Unknown
  misc_feature (1)..( 10): Result.003 file - promoters60/3437193
ggatagttta

SEQ ID NO: 130103 - DNA, 9 bp, Unknown
  misc_feature (1)..( 9): Result.003 file - promoters60/3437193
ttggcttct

SEQ ID NO: 130104 - DNA, 9 bp, Unknown
  misc_feature (1)..( 9): Result.003 file - promoters60/3437193
tatattttt

SEQ ID NO: 130105 - DNA, 10 bp, Unknown
  misc_feature (1)..( 10): Result.003 file - promoters60/3437193
tatatgttta

SEQ ID NO: 130106 - DNA, 11 bp, Unknown
  misc_feature (1)..( 11): Result.003 file - promoters60/3437193
aaaacaaacgt

SEQ ID NO: 130107 - DNA, 11 bp, Unknown
  misc_feature (1)..( 11): Result.003 file - promoters60/3437193
ggaacaaaacc

SEQ ID NO: 130108 - DNA, 11 bp, Unknown
  misc_feature (1)..( 11): Result.003 file - promoters60/3437193
tgaaaaaaaaa

SEQ ID NO: 130109 - DNA, 11 bp, Unknown
  misc_feature (1)..( 11): Result.003 file - promoters60/3437193
ataaataaatt

SEQ ID NO: 130110 - DNA, 11 bp, Unknown
  misc_feature (1)..( 11): Result.003 file - promoters60/3437193
caaacaaatgt

SEQ ID NO: 130111 - DNA, 11 bp, Unknown
  misc_feature (1)..( 11): Result.003 file - promoters60/3437193
ttaaaaaaaga

SEQ ID NO: 130112 - DNA, 11 bp, Unknown
  misc_feature (1)..( 11): Result.003 file - promoters60/3437193
tcaaaacaatt

SEQ ID NO: 130113 - DNA, 9 bp, Unknown
  misc_feature (1)..( 9): Result.003 file - promoters60/3437193
aaaaataaa

SEQ ID NO: 130114 - DNA, 9 bp, Unknown
  misc_feature (1)..( 9): Result.003 file - promoters60/3437193
aaaaatata

SEQ ID NO: 130115 - DNA, 9 bp, Unknown
  misc_feature (1)..( 9): Result.003 file - promoters60/3437193
aaaattaat

SEQ ID NO: 130116 - DNA, 9 bp, Unknown
  misc_feature (1)..( 9): Result.003 file - promoters60/3437193
taaaataca

SEQ ID NO: 130117 - DNA, 9 bp, Unknown
  misc_feature (1)..( 9): Result.003 file - promoters60/3437193
aaaaattta

SEQ ID NO: 130118 - DNA, 9 bp, Unknown
  misc_feature (1)..( 9): Result.003 file - promoters60/3437193
gataatatt

SEQ ID NO: 130119 - DNA, 10 bp, Unknown
  misc_feature (1)..( 10): Result.003 file - promoters60/3437193
aaataaaagc

SEQ ID NO: 130120 - DNA, 10 bp, Unknown
  misc_feature (1)..( 10): Result.003 file - promoters60/3437193
atataaaaaa

SEQ ID NO: 130121 - DNA, 10 bp, Unknown
  misc_feature (1)..( 10): Result.003 file - promoters60/3437193
caataaaatt

SEQ ID NO: 130122 - DNA, 10 bp, Unknown
  misc_feature (1)..( 10): Result.003 file - promoters60/3437193
ttataaaata

SEQ ID NO: 130123 - DNA, 10 bp, Unknown
  misc_feature (1)..( 10): Result.003 file - promoters60/3437193
tattaaaata

SEQ ID NO: 130124 - DNA, 10 bp, Unknown
  misc_feature (1)..( 10): Result.003 file - promoters60/3437193
agataatatt

SEQ ID NO: 130125 - DNA, 9 bp, Unknown
  misc_feature (1)..( 9): Result.003 file - promoters60/3437193
gaaaaacaa

SEQ ID NO: 130126 - DNA, 9 bp, Unknown
  misc_feature (1)..( 9): Result.003 file - promoters60/3437193
aaaaaactc

SEQ ID NO: 130127 - DNA, 9 bp, Unknown
  misc_feature (1)..( 9): Result.003 file - promoters60/3437193
gaaaaaata

SEQ ID NO: 130128 - DNA, 10 bp, Unknown
  misc_feature (1)..( 10): Result.003 file - promoters60/3437193
ttcaaaacaa

SEQ ID NO: 130129 - DNA, 10 bp, Unknown
  misc_feature (1)..( 10): Result.003 file - promoters60/3437193
gaacaaaacc

SEQ ID NO: 130130 - DNA, 10 bp, Unknown
  misc_feature (1)..( 10): Result.003 file - promoters60/3437193
taaaaaatat

SEQ ID NO: 130131 - DNA, 11 bp, Unknown
  misc_feature (1)..( 11): Result.003 file - promoters60/3437193
cattatatata

SEQ ID NO: 130132 - DNA, 11 bp, Unknown
  misc_feature (1)..( 11): Result.003 file - promoters60/3437193
acatatataaa

SEQ ID NO: 130133 - DNA, 11 bp, Unknown
  misc_feature (1)..( 11): Result.003 file - promoters60/3437193
gcctatatata

SEQ ID NO: 130134 - DNA, 11 bp, Unknown
  misc_feature (1)..( 11): Result.003 file - promoters60/3437193
ttgtatatata

SEQ ID NO: 130135 - DNA, 11 bp, Unknown
  misc_feature (1)..( 11): Result.003 file - promoters60/3437193
ccttataaata

SEQ ID NO: 130136 - DNA, 11 bp, Unknown
  misc_feature (1)..( 11): Result.003 file - promoters60/3437193
ccatataaatt

SEQ ID NO: 130137 - DNA, 11 bp, Unknown
  misc_feature (1)..( 11): Result.003 file - promoters60/3437193
ccttaaaaacc

SEQ ID NO: 130138 - DNA, 16 bp, Unknown
  misc_feature (1)..( 16): Result.003 file - promoters60/3437244
aaaatattaaccttga

SEQ ID NO: 130139 - DNA, 16 bp, Unknown
  misc_feature (1)..( 16): Result.003 file - promoters60/3437244
taaaaattaaatgcta

SEQ ID NO: 130140 - DNA, 16 bp, Unknown
  misc_feature (1)..( 16): Result.003 file - promoters60/3437244
taaatattagtatttg

SEQ ID NO: 130141 - DNA, 16 bp, Unknown
  misc_feature (1)..( 16): Result.003 file - promoters60/3437244
ccaaaattgaccctga

SEQ ID NO: 130142 - DNA, 16 bp, Unknown
  misc_feature (1)..( 16): Result.003 file - promoters60/3437244
gtaaaatttcataacc

SEQ ID NO: 130143 - DNA, 16 bp, Unknown
  misc_feature (1)..( 16): Result.003 file - promoters60/3437244
taacaattctaatttt

SEQ ID NO: 130144 - DNA, 16 bp, Unknown
  misc_feature (1)..( 16): Result.003 file - promoters60/3437244
ccaaaattcattataa

SEQ ID NO: 130145 - DNA, 9 bp, Unknown
  misc_feature (1)..( 9): Result.003 file - promoters60/3437244
aaaaataaa

SEQ ID NO: 130146 - DNA, 9 bp, Unknown
  misc_feature (1)..( 9): Result.003 file - promoters60/3437244
aaaattaat

SEQ ID NO: 130147 - DNA, 9 bp, Unknown
  misc_feature (1)..( 9): Result.003 file - promoters60/3437244
taaaataca

SEQ ID NO: 130148 - DNA, 9 bp, Unknown
  misc_feature (1)..( 9): Result.003 file - promoters60/3437244
aaaaattta

SEQ ID NO: 130149 - DNA, 9 bp, Unknown
  misc_feature (1)..( 9): Result.003 file - promoters60/3437244
aaaaatcaa

SEQ ID NO: 130150 - DNA, 9 bp, Unknown
  misc_feature (1)..( 9): Result.003 file - promoters60/3437244
gataatatt

SEQ ID NO: 130151 - DNA, 13 bp, Unknown
  misc_feature (1)..( 13): Result.003 file - promoters60/3437244
aataaataaaagc

SEQ ID NO: 130152 - DNA, 13 bp, Unknown
  misc_feature (1)..( 13): Result.003 file - promoters60/3437244
aaacaataaaatt

SEQ ID NO: 130153 - DNA, 13 bp, Unknown
  misc_feature (1)..( 13): Result.003 file - promoters60/3437244
acattataaaata

SEQ ID NO: 130154 - DNA, 13 bp, Unknown
  misc_feature (1)..( 13): Result.003 file - promoters60/3437244
aggagataatatt

SEQ ID NO: 130155 - DNA, 13 bp, Unknown
  misc_feature (1)..( 13): Result.003 file - promoters60/3437244
aaaaaatcaaaat

SEQ ID NO: 130156 - DNA, 14 bp, Unknown
  misc_feature (1)..( 14): Result.003 file - promoters60/3437244
cacgcatctaaaga

SEQ ID NO: 130157 - DNA, 14 bp, Unknown
  misc_feature (1)..( 14): Result.003 file - promoters60/3437244
aaaatttacaaact

SEQ ID NO: 130158 - DNA, 8 bp, Unknown
  misc_feature (1)..( 8): Result.003 file - promoters60/3437244
aaaacaaa

SEQ ID NO: 130159 - DNA, 8 bp, Unknown
  misc_feature (1)..( 8): Result.003 file - promoters60/3437244
taaataaa

SEQ ID NO: 130160 - DNA, 8 bp, Unknown
  misc_feature (1)..( 8): Result.003 file - promoters60/3437244
caaacaaa

SEQ ID NO: 130161 - DNA, 8 bp, Unknown
  misc_feature (1)..( 8): Result.003 file - promoters60/3437244
taaaaaaa

SEQ ID NO: 130162 - DNA, 8 bp, Unknown
  misc_feature (1)..( 8): Result.003 file - promoters60/3437244
aaaacaat

SEQ ID NO: 130163 - DNA, 8 bp, Unknown
  misc_feature (1)..( 8): Result.003 file - promoters60/3437244
aaaatgaa

SEQ ID NO: 130164 - DNA, 10 bp, Unknown
  misc_feature (1)..( 10): Result.003 file - promoters60/3437244
atattattag

SEQ ID NO: 130165 - DNA, 10 bp, Unknown
  misc_feature (1)..( 10): Result.003 file - promoters60/3437244
atattattag

SEQ ID NO: 130166 - DNA, 10 bp, Unknown
  misc_feature (1)..( 10): Result.003 file - promoters60/3437244
ttattatatt

SEQ ID NO: 130167 - DNA, 10 bp, Unknown
  misc_feature (1)..( 10): Result.003 file - promoters60/3437244
gtatttttat

SEQ ID NO: 130168 - DNA, 10 bp, Unknown
  misc_feature (1)..( 10): Result.003 file - promoters60/3437244
atataattat

SEQ ID NO: 130169 - DNA, 11 bp, Unknown
  misc_feature (1)..( 11): Result.003 file - promoters60/3437244
aaatgaattta

SEQ ID NO: 130170 - DNA, 11 bp, Unknown
  misc_feature (1)..( 11): Result.003 file - promoters60/3437244
atgtttgttta

SEQ ID NO: 130171 - DNA, 11 bp, Unknown
  misc_feature (1)..( 11): Result.003 file - promoters60/3437244
ctttttatttc

SEQ ID NO: 130172 - DNA, 11 bp, Unknown
  misc_feature (1)..( 11): Result.003 file - promoters60/3437244
acttttgtttc

SEQ ID NO: 130173 - DNA, 11 bp, Unknown
  misc_feature (1)..( 11): Result.003 file - promoters60/3437244
acatttttttc

SEQ ID NO: 130174 - DNA, 11 bp, Unknown
  misc_feature (1)..( 11): Result.003 file - promoters60/3437244
ttaattctttt

SEQ ID NO: 130175 - DNA, 11 bp, Unknown
  misc_feature (1)..( 11): Result.003 file - promoters60/3437244
cttcttctttg

SEQ ID NO: 130176 - DNA, 15 bp, Unknown
  misc_feature (1)..( 15): Result.003 file - promoters60/3437244
caaccaactatccaa

SEQ ID NO: 130177 - DNA, 15 bp, Unknown
  misc_feature (1)..( 15): Result.003 file - promoters60/3437244
aaaccaatgtttatt

SEQ ID NO: 130178 - DNA, 15 bp, Unknown
  misc_feature (1)..( 15): Result.003 file - promoters60/3437244
aaatcaaatagtttt

SEQ ID NO: 130179 - DNA, 15 bp, Unknown
  misc_feature (1)..( 15): Result.003 file - promoters60/3437244
acatcatatacttta

SEQ ID NO: 130180 - DNA, 15 bp, Unknown
  misc_feature (1)..( 15): Result.003 file - promoters60/3437244
attaaccttactttt

SEQ ID NO: 130181 - DNA, 15 bp, Unknown
  misc_feature (1)..( 15): Result.003 file - promoters60/3437244
tttatttttacgttt

SEQ ID NO: 130182 - DNA, 11 bp, Unknown
  misc_feature (1)..( 11): Result.003 file - promoters60/3437244
aaattaaaatc

SEQ ID NO: 130183 - DNA, 11 bp, Unknown
  misc_feature (1)..( 11): Result.003 file - promoters60/3437244
ccgttaaaaat

SEQ ID NO: 130184 - DNA, 11 bp, Unknown
  misc_feature (1)..( 11): Result.003 file - promoters60/3437244
catataaaaat

SEQ ID NO: 130185 - DNA, 11 bp, Unknown
  misc_feature (1)..( 11): Result.003 file - promoters60/3437244
cgtttaaataa

SEQ ID NO: 130186 - DNA, 11 bp, Unknown
  misc_feature (1)..( 11): Result.003 file - promoters60/3437244
cgtttagtgtc

SEQ ID NO: 130187 - DNA, 11 bp, Unknown
  misc_feature (1)..( 11): Result.003 file - promoters60/3437244
accttactttt

SEQ ID NO: 130188 - DNA, 17 bp, Unknown
  misc_feature (1)..( 17): Result.003 file - promoters60/3437244
tatccaaaatgaaaaac

SEQ ID NO: 130189 - DNA, 17 bp, Unknown
  misc_feature (1)..( 17): Result.003 file - promoters60/3437244
gagccaaaatgaacctt

SEQ ID NO: 130190 - DNA, 17 bp, Unknown
  misc_feature (1)..( 17): Result.003 file - promoters60/3437244
attgtttaatgaaattc

SEQ ID NO: 130191 - DNA, 17 bp, Unknown
  misc_feature (1)..( 17): Result.003 file - promoters60/3437244
tatacaaactattcaaa

SEQ ID NO: 130192 - DNA, 17 bp, Unknown
  misc_feature (1)..( 17): Result.003 file - promoters60/3437244
tccaaccaatgatattc

SEQ ID NO: 130193 - DNA, 17 bp, Unknown
  misc_feature (1)..( 17): Result.003 file - promoters60/3437244
caacggttgtgatatac

SEQ ID NO: 130194 - DNA, 11 bp, Unknown
  misc_feature (1)..( 11): Result.003 file - promoters60/3437244
tatccaaaatt

SEQ ID NO: 130195 - DNA, 11 bp, Unknown
  misc_feature (1)..( 11): Result.003 file - promoters60/3437244
atataaaaatt

SEQ ID NO: 130196 - DNA, 11 bp, Unknown
  misc_feature (1)..( 11): Result.003 file - promoters60/3437244
cgttaaaaatc

SEQ ID NO: 130197 - DNA, 11 bp, Unknown
  misc_feature (1)..( 11): Result.003 file - promoters60/3437244
cgtttaaataa

SEQ ID NO: 130198 - DNA, 11 bp, Unknown
  misc_feature (1)..( 11): Result.003 file - promoters60/3437244
cgtttagtgtc

SEQ ID NO: 130199 - DNA, 11 bp, Unknown
  misc_feature (1)..( 11): Result.003 file - promoters60/3437244
accttactttt

SEQ ID NO: 130200 - DNA, 10 bp, Unknown
  misc_feature (1)..( 10): Result.003 file - promoters60/3437331
cgatttgtta

SEQ ID NO: 130201 - DNA, 10 bp, Unknown
  misc_feature (1)..( 10): Result.003 file - promoters60/3437331
gattttgttc

SEQ ID NO: 130202 - DNA, 10 bp, Unknown
  misc_feature (1)..( 10): Result.003 file - promoters60/3437331
ttatttgtgt

SEQ ID NO: 130203 - DNA, 10 bp, Unknown
  misc_feature (1)..( 10): Result.003 file - promoters60/3437331
ttacttgacg

SEQ ID NO: 130204 - DNA, 10 bp, Unknown
  misc_feature (1)..( 10): Result.003 file - promoters60/3437331
ttatatgtat

SEQ ID NO: 130205 - DNA, 10 bp, Unknown
  misc_feature (1)..( 10): Result.003 file - promoters60/3437331
ctatgtgtgt

SEQ ID NO: 130206 - DNA, 14 bp, Unknown
  misc_feature (1)..( 14): Result.003 file - promoters60/3437331
ccgaatttctccca

SEQ ID NO: 130207 - DNA, 14 bp, Unknown
  misc_feature (1)..( 14): Result.003 file - promoters60/3437331
tcgaatttgtccca

SEQ ID NO: 130208 - DNA, 14 bp, Unknown
  misc_feature (1)..( 14): Result.003 file - promoters60/3437331
ccgcattaatgggc

SEQ ID NO: 130209 - DNA, 14 bp, Unknown
  misc_feature (1)..( 14): Result.003 file - promoters60/3437331
aagaaattgagaaa

SEQ ID NO: 130210 - DNA, 15 bp, Unknown
  misc_feature (1)..( 15): Result.003 file - promoters60/3437331
cagatatttttggcg

SEQ ID NO: 130211 - DNA, 12 bp, Unknown
  misc_feature (1)..( 12): Result.003 file - promoters60/3437331
aaccagattaaa

SEQ ID NO: 130212 - DNA, 12 bp, Unknown
  misc_feature (1)..( 12): Result.003 file - promoters60/3437331
tcatagataaaa

SEQ ID NO: 130213 - DNA, 12 bp, Unknown
  misc_feature (1)..( 12): Result.003 file - promoters60/3437331
aaccaaattaca

SEQ ID NO: 130214 - DNA, 12 bp, Unknown
  misc_feature (1)..( 12): Result.003 file - promoters60/3437331
caaaagagaaag

SEQ ID NO: 130215 - DNA, 12 bp, Unknown
  misc_feature (1)..( 12): Result.003 file - promoters60/3437331
atataaaatacc

SEQ ID NO: 130216 - DNA, 9 bp, Unknown
  misc_feature (1)..( 9): Result.003 file - promoters60/3437367
tttacacaa

SEQ ID NO: 130217 - DNA, 9 bp, Unknown
  misc_feature (1)..( 9): Result.003 file - promoters60/3437367
ttttcactg

SEQ ID NO: 130218 - DNA, 9 bp, Unknown
  misc_feature (1)..( 9): Result.003 file - promoters60/3437367
atttgactg

SEQ ID NO: 130219 - DNA, 10 bp, Unknown
  misc_feature (1)..( 10): Result.003 file - promoters60/3437367
agtttttaag

SEQ ID NO: 130220 - DNA, 10 bp, Unknown
  misc_feature (1)..( 10): Result.003 file - promoters60/3437367
agtgtttgat

SEQ ID NO: 130221 - DNA, 10 bp, Unknown
  misc_feature (1)..( 10): Result.003 file - promoters60/3437367
catttttatt

SEQ ID NO: 130222 - DNA, 10 bp, Unknown
  misc_feature (1)..( 10): Result.003 file - promoters60/3437367
gattattatt

SEQ ID NO: 130223 - DNA, 8 bp, Unknown
  misc_feature (1)..( 8): Result.003 file - promoters60/3437367
acaaacta

SEQ ID NO: 130224 - DNA, 8 bp, Unknown
  misc_feature (1)..( 8): Result.003 file - promoters60/3437367
acaaacga

SEQ ID NO: 130225 - DNA, 8 bp, Unknown
  misc_feature (1)..( 8): Result.003 file - promoters60/3437367
aaaaaaaa

SEQ ID NO: 130226 - DNA, 13 bp, Unknown
  misc_feature (1)..( 13): Result.003 file - promoters60/3437367
aaaattattaaaa

SEQ ID NO: 130227 - DNA, 13 bp, Unknown
  misc_feature (1)..( 13): Result.003 file - promoters60/3437367
aaatttagtaagc

SEQ ID NO: 130228 - DNA, 13 bp, Unknown
  misc_feature (1)..( 13): Result.003 file - promoters60/3437367
tcaattactaaaa

SEQ ID NO: 130229 - DNA, 8 bp, Unknown
  misc_feature (1)..( 8): Result.003 file - promoters60/3437367
attttgaa

SEQ ID NO: 130230 - DNA, 8 bp, Unknown
  misc_feature (1)..( 8): Result.003 file - promoters60/3437367
attgtgag

SEQ ID NO: 130231 - DNA, 8 bp, Unknown
  misc_feature (1)..( 8): Result.003 file - promoters60/3437367
gtttcgaa

SEQ ID NO: 130232 - DNA, 7 bp, Unknown
  misc_feature (1)..( 7): Result.003 file - promoters60/3437367
tttttaa

SEQ ID NO: 130233 - DNA, 7 bp, Unknown
  misc_feature (1)..( 7): Result.003 file - promoters60/3437367
attttaa

SEQ ID NO: 130234 - DNA, 7 bp, Unknown
  misc_feature (1)..( 7): Result.003 file - promoters60/3437367
attttag

SEQ ID NO: 130235 - DNA, 6 bp, Unknown
  misc_feature (1)..( 6): Result.003 file - promoters60/3437367
aaaaaa

SEQ ID NO: 130236 - DNA, 6 bp, Unknown
  misc_feature (1)..( 6): Result.003 file - promoters60/3437367
aaaaaa

SEQ ID NO: 130237 - DNA, 6 bp, Unknown
  misc_feature (1)..( 6): Result.003 file - promoters60/3437367
aaaaaa

SEQ ID NO: 130238 - DNA, 17 bp, Unknown
  misc_feature (1)..( 17): Result.003 file - promoters60/3437375
gctctctcgtataattc

SEQ ID NO: 130239 - DNA, 17 bp, Unknown
  misc_feature (1)..( 17): Result.003 file - promoters60/3437375
ctccactcttatgattt

SEQ ID NO: 130240 - DNA, 17 bp, Unknown
  misc_feature (1)..( 17): Result.003 file - promoters60/3437375
tctacttcttattggaa

SEQ ID NO: 130241 - DNA, 18 bp, Unknown
  misc_feature (1)..( 18): Result.003 file - promoters60/3437375
caagaacttccatgtttt

SEQ ID NO: 130242 - DNA, 17 bp, Unknown
  misc_feature (1)..( 17): Result.003 file - promoters60/3437375
ctctactcttggaatat

SEQ ID NO: 130243 - DNA, 17 bp, Unknown
  misc_feature (1)..( 17): Result.003 file - promoters60/3437375
aaatgaacttctgatat

SEQ ID NO: 130244 - DNA, 18 bp, Unknown
  misc_feature (1)..( 18): Result.003 file - promoters60/3437375
tctatttctctattctca

SEQ ID NO: 130245 - DNA, 13 bp, Unknown
  misc_feature (1)..( 13): Result.003 file - promoters60/3437375
aaagtttttgtaa

SEQ ID NO: 130246 - DNA, 13 bp, Unknown
  misc_feature (1)..( 13): Result.003 file - promoters60/3437375
ttagttttgtaaa

SEQ ID NO: 130247 - DNA, 13 bp, Unknown
  misc_feature (1)..( 13): Result.003 file - promoters60/3437375
aaaatttcactag

SEQ ID NO: 130248 - DNA, 13 bp, Unknown
  misc_feature (1)..( 13): Result.003 file - promoters60/3437375
caagtttcctcta

SEQ ID NO: 130249 - DNA, 13 bp, Unknown
  misc_feature (1)..( 13): Result.003 file - promoters60/3437375
aatttttactttt

SEQ ID NO: 130250 - DNA, 13 bp, Unknown
  misc_feature (1)..( 13): Result.003 file - promoters60/3437375
tctgttttcttca

SEQ ID NO: 130251 - DNA, 11 bp, Unknown
  misc_feature (1)..( 11): Result.003 file - promoters60/3437660
aaaagatagca

SEQ ID NO: 130252 - DNA, 11 bp, Unknown
  misc_feature (1)..( 11): Result.003 file - promoters60/3437660
gaaatatataa

SEQ ID NO: 130253 - DNA, 11 bp, Unknown
  misc_feature (1)..( 11): Result.003 file - promoters60/3437660
gaaatagattg

SEQ ID NO: 130254 - DNA, 11 bp, Unknown
  misc_feature (1)..( 11): Result.003 file - promoters60/3437660
ttaatttatta

SEQ ID NO: 130255 - DNA, 11 bp, Unknown
  misc_feature (1)..( 11): Result.003 file - promoters60/3437660
atgattacttt

SEQ ID NO: 130256 - DNA, 8 bp, Unknown
  misc_feature (1)..( 8): Result.003 file - promoters60/3437671
atataata

SEQ ID NO: 130257 - DNA, 8 bp, Unknown
  misc_feature (1)..( 8): Result.003 file - promoters60/3437671
atatcata

SEQ ID NO: 130258 - DNA, 6 bp, Unknown
  misc_feature (1)..( 6): Result.003 file - promoters60/3437671
atttga

SEQ ID NO: 130259 - DNA, 6 bp, Unknown
  misc_feature (1)..( 6): Result.003 file - promoters60/3437671
atttga

SEQ ID NO: 130260 - DNA, 7 bp, Unknown
  misc_feature (1)..( 7): Result.003 file - promoters60/3437671
ttaggtc

SEQ ID NO: 130261 - DNA, 7 bp, Unknown
  misc_feature (1)..( 7): Result.003 file - promoters60/3437671
ttaggtg

SEQ ID NO: 130262 - DNA, 7 bp, Unknown
  misc_feature (1)..( 7): Result.003 file - promoters60/3437671
ttatgtg

SEQ ID NO: 130263 - DNA, 6 bp, Unknown
  misc_feature (1)..( 6): Result.003 file - promoters60/3437671
aaatgg

SEQ ID NO: 130264 - DNA, 6 bp, Unknown
  misc_feature (1)..( 6): Result.003 file - promoters60/3437671
aaatgg

SEQ ID NO: 130265 - DNA, 7 bp, Unknown
  misc_feature (1)..( 7): Result.003 file - promoters60/3437671
cacctaa

SEQ ID NO: 130266 - DNA, 7 bp, Unknown
  misc_feature (1)..( 7): Result.003 file - promoters60/3437671
cacttaa

SEQ ID NO: 130267 - DNA, 7 bp, Unknown
  misc_feature (1)..( 7): Result.003 file - promoters60/3437671
aaaacga

SEQ ID NO: 130268 - DNA, 7 bp, Unknown
  misc_feature (1)..( 7): Result.003 file - promoters60/3437671
aaaacga

SEQ ID NO: 130269 - DNA, 10 bp, Unknown
  misc_feature (1)..( 10): Result.003 file - promoters60/3437671
ttagataatt

SEQ ID NO: 130270 - DNA, 10 bp, Unknown
  misc_feature (1)..( 10): Result.003 file - promoters60/3437671
ttagataatt

SEQ ID NO: 130271 - DNA, 6 bp, Unknown
  misc_feature (1)..( 6): Result.003 file - promoters60/3437671
aaatta

SEQ ID NO: 130272 - DNA, 6 bp, Unknown
  misc_feature (1)..( 6): Result.003 file - promoters60/3437671
aaatta

SEQ ID NO: 130273 - DNA, 7 bp, Unknown
  misc_feature (1)..( 7): Result.003 file - promoters60/3437671
catctga

SEQ ID NO: 130274 - DNA, 7 bp, Unknown
  misc_feature (1)..( 7): Result.003 file - promoters60/3437671
catttga

SEQ ID NO: 130275 - DNA, 6 bp, Unknown
  misc_feature (1)..( 6): Result.003 file - promoters60/3437671
atttat

SEQ ID NO: 130276 - DNA, 6 bp, Unknown
  misc_feature (1)..( 6): Result.003 file - promoters60/3437671
atttat

SEQ ID NO: 130277 - DNA, 6 bp, Unknown
  misc_feature (1)..( 6): Result.003 file - promoters60/3437671
tcatat

SEQ ID NO: 130278 - DNA, 6 bp, Unknown
  misc_feature (1)..( 6): Result.003 file - promoters60/3437671
tcatat

SEQ ID NO: 130279 - DNA, 8 bp, Unknown
  misc_feature (1)..( 8): Result.003 file - promoters60/3437671
atatatac

SEQ ID NO: 130280 - DNA, 8 bp, Unknown
  misc_feature (1)..( 8): Result.003 file - promoters60/3437671
atacatac

SEQ ID NO: 130281 - DNA, 6 bp, Unknown
  misc_feature (1)..( 6): Result.003 file - promoters60/3437671
ttcaaa

SEQ ID NO: 130282 - DNA, 6 bp, Unknown
  misc_feature (1)..( 6): Result.003 file - promoters60/3437671
ttcaaa

SEQ ID NO: 130283 - DNA, 7 bp, Unknown
  misc_feature (1)..( 7): Result.003 file - promoters60/3437776
ctagatt

SEQ ID NO: 130284 - DNA, 7 bp, Unknown
  misc_feature (1)..( 7): Result.003 file - promoters60/3437776
ctacatt

SEQ ID NO: 130285 - DNA, 8 bp, Unknown
  misc_feature (1)..( 8): Result.003 file - promoters60/3437776
ttataaat

SEQ ID NO: 130286 - DNA, 8 bp, Unknown
  misc_feature (1)..( 8): Result.003 file - promoters60/3437776
ttataaat

SEQ ID NO: 130287 - DNA, 6 bp, Unknown
  misc_feature (1)..( 6): Result.003 file - promoters60/3437776
agattt

SEQ ID NO: 130288 - DNA, 6 bp, Unknown
  misc_feature (1)..( 6): Result.003 file - promoters60/3437776
agattt

SEQ ID NO: 130289 - DNA, 7 bp, Unknown
  misc_feature (1)..( 7): Result.003 file - promoters60/3437776
atttaca

SEQ ID NO: 130290 - DNA, 7 bp, Unknown
  misc_feature (1)..( 7): Result.003 file - promoters60/3437776
atttacc

SEQ ID NO: 130291 - DNA, 7 bp, Unknown
  misc_feature (1)..( 7): Result.003 file - promoters60/3437776
attaacc

SEQ ID NO: 130292 - DNA, 8 bp, Unknown
  misc_feature (1)..( 8): Result.003 file - promoters60/3437776
atatctga

SEQ ID NO: 130293 - DNA, 8 bp, Unknown
  misc_feature (1)..( 8): Result.003 file - promoters60/3437776
atatatga

SEQ ID NO: 130294 - DNA, 7 bp, Unknown
  misc_feature (1)..( 7): Result.003 file - promoters60/3437776
tttaata

SEQ ID NO: 130295 - DNA, 7 bp, Unknown
  misc_feature (1)..( 7): Result.003 file - promoters60/3437776
tttgata

SEQ ID NO: 130296 - DNA, 6 bp, Unknown
  misc_feature (1)..( 6): Result.003 file - promoters60/3437776
gtgtgt

SEQ ID NO: 130297 - DNA, 6 bp, Unknown
  misc_feature (1)..( 6): Result.003 file - promoters60/3437776
gtgtgt

SEQ ID NO: 130298 - DNA, 6 bp, Unknown
  misc_feature (1)..( 6): Result.003 file - promoters60/3437776
acagct

SEQ ID NO: 130299 - DNA, 6 bp, Unknown
  misc_feature (1)..( 6): Result.003 file - promoters60/3437776
acagct

SEQ ID NO: 130300 - DNA, 6 bp, Unknown
  misc_feature (1)..( 6): Result.003 file - promoters60/3437776
ccatat

SEQ ID NO: 130301 - DNA, 6 bp, Unknown
  misc_feature (1)..( 6): Result.003 file - promoters60/3437776
ccatat

SEQ ID NO: 130302 - DNA, 8 bp, Unknown
  misc_feature (1)..( 8): Result.003 file - promoters60/3437776
tgcgtcag

SEQ ID NO: 130303 - DNA, 8 bp, Unknown
  misc_feature (1)..( 8): Result.003 file - promoters60/3437776
tgcctcag

SEQ ID NO: 130304 - DNA, 7 bp, Unknown
  misc_feature (1)..( 7): Result.003 file - promoters60/3437776
ttctgtt

SEQ ID NO: 130305 - DNA, 7 bp, Unknown
  misc_feature (1)..( 7): Result.003 file - promoters60/3437776
ttcggtt

SEQ ID NO: 130306 - DNA, 8 bp, Unknown
  misc_feature (1)..( 8): Result.003 file - promoters60/3437776
gtgtgtat

SEQ ID NO: 130307 - DNA, 8 bp, Unknown
  misc_feature (1)..( 8): Result.003 file - promoters60/3437776
gtgggtat

SEQ ID NO: 130308 - DNA, 12 bp, Unknown
  misc_feature (1)..( 12): Result.003 file - promoters60/3437779
ctatttttacac

SEQ ID NO: 130309 - DNA, 12 bp, Unknown
  misc_feature (1)..( 12): Result.003 file - promoters60/3437779
ctaattttaatt

SEQ ID NO: 130310 - DNA, 12 bp, Unknown
  misc_feature (1)..( 12): Result.003 file - promoters60/3437779
ataattttagag

SEQ ID NO: 130311 - DNA, 12 bp, Unknown
  misc_feature (1)..( 12): Result.003 file - promoters60/3437779
ttagtttgagag

SEQ ID NO: 130312 - DNA, 9 bp, Unknown
  misc_feature (1)..( 9): Result.003 file - promoters60/3437779
tctgacaaa

SEQ ID NO: 130313 - DNA, 9 bp, Unknown
  misc_feature (1)..( 9): Result.003 file - promoters60/3437779
aatgacaat

SEQ ID NO: 130314 - DNA, 9 bp, Unknown
  misc_feature (1)..( 9): Result.003 file - promoters60/3437779
tctaacaaa

SEQ ID NO: 130315 - DNA, 9 bp, Unknown
  misc_feature (1)..( 9): Result.003 file - promoters60/3437779
tatgagaaa

SEQ ID NO: 130316 - DNA, 13 bp, Unknown
  misc_feature (1)..( 13): Result.003 file - promoters60/3437779
gaaatatacttac

SEQ ID NO: 130317 - DNA, 13 bp, Unknown
  misc_feature (1)..( 13): Result.003 file - promoters60/3437779
tgctaatatttac

SEQ ID NO: 130318 - DNA, 13 bp, Unknown
  misc_feature (1)..( 13): Result.003 file - promoters60/3437779
gaaaaatatttag

SEQ ID NO: 130319 - DNA, 13 bp, Unknown
  misc_feature (1)..( 13): Result.003 file - promoters60/3437779
taaaaaaattaag

SEQ ID NO: 130320 - DNA, 10 bp, Unknown
  misc_feature (1)..( 10): Result.003 file - promoters60/3437803
ttccaaaatt

SEQ ID NO: 130321 - DNA, 10 bp, Unknown
  misc_feature (1)..( 10): Result.003 file - promoters60/3437803
gaccaaaaaa

SEQ ID NO: 130322 - DNA, 10 bp, Unknown
  misc_feature (1)..( 10): Result.003 file - promoters60/3437803
ttctaaaaat

SEQ ID NO: 130323 - DNA, 10 bp, Unknown
  misc_feature (1)..( 10): Result.003 file - promoters60/3437803
gtccaaagat

SEQ ID NO: 130324 - DNA, 10 bp, Unknown
  misc_feature (1)..( 10): Result.003 file - promoters60/3437803
gaacaaaaaa

SEQ ID NO: 130325 - DNA, 10 bp, Unknown
  misc_feature (1)..( 10): Result.003 file - promoters60/3437803
ttctaagcac

SEQ ID NO: 130326 - DNA, 7 bp, Unknown
  misc_feature (1)..( 7): Result.003 file - promoters60/3437803
cattttc

SEQ ID NO: 130327 - DNA, 7 bp, Unknown
  misc_feature (1)..( 7): Result.003 file - promoters60/3437803
tattttc

SEQ ID NO: 130328 - DNA, 7 bp, Unknown
  misc_feature (1)..( 7): Result.003 file - promoters60/3437803
catttta

SEQ ID NO: 130329 - DNA, 7 bp, Unknown
  misc_feature (1)..( 7): Result.003 file - promoters60/3437803
gattttc

SEQ ID NO: 130330 - DNA, 10 bp, Unknown
  misc_feature (1)..( 10): Result.003 file - promoters60/3437803
atacacttta

SEQ ID NO: 130331 - DNA, 10 bp, Unknown
  misc_feature (1)..( 10): Result.003 file - promoters60/3437803
tcacactttt

SEQ ID NO: 130332 - DNA, 11 bp, Unknown
  misc_feature (1)..( 11): Result.003 file - promoters60/3437803
actttacttta

SEQ ID NO: 130333 - DNA, 11 bp, Unknown
  misc_feature (1)..( 11): Result.003 file - promoters60/3437803
tcacacctttt

SEQ ID NO: 130334 - DNA, 9 bp, Unknown
  misc_feature (1)..( 9): Result.003 file - promoters60/3437803
gttgtatat

SEQ ID NO: 130335 - DNA, 9 bp, Unknown
  misc_feature (1)..( 9): Result.003 file - promoters60/3437803
tttgtttat

SEQ ID NO: 130336 - DNA, 9 bp, Unknown
  misc_feature (1)..( 9): Result.003 file - promoters60/3437803
gttttatat

SEQ ID NO: 130337 - DNA, 9 bp, Unknown
  misc_feature (1)..( 9): Result.003 file - promoters60/3437803
attttataa

SEQ ID NO: 130338 - DNA, 12 bp, Unknown
  misc_feature (1)..( 12): Result.003 file - promoters60/3437803
tcctatttaaac

SEQ ID NO: 130339 - DNA, 12 bp, Unknown
  misc_feature (1)..( 12): Result.003 file - promoters60/3437803
tcctatttaaat

SEQ ID NO: 130340 - DNA, 12 bp, Unknown
  misc_feature (1)..( 12): Result.003 file - promoters60/3437803
ccctatataaag

SEQ ID NO: 130341 - DNA, 12 bp, Unknown
  misc_feature (1)..( 12): Result.003 file - promoters60/3437803
tttattttaaag

SEQ ID NO: 130342 - DNA, 12 bp, Unknown
  misc_feature (1)..( 12): Result.003 file - promoters60/3437803
gataatataaag

SEQ ID NO: 130343 - DNA, 9 bp, Unknown
  misc_feature (1)..( 9): Result.003 file - promoters60/3437803
tttacacta

SEQ ID NO: 130344 - DNA, 9 bp, Unknown
  misc_feature (1)..( 9): Result.003 file - promoters60/3437803
tttacaaga

SEQ ID NO: 130345 - DNA, 9 bp, Unknown
  misc_feature (1)..( 9): Result.003 file - promoters60/3437803
tttatactc

SEQ ID NO: 130346 - DNA, 9 bp, Unknown
  misc_feature (1)..( 9): Result.003 file - promoters60/3437803
attagaaga

SEQ ID NO: 130347 - DNA, 9 bp, Unknown
  misc_feature (1)..( 9): Result.003 file - promoters60/3437808
aagttttaa

SEQ ID NO: 130348 - DNA, 9 bp, Unknown
  misc_feature (1)..( 9): Result.003 file - promoters60/3437808
aagatttga

SEQ ID NO: 130349 - DNA, 9 bp, Unknown
  misc_feature (1)..( 9): Result.003 file - promoters60/3437808
aagctttaa

SEQ ID NO: 130350 - DNA, 9 bp, Unknown
  misc_feature (1)..( 9): Result.003 file - promoters60/3437808
tagaattgt

SEQ ID NO: 130351 - DNA, 13 bp, Unknown
  misc_feature (1)..( 13): Result.003 file - promoters60/3437871
catataagcaaac

SEQ ID NO: 130352 - DNA, 13 bp, Unknown
  misc_feature (1)..( 13): Result.003 file - promoters60/3437871
cataaaagaaaaa

SEQ ID NO: 130353 - DNA, 13 bp, Unknown
  misc_feature (1)..( 13): Result.003 file - promoters60/3437871
aatccgagaaaaa

SEQ ID NO: 130354 - DNA, 13 bp, Unknown
  misc_feature (1)..( 13): Result.003 file - promoters60/3437871
tgtcaaagaagaa

SEQ ID NO: 130355 - DNA, 12 bp, Unknown
  misc_feature (1)..( 12): Result.003 file - promoters60/3437871
aacgaaacacct

SEQ ID NO: 130356 - DNA, 12 bp, Unknown
  misc_feature (1)..( 12): Result.003 file - promoters60/3437871
ggacaaaaacct

SEQ ID NO: 130357 - DNA, 12 bp, Unknown
  misc_feature (1)..( 12): Result.003 file - promoters60/3437871
atggaaacaact

SEQ ID NO: 130358 - DNA, 12 bp, Unknown
  misc_feature (1)..( 12): Result.003 file - promoters60/3437871
gaccaaaagagc

SEQ ID NO: 130359 - DNA, 6 bp, Unknown
  misc_feature (1)..( 6): Result.003 file - promoters60/3437875
tataat

SEQ ID NO: 130360 - DNA, 6 bp, Unknown
  misc_feature (1)..( 6): Result.003 file - promoters60/3437875
tataat

SEQ ID NO: 130361 - DNA, 10 bp, Unknown
  misc_feature (1)..( 10): Result.003 file - promoters60/3437875
aattaaatta

SEQ ID NO: 130362 - DNA, 10 bp, Unknown
  misc_feature (1)..( 10): Result.003 file - promoters60/3437875
aataaaatta

SEQ ID NO: 130363 - DNA, 7 bp, Unknown
  misc_feature (1)..( 7): Result.003 file - promoters60/3437875
ttaatgt

SEQ ID NO: 130364 - DNA, 7 bp, Unknown
  misc_feature (1)..( 7): Result.003 file - promoters60/3437875
ttattgt

SEQ ID NO: 130365 - DNA, 7 bp, Unknown
  misc_feature (1)..( 7): Result.003 file - promoters60/3437875
gtgttgt

SEQ ID NO: 130366 - DNA, 7 bp, Unknown
  misc_feature (1)..( 7): Result.003 file - promoters60/3437875
gtgatgt

SEQ ID NO: 130367 - DNA, 7 bp, Unknown
  misc_feature (1)..( 7): Result.003 file - promoters60/3437875
agaccaa

SEQ ID NO: 130368 - DNA, 7 bp, Unknown
  misc_feature (1)..( 7): Result.003 file - promoters60/3437875
agagcaa

SEQ ID NO: 130369 - DNA, 9 bp, Unknown
  misc_feature (1)..( 9): Result.003 file - promoters60/3437875
tcagacttt

SEQ ID NO: 130370 - DNA, 9 bp, Unknown
  misc_feature (1)..( 9): Result.003 file - promoters60/3437875
tcagtcttt

SEQ ID NO: 130371 - DNA, 6 bp, Unknown
  misc_feature (1)..( 6): Result.003 file - promoters60/3437875
ttctca

SEQ ID NO: 130372 - DNA, 6 bp, Unknown
  misc_feature (1)..( 6): Result.003 file - promoters60/3437875
ttctca

SEQ ID NO: 130373 - DNA, 6 bp, Unknown
  misc_feature (1)..( 6): Result.003 file - promoters60/3437875
tgtttc

SEQ ID NO: 130374 - DNA, 6 bp, Unknown
  misc_feature (1)..( 6): Result.003 file - promoters60/3437875
tgtttc

SEQ ID NO: 130375 - DNA, 7 bp, Unknown
  misc_feature (1)..( 7): Result.003 file - promoters60/3437991
gatgaca

SEQ ID NO: 130376 - DNA, 7 bp, Unknown
  misc_feature (1)..( 7): Result.003 file - promoters60/3437991
gatgaca

SEQ ID NO: 130377 - DNA, 8 bp, Unknown
  misc_feature (1)..( 8): Result.003 file - promoters60/3437991
aaatcaaa

SEQ ID NO: 130378 - DNA, 8 bp, Unknown
  misc_feature (1)..( 8): Result.003 file - promoters60/3437991
aaatgaaa

SEQ ID NO: 130379 - DNA, 8 bp, Unknown
  misc_feature (1)..( 8): Result.003 file - promoters60/3437991
aaataatt

SEQ ID NO: 130380 - DNA, 8 bp, Unknown
  misc_feature (1)..( 8): Result.003 file - promoters60/3437991
aaagaatc

SEQ ID NO: 130381 - DNA, 8 bp, Unknown
  misc_feature (1)..( 8): Result.003 file - promoters60/3437991
gtataatt

SEQ ID NO: 130382 - DNA, 6 bp, Unknown
  misc_feature (1)..( 6): Result.003 file - promoters60/3437991
gagaga

SEQ ID NO: 130383 - DNA, 6 bp, Unknown
  misc_feature (1)..( 6): Result.003 file - promoters60/3437991
gagaga

SEQ ID NO: 130384 - DNA, 9 bp, Unknown
  misc_feature (1)..( 9): Result.003 file - promoters60/3437991
ttttgattt

SEQ ID NO: 130385 - DNA, 9 bp, Unknown
  misc_feature (1)..( 9): Result.003 file - promoters60/3437991
ttttcattt

SEQ ID NO: 130386 - DNA, 6 bp, Unknown
  misc_feature (1)..( 6): Result.003 file - promoters60/3437991
taaaaa

SEQ ID NO: 130387 - DNA, 6 bp, Unknown
  misc_feature (1)..( 6): Result.003 file - promoters60/3437991
taaaaa

SEQ ID NO: 130388 - DNA, 7 bp, Unknown
  misc_feature (1)..( 7): Result.003 file - promoters60/3437991
agaaaat

SEQ ID NO: 130389 - DNA, 7 bp, Unknown
  misc_feature (1)..( 7): Result.003 file - promoters60/3437991
agaaaat

SEQ ID NO: 130390 - DNA, 6 bp, Unknown
  misc_feature (1)..( 6): Result.003 file - promoters60/3437991
ttataa

SEQ ID NO: 130391 - DNA, 6 bp, Unknown
  misc_feature (1)..( 6): Result.003 file - promoters60/3437991
ttataa

SEQ ID NO: 130392 - DNA, 6 bp, Unknown
  misc_feature (1)..( 6): Result.003 file - promoters60/3437991
ttataa

SEQ ID NO: 130393 - DNA, 10 bp, Unknown
  misc_feature (1)..( 10): Result.003 file - promoters60/3437991
tgtaataatc

SEQ ID NO: 130394 - DNA, 10 bp, Unknown
  misc_feature (1)..( 10): Result.003 file - promoters60/3437991
atgaatgatc

SEQ ID NO: 130395 - DNA, 10 bp, Unknown
  misc_feature (1)..( 10): Result.003 file - promoters60/3437991
tgttataact

SEQ ID NO: 130396 - DNA, 11 bp, Unknown
  misc_feature (1)..( 11): Result.003 file - promoters60/3437991
aataaacaatt

SEQ ID NO: 130397 - DNA, 11 bp, Unknown
  misc_feature (1)..( 11): Result.003 file - promoters60/3437991
aatagacaatt

SEQ ID NO: 130398 - DNA, 8 bp, Unknown
  misc_feature (1)..( 8): Result.003 file - promoters60/3437991
tcaagccc

SEQ ID NO: 130399 - DNA, 8 bp, Unknown
  misc_feature (1)..( 8): Result.003 file - promoters60/3437991
tcaaaccc

SEQ ID NO: 130400 - DNA, 6 bp, Unknown
  misc_feature (1)..( 6): Result.003 file - promoters60/3437991
actaat

SEQ ID NO: 130401 - DNA, 6 bp, Unknown
  misc_feature (1)..( 6): Result.003 file - promoters60/3437991
actaat

SEQ ID NO: 130402 - DNA, 6 bp, Unknown
  misc_feature (1)..( 6): Result.003 file - promoters60/3437991
ctattc

SEQ ID NO: 130403 - DNA, 6 bp, Unknown
  misc_feature (1)..( 6): Result.003 file - promoters60/3437991
ctattc

SEQ ID NO: 130404 - DNA, 7 bp, Unknown
  misc_feature (1)..( 7): Result.003 file - promoters60/3437991
taattgt

SEQ ID NO: 130405 - DNA, 7 bp, Unknown
  misc_feature (1)..( 7): Result.003 file - promoters60/3437991
taaatgt

SEQ ID NO: 130406 - DNA, 6 bp, Unknown
  misc_feature (1)..( 6): Result.003 file - promoters60/3437991
aatatt

SEQ ID NO: 130407 - DNA, 6 bp, Unknown
  misc_feature (1)..( 6): Result.003 file - promoters60/3437991
aatatt

SEQ ID NO: 130408 - DNA, 7 bp, Unknown
  misc_feature (1)..( 7): Result.003 file - promoters60/3437991
agaaata

SEQ ID NO: 130409 - DNA, 7 bp, Unknown
  misc_feature (1)..( 7): Result.003 file - promoters60/3437991
agaaata

SEQ ID NO: 130410 - DNA, 6 bp, Unknown
  misc_feature (1)..( 6): Result.003 file - promoters60/3437991
tgattt

SEQ ID NO: 130411 - DNA, 6 bp, Unknown
  misc_feature (1)..( 6): Result.003 file - promoters60/3437991
tgattt

SEQ ID NO: 130412 - DNA, 6 bp, Unknown
  misc_feature (1)..( 6): Result.003 file - promoters60/3437991
ctaaac

SEQ ID NO: 130413 - DNA, 6 bp, Unknown
  misc_feature (1)..( 6): Result.003 file - promoters60/3437991
ctaaac

SEQ ID NO: 130414 - DNA, 6 bp, Unknown
  misc_feature (1)..( 6): Result.003 file - promoters60/3437991
attcaa

SEQ ID NO: 130415 - DNA, 6 bp, Unknown
  misc_feature (1)..( 6): Result.003 file - promoters60/3437991
attcaa

SEQ ID NO: 130416 - DNA, 8 bp, Unknown
  misc_feature (1)..( 8): Result.003 file - promoters60/3437991
attattca

SEQ ID NO: 130417 - DNA, 8 bp, Unknown
  misc_feature (1)..( 8): Result.003 file - promoters60/3437991
attattca

SEQ ID NO: 130418 - DNA, 8 bp, Unknown
  misc_feature (1)..( 8): Result.003 file - promoters60/3437991
gtccaaaa

SEQ ID NO: 130419 - DNA, 8 bp, Unknown
  misc_feature (1)..( 8): Result.003 file - promoters60/3437991
gtcctaaa

SEQ ID NO: 130420 - DNA, 7 bp, Unknown
  misc_feature (1)..( 7): Result.003 file - promoters60/3437991
taggatt

SEQ ID NO: 130421 - DNA, 7 bp, Unknown
  misc_feature (1)..( 7): Result.003 file - promoters60/3437991
tagaatt

SEQ ID NO: 130422 - DNA, 6 bp, Unknown
  misc_feature (1)..( 6): Result.003 file - promoters60/3437991
gtgatt

SEQ ID NO: 130423 - DNA, 6 bp, Unknown
  misc_feature (1)..( 6): Result.003 file - promoters60/3437991
gtgatt

SEQ ID NO: 130424 - DNA, 8 bp, Unknown
  misc_feature (1)..( 8): Result.003 file - promoters60/3437991
atattttt

SEQ ID NO: 130425 - DNA, 8 bp, Unknown
  misc_feature (1)..( 8): Result.003 file - promoters60/3437991
atatattt

SEQ ID NO: 130426 - DNA, 6 bp, Unknown
  misc_feature (1)..( 6): Result.003 file - promoters60/3437991
atttaa

SEQ ID NO: 130427 - DNA, 6 bp, Unknown
  misc_feature (1)..( 6): Result.003 file - promoters60/3437991
atttaa

SEQ ID NO: 130428 - DNA, 6 bp, Unknown
  misc_feature (1)..( 6): Result.003 file - promoters60/3437991
atttat

SEQ ID NO: 130429 - DNA, 6 bp, Unknown
  misc_feature (1)..( 6): Result.003 file - promoters60/3437991
atttat

SEQ ID NO: 130430 - DNA, 9 bp, Unknown
  misc_feature (1)..( 9): Result.003 file - promoters60/3437991
aatatatat

SEQ ID NO: 130431 - DNA, 9 bp, Unknown
  misc_feature (1)..( 9): Result.003 file - promoters60/3437991
aatatatat

SEQ ID NO: 130432 - DNA, 9 bp, Unknown
  misc_feature (1)..( 9): Result.003 file - promoters60/3437991
taaattaat

SEQ ID NO: 130433 - DNA, 9 bp, Unknown
  misc_feature (1)..( 9): Result.003 file - promoters60/3437991
taaaataat

SEQ ID NO: 130434 - DNA, 7 bp, Unknown
  misc_feature (1)..( 7): Result.003 file - promoters60/3437991
ttataca

SEQ ID NO: 130435 - DNA, 7 bp, Unknown
  misc_feature (1)..( 7): Result.003 file - promoters60/3437991
ttacaca

SEQ ID NO: 130436 - DNA, 6 bp, Unknown
  misc_feature (1)..( 6): Result.003 file - promoters60/3437991
aataaa

SEQ ID NO: 130437 - DNA, 6 bp, Unknown
  misc_feature (1)..( 6): Result.003 file - promoters60/3437991
aataaa

SEQ ID NO: 130438 - DNA, 7 bp, Unknown
  misc_feature (1)..( 7): Result.003 file - promoters60/3437991
tatgaaa

SEQ ID NO: 130439 - DNA, 7 bp, Unknown
  misc_feature (1)..( 7): Result.003 file - promoters60/3437991
tatcaaa

SEQ ID NO: 130440 - DNA, 6 bp, Unknown
  misc_feature (1)..( 6): Result.003 file - promoters60/3438046
tttttg

SEQ ID NO: 130441 - DNA, 6 bp, Unknown
  misc_feature (1)..( 6): Result.003 file - promoters60/3438046
tttttg

SEQ ID NO: 130442 - DNA, 10 bp, Unknown
  misc_feature (1)..( 10): Result.003 file - promoters60/3438046
atgtaagaaa

SEQ ID NO: 130443 - DNA, 10 bp, Unknown
  misc_feature (1)..( 10): Result.003 file - promoters60/3438046
atgaaagaca

SEQ ID NO: 130444 - DNA, 10 bp, Unknown
  misc_feature (1)..( 10): Result.003 file - promoters60/3438046
ttataacaaa

SEQ ID NO: 130445 - DNA, 11 bp, Unknown
  misc_feature (1)..( 11): Result.003 file - promoters60/3438046
cctatatttat

SEQ ID NO: 130446 - DNA, 11 bp, Unknown
  misc_feature (1)..( 11): Result.003 file - promoters60/3438046
cctaaatttac

SEQ ID NO: 130447 - DNA, 11 bp, Unknown
  misc_feature (1)..( 11): Result.003 file - promoters60/3438046
tgacgatttat

SEQ ID NO: 130448 - DNA, 6 bp, Unknown
  misc_feature (1)..( 6): Result.003 file - promoters60/3438046
atactt

SEQ ID NO: 130449 - DNA, 6 bp, Unknown
  misc_feature (1)..( 6): Result.003 file - promoters60/3438046
atactt

SEQ ID NO: 130450 - DNA, 6 bp, Unknown
  misc_feature (1)..( 6): Result.003 file - promoters60/3438046
ctatct

SEQ ID NO: 130451 - DNA, 6 bp, Unknown
  misc_feature (1)..( 6): Result.003 file - promoters60/3438046
ctatct

SEQ ID NO: 130452 - DNA, 9 bp, Unknown
  misc_feature (1)..( 9): Result.003 file - promoters60/3438046
gaatctaaa

SEQ ID NO: 130453 - DNA, 9 bp, Unknown
  misc_feature (1)..( 9): Result.003 file - promoters60/3438046
gaaactaaa

SEQ ID NO: 130454 - DNA, 8 bp, Unknown
  misc_feature (1)..( 8): Result.003 file - promoters60/3438046
gaatgcat

SEQ ID NO: 130455 - DNA, 8 bp, Unknown
  misc_feature (1)..( 8): Result.003 file - promoters60/3438046
gaatgcat

SEQ ID NO: 130456 - DNA, 7 bp, Unknown
  misc_feature (1)..( 7): Result.003 file - promoters60/3438046
aaacaat

SEQ ID NO: 130457 - DNA, 7 bp, Unknown
  misc_feature (1)..( 7): Result.003 file - promoters60/3438046
aaacaat

SEQ ID NO: 130458 - DNA, 9 bp, Unknown
  misc_feature (1)..( 9): Result.003 file - promoters60/3438046
tgtaaacac

SEQ ID NO: 130459 - DNA, 9 bp, Unknown
  misc_feature (1)..( 9): Result.003 file - promoters60/3438046
tgttaacac

SEQ ID NO: 130460 - DNA, 8 bp, Unknown
  misc_feature (1)..( 8): Result.003 file - promoters60/3438046
ttgtcgtg

SEQ ID NO: 130461 - DNA, 8 bp, Unknown
  misc_feature (1)..( 8): Result.003 file - promoters60/3438046
ttgtggtg

SEQ ID NO: 130462 - DNA, 7 bp, Unknown
  misc_feature (1)..( 7): Result.003 file - promoters60/3438046
tcacaaa

SEQ ID NO: 130463 - DNA, 7 bp, Unknown
  misc_feature (1)..( 7): Result.003 file - promoters60/3438046
tcaaaaa

SEQ ID NO: 130464 - DNA, 7 bp, Unknown
  misc_feature (1)..( 7): Result.003 file - promoters60/3438046
caaaaat

SEQ ID NO: 130465 - DNA, 7 bp, Unknown
  misc_feature (1)..( 7): Result.003 file - promoters60/3438046
caataat

SEQ ID NO: 130466 - DNA, 7 bp, Unknown
  misc_feature (1)..( 7): Result.003 file - promoters60/3438046
gggaaaa

SEQ ID NO: 130467 - DNA, 7 bp, Unknown
  misc_feature (1)..( 7): Result.003 file - promoters60/3438046
gggaaaa

SEQ ID NO: 130468 - DNA, 8 bp, Unknown
  misc_feature (1)..( 8): Result.003 file - promoters60/3438046
ttcttttc

SEQ ID NO: 130469 - DNA, 8 bp, Unknown
  misc_feature (1)..( 8): Result.003 file - promoters60/3438046
ttcgtttc

SEQ ID NO: 130470 - DNA, 7 bp, Unknown
  misc_feature (1)..( 7): Result.003 file - promoters60/3438069
agaaagg

SEQ ID NO: 130471 - DNA, 7 bp, Unknown
  misc_feature (1)..( 7): Result.003 file - promoters60/3438069
agaaagt

SEQ ID NO: 130472 - DNA, 7 bp, Unknown
  misc_feature (1)..( 7): Result.003 file - promoters60/3438069
agatagt

SEQ ID NO: 130473 - DNA, 8 bp, Unknown
  misc_feature (1)..( 8): Result.003 file - promoters60/3438069
gcataatg

SEQ ID NO: 130474 - DNA, 8 bp, Unknown
  misc_feature (1)..( 8): Result.003 file - promoters60/3438069
ttataatg

SEQ ID NO: 130475 - DNA, 8 bp, Unknown
  misc_feature (1)..( 8): Result.003 file - promoters60/3438069
ttaaaatc

SEQ ID NO: 130476 - DNA, 8 bp, Unknown
  misc_feature (1)..( 8): Result.003 file - promoters60/3438069
tcaaaatc

SEQ ID NO: 130477 - DNA, 8 bp, Unknown
  misc_feature (1)..( 8): Result.003 file - promoters60/3438069
gttaattg

SEQ ID NO: 130478 - DNA, 8 bp, Unknown
  misc_feature (1)..( 8): Result.003 file - promoters60/3438069
gttaattg

SEQ ID NO: 130479 - DNA, 8 bp, Unknown
  misc_feature (1)..( 8): Result.003 file - promoters60/3438069
attacttg

SEQ ID NO: 130480 - DNA, 13 bp, Unknown
  misc_feature (1)..( 13): Result.003 file - promoters60/3438171
tttaaaaattaaa

SEQ ID NO: 130481 - DNA, 13 bp, Unknown
  misc_feature (1)..( 13): Result.003 file - promoters60/3438171
tggtaaaatttca

SEQ ID NO: 130482 - DNA, 14 bp, Unknown
  misc_feature (1)..( 14): Result.003 file - promoters60/3438171
atctaataatttct

SEQ ID NO: 130483 - DNA, 14 bp, Unknown
  misc_feature (1)..( 14): Result.003 file - promoters60/3438171
gttaaaaaattgtc

SEQ ID NO: 130484 - DNA, 14 bp, Unknown
  misc_feature (1)..( 14): Result.003 file - promoters60/3438171
caaaaaaaatatag

SEQ ID NO: 130485 - DNA, 14 bp, Unknown
  misc_feature (1)..( 14): Result.003 file - promoters60/3438171
gttgagaaatttca

SEQ ID NO: 130486 - DNA, 13 bp, Unknown
  misc_feature (1)..( 13): Result.003 file - promoters60/3438171
caataaaattaat

SEQ ID NO: 130487 - DNA, 13 bp, Unknown
  misc_feature (1)..( 13): Result.003 file - promoters60/3438171
agataatatttca

SEQ ID NO: 130488 - DNA, 13 bp, Unknown
  misc_feature (1)..( 13): Result.003 file - promoters60/3438171
aaataaaattaaa

SEQ ID NO: 130489 - DNA, 13 bp, Unknown
  misc_feature (1)..( 13): Result.003 file - promoters60/3438171
caaaaaactttat

SEQ ID NO: 130490 - DNA, 13 bp, Unknown
  misc_feature (1)..( 13): Result.003 file - promoters60/3438171
tcgtaatgtttca

SEQ ID NO: 130491 - DNA, 13 bp, Unknown
  misc_feature (1)..( 13): Result.003 file - promoters60/3438171
ttttaatatgaag

SEQ ID NO: 130492 - DNA, 14 bp, Unknown
  misc_feature (1)..( 14): Result.003 file - promoters60/3438171
taaataaatttttg

SEQ ID NO: 130493 - DNA, 14 bp, Unknown
  misc_feature (1)..( 14): Result.003 file - promoters60/3438171
caaacaaatgtttg

SEQ ID NO: 130494 - DNA, 14 bp, Unknown
  misc_feature (1)..( 14): Result.003 file - promoters60/3438171
attatatattctgc

SEQ ID NO: 130495 - DNA, 14 bp, Unknown
  misc_feature (1)..( 14): Result.003 file - promoters60/3438171
tcaataaaaaaaaa

SEQ ID NO: 130496 - DNA, 14 bp, Unknown
  misc_feature (1)..( 14): Result.003 file - promoters60/3438171
taactaatttctta

SEQ ID NO: 130497 - DNA, 15 bp, Unknown
  misc_feature (1)..( 15): Result.003 file - promoters60/3438171
aaaatacaaaacgtt

SEQ ID NO: 130498 - DNA, 13 bp, Unknown
  misc_feature (1)..( 13): Result.003 file - promoters60/3438171
tttgaataaaagc

SEQ ID NO: 130499 - DNA, 13 bp, Unknown
  misc_feature (1)..( 13): Result.003 file - promoters60/3438171
atccaattaaaaa

SEQ ID NO: 130500 - DNA, 13 bp, Unknown
  misc_feature (1)..( 13): Result.003 file - promoters60/3438171
tttaaataaacaa

SEQ ID NO: 130501 - DNA, 13 bp, Unknown
  misc_feature (1)..( 13): Result.003 file - promoters60/3438171
tcagatttaaaga

SEQ ID NO: 130502 - DNA, 13 bp, Unknown
  misc_feature (1)..( 13): Result.003 file - promoters60/3438171
tcatgtttaaaac

SEQ ID NO: 130503 - DNA, 13 bp, Unknown
  misc_feature (1)..( 13): Result.003 file - promoters60/3438171
caaattttagata

SEQ ID NO: 130504 - DNA, 13 bp, Unknown
  misc_feature (1)..( 13): Result.003 file - promoters60/3438171
gaaaaagaaagac

SEQ ID NO: 130505 - DNA, 21 bp, Unknown
  misc_feature (1)..( 21): Result.003 file - promoters60/3438171
gcaaattattcacacatgttg

SEQ ID NO: 130506 - DNA, 21 bp, Unknown
  misc_feature (1)..( 21): Result.003 file - promoters60/3438171
ccaaaatatctaaacactaat

SEQ ID NO: 130507 - DNA, 21 bp, Unknown
  misc_feature (1)..( 21): Result.003 file - promoters60/3438171
attaattattcatacaagttg

SEQ ID NO: 130508 - DNA, 21 bp, Unknown
  misc_feature (1)..( 21): Result.003 file - promoters60/3438171
caaaattagcgagtaggataa

SEQ ID NO: 130509 - DNA, 21 bp, Unknown
  misc_feature (1)..( 21): Result.003 file - promoters60/3438171
ccaaaaacacttagctgtttt

SEQ ID NO: 130510 - DNA, 21 bp, Unknown
  misc_feature (1)..( 21): Result.003 file - promoters60/3438171
gcaaaaaaagaacagaaaaaa

SEQ ID NO: 130511 - DNA, 11 bp, Unknown
  misc_feature (1)..( 11): Result.003 file - promoters60/3438171
tggatatatca

SEQ ID NO: 130512 - DNA, 11 bp, Unknown
  misc_feature (1)..( 11): Result.003 file - promoters60/3438171
aatgtatgtca

SEQ ID NO: 130513 - DNA, 11 bp, Unknown
  misc_feature (1)..( 11): Result.003 file - promoters60/3438171
cacatacatct

SEQ ID NO: 130514 - DNA, 11 bp, Unknown
  misc_feature (1)..( 11): Result.003 file - promoters60/3438171
ttaatatatac

SEQ ID NO: 130515 - DNA, 11 bp, Unknown
  misc_feature (1)..( 11): Result.003 file - promoters60/3438171
ttcatatatta

SEQ ID NO: 130516 - DNA, 11 bp, Unknown
  misc_feature (1)..( 11): Result.003 file - promoters60/3438171
ttattatagat

SEQ ID NO: 130517 - DNA, 11 bp, Unknown
  misc_feature (1)..( 11): Result.003 file - promoters60/3438171
ttaatatttag

SEQ ID NO: 130518 - DNA, 11 bp, Unknown
  misc_feature (1)..( 11): Result.003 file - promoters60/3438171
gtaatgtttca

SEQ ID NO: 130519 - DNA, 11 bp, Unknown
  misc_feature (1)..( 11): Result.003 file - promoters60/3438171
ttaatatgaag

SEQ ID NO: 130520 - DNA, 11 bp, Unknown
  misc_feature (1)..( 11): Result.003 file - promoters60/3438171
ataaaattaaa

SEQ ID NO: 130521 - DNA, 11 bp, Unknown
  misc_feature (1)..( 11): Result.003 file - promoters60/3438171
ttattatagat

SEQ ID NO: 130522 - DNA, 11 bp, Unknown
  misc_feature (1)..( 11): Result.003 file - promoters60/3438171
ataatatttca

SEQ ID NO: 130523 - DNA, 11 bp, Unknown
  misc_feature (1)..( 11): Result.003 file - promoters60/3438171
acattacatga

SEQ ID NO: 130524 - DNA, 10 bp, Unknown
  misc_feature (1)..( 10): Result.003 file - promoters60/3438171
ctttttattt

SEQ ID NO: 130525 - DNA, 10 bp, Unknown
  misc_feature (1)..( 10): Result.003 file - promoters60/3438171
aattttatta

SEQ ID NO: 130526 - DNA, 10 bp, Unknown
  misc_feature (1)..( 10): Result.003 file - promoters60/3438171
atttttattg

SEQ ID NO: 130527 - DNA, 10 bp, Unknown
  misc_feature (1)..( 10): Result.003 file - promoters60/3438171
ttttttactc

SEQ ID NO: 130528 - DNA, 10 bp, Unknown
  misc_feature (1)..( 10): Result.003 file - promoters60/3438171
cattttataa

SEQ ID NO: 130529 - DNA, 10 bp, Unknown
  misc_feature (1)..( 10): Result.003 file - promoters60/3438171
ctggttatta

SEQ ID NO: 130530 - DNA, 10 bp, Unknown
  misc_feature (1)..( 10): Result.003 file - promoters60/3438171
catgttacta

SEQ ID NO: 130531 - DNA, 10 bp, Unknown
  misc_feature (1)..( 10): Result.003 file - promoters60/3438171
taaattttaa

SEQ ID NO: 130532 - DNA, 10 bp, Unknown
  misc_feature (1)..( 10): Result.003 file - promoters60/3438171
ttaattttcg

SEQ ID NO: 130533 - DNA, 10 bp, Unknown
  misc_feature (1)..( 10): Result.003 file - promoters60/3438171
aaaattataa

SEQ ID NO: 130534 - DNA, 10 bp, Unknown
  misc_feature (1)..( 10): Result.003 file - promoters60/3438171
gtaatgttca

SEQ ID NO: 130535 - DNA, 10 bp, Unknown
  misc_feature (1)..( 10): Result.003 file - promoters60/3438171
attatttttt

SEQ ID NO: 130536 - DNA, 10 bp, Unknown
  misc_feature (1)..( 10): Result.003 file - promoters60/3438171
aaaattaact

SEQ ID NO: 130537 - DNA, 12 bp, Unknown
  misc_feature (1)..( 12): Result.003 file - promoters60/3438171
caaacaaaaact

SEQ ID NO: 130538 - DNA, 12 bp, Unknown
  misc_feature (1)..( 12): Result.003 file - promoters60/3438171
aacgtaaagact

SEQ ID NO: 130539 - DNA, 12 bp, Unknown
  misc_feature (1)..( 12): Result.003 file - promoters60/3438171
aaaataaaaata

SEQ ID NO: 130540 - DNA, 12 bp, Unknown
  misc_feature (1)..( 12): Result.003 file - promoters60/3438171
caaacaaaaata

SEQ ID NO: 130541 - DNA, 12 bp, Unknown
  misc_feature (1)..( 12): Result.003 file - promoters60/3438171
caattaaaaagg

SEQ ID NO: 130542 - DNA, 12 bp, Unknown
  misc_feature (1)..( 12): Result.003 file - promoters60/3438171
caaccaaacctc

SEQ ID NO: 130543 - DNA, 10 bp, Unknown
  misc_feature (1)..( 10): Result.003 file - promoters60/3438171
ggatagttta

SEQ ID NO: 130544 - DNA, 10 bp, Unknown
  misc_feature (1)..( 10): Result.003 file - promoters60/3438171
taataatttc

SEQ ID NO: 130545 - DNA, 10 bp, Unknown
  misc_feature (1)..( 10): Result.003 file - promoters60/3438171
gtaaaatttc

SEQ ID NO: 130546 - DNA, 10 bp, Unknown
  misc_feature (1)..( 10): Result.003 file - promoters60/3438171
gagaaatttc

SEQ ID NO: 130547 - DNA, 10 bp, Unknown
  misc_feature (1)..( 10): Result.003 file - promoters60/3438171
tagacatttt

SEQ ID NO: 130548 - DNA, 10 bp, Unknown
  misc_feature (1)..( 10): Result.003 file - promoters60/3438171
tagacacata

SEQ ID NO: 130549 - DNA, 9 bp, Unknown
  misc_feature (1)..( 9): Result.003 file - promoters60/3438171
tacaaaaaa

SEQ ID NO: 130550 - DNA, 9 bp, Unknown
  misc_feature (1)..( 9): Result.003 file - promoters60/3438171
tagaaaaaa

SEQ ID NO: 130551 - DNA, 9 bp, Unknown
  misc_feature (1)..( 9): Result.003 file - promoters60/3438171
cacataaat

SEQ ID NO: 130552 - DNA, 9 bp, Unknown
  misc_feature (1)..( 9): Result.003 file - promoters60/3438171
aacaaaaaa

SEQ ID NO: 130553 - DNA, 9 bp, Unknown
  misc_feature (1)..( 9): Result.003 file - promoters60/3438171
gtcataaat

SEQ ID NO: 130554 - DNA, 9 bp, Unknown
  misc_feature (1)..( 9): Result.003 file - promoters60/3438171
aaccaaagt

SEQ ID NO: 130555 - DNA, 17 bp, Unknown
  misc_feature (1)..( 17): Result.003 file - promoters60/3438171
cgcctatatataaaaca

SEQ ID NO: 130556 - DNA, 17 bp, Unknown
  misc_feature (1)..( 17): Result.003 file - promoters60/3438171
aaaatataaataacaca

SEQ ID NO: 130557 - DNA, 17 bp, Unknown
  misc_feature (1)..( 17): Result.003 file - promoters60/3438171
cacttataaatacttat

SEQ ID NO: 130558 - DNA, 17 bp, Unknown
  misc_feature (1)..( 17): Result.003 file - promoters60/3438171
ttctcatatataacaca

SEQ ID NO: 130559 - DNA, 17 bp, Unknown
  misc_feature (1)..( 17): Result.003 file - promoters60/3438171
cctttataaactcatac

SEQ ID NO: 130560 - DNA, 17 bp, Unknown
  misc_feature (1)..( 17): Result.003 file - promoters60/3438171
gctatttaagtaaaatc

SEQ ID NO: 130561 - DNA, 17 bp, Unknown
  misc_feature (1)..( 17): Result.003 file - promoters60/3438171
cgtgtttatataagtgt

SEQ ID NO: 130562 - DNA, 8 bp, Unknown
  misc_feature (1)..( 8): Result.003 file - promoters60/3438222
attactta

SEQ ID NO: 130563 - DNA, 8 bp, Unknown
  misc_feature (1)..( 8): Result.003 file - promoters60/3438222
catactta

SEQ ID NO: 130564 - DNA, 8 bp, Unknown
  misc_feature (1)..( 8): Result.003 file - promoters60/3438222
attaatta

SEQ ID NO: 130565 - DNA, 8 bp, Unknown
  misc_feature (1)..( 8): Result.003 file - promoters60/3438222
ctacgcaa

SEQ ID NO: 130566 - DNA, 8 bp, Unknown
  misc_feature (1)..( 8): Result.003 file - promoters60/3438222
ctacacaa

SEQ ID NO: 130567 - DNA, 7 bp, Unknown
  misc_feature (1)..( 7): Result.003 file - promoters60/3438222
aagaaac

SEQ ID NO: 130568 - DNA, 7 bp, Unknown
  misc_feature (1)..( 7): Result.003 file - promoters60/3438222
aagtaac

SEQ ID NO: 130569 - DNA, 7 bp, Unknown
  misc_feature (1)..( 7): Result.003 file - promoters60/3438222
ggtggta

SEQ ID NO: 130570 - DNA, 7 bp, Unknown
  misc_feature (1)..( 7): Result.003 file - promoters60/3438222
ggttgta

SEQ ID NO: 130571 - DNA, 8 bp, Unknown
  misc_feature (1)..( 8): Result.003 file - promoters60/3438222
attgttgt

SEQ ID NO: 130572 - DNA, 8 bp, Unknown
  misc_feature (1)..( 8): Result.003 file - promoters60/3438222
attgatgt

SEQ ID NO: 130573 - DNA, 6 bp, Unknown
  misc_feature (1)..( 6): Result.003 file - promoters60/3438222
attact

SEQ ID NO: 130574 - DNA, 6 bp, Unknown
  misc_feature (1)..( 6): Result.003 file - promoters60/3438222
attact

SEQ ID NO: 130575 - DNA, 7 bp, Unknown
  misc_feature (1)..( 7): Result.003 file - promoters60/3438222
gatgttt

SEQ ID NO: 130576 - DNA, 7 bp, Unknown
  misc_feature (1)..( 7): Result.003 file - promoters60/3438222
gatcttt

SEQ ID NO: 130577 - DNA, 6 bp, Unknown
  misc_feature (1)..( 6): Result.003 file - promoters60/3438222
caactg

SEQ ID NO: 130578 - DNA, 6 bp, Unknown
  misc_feature (1)..( 6): Result.003 file - promoters60/3438222
caactg

SEQ ID NO: 130579 - DNA, 6 bp, Unknown
  misc_feature (1)..( 6): Result.003 file - promoters60/3438222
tgaaaa

SEQ ID NO: 130580 - DNA, 6 bp, Unknown
  misc_feature (1)..( 6): Result.003 file - promoters60/3438222
tgaaaa

SEQ ID NO: 130581 - DNA, 8 bp, Unknown
  misc_feature (1)..( 8): Result.003 file - promoters60/3438222
tatcaaat

SEQ ID NO: 130582 - DNA, 8 bp, Unknown
  misc_feature (1)..( 8): Result.003 file - promoters60/3438222
tattaaat

SEQ ID NO: 130583 - DNA, 6 bp, Unknown
  misc_feature (1)..( 6): Result.003 file - promoters60/3438222
taagag

SEQ ID NO: 130584 - DNA, 6 bp, Unknown
  misc_feature (1)..( 6): Result.003 file - promoters60/3438222
taagag

SEQ ID NO: 130585 - DNA, 6 bp, Unknown
  misc_feature (1)..( 6): Result.003 file - promoters60/3438222
taaaaa

SEQ ID NO: 130586 - DNA, 6 bp, Unknown
  misc_feature (1)..( 6): Result.003 file - promoters60/3438222
taaaaa

SEQ ID NO: 130587 - DNA, 6 bp, Unknown
  misc_feature (1)..( 6): Result.003 file - promoters60/3438222
caagtg

SEQ ID NO: 130588 - DNA, 6 bp, Unknown
  misc_feature (1)..( 6): Result.003 file - promoters60/3438222
caagtg

SEQ ID NO: 130589 - DNA, 8 bp, Unknown
  misc_feature (1)..( 8): Result.003 file - promoters60/3438222
aaaagatc

SEQ ID NO: 130590 - DNA, 8 bp, Unknown
  misc_feature (1)..( 8): Result.003 file - promoters60/3438222
aaaacatc

SEQ ID NO: 130591 - DNA, 7 bp, Unknown
  misc_feature (1)..( 7): Result.003 file - promoters60/3438222
aaaaaat

SEQ ID NO: 130592 - DNA, 7 bp, Unknown
  misc_feature (1)..( 7): Result.003 file - promoters60/3438222
aaacaat

SEQ ID NO: 130593 - DNA, 6 bp, Unknown
  misc_feature (1)..( 6): Result.003 file - promoters60/3438222
aacaat

SEQ ID NO: 130594 - DNA, 6 bp, Unknown
  misc_feature (1)..( 6): Result.003 file - promoters60/3438222
aacaat

SEQ ID NO: 130595 - DNA, 6 bp, Unknown
  misc_feature (1)..( 6): Result.003 file - promoters60/3438222
catgtt

SEQ ID NO: 130596 - DNA, 6 bp, Unknown
  misc_feature (1)..( 6): Result.003 file - promoters60/3438222
catgtt

SEQ ID NO: 130597 - DNA, 7 bp, Unknown
  misc_feature (1)..( 7): Result.003 file - promoters60/3438222
aaagtaa

SEQ ID NO: 130598 - DNA, 7 bp, Unknown
  misc_feature (1)..( 7): Result.003 file - promoters60/3438222
aaaataa

SEQ ID NO: 130599 - DNA, 6 bp, Unknown
  misc_feature (1)..( 6): Result.003 file - promoters60/3438222
ccacgt

SEQ ID NO: 130600 - DNA, 6 bp, Unknown
  misc_feature (1)..( 6): Result.003 file - promoters60/3438222
ccacgt

SEQ ID NO: 130601 - DNA, 6 bp, Unknown
  misc_feature (1)..( 6): Result.003 file - promoters60/3438222
tttctt

SEQ ID NO: 130602 - DNA, 6 bp, Unknown
  misc_feature (1)..( 6): Result.003 file - promoters60/3438222
tttctt

SEQ ID NO: 130603 - DNA, 8 bp, Unknown
  misc_feature (1)..( 8): Result.003 file - promoters60/3438236
attcaaat

SEQ ID NO: 130604 - DNA, 8 bp, Unknown
  misc_feature (1)..( 8): Result.003 file - promoters60/3438236
attcaact

SEQ ID NO: 130605 - DNA, 9 bp, Unknown
  misc_feature (1)..( 9): Result.003 file - promoters60/3438236
tttctaatg

SEQ ID NO: 130606 - DNA, 9 bp, Unknown
  misc_feature (1)..( 9): Result.003 file - promoters60/3438236
attctaatt

SEQ ID NO: 130607 - DNA, 9 bp, Unknown
  misc_feature (1)..( 9): Result.003 file - promoters60/3438236
ctgctaatt

SEQ ID NO: 130608 - DNA, 9 bp, Unknown
  misc_feature (1)..( 9): Result.003 file - promoters60/3438236
attctatat

SEQ ID NO: 130609 - DNA, 9 bp, Unknown
  misc_feature (1)..( 9): Result.003 file - promoters60/3438351
ttctatagt

SEQ ID NO: 130610 - DNA, 9 bp, Unknown
  misc_feature (1)..( 9): Result.003 file - promoters60/3438351
ttcaatagt

SEQ ID NO: 130611 - DNA, 6 bp, Unknown
  misc_feature (1)..( 6): Result.003 file - promoters60/3438351
attttt

SEQ ID NO: 130612 - DNA, 6 bp, Unknown
  misc_feature (1)..( 6): Result.003 file - promoters60/3438351
attttt

SEQ ID NO: 130613 - DNA, 7 bp, Unknown
  misc_feature (1)..( 7): Result.003 file - promoters60/3438351
caagaaa

SEQ ID NO: 130614 - DNA, 7 bp, Unknown
  misc_feature (1)..( 7): Result.003 file - promoters60/3438351
caaaaaa

SEQ ID NO: 130615 - DNA, 8 bp, Unknown
  misc_feature (1)..( 8): Result.003 file - promoters60/3438351
gaactaaa

SEQ ID NO: 130616 - DNA, 7 bp, Unknown
  misc_feature (1)..( 7): Result.003 file - promoters60/3438351
agaatca

SEQ ID NO: 130617 - DNA, 7 bp, Unknown
  misc_feature (1)..( 7): Result.003 file - promoters60/3438351
agaatca

SEQ ID NO: 130618 - DNA, 7 bp, Unknown
  misc_feature (1)..( 7): Result.003 file - promoters60/3438351
attacaa

SEQ ID NO: 130619 - DNA, 7 bp, Unknown
  misc_feature (1)..( 7): Result.003 file - promoters60/3438351
attacaa

SEQ ID NO: 130620 - DNA, 6 bp, Unknown
  misc_feature (1)..( 6): Result.003 file - promoters60/3438351
attatt

SEQ ID NO: 130621 - DNA, 6 bp, Unknown
  misc_feature (1)..( 6): Result.003 file - promoters60/3438351
attatt

SEQ ID NO: 130622 - DNA, 9 bp, Unknown
  misc_feature (1)..( 9): Result.003 file - promoters60/3438351
atcaagcta

SEQ ID NO: 130623 - DNA, 9 bp, Unknown
  misc_feature (1)..( 9): Result.003 file - promoters60/3438351
atcaaacta

SEQ ID NO: 130624 - DNA, 9 bp, Unknown
  misc_feature (1)..( 9): Result.003 file - promoters60/3438351
ttttatcct

SEQ ID NO: 130625 - DNA, 9 bp, Unknown
  misc_feature (1)..( 9): Result.003 file - promoters60/3438351
tttgatcct

SEQ ID NO: 130626 - DNA, 6 bp, Unknown
  misc_feature (1)..( 6): Result.003 file - promoters60/3438351
ttttaa

SEQ ID NO: 130627 - DNA, 6 bp, Unknown
  misc_feature (1)..( 6): Result.003 file - promoters60/3438351
ttttaa

SEQ ID NO: 130628 - DNA, 7 bp, Unknown
  misc_feature (1)..( 7): Result.003 file - promoters60/3438351
taaaaat

SEQ ID NO: 130629 - DNA, 7 bp, Unknown
  misc_feature (1)..( 7): Result.003 file - promoters60/3438351
taaaaat

SEQ ID NO: 130630 - DNA, 6 bp, Unknown
  misc_feature (1)..( 6): Result.003 file - promoters60/3438351
aaatca

SEQ ID NO: 130631 - DNA, 6 bp, Unknown
  misc_feature (1)..( 6): Result.003 file - promoters60/3438351
aaatca

SEQ ID NO: 130632 - DNA, 7 bp, Unknown
  misc_feature (1)..( 7): Result.003 file - promoters60/3438351
aaaagtc

SEQ ID NO: 130633 - DNA, 7 bp, Unknown
  misc_feature (1)..( 7): Result.003 file - promoters60/3438351
aaaggtc

SEQ ID NO: 130634 - DNA, 9 bp, Unknown
  misc_feature (1)..( 9): Result.003 file - promoters60/3438351
taaaagttt

SEQ ID NO: 130635 - DNA, 9 bp, Unknown
  misc_feature (1)..( 9): Result.003 file - promoters60/3438351
taaaaattt

SEQ ID NO: 130636 - DNA, 7 bp, Unknown
  misc_feature (1)..( 7): Result.003 file - promoters60/3438351
tcttctt

SEQ ID NO: 130637 - DNA, 7 bp, Unknown
  misc_feature (1)..( 7): Result.003 file - promoters60/3438351
tcttctt

SEQ ID NO: 130638 - DNA, 7 bp, Unknown
  misc_feature (1)..( 7): Result.003 file - promoters60/3438351
tcatatt

SEQ ID NO: 130639 - DNA, 7 bp, Unknown
  misc_feature (1)..( 7): Result.003 file - promoters60/3438351
tcagatt

SEQ ID NO: 130640 - DNA, 6 bp, Unknown
  misc_feature (1)..( 6): Result.003 file - promoters60/3438351
ttgttt

SEQ ID NO: 130641 - DNA, 6 bp, Unknown
  misc_feature (1)..( 6): Result.003 file - promoters60/3438351
ttgttt

SEQ ID NO: 130642 - DNA, 7 bp, Unknown
  misc_feature (1)..( 7): Result.003 file - promoters60/3438351
tttcttt

SEQ ID NO: 130643 - DNA, 7 bp, Unknown
  misc_feature (1)..( 7): Result.003 file - promoters60/3438351
tttgttt

SEQ ID NO: 130644 - DNA, 6 bp, Unknown
  misc_feature (1)..( 6): Result.003 file - promoters60/3438351
cttata

SEQ ID NO: 130645 - DNA, 6 bp, Unknown
  misc_feature (1)..( 6): Result.003 file - promoters60/3438351
cttata

SEQ ID NO: 130646 - DNA, 8 bp, Unknown
  misc_feature (1)..( 8): Result.003 file - promoters60/3438351
gtttgctt

SEQ ID NO: 130647 - DNA, 8 bp, Unknown
  misc_feature (1)..( 8): Result.003 file - promoters60/3438351
gttttctt

SEQ ID NO: 130648 - DNA, 7 bp, Unknown
  misc_feature (1)..( 7): Result.003 file - promoters60/3438351
tgagaaa

SEQ ID NO: 130649 - DNA, 7 bp, Unknown
  misc_feature (1)..( 7): Result.003 file - promoters60/3438351
tgacaaa

SEQ ID NO: 130650 - DNA, 8 bp, Unknown
  misc_feature (1)..( 8): Result.003 file - promoters60/3438369
aaagaaat

SEQ ID NO: 130651 - DNA, 8 bp, Unknown
  misc_feature (1)..( 8): Result.003 file - promoters60/3438369
aaataaaa

SEQ ID NO: 130652 - DNA, 9 bp, Unknown
  misc_feature (1)..( 9): Result.003 file - promoters60/3438369
aaatgaaat

SEQ ID NO: 130653 - DNA, 9 bp, Unknown
  misc_feature (1)..( 9): Result.003 file - promoters60/3438369
aaaataata

SEQ ID NO: 130654 - DNA, 9 bp, Unknown
  misc_feature (1)..( 9): Result.003 file - promoters60/3438369
tatataata

SEQ ID NO: 130655 - DNA, 7 bp, Unknown
  misc_feature (1)..( 7): Result.003 file - promoters60/3438373
ttgcttc

SEQ ID NO: 130656 - DNA, 7 bp, Unknown
  misc_feature (1)..( 7): Result.003 file - promoters60/3438373
ttgcttc

SEQ ID NO: 130657 - DNA, 7 bp, Unknown
  misc_feature (1)..( 7): Result.003 file - promoters60/3438373
ggaacaa

SEQ ID NO: 130658 - DNA, 7 bp, Unknown
  misc_feature (1)..( 7): Result.003 file - promoters60/3438373
ggaacaa

SEQ ID NO: 130659 - DNA, 7 bp, Unknown
  misc_feature (1)..( 7): Result.003 file - promoters60/3438373
acaagat

SEQ ID NO: 130660 - DNA, 7 bp, Unknown
  misc_feature (1)..( 7): Result.003 file - promoters60/3438373
acatgat

SEQ ID NO: 130661 - DNA, 7 bp, Unknown
  misc_feature (1)..( 7): Result.003 file - promoters60/3438373
attacat

SEQ ID NO: 130662 - DNA, 7 bp, Unknown
  misc_feature (1)..( 7): Result.003 file - promoters60/3438373
attacat

SEQ ID NO: 130663 - DNA, 6 bp, Unknown
  misc_feature (1)..( 6): Result.003 file - promoters60/3438373
ttgtaa

SEQ ID NO: 130664 - DNA, 6 bp, Unknown
  misc_feature (1)..( 6): Result.003 file - promoters60/3438373
ttgtaa

SEQ ID NO: 130665 - DNA, 6 bp, Unknown
  misc_feature (1)..( 6): Result.003 file - promoters60/3438373
gaaaat

SEQ ID NO: 130666 - DNA, 6 bp, Unknown
  misc_feature (1)..( 6): Result.003 file - promoters60/3438373
gaaaat

SEQ ID NO: 130667 - DNA, 8 bp, Unknown
  misc_feature (1)..( 8): Result.003 file - promoters60/3438373
gttcttaa

SEQ ID NO: 130668 - DNA, 8 bp, Unknown
  misc_feature (1)..( 8): Result.003 file - promoters60/3438373
gttcctaa

SEQ ID NO: 130669 - DNA, 7 bp, Unknown
  misc_feature (1)..( 7): Result.003 file - promoters60/3438373
aatcaat

SEQ ID NO: 130670 - DNA, 7 bp, Unknown
  misc_feature (1)..( 7): Result.003 file - promoters60/3438373
aattaat

SEQ ID NO: 130671 - DNA, 8 bp, Unknown
  misc_feature (1)..( 8): Result.003 file - promoters60/3438373
atatctta

SEQ ID NO: 130672 - DNA, 8 bp, Unknown
  misc_feature (1)..( 8): Result.003 file - promoters60/3438373
atatctta

SEQ ID NO: 130673 - DNA, 6 bp, Unknown
  misc_feature (1)..( 6): Result.003 file - promoters60/3438373
gttcgt

SEQ ID NO: 130674 - DNA, 6 bp, Unknown
  misc_feature (1)..( 6): Result.003 file - promoters60/3438373
gttcgt

SEQ ID NO: 130675 - DNA, 9 bp, Unknown
  misc_feature (1)..( 9): Result.003 file - promoters60/3438373
tgaatcgaa

SEQ ID NO: 130676 - DNA, 9 bp, Unknown
  misc_feature (1)..( 9): Result.003 file - promoters60/3438373
tgactcgaa

SEQ ID NO: 130677 - DNA, 7 bp, Unknown
  misc_feature (1)..( 7): Result.003 file - promoters60/3438373
agaaaaa

SEQ ID NO: 130678 - DNA, 7 bp, Unknown
  misc_feature (1)..( 7): Result.003 file - promoters60/3438373
agaaaaa

SEQ ID NO: 130679 - DNA, 6 bp, Unknown
  misc_feature (1)..( 6): Result.003 file - promoters60/3438373
agtaaa

SEQ ID NO: 130680 - DNA, 6 bp, Unknown
  misc_feature (1)..( 6): Result.003 file - promoters60/3438373
agtaaa

SEQ ID NO: 130681 - DNA, 7 bp, Unknown
  misc_feature (1)..( 7): Result.003 file - promoters60/3438373
aatcggg

SEQ ID NO: 130682 - DNA, 7 bp, Unknown
  misc_feature (1)..( 7): Result.003 file - promoters60/3438373
aattggg

SEQ ID NO: 130683 - DNA, 8 bp, Unknown
  misc_feature (1)..( 8): Result.003 file - promoters60/3438373
gaaagaaa

SEQ ID NO: 130684 - DNA, 8 bp, Unknown
  misc_feature (1)..( 8): Result.003 file - promoters60/3438373
gaaacaaa

SEQ ID NO: 130685 - DNA, 10 bp, Unknown
  misc_feature (1)..( 10): Result.003 file - promoters60/3438373
ggaaaagaaa

SEQ ID NO: 130686 - DNA, 10 bp, Unknown
  misc_feature (1)..( 10): Result.003 file - promoters60/3438373
ggaaatgaaa

SEQ ID NO: 130687 - DNA, 7 bp, Unknown
  misc_feature (1)..( 7): Result.003 file - promoters60/3438373
cccacta

SEQ ID NO: 130688 - DNA, 7 bp, Unknown
  misc_feature (1)..( 7): Result.003 file - promoters60/3438373
cccacta

SEQ ID NO: 130689 - DNA, 9 bp, Unknown
  misc_feature (1)..( 9): Result.003 file - promoters60/3438373
aaagaaaag

SEQ ID NO: 130690 - DNA, 9 bp, Unknown
  misc_feature (1)..( 9): Result.003 file - promoters60/3438373
aaagtaaag

SEQ ID NO: 130691 - DNA, 7 bp, Unknown
  misc_feature (1)..( 7): Result.003 file - promoters60/3438373
gtatata

SEQ ID NO: 130692 - DNA, 7 bp, Unknown
  misc_feature (1)..( 7): Result.003 file - promoters60/3438373
gtatata

SEQ ID NO: 130693 - DNA, 7 bp, Unknown
  misc_feature (1)..( 7): Result.003 file - promoters60/3438420
ttccttt

SEQ ID NO: 130694 - DNA, 7 bp, Unknown
  misc_feature (1)..( 7): Result.003 file - promoters60/3438420
ttctttt

SEQ ID NO: 130695 - DNA, 8 bp, Unknown
  misc_feature (1)..( 8): Result.003 file - promoters60/3438420
tttctctc

SEQ ID NO: 130696 - DNA, 8 bp, Unknown
  misc_feature (1)..( 8): Result.003 file - promoters60/3438420
tttgtctc

SEQ ID NO: 130697 - DNA, 8 bp, Unknown
  misc_feature (1)..( 8): Result.003 file - promoters60/3438420
tttattgt

SEQ ID NO: 130698 - DNA, 6 bp, Unknown
  misc_feature (1)..( 6): Result.003 file - promoters60/3438420
tctcaa

SEQ ID NO: 130699 - DNA, 6 bp, Unknown
  misc_feature (1)..( 6): Result.003 file - promoters60/3438420
tctcaa

SEQ ID NO: 130700 - DNA, 7 bp, Unknown
  misc_feature (1)..( 7): Result.003 file - promoters60/3438420
ttttaga

SEQ ID NO: 130701 - DNA, 7 bp, Unknown
  misc_feature (1)..( 7): Result.003 file - promoters60/3438420
ttttaga

SEQ ID NO: 130702 - DNA, 11 bp, Unknown
  misc_feature (1)..( 11): Result.003 file - promoters60/3438420
atcaaaatcat

SEQ ID NO: 130703 - DNA, 11 bp, Unknown
  misc_feature (1)..( 11): Result.003 file - promoters60/3438420
atccaaatcat

SEQ ID NO: 130704 - DNA, 9 bp, Unknown
  misc_feature (1)..( 9): Result.003 file - promoters60/3438420
ccagtattc

SEQ ID NO: 130705 - DNA, 9 bp, Unknown
  misc_feature (1)..( 9): Result.003 file - promoters60/3438420
ccattattc

SEQ ID NO: 130706 - DNA, 8 bp, Unknown
  misc_feature (1)..( 8): Result.003 file - promoters60/3438420
gattttgg

SEQ ID NO: 130707 - DNA, 8 bp, Unknown
  misc_feature (1)..( 8): Result.003 file - promoters60/3438420
gattttac

SEQ ID NO: 130708 - DNA, 8 bp, Unknown
  misc_feature (1)..( 8): Result.003 file - promoters60/3438420
cattttac

SEQ ID NO: 130709 - DNA, 6 bp, Unknown
  misc_feature (1)..( 6): Result.003 file - promoters60/3438420
ttttgg

SEQ ID NO: 130710 - DNA, 6 bp, Unknown
  misc_feature (1)..( 6): Result.003 file - promoters60/3438420
ttttgg

SEQ ID NO: 130711 - DNA, 7 bp, Unknown
  misc_feature (1)..( 7): Result.003 file - promoters60/3438420
ttttttt

SEQ ID NO: 130712 - DNA, 7 bp, Unknown
  misc_feature (1)..( 7): Result.003 file - promoters60/3438420
ttttttt

SEQ ID NO: 130713 - DNA, 6 bp, Unknown
  misc_feature (1)..( 6): Result.003 file - promoters60/3438420
tcactt

SEQ ID NO: 130714 - DNA, 6 bp, Unknown
  misc_feature (1)..( 6): Result.003 file - promoters60/3438420
tcactt

SEQ ID NO: 130715 - DNA, 6 bp, Unknown
  misc_feature (1)..( 6): Result.003 file - promoters60/3438420
ggtaaa

SEQ ID NO: 130716 - DNA, 6 bp, Unknown
  misc_feature (1)..( 6): Result.003 file - promoters60/3438420
ggtaaa

SEQ ID NO: 130717 - DNA, 6 bp, Unknown
  misc_feature (1)..( 6): Result.003 file - promoters60/3438420
tgtgtt

SEQ ID NO: 130718 - DNA, 6 bp, Unknown
  misc_feature (1)..( 6): Result.003 file - promoters60/3438420
tgtgtt

SEQ ID NO: 130719 - DNA, 6 bp, Unknown
  misc_feature (1)..( 6): Result.003 file - promoters60/3438420
tttttt

SEQ ID NO: 130720 - DNA, 6 bp, Unknown
  misc_feature (1)..( 6): Result.003 file - promoters60/3438420
tttttt

SEQ ID NO: 130721 - DNA, 6 bp, Unknown
  misc_feature (1)..( 6): Result.003 file - promoters60/3438420
cttttt

SEQ ID NO: 130722 - DNA, 6 bp, Unknown
  misc_feature (1)..( 6): Result.003 file - promoters60/3438420
cttttt

SEQ ID NO: 130723 - DNA, 8 bp, Unknown
  misc_feature (1)..( 8): Result.003 file - promoters60/3438420
aaatgtaa

SEQ ID NO: 130724 - DNA, 8 bp, Unknown
  misc_feature (1)..( 8): Result.003 file - promoters60/3438420
aaatttaa

SEQ ID NO: 130725 - DNA, 6 bp, Unknown
  misc_feature (1)..( 6): Result.003 file - promoters60/3438420
ttatat

SEQ ID NO: 130726 - DNA, 6 bp, Unknown
  misc_feature (1)..( 6): Result.003 file - promoters60/3438420
ttatat

SEQ ID NO: 130727 - DNA, 7 bp, Unknown
  misc_feature (1)..( 7): Result.003 file - promoters60/3438420
ttttaga

SEQ ID NO: 130728 - DNA, 7 bp, Unknown
  misc_feature (1)..( 7): Result.003 file - promoters60/3438420
ttttaga

SEQ ID NO: 130729 - DNA, 6 bp, Unknown
  misc_feature (1)..( 6): Result.003 file - promoters60/3438420
aaaata

SEQ ID NO: 130730 - DNA, 6 bp, Unknown
  misc_feature (1)..( 6): Result.003 file - promoters60/3438420
aaaata

SEQ ID NO: 130731 - DNA, 7 bp, Unknown
  misc_feature (1)..( 7): Result.003 file - promoters60/3438420
aaccaac

SEQ ID NO: 130732 - DNA, 7 bp, Unknown
  misc_feature (1)..( 7): Result.003 file - promoters60/3438420
aaccaac

SEQ ID NO: 130733 - DNA, 8 bp, Unknown
  misc_feature (1)..( 8): Result.003 file - promoters60/3438429
aacagaga

SEQ ID NO: 130734 - DNA, 8 bp, Unknown
  misc_feature (1)..( 8): Result.003 file - promoters60/3438429
aacagaga

SEQ ID NO: 130735 - DNA, 6 bp, Unknown
  misc_feature (1)..( 6): Result.003 file - promoters60/3438429
taaaaa

SEQ ID NO: 130736 - DNA, 6 bp, Unknown
  misc_feature (1)..( 6): Result.003 file - promoters60/3438429
taaaaa

SEQ ID NO: 130737 - DNA, 7 bp, Unknown
  misc_feature (1)..( 7): Result.003 file - promoters60/3438429
ttcatct

SEQ ID NO: 130738 - DNA, 7 bp, Unknown
  misc_feature (1)..( 7): Result.003 file - promoters60/3438429
ttcatct

SEQ ID NO: 130739 - DNA, 6 bp, Unknown
  misc_feature (1)..( 6): Result.003 file - promoters60/3438429
aaaatt

SEQ ID NO: 130740 - DNA, 6 bp, Unknown
  misc_feature (1)..( 6): Result.003 file - promoters60/3438429
aaaatt

SEQ ID NO: 130741 - DNA, 8 bp, Unknown
  misc_feature (1)..( 8): Result.003 file - promoters60/3438429
aaaacaaa

SEQ ID NO: 130742 - DNA, 8 bp, Unknown
  misc_feature (1)..( 8): Result.003 file - promoters60/3438429
aaaacagt

SEQ ID NO: 130743 - DNA, 8 bp, Unknown
  misc_feature (1)..( 8): Result.003 file - promoters60/3438429
aaaaaaat

SEQ ID NO: 130744 - DNA, 8 bp, Unknown
  misc_feature (1)..( 8): Result.003 file - promoters60/3438429
aaaatgag

SEQ ID NO: 130745 - DNA, 8 bp, Unknown
  misc_feature (1)..( 8): Result.003 file - promoters60/3438429
aaactgag

SEQ ID NO: 130746 - DNA, 7 bp, Unknown
  misc_feature (1)..( 7): Result.003 file - promoters60/3438429
tgatttt

SEQ ID NO: 130747 - DNA, 7 bp, Unknown
  misc_feature (1)..( 7): Result.003 file - promoters60/3438429
tgagttt

SEQ ID NO: 130748 - DNA, 8 bp, Unknown
  misc_feature (1)..( 8): Result.003 file - promoters60/3438429
agaaattg

SEQ ID NO: 130749 - DNA, 8 bp, Unknown
  misc_feature (1)..( 8): Result.003 file - promoters60/3438429
agaaattg

SEQ ID NO: 130750 - DNA, 10 bp, Unknown
  misc_feature (1)..( 10): Result.003 file - promoters60/3438429
ttgccactct

SEQ ID NO: 130751 - DNA, 10 bp, Unknown
  misc_feature (1)..( 10): Result.003 file - promoters60/3438429
ttggcactct

SEQ ID NO: 130752 - DNA, 6 bp, Unknown
  misc_feature (1)..( 6): Result.003 file - promoters60/3438429
tcttct

SEQ ID NO: 130753 - DNA, 6 bp, Unknown
  misc_feature (1)..( 6): Result.003 file - promoters60/3438429
tcttct

SEQ ID NO: 130754 - DNA, 7 bp, Unknown
  misc_feature (1)..( 7): Result.003 file - promoters60/3438429
ttctaaa

SEQ ID NO: 130755 - DNA, 7 bp, Unknown
  misc_feature (1)..( 7): Result.003 file - promoters60/3438429
ttccaaa

SEQ ID NO: 130756 - DNA, 6 bp, Unknown
  misc_feature (1)..( 6): Result.003 file - promoters60/3438429
agaaaa

SEQ ID NO: 130757 - DNA, 6 bp, Unknown
  misc_feature (1)..( 6): Result.003 file - promoters60/3438429
agaaaa

SEQ ID NO: 130758 - DNA, 6 bp, Unknown
  misc_feature (1)..( 6): Result.003 file - promoters60/3438429
aaaagt

SEQ ID NO: 130759 - DNA, 6 bp, Unknown
  misc_feature (1)..( 6): Result.003 file - promoters60/3438429
aaaagt

SEQ ID NO: 130760 - DNA, 8 bp, Unknown
  misc_feature (1)..( 8): Result.003 file - promoters60/3438429
tttaattt

SEQ ID NO: 130761 - DNA, 8 bp, Unknown
  misc_feature (1)..( 8): Result.003 file - promoters60/3438429
tttcattt

SEQ ID NO: 130762 - DNA, 8 bp, Unknown
  misc_feature (1)..( 8): Result.003 file - promoters60/3438429
tttagttt

SEQ ID NO: 130763 - DNA, 8 bp, Unknown
  misc_feature (1)..( 8): Result.003 file - promoters60/3438429
tttagttt

SEQ ID NO: 130764 - DNA, 7 bp, Unknown
  misc_feature (1)..( 7): Result.003 file - promoters60/3438429
tttattt

SEQ ID NO: 130765 - DNA, 7 bp, Unknown
  misc_feature (1)..( 7): Result.003 file - promoters60/3438429
tttattt

SEQ ID NO: 130766 - DNA, 6 bp, Unknown
  misc_feature (1)..( 6): Result.003 file - promoters60/3438429
caaacc

SEQ ID NO: 130767 - DNA, 6 bp, Unknown
  misc_feature (1)..( 6): Result.003 file - promoters60/3438429
caaacc

SEQ ID NO: 130768 - DNA, 7 bp, Unknown
  misc_feature (1)..( 7): Result.003 file - promoters60/3438429
tttaggt

SEQ ID NO: 130769 - DNA, 7 bp, Unknown
  misc_feature (1)..( 7): Result.003 file - promoters60/3438429
ttttggt

SEQ ID NO: 130770 - DNA, 6 bp, Unknown
  misc_feature (1)..( 6): Result.003 file - promoters60/3438429
ttcagt

SEQ ID NO: 130771 - DNA, 6 bp, Unknown
  misc_feature (1)..( 6): Result.003 file - promoters60/3438429
ttcagt

SEQ ID NO: 130772 - DNA, 6 bp, Unknown
  misc_feature (1)..( 6): Result.003 file - promoters60/3438494
ggagga

SEQ ID NO: 130773 - DNA, 6 bp, Unknown
  misc_feature (1)..( 6): Result.003 file - promoters60/3438494
ggagga

SEQ ID NO: 130774 - DNA, 6 bp, Unknown
  misc_feature (1)..( 6): Result.003 file - promoters60/3438494
ttaatt

SEQ ID NO: 130775 - DNA, 6 bp, Unknown
  misc_feature (1)..( 6): Result.003 file - promoters60/3438494
ttaatt

SEQ ID NO: 130776 - DNA, 7 bp, Unknown
  misc_feature (1)..( 7): Result.003 file - promoters60/3438494
caaagag

SEQ ID NO: 130777 - DNA, 7 bp, Unknown
  misc_feature (1)..( 7): Result.003 file - promoters60/3438494
caatgag

SEQ ID NO: 130778 - DNA, 7 bp, Unknown
  misc_feature (1)..( 7): Result.003 file - promoters60/3438494
tatcaaa

SEQ ID NO: 130779 - DNA, 7 bp, Unknown
  misc_feature (1)..( 7): Result.003 file - promoters60/3438494
tataaaa

SEQ ID NO: 130780 - DNA, 7 bp, Unknown
  misc_feature (1)..( 7): Result.003 file - promoters60/3438494
acaaaat

SEQ ID NO: 130781 - DNA, 7 bp, Unknown
  misc_feature (1)..( 7): Result.003 file - promoters60/3438494
acaaaat

SEQ ID NO: 130782 - DNA, 7 bp, Unknown
  misc_feature (1)..( 7): Result.003 file - promoters60/3438494
atgaaat

SEQ ID NO: 130783 - DNA, 7 bp, Unknown
  misc_feature (1)..( 7): Result.003 file - promoters60/3438494
atgaaat

SEQ ID NO: 130784 - DNA, 6 bp, Unknown
  misc_feature (1)..( 6): Result.003 file - promoters60/3438494
aagttg

SEQ ID NO: 130785 - DNA, 6 bp, Unknown
  misc_feature (1)..( 6): Result.003 file - promoters60/3438494
aagttg

SEQ ID NO: 130786 - DNA, 7 bp, Unknown
  misc_feature (1)..( 7): Result.003 file - promoters60/3438494
gttgaac

SEQ ID NO: 130787 - DNA, 7 bp, Unknown
  misc_feature (1)..( 7): Result.003 file - promoters60/3438494
gttgaac

SEQ ID NO: 130788 - DNA, 12 bp, Unknown
  misc_feature (1)..( 12): Result.003 file - promoters60/3438494
atatctataaag

SEQ ID NO: 130789 - DNA, 12 bp, Unknown
  misc_feature (1)..( 12): Result.003 file - promoters60/3438494
ctccttataaat

SEQ ID NO: 130790 - DNA, 12 bp, Unknown
  misc_feature (1)..( 12): Result.003 file - promoters60/3438494
atatatataaag

SEQ ID NO: 130791 - DNA, 8 bp, Unknown
  misc_feature (1)..( 8): Result.003 file - promoters60/3438494
tttgagtt

SEQ ID NO: 130792 - DNA, 8 bp, Unknown
  misc_feature (1)..( 8): Result.003 file - promoters60/3438494
tttaagtt

SEQ ID NO: 130793 - DNA, 9 bp, Unknown
  misc_feature (1)..( 9): Result.003 file - promoters60/3438494
acatggttt

SEQ ID NO: 130794 - DNA, 9 bp, Unknown
  misc_feature (1)..( 9): Result.003 file - promoters60/3438494
acatgtttt

SEQ ID NO: 130795 - DNA, 7 bp, Unknown
  misc_feature (1)..( 7): Result.003 file - promoters60/3438494
aaacata

SEQ ID NO: 130796 - DNA, 7 bp, Unknown
  misc_feature (1)..( 7): Result.003 file - promoters60/3438494
aaatata

SEQ ID NO: 130797 - DNA, 7 bp, Unknown
  misc_feature (1)..( 7): Result.003 file - promoters60/3438494
atataca

SEQ ID NO: 130798 - DNA, 7 bp, Unknown
  misc_feature (1)..( 7): Result.003 file - promoters60/3438494
atataca

SEQ ID NO: 130799 - DNA, 7 bp, Unknown
  misc_feature (1)..( 7): Result.003 file - promoters60/3438494
ttaagtt

SEQ ID NO: 130800 - DNA, 7 bp, Unknown
  misc_feature (1)..( 7): Result.003 file - promoters60/3438494
ttaagtt

SEQ ID NO: 130801 - DNA, 7 bp, Unknown
  misc_feature (1)..( 7): Result.003 file - promoters60/3438494
taaaact

SEQ ID NO: 130802 - DNA, 7 bp, Unknown
  misc_feature (1)..( 7): Result.003 file - promoters60/3438494
taacact

SEQ ID NO: 130803 - DNA, 6 bp, Unknown
  misc_feature (1)..( 6): Result.003 file - promoters60/3438494
gaaaaa

SEQ ID NO: 130804 - DNA, 6 bp, Unknown
  misc_feature (1)..( 6): Result.003 file - promoters60/3438494
gaaaaa

SEQ ID NO: 130805 - DNA, 6 bp, Unknown
  misc_feature (1)..( 6): Result.003 file - promoters60/3438494
aattca

SEQ ID NO: 130806 - DNA, 6 bp, Unknown
  misc_feature (1)..( 6): Result.003 file - promoters60/3438494
aattca

SEQ ID NO: 130807 - DNA, 8 bp, Unknown
  misc_feature (1)..( 8): Result.003 file - promoters60/3438494
agtatttt

SEQ ID NO: 130808 - DNA, 8 bp, Unknown
  misc_feature (1)..( 8): Result.003 file - promoters60/3438494
agtttttt

SEQ ID NO: 130809 - DNA, 7 bp, Unknown
  misc_feature (1)..( 7): Result.003 file - promoters60/3438494
attgaaa

SEQ ID NO: 130810 - DNA, 7 bp, Unknown
  misc_feature (1)..( 7): Result.003 file - promoters60/3438494
attaaaa

SEQ ID NO: 130811 - DNA, 7 bp, Unknown
  misc_feature (1)..( 7): Result.003 file - promoters60/3438505
gttcctt

SEQ ID NO: 130812 - DNA, 7 bp, Unknown
  misc_feature (1)..( 7): Result.003 file - promoters60/3438505
gtttctt

SEQ ID NO: 130813 - DNA, 7 bp, Unknown
  misc_feature (1)..( 7): Result.003 file - promoters60/3438505
gttcctc

SEQ ID NO: 130814 - DNA, 8 bp, Unknown
  misc_feature (1)..( 8): Result.003 file - promoters60/3438505
gttgattc

SEQ ID NO: 130815 - DNA, 8 bp, Unknown
  misc_feature (1)..( 8): Result.003 file - promoters60/3438505
gttgatga

SEQ ID NO: 130816 - DNA, 8 bp, Unknown
  misc_feature (1)..( 8): Result.003 file - promoters60/3438505
cttgattc

SEQ ID NO: 130817 - DNA, 8 bp, Unknown
  misc_feature (1)..( 8): Result.003 file - promoters60/3438505
cgacatgt

SEQ ID NO: 130818 - DNA, 8 bp, Unknown
  misc_feature (1)..( 8): Result.003 file - promoters60/3438505
cgacatta

SEQ ID NO: 130819 - DNA, 8 bp, Unknown
  misc_feature (1)..( 8): Result.003 file - promoters60/3438505
cgacatgt

SEQ ID NO: 130820 - DNA, 8 bp, Unknown
  misc_feature (1)..( 8): Result.003 file - promoters60/3438505
tacgcata

SEQ ID NO: 130821 - DNA, 8 bp, Unknown
  misc_feature (1)..( 8): Result.003 file - promoters60/3438505
tacccata

SEQ ID NO: 130822 - DNA, 8 bp, Unknown
  misc_feature (1)..( 8): Result.003 file - promoters60/3438505
ggcacatg

SEQ ID NO: 130823 - DNA, 13 bp, Unknown
  misc_feature (1)..( 13): Result.003 file - promoters60/3438512
acaatccaaaggg

SEQ ID NO: 130824 - DNA, 13 bp, Unknown
  misc_feature (1)..( 13): Result.003 file - promoters60/3438512
caaatcgaaatcg

SEQ ID NO: 130825 - DNA, 13 bp, Unknown
  misc_feature (1)..( 13): Result.003 file - promoters60/3438512
caaaaccaaagaa

SEQ ID NO: 130826 - DNA, 13 bp, Unknown
  misc_feature (1)..( 13): Result.003 file - promoters60/3438512
gcataacaaaaaa

SEQ ID NO: 130827 - DNA, 13 bp, Unknown
  misc_feature (1)..( 13): Result.003 file - promoters60/3438512
gagttggatagct

SEQ ID NO: 130828 - DNA, 13 bp, Unknown
  misc_feature (1)..( 13): Result.003 file - promoters60/3438512
tgagtggatattg

SEQ ID NO: 130829 - DNA, 13 bp, Unknown
  misc_feature (1)..( 13): Result.003 file - promoters60/3438512
tatgaggattttg

SEQ ID NO: 130830 - DNA, 12 bp, Unknown
  misc_feature (1)..( 12): Result.003 file - promoters60/3438512
caacaatgtaca

SEQ ID NO: 130831 - DNA, 12 bp, Unknown
  misc_feature (1)..( 12): Result.003 file - promoters60/3438512
caataatttaca

SEQ ID NO: 130832 - DNA, 12 bp, Unknown
  misc_feature (1)..( 12): Result.003 file - promoters60/3438512
ttacaatgttgc

SEQ ID NO: 130833 - DNA, 12 bp, Unknown
  misc_feature (1)..( 12): Result.003 file - promoters60/3438512
tcacaatgtgtt

SEQ ID NO: 130834 - DNA, 12 bp, Unknown
  misc_feature (1)..( 12): Result.003 file - promoters60/3438512
gtataattttat

SEQ ID NO: 130835 - DNA, 12 bp, Unknown
  misc_feature (1)..( 12): Result.003 file - promoters60/3438512
gcatagtttctc

SEQ ID NO: 130836 - DNA, 20 bp, Unknown
  misc_feature (1)..( 20): Result.003 file - promoters60/3438512
ttagtctttgcttacaattt

SEQ ID NO: 130837 - DNA, 20 bp, Unknown
  misc_feature (1)..( 20): Result.003 file - promoters60/3438512
aaaagttttacttttttttt

SEQ ID NO: 130838 - DNA, 20 bp, Unknown
  misc_feature (1)..( 20): Result.003 file - promoters60/3438512
aataaagttgtttatataaa

SEQ ID NO: 130839 - DNA, 20 bp, Unknown
  misc_feature (1)..( 20): Result.003 file - promoters60/3438512
ctcttacttgtttaaagata

SEQ ID NO: 130840 - DNA, 20 bp, Unknown
  misc_feature (1)..( 20): Result.003 file - promoters60/3438512
ctcacccttctttaaccatc

SEQ ID NO: 130841 - DNA, 21 bp, Unknown
  misc_feature (1)..( 21): Result.003 file - promoters60/3438512
aaaggttttacctttttacca

SEQ ID NO: 130842 - DNA, 21 bp, Unknown
  misc_feature (1)..( 21): Result.003 file - promoters60/3438512
caaaagacacgtttgtatgtt

SEQ ID NO: 130843 - DNA, 21 bp, Unknown
  misc_feature (1)..( 21): Result.003 file - promoters60/3438512
tttttgttaaacttacatgtt

SEQ ID NO: 130844 - DNA, 10 bp, Unknown
  misc_feature (1)..( 10): Result.003 file - promoters60/3438512
tttataaaac

SEQ ID NO: 130845 - DNA, 10 bp, Unknown
  misc_feature (1)..( 10): Result.003 file - promoters60/3438512
actattaaag

SEQ ID NO: 130846 - DNA, 10 bp, Unknown
  misc_feature (1)..( 10): Result.003 file - promoters60/3438512
tatataaatg

SEQ ID NO: 130847 - DNA, 10 bp, Unknown
  misc_feature (1)..( 10): Result.003 file - promoters60/3438512
actataaaac

SEQ ID NO: 130848 - DNA, 10 bp, Unknown
  misc_feature (1)..( 10): Result.003 file - promoters60/3438512
attatttaag

SEQ ID NO: 130849 - DNA, 10 bp, Unknown
  misc_feature (1)..( 10): Result.003 file - promoters60/3438512
ctcatttttt

SEQ ID NO: 130850 - DNA, 6 bp, Unknown
  misc_feature (1)..( 6): Result.003 file - promoters60/3438518
aaaata

SEQ ID NO: 130851 - DNA, 6 bp, Unknown
  misc_feature (1)..( 6): Result.003 file - promoters60/3438518
aaaata

SEQ ID NO: 130852 - DNA, 6 bp, Unknown
  misc_feature (1)..( 6): Result.003 file - promoters60/3438518
ttaaaa

SEQ ID NO: 130853 - DNA, 6 bp, Unknown
  misc_feature (1)..( 6): Result.003 file - promoters60/3438518
ttaaaa

SEQ ID NO: 130854 - DNA, 7 bp, Unknown
  misc_feature (1)..( 7): Result.003 file - promoters60/3438518
aaaatta

SEQ ID NO: 130855 - DNA, 7 bp, Unknown
  misc_feature (1)..( 7): Result.003 file - promoters60/3438518
aaaattt

SEQ ID NO: 130856 - DNA, 7 bp, Unknown
  misc_feature (1)..( 7): Result.003 file - promoters60/3438518
aaagtta

SEQ ID NO: 130857 - DNA, 9 bp, Unknown
  misc_feature (1)..( 9): Result.003 file - promoters60/3438518
aatacattt

SEQ ID NO: 130858 - DNA, 9 bp, Unknown
  misc_feature (1)..( 9): Result.003 file - promoters60/3438518
aatactttt

SEQ ID NO: 130859 - DNA, 6 bp, Unknown
  misc_feature (1)..( 6): Result.003 file - promoters60/3438518
tcctct

SEQ ID NO: 130860 - DNA, 6 bp, Unknown
  misc_feature (1)..( 6): Result.003 file - promoters60/3438518
tcctct

SEQ ID NO: 130861 - DNA, 8 bp, Unknown
  misc_feature (1)..( 8): Result.003 file - promoters60/3438518
tatatata

SEQ ID NO: 130862 - DNA, 8 bp, Unknown
  misc_feature (1)..( 8): Result.003 file - promoters60/3438518
tatatata

SEQ ID NO: 130863 - DNA, 6 bp, Unknown
  misc_feature (1)..( 6): Result.003 file - promoters60/3438518
aataaa

SEQ ID NO: 130864 - DNA, 6 bp, Unknown
  misc_feature (1)..( 6): Result.003 file - promoters60/3438518
aataaa

SEQ ID NO: 130865 - DNA, 6 bp, Unknown
  misc_feature (1)..( 6): Result.003 file - promoters60/3438518
ctaacc

SEQ ID NO: 130866 - DNA, 6 bp, Unknown
  misc_feature (1)..( 6): Result.003 file - promoters60/3438518
ctaacc

SEQ ID NO: 130867 - DNA, 6 bp, Unknown
  misc_feature (1)..( 6): Result.003 file - promoters60/3438518
attagt

SEQ ID NO: 130868 - DNA, 6 bp, Unknown
  misc_feature (1)..( 6): Result.003 file - promoters60/3438518
attagt

SEQ ID NO: 130869 - DNA, 6 bp, Unknown
  misc_feature (1)..( 6): Result.003 file - promoters60/3438518
ttaaca

SEQ ID NO: 130870 - DNA, 6 bp, Unknown
  misc_feature (1)..( 6): Result.003 file - promoters60/3438518
ttaaca

SEQ ID NO: 130871 - DNA, 6 bp, Unknown
  misc_feature (1)..( 6): Result.003 file - promoters60/3438518
taagaa

SEQ ID NO: 130872 - DNA, 6 bp, Unknown
  misc_feature (1)..( 6): Result.003 file - promoters60/3438518
taagaa

SEQ ID NO: 130873 - DNA, 6 bp, Unknown
  misc_feature (1)..( 6): Result.003 file - promoters60/3438518
gataga

SEQ ID NO: 130874 - DNA, 6 bp, Unknown
  misc_feature (1)..( 6): Result.003 file - promoters60/3438518
gataga

SEQ ID NO: 130875 - DNA, 9 bp, Unknown
  misc_feature (1)..( 9): Result.003 file - promoters60/3438518
gagttgagt

SEQ ID NO: 130876 - DNA, 9 bp, Unknown
  misc_feature (1)..( 9): Result.003 file - promoters60/3438518
gagtggagt

SEQ ID NO: 130877 - DNA, 8 bp, Unknown
  misc_feature (1)..( 8): Result.003 file - promoters60/3438518
gactaaaa

SEQ ID NO: 130878 - DNA, 8 bp, Unknown
  misc_feature (1)..( 8): Result.003 file - promoters60/3438518
gacgaaaa

SEQ ID NO: 130879 - DNA, 6 bp, Unknown
  misc_feature (1)..( 6): Result.003 file - promoters60/3438518
cgattt

SEQ ID NO: 130880 - DNA, 6 bp, Unknown
  misc_feature (1)..( 6): Result.003 file - promoters60/3438518
cgattt

SEQ ID NO: 130881 - DNA, 7 bp, Unknown
  misc_feature (1)..( 7): Result.003 file - promoters60/3438518
tcaattt

SEQ ID NO: 130882 - DNA, 7 bp, Unknown
  misc_feature (1)..( 7): Result.003 file - promoters60/3438518
tcaattt

SEQ ID NO: 130883 - DNA, 7 bp, Unknown
  misc_feature (1)..( 7): Result.003 file - promoters60/3438518
tttgaat

SEQ ID NO: 130884 - DNA, 7 bp, Unknown
  misc_feature (1)..( 7): Result.003 file - promoters60/3438518
ttttaat

SEQ ID NO: 130885 - DNA, 6 bp, Unknown
  misc_feature (1)..( 6): Result.003 file - promoters60/3438518
aataaa

SEQ ID NO: 130886 - DNA, 6 bp, Unknown
  misc_feature (1)..( 6): Result.003 file - promoters60/3438518
aataaa

SEQ ID NO: 130887 - DNA, 8 bp, Unknown
  misc_feature (1)..( 8): Result.003 file - promoters60/3438518
aaatagaa

SEQ ID NO: 130888 - DNA, 8 bp, Unknown
  misc_feature (1)..( 8): Result.003 file - promoters60/3438518
aaatcgaa

SEQ ID NO: 130889 - DNA, 7 bp, Unknown
  misc_feature (1)..( 7): Result.003 file - promoters60/3438518
aatattt

SEQ ID NO: 130890 - DNA, 7 bp, Unknown
  misc_feature (1)..( 7): Result.003 file - promoters60/3438518
aatgttt

SEQ ID NO: 130891 - DNA, 6 bp, Unknown
  misc_feature (1)..( 6): Result.003 file - promoters60/3438518
agcttc

SEQ ID NO: 130892 - DNA, 6 bp, Unknown
  misc_feature (1)..( 6): Result.003 file - promoters60/3438518
agcttc

SEQ ID NO: 130893 - DNA, 7 bp, Unknown
  misc_feature (1)..( 7): Result.003 file - promoters60/3438518
acacaaa

SEQ ID NO: 130894 - DNA, 7 bp, Unknown
  misc_feature (1)..( 7): Result.003 file - promoters60/3438518
acacaaa

SEQ ID NO: 130895 - DNA, 11 bp, Unknown
  misc_feature (1)..( 11): Result.003 file - promoters60/3438594
taaaaacttct

SEQ ID NO: 130896 - DNA, 11 bp, Unknown
  misc_feature (1)..( 11): Result.003 file - promoters60/3438594
taaaacctttt

SEQ ID NO: 130897 - DNA, 11 bp, Unknown
  misc_feature (1)..( 11): Result.003 file - promoters60/3438594
gaaaagcttct

SEQ ID NO: 130898 - DNA, 11 bp, Unknown
  misc_feature (1)..( 11): Result.003 file - promoters60/3438594
gaaaaacttta

SEQ ID NO: 130899 - DNA, 9 bp, Unknown
  misc_feature (1)..( 9): Result.003 file - promoters60/3438594
aaataaaaa

SEQ ID NO: 130900 - DNA, 9 bp, Unknown
  misc_feature (1)..( 9): Result.003 file - promoters60/3438594
aaacaaaag

SEQ ID NO: 130901 - DNA, 9 bp, Unknown
  misc_feature (1)..( 9): Result.003 file - promoters60/3438594
aattaaatt

SEQ ID NO: 130902 - DNA, 9 bp, Unknown
  misc_feature (1)..( 9): Result.003 file - promoters60/3438594
ctataaaaa

SEQ ID NO: 130903 - DNA, 9 bp, Unknown
  misc_feature (1)..( 9): Result.003 file - promoters60/3438594
tattaaaat

SEQ ID NO: 130904 - DNA, 11 bp, Unknown
  misc_feature (1)..( 11): Result.003 file - promoters60/3438594
taagtaaacaa

SEQ ID NO: 130905 - DNA, 11 bp, Unknown
  misc_feature (1)..( 11): Result.003 file - promoters60/3438594
gttttaaacag

SEQ ID NO: 130906 - DNA, 11 bp, Unknown
  misc_feature (1)..( 11): Result.003 file - promoters60/3438594
aaaataaaaat

SEQ ID NO: 130907 - DNA, 11 bp, Unknown
  misc_feature (1)..( 11): Result.003 file - promoters60/3438594
aaaagaaatgt

SEQ ID NO: 130908 - DNA, 11 bp, Unknown
  misc_feature (1)..( 11): Result.003 file - promoters60/3438594
aaaatagaaat

SEQ ID NO: 130909 - DNA, 9 bp, Unknown
  misc_feature (1)..( 9): Result.003 file - promoters60/3438594
aattaatta

SEQ ID NO: 130910 - DNA, 9 bp, Unknown
  misc_feature (1)..( 9): Result.003 file - promoters60/3438594
aatcaattt

SEQ ID NO: 130911 - DNA, 9 bp, Unknown
  misc_feature (1)..( 9): Result.003 file - promoters60/3438594
cgttattta

SEQ ID NO: 130912 - DNA, 9 bp, Unknown
  misc_feature (1)..( 9): Result.003 file - promoters60/3438594
tactattta

SEQ ID NO: 130913 - DNA, 9 bp, Unknown
  misc_feature (1)..( 9): Result.003 file - promoters60/3438594
taagtaaac

SEQ ID NO: 130914 - DNA, 9 bp, Unknown
  misc_feature (1)..( 9): Result.003 file - promoters60/3438594
aaagaaaat

SEQ ID NO: 130915 - DNA, 9 bp, Unknown
  misc_feature (1)..( 9): Result.003 file - promoters60/3438594
aaacaaaag

SEQ ID NO: 130916 - DNA, 9 bp, Unknown
  misc_feature (1)..( 9): Result.003 file - promoters60/3438594
aaagaaatg

SEQ ID NO: 130917 - DNA, 9 bp, Unknown
  misc_feature (1)..( 9): Result.003 file - promoters60/3438594
gtggaaaat

SEQ ID NO: 130918 - DNA, 12 bp, Unknown
  misc_feature (1)..( 12): Result.003 file - promoters60/3438594
aaaataagtaaa

SEQ ID NO: 130919 - DNA, 12 bp, Unknown
  misc_feature (1)..( 12): Result.003 file - promoters60/3438594
aaaataaaaatc

SEQ ID NO: 130920 - DNA, 12 bp, Unknown
  misc_feature (1)..( 12): Result.003 file - promoters60/3438594
aaaatagaaata

SEQ ID NO: 130921 - DNA, 12 bp, Unknown
  misc_feature (1)..( 12): Result.003 file - promoters60/3438594
caaataaagatc

SEQ ID NO: 130922 - DNA, 9 bp, Unknown
  misc_feature (1)..( 9): Result.003 file - promoters60/3438594
tagaaataa

SEQ ID NO: 130923 - DNA, 9 bp, Unknown
  misc_feature (1)..( 9): Result.003 file - promoters60/3438594
caaaaataa

SEQ ID NO: 130924 - DNA, 9 bp, Unknown
  misc_feature (1)..( 9): Result.003 file - promoters60/3438594
gccaaataa

SEQ ID NO: 130925 - DNA, 9 bp, Unknown
  misc_feature (1)..( 9): Result.003 file - promoters60/3438594
tagaaatat

SEQ ID NO: 130926 - DNA, 10 bp, Unknown
  misc_feature (1)..( 10): Result.003 file - promoters60/3438594
tcaaaactaa

SEQ ID NO: 130927 - DNA, 12 bp, Unknown
  misc_feature (1)..( 12): Result.003 file - promoters60/3438594
agtatacaatga

SEQ ID NO: 130928 - DNA, 12 bp, Unknown
  misc_feature (1)..( 12): Result.003 file - promoters60/3438594
agtaaacaaaag

SEQ ID NO: 130929 - DNA, 12 bp, Unknown
  misc_feature (1)..( 12): Result.003 file - promoters60/3438594
actaaacaaaat

SEQ ID NO: 130930 - DNA, 12 bp, Unknown
  misc_feature (1)..( 12): Result.003 file - promoters60/3438594
tgtttccaaaat

SEQ ID NO: 130931 - DNA, 11 bp, Unknown
  misc_feature (1)..( 11): Result.003 file - promoters60/3438594
aacaaaagatt

SEQ ID NO: 130932 - DNA, 11 bp, Unknown
  misc_feature (1)..( 11): Result.003 file - promoters60/3438594
aaataaagatc

SEQ ID NO: 130933 - DNA, 11 bp, Unknown
  misc_feature (1)..( 11): Result.003 file - promoters60/3438594
aaataaaaatc

SEQ ID NO: 130934 - DNA, 11 bp, Unknown
  misc_feature (1)..( 11): Result.003 file - promoters60/3438594
tccaaaatatc

SEQ ID NO: 130935 - DNA, 9 bp, Unknown
  misc_feature (1)..( 9): Result.003 file - promoters60/3438594
ttatttgaa

SEQ ID NO: 130936 - DNA, 9 bp, Unknown
  misc_feature (1)..( 9): Result.003 file - promoters60/3438594
ttatttatg

SEQ ID NO: 130937 - DNA, 9 bp, Unknown
  misc_feature (1)..( 9): Result.003 file - promoters60/3438594
ctatttagc

SEQ ID NO: 130938 - DNA, 9 bp, Unknown
  misc_feature (1)..( 9): Result.003 file - promoters60/3438594
atatatatg

SEQ ID NO: 130939 - DNA, 9 bp, Unknown
  misc_feature (1)..( 9): Result.003 file - promoters60/3438648
tcaataaac

SEQ ID NO: 130940 - DNA, 9 bp, Unknown
  misc_feature (1)..( 9): Result.003 file - promoters60/3438648
acaaaaaat

SEQ ID NO: 130941 - DNA, 9 bp, Unknown
  misc_feature (1)..( 9): Result.003 file - promoters60/3438648
ggaaaaaaa

SEQ ID NO: 130942 - DNA, 9 bp, Unknown
  misc_feature (1)..( 9): Result.003 file - promoters60/3438648
agaagaaaa

SEQ ID NO: 130943 - DNA, 9 bp, Unknown
  misc_feature (1)..( 9): Result.003 file - promoters60/3438648
agaagagac

SEQ ID NO: 130944 - DNA, 9 bp, Unknown
  misc_feature (1)..( 9): Result.003 file - promoters60/3438648
agaaacaat

SEQ ID NO: 130945 - DNA, 7 bp, Unknown
  misc_feature (1)..( 7): Result.003 file - promoters60/3438919
ggtctat

SEQ ID NO: 130946 - DNA, 7 bp, Unknown
  misc_feature (1)..( 7): Result.003 file - promoters60/3438919
ggtgtat

SEQ ID NO: 130947 - DNA, 9 bp, Unknown
  misc_feature (1)..( 9): Result.003 file - promoters60/3438919
cataatcaa

SEQ ID NO: 130948 - DNA, 9 bp, Unknown
  misc_feature (1)..( 9): Result.003 file - promoters60/3438919
tttaaacaa

SEQ ID NO: 130949 - DNA, 9 bp, Unknown
  misc_feature (1)..( 9): Result.003 file - promoters60/3438919
tttaatcaa

SEQ ID NO: 130950 - DNA, 6 bp, Unknown
  misc_feature (1)..( 6): Result.003 file - promoters60/3438919
taatta

SEQ ID NO: 130951 - DNA, 6 bp, Unknown
  misc_feature (1)..( 6): Result.003 file - promoters60/3438919
taatta

SEQ ID NO: 130952 - DNA, 6 bp, Unknown
  misc_feature (1)..( 6): Result.003 file - promoters60/3438919
ttaaaa

SEQ ID NO: 130953 - DNA, 6 bp, Unknown
  misc_feature (1)..( 6): Result.003 file - promoters60/3438919
ttaaaa

SEQ ID NO: 130954 - DNA, 6 bp, Unknown
  misc_feature (1)..( 6): Result.003 file - promoters60/3438919
aaaaaa

SEQ ID NO: 130955 - DNA, 6 bp, Unknown
  misc_feature (1)..( 6): Result.003 file - promoters60/3438919
aaaaaa

SEQ ID NO: 130956 - DNA, 9 bp, Unknown
  misc_feature (1)..( 9): Result.003 file - promoters60/3438919
tttcatctg

SEQ ID NO: 130957 - DNA, 9 bp, Unknown
  misc_feature (1)..( 9): Result.003 file - promoters60/3438919
tttaatcaa

SEQ ID NO: 130958 - DNA, 9 bp, Unknown
  misc_feature (1)..( 9): Result.003 file - promoters60/3438919
tttaaacaa

SEQ ID NO: 130959 - DNA, 6 bp, Unknown
  misc_feature (1)..( 6): Result.003 file - promoters60/3438919
gacgtg

SEQ ID NO: 130960 - DNA, 6 bp, Unknown
  misc_feature (1)..( 6): Result.003 file - promoters60/3438919
gacgtg

SEQ ID NO: 130961 - DNA, 7 bp, Unknown
  misc_feature (1)..( 7): Result.003 file - promoters60/3438919
tttttta

SEQ ID NO: 130962 - DNA, 7 bp, Unknown
  misc_feature (1)..( 7): Result.003 file - promoters60/3438919
tttatta

SEQ ID NO: 130963 - DNA, 7 bp, Unknown
  misc_feature (1)..( 7): Result.003 file - promoters60/3438919
attgggc

SEQ ID NO: 130964 - DNA, 7 bp, Unknown
  misc_feature (1)..( 7): Result.003 file - promoters60/3438919
attaggc

SEQ ID NO: 130965 - DNA, 7 bp, Unknown
  misc_feature (1)..( 7): Result.003 file - promoters60/3438919
ttacaaa

SEQ ID NO: 130966 - DNA, 7 bp, Unknown
  misc_feature (1)..( 7): Result.003 file - promoters60/3438919
ttaaaaa

SEQ ID NO: 130967 - DNA, 7 bp, Unknown
  misc_feature (1)..( 7): Result.003 file - promoters60/3438919
aatacat

SEQ ID NO: 130968 - DNA, 7 bp, Unknown
  misc_feature (1)..( 7): Result.003 file - promoters60/3438919
aattcat

SEQ ID NO: 130969 - DNA, 8 bp, Unknown
  misc_feature (1)..( 8): Result.003 file - promoters60/3438919
ctgacaaa

SEQ ID NO: 130970 - DNA, 8 bp, Unknown
  misc_feature (1)..( 8): Result.003 file - promoters60/3438919
ctgagaaa

SEQ ID NO: 130971 - DNA, 8 bp, Unknown
  misc_feature (1)..( 8): Result.003 file - promoters60/3438927
tgttgtgc

SEQ ID NO: 130972 - DNA, 8 bp, Unknown
  misc_feature (1)..( 8): Result.003 file - promoters60/3438927
tgttttgc

SEQ ID NO: 130973 - DNA, 12 bp, Unknown
  misc_feature (1)..( 12): Result.003 file - promoters60/3438927
tttcagggattc

SEQ ID NO: 130974 - DNA, 12 bp, Unknown
  misc_feature (1)..( 12): Result.003 file - promoters60/3438927
tttcaaggattc

SEQ ID NO: 130975 - DNA, 6 bp, Unknown
  misc_feature (1)..( 6): Result.003 file - promoters60/3438927
ttcata

SEQ ID NO: 130976 - DNA, 6 bp, Unknown
  misc_feature (1)..( 6): Result.003 file - promoters60/3438927
ttcata

SEQ ID NO: 130977 - DNA, 7 bp, Unknown
  misc_feature (1)..( 7): Result.003 file - promoters60/3438927
aaagaca

SEQ ID NO: 130978 - DNA, 7 bp, Unknown
  misc_feature (1)..( 7): Result.003 file - promoters60/3438927
aaagaca

SEQ ID NO: 130979 - DNA, 9 bp, Unknown
  misc_feature (1)..( 9): Result.003 file - promoters60/3438927
atatgtaaa

SEQ ID NO: 130980 - DNA, 9 bp, Unknown
  misc_feature (1)..( 9): Result.003 file - promoters60/3438927
ataagtaaa

SEQ ID NO: 130981 - DNA, 9 bp, Unknown
  misc_feature (1)..( 9): Result.003 file - promoters60/3438927
aagagtaaa

SEQ ID NO: 130982 - DNA, 8 bp, Unknown
  misc_feature (1)..( 8): Result.003 file - promoters60/3438927
tcatttta

SEQ ID NO: 130983 - DNA, 8 bp, Unknown
  misc_feature (1)..( 8): Result.003 file - promoters60/3438927
tcacttta

SEQ ID NO: 130984 - DNA, 10 bp, Unknown
  misc_feature (1)..( 10): Result.003 file - promoters60/3438927
ccaaaaaata

SEQ ID NO: 130985 - DNA, 10 bp, Unknown
  misc_feature (1)..( 10): Result.003 file - promoters60/3438927
aaagaaaata

SEQ ID NO: 130986 - DNA, 10 bp, Unknown
  misc_feature (1)..( 10): Result.003 file - promoters60/3438927
aaatgaaata

SEQ ID NO: 130987 - DNA, 6 bp, Unknown
  misc_feature (1)..( 6): Result.003 file - promoters60/3438927
gaagaa

SEQ ID NO: 130988 - DNA, 6 bp, Unknown
  misc_feature (1)..( 6): Result.003 file - promoters60/3438927
gaagaa

SEQ ID NO: 130989 - DNA, 8 bp, Unknown
  misc_feature (1)..( 8): Result.003 file - promoters60/3438927
attagttt

SEQ ID NO: 130990 - DNA, 8 bp, Unknown
  misc_feature (1)..( 8): Result.003 file - promoters60/3438927
atttgttt

SEQ ID NO: 130991 - DNA, 7 bp, Unknown
  misc_feature (1)..( 7): Result.003 file - promoters60/3438927
tattttt

SEQ ID NO: 130992 - DNA, 7 bp, Unknown
  misc_feature (1)..( 7): Result.003 file - promoters60/3438927
tattttt

SEQ ID NO: 130993 - DNA, 9 bp, Unknown
  misc_feature (1)..( 9): Result.003 file - promoters60/3438927
aaaaaaaaa

SEQ ID NO: 130994 - DNA, 9 bp, Unknown
  misc_feature (1)..( 9): Result.003 file - promoters60/3438927
aaaaagaaa

SEQ ID NO: 130995 - DNA, 9 bp, Unknown
  misc_feature (1)..( 9): Result.003 file - promoters60/3438927
aaaaaactt

SEQ ID NO: 130996 - DNA, 6 bp, Unknown
  misc_feature (1)..( 6): Result.003 file - promoters60/3438927
taaaac

SEQ ID NO: 130997 - DNA, 6 bp, Unknown
  misc_feature (1)..( 6): Result.003 file - promoters60/3438927
taaaac

SEQ ID NO: 130998 - DNA, 8 bp, Unknown
  misc_feature (1)..( 8): Result.003 file - promoters60/3438927
tgtacaaa

SEQ ID NO: 130999 - DNA, 8 bp, Unknown
  misc_feature (1)..( 8): Result.003 file - promoters60/3438927
agtaaaaa

SEQ ID NO: 131000 - DNA, 8 bp, Unknown
  misc_feature (1)..( 8): Result.003 file - promoters60/3438927
agtaaaga

SEQ ID NO: 131001 - DNA, 8 bp, Unknown
  misc_feature (1)..( 8): Result.003 file - promoters60/3438927
attatgtt

SEQ ID NO: 131002 - DNA, 8 bp, Unknown
  misc_feature (1)..( 8): Result.003 file - promoters60/3438927
attttgtt

SEQ ID NO: 131003 - DNA, 13 bp, Unknown
  misc_feature (1)..( 13): Result.003 file - promoters60/3438927
gaaaaatcttaac

SEQ ID NO: 131004 - DNA, 13 bp, Unknown
  misc_feature (1)..( 13): Result.003 file - promoters60/3438927
gaaatatcttaac

SEQ ID NO: 131005 - DNA, 13 bp, Unknown
  misc_feature (1)..( 13): Result.003 file - promoters60/3438927
aaaataaaataaa

SEQ ID NO: 131006 - DNA, 7 bp, Unknown
  misc_feature (1)..( 7): Result.003 file - promoters60/3438927
aacaaat

SEQ ID NO: 131007 - DNA, 7 bp, Unknown
  misc_feature (1)..( 7): Result.003 file - promoters60/3438927
aaccaat

SEQ ID NO: 131008 - DNA, 6 bp, Unknown
  misc_feature (1)..( 6): Result.003 file - promoters60/3438927
aagaaa

SEQ ID NO: 131009 - DNA, 6 bp, Unknown
  misc_feature (1)..( 6): Result.003 file - promoters60/3438927
aagaaa

SEQ ID NO: 131010 - DNA, 7 bp, Unknown
  misc_feature (1)..( 7): Result.003 file - promoters60/3438927
ttaatgt

SEQ ID NO: 131011 - DNA, 7 bp, Unknown
  misc_feature (1)..( 7): Result.003 file - promoters60/3438927
ttattgt

SEQ ID NO: 131012 - DNA, 7 bp, Unknown
  misc_feature (1)..( 7): Result.003 file - promoters60/3438927
aatcggg

SEQ ID NO: 131013 - DNA, 7 bp, Unknown
  misc_feature (1)..( 7): Result.003 file - promoters60/3438927
aattggg

SEQ ID NO: 131014 - DNA, 8 bp, Unknown
  misc_feature (1)..( 8): Result.003 file - promoters60/3438927
gaaagaaa

SEQ ID NO: 131015 - DNA, 8 bp, Unknown
  misc_feature (1)..( 8): Result.003 file - promoters60/3438927
gaaacaaa

SEQ ID NO: 131016 - DNA, 10 bp, Unknown
  misc_feature (1)..( 10): Result.003 file - promoters60/3438927
ggaaaagaaa

SEQ ID NO: 131017 - DNA, 10 bp, Unknown
  misc_feature (1)..( 10): Result.003 file - promoters60/3438927
ggaaatgaaa

SEQ ID NO: 131018 - DNA, 7 bp, Unknown
  misc_feature (1)..( 7): Result.003 file - promoters60/3438927
cccacta

SEQ ID NO: 131019 - DNA, 7 bp, Unknown
  misc_feature (1)..( 7): Result.003 file - promoters60/3438927
cccacta

SEQ ID NO: 131020 - DNA, 9 bp, Unknown
  misc_feature (1)..( 9): Result.003 file - promoters60/3438927
aaagaaaag

SEQ ID NO: 131021 - DNA, 9 bp, Unknown
  misc_feature (1)..( 9): Result.003 file - promoters60/3438927
aaagtaaag

SEQ ID NO: 131022 - DNA, 7 bp, Unknown
  misc_feature (1)..( 7): Result.003 file - promoters60/3438927
gtatata

SEQ ID NO: 131023 - DNA, 7 bp, Unknown
  misc_feature (1)..( 7): Result.003 file - promoters60/3438927
gtatata

SEQ ID NO: 131024 - DNA, 7 bp, Unknown
  misc_feature (1)..( 7): Result.003 file - promoters60/3438946
agaaagg

SEQ ID NO: 131025 - DNA, 7 bp, Unknown
  misc_feature (1)..( 7): Result.003 file - promoters60/3438946
agaaagt

SEQ ID NO: 131026 - DNA, 7 bp, Unknown
  misc_feature (1)..( 7): Result.003 file - promoters60/3438946
agatagt

SEQ ID NO: 131027 - DNA, 8 bp, Unknown
  misc_feature (1)..( 8): Result.003 file - promoters60/3438946
gcataatg

SEQ ID NO: 131028 - DNA, 8 bp, Unknown
  misc_feature (1)..( 8): Result.003 file - promoters60/3438946
ttataatg

SEQ ID NO: 131029 - DNA, 8 bp, Unknown
  misc_feature (1)..( 8): Result.003 file - promoters60/3438946
ttaaaatc

SEQ ID NO: 131030 - DNA, 8 bp, Unknown
  misc_feature (1)..( 8): Result.003 file - promoters60/3438946
tcaaaatc

SEQ ID NO: 131031 - DNA, 8 bp, Unknown
  misc_feature (1)..( 8): Result.003 file - promoters60/3438946
gttaattg

SEQ ID NO: 131032 - DNA, 8 bp, Unknown
  misc_feature (1)..( 8): Result.003 file - promoters60/3438946
gttaattg

SEQ ID NO: 131033 - DNA, 8 bp, Unknown
  misc_feature (1)..( 8): Result.003 file - promoters60/3438946
attacttg

SEQ ID NO: 131034 - DNA, 8 bp, Unknown
  misc_feature (1)..( 8): Result.003 file - promoters60/3438990
aaaattac

SEQ ID NO: 131035 - DNA, 8 bp, Unknown
  misc_feature (1)..( 8): Result.003 file - promoters60/3438990
aaacttac

SEQ ID NO: 131036 - DNA, 6 bp, Unknown
  misc_feature (1)..( 6): Result.003 file - promoters60/3438990
aacact

SEQ ID NO: 131037 - DNA, 6 bp, Unknown
  misc_feature (1)..( 6): Result.003 file - promoters60/3438990
aacact

SEQ ID NO: 131038 - DNA, 9 bp, Unknown
  misc_feature (1)..( 9): Result.003 file - promoters60/3438990
gcatatttt

SEQ ID NO: 131039 - DNA, 9 bp, Unknown
  misc_feature (1)..( 9): Result.003 file - promoters60/3438990
gcatagttt

SEQ ID NO: 131040 - DNA, 9 bp, Unknown
  misc_feature (1)..( 9): Result.003 file - promoters60/3438990
ctatattaa

SEQ ID NO: 131041 - DNA, 8 bp, Unknown
  misc_feature (1)..( 8): Result.003 file - promoters60/3438990
tattttat

SEQ ID NO: 131042 - DNA, 8 bp, Unknown
  misc_feature (1)..( 8): Result.003 file - promoters60/3438990
tcttttat

SEQ ID NO: 131043 - DNA, 8 bp, Unknown
  misc_feature (1)..( 8): Result.003 file - promoters60/3438990
tatattaa

SEQ ID NO: 131044 - DNA, 8 bp, Unknown
  misc_feature (1)..( 8): Result.003 file - promoters60/3438990
aaaaaaaa

SEQ ID NO: 131045 - DNA, 8 bp, Unknown
  misc_feature (1)..( 8): Result.003 file - promoters60/3438990
aaaataaa

SEQ ID NO: 131046 - DNA, 6 bp, Unknown
  misc_feature (1)..( 6): Result.003 file - promoters60/3438990
aataaa

SEQ ID NO: 131047 - DNA, 6 bp, Unknown
  misc_feature (1)..( 6): Result.003 file - promoters60/3438990
aataaa

SEQ ID NO: 131048 - DNA, 6 bp, Unknown
  misc_feature (1)..( 6): Result.003 file - promoters60/3438990
ttaagt

SEQ ID NO: 131049 - DNA, 6 bp, Unknown
  misc_feature (1)..( 6): Result.003 file - promoters60/3438990
ttaagt

SEQ ID NO: 131050 - DNA, 6 bp, Unknown
  misc_feature (1)..( 6): Result.003 file - promoters60/3438990
tatatt

SEQ ID NO: 131051 - DNA, 6 bp, Unknown
  misc_feature (1)..( 6): Result.003 file - promoters60/3438990
tatatt

SEQ ID NO: 131052 - DNA, 7 bp, Unknown
  misc_feature (1)..( 7): Result.003 file - promoters60/3438990
aaagtct

SEQ ID NO: 131053 - DNA, 7 bp, Unknown
  misc_feature (1)..( 7): Result.003 file - promoters60/3438990
aaaatct

SEQ ID NO: 131054 - DNA, 7 bp, Unknown
  misc_feature (1)..( 7): Result.003 file - promoters60/3438990
caagtaa

SEQ ID NO: 131055 - DNA, 7 bp, Unknown
  misc_feature (1)..( 7): Result.003 file - promoters60/3438990
caattaa

SEQ ID NO: 131056 - DNA, 7 bp, Unknown
  misc_feature (1)..( 7): Result.003 file - promoters60/3438990
tgttgaa

SEQ ID NO: 131057 - DNA, 7 bp, Unknown
  misc_feature (1)..( 7): Result.003 file - promoters60/3438990
tgttgaa

SEQ ID NO: 131058 - DNA, 6 bp, Unknown
  misc_feature (1)..( 6): Result.003 file - promoters60/3438990
ctaaaa

SEQ ID NO: 131059 - DNA, 6 bp, Unknown
  misc_feature (1)..( 6): Result.003 file - promoters60/3438990
ctaaaa

SEQ ID NO: 131060 - DNA, 10 bp, Unknown
  misc_feature (1)..( 10): Result.003 file - promoters60/3438990
aaaaccaaac

SEQ ID NO: 131061 - DNA, 10 bp, Unknown
  misc_feature (1)..( 10): Result.003 file - promoters60/3438990
aaagccaaac

SEQ ID NO: 131062 - DNA, 7 bp, Unknown
  misc_feature (1)..( 7): Result.003 file - promoters60/3438990
gcccaat

SEQ ID NO: 131063 - DNA, 7 bp, Unknown
  misc_feature (1)..( 7): Result.003 file - promoters60/3438990
gccgaat

SEQ ID NO: 131064 - DNA, 12 bp, Unknown
  misc_feature (1)..( 12): Result.003 file - promoters60/3439043
agagagaaagaa

SEQ ID NO: 131065 - DNA, 12 bp, Unknown
  misc_feature (1)..( 12): Result.003 file - promoters60/3439043
aaagaaaaaatt

SEQ ID NO: 131066 - DNA, 12 bp, Unknown
  misc_feature (1)..( 12): Result.003 file - promoters60/3439043
aaataaaacatt

SEQ ID NO: 131067 - DNA, 12 bp, Unknown
  misc_feature (1)..( 12): Result.003 file - promoters60/3439043
tacgaaaaaggt

SEQ ID NO: 131068 - DNA, 8 bp, Unknown
  misc_feature (1)..( 8): Result.003 file - promoters60/3439044
ataagttt

SEQ ID NO: 131069 - DNA, 8 bp, Unknown
  misc_feature (1)..( 8): Result.003 file - promoters60/3439044
ataagtct

SEQ ID NO: 131070 - DNA, 8 bp, Unknown
  misc_feature (1)..( 8): Result.003 file - promoters60/3439044
ttaagttc

SEQ ID NO: 131071 - DNA, 8 bp, Unknown
  misc_feature (1)..( 8): Result.003 file - promoters60/3439044
ttatgttt

SEQ ID NO: 131072 - DNA, 8 bp, Unknown
  misc_feature (1)..( 8): Result.003 file - promoters60/3439044
ttaattct

SEQ ID NO: 131073 - DNA, 8 bp, Unknown
  misc_feature (1)..( 8): Result.003 file - promoters60/3439044
gtaaatct

SEQ ID NO: 131074 - DNA, 8 bp, Unknown
  misc_feature (1)..( 8): Result.003 file - promoters60/3439044
aaaactta

SEQ ID NO: 131075 - DNA, 7 bp, Unknown
  misc_feature (1)..( 7): Result.003 file - promoters60/3439056
ttagctt

SEQ ID NO: 131076 - DNA, 7 bp, Unknown
  misc_feature (1)..( 7): Result.003 file - promoters60/3439056
ttatctt

SEQ ID NO: 131077 - DNA, 6 bp, Unknown
  misc_feature (1)..( 6): Result.003 file - promoters60/3439056
ctttat

SEQ ID NO: 131078 - DNA, 6 bp, Unknown
  misc_feature (1)..( 6): Result.003 file - promoters60/3439056
ctttat

SEQ ID NO: 131079 - DNA, 9 bp, Unknown
  misc_feature (1)..( 9): Result.003 file - promoters60/3439056
aaaaccaaa

SEQ ID NO: 131080 - DNA, 9 bp, Unknown
  misc_feature (1)..( 9): Result.003 file - promoters60/3439056
aaacccaaa

SEQ ID NO: 131081 - DNA, 7 bp, Unknown
  misc_feature (1)..( 7): Result.003 file - promoters60/3439056
atcgttt

SEQ ID NO: 131082 - DNA, 7 bp, Unknown
  misc_feature (1)..( 7): Result.003 file - promoters60/3439056
atcattt

SEQ ID NO: 131083 - DNA, 6 bp, Unknown
  misc_feature (1)..( 6): Result.003 file - promoters60/3439056
gcatgg

SEQ ID NO: 131084 - DNA, 6 bp, Unknown
  misc_feature (1)..( 6): Result.003 file - promoters60/3439056
gcatgg

SEQ ID NO: 131085 - DNA, 6 bp, Unknown
  misc_feature (1)..( 6): Result.003 file - promoters60/3439056
ttgata

SEQ ID NO: 131086 - DNA, 6 bp, Unknown
  misc_feature (1)..( 6): Result.003 file - promoters60/3439056
ttgata

SEQ ID NO: 131087 - DNA, 8 bp, Unknown
  misc_feature (1)..( 8): Result.003 file - promoters60/3439056
taaaatta

SEQ ID NO: 131088 - DNA, 8 bp, Unknown
  misc_feature (1)..( 8): Result.003 file - promoters60/3439056
taagatta

SEQ ID NO: 131089 - DNA, 6 bp, Unknown
  misc_feature (1)..( 6): Result.003 file - promoters60/3439056
ttggtc

SEQ ID NO: 131090 - DNA, 6 bp, Unknown
  misc_feature (1)..( 6): Result.003 file - promoters60/3439056
ttggtc

SEQ ID NO: 131091 - DNA, 8 bp, Unknown
  misc_feature (1)..( 8): Result.003 file - promoters60/3439056
ttttagat

SEQ ID NO: 131092 - DNA, 8 bp, Unknown
  misc_feature (1)..( 8): Result.003 file - promoters60/3439056
ttttagat

SEQ ID NO: 131093 - DNA, 8 bp, Unknown
  misc_feature (1)..( 8): Result.003 file - promoters60/3439056
caattttt

SEQ ID NO: 131094 - DNA, 8 bp, Unknown
  misc_feature (1)..( 8): Result.003 file - promoters60/3439056
caatattt

SEQ ID NO: 131095 - DNA, 6 bp, Unknown
  misc_feature (1)..( 6): Result.003 file - promoters60/3439056
aaattt

SEQ ID NO: 131096 - DNA, 6 bp, Unknown
  misc_feature (1)..( 6): Result.003 file - promoters60/3439056
aaattt

SEQ ID NO: 131097 - DNA, 6 bp, Unknown
  misc_feature (1)..( 6): Result.003 file - promoters60/3439056
catgtc

SEQ ID NO: 131098 - DNA, 6 bp, Unknown
  misc_feature (1)..( 6): Result.003 file - promoters60/3439056
catgtc

SEQ ID NO: 131099 - DNA, 7 bp, Unknown
  misc_feature (1)..( 7): Result.003 file - promoters60/3439056
ataattt

SEQ ID NO: 131100 - DNA, 7 bp, Unknown
  misc_feature (1)..( 7): Result.003 file - promoters60/3439056
ataattt

SEQ ID NO: 131101 - DNA, 7 bp, Unknown
  misc_feature (1)..( 7): Result.003 file - promoters60/3439056
agcgcta

SEQ ID NO: 131102 - DNA, 7 bp, Unknown
  misc_feature (1)..( 7): Result.003 file - promoters60/3439056
agcccta

SEQ ID NO: 131103 - DNA, 9 bp, Unknown
  misc_feature (1)..( 9): Result.003 file - promoters60/3439056
tttagcatg

SEQ ID NO: 131104 - DNA, 9 bp, Unknown
  misc_feature (1)..( 9): Result.003 file - promoters60/3439056
ttttgcatg

SEQ ID NO: 131105 - DNA, 7 bp, Unknown
  misc_feature (1)..( 7): Result.003 file - promoters60/3439056
atatata

SEQ ID NO: 131106 - DNA, 7 bp, Unknown
  misc_feature (1)..( 7): Result.003 file - promoters60/3439056
ataaata

SEQ ID NO: 131107 - DNA, 10 bp, Unknown
  misc_feature (1)..( 10): Result.003 file - promoters60/3439059
aataaaaatg

SEQ ID NO: 131108 - DNA, 10 bp, Unknown
  misc_feature (1)..( 10): Result.003 file - promoters60/3439059
tataataatt

SEQ ID NO: 131109 - DNA, 10 bp, Unknown
  misc_feature (1)..( 10): Result.003 file - promoters60/3439059
tataaatatg

SEQ ID NO: 131110 - DNA, 10 bp, Unknown
  misc_feature (1)..( 10): Result.003 file - promoters60/3439059
tatcataaat

SEQ ID NO: 131111 - DNA, 8 bp, Unknown
  misc_feature (1)..( 8): Result.003 file - promoters60/3439059
tcatatag

SEQ ID NO: 131112 - DNA, 8 bp, Unknown
  misc_feature (1)..( 8): Result.003 file - promoters60/3439059
gaatatag

SEQ ID NO: 131113 - DNA, 8 bp, Unknown
  misc_feature (1)..( 8): Result.003 file - promoters60/3439059
tcaaataa

SEQ ID NO: 131114 - DNA, 6 bp, Unknown
  misc_feature (1)..( 6): Result.003 file - promoters60/3439063
tttcta

SEQ ID NO: 131115 - DNA, 6 bp, Unknown
  misc_feature (1)..( 6): Result.003 file - promoters60/3439063
tttcta

SEQ ID NO: 131116 - DNA, 12 bp, Unknown
  misc_feature (1)..( 12): Result.003 file - promoters60/3439063
taaaaaaaaaaa

SEQ ID NO: 131117 - DNA, 12 bp, Unknown
  misc_feature (1)..( 12): Result.003 file - promoters60/3439063
taaacaaataaa

SEQ ID NO: 131118 - DNA, 7 bp, Unknown
  misc_feature (1)..( 7): Result.003 file - promoters60/3439063
tatatat

SEQ ID NO: 131119 - DNA, 7 bp, Unknown
  misc_feature (1)..( 7): Result.003 file - promoters60/3439063
tatgtat

SEQ ID NO: 131120 - DNA, 8 bp, Unknown
  misc_feature (1)..( 8): Result.003 file - promoters60/3439063
tatatata

SEQ ID NO: 131121 - DNA, 8 bp, Unknown
  misc_feature (1)..( 8): Result.003 file - promoters60/3439063
tatatata

SEQ ID NO: 131122 - DNA, 6 bp, Unknown
  misc_feature (1)..( 6): Result.003 file - promoters60/3439063
atgaat

SEQ ID NO: 131123 - DNA, 6 bp, Unknown
  misc_feature (1)..( 6): Result.003 file - promoters60/3439063
atgaat

SEQ ID NO: 131124 - DNA, 6 bp, Unknown
  misc_feature (1)..( 6): Result.003 file - promoters60/3439063
attgag

SEQ ID NO: 131125 - DNA, 6 bp, Unknown
  misc_feature (1)..( 6): Result.003 file - promoters60/3439063
attgag

SEQ ID NO: 131126 - DNA, 8 bp, Unknown
  misc_feature (1)..( 8): Result.003 file - promoters60/3439063
aagtcaaa

SEQ ID NO: 131127 - DNA, 8 bp, Unknown
  misc_feature (1)..( 8): Result.003 file - promoters60/3439063
aagttaaa

SEQ ID NO: 131128 - DNA, 9 bp, Unknown
  misc_feature (1)..( 9): Result.003 file - promoters60/3439063
tcaaaattt

SEQ ID NO: 131129 - DNA, 9 bp, Unknown
  misc_feature (1)..( 9): Result.003 file - promoters60/3439063
tcaacatta

SEQ ID NO: 131130 - DNA, 9 bp, Unknown
  misc_feature (1)..( 9): Result.003 file - promoters60/3439063
ctaacatta

SEQ ID NO: 131131 - DNA, 7 bp, Unknown
  misc_feature (1)..( 7): Result.003 file - promoters60/3439063
aagttta

SEQ ID NO: 131132 - DNA, 7 bp, Unknown
  misc_feature (1)..( 7): Result.003 file - promoters60/3439063
aagttta

SEQ ID NO: 131133 - DNA, 6 bp, Unknown
  misc_feature (1)..( 6): Result.003 file - promoters60/3439063
tttatt

SEQ ID NO: 131134 - DNA, 6 bp, Unknown
  misc_feature (1)..( 6): Result.003 file - promoters60/3439063
tttatt

SEQ ID NO: 131135 - DNA, 8 bp, Unknown
  misc_feature (1)..( 8): Result.003 file - promoters60/3439063
aaattctc

SEQ ID NO: 131136 - DNA, 8 bp, Unknown
  misc_feature (1)..( 8): Result.003 file - promoters60/3439063
aaatcctc

SEQ ID NO: 131137 - DNA, 7 bp, Unknown
  misc_feature (1)..( 7): Result.003 file - promoters60/3439063
tataaat

SEQ ID NO: 131138 - DNA, 7 bp, Unknown
  misc_feature (1)..( 7): Result.003 file - promoters60/3439063
tataaat

SEQ ID NO: 131139 - DNA, 12 bp, Unknown
  misc_feature (1)..( 12): Result.003 file - promoters60/3439063
aacttgttttag

SEQ ID NO: 131140 - DNA, 12 bp, Unknown
  misc_feature (1)..( 12): Result.003 file - promoters60/3439063
aacatgtcttag

SEQ ID NO: 131141 - DNA, 7 bp, Unknown
  misc_feature (1)..( 7): Result.003 file - promoters60/3439063
tttgatt

SEQ ID NO: 131142 - DNA, 7 bp, Unknown
  misc_feature (1)..( 7): Result.003 file - promoters60/3439063
tttaatt

SEQ ID NO: 131143 - DNA, 7 bp, Unknown
  misc_feature (1)..( 7): Result.003 file - promoters60/3439063
aacatat

SEQ ID NO: 131144 - DNA, 7 bp, Unknown
  misc_feature (1)..( 7): Result.003 file - promoters60/3439063
aacttat

SEQ ID NO: 131145 - DNA, 8 bp, Unknown
  misc_feature (1)..( 8): Result.003 file - promoters60/3439063
ttttctat

SEQ ID NO: 131146 - DNA, 8 bp, Unknown
  misc_feature (1)..( 8): Result.003 file - promoters60/3439063
ttttttat

SEQ ID NO: 131147 - DNA, 6 bp, Unknown
  misc_feature (1)..( 6): Result.003 file - promoters60/3439063
attaat

SEQ ID NO: 131148 - DNA, 6 bp, Unknown
  misc_feature (1)..( 6): Result.003 file - promoters60/3439063
attaat

SEQ ID NO: 131149 - DNA, 9 bp, Unknown
  misc_feature (1)..( 9): Result.003 file - promoters60/3439063
tcatcattt

SEQ ID NO: 131150 - DNA, 9 bp, Unknown
  misc_feature (1)..( 9): Result.003 file - promoters60/3439063
tcatccttt

SEQ ID NO: 131151 - DNA, 6 bp, Unknown
  misc_feature (1)..( 6): Result.003 file - promoters60/3439063
gataat

SEQ ID NO: 131152 - DNA, 6 bp, Unknown
  misc_feature (1)..( 6): Result.003 file - promoters60/3439063
gataat

SEQ ID NO: 131153 - DNA, 7 bp, Unknown
  misc_feature (1)..( 7): Result.003 file - promoters60/3439063
taagata

SEQ ID NO: 131154 - DNA, 7 bp, Unknown
  misc_feature (1)..( 7): Result.003 file - promoters60/3439063
taacata

SEQ ID NO: 131155 - DNA, 7 bp, Unknown
  misc_feature (1)..( 7): Result.003 file - promoters60/3439063
taaatat

SEQ ID NO: 131156 - DNA, 7 bp, Unknown
  misc_feature (1)..( 7): Result.003 file - promoters60/3439063
taattat

SEQ ID NO: 131157 - DNA, 10 bp, Unknown
  misc_feature (1)..( 10): Result.003 file - promoters60/3439063
tatattttta

SEQ ID NO: 131158 - DNA, 10 bp, Unknown
  misc_feature (1)..( 10): Result.003 file - promoters60/3439063
tattttttta

SEQ ID NO: 131159 - DNA, 8 bp, Unknown
  misc_feature (1)..( 8): Result.003 file - promoters60/3439063
tttacact

SEQ ID NO: 131160 - DNA, 8 bp, Unknown
  misc_feature (1)..( 8): Result.003 file - promoters60/3439063
tttagact

SEQ ID NO: 131161 - DNA, 7 bp, Unknown
  misc_feature (1)..( 7): Result.003 file - promoters60/3439063
taatcat

SEQ ID NO: 131162 - DNA, 7 bp, Unknown
  misc_feature (1)..( 7): Result.003 file - promoters60/3439063
taaacat

SEQ ID NO: 131163 - DNA, 7 bp, Unknown
  misc_feature (1)..( 7): Result.003 file - promoters60/3439063
atatcaa

SEQ ID NO: 131164 - DNA, 7 bp, Unknown
  misc_feature (1)..( 7): Result.003 file - promoters60/3439063
ataacaa

SEQ ID NO: 131165 - DNA, 10 bp, Unknown
  misc_feature (1)..( 10): Result.003 file - promoters60/3439184
ttctctactt

SEQ ID NO: 131166 - DNA, 10 bp, Unknown
  misc_feature (1)..( 10): Result.003 file - promoters60/3439184
ttctctgctt

SEQ ID NO: 131167 - DNA, 6 bp, Unknown
  misc_feature (1)..( 6): Result.003 file - promoters60/3439184
aattta

SEQ ID NO: 131168 - DNA, 6 bp, Unknown
  misc_feature (1)..( 6): Result.003 file - promoters60/3439184
aattta

SEQ ID NO: 131169 - DNA, 9 bp, Unknown
  misc_feature (1)..( 9): Result.003 file - promoters60/3439184
tataattta

SEQ ID NO: 131170 - DNA, 9 bp, Unknown
  misc_feature (1)..( 9): Result.003 file - promoters60/3439184
tattattta

SEQ ID NO: 131171 - DNA, 7 bp, Unknown
  misc_feature (1)..( 7): Result.003 file - promoters60/3439184
ctatgat

SEQ ID NO: 131172 - DNA, 7 bp, Unknown
  misc_feature (1)..( 7): Result.003 file - promoters60/3439184
ctaagat

SEQ ID NO: 131173 - DNA, 7 bp, Unknown
  misc_feature (1)..( 7): Result.003 file - promoters60/3439184
taatgtt

SEQ ID NO: 131174 - DNA, 7 bp, Unknown
  misc_feature (1)..( 7): Result.003 file - promoters60/3439184
taatgtt

SEQ ID NO: 131175 - DNA, 7 bp, Unknown
  misc_feature (1)..( 7): Result.003 file - promoters60/3439184
tgttttg

SEQ ID NO: 131176 - DNA, 7 bp, Unknown
  misc_feature (1)..( 7): Result.003 file - promoters60/3439184
tgtattg

SEQ ID NO: 131177 - DNA, 7 bp, Unknown
  misc_feature (1)..( 7): Result.003 file - promoters60/3439184
ttcacta

SEQ ID NO: 131178 - DNA, 7 bp, Unknown
  misc_feature (1)..( 7): Result.003 file - promoters60/3439184
ttctcta

SEQ ID NO: 131179 - DNA, 7 bp, Unknown
  misc_feature (1)..( 7): Result.003 file - promoters60/3439184
tctgttc

SEQ ID NO: 131180 - DNA, 7 bp, Unknown
  misc_feature (1)..( 7): Result.003 file - promoters60/3439184
tctgttc

SEQ ID NO: 131181 - DNA, 7 bp, Unknown
  misc_feature (1)..( 7): Result.003 file - promoters60/3439184
ttgcagc

SEQ ID NO: 131182 - DNA, 7 bp, Unknown
  misc_feature (1)..( 7): Result.003 file - promoters60/3439184
ttgaagc

SEQ ID NO: 131183 - DNA, 7 bp, Unknown
  misc_feature (1)..( 7): Result.003 file - promoters60/3439184
tttttac

SEQ ID NO: 131184 - DNA, 7 bp, Unknown
  misc_feature (1)..( 7): Result.003 file - promoters60/3439184
tttttac

SEQ ID NO: 131185 - DNA, 6 bp, Unknown
  misc_feature (1)..( 6): Result.003 file - promoters60/3439184
tgaatt

SEQ ID NO: 131186 - DNA, 6 bp, Unknown
  misc_feature (1)..( 6): Result.003 file - promoters60/3439184
tgaatt

SEQ ID NO: 131187 - DNA, 8 bp, Unknown
  misc_feature (1)..( 8): Result.003 file - promoters60/3439184
ttgtacat

SEQ ID NO: 131188 - DNA, 8 bp, Unknown
  misc_feature (1)..( 8): Result.003 file - promoters60/3439184
ttgttcat

SEQ ID NO: 131189 - DNA, 6 bp, Unknown
  misc_feature (1)..( 6): Result.003 file - promoters60/3439184
tttaac

SEQ ID NO: 131190 - DNA, 6 bp, Unknown
  misc_feature (1)..( 6): Result.003 file - promoters60/3439184
tttaac

SEQ ID NO: 131191 - DNA, 7 bp, Unknown
  misc_feature (1)..( 7): Result.003 file - promoters60/3439184
ggagcat

SEQ ID NO: 131192 - DNA, 7 bp, Unknown
  misc_feature (1)..( 7): Result.003 file - promoters60/3439184
ggaccat

SEQ ID NO: 131193 - DNA, 12 bp, Unknown
  misc_feature (1)..( 12): Result.003 file - promoters60/3439184
attaaagaccaa

SEQ ID NO: 131194 - DNA, 12 bp, Unknown
  misc_feature (1)..( 12): Result.003 file - promoters60/3439184
attcaagatcaa

SEQ ID NO: 131195 - DNA, 7 bp, Unknown
  misc_feature (1)..( 7): Result.003 file - promoters60/3439184
ctgcaac

SEQ ID NO: 131196 - DNA, 7 bp, Unknown
  misc_feature (1)..( 7): Result.003 file - promoters60/3439184
ctgtaac

SEQ ID NO: 131197 - DNA, 6 bp, Unknown
  misc_feature (1)..( 6): Result.003 file - promoters60/3439184
ttatat

SEQ ID NO: 131198 - DNA, 6 bp, Unknown
  misc_feature (1)..( 6): Result.003 file - promoters60/3439184
ttatat

SEQ ID NO: 131199 - DNA, 6 bp, Unknown
  misc_feature (1)..( 6): Result.003 file - promoters60/3439184
tcaatg

SEQ ID NO: 131200 - DNA, 6 bp, Unknown
  misc_feature (1)..( 6): Result.003 file - promoters60/3439184
tcaatg

SEQ ID NO: 131201 - DNA, 6 bp, Unknown
  misc_feature (1)..( 6): Result.003 file - promoters60/3439184
taacca

SEQ ID NO: 131202 - DNA, 6 bp, Unknown
  misc_feature (1)..( 6): Result.003 file - promoters60/3439184
taacca

SEQ ID NO: 131203 - DNA, 13 bp, Unknown
  misc_feature (1)..( 13): Result.003 file - promoters60/3439206
aagaaaattcttt

SEQ ID NO: 131204 - DNA, 13 bp, Unknown
  misc_feature (1)..( 13): Result.003 file - promoters60/3439206
aagaaagttcatc

SEQ ID NO: 131205 - DNA, 13 bp, Unknown
  misc_feature (1)..( 13): Result.003 file - promoters60/3439206
tagaatatttttt

SEQ ID NO: 131206 - DNA, 8 bp, Unknown
  misc_feature (1)..( 8): Result.003 file - promoters60/3439206
tttcttag

SEQ ID NO: 131207 - DNA, 8 bp, Unknown
  misc_feature (1)..( 8): Result.003 file - promoters60/3439206
tttattat

SEQ ID NO: 131208 - DNA, 9 bp, Unknown
  misc_feature (1)..( 9): Result.003 file - promoters60/3439206
tttgattat

SEQ ID NO: 131209 - DNA, 10 bp, Unknown
  misc_feature (1)..( 10): Result.003 file - promoters60/3439206
gtttggattg

SEQ ID NO: 131210 - DNA, 10 bp, Unknown
  misc_feature (1)..( 10): Result.003 file - promoters60/3439206
gttttgatta

SEQ ID NO: 131211 - DNA, 10 bp, Unknown
  misc_feature (1)..( 10): Result.003 file - promoters60/3439206
cttttattat

SEQ ID NO: 131212 - DNA, 9 bp, Unknown
  misc_feature (1)..( 9): Result.003 file - promoters60/3439213
attggttct

SEQ ID NO: 131213 - DNA, 9 bp, Unknown
  misc_feature (1)..( 9): Result.003 file - promoters60/3439213
tttggttac

SEQ ID NO: 131214 - DNA, 9 bp, Unknown
  misc_feature (1)..( 9): Result.003 file - promoters60/3439213
cttgtttat

SEQ ID NO: 131215 - DNA, 9 bp, Unknown
  misc_feature (1)..( 9): Result.003 file - promoters60/3439213
cgagtttat

SEQ ID NO: 131216 - DNA, 9 bp, Unknown
  misc_feature (1)..( 9): Result.003 file - promoters60/3439213
cttgtttac

SEQ ID NO: 131217 - DNA, 9 bp, Unknown
  misc_feature (1)..( 9): Result.003 file - promoters60/3439213
atttttttt

SEQ ID NO: 131218 - DNA, 8 bp, Unknown
  misc_feature (1)..( 8): Result.003 file - promoters60/3439224
tttgtttc

SEQ ID NO: 131219 - DNA, 8 bp, Unknown
  misc_feature (1)..( 8): Result.003 file - promoters60/3439224
tttgttgt

SEQ ID NO: 131220 - DNA, 8 bp, Unknown
  misc_feature (1)..( 8): Result.003 file - promoters60/3439224
tttcttgt

SEQ ID NO: 131221 - DNA, 13 bp, Unknown
  misc_feature (1)..( 13): Result.003 file - promoters60/3439224
attataaatagcc

SEQ ID NO: 131222 - DNA, 13 bp, Unknown
  misc_feature (1)..( 13): Result.003 file - promoters60/3439224
attatatgggcct

SEQ ID NO: 131223 - DNA, 13 bp, Unknown
  misc_feature (1)..( 13): Result.003 file - promoters60/3439224
cttatctgggcct

SEQ ID NO: 131224 - DNA, 7 bp, Unknown
  misc_feature (1)..( 7): Result.003 file - promoters60/3439242
taaacca

SEQ ID NO: 131225 - DNA, 7 bp, Unknown
  misc_feature (1)..( 7): Result.003 file - promoters60/3439242
taagcca

SEQ ID NO: 131226 - DNA, 8 bp, Unknown
  misc_feature (1)..( 8): Result.003 file - promoters60/3439242
tatcgtgt

SEQ ID NO: 131227 - DNA, 8 bp, Unknown
  misc_feature (1)..( 8): Result.003 file - promoters60/3439242
tatcgtgt

SEQ ID NO: 131228 - DNA, 7 bp, Unknown
  misc_feature (1)..( 7): Result.003 file - promoters60/3439242
tgtgttg

SEQ ID NO: 131229 - DNA, 7 bp, Unknown
  misc_feature (1)..( 7): Result.003 file - promoters60/3439242
tgttttg

SEQ ID NO: 131230 - DNA, 6 bp, Unknown
  misc_feature (1)..( 6): Result.003 file - promoters60/3439242
ttattt

SEQ ID NO: 131231 - DNA, 6 bp, Unknown
  misc_feature (1)..( 6): Result.003 file - promoters60/3439242
ttattt

SEQ ID NO: 131232 - DNA, 7 bp, Unknown
  misc_feature (1)..( 7): Result.003 file - promoters60/3439242
tgattat

SEQ ID NO: 131233 - DNA, 7 bp, Unknown
  misc_feature (1)..( 7): Result.003 file - promoters60/3439242
tgattat

SEQ ID NO: 131234 - DNA, 6 bp, Unknown
  misc_feature (1)..( 6): Result.003 file - promoters60/3439242
tgttaa

SEQ ID NO: 131235 - DNA, 6 bp, Unknown
  misc_feature (1)..( 6): Result.003 file - promoters60/3439242
tgttaa

SEQ ID NO: 131236 - DNA, 6 bp, Unknown
  misc_feature (1)..( 6): Result.003 file - promoters60/3439242
tttata

SEQ ID NO: 131237 - DNA, 6 bp, Unknown
  misc_feature (1)..( 6): Result.003 file - promoters60/3439242
tttata

SEQ ID NO: 131238 - DNA, 6 bp, Unknown
  misc_feature (1)..( 6): Result.003 file - promoters60/3439242
tcacat

SEQ ID NO: 131239 - DNA, 6 bp, Unknown
  misc_feature (1)..( 6): Result.003 file - promoters60/3439242
tcacat

SEQ ID NO: 131240 - DNA, 8 bp, Unknown
  misc_feature (1)..( 8): Result.003 file - promoters60/3439242
atcaaacc

SEQ ID NO: 131241 - DNA, 8 bp, Unknown
  misc_feature (1)..( 8): Result.003 file - promoters60/3439242
atcgaacc

SEQ ID NO: 131242 - DNA, 6 bp, Unknown
  misc_feature (1)..( 6): Result.003 file - promoters60/3439242
aactat

SEQ ID NO: 131243 - DNA, 6 bp, Unknown
  misc_feature (1)..( 6): Result.003 file - promoters60/3439242
aactat

SEQ ID NO: 131244 - DNA, 7 bp, Unknown
  misc_feature (1)..( 7): Result.003 file - promoters60/3439242
tcatttt

SEQ ID NO: 131245 - DNA, 7 bp, Unknown
  misc_feature (1)..( 7): Result.003 file - promoters60/3439242
tcaattt

SEQ ID NO: 131246 - DNA, 6 bp, Unknown
  misc_feature (1)..( 6): Result.003 file - promoters60/3439242
tttgct

SEQ ID NO: 131247 - DNA, 6 bp, Unknown
  misc_feature (1)..( 6): Result.003 file - promoters60/3439242
tttgct

SEQ ID NO: 131248 - DNA, 6 bp, Unknown
  misc_feature (1)..( 6): Result.003 file - promoters60/3439242
gttttc

SEQ ID NO: 131249 - DNA, 6 bp, Unknown
  misc_feature (1)..( 6): Result.003 file - promoters60/3439242
gttttc

SEQ ID NO: 131250 - DNA, 9 bp, Unknown
  misc_feature (1)..( 9): Result.003 file - promoters60/3439242
tttgacttt

SEQ ID NO: 131251 - DNA, 9 bp, Unknown
  misc_feature (1)..( 9): Result.003 file - promoters60/3439242
tttgtcttt

SEQ ID NO: 131252 - DNA, 9 bp, Unknown
  misc_feature (1)..( 9): Result.003 file - promoters60/3439242
gggttagaa

SEQ ID NO: 131253 - DNA, 9 bp, Unknown
  misc_feature (1)..( 9): Result.003 file - promoters60/3439242
ggggtagaa

SEQ ID NO: 131254 - DNA, 9 bp, Unknown
  misc_feature (1)..( 9): Result.003 file - promoters60/3439242
gtataaata

SEQ ID NO: 131255 - DNA, 9 bp, Unknown
  misc_feature (1)..( 9): Result.003 file - promoters60/3439242
gtataaata

SEQ ID NO: 131256 - DNA, 6 bp, Unknown
  misc_feature (1)..( 6): Result.003 file - promoters60/3439242
aaattg

SEQ ID NO: 131257 - DNA, 6 bp, Unknown
  misc_feature (1)..( 6): Result.003 file - promoters60/3439242
aaattg

SEQ ID NO: 131258 - DNA, 7 bp, Unknown
  misc_feature (1)..( 7): Result.003 file - promoters60/3439242
tgatgaa

SEQ ID NO: 131259 - DNA, 7 bp, Unknown
  misc_feature (1)..( 7): Result.003 file - promoters60/3439242
tgaggaa

SEQ ID NO: 131260 - DNA, 6 bp, Unknown
  misc_feature (1)..( 6): Result.003 file - promoters60/3439242
gaagag

SEQ ID NO: 131261 - DNA, 6 bp, Unknown
  misc_feature (1)..( 6): Result.003 file - promoters60/3439242
gaagag

SEQ ID NO: 131262 - DNA, 7 bp, Unknown
  misc_feature (1)..( 7): Result.003 file - promoters60/3439242
aaaggag

SEQ ID NO: 131263 - DNA, 7 bp, Unknown
  misc_feature (1)..( 7): Result.003 file - promoters60/3439242
aaaagag

SEQ ID NO: 131264 - DNA, 9 bp, Unknown
  misc_feature (1)..( 9): Result.003 file - promoters60/3439289
ttattttca

SEQ ID NO: 131265 - DNA, 9 bp, Unknown
  misc_feature (1)..( 9): Result.003 file - promoters60/3439289
atattttta

SEQ ID NO: 131266 - DNA, 9 bp, Unknown
  misc_feature (1)..( 9): Result.003 file - promoters60/3439289
ttatcttca

SEQ ID NO: 131267 - DNA, 9 bp, Unknown
  misc_feature (1)..( 9): Result.003 file - promoters60/3439289
ttatttcat

SEQ ID NO: 131268 - DNA, 8 bp, Unknown
  misc_feature (1)..( 8): Result.003 file - promoters60/3439289
atttaaaa

SEQ ID NO: 131269 - DNA, 8 bp, Unknown
  misc_feature (1)..( 8): Result.003 file - promoters60/3439289
atttaata

SEQ ID NO: 131270 - DNA, 8 bp, Unknown
  misc_feature (1)..( 8): Result.003 file - promoters60/3439289
attaaaaa

SEQ ID NO: 131271 - DNA, 8 bp, Unknown
  misc_feature (1)..( 8): Result.003 file - promoters60/3439289
ttttcata

SEQ ID NO: 131272 - DNA, 8 bp, Unknown
  misc_feature (1)..( 8): Result.003 file - promoters60/3439289
ttaaaaat

SEQ ID NO: 131273 - DNA, 8 bp, Unknown
  misc_feature (1)..( 8): Result.003 file - promoters60/3439289
ttacaaag

SEQ ID NO: 131274 - DNA, 8 bp, Unknown
  misc_feature (1)..( 8): Result.003 file - promoters60/3439289
ttaaaaac

SEQ ID NO: 131275 - DNA, 8 bp, Unknown
  misc_feature (1)..( 8): Result.003 file - promoters60/3439289
aaaaaaac

SEQ ID NO: 131276 - DNA, 8 bp, Unknown
  misc_feature (1)..( 8): Result.003 file - promoters60/3439289
aaaaatta

SEQ ID NO: 131277 - DNA, 8 bp, Unknown
  misc_feature (1)..( 8): Result.003 file - promoters60/3439289
caaaatta

SEQ ID NO: 131278 - DNA, 8 bp, Unknown
  misc_feature (1)..( 8): Result.003 file - promoters60/3439289
caatattt

SEQ ID NO: 131279 - DNA, 8 bp, Unknown
  misc_feature (1)..( 8): Result.003 file - promoters60/3439289
caatatac

SEQ ID NO: 131280 - DNA, 10 bp, Unknown
  misc_feature (1)..( 10): Result.003 file - promoters60/3439289
gaatataaga

SEQ ID NO: 131281 - DNA, 10 bp, Unknown
  misc_feature (1)..( 10): Result.003 file - promoters60/3439289
caatatacac

SEQ ID NO: 131282 - DNA, 10 bp, Unknown
  misc_feature (1)..( 10): Result.003 file - promoters60/3439289
ttatagaaga

SEQ ID NO: 131283 - DNA, 10 bp, Unknown
  misc_feature (1)..( 10): Result.003 file - promoters60/3439289
caatattttt

SEQ ID NO: 131284 - DNA, 10 bp, Unknown
  misc_feature (1)..( 10): Result.003 file - promoters60/3439289
gaacacaaaa

SEQ ID NO: 131285 - DNA, 13 bp, Unknown
  misc_feature (1)..( 13): Result.003 file - promoters60/3439289
acgttaaggcaaa

SEQ ID NO: 131286 - DNA, 13 bp, Unknown
  misc_feature (1)..( 13): Result.003 file - promoters60/3439289
ccataaaggaaaa

SEQ ID NO: 131287 - DNA, 13 bp, Unknown
  misc_feature (1)..( 13): Result.003 file - promoters60/3439289
tgtttatggaaaa

SEQ ID NO: 131288 - DNA, 13 bp, Unknown
  misc_feature (1)..( 13): Result.003 file - promoters60/3439289
ccaaaaaagaaat

SEQ ID NO: 131289 - DNA, 13 bp, Unknown
  misc_feature (1)..( 13): Result.003 file - promoters60/3439289
tacttcaacaata

SEQ ID NO: 131290 - DNA, 13 bp, Unknown
  misc_feature (1)..( 13): Result.003 file - promoters60/3439289
aaagcaaacaatg

SEQ ID NO: 131291 - DNA, 13 bp, Unknown
  misc_feature (1)..( 13): Result.003 file - promoters60/3439289
aatcacaacaaat

SEQ ID NO: 131292 - DNA, 13 bp, Unknown
  misc_feature (1)..( 13): Result.003 file - promoters60/3439289
aaaggaaagaatt

SEQ ID NO: 131293 - DNA, 13 bp, Unknown
  misc_feature (1)..( 13): Result.003 file - promoters60/3439289
gaaaaaaacaaat

SEQ ID NO: 131294 - DNA, 7 bp, Unknown
  misc_feature (1)..( 7): Result.003 file - promoters60/3439289
tttttac

SEQ ID NO: 131295 - DNA, 7 bp, Unknown
  misc_feature (1)..( 7): Result.003 file - promoters60/3439289
gttttac

SEQ ID NO: 131296 - DNA, 7 bp, Unknown
  misc_feature (1)..( 7): Result.003 file - promoters60/3439289
tttttat

SEQ ID NO: 131297 - DNA, 7 bp, Unknown
  misc_feature (1)..( 7): Result.003 file - promoters60/3439289
tttttat

SEQ ID NO: 131298 - DNA, 13 bp, Unknown
  misc_feature (1)..( 13): Result.003 file - promoters60/3439289
ctcctataaattg

SEQ ID NO: 131299 - DNA, 13 bp, Unknown
  misc_feature (1)..( 13): Result.003 file - promoters60/3439289
ggtgtataaattg

SEQ ID NO: 131300 - DNA, 13 bp, Unknown
  misc_feature (1)..( 13): Result.003 file - promoters60/3439289
ttagtataaataa

SEQ ID NO: 131301 - DNA, 13 bp, Unknown
  misc_feature (1)..( 13): Result.003 file - promoters60/3439289
ctcttatatattc

SEQ ID NO: 131302 - DNA, 11 bp, Unknown
  misc_feature (1)..( 11): Result.003 file - promoters60/3439289
aaatatgaaat

SEQ ID NO: 131303 - DNA, 11 bp, Unknown
  misc_feature (1)..( 11): Result.003 file - promoters60/3439289
aaatttgacct

SEQ ID NO: 131304 - DNA, 11 bp, Unknown
  misc_feature (1)..( 11): Result.003 file - promoters60/3439289
atataggaata

SEQ ID NO: 131305 - DNA, 11 bp, Unknown
  misc_feature (1)..( 11): Result.003 file - promoters60/3439289
agatagtaata

SEQ ID NO: 131306 - DNA, 7 bp, Unknown
  misc_feature (1)..( 7): Result.003 file - promoters60/3439330
attataa

SEQ ID NO: 131307 - DNA, 7 bp, Unknown
  misc_feature (1)..( 7): Result.003 file - promoters60/3439330
attttaa

SEQ ID NO: 131308 - DNA, 7 bp, Unknown
  misc_feature (1)..( 7): Result.003 file - promoters60/3439330
attttaa

SEQ ID NO: 131309 - DNA, 9 bp, Unknown
  misc_feature (1)..( 9): Result.003 file - promoters60/3439330
ttttaaaaa

SEQ ID NO: 131310 - DNA, 9 bp, Unknown
  misc_feature (1)..( 9): Result.003 file - promoters60/3439330
ttttacaaa

SEQ ID NO: 131311 - DNA, 6 bp, Unknown
  misc_feature (1)..( 6): Result.003 file - promoters60/3439330
aatcaa

SEQ ID NO: 131312 - DNA, 6 bp, Unknown
  misc_feature (1)..( 6): Result.003 file - promoters60/3439330
aatcaa

SEQ ID NO: 131313 - DNA, 6 bp, Unknown
  misc_feature (1)..( 6): Result.003 file - promoters60/3439330
aatttt

SEQ ID NO: 131314 - DNA, 6 bp, Unknown
  misc_feature (1)..( 6): Result.003 file - promoters60/3439330
aatttt

SEQ ID NO: 131315 - DNA, 6 bp, Unknown
  misc_feature (1)..( 6): Result.003 file - promoters60/3439330
catata

SEQ ID NO: 131316 - DNA, 6 bp, Unknown
  misc_feature (1)..( 6): Result.003 file - promoters60/3439330
catata

SEQ ID NO: 131317 - DNA, 8 bp, Unknown
  misc_feature (1)..( 8): Result.003 file - promoters60/3439330
atttctaa

SEQ ID NO: 131318 - DNA, 8 bp, Unknown
  misc_feature (1)..( 8): Result.003 file - promoters60/3439330
atttctaa

SEQ ID NO: 131319 - DNA, 7 bp, Unknown
  misc_feature (1)..( 7): Result.003 file - promoters60/3439330
tttattt

SEQ ID NO: 131320 - DNA, 7 bp, Unknown
  misc_feature (1)..( 7): Result.003 file - promoters60/3439330
tttattt

SEQ ID NO: 131321 - DNA, 11 bp, Unknown
  misc_feature (1)..( 11): Result.003 file - promoters60/3439330
aaaaaaaattt

SEQ ID NO: 131322 - DNA, 11 bp, Unknown
  misc_feature (1)..( 11): Result.003 file - promoters60/3439330
aaacaaaattt

SEQ ID NO: 131323 - DNA, 10 bp, Unknown
  misc_feature (1)..( 10): Result.003 file - promoters60/3439330
aataaaaaaa

SEQ ID NO: 131324 - DNA, 10 bp, Unknown
  misc_feature (1)..( 10): Result.003 file - promoters60/3439330
aataataaaa

SEQ ID NO: 131325 - DNA, 10 bp, Unknown
  misc_feature (1)..( 10): Result.003 file - promoters60/3439330
cggaaaaaag

SEQ ID NO: 131326 - DNA, 6 bp, Unknown
  misc_feature (1)..( 6): Result.003 file - promoters60/3439330
aatttt

SEQ ID NO: 131327 - DNA, 6 bp, Unknown
  misc_feature (1)..( 6): Result.003 file - promoters60/3439330
aatttt

SEQ ID NO: 131328 - DNA, 9 bp, Unknown
  misc_feature (1)..( 9): Result.003 file - promoters60/3439330
ttttcaaaa

SEQ ID NO: 131329 - DNA, 9 bp, Unknown
  misc_feature (1)..( 9): Result.003 file - promoters60/3439330
tttacaaaa

SEQ ID NO: 131330 - DNA, 6 bp, Unknown
  misc_feature (1)..( 6): Result.003 file - promoters60/3439330
ttctaa

SEQ ID NO: 131331 - DNA, 6 bp, Unknown
  misc_feature (1)..( 6): Result.003 file - promoters60/3439330
ttctaa

SEQ ID NO: 131332 - DNA, 7 bp, Unknown
  misc_feature (1)..( 7): Result.003 file - promoters60/3439330
ataaaaa

SEQ ID NO: 131333 - DNA, 7 bp, Unknown
  misc_feature (1)..( 7): Result.003 file - promoters60/3439330
atagaaa

SEQ ID NO: 131334 - DNA, 8 bp, Unknown
  misc_feature (1)..( 8): Result.003 file - promoters60/3439330
caaagagt

SEQ ID NO: 131335 - DNA, 8 bp, Unknown
  misc_feature (1)..( 8): Result.003 file - promoters60/3439330
aaaagagg

SEQ ID NO: 131336 - DNA, 8 bp, Unknown
  misc_feature (1)..( 8): Result.003 file - promoters60/3439330
aaaataga

SEQ ID NO: 131337 - DNA, 6 bp, Unknown
  misc_feature (1)..( 6): Result.003 file - promoters60/3439330
ttttgt

SEQ ID NO: 131338 - DNA, 6 bp, Unknown
  misc_feature (1)..( 6): Result.003 file - promoters60/3439330
ttttgt

SEQ ID NO: 131339 - DNA, 6 bp, Unknown
  misc_feature (1)..( 6): Result.003 file - promoters60/3439330
tgtttt

SEQ ID NO: 131340 - DNA, 6 bp, Unknown
  misc_feature (1)..( 6): Result.003 file - promoters60/3439330
tgtttt

SEQ ID NO: 131341 - DNA, 7 bp, Unknown
  misc_feature (1)..( 7): Result.003 file - promoters60/3439330
gtaatgt

SEQ ID NO: 131342 - DNA, 7 bp, Unknown
  misc_feature (1)..( 7): Result.003 file - promoters60/3439330
gtattgt

SEQ ID NO: 131343 - DNA, 6 bp, Unknown
  misc_feature (1)..( 6): Result.003 file - promoters60/3439330
ccccca

SEQ ID NO: 131344 - DNA, 6 bp, Unknown
  misc_feature (1)..( 6): Result.003 file - promoters60/3439330
ccccca

SEQ ID NO: 131345 - DNA, 6 bp, Unknown
  misc_feature (1)..( 6): Result.003 file - promoters60/3439353
aaccgt

SEQ ID NO: 131346 - DNA, 6 bp, Unknown
  misc_feature (1)..( 6): Result.003 file - promoters60/3439353
aaccgt

SEQ ID NO: 131347 - DNA, 8 bp, Unknown
  misc_feature (1)..( 8): Result.003 file - promoters60/3439353
ttttaaat

SEQ ID NO: 131348 - DNA, 8 bp, Unknown
  misc_feature (1)..( 8): Result.003 file - promoters60/3439353
tttaaaat

SEQ ID NO: 131349 - DNA, 8 bp, Unknown
  misc_feature (1)..( 8): Result.003 file - promoters60/3439353
tcagttaa

SEQ ID NO: 131350 - DNA, 8 bp, Unknown
  misc_feature (1)..( 8): Result.003 file - promoters60/3439353
tcaattaa

SEQ ID NO: 131351 - DNA, 6 bp, Unknown
  misc_feature (1)..( 6): Result.003 file - promoters60/3439353
tcatgt

SEQ ID NO: 131352 - DNA, 6 bp, Unknown
  misc_feature (1)..( 6): Result.003 file - promoters60/3439353
tcatgt

SEQ ID NO: 131353 - DNA, 8 bp, Unknown
  misc_feature (1)..( 8): Result.003 file - promoters60/3439353
taaacgca

SEQ ID NO: 131354 - DNA, 8 bp, Unknown
  misc_feature (1)..( 8): Result.003 file - promoters60/3439353
taaaagca

SEQ ID NO: 131355 - DNA, 9 bp, Unknown
  misc_feature (1)..( 9): Result.003 file - promoters60/3439353
gaaaataaa

SEQ ID NO: 131356 - DNA, 9 bp, Unknown
  misc_feature (1)..( 9): Result.003 file - promoters60/3439353
caaaaaaaa

SEQ ID NO: 131357 - DNA, 9 bp, Unknown
  misc_feature (1)..( 9): Result.003 file - promoters60/3439353
gaaaagaaa

SEQ ID NO: 131358 - DNA, 7 bp, Unknown
  misc_feature (1)..( 7): Result.003 file - promoters60/3439353
catttta

SEQ ID NO: 131359 - DNA, 7 bp, Unknown
  misc_feature (1)..( 7): Result.003 file - promoters60/3439353
catatta

SEQ ID NO: 131360 - DNA, 6 bp, Unknown
  misc_feature (1)..( 6): Result.003 file - promoters60/3439353
gataag

SEQ ID NO: 131361 - DNA, 6 bp, Unknown
  misc_feature (1)..( 6): Result.003 file - promoters60/3439353
gataag

SEQ ID NO: 131362 - DNA, 8 bp, Unknown
  misc_feature (1)..( 8): Result.003 file - promoters60/3439353
ttcctccg

SEQ ID NO: 131363 - DNA, 8 bp, Unknown
  misc_feature (1)..( 8): Result.003 file - promoters60/3439353
ttccaccg

SEQ ID NO: 131364 - DNA, 6 bp, Unknown
  misc_feature (1)..( 6): Result.003 file - promoters60/3439353
ttttgt

SEQ ID NO: 131365 - DNA, 6 bp, Unknown
  misc_feature (1)..( 6): Result.003 file - promoters60/3439353
ttttgt

SEQ ID NO: 131366 - DNA, 7 bp, Unknown
  misc_feature (1)..( 7): Result.003 file - promoters60/3439353
tacattt

SEQ ID NO: 131367 - DNA, 7 bp, Unknown
  misc_feature (1)..( 7): Result.003 file - promoters60/3439353
tacattt

SEQ ID NO: 131368 - DNA, 7 bp, Unknown
  misc_feature (1)..( 7): Result.003 file - promoters60/3439353
aaatcta

SEQ ID NO: 131369 - DNA, 7 bp, Unknown
  misc_feature (1)..( 7): Result.003 file - promoters60/3439353
aaatcta

SEQ ID NO: 131370 - DNA, 11 bp, Unknown
  misc_feature (1)..( 11): Result.003 file - promoters60/3439353
gtaaaagttta

SEQ ID NO: 131371 - DNA, 11 bp, Unknown
  misc_feature (1)..( 11): Result.003 file - promoters60/3439353
gtaaaagttta

SEQ ID NO: 131372 - DNA, 7 bp, Unknown
  misc_feature (1)..( 7): Result.003 file - promoters60/3439353
ttaaatt

SEQ ID NO: 131373 - DNA, 7 bp, Unknown
  misc_feature (1)..( 7): Result.003 file - promoters60/3439353
ttatatt

SEQ ID NO: 131374 - DNA, 6 bp, Unknown
  misc_feature (1)..( 6): Result.003 file - promoters60/3439353
attttc

SEQ ID NO: 131375 - DNA, 6 bp, Unknown
  misc_feature (1)..( 6): Result.003 file - promoters60/3439353
attttc

SEQ ID NO: 131376 - DNA, 6 bp, Unknown
  misc_feature (1)..( 6): Result.003 file - promoters60/3439353
caaaat

SEQ ID NO: 131377 - DNA, 6 bp, Unknown
  misc_feature (1)..( 6): Result.003 file - promoters60/3439353
caaaat

SEQ ID NO: 131378 - DNA, 10 bp, Unknown
  misc_feature (1)..( 10): Result.003 file - promoters60/3439353
acaacaatct

SEQ ID NO: 131379 - DNA, 10 bp, Unknown
  misc_feature (1)..( 10): Result.003 file - promoters60/3439353
acagcaatct

SEQ ID NO: 131380 - DNA, 6 bp, Unknown
  misc_feature (1)..( 6): Result.003 file - promoters60/3439353
cacaca

SEQ ID NO: 131381 - DNA, 6 bp, Unknown
  misc_feature (1)..( 6): Result.003 file - promoters60/3439353
cacaca

SEQ ID NO: 131382 - DNA, 10 bp, Unknown
  misc_feature (1)..( 10): Result.003 file - promoters60/3439364
ttttaacaaa

SEQ ID NO: 131383 - DNA, 10 bp, Unknown
  misc_feature (1)..( 10): Result.003 file - promoters60/3439364
atgtaaaaaa

SEQ ID NO: 131384 - DNA, 10 bp, Unknown
  misc_feature (1)..( 10): Result.003 file - promoters60/3439364
ttttaaaaaa

SEQ ID NO: 131385 - DNA, 10 bp, Unknown
  misc_feature (1)..( 10): Result.003 file - promoters60/3439364
tagtaaaaaa

SEQ ID NO: 131386 - DNA, 14 bp, Unknown
  misc_feature (1)..( 14): Result.003 file - promoters60/3439364
ttttttttaacaaa

SEQ ID NO: 131387 - DNA, 14 bp, Unknown
  misc_feature (1)..( 14): Result.003 file - promoters60/3439364
aaaactttaactat

SEQ ID NO: 131388 - DNA, 14 bp, Unknown
  misc_feature (1)..( 14): Result.003 file - promoters60/3439364
gtgattttaaaaaa

SEQ ID NO: 131389 - DNA, 14 bp, Unknown
  misc_feature (1)..( 14): Result.003 file - promoters60/3439364
atatttttataaat

SEQ ID NO: 131390 - DNA, 14 bp, Unknown
  misc_feature (1)..( 14): Result.003 file - promoters60/3439364
atatatttaatcag

SEQ ID NO: 131391 - DNA, 9 bp, Unknown
  misc_feature (1)..( 9): Result.003 file - promoters60/3439364
cacagtttc

SEQ ID NO: 131392 - DNA, 9 bp, Unknown
  misc_feature (1)..( 9): Result.003 file - promoters60/3439364
agcagtttc

SEQ ID NO: 131393 - DNA, 9 bp, Unknown
  misc_feature (1)..( 9): Result.003 file - promoters60/3439364
aacagtttt

SEQ ID NO: 131394 - DNA, 9 bp, Unknown
  misc_feature (1)..( 9): Result.003 file - promoters60/3439364
aacagtaat

SEQ ID NO: 131395 - DNA, 9 bp, Unknown
  misc_feature (1)..( 9): Result.003 file - promoters60/3439364
gtatttaga

SEQ ID NO: 131396 - DNA, 9 bp, Unknown
  misc_feature (1)..( 9): Result.003 file - promoters60/3439364
atatttaat

SEQ ID NO: 131397 - DNA, 9 bp, Unknown
  misc_feature (1)..( 9): Result.003 file - promoters60/3439364
atatttaat

SEQ ID NO: 131398 - DNA, 9 bp, Unknown
  misc_feature (1)..( 9): Result.003 file - promoters60/3439364
atattttta

SEQ ID NO: 131399 - DNA, 8 bp, Unknown
  misc_feature (1)..( 8): Result.003 file - promoters60/3439364
taataaac

SEQ ID NO: 131400 - DNA, 8 bp, Unknown
  misc_feature (1)..( 8): Result.003 file - promoters60/3439364
taataaaa

SEQ ID NO: 131401 - DNA, 9 bp, Unknown
  misc_feature (1)..( 9): Result.003 file - promoters60/3439364
aaattaaaa

SEQ ID NO: 131402 - DNA, 9 bp, Unknown
  misc_feature (1)..( 9): Result.003 file - promoters60/3439364
agtataaaa

SEQ ID NO: 131403 - DNA, 7 bp, Unknown
  misc_feature (1)..( 7): Result.003 file - promoters60/3439374
ttatatg

SEQ ID NO: 131404 - DNA, 7 bp, Unknown
  misc_feature (1)..( 7): Result.003 file - promoters60/3439374
ttacatg

SEQ ID NO: 131405 - DNA, 11 bp, Unknown
  misc_feature (1)..( 11): Result.003 file - promoters60/3439374
aaaagctatca

SEQ ID NO: 131406 - DNA, 11 bp, Unknown
  misc_feature (1)..( 11): Result.003 file - promoters60/3439374
ttgagcaatca

SEQ ID NO: 131407 - DNA, 11 bp, Unknown
  misc_feature (1)..( 11): Result.003 file - promoters60/3439374
aaatgctaaaa

SEQ ID NO: 131408 - DNA, 7 bp, Unknown
  misc_feature (1)..( 7): Result.003 file - promoters60/3439374
aaaatta

SEQ ID NO: 131409 - DNA, 7 bp, Unknown
  misc_feature (1)..( 7): Result.003 file - promoters60/3439374
aaaatta

SEQ ID NO: 131410 - DNA, 8 bp, Unknown
  misc_feature (1)..( 8): Result.003 file - promoters60/3439374
aaaaagca

SEQ ID NO: 131411 - DNA, 8 bp, Unknown
  misc_feature (1)..( 8): Result.003 file - promoters60/3439374
aaagagca

SEQ ID NO: 131412 - DNA, 9 bp, Unknown
  misc_feature (1)..( 9): Result.003 file - promoters60/3439374
aatttaata

SEQ ID NO: 131413 - DNA, 9 bp, Unknown
  misc_feature (1)..( 9): Result.003 file - promoters60/3439374
aattcaata

SEQ ID NO: 131414 - DNA, 7 bp, Unknown
  misc_feature (1)..( 7): Result.003 file - promoters60/3439374
ataagac

SEQ ID NO: 131415 - DNA, 7 bp, Unknown
  misc_feature (1)..( 7): Result.003 file - promoters60/3439374
atatgac

SEQ ID NO: 131416 - DNA, 8 bp, Unknown
  misc_feature (1)..( 8): Result.003 file - promoters60/3439374
tctaattt

SEQ ID NO: 131417 - DNA, 8 bp, Unknown
  misc_feature (1)..( 8): Result.003 file - promoters60/3439374
tctatttt

SEQ ID NO: 131418 - DNA, 7 bp, Unknown
  misc_feature (1)..( 7): Result.003 file - promoters60/3439374
gattttt

SEQ ID NO: 131419 - DNA, 7 bp, Unknown
  misc_feature (1)..( 7): Result.003 file - promoters60/3439374
gatattt

SEQ ID NO: 131420 - DNA, 7 bp, Unknown
  misc_feature (1)..( 7): Result.003 file - promoters60/3439374
aaaaagc

SEQ ID NO: 131421 - DNA, 7 bp, Unknown
  misc_feature (1)..( 7): Result.003 file - promoters60/3439374
aaaaagc

SEQ ID NO: 131422 - DNA, 9 bp, Unknown
  misc_feature (1)..( 9): Result.003 file - promoters60/3439374
taatttgaa

SEQ ID NO: 131423 - DNA, 9 bp, Unknown
  misc_feature (1)..( 9): Result.003 file - promoters60/3439374
taattagaa

SEQ ID NO: 131424 - DNA, 8 bp, Unknown
  misc_feature (1)..( 8): Result.003 file - promoters60/3439374
atccaacg

SEQ ID NO: 131425 - DNA, 8 bp, Unknown
  misc_feature (1)..( 8): Result.003 file - promoters60/3439374
atcctacg

SEQ ID NO: 131426 - DNA, 6 bp, Unknown
  misc_feature (1)..( 6): Result.003 file - promoters60/3439374
aataaa

SEQ ID NO: 131427 - DNA, 6 bp, Unknown
  misc_feature (1)..( 6): Result.003 file - promoters60/3439374
aataaa

SEQ ID NO: 131428 - DNA, 7 bp, Unknown
  misc_feature (1)..( 7): Result.003 file - promoters60/3439374
atataat

SEQ ID NO: 131429 - DNA, 7 bp, Unknown
  misc_feature (1)..( 7): Result.003 file - promoters60/3439374
ataaaat

SEQ ID NO: 131430 - DNA, 9 bp, Unknown
  misc_feature (1)..( 9): Result.003 file - promoters60/3439374
aattaaaat

SEQ ID NO: 131431 - DNA, 9 bp, Unknown
  misc_feature (1)..( 9): Result.003 file - promoters60/3439374
aataaaaat

SEQ ID NO: 131432 - DNA, 6 bp, Unknown
  misc_feature (1)..( 6): Result.003 file - promoters60/3439374
tttcta

SEQ ID NO: 131433 - DNA, 6 bp, Unknown
  misc_feature (1)..( 6): Result.003 file - promoters60/3439374
tttcta

SEQ ID NO: 131434 - DNA, 8 bp, Unknown
  misc_feature (1)..( 8): Result.003 file - promoters60/3439374
ctataaat

SEQ ID NO: 131435 - DNA, 8 bp, Unknown
  misc_feature (1)..( 8): Result.003 file - promoters60/3439374
ctataaat

SEQ ID NO: 131436 - DNA, 6 bp, Unknown
  misc_feature (1)..( 6): Result.003 file - promoters60/3439374
acctaa

SEQ ID NO: 131437 - DNA, 6 bp, Unknown
  misc_feature (1)..( 6): Result.003 file - promoters60/3439374
acctaa

SEQ ID NO: 131438 - DNA, 11 bp, Unknown
  misc_feature (1)..( 11): Result.003 file - promoters60/3439472
tcaaagaaaga

SEQ ID NO: 131439 - DNA, 11 bp, Unknown
  misc_feature (1)..( 11): Result.003 file - promoters60/3439472
tcaaacaaatc

SEQ ID NO: 131440 - DNA, 11 bp, Unknown
  misc_feature (1)..( 11): Result.003 file - promoters60/3439472
ccaaagaaagg

SEQ ID NO: 131441 - DNA, 11 bp, Unknown
  misc_feature (1)..( 11): Result.003 file - promoters60/3439472
acaaggaaaga

SEQ ID NO: 131442 - DNA, 11 bp, Unknown
  misc_feature (1)..( 11): Result.003 file - promoters60/3439472
acaacgaataa

SEQ ID NO: 131443 - DNA, 11 bp, Unknown
  misc_feature (1)..( 11): Result.003 file - promoters60/3439472
gaaaagaaaga

SEQ ID NO: 131444 - DNA, 11 bp, Unknown
  misc_feature (1)..( 11): Result.003 file - promoters60/3439472
caaaaaaaaac

SEQ ID NO: 131445 - DNA, 10 bp, Unknown
  misc_feature (1)..( 10): Result.003 file - promoters60/3439472
ctttttaaat

SEQ ID NO: 131446 - DNA, 10 bp, Unknown
  misc_feature (1)..( 10): Result.003 file - promoters60/3439472
ctttttgtgc

SEQ ID NO: 131447 - DNA, 10 bp, Unknown
  misc_feature (1)..( 10): Result.003 file - promoters60/3439472
atttataagg

SEQ ID NO: 131448 - DNA, 10 bp, Unknown
  misc_feature (1)..( 10): Result.003 file - promoters60/3439472
gtttttgtaa

SEQ ID NO: 131449 - DNA, 10 bp, Unknown
  misc_feature (1)..( 10): Result.003 file - promoters60/3439472
ttttgtgtta

SEQ ID NO: 131450 - DNA, 10 bp, Unknown
  misc_feature (1)..( 10): Result.003 file - promoters60/3439472
agttttgtaa

SEQ ID NO: 131451 - DNA, 15 bp, Unknown
  misc_feature (1)..( 15): Result.003 file - promoters60/3439472
caaatgggcctaatt

SEQ ID NO: 131452 - DNA, 15 bp, Unknown
  misc_feature (1)..( 15): Result.003 file - promoters60/3439472
cctaaaggcccaata

SEQ ID NO: 131453 - DNA, 15 bp, Unknown
  misc_feature (1)..( 15): Result.003 file - promoters60/3439472
ttaatgggccgaatt

SEQ ID NO: 131454 - DNA, 15 bp, Unknown
  misc_feature (1)..( 15): Result.003 file - promoters60/3439472
taaaaaggcccatta

SEQ ID NO: 131455 - DNA, 15 bp, Unknown
  misc_feature (1)..( 15): Result.003 file - promoters60/3439472
ccaaacggctaggat

SEQ ID NO: 131456 - DNA, 15 bp, Unknown
  misc_feature (1)..( 15): Result.003 file - promoters60/3439472
taaaagggcttcaag

SEQ ID NO: 131457 - DNA, 10 bp, Unknown
  misc_feature (1)..( 10): Result.003 file - promoters60/3439472
caaatcaaat

SEQ ID NO: 131458 - DNA, 10 bp, Unknown
  misc_feature (1)..( 10): Result.003 file - promoters60/3439472
aaaaccaaag

SEQ ID NO: 131459 - DNA, 10 bp, Unknown
  misc_feature (1)..( 10): Result.003 file - promoters60/3439472
gcagtcaaat

SEQ ID NO: 131460 - DNA, 10 bp, Unknown
  misc_feature (1)..( 10): Result.003 file - promoters60/3439472
aacaccaaag

SEQ ID NO: 131461 - DNA, 10 bp, Unknown
  misc_feature (1)..( 10): Result.003 file - promoters60/3439472
caagtaaaaa

SEQ ID NO: 131462 - DNA, 10 bp, Unknown
  misc_feature (1)..( 10): Result.003 file - promoters60/3439472
caaggaaaga

SEQ ID NO: 131463 - DNA, 8 bp, Unknown
  misc_feature (1)..( 8): Result.003 file - promoters60/3439482
attcgtta

SEQ ID NO: 131464 - DNA, 8 bp, Unknown
  misc_feature (1)..( 8): Result.003 file - promoters60/3439482
catcgtta

SEQ ID NO: 131465 - DNA, 8 bp, Unknown
  misc_feature (1)..( 8): Result.003 file - promoters60/3439482
attcttta

SEQ ID NO: 131466 - DNA, 8 bp, Unknown
  misc_feature (1)..( 8): Result.003 file - promoters60/3439482
aatcgttc

SEQ ID NO: 131467 - DNA, 6 bp, Unknown
  misc_feature (1)..( 6): Result.003 file - promoters60/3439506
tgtttt

SEQ ID NO: 131468 - DNA, 6 bp, Unknown
  misc_feature (1)..( 6): Result.003 file - promoters60/3439506
tgtttt

SEQ ID NO: 131469 - DNA, 8 bp, Unknown
  misc_feature (1)..( 8): Result.003 file - promoters60/3439506
tgaatatg

SEQ ID NO: 131470 - DNA, 8 bp, Unknown
  misc_feature (1)..( 8): Result.003 file - promoters60/3439506
tgaagatg

SEQ ID NO: 131471 - DNA, 6 bp, Unknown
  misc_feature (1)..( 6): Result.003 file - promoters60/3439506
atgtta

SEQ ID NO: 131472 - DNA, 6 bp, Unknown
  misc_feature (1)..( 6): Result.003 file - promoters60/3439506
atgtta

SEQ ID NO: 131473 - DNA, 6 bp, Unknown
  misc_feature (1)..( 6): Result.003 file - promoters60/3439506
aaggtt

SEQ ID NO: 131474 - DNA, 6 bp, Unknown
  misc_feature (1)..( 6): Result.003 file - promoters60/3439506
aaggtt

SEQ ID NO: 131475 - DNA, 6 bp, Unknown
  misc_feature (1)..( 6): Result.003 file - promoters60/3439506
ttcata

SEQ ID NO: 131476 - DNA, 6 bp, Unknown
  misc_feature (1)..( 6): Result.003 file - promoters60/3439506
ttcata

SEQ ID NO: 131477 - DNA, 7 bp, Unknown
  misc_feature (1)..( 7): Result.003 file - promoters60/3439506
tgggttg

SEQ ID NO: 131478 - DNA, 7 bp, Unknown
  misc_feature (1)..( 7): Result.003 file - promoters60/3439506
tggtttg

SEQ ID NO: 131479 - DNA, 8 bp, Unknown
  misc_feature (1)..( 8): Result.003 file - promoters60/3439506
aaactgaa

SEQ ID NO: 131480 - DNA, 8 bp, Unknown
  misc_feature (1)..( 8): Result.003 file - promoters60/3439506
aaattgaa

SEQ ID NO: 131481 - DNA, 8 bp, Unknown
  misc_feature (1)..( 8): Result.003 file - promoters60/3439506
aaattgtt

SEQ ID NO: 131482 - DNA, 7 bp, Unknown
  misc_feature (1)..( 7): Result.003 file - promoters60/3439506
tgtaaaa

SEQ ID NO: 131483 - DNA, 7 bp, Unknown
  misc_feature (1)..( 7): Result.003 file - promoters60/3439506
tgtaaaa

SEQ ID NO: 131484 - DNA, 7 bp, Unknown
  misc_feature (1)..( 7): Result.003 file - promoters60/3439506
agataaa

SEQ ID NO: 131485 - DNA, 7 bp, Unknown
  misc_feature (1)..( 7): Result.003 file - promoters60/3439506
agagaaa

SEQ ID NO: 131486 - DNA, 10 bp, Unknown
  misc_feature (1)..( 10): Result.003 file - promoters60/3439506
atgcttttgt

SEQ ID NO: 131487 - DNA, 10 bp, Unknown
  misc_feature (1)..( 10): Result.003 file - promoters60/3439506
atgcttttgt

SEQ ID NO: 131488 - DNA, 8 bp, Unknown
  misc_feature (1)..( 8): Result.003 file - promoters60/3439506
aaataaga

SEQ ID NO: 131489 - DNA, 8 bp, Unknown
  misc_feature (1)..( 8): Result.003 file - promoters60/3439506
aaaaaaga

SEQ ID NO: 131490 - DNA, 8 bp, Unknown
  misc_feature (1)..( 8): Result.003 file - promoters60/3439506
aaaggagg

SEQ ID NO: 131491 - DNA, 8 bp, Unknown
  misc_feature (1)..( 8): Result.003 file - promoters60/3439506
ttaatatt

SEQ ID NO: 131492 - DNA, 8 bp, Unknown
  misc_feature (1)..( 8): Result.003 file - promoters60/3439506
ttaatatt

SEQ ID NO: 131493 - DNA, 7 bp, Unknown
  misc_feature (1)..( 7): Result.003 file - promoters60/3439506
tgatgaa

SEQ ID NO: 131494 - DNA, 7 bp, Unknown
  misc_feature (1)..( 7): Result.003 file - promoters60/3439506
tgaggaa

SEQ ID NO: 131495 - DNA, 6 bp, Unknown
  misc_feature (1)..( 6): Result.003 file - promoters60/3439506
gaagag

SEQ ID NO: 131496 - DNA, 6 bp, Unknown
  misc_feature (1)..( 6): Result.003 file - promoters60/3439506
gaagag

SEQ ID NO: 131497 - DNA, 8 bp, Unknown
  misc_feature (1)..( 8): Result.003 file - promoters60/3439593
aggaattt

SEQ ID NO: 131498 - DNA, 8 bp, Unknown
  misc_feature (1)..( 8): Result.003 file - promoters60/3439593
tggatttt

SEQ ID NO: 131499 - DNA, 8 bp, Unknown
  misc_feature (1)..( 8): Result.003 file - promoters60/3439593
acgaattt

SEQ ID NO: 131500 - DNA, 8 bp, Unknown
  misc_feature (1)..( 8): Result.003 file - promoters60/3439593
tgggtttg

SEQ ID NO: 131501 - DNA, 7 bp, Unknown
  misc_feature (1)..( 7): Result.003 file - promoters60/3439595
aacaaaa

SEQ ID NO: 131502 - DNA, 7 bp, Unknown
  misc_feature (1)..( 7): Result.003 file - promoters60/3439595
aacgaaa

SEQ ID NO: 131503 - DNA, 7 bp, Unknown
  misc_feature (1)..( 7): Result.003 file - promoters60/3439595
gacgaaa

SEQ ID NO: 131504 - DNA, 7 bp, Unknown
  misc_feature (1)..( 7): Result.003 file - promoters60/3439595
taattca

SEQ ID NO: 131505 - DNA, 7 bp, Unknown
  misc_feature (1)..( 7): Result.003 file - promoters60/3439595
aaattca

SEQ ID NO: 131506 - DNA, 7 bp, Unknown
  misc_feature (1)..( 7): Result.003 file - promoters60/3439595
taattct

SEQ ID NO: 131507 - DNA, 12 bp, Unknown
  misc_feature (1)..( 12): Result.003 file - promoters60/3439595
tgacatgattta

SEQ ID NO: 131508 - DNA, 12 bp, Unknown
  misc_feature (1)..( 12): Result.003 file - promoters60/3439595
tgacatgatttt

SEQ ID NO: 131509 - DNA, 12 bp, Unknown
  misc_feature (1)..( 12): Result.003 file - promoters60/3439595
gaaagggatttt

SEQ ID NO: 131510 - DNA, 7 bp, Unknown
  misc_feature (1)..( 7): Result.003 file - promoters60/3439595
caaattg

SEQ ID NO: 131511 - DNA, 7 bp, Unknown
  misc_feature (1)..( 7): Result.003 file - promoters60/3439595
caaattt

SEQ ID NO: 131512 - DNA, 7 bp, Unknown
  misc_feature (1)..( 7): Result.003 file - promoters60/3439595
aaaattt

SEQ ID NO: 131513 - DNA, 11 bp, Unknown
  misc_feature (1)..( 11): Result.003 file - promoters60/3439595
cccatataaaa

SEQ ID NO: 131514 - DNA, 11 bp, Unknown
  misc_feature (1)..( 11): Result.003 file - promoters60/3439595
cccttataaaa

SEQ ID NO: 131515 - DNA, 11 bp, Unknown
  misc_feature (1)..( 11): Result.003 file - promoters60/3439595
tgcttatataa

SEQ ID NO: 131516 - DNA, 12 bp, Unknown
  misc_feature (1)..( 12): Result.003 file - promoters60/3439605
ttcgatttggcg

SEQ ID NO: 131517 - DNA, 12 bp, Unknown
  misc_feature (1)..( 12): Result.003 file - promoters60/3439605
ttccattttcta

SEQ ID NO: 131518 - DNA, 12 bp, Unknown
  misc_feature (1)..( 12): Result.003 file - promoters60/3439605
cagaatttgcga

SEQ ID NO: 131519 - DNA, 10 bp, Unknown
  misc_feature (1)..( 10): Result.003 file - promoters60/3439605
ctgaaaagga

SEQ ID NO: 131520 - DNA, 10 bp, Unknown
  misc_feature (1)..( 10): Result.003 file - promoters60/3439605
ctgaaacaaa

SEQ ID NO: 131521 - DNA, 10 bp, Unknown
  misc_feature (1)..( 10): Result.003 file - promoters60/3439605
atgaaaacaa

SEQ ID NO: 131522 - DNA, 10 bp, Unknown
  misc_feature (1)..( 10): Result.003 file - promoters60/3439605
gagaaaacaa

SEQ ID NO: 131523 - DNA, 12 bp, Unknown
  misc_feature (1)..( 12): Result.003 file - promoters60/3439605
tctattttaatt

SEQ ID NO: 131524 - DNA, 12 bp, Unknown
  misc_feature (1)..( 12): Result.003 file - promoters60/3439605
tctctttttttt

SEQ ID NO: 131525 - DNA, 12 bp, Unknown
  misc_feature (1)..( 12): Result.003 file - promoters60/3439605
agaatttaaatg

SEQ ID NO: 131526 - DNA, 12 bp, Unknown
  misc_feature (1)..( 12): Result.003 file - promoters60/3439605
agtgaataaatg

SEQ ID NO: 131527 - DNA, 7 bp, Unknown
  misc_feature (1)..( 7): Result.003 file - promoters60/3439605
taatttc

SEQ ID NO: 131528 - DNA, 7 bp, Unknown
  misc_feature (1)..( 7): Result.003 file - promoters60/3439605
taatttt

SEQ ID NO: 131529 - DNA, 7 bp, Unknown
  misc_feature (1)..( 7): Result.003 file - promoters60/3439605
taaattc

SEQ ID NO: 131530 - DNA, 9 bp, Unknown
  misc_feature (1)..( 9): Result.003 file - promoters60/3439605
cgattgaat

SEQ ID NO: 131531 - DNA, 9 bp, Unknown
  misc_feature (1)..( 9): Result.003 file - promoters60/3439605
cgattaaat

SEQ ID NO: 131532 - DNA, 9 bp, Unknown
  misc_feature (1)..( 9): Result.003 file - promoters60/3439605
atattaaat

SEQ ID NO: 131533 - DNA, 15 bp, Unknown
  misc_feature (1)..( 15): Result.003 file - promoters60/3439605
gattgaaatatttaa

SEQ ID NO: 131534 - DNA, 15 bp, Unknown
  misc_feature (1)..( 15): Result.003 file - promoters60/3439605
acatgaaatagttaa

SEQ ID NO: 131535 - DNA, 15 bp, Unknown
  misc_feature (1)..( 15): Result.003 file - promoters60/3439605
acataaaataaattt

SEQ ID NO: 131536 - DNA, 8 bp, Unknown
  misc_feature (1)..( 8): Result.003 file - promoters60/3439605
aaacaaag

SEQ ID NO: 131537 - DNA, 8 bp, Unknown
  misc_feature (1)..( 8): Result.003 file - promoters60/3439605
tcacaaag

SEQ ID NO: 131538 - DNA, 8 bp, Unknown
  misc_feature (1)..( 8): Result.003 file - promoters60/3439605
tcataaat

SEQ ID NO: 131539 - DNA, 11 bp, Unknown
  misc_feature (1)..( 11): Result.003 file - promoters60/3439605
taaattcgcca

SEQ ID NO: 131540 - DNA, 11 bp, Unknown
  misc_feature (1)..( 11): Result.003 file - promoters60/3439605
taaattctggg

SEQ ID NO: 131541 - DNA, 11 bp, Unknown
  misc_feature (1)..( 11): Result.003 file - promoters60/3439605
aaaattttggg

SEQ ID NO: 131542 - DNA, 8 bp, Unknown
  misc_feature (1)..( 8): Result.003 file - promoters60/3439605
ttttaatt

SEQ ID NO: 131543 - DNA, 8 bp, Unknown
  misc_feature (1)..( 8): Result.003 file - promoters60/3439605
attttatt

SEQ ID NO: 131544 - DNA, 8 bp, Unknown
  misc_feature (1)..( 8): Result.003 file - promoters60/3439605
attttaga

SEQ ID NO: 131545 - DNA, 7 bp, Unknown
  misc_feature (1)..( 7): Result.003 file - promoters60/3439605
catttat

SEQ ID NO: 131546 - DNA, 7 bp, Unknown
  misc_feature (1)..( 7): Result.003 file - promoters60/3439605
aatttat

SEQ ID NO: 131547 - DNA, 7 bp, Unknown
  misc_feature (1)..( 7): Result.003 file - promoters60/3439605
catttaa

SEQ ID NO: 131548 - DNA, 8 bp, Unknown
  misc_feature (1)..( 8): Result.003 file - promoters60/3439605
caaagcaa

SEQ ID NO: 131549 - DNA, 8 bp, Unknown
  misc_feature (1)..( 8): Result.003 file - promoters60/3439605
gaaaacaa

SEQ ID NO: 131550 - DNA, 8 bp, Unknown
  misc_feature (1)..( 8): Result.003 file - promoters60/3439605
gaaaacaa

SEQ ID NO: 131551 - DNA, 19 bp, Unknown
  misc_feature (1)..( 19): Result.003 file - promoters60/3439614
tctctcaaagatttttttg

SEQ ID NO: 131552 - DNA, 19 bp, Unknown
  misc_feature (1)..( 19): Result.003 file - promoters60/3439614
tctttcaaaatttgaaggc

SEQ ID NO: 131553 - DNA, 19 bp, Unknown
  misc_feature (1)..( 19): Result.003 file - promoters60/3439614
aatttcacagaaatagata

SEQ ID NO: 131554 - DNA, 19 bp, Unknown
  misc_feature (1)..( 19): Result.003 file - promoters60/3439614
cgtgtcaaataaattattt

SEQ ID NO: 131555 - DNA, 19 bp, Unknown
  misc_feature (1)..( 19): Result.003 file - promoters60/3439614
gcagtcaaatatagagttg

SEQ ID NO: 131556 - DNA, 19 bp, Unknown
  misc_feature (1)..( 19): Result.003 file - promoters60/3439614
gggtgagaatcattaatcc

SEQ ID NO: 131557 - DNA, 19 bp, Unknown
  misc_feature (1)..( 19): Result.003 file - promoters60/3439614
agtaaaaaagtataaaaac

SEQ ID NO: 131558 - DNA, 9 bp, Unknown
  misc_feature (1)..( 9): Result.003 file - promoters60/3439614
aaatatata

SEQ ID NO: 131559 - DNA, 9 bp, Unknown
  misc_feature (1)..( 9): Result.003 file - promoters60/3439614
gaatatata

SEQ ID NO: 131560 - DNA, 9 bp, Unknown
  misc_feature (1)..( 9): Result.003 file - promoters60/3439614
aaaaatact

SEQ ID NO: 131561 - DNA, 9 bp, Unknown
  misc_feature (1)..( 9): Result.003 file - promoters60/3439614
aaagatagt

SEQ ID NO: 131562 - DNA, 9 bp, Unknown
  misc_feature (1)..( 9): Result.003 file - promoters60/3439614
ggagagaga

SEQ ID NO: 131563 - DNA, 9 bp, Unknown
  misc_feature (1)..( 9): Result.003 file - promoters60/3439614
caaggtaga

SEQ ID NO: 131564 - DNA, 15 bp, Unknown
  misc_feature (1)..( 15): Result.003 file - promoters60/3439614
cacaaaaatacattt

SEQ ID NO: 131565 - DNA, 15 bp, Unknown
  misc_feature (1)..( 15): Result.003 file - promoters60/3439614
gtcaaatatagagtt

SEQ ID NO: 131566 - DNA, 15 bp, Unknown
  misc_feature (1)..( 15): Result.003 file - promoters60/3439614
aacaaaaaaaaacga

SEQ ID NO: 131567 - DNA, 15 bp, Unknown
  misc_feature (1)..( 15): Result.003 file - promoters60/3439614
cacaactatgcctac

SEQ ID NO: 131568 - DNA, 15 bp, Unknown
  misc_feature (1)..( 15): Result.003 file - promoters60/3439614
cgcaactatatctgc

SEQ ID NO: 131569 - DNA, 16 bp, Unknown
  misc_feature (1)..( 16): Result.003 file - promoters60/3439614
actaaaagaaaccaat

SEQ ID NO: 131570 - DNA, 16 bp, Unknown
  misc_feature (1)..( 16): Result.003 file - promoters60/3439614
tgaaacaacacaaaaa

SEQ ID NO: 131571 - DNA, 16 bp, Unknown
  misc_feature (1)..( 16): Result.003 file - promoters60/3439614
aaaaaaaacgaatggc

SEQ ID NO: 131572 - DNA, 16 bp, Unknown
  misc_feature (1)..( 16): Result.003 file - promoters60/3439614
ggaaaatgaattcttt

SEQ ID NO: 131573 - DNA, 16 bp, Unknown
  misc_feature (1)..( 16): Result.003 file - promoters60/3439614
gtcaaataaattattt

SEQ ID NO: 131574 - DNA, 16 bp, Unknown
  misc_feature (1)..( 16): Result.003 file - promoters60/3439614
ctaaaagaaaccaatt

SEQ ID NO: 131575 - DNA, 16 bp, Unknown
  misc_feature (1)..( 16): Result.003 file - promoters60/3439614
gtcaaatatagagttg

SEQ ID NO: 131576 - DNA, 16 bp, Unknown
  misc_feature (1)..( 16): Result.003 file - promoters60/3439614
tgggtgagaatcatta

SEQ ID NO: 131577 - DNA, 14 bp, Unknown
  misc_feature (1)..( 14): Result.003 file - promoters60/3439614
caaaatttacaaga

SEQ ID NO: 131578 - DNA, 14 bp, Unknown
  misc_feature (1)..( 14): Result.003 file - promoters60/3439614
caaaatttataagg

SEQ ID NO: 131579 - DNA, 14 bp, Unknown
  misc_feature (1)..( 14): Result.003 file - promoters60/3439614
gttgattgataggt

SEQ ID NO: 131580 - DNA, 15 bp, Unknown
  misc_feature (1)..( 15): Result.003 file - promoters60/3439614
acagcggcgataagg

SEQ ID NO: 131581 - DNA, 14 bp, Unknown
  misc_feature (1)..( 14): Result.003 file - promoters60/3439614
ataattttatatat

SEQ ID NO: 131582 - DNA, 15 bp, Unknown
  misc_feature (1)..( 15): Result.003 file - promoters60/3439614
actaattctataaca

SEQ ID NO: 131583 - DNA, 16 bp, Unknown
  misc_feature (1)..( 16): Result.003 file - promoters60/3439614
ggaaaatgaattcttt

SEQ ID NO: 131584 - DNA, 16 bp, Unknown
  misc_feature (1)..( 16): Result.003 file - promoters60/3439614
actaaaagaaaccaat

SEQ ID NO: 131585 - DNA, 16 bp, Unknown
  misc_feature (1)..( 16): Result.003 file - promoters60/3439614
aaaaaacgaatggcaa

SEQ ID NO: 131586 - DNA, 16 bp, Unknown
  misc_feature (1)..( 16): Result.003 file - promoters60/3439614
gtcaaataaattattt

SEQ ID NO: 131587 - DNA, 16 bp, Unknown
  misc_feature (1)..( 16): Result.003 file - promoters60/3439614
gtcaaatatagagttg

SEQ ID NO: 131588 - DNA, 16 bp, Unknown
  misc_feature (1)..( 16): Result.003 file - promoters60/3439614
tgagaatcattaatcc

SEQ ID NO: 131589 - DNA, 12 bp, Unknown
  misc_feature (1)..( 12): Result.003 file - promoters60/3439641
tattaaaatgca

SEQ ID NO: 131590 - DNA, 12 bp, Unknown
  misc_feature (1)..( 12): Result.003 file - promoters60/3439641
tataaaaagaaa

SEQ ID NO: 131591 - DNA, 12 bp, Unknown
  misc_feature (1)..( 12): Result.003 file - promoters60/3439641
tattaaaataga

SEQ ID NO: 131592 - DNA, 12 bp, Unknown
  misc_feature (1)..( 12): Result.003 file - promoters60/3439641
aagaaaaagaaa

SEQ ID NO: 131593 - DNA, 12 bp, Unknown
  misc_feature (1)..( 12): Result.003 file - promoters60/3439641
cagacaagcgag

SEQ ID NO: 131594 - DNA, 9 bp, Unknown
  misc_feature (1)..( 9): Result.003 file - promoters60/3439641
tttttttta

SEQ ID NO: 131595 - DNA, 9 bp, Unknown
  misc_feature (1)..( 9): Result.003 file - promoters60/3439641
ttttatttt

SEQ ID NO: 131596 - DNA, 9 bp, Unknown
  misc_feature (1)..( 9): Result.003 file - promoters60/3439641
ttatatttg

SEQ ID NO: 131597 - DNA, 9 bp, Unknown
  misc_feature (1)..( 9): Result.003 file - promoters60/3439641
ttagattat

SEQ ID NO: 131598 - DNA, 12 bp, Unknown
  misc_feature (1)..( 12): Result.003 file - promoters60/3439641
tgcatacgtttt

SEQ ID NO: 131599 - DNA, 12 bp, Unknown
  misc_feature (1)..( 12): Result.003 file - promoters60/3439641
aatcgtcgtttt

SEQ ID NO: 131600 - DNA, 12 bp, Unknown
  misc_feature (1)..( 12): Result.003 file - promoters60/3439641
gaaatatgtttc

SEQ ID NO: 131601 - DNA, 12 bp, Unknown
  misc_feature (1)..( 12): Result.003 file - promoters60/3439641
aaattatgttat

SEQ ID NO: 131602 - DNA, 12 bp, Unknown
  misc_feature (1)..( 12): Result.003 file - promoters60/3439641
gaagtatgtgtt

SEQ ID NO: 131603 - DNA, 11 bp, Unknown
  misc_feature (1)..( 11): Result.003 file - promoters60/3439641
ttttgtttcgt

SEQ ID NO: 131604 - DNA, 11 bp, Unknown
  misc_feature (1)..( 11): Result.003 file - promoters60/3439641
ttttgattcgt

SEQ ID NO: 131605 - DNA, 11 bp, Unknown
  misc_feature (1)..( 11): Result.003 file - promoters60/3439641
gtttgcttcga

SEQ ID NO: 131606 - DNA, 11 bp, Unknown
  misc_feature (1)..( 11): Result.003 file - promoters60/3439641
ggttggttcat

SEQ ID NO: 131607 - DNA, 11 bp, Unknown
  misc_feature (1)..( 11): Result.003 file - promoters60/3439641
taacaaatttt

SEQ ID NO: 131608 - DNA, 11 bp, Unknown
  misc_feature (1)..( 11): Result.003 file - promoters60/3439641
gagataatttt

SEQ ID NO: 131609 - DNA, 12 bp, Unknown
  misc_feature (1)..( 12): Result.003 file - promoters60/3439641
catgtaatgttt

SEQ ID NO: 131610 - DNA, 12 bp, Unknown
  misc_feature (1)..( 12): Result.003 file - promoters60/3439641
tgtctaattata

SEQ ID NO: 131611 - DNA, 9 bp, Unknown
  misc_feature (1)..( 9): Result.003 file - promoters60/3439641
ttatataaa

SEQ ID NO: 131612 - DNA, 9 bp, Unknown
  misc_feature (1)..( 9): Result.003 file - promoters60/3439641
ttatatttg

SEQ ID NO: 131613 - DNA, 9 bp, Unknown
  misc_feature (1)..( 9): Result.003 file - promoters60/3439641
ttatttttg

SEQ ID NO: 131614 - DNA, 9 bp, Unknown
  misc_feature (1)..( 9): Result.003 file - promoters60/3439641
ttagattat

SEQ ID NO: 131615 - DNA, 11 bp, Unknown
  misc_feature (1)..( 11): Result.003 file - promoters60/3439641
aagaaatgtag

SEQ ID NO: 131616 - DNA, 11 bp, Unknown
  misc_feature (1)..( 11): Result.003 file - promoters60/3439641
aagaaatttat

SEQ ID NO: 131617 - DNA, 11 bp, Unknown
  misc_feature (1)..( 11): Result.003 file - promoters60/3439641
tagaaatatgt

SEQ ID NO: 131618 - DNA, 11 bp, Unknown
  misc_feature (1)..( 11): Result.003 file - promoters60/3439641
tggaagtatgt

SEQ ID NO: 131619 - DNA, 10 bp, Unknown
  misc_feature (1)..( 10): Result.003 file - promoters60/3439662
agtttttgaa

SEQ ID NO: 131620 - DNA, 10 bp, Unknown
  misc_feature (1)..( 10): Result.003 file - promoters60/3439662
taattttgaa

SEQ ID NO: 131621 - DNA, 8 bp, Unknown
  misc_feature (1)..( 8): Result.003 file - promoters60/3439662
aatttgaa

SEQ ID NO: 131622 - DNA, 10 bp, Unknown
  misc_feature (1)..( 10): Result.003 file - promoters60/3439662
taatattggt

SEQ ID NO: 131623 - DNA, 10 bp, Unknown
  misc_feature (1)..( 10): Result.003 file - promoters60/3439662
tagatttgat

SEQ ID NO: 131624 - DNA, 7 bp, Unknown
  misc_feature (1)..( 7): Result.003 file - promoters60/3439905
aaataat

SEQ ID NO: 131625 - DNA, 7 bp, Unknown
  misc_feature (1)..( 7): Result.003 file - promoters60/3439905
taataat

SEQ ID NO: 131626 - DNA, 7 bp, Unknown
  misc_feature (1)..( 7): Result.003 file - promoters60/3439905
aaataaa

SEQ ID NO: 131627 - DNA, 8 bp, Unknown
  misc_feature (1)..( 8): Result.003 file - promoters60/3439905
tgaaatca

SEQ ID NO: 131628 - DNA, 8 bp, Unknown
  misc_feature (1)..( 8): Result.003 file - promoters60/3439905
tgacatca

SEQ ID NO: 131629 - DNA, 7 bp, Unknown
  misc_feature (1)..( 7): Result.003 file - promoters60/3439905
taaaaaa

SEQ ID NO: 131630 - DNA, 7 bp, Unknown
  misc_feature (1)..( 7): Result.003 file - promoters60/3439905
taaaaaa

SEQ ID NO: 131631 - DNA, 7 bp, Unknown
  misc_feature (1)..( 7): Result.003 file - promoters60/3439905
taaaaac

SEQ ID NO: 131632 - DNA, 6 bp, Unknown
  misc_feature (1)..( 6): Result.003 file - promoters60/3439905
aatgaa

SEQ ID NO: 131633 - DNA, 6 bp, Unknown
  misc_feature (1)..( 6): Result.003 file - promoters60/3439905
aatgaa

SEQ ID NO: 131634 - DNA, 6 bp, Unknown
  misc_feature (1)..( 6): Result.003 file - promoters60/3439905
ggaaat

SEQ ID NO: 131635 - DNA, 6 bp, Unknown
  misc_feature (1)..( 6): Result.003 file - promoters60/3439905
ggaaat

SEQ ID NO: 131636 - DNA, 6 bp, Unknown
  misc_feature (1)..( 6): Result.003 file - promoters60/3439905
aagaaa

SEQ ID NO: 131637 - DNA, 6 bp, Unknown
  misc_feature (1)..( 6): Result.003 file - promoters60/3439905
aagaaa

SEQ ID NO: 131638 - DNA, 7 bp, Unknown
  misc_feature (1)..( 7): Result.003 file - promoters60/3439905
aaagaat

SEQ ID NO: 131639 - DNA, 7 bp, Unknown
  misc_feature (1)..( 7): Result.003 file - promoters60/3439905
aaaaaat

SEQ ID NO: 131640 - DNA, 9 bp, Unknown
  misc_feature (1)..( 9): Result.003 file - promoters60/3439905
ttctttctc

SEQ ID NO: 131641 - DNA, 9 bp, Unknown
  misc_feature (1)..( 9): Result.003 file - promoters60/3439905
ttctctctc

SEQ ID NO: 131642 - DNA, 7 bp, Unknown
  misc_feature (1)..( 7): Result.003 file - promoters60/3439905
atttttc

SEQ ID NO: 131643 - DNA, 7 bp, Unknown
  misc_feature (1)..( 7): Result.003 file - promoters60/3439905
attcttc

SEQ ID NO: 131644 - DNA, 6 bp, Unknown
  misc_feature (1)..( 6): Result.003 file - promoters60/3439905
tataaa

SEQ ID NO: 131645 - DNA, 6 bp, Unknown
  misc_feature (1)..( 6): Result.003 file - promoters60/3439905
tataaa

SEQ ID NO: 131646 - DNA, 10 bp, Unknown
  misc_feature (1)..( 10): Result.003 file - promoters60/3442171
ttttttttta

SEQ ID NO: 131647 - DNA, 10 bp, Unknown
  misc_feature (1)..( 10): Result.003 file - promoters60/3442171
atttatttta

SEQ ID NO: 131648 - DNA, 10 bp, Unknown
  misc_feature (1)..( 10): Result.003 file - promoters60/3442171
ttttattcat

SEQ ID NO: 131649 - DNA, 10 bp, Unknown
  misc_feature (1)..( 10): Result.003 file - promoters60/3442171
ttttaaccaa

SEQ ID NO: 131650 - DNA, 10 bp, Unknown
  misc_feature (1)..( 10): Result.003 file - promoters60/3442171
aaataaagtt

SEQ ID NO: 131651 - DNA, 10 bp, Unknown
  misc_feature (1)..( 10): Result.003 file - promoters60/3442171
aaataaggtt

SEQ ID NO: 131652 - DNA, 10 bp, Unknown
  misc_feature (1)..( 10): Result.003 file - promoters60/3442171
caacaaagtt

SEQ ID NO: 131653 - DNA, 10 bp, Unknown
  misc_feature (1)..( 10): Result.003 file - promoters60/3442171
gttaaaagtt

SEQ ID NO: 131654 - DNA, 15 bp, Unknown
  misc_feature (1)..( 15): Result.003 file - promoters60/3445482
acaatgggctgggcc

SEQ ID NO: 131655 - DNA, 15 bp, Unknown
  misc_feature (1)..( 15): Result.003 file - promoters60/3445482
attttgggcttctta

SEQ ID NO: 131656 - DNA, 15 bp, Unknown
  misc_feature (1)..( 15): Result.003 file - promoters60/3445482
gaaataggcccaaca

SEQ ID NO: 131657 - DNA, 15 bp, Unknown
  misc_feature (1)..( 15): Result.003 file - promoters60/3445482
taattgggcttttta

SEQ ID NO: 131658 - DNA, 15 bp, Unknown
  misc_feature (1)..( 15): Result.003 file - promoters60/3445482
caattgggattattt

SEQ ID NO: 131659 - DNA, 15 bp, Unknown
  misc_feature (1)..( 15): Result.003 file - promoters60/3445482
taaaaaggcccatta

SEQ ID NO: 131660 - DNA, 15 bp, Unknown
  misc_feature (1)..( 15): Result.003 file - promoters60/3445482
taaaaaatatctgaa

SEQ ID NO: 131661 - DNA, 15 bp, Unknown
  misc_feature (1)..( 15): Result.003 file - promoters60/3445482
cctaaaggcccaata

SEQ ID NO: 131662 - DNA, 11 bp, Unknown
  misc_feature (1)..( 11): Result.003 file - promoters60/3445482
tcaagacctaa

SEQ ID NO: 131663 - DNA, 11 bp, Unknown
  misc_feature (1)..( 11): Result.003 file - promoters60/3445482
gcaaaaccaaa

SEQ ID NO: 131664 - DNA, 11 bp, Unknown
  misc_feature (1)..( 11): Result.003 file - promoters60/3445482
cctaaaccact

SEQ ID NO: 131665 - DNA, 11 bp, Unknown
  misc_feature (1)..( 11): Result.003 file - promoters60/3445482
aacaaatcaaa

SEQ ID NO: 131666 - DNA, 11 bp, Unknown
  misc_feature (1)..( 11): Result.003 file - promoters60/3445482
tcaaatataga

SEQ ID NO: 131667 - DNA, 11 bp, Unknown
  misc_feature (1)..( 11): Result.003 file - promoters60/3445482
acaaaactgaa

SEQ ID NO: 131668 - DNA, 10 bp, Unknown
  misc_feature (1)..( 10): Result.003 file - promoters60/3593205
aataataaac

SEQ ID NO: 131669 - DNA, 10 bp, Unknown
  misc_feature (1)..( 10): Result.003 file - promoters60/3593205
cgaaatcaac

SEQ ID NO: 131670 - DNA, 10 bp, Unknown
  misc_feature (1)..( 10): Result.003 file - promoters60/3593205
ataaataatt

SEQ ID NO: 131671 - DNA, 10 bp, Unknown
  misc_feature (1)..( 10): Result.003 file - promoters60/3593205
taaaatcaca

SEQ ID NO: 131672 - DNA, 13 bp, Unknown
  misc_feature (1)..( 13): Result.003 file - promoters60/3593205
tattgaatcatat

SEQ ID NO: 131673 - DNA, 13 bp, Unknown
  misc_feature (1)..( 13): Result.003 file - promoters60/3593205
aattggatccgaa

SEQ ID NO: 131674 - DNA, 13 bp, Unknown
  misc_feature (1)..( 13): Result.003 file - promoters60/3593205
aattagatttttt

SEQ ID NO: 131675 - DNA, 13 bp, Unknown
  misc_feature (1)..( 13): Result.003 file - promoters60/3593205
tattcgatctttt

SEQ ID NO: 131676 - DNA, 10 bp, Unknown
  misc_feature (1)..( 10): Result.003 file - promoters60/3593205
aactaaaact

SEQ ID NO: 131677 - DNA, 10 bp, Unknown
  misc_feature (1)..( 10): Result.003 file - promoters60/3593205
tactcaaata

SEQ ID NO: 131678 - DNA, 10 bp, Unknown
  misc_feature (1)..( 10): Result.003 file - promoters60/3593205
gaatctaata

SEQ ID NO: 131679 - DNA, 10 bp, Unknown
  misc_feature (1)..( 10): Result.003 file - promoters60/3593205
atttcttata

SEQ ID NO: 131680 - DNA, 11 bp, Unknown
  misc_feature (1)..( 11): Result.003 file - promoters60/3593205
acaataataaa

SEQ ID NO: 131681 - DNA, 11 bp, Unknown
  misc_feature (1)..( 11): Result.003 file - promoters60/3593205
tttataatata

SEQ ID NO: 131682 - DNA, 11 bp, Unknown
  misc_feature (1)..( 11): Result.003 file - promoters60/3593205
acaattatata

SEQ ID NO: 131683 - DNA, 11 bp, Unknown
  misc_feature (1)..( 11): Result.003 file - promoters60/3593205
cactttaaaat

SEQ ID NO: 131684 - DNA, 9 bp, Unknown
  misc_feature (1)..( 9): Result.003 file - promoters60/3593205
ctattttgt

SEQ ID NO: 131685 - DNA, 9 bp, Unknown
  misc_feature (1)..( 9): Result.003 file - promoters60/3593205
ttattttat

SEQ ID NO: 131686 - DNA, 9 bp, Unknown
  misc_feature (1)..( 9): Result.003 file - promoters60/3593205
ctaatttag

SEQ ID NO: 131687 - DNA, 9 bp, Unknown
  misc_feature (1)..( 9): Result.003 file - promoters60/3593205
atattttat

SEQ ID NO: 131688 - DNA, 13 bp, Unknown
  misc_feature (1)..( 13): Result.003 file - promoters60/3593205
tattatattgaat

SEQ ID NO: 131689 - DNA, 13 bp, Unknown
  misc_feature (1)..( 13): Result.003 file - promoters60/3593205
aattagatttttt

SEQ ID NO: 131690 - DNA, 13 bp, Unknown
  misc_feature (1)..( 13): Result.003 file - promoters60/3593205
aattggatccgaa

SEQ ID NO: 131691 - DNA, 13 bp, Unknown
  misc_feature (1)..( 13): Result.003 file - promoters60/3593205
tattcgatctttt

SEQ ID NO: 131692 - DNA, 11 bp, Unknown
  misc_feature (1)..( 11): Result.003 file - promoters60/3593230
attaataaagc

SEQ ID NO: 131693 - DNA, 11 bp, Unknown
  misc_feature (1)..( 11): Result.003 file - promoters60/3593230
gttaacaaaaa

SEQ ID NO: 131694 - DNA, 11 bp, Unknown
  misc_feature (1)..( 11): Result.003 file - promoters60/3593230
gtaaataaata

SEQ ID NO: 131695 - DNA, 11 bp, Unknown
  misc_feature (1)..( 11): Result.003 file - promoters60/3593230
ttacacaaatt

SEQ ID NO: 131696 - DNA, 11 bp, Unknown
  misc_feature (1)..( 11): Result.003 file - promoters60/3593230
gttatcaatta

SEQ ID NO: 131697 - DNA, 11 bp, Unknown
  misc_feature (1)..( 11): Result.003 file - promoters60/3593230
aatatcaatac

SEQ ID NO: 131698 - DNA, 11 bp, Unknown
  misc_feature (1)..( 11): Result.003 file - promoters60/3593230
cttgataaata

SEQ ID NO: 131699 - DNA, 6 bp, Unknown
  misc_feature (1)..( 6): Result.003 file - promoters60/3593243
attaaa

SEQ ID NO: 131700 - DNA, 6 bp, Unknown
  misc_feature (1)..( 6): Result.003 file - promoters60/3593243
attaaa

SEQ ID NO: 131701 - DNA, 10 bp, Unknown
  misc_feature (1)..( 10): Result.003 file - promoters60/3593243
aaagataaga

SEQ ID NO: 131702 - DNA, 10 bp, Unknown
  misc_feature (1)..( 10): Result.003 file - promoters60/3593243
aaacataatg

SEQ ID NO: 131703 - DNA, 10 bp, Unknown
  misc_feature (1)..( 10): Result.003 file - promoters60/3593243
cgtcattatg

SEQ ID NO: 131704 - DNA, 8 bp, Unknown
  misc_feature (1)..( 8): Result.003 file - promoters60/3593243
atatgttt

SEQ ID NO: 131705 - DNA, 8 bp, Unknown
  misc_feature (1)..( 8): Result.003 file - promoters60/3593243
atatcttt

SEQ ID NO: 131706 - DNA, 8 bp, Unknown
  misc_feature (1)..( 8): Result.003 file - promoters60/3593243
ttgtcttc

SEQ ID NO: 131707 - DNA, 8 bp, Unknown
  misc_feature (1)..( 8): Result.003 file - promoters60/3593243
ttgttttc

SEQ ID NO: 131708 - DNA, 8 bp, Unknown
  misc_feature (1)..( 8): Result.003 file - promoters60/3593243
ttgttttt

SEQ ID NO: 131709 - DNA, 6 bp, Unknown
  misc_feature (1)..( 6): Result.003 file - promoters60/3593243
cttcaa

SEQ ID NO: 131710 - DNA, 6 bp, Unknown
  misc_feature (1)..( 6): Result.003 file - promoters60/3593243
cttcaa

SEQ ID NO: 131711 - DNA, 6 bp, Unknown
  misc_feature (1)..( 6): Result.003 file - promoters60/3593243
cattta

SEQ ID NO: 131712 - DNA, 6 bp, Unknown
  misc_feature (1)..( 6): Result.003 file - promoters60/3593243
cattta

SEQ ID NO: 131713 - DNA, 6 bp, Unknown
  misc_feature (1)..( 6): Result.003 file - promoters60/3593243
caaaaa

SEQ ID NO: 131714 - DNA, 6 bp, Unknown
  misc_feature (1)..( 6): Result.003 file - promoters60/3593243
caaaaa

SEQ ID NO: 131715 - DNA, 6 bp, Unknown
  misc_feature (1)..( 6): Result.003 file - promoters60/3593243
aaatgc

SEQ ID NO: 131716 - DNA, 6 bp, Unknown
  misc_feature (1)..( 6): Result.003 file - promoters60/3593243
aaatgc

SEQ ID NO: 131717 - DNA, 9 bp, Unknown
  misc_feature (1)..( 9): Result.003 file - promoters60/3593243
taacacatg

SEQ ID NO: 131718 - DNA, 9 bp, Unknown
  misc_feature (1)..( 9): Result.003 file - promoters60/3593243
taatacata

SEQ ID NO: 131719 - DNA, 9 bp, Unknown
  misc_feature (1)..( 9): Result.003 file - promoters60/3593243
acatatata

SEQ ID NO: 131720 - DNA, 7 bp, Unknown
  misc_feature (1)..( 7): Result.003 file - promoters60/3593243
atactaa

SEQ ID NO: 131721 - DNA, 7 bp, Unknown
  misc_feature (1)..( 7): Result.003 file - promoters60/3593243
ataataa

SEQ ID NO: 131722 - DNA, 6 bp, Unknown
  misc_feature (1)..( 6): Result.003 file - promoters60/3593243
tttaag

SEQ ID NO: 131723 - DNA, 6 bp, Unknown
  misc_feature (1)..( 6): Result.003 file - promoters60/3593243
tttaag

SEQ ID NO: 131724 - DNA, 9 bp, Unknown
  misc_feature (1)..( 9): Result.003 file - promoters60/3593243
agtcttaat

SEQ ID NO: 131725 - DNA, 9 bp, Unknown
  misc_feature (1)..( 9): Result.003 file - promoters60/3593243
agtattaat

SEQ ID NO: 131726 - DNA, 9 bp, Unknown
  misc_feature (1)..( 9): Result.003 file - promoters60/3593243
agacaagtt

SEQ ID NO: 131727 - DNA, 9 bp, Unknown
  misc_feature (1)..( 9): Result.003 file - promoters60/3593243
agacaagtt

SEQ ID NO: 131728 - DNA, 7 bp, Unknown
  misc_feature (1)..( 7): Result.003 file - promoters60/3593243
ttacatg

SEQ ID NO: 131729 - DNA, 7 bp, Unknown
  misc_feature (1)..( 7): Result.003 file - promoters60/3593243
ttatatg

SEQ ID NO: 131730 - DNA, 7 bp, Unknown
  misc_feature (1)..( 7): Result.003 file - promoters60/3593243
tctctga

SEQ ID NO: 131731 - DNA, 7 bp, Unknown
  misc_feature (1)..( 7): Result.003 file - promoters60/3593243
tctctga

SEQ ID NO: 131732 - DNA, 9 bp, Unknown
  misc_feature (1)..( 9): Result.003 file - promoters60/3593243
aacacacat

SEQ ID NO: 131733 - DNA, 9 bp, Unknown
  misc_feature (1)..( 9): Result.003 file - promoters60/3593243
aacacacat

SEQ ID NO: 131734 - DNA, 6 bp, Unknown
  misc_feature (1)..( 6): Result.003 file - promoters60/3593243
atgtca

SEQ ID NO: 131735 - DNA, 6 bp, Unknown
  misc_feature (1)..( 6): Result.003 file - promoters60/3593243
atgtca

SEQ ID NO: 131736 - DNA, 9 bp, Unknown
  misc_feature (1)..( 9): Result.003 file - promoters60/3593243
gttaatctt

SEQ ID NO: 131737 - DNA, 9 bp, Unknown
  misc_feature (1)..( 9): Result.003 file - promoters60/3593243
gttaatctt

SEQ ID NO: 131738 - DNA, 7 bp, Unknown
  misc_feature (1)..( 7): Result.003 file - promoters60/3593243
aacttta

SEQ ID NO: 131739 - DNA, 7 bp, Unknown
  misc_feature (1)..( 7): Result.003 file - promoters60/3593243
aacatta

SEQ ID NO: 131740 - DNA, 6 bp, Unknown
  misc_feature (1)..( 6): Result.003 file - promoters60/3593243
aagaaa

SEQ ID NO: 131741 - DNA, 6 bp, Unknown
  misc_feature (1)..( 6): Result.003 file - promoters60/3593243
aagaaa

SEQ ID NO: 131742 - DNA, 6 bp, Unknown
  misc_feature (1)..( 6): Result.003 file - promoters60/3593243
cttctt

SEQ ID NO: 131743 - DNA, 6 bp, Unknown
  misc_feature (1)..( 6): Result.003 file - promoters60/3593243
cttctt

SEQ ID NO: 131744 - DNA, 6 bp, Unknown
  misc_feature (1)..( 6): Result.003 file - promoters60/3593243
tataaa

SEQ ID NO: 131745 - DNA, 6 bp, Unknown
  misc_feature (1)..( 6): Result.003 file - promoters60/3593243
tataaa

SEQ ID NO: 131746 - DNA, 7 bp, Unknown
  misc_feature (1)..( 7): Result.003 file - promoters60/3593264
gtttttg

SEQ ID NO: 131747 - DNA, 7 bp, Unknown
  misc_feature (1)..( 7): Result.003 file - promoters60/3593264
ttttttg

SEQ ID NO: 131748 - DNA, 7 bp, Unknown
  misc_feature (1)..( 7): Result.003 file - promoters60/3593264
gttcttg

SEQ ID NO: 131749 - DNA, 10 bp, Unknown
  misc_feature (1)..( 10): Result.003 file - promoters60/3593264
ttagattttt

SEQ ID NO: 131750 - DNA, 10 bp, Unknown
  misc_feature (1)..( 10): Result.003 file - promoters60/3593264
ttaaattaat

SEQ ID NO: 131751 - DNA, 10 bp, Unknown
  misc_feature (1)..( 10): Result.003 file - promoters60/3593264
caaaactaat

SEQ ID NO: 131752 - DNA, 10 bp, Unknown
  misc_feature (1)..( 10): Result.003 file - promoters60/3593264
aaaaaaattc

SEQ ID NO: 131753 - DNA, 10 bp, Unknown
  misc_feature (1)..( 10): Result.003 file - promoters60/3593264
acaaaacttc

SEQ ID NO: 131754 - DNA, 10 bp, Unknown
  misc_feature (1)..( 10): Result.003 file - promoters60/3593264
aaaaaacttc

SEQ ID NO: 131755 - DNA, 10 bp, Unknown
  misc_feature (1)..( 10): Result.003 file - promoters60/3593264
gcaaacattt

SEQ ID NO: 131756 - DNA, 8 bp, Unknown
  misc_feature (1)..( 8): Result.003 file - promoters60/3593264
cattttac

SEQ ID NO: 131757 - DNA, 8 bp, Unknown
  misc_feature (1)..( 8): Result.003 file - promoters60/3593264
acttttac

SEQ ID NO: 131758 - DNA, 8 bp, Unknown
  misc_feature (1)..( 8): Result.003 file - promoters60/3593264
catattaa

SEQ ID NO: 131759 - DNA, 13 bp, Unknown
  misc_feature (1)..( 13): Result.003 file - promoters60/3593264
aaacaaaaaaaaa

SEQ ID NO: 131760 - DNA, 13 bp, Unknown
  misc_feature (1)..( 13): Result.003 file - promoters60/3593264
taggaaaaaaaaa

SEQ ID NO: 131761 - DNA, 13 bp, Unknown
  misc_feature (1)..( 13): Result.003 file - promoters60/3593264
aaacaagaaaaac

SEQ ID NO: 131762 - DNA, 13 bp, Unknown
  misc_feature (1)..( 13): Result.003 file - promoters60/3593264
aatatataaaaat

SEQ ID NO: 131763 - DNA, 10 bp, Unknown
  misc_feature (1)..( 10): Result.003 file - promoters60/3593264
actcaaaaaa

SEQ ID NO: 131764 - DNA, 10 bp, Unknown
  misc_feature (1)..( 10): Result.003 file - promoters60/3593264
tagcaaaaaa

SEQ ID NO: 131765 - DNA, 10 bp, Unknown
  misc_feature (1)..( 10): Result.003 file - promoters60/3593264
tctcaaaaat

SEQ ID NO: 131766 - DNA, 10 bp, Unknown
  misc_feature (1)..( 10): Result.003 file - promoters60/3593264
tctgaaaaat

SEQ ID NO: 131767 - DNA, 12 bp, Unknown
  misc_feature (1)..( 12): Result.003 file - promoters60/3593264
ttgaattactca

SEQ ID NO: 131768 - DNA, 12 bp, Unknown
  misc_feature (1)..( 12): Result.003 file - promoters60/3593264
caaaatttctca

SEQ ID NO: 131769 - DNA, 12 bp, Unknown
  misc_feature (1)..( 12): Result.003 file - promoters60/3593264
caaaacttctct

SEQ ID NO: 131770 - DNA, 12 bp, Unknown
  misc_feature (1)..( 12): Result.003 file - promoters60/3593264
tttgaataataa

SEQ ID NO: 131771 - DNA, 12 bp, Unknown
  misc_feature (1)..( 12): Result.003 file - promoters60/3593264
tctgaaaaattc

SEQ ID NO: 131772 - DNA, 12 bp, Unknown
  misc_feature (1)..( 12): Result.003 file - promoters60/3593264
tctcaaaaataa

SEQ ID NO: 131773 - DNA, 12 bp, Unknown
  misc_feature (1)..( 12): Result.003 file - promoters60/3593264
gcaaaaaacttc

SEQ ID NO: 131774 - DNA, 15 bp, Unknown
  misc_feature (1)..( 15): Result.003 file - promoters60/3593264
ataataaaatttgaa

SEQ ID NO: 131775 - DNA, 15 bp, Unknown
  misc_feature (1)..( 15): Result.003 file - promoters60/3593264
gcaagaaaatctgaa

SEQ ID NO: 131776 - DNA, 15 bp, Unknown
  misc_feature (1)..( 15): Result.003 file - promoters60/3593264
tctcaaaaataaaag

SEQ ID NO: 131777 - DNA, 8 bp, Unknown
  misc_feature (1)..( 8): Result.003 file - promoters60/3593264
ctctattt

SEQ ID NO: 131778 - DNA, 8 bp, Unknown
  misc_feature (1)..( 8): Result.003 file - promoters60/3593264
ttctcttt

SEQ ID NO: 131779 - DNA, 8 bp, Unknown
  misc_feature (1)..( 8): Result.003 file - promoters60/3593264
ctcaattg

SEQ ID NO: 131780 - DNA, 8 bp, Unknown
  misc_feature (1)..( 8): Result.003 file - promoters60/3593264
tatataac

SEQ ID NO: 131781 - DNA, 8 bp, Unknown
  misc_feature (1)..( 8): Result.003 file - promoters60/3593264
tatataaa

SEQ ID NO: 131782 - DNA, 8 bp, Unknown
  misc_feature (1)..( 8): Result.003 file - promoters60/3593264
actataaa

SEQ ID NO: 131783 - DNA, 9 bp, Unknown
  misc_feature (1)..( 9): Result.003 file - promoters60/3593264
gttttgttt

SEQ ID NO: 131784 - DNA, 9 bp, Unknown
  misc_feature (1)..( 9): Result.003 file - promoters60/3593264
gtttggtta

SEQ ID NO: 131785 - DNA, 9 bp, Unknown
  misc_feature (1)..( 9): Result.003 file - promoters60/3593264
ttttgatta

SEQ ID NO: 131786 - DNA, 8 bp, Unknown
  misc_feature (1)..( 8): Result.003 file - promoters60/3593290
tatcagtt

SEQ ID NO: 131787 - DNA, 8 bp, Unknown
  misc_feature (1)..( 8): Result.003 file - promoters60/3593290
tatgagtt

SEQ ID NO: 131788 - DNA, 6 bp, Unknown
  misc_feature (1)..( 6): Result.003 file - promoters60/3593290
tttaga

SEQ ID NO: 131789 - DNA, 6 bp, Unknown
  misc_feature (1)..( 6): Result.003 file - promoters60/3593290
tttaga

SEQ ID NO: 131790 - DNA, 6 bp, Unknown
  misc_feature (1)..( 6): Result.003 file - promoters60/3593290
taactt

SEQ ID NO: 131791 - DNA, 6 bp, Unknown
  misc_feature (1)..( 6): Result.003 file - promoters60/3593290
taactt

SEQ ID NO: 131792 - DNA, 10 bp, Unknown
  misc_feature (1)..( 10): Result.003 file - promoters60/3593290
atatgttaga

SEQ ID NO: 131793 - DNA, 10 bp, Unknown
  misc_feature (1)..( 10): Result.003 file - promoters60/3593290
atatgtgaga

SEQ ID NO: 131794 - DNA, 8 bp, Unknown
  misc_feature (1)..( 8): Result.003 file - promoters60/3593290
tttttgtc

SEQ ID NO: 131795 - DNA, 8 bp, Unknown
  misc_feature (1)..( 8): Result.003 file - promoters60/3593290
tttttgtc

SEQ ID NO: 131796 - DNA, 6 bp, Unknown
  misc_feature (1)..( 6): Result.003 file - promoters60/3593290
tctttt

SEQ ID NO: 131797 - DNA, 6 bp, Unknown
  misc_feature (1)..( 6): Result.003 file - promoters60/3593290
tctttt

SEQ ID NO: 131798 - DNA, 6 bp, Unknown
  misc_feature (1)..( 6): Result.003 file - promoters60/3593290
tttctt

SEQ ID NO: 131799 - DNA, 6 bp, Unknown
  misc_feature (1)..( 6): Result.003 file - promoters60/3593290
tttctt

SEQ ID NO: 131800 - DNA, 7 bp, Unknown
  misc_feature (1)..( 7): Result.003 file - promoters60/3593290
tttattt

SEQ ID NO: 131801 - DNA, 7 bp, Unknown
  misc_feature (1)..( 7): Result.003 file - promoters60/3593290
tttgttt

SEQ ID NO: 131802 - DNA, 7 bp, Unknown
  misc_feature (1)..( 7): Result.003 file - promoters60/3593290
ctcggaa

SEQ ID NO: 131803 - DNA, 7 bp, Unknown
  misc_feature (1)..( 7): Result.003 file - promoters60/3593290
ctcagaa

SEQ ID NO: 131804 - DNA, 10 bp, Unknown
  misc_feature (1)..( 10): Result.003 file - promoters60/3593290
gctcgttgtg

SEQ ID NO: 131805 - DNA, 10 bp, Unknown
  misc_feature (1)..( 10): Result.003 file - promoters60/3593290
gattgttgtg

SEQ ID NO: 131806 - DNA, 10 bp, Unknown
  misc_feature (1)..( 10): Result.003 file - promoters60/3593290
gattgatgta

SEQ ID NO: 131807 - DNA, 9 bp, Unknown
  misc_feature (1)..( 9): Result.003 file - promoters60/3593290
gatcaggaa

SEQ ID NO: 131808 - DNA, 9 bp, Unknown
  misc_feature (1)..( 9): Result.003 file - promoters60/3593290
gatctggaa

SEQ ID NO: 131809 - DNA, 8 bp, Unknown
  misc_feature (1)..( 8): Result.003 file - promoters60/3593290
atttggac

SEQ ID NO: 131810 - DNA, 8 bp, Unknown
  misc_feature (1)..( 8): Result.003 file - promoters60/3593290
attttgac

SEQ ID NO: 131811 - DNA, 8 bp, Unknown
  misc_feature (1)..( 8): Result.003 file - promoters60/3593290
ctttagac

SEQ ID NO: 131812 - DNA, 8 bp, Unknown
  misc_feature (1)..( 8): Result.003 file - promoters60/3593290
ctttcgac

SEQ ID NO: 131813 - DNA, 7 bp, Unknown
  misc_feature (1)..( 7): Result.003 file - promoters60/3593290
gaaactt

SEQ ID NO: 131814 - DNA, 7 bp, Unknown
  misc_feature (1)..( 7): Result.003 file - promoters60/3593290
gaagctt

SEQ ID NO: 131815 - DNA, 7 bp, Unknown
  misc_feature (1)..( 7): Result.003 file - promoters60/3593290
tcatctg

SEQ ID NO: 131816 - DNA, 7 bp, Unknown
  misc_feature (1)..( 7): Result.003 file - promoters60/3593290
tcatctg

SEQ ID NO: 131817 - DNA, 7 bp, Unknown
  misc_feature (1)..( 7): Result.003 file - promoters60/3593290
ctttttg

SEQ ID NO: 131818 - DNA, 7 bp, Unknown
  misc_feature (1)..( 7): Result.003 file - promoters60/3593290
ctttttg

SEQ ID NO: 131819 - DNA, 9 bp, Unknown
  misc_feature (1)..( 9): Result.003 file - promoters60/3593340
tttaaagaa

SEQ ID NO: 131820 - DNA, 9 bp, Unknown
  misc_feature (1)..( 9): Result.003 file - promoters60/3593340
gttaaggaa

SEQ ID NO: 131821 - DNA, 9 bp, Unknown
  misc_feature (1)..( 9): Result.003 file - promoters60/3593340
tttgaagat

SEQ ID NO: 131822 - DNA, 12 bp, Unknown
  misc_feature (1)..( 12): Result.003 file - promoters60/3593340
aaaaatggtaat

SEQ ID NO: 131823 - DNA, 12 bp, Unknown
  misc_feature (1)..( 12): Result.003 file - promoters60/3593340
ctaaatgctaat

SEQ ID NO: 131824 - DNA, 12 bp, Unknown
  misc_feature (1)..( 12): Result.003 file - promoters60/3593340
aaaaaagatgta

SEQ ID NO: 131825 - DNA, 12 bp, Unknown
  misc_feature (1)..( 12): Result.003 file - promoters60/3593340
tgaaagggtata

SEQ ID NO: 131826 - DNA, 11 bp, Unknown
  misc_feature (1)..( 11): Result.003 file - promoters60/3593340
aaggcaaaaga

SEQ ID NO: 131827 - DNA, 11 bp, Unknown
  misc_feature (1)..( 11): Result.003 file - promoters60/3593340
tctgcagaaga

SEQ ID NO: 131828 - DNA, 11 bp, Unknown
  misc_feature (1)..( 11): Result.003 file - promoters60/3593340
aagacaaaact

SEQ ID NO: 131829 - DNA, 7 bp, Unknown
  misc_feature (1)..( 7): Result.003 file - promoters60/3593340
ataattt

SEQ ID NO: 131830 - DNA, 7 bp, Unknown
  misc_feature (1)..( 7): Result.003 file - promoters60/3593340
ttaattt

SEQ ID NO: 131831 - DNA, 7 bp, Unknown
  misc_feature (1)..( 7): Result.003 file - promoters60/3593340
ttaattg

SEQ ID NO: 131832 - DNA, 7 bp, Unknown
  misc_feature (1)..( 7): Result.003 file - promoters60/3593340
tttattg

SEQ ID NO: 131833 - DNA, 7 bp, Unknown
  misc_feature (1)..( 7): Result.003 file - promoters60/3593340
tttatta

SEQ ID NO: 131834 - DNA, 7 bp, Unknown
  misc_feature (1)..( 7): Result.003 file - promoters60/3593340
tttgtta

SEQ ID NO: 131835 - DNA, 9 bp, Unknown
  misc_feature (1)..( 9): Result.003 file - promoters60/3593340
tttttataa

SEQ ID NO: 131836 - DNA, 9 bp, Unknown
  misc_feature (1)..( 9): Result.003 file - promoters60/3593340
ttttaataa

SEQ ID NO: 131837 - DNA, 9 bp, Unknown
  misc_feature (1)..( 9): Result.003 file - promoters60/3593340
ttttaaagg

SEQ ID NO: 131838 - DNA, 11 bp, Unknown
  misc_feature (1)..( 11): Result.003 file - promoters60/3593340
gtaaataatag

SEQ ID NO: 131839 - DNA, 11 bp, Unknown
  misc_feature (1)..( 11): Result.003 file - promoters60/3593340
gtaaaaaatat

SEQ ID NO: 131840 - DNA, 11 bp, Unknown
  misc_feature (1)..( 11): Result.003 file - promoters60/3593340
tgaaaatatat

SEQ ID NO: 131841 - DNA, 8 bp, Unknown
  misc_feature (1)..( 8): Result.003 file - promoters60/3593346
aaaataat

SEQ ID NO: 131842 - DNA, 6 bp, Unknown
  misc_feature (1)..( 6): Result.003 file - promoters60/3593346
aataat

SEQ ID NO: 131843 - DNA, 8 bp, Unknown
  misc_feature (1)..( 8): Result.003 file - promoters60/3593346
aaaacaat

SEQ ID NO: 131844 - DNA, 7 bp, Unknown
  misc_feature (1)..( 7): Result.003 file - promoters60/3593346
aaacaaa

SEQ ID NO: 131845 - DNA, 7 bp, Unknown
  misc_feature (1)..( 7): Result.003 file - promoters60/3593346
aaacaat

SEQ ID NO: 131846 - DNA, 7 bp, Unknown
  misc_feature (1)..( 7): Result.003 file - promoters60/3593346
aaagaaa

SEQ ID NO: 131847 - DNA, 8 bp, Unknown
  misc_feature (1)..( 8): Result.003 file - promoters60/3593346
ctatcttt

SEQ ID NO: 131848 - DNA, 8 bp, Unknown
  misc_feature (1)..( 8): Result.003 file - promoters60/3593346
aaatcttt

SEQ ID NO: 131849 - DNA, 8 bp, Unknown
  misc_feature (1)..( 8): Result.003 file - promoters60/3593346
aaagctta

SEQ ID NO: 131850 - DNA, 9 bp, Unknown
  misc_feature (1)..( 9): Result.003 file - promoters60/3594312
ccctcaaaa

SEQ ID NO: 131851 - DNA, 9 bp, Unknown
  misc_feature (1)..( 9): Result.003 file - promoters60/3594312
ctttcaaaa

SEQ ID NO: 131852 - DNA, 9 bp, Unknown
  misc_feature (1)..( 9): Result.003 file - promoters60/3594312
tttttaaaa

SEQ ID NO: 131853 - DNA, 10 bp, Unknown
  misc_feature (1)..( 10): Result.003 file - promoters60/3594312
gttttagaaa

SEQ ID NO: 131854 - DNA, 10 bp, Unknown
  misc_feature (1)..( 10): Result.003 file - promoters60/3594312
tttttattaa

SEQ ID NO: 131855 - DNA, 10 bp, Unknown
  misc_feature (1)..( 10): Result.003 file - promoters60/3594312
cctttgattc

SEQ ID NO: 131856 - DNA, 10 bp, Unknown
  misc_feature (1)..( 10): Result.003 file - promoters60/3594312
cacataaaca

SEQ ID NO: 131857 - DNA, 10 bp, Unknown
  misc_feature (1)..( 10): Result.003 file - promoters60/3594312
ttcataaatc

SEQ ID NO: 131858 - DNA, 10 bp, Unknown
  misc_feature (1)..( 10): Result.003 file - promoters60/3594312
aaaatataca

SEQ ID NO: 131859 - DNA, 10 bp, Unknown
  misc_feature (1)..( 10): Result.003 file - promoters60/3594312
tacataaaac

SEQ ID NO: 131860 - DNA, 10 bp, Unknown
  misc_feature (1)..( 10): Result.003 file - promoters60/3594312
gccattaatg

SEQ ID NO: 131861 - DNA, 10 bp, Unknown
  misc_feature (1)..( 10): Result.003 file - promoters60/3594312
tgaattaatt

SEQ ID NO: 131862 - DNA, 10 bp, Unknown
  misc_feature (1)..( 10): Result.003 file - promoters60/3594312
ttcttaaaag

SEQ ID NO: 131863 - DNA, 16 bp, Unknown
  misc_feature (1)..( 16): Result.003 file - promoters60/3594312
gattcggcccaaattt

SEQ ID NO: 131864 - DNA, 16 bp, Unknown
  misc_feature (1)..( 16): Result.003 file - promoters60/3594312
caaaaggcccaataaa

SEQ ID NO: 131865 - DNA, 16 bp, Unknown
  misc_feature (1)..( 16): Result.003 file - promoters60/3594312
ttgaaggcccataaat

SEQ ID NO: 131866 - DNA, 16 bp, Unknown
  misc_feature (1)..( 16): Result.003 file - promoters60/3594312
aaataggcccaacaaa

SEQ ID NO: 131867 - DNA, 16 bp, Unknown
  misc_feature (1)..( 16): Result.003 file - promoters60/3594312
aaatgggcctagcgaa

SEQ ID NO: 131868 - DNA, 16 bp, Unknown
  misc_feature (1)..( 16): Result.003 file - promoters60/3594312
ctcaaagcccaataaa

SEQ ID NO: 131869 - DNA, 9 bp, Unknown
  misc_feature (1)..( 9): Result.003 file - promoters60/3594312
attctttca

SEQ ID NO: 131870 - DNA, 9 bp, Unknown
  misc_feature (1)..( 9): Result.003 file - promoters60/3594312
attcttaaa

SEQ ID NO: 131871 - DNA, 9 bp, Unknown
  misc_feature (1)..( 9): Result.003 file - promoters60/3594312
atttttttt

SEQ ID NO: 131872 - DNA, 9 bp, Unknown
  misc_feature (1)..( 9): Result.003 file - promoters60/3594312
attcttgaa

SEQ ID NO: 131873 - DNA, 9 bp, Unknown
  misc_feature (1)..( 9): Result.003 file - promoters60/3594312
atttttgta

SEQ ID NO: 131874 - DNA, 9 bp, Unknown
  misc_feature (1)..( 9): Result.003 file - promoters60/3594312
cttcataaa

SEQ ID NO: 131875 - DNA, 16 bp, Unknown
  misc_feature (1)..( 16): Result.003 file - promoters60/3597145
ccgaatcgatagctga

SEQ ID NO: 131876 - DNA, 16 bp, Unknown
  misc_feature (1)..( 16): Result.003 file - promoters60/3597145
acaaatctataaatat

SEQ ID NO: 131877 - DNA, 16 bp, Unknown
  misc_feature (1)..( 16): Result.003 file - promoters60/3597145
gtaaatctttaattat

SEQ ID NO: 131878 - DNA, 16 bp, Unknown
  misc_feature (1)..( 16): Result.003 file - promoters60/3597145
tttgattgttatggtg

SEQ ID NO: 131879 - DNA, 16 bp, Unknown
  misc_feature (1)..( 16): Result.003 file - promoters60/3597145
aaaaatcttcgaatat

SEQ ID NO: 131880 - DNA, 16 bp, Unknown
  misc_feature (1)..( 16): Result.003 file - promoters60/3597145
tagtcactaaaaaggt

SEQ ID NO: 131881 - DNA, 6 bp, Unknown
  misc_feature (1)..( 6): Result.003 file - promoters60/3597158
aatact

SEQ ID NO: 131882 - DNA, 6 bp, Unknown
  misc_feature (1)..( 6): Result.003 file - promoters60/3597158
aatact

SEQ ID NO: 131883 - DNA, 7 bp, Unknown
  misc_feature (1)..( 7): Result.003 file - promoters60/3597158
tttgtaa

SEQ ID NO: 131884 - DNA, 7 bp, Unknown
  misc_feature (1)..( 7): Result.003 file - promoters60/3597158
tttgtaa

SEQ ID NO: 131885 - DNA, 7 bp, Unknown
  misc_feature (1)..( 7): Result.003 file - promoters60/3597158
aaagttg

SEQ ID NO: 131886 - DNA, 7 bp, Unknown
  misc_feature (1)..( 7): Result.003 file - promoters60/3597158
aaatttg

SEQ ID NO: 131887 - DNA, 6 bp, Unknown
  misc_feature (1)..( 6): Result.003 file - promoters60/3597158
attaaa

SEQ ID NO: 131888 - DNA, 6 bp, Unknown
  misc_feature (1)..( 6): Result.003 file - promoters60/3597158
attaaa

SEQ ID NO: 131889 - DNA, 8 bp, Unknown
  misc_feature (1)..( 8): Result.003 file - promoters60/3597158
gtttcctc

SEQ ID NO: 131890 - DNA, 8 bp, Unknown
  misc_feature (1)..( 8): Result.003 file - promoters60/3597158
gttttctc

SEQ ID NO: 131891 - DNA, 9 bp, Unknown
  misc_feature (1)..( 9): Result.003 file - promoters60/3597158
tcttcttct

SEQ ID NO: 131892 - DNA, 9 bp, Unknown
  misc_feature (1)..( 9): Result.003 file - promoters60/3597158
tctttttct

SEQ ID NO: 131893 - DNA, 8 bp, Unknown
  misc_feature (1)..( 8): Result.003 file - promoters60/3597158
tcacatca

SEQ ID NO: 131894 - DNA, 8 bp, Unknown
  misc_feature (1)..( 8): Result.003 file - promoters60/3597158
tcacatag

SEQ ID NO: 131895 - DNA, 8 bp, Unknown
  misc_feature (1)..( 8): Result.003 file - promoters60/3597158
acacttag

SEQ ID NO: 131896 - DNA, 9 bp, Unknown
  misc_feature (1)..( 9): Result.003 file - promoters60/3597158
aaagaaaaa

SEQ ID NO: 131897 - DNA, 9 bp, Unknown
  misc_feature (1)..( 9): Result.003 file - promoters60/3597158
aaagcaaaa

SEQ ID NO: 131898 - DNA, 7 bp, Unknown
  misc_feature (1)..( 7): Result.003 file - promoters60/3597158
aaaaatt

SEQ ID NO: 131899 - DNA, 7 bp, Unknown
  misc_feature (1)..( 7): Result.003 file - promoters60/3597158
aaacatt

SEQ ID NO: 131900 - DNA, 7 bp, Unknown
  misc_feature (1)..( 7): Result.003 file - promoters60/3597158
aaacaac

SEQ ID NO: 131901 - DNA, 7 bp, Unknown
  misc_feature (1)..( 7): Result.003 file - promoters60/3597158
aaacaac

SEQ ID NO: 131902 - DNA, 6 bp, Unknown
  misc_feature (1)..( 6): Result.003 file - promoters60/3597158
actctc

SEQ ID NO: 131903 - DNA, 6 bp, Unknown
  misc_feature (1)..( 6): Result.003 file - promoters60/3597158
actctc

SEQ ID NO: 131904 - DNA, 8 bp, Unknown
  misc_feature (1)..( 8): Result.003 file - promoters60/3597158
tgtcattt

SEQ ID NO: 131905 - DNA, 8 bp, Unknown
  misc_feature (1)..( 8): Result.003 file - promoters60/3597158
tgtcattt

SEQ ID NO: 131906 - DNA, 7 bp, Unknown
  misc_feature (1)..( 7): Result.003 file - promoters60/3597158
aattttc

SEQ ID NO: 131907 - DNA, 7 bp, Unknown
  misc_feature (1)..( 7): Result.003 file - promoters60/3597158
aatcttc

SEQ ID NO: 131908 - DNA, 6 bp, Unknown
  misc_feature (1)..( 6): Result.003 file - promoters60/3597158
ttggta

SEQ ID NO: 131909 - DNA, 6 bp, Unknown
  misc_feature (1)..( 6): Result.003 file - promoters60/3597158
ttggta

SEQ ID NO: 131910 - DNA, 6 bp, Unknown
  misc_feature (1)..( 6): Result.003 file - promoters60/3597158
aaccaa

SEQ ID NO: 131911 - DNA, 6 bp, Unknown
  misc_feature (1)..( 6): Result.003 file - promoters60/3597158
aaccaa

SEQ ID NO: 131912 - DNA, 9 bp, Unknown
  misc_feature (1)..( 9): Result.003 file - promoters60/3597158
tttcaaaag

SEQ ID NO: 131913 - DNA, 9 bp, Unknown
  misc_feature (1)..( 9): Result.003 file - promoters60/3597158
tttccaaag

SEQ ID NO: 131914 - DNA, 6 bp, Unknown
  misc_feature (1)..( 6): Result.003 file - promoters60/3597158
aagaaa

SEQ ID NO: 131915 - DNA, 6 bp, Unknown
  misc_feature (1)..( 6): Result.003 file - promoters60/3597158
aagaaa

SEQ ID NO: 131916 - DNA, 6 bp, Unknown
  misc_feature (1)..( 6): Result.003 file - promoters60/3597158
tagtta

SEQ ID NO: 131917 - DNA, 6 bp, Unknown
  misc_feature (1)..( 6): Result.003 file - promoters60/3597158
tagtta

SEQ ID NO: 131918 - DNA, 8 bp, Unknown
  misc_feature (1)..( 8): Result.003 file - promoters60/3597158
agtttcac

SEQ ID NO: 131919 - DNA, 8 bp, Unknown
  misc_feature (1)..( 8): Result.003 file - promoters60/3597158
agttccac

SEQ ID NO: 131920 - DNA, 7 bp, Unknown
  misc_feature (1)..( 7): Result.003 file - promoters60/3597158
atcccat

SEQ ID NO: 131921 - DNA, 7 bp, Unknown
  misc_feature (1)..( 7): Result.003 file - promoters60/3597158
atcacat

SEQ ID NO: 131922 - DNA, 6 bp, Unknown
  misc_feature (1)..( 6): Result.003 file - promoters60/3597158
aaacat

SEQ ID NO: 131923 - DNA, 6 bp, Unknown
  misc_feature (1)..( 6): Result.003 file - promoters60/3597158
aaacat

SEQ ID NO: 131924 - DNA, 7 bp, Unknown
  misc_feature (1)..( 7): Result.003 file - promoters60/3597158
ttctctc

SEQ ID NO: 131925 - DNA, 7 bp, Unknown
  misc_feature (1)..( 7): Result.003 file - promoters60/3597158
ttctctc

SEQ ID NO: 131926 - DNA, 9 bp, Unknown
  misc_feature (1)..( 9): Result.003 file - promoters60/3597162
ctcatttta

SEQ ID NO: 131927 - DNA, 9 bp, Unknown
  misc_feature (1)..( 9): Result.003 file - promoters60/3597162
ttcaattta

SEQ ID NO: 131928 - DNA, 9 bp, Unknown
  misc_feature (1)..( 9): Result.003 file - promoters60/3597162
ttcaataga

SEQ ID NO: 131929 - DNA, 6 bp, Unknown
  misc_feature (1)..( 6): Result.003 file - promoters60/3597162
atcaac

SEQ ID NO: 131930 - DNA, 6 bp, Unknown
  misc_feature (1)..( 6): Result.003 file - promoters60/3597162
atcaac

SEQ ID NO: 131931 - DNA, 7 bp, Unknown
  misc_feature (1)..( 7): Result.003 file - promoters60/3597162
tgacttg

SEQ ID NO: 131932 - DNA, 7 bp, Unknown
  misc_feature (1)..( 7): Result.003 file - promoters60/3597162
tgaattg

SEQ ID NO: 131933 - DNA, 7 bp, Unknown
  misc_feature (1)..( 7): Result.003 file - promoters60/3597162
tgacttt

SEQ ID NO: 131934 - DNA, 8 bp, Unknown
  misc_feature (1)..( 8): Result.003 file - promoters60/3597162
agataaaa

SEQ ID NO: 131935 - DNA, 8 bp, Unknown
  misc_feature (1)..( 8): Result.003 file - promoters60/3597162
agataaat

SEQ ID NO: 131936 - DNA, 8 bp, Unknown
  misc_feature (1)..( 8): Result.003 file - promoters60/3597162
agaaaaaa

SEQ ID NO: 131937 - DNA, 7 bp, Unknown
  misc_feature (1)..( 7): Result.003 file - promoters60/3597162
acaattt

SEQ ID NO: 131938 - DNA, 7 bp, Unknown
  misc_feature (1)..( 7): Result.003 file - promoters60/3597162
acaattt

SEQ ID NO: 131939 - DNA, 8 bp, Unknown
  misc_feature (1)..( 8): Result.003 file - promoters60/3597162
agaaaatt

SEQ ID NO: 131940 - DNA, 8 bp, Unknown
  misc_feature (1)..( 8): Result.003 file - promoters60/3597162
agaaaatt

SEQ ID NO: 131941 - DNA, 6 bp, Unknown
  misc_feature (1)..( 6): Result.003 file - promoters60/3597162
ttggtt

SEQ ID NO: 131942 - DNA, 6 bp, Unknown
  misc_feature (1)..( 6): Result.003 file - promoters60/3597162
ttggtt

SEQ ID NO: 131943 - DNA, 6 bp, Unknown
  misc_feature (1)..( 6): Result.003 file - promoters60/3597162
aacttt

SEQ ID NO: 131944 - DNA, 6 bp, Unknown
  misc_feature (1)..( 6): Result.003 file - promoters60/3597162
aacttt

SEQ ID NO: 131945 - DNA, 6 bp, Unknown
  misc_feature (1)..( 6): Result.003 file - promoters60/3597162
aattga

SEQ ID NO: 131946 - DNA, 6 bp, Unknown
  misc_feature (1)..( 6): Result.003 file - promoters60/3597162
aattga

SEQ ID NO: 131947 - DNA, 7 bp, Unknown
  misc_feature (1)..( 7): Result.003 file - promoters60/3597162
aattgat

SEQ ID NO: 131948 - DNA, 7 bp, Unknown
  misc_feature (1)..( 7): Result.003 file - promoters60/3597162
aatagat

SEQ ID NO: 131949 - DNA, 7 bp, Unknown
  misc_feature (1)..( 7): Result.003 file - promoters60/3597162
aatagaa

SEQ ID NO: 131950 - DNA, 6 bp, Unknown
  misc_feature (1)..( 6): Result.003 file - promoters60/3597162
taccat

SEQ ID NO: 131951 - DNA, 6 bp, Unknown
  misc_feature (1)..( 6): Result.003 file - promoters60/3597162
taccat

SEQ ID NO: 131952 - DNA, 7 bp, Unknown
  misc_feature (1)..( 7): Result.003 file - promoters60/3597162
ataatat

SEQ ID NO: 131953 - DNA, 7 bp, Unknown
  misc_feature (1)..( 7): Result.003 file - promoters60/3597162
atagtat

SEQ ID NO: 131954 - DNA, 13 bp, Unknown
  misc_feature (1)..( 13): Result.003 file - promoters60/3597162
taaatagaaaacg

SEQ ID NO: 131955 - DNA, 13 bp, Unknown
  misc_feature (1)..( 13): Result.003 file - promoters60/3597162
tctatataaatcc

SEQ ID NO: 131956 - DNA, 13 bp, Unknown
  misc_feature (1)..( 13): Result.003 file - promoters60/3597162
tctatatatatcc

SEQ ID NO: 131957 - DNA, 7 bp, Unknown
  misc_feature (1)..( 7): Result.003 file - promoters60/3597162
ttagaat

SEQ ID NO: 131958 - DNA, 7 bp, Unknown
  misc_feature (1)..( 7): Result.003 file - promoters60/3597162
ttaaaat

SEQ ID NO: 131959 - DNA, 6 bp, Unknown
  misc_feature (1)..( 6): Result.003 file - promoters60/3597162
attcaa

SEQ ID NO: 131960 - DNA, 6 bp, Unknown
  misc_feature (1)..( 6): Result.003 file - promoters60/3597162
attcaa

SEQ ID NO: 131961 - DNA, 9 bp, Unknown
  misc_feature (1)..( 9): Result.003 file - promoters60/3597162
ttttttttt

SEQ ID NO: 131962 - DNA, 9 bp, Unknown
  misc_feature (1)..( 9): Result.003 file - promoters60/3597162
ttttatttt

SEQ ID NO: 131963 - DNA, 7 bp, Unknown
  misc_feature (1)..( 7): Result.003 file - promoters60/3597162
tcttata

SEQ ID NO: 131964 - DNA, 7 bp, Unknown
  misc_feature (1)..( 7): Result.003 file - promoters60/3597162
tctcata

SEQ ID NO: 131965 - DNA, 6 bp, Unknown
  misc_feature (1)..( 6): Result.003 file - promoters60/3597162
aattta

SEQ ID NO: 131966 - DNA, 6 bp, Unknown
  misc_feature (1)..( 6): Result.003 file - promoters60/3597162
aattta

SEQ ID NO: 131967 - DNA, 9 bp, Unknown
  misc_feature (1)..( 9): Result.003 file - promoters60/3597162
taaacttaa

SEQ ID NO: 131968 - DNA, 9 bp, Unknown
  misc_feature (1)..( 9): Result.003 file - promoters60/3597162
taaacttaa

SEQ ID NO: 131969 - DNA, 7 bp, Unknown
  misc_feature (1)..( 7): Result.003 file - promoters60/3597162
actctca

SEQ ID NO: 131970 - DNA, 7 bp, Unknown
  misc_feature (1)..( 7): Result.003 file - promoters60/3597162
actttca

SEQ ID NO: 131971 - DNA, 8 bp, Unknown
  misc_feature (1)..( 8): Result.003 file - promoters60/3597175
tttattca

SEQ ID NO: 131972 - DNA, 8 bp, Unknown
  misc_feature (1)..( 8): Result.003 file - promoters60/3597175
tttattct

SEQ ID NO: 131973 - DNA, 8 bp, Unknown
  misc_feature (1)..( 8): Result.003 file - promoters60/3597175
tttatttc

SEQ ID NO: 131974 - DNA, 8 bp, Unknown
  misc_feature (1)..( 8): Result.003 file - promoters60/3597175
tttcttct

SEQ ID NO: 131975 - DNA, 8 bp, Unknown
  misc_feature (1)..( 8): Result.003 file - promoters60/3597175
tttattta

SEQ ID NO: 131976 - DNA, 13 bp, Unknown
  misc_feature (1)..( 13): Result.003 file - promoters60/3597175
tttcatttattta

SEQ ID NO: 131977 - DNA, 13 bp, Unknown
  misc_feature (1)..( 13): Result.003 file - promoters60/3597175
attcttttccatc

SEQ ID NO: 131978 - DNA, 13 bp, Unknown
  misc_feature (1)..( 13): Result.003 file - promoters60/3597175
ttttattataaag

SEQ ID NO: 131979 - DNA, 13 bp, Unknown
  misc_feature (1)..( 13): Result.003 file - promoters60/3597175
cattattttttac

SEQ ID NO: 131980 - DNA, 13 bp, Unknown
  misc_feature (1)..( 13): Result.003 file - promoters60/3597175
ttaaatttaaaaa

SEQ ID NO: 131981 - DNA, 13 bp, Unknown
  misc_feature (1)..( 13): Result.003 file - promoters60/3597175
tttttgttagaaa

SEQ ID NO: 131982 - DNA, 10 bp, Unknown
  misc_feature (1)..( 10): Result.003 file - promoters60/3597175
agaattaaaa

SEQ ID NO: 131983 - DNA, 10 bp, Unknown
  misc_feature (1)..( 10): Result.003 file - promoters60/3597175
ctaattaacc

SEQ ID NO: 131984 - DNA, 10 bp, Unknown
  misc_feature (1)..( 10): Result.003 file - promoters60/3597175
ttaattaaaa

SEQ ID NO: 131985 - DNA, 10 bp, Unknown
  misc_feature (1)..( 10): Result.003 file - promoters60/3597175
tgaattacca

SEQ ID NO: 131986 - DNA, 10 bp, Unknown
  misc_feature (1)..( 10): Result.003 file - promoters60/3597175
ctaattactg

SEQ ID NO: 131987 - DNA, 16 bp, Unknown
  misc_feature (1)..( 16): Result.003 file - promoters60/3597175
tttaactttattcttc

SEQ ID NO: 131988 - DNA, 16 bp, Unknown
  misc_feature (1)..( 16): Result.003 file - promoters60/3597175
aaaaactttttacggc

SEQ ID NO: 131989 - DNA, 16 bp, Unknown
  misc_feature (1)..( 16): Result.003 file - promoters60/3597175
catgactttcttcttc

SEQ ID NO: 131990 - DNA, 16 bp, Unknown
  misc_feature (1)..( 16): Result.003 file - promoters60/3597175
ttcatttttattctat

SEQ ID NO: 131991 - DNA, 16 bp, Unknown
  misc_feature (1)..( 16): Result.003 file - promoters60/3597175
aaaaagtttttatttc

SEQ ID NO: 131992 - DNA, 15 bp, Unknown
  misc_feature (1)..( 15): Result.003 file - promoters60/3597175
gtctcctataataaa

SEQ ID NO: 131993 - DNA, 15 bp, Unknown
  misc_feature (1)..( 15): Result.003 file - promoters60/3597175
gtagcctttaaaaaa

SEQ ID NO: 131994 - DNA, 15 bp, Unknown
  misc_feature (1)..( 15): Result.003 file - promoters60/3597175
acaaaatataaataa

SEQ ID NO: 131995 - DNA, 15 bp, Unknown
  misc_feature (1)..( 15): Result.003 file - promoters60/3597175
tcttctcatatataa

SEQ ID NO: 131996 - DNA, 15 bp, Unknown
  misc_feature (1)..( 15): Result.003 file - promoters60/3597175
gtctcttatatattc

SEQ ID NO: 131997 - DNA, 15 bp, Unknown
  misc_feature (1)..( 15): Result.003 file - promoters60/3597175
cacctatattctttt

SEQ ID NO: 131998 - DNA, 15 bp, Unknown
  misc_feature (1)..( 15): Result.003 file - promoters60/3597175
tctatagtttcattt

SEQ ID NO: 131999 - DNA, 15 bp, Unknown
  misc_feature (1)..( 15): Result.003 file - promoters60/3597175
actgatttttcatta

SEQ ID NO: 132000 - DNA, 15 bp, Unknown
  misc_feature (1)..( 15): Result.003 file - promoters60/3597175
aaaaagtttttattt

SEQ ID NO: 132001 - DNA, 15 bp, Unknown
  misc_feature (1)..( 15): Result.003 file - promoters60/3597175
aaaaactttttacgg

SEQ ID NO: 132002 - DNA, 17 bp, Unknown
  misc_feature (1)..( 17): Result.003 file - promoters60/3597175
tataacccaaaattgac

SEQ ID NO: 132003 - DNA, 17 bp, Unknown
  misc_feature (1)..( 17): Result.003 file - promoters60/3597175
taaatcgtaaaattttt

SEQ ID NO: 132004 - DNA, 17 bp, Unknown
  misc_feature (1)..( 17): Result.003 file - promoters60/3597175
ttttgtcataaatttgt

SEQ ID NO: 132005 - DNA, 17 bp, Unknown
  misc_feature (1)..( 17): Result.003 file - promoters60/3597175
tataaccaaaaataata

SEQ ID NO: 132006 - DNA, 17 bp, Unknown
  misc_feature (1)..( 17): Result.003 file - promoters60/3597175
aacactggaaactttat

SEQ ID NO: 132007 - DNA, 17 bp, Unknown
  misc_feature (1)..( 17): Result.003 file - promoters60/3597175
taccgccaaaaaaaata

SEQ ID NO: 132008 - DNA, 10 bp, Unknown
  misc_feature (1)..( 10): Result.003 file - promoters60/3597175
aaataaatcg

SEQ ID NO: 132009 - DNA, 10 bp, Unknown
  misc_feature (1)..( 10): Result.003 file - promoters60/3597175
acataaatct

SEQ ID NO: 132010 - DNA, 10 bp, Unknown
  misc_feature (1)..( 10): Result.003 file - promoters60/3597175
aaataaacta

SEQ ID NO: 132011 - DNA, 10 bp, Unknown
  misc_feature (1)..( 10): Result.003 file - promoters60/3597175
tcataaattt

SEQ ID NO: 132012 - DNA, 10 bp, Unknown
  misc_feature (1)..( 10): Result.003 file - promoters60/3597175
taataagttt

SEQ ID NO: 132013 - DNA, 8 bp, Unknown
  misc_feature (1)..( 8): Result.003 file - promoters60/3600084
atttttat

SEQ ID NO: 132014 - DNA, 8 bp, Unknown
  misc_feature (1)..( 8): Result.003 file - promoters60/3600084
atttttat

SEQ ID NO: 132015 - DNA, 7 bp, Unknown
  misc_feature (1)..( 7): Result.003 file - promoters60/3600084
tccaaaa

SEQ ID NO: 132016 - DNA, 7 bp, Unknown
  misc_feature (1)..( 7): Result.003 file - promoters60/3600084
tccaaac

SEQ ID NO: 132017 - DNA, 7 bp, Unknown
  misc_feature (1)..( 7): Result.003 file - promoters60/3600084
tccaaaa

SEQ ID NO: 132018 - DNA, 7 bp, Unknown
  misc_feature (1)..( 7): Result.003 file - promoters60/3600084
ctaaaaa

SEQ ID NO: 132019 - DNA, 7 bp, Unknown
  misc_feature (1)..( 7): Result.003 file - promoters60/3600084
ttaaaaa

SEQ ID NO: 132020 - DNA, 7 bp, Unknown
  misc_feature (1)..( 7): Result.003 file - promoters60/3600084
ttacaaa

SEQ ID NO: 132021 - DNA, 6 bp, Unknown
  misc_feature (1)..( 6): Result.003 file - promoters60/3600084
aaaaca

SEQ ID NO: 132022 - DNA, 6 bp, Unknown
  misc_feature (1)..( 6): Result.003 file - promoters60/3600084
aaaaca

SEQ ID NO: 132023 - DNA, 6 bp, Unknown
  misc_feature (1)..( 6): Result.003 file - promoters60/3600084
aattac

SEQ ID NO: 132024 - DNA, 6 bp, Unknown
  misc_feature (1)..( 6): Result.003 file - promoters60/3600084
aattac

SEQ ID NO: 132025 - DNA, 7 bp, Unknown
  misc_feature (1)..( 7): Result.003 file - promoters60/3600084
aagtagt

SEQ ID NO: 132026 - DNA, 7 bp, Unknown
  misc_feature (1)..( 7): Result.003 file - promoters60/3600084
aagaagt

SEQ ID NO: 132027 - DNA, 8 bp, Unknown
  misc_feature (1)..( 8): Result.003 file - promoters60/3600084
tttttttt

SEQ ID NO: 132028 - DNA, 8 bp, Unknown
  misc_feature (1)..( 8): Result.003 file - promoters60/3600084
tttttttt

SEQ ID NO: 132029 - DNA, 10 bp, Unknown
  misc_feature (1)..( 10): Result.003 file - promoters60/3600084
attgatgttc

SEQ ID NO: 132030 - DNA, 10 bp, Unknown
  misc_feature (1)..( 10): Result.003 file - promoters60/3600084
attaatgttc

SEQ ID NO: 132031 - DNA, 6 bp, Unknown
  misc_feature (1)..( 6): Result.003 file - promoters60/3600084
taaaat

SEQ ID NO: 132032 - DNA, 6 bp, Unknown
  misc_feature (1)..( 6): Result.003 file - promoters60/3600084
taaaat

SEQ ID NO: 132033 - DNA, 7 bp, Unknown
  misc_feature (1)..( 7): Result.003 file - promoters60/3600084
tcctaaa

SEQ ID NO: 132034 - DNA, 7 bp, Unknown
  misc_feature (1)..( 7): Result.003 file - promoters60/3600084
tccaaaa

SEQ ID NO: 132035 - DNA, 9 bp, Unknown
  misc_feature (1)..( 9): Result.003 file - promoters60/3600084
ttcctctca

SEQ ID NO: 132036 - DNA, 9 bp, Unknown
  misc_feature (1)..( 9): Result.003 file - promoters60/3600084
ttcatctca

SEQ ID NO: 132037 - DNA, 6 bp, Unknown
  misc_feature (1)..( 6): Result.003 file - promoters60/3600084
catcct

SEQ ID NO: 132038 - DNA, 6 bp, Unknown
  misc_feature (1)..( 6): Result.003 file - promoters60/3600084
catcct

SEQ ID NO: 132039 - DNA, 7 bp, Unknown
  misc_feature (1)..( 7): Result.003 file - promoters60/3600084
actgaaa

SEQ ID NO: 132040 - DNA, 7 bp, Unknown
  misc_feature (1)..( 7): Result.003 file - promoters60/3600084
actgaaa

SEQ ID NO: 132041 - DNA, 8 bp, Unknown
  misc_feature (1)..( 8): Result.003 file - promoters60/3600084
aaaacaaa

SEQ ID NO: 132042 - DNA, 8 bp, Unknown
  misc_feature (1)..( 8): Result.003 file - promoters60/3600084
aaaccaaa

SEQ ID NO: 132043 - DNA, 7 bp, Unknown
  misc_feature (1)..( 7): Result.003 file - promoters60/3600084
gtcaaaa

SEQ ID NO: 132044 - DNA, 7 bp, Unknown
  misc_feature (1)..( 7): Result.003 file - promoters60/3600084
gtcgaaa

SEQ ID NO: 132045 - DNA, 7 bp, Unknown
  misc_feature (1)..( 7): Result.003 file - promoters60/3611292
atataat

SEQ ID NO: 132046 - DNA, 7 bp, Unknown
  misc_feature (1)..( 7): Result.003 file - promoters60/3611292
ataaaat

SEQ ID NO: 132047 - DNA, 7 bp, Unknown
  misc_feature (1)..( 7): Result.003 file - promoters60/3611292
gtataat

SEQ ID NO: 132048 - DNA, 7 bp, Unknown
  misc_feature (1)..( 7): Result.003 file - promoters60/3611292
ttaaaat

SEQ ID NO: 132049 - DNA, 7 bp, Unknown
  misc_feature (1)..( 7): Result.003 file - promoters60/3611292
ttaaaag

SEQ ID NO: 132050 - DNA, 9 bp, Unknown
  misc_feature (1)..( 9): Result.003 file - promoters60/3611292
ttacaaaaa

SEQ ID NO: 132051 - DNA, 9 bp, Unknown
  misc_feature (1)..( 9): Result.003 file - promoters60/3611292
ttactaaaa

SEQ ID NO: 132052 - DNA, 10 bp, Unknown
  misc_feature (1)..( 10): Result.003 file - promoters60/3611292
aaacataaaa

SEQ ID NO: 132053 - DNA, 10 bp, Unknown
  misc_feature (1)..( 10): Result.003 file - promoters60/3611292
gaactaaact

SEQ ID NO: 132054 - DNA, 7 bp, Unknown
  misc_feature (1)..( 7): Result.003 file - promoters60/3611292
tcttttt

SEQ ID NO: 132055 - DNA, 7 bp, Unknown
  misc_feature (1)..( 7): Result.003 file - promoters60/3611292
tcttttg

SEQ ID NO: 132056 - DNA, 7 bp, Unknown
  misc_feature (1)..( 7): Result.003 file - promoters60/3611292
ccttttt

SEQ ID NO: 132057 - DNA, 8 bp, Unknown
  misc_feature (1)..( 8): Result.003 file - promoters60/3611292
acttgttt

SEQ ID NO: 132058 - DNA, 11 bp, Unknown
  misc_feature (1)..( 11): Result.003 file - promoters60/3611292
taaacaaacga

SEQ ID NO: 132059 - DNA, 11 bp, Unknown
  misc_feature (1)..( 11): Result.003 file - promoters60/3611292
aaaaaaaaaag

SEQ ID NO: 132060 - DNA, 11 bp, Unknown
  misc_feature (1)..( 11): Result.003 file - promoters60/3611292
caaaaaaatca

SEQ ID NO: 132061 - DNA, 11 bp, Unknown
  misc_feature (1)..( 11): Result.003 file - promoters60/3611292
caagaaattca

SEQ ID NO: 132062 - DNA, 8 bp, Unknown
  misc_feature (1)..( 8): Result.003 file - promoters60/3646410
aaaaaaaa

SEQ ID NO: 132063 - DNA, 8 bp, Unknown
  misc_feature (1)..( 8): Result.003 file - promoters60/3646410
aaaaaaaa

SEQ ID NO: 132064 - DNA, 8 bp, Unknown
  misc_feature (1)..( 8): Result.003 file - promoters60/3646410
aaagaaga

SEQ ID NO: 132065 - DNA, 9 bp, Unknown
  misc_feature (1)..( 9): Result.003 file - promoters60/3646410
gaaaggttt

SEQ ID NO: 132066 - DNA, 9 bp, Unknown
  misc_feature (1)..( 9): Result.003 file - promoters60/3646410
aaaagattt

SEQ ID NO: 132067 - DNA, 9 bp, Unknown
  misc_feature (1)..( 9): Result.003 file - promoters60/3646410
aaaagacgc

SEQ ID NO: 132068 - DNA, 9 bp, Unknown
  misc_feature (1)..( 9): Result.003 file - promoters60/3646410
gaaagtctt

SEQ ID NO: 132069 - DNA, 9 bp, Unknown
  misc_feature (1)..( 9): Result.003 file - promoters60/3646410
aaaattctt

SEQ ID NO: 132070 - DNA, 9 bp, Unknown
  misc_feature (1)..( 9): Result.003 file - promoters60/3646410
gaaagtgga

SEQ ID NO: 132071 - DNA, 7 bp, Unknown
  misc_feature (1)..( 7): Result.003 file - promoters60/3659211
aatttag

SEQ ID NO: 132072 - DNA, 7 bp, Unknown
  misc_feature (1)..( 7): Result.003 file - promoters60/3659211
aatgtag

SEQ ID NO: 132073 - DNA, 8 bp, Unknown
  misc_feature (1)..( 8): Result.003 file - promoters60/3659211
aatatttt

SEQ ID NO: 132074 - DNA, 8 bp, Unknown
  misc_feature (1)..( 8): Result.003 file - promoters60/3659211
aatttttt

SEQ ID NO: 132075 - DNA, 7 bp, Unknown
  misc_feature (1)..( 7): Result.003 file - promoters60/3659211
actggtg

SEQ ID NO: 132076 - DNA, 7 bp, Unknown
  misc_feature (1)..( 7): Result.003 file - promoters60/3659211
acttgtg

SEQ ID NO: 132077 - DNA, 6 bp, Unknown
  misc_feature (1)..( 6): Result.003 file - promoters60/3659211
aaaaga

SEQ ID NO: 132078 - DNA, 6 bp, Unknown
  misc_feature (1)..( 6): Result.003 file - promoters60/3659211
aaaaga

SEQ ID NO: 132079 - DNA, 8 bp, Unknown
  misc_feature (1)..( 8): Result.003 file - promoters60/3659211
atttagtt

SEQ ID NO: 132080 - DNA, 8 bp, Unknown
  misc_feature (1)..( 8): Result.003 file - promoters60/3659211
atttggtt

SEQ ID NO: 132081 - DNA, 7 bp, Unknown
  misc_feature (1)..( 7): Result.003 file - promoters60/3659211
tacgatt

SEQ ID NO: 132082 - DNA, 7 bp, Unknown
  misc_feature (1)..( 7): Result.003 file - promoters60/3659211
tacaatt

SEQ ID NO: 132083 - DNA, 6 bp, Unknown
  misc_feature (1)..( 6): Result.003 file - promoters60/3659211
gaatca

SEQ ID NO: 132084 - DNA, 6 bp, Unknown
  misc_feature (1)..( 6): Result.003 file - promoters60/3659211
gaatca

SEQ ID NO: 132085 - DNA, 8 bp, Unknown
  misc_feature (1)..( 8): Result.003 file - promoters60/3659211
ataaatta

SEQ ID NO: 132086 - DNA, 8 bp, Unknown
  misc_feature (1)..( 8): Result.003 file - promoters60/3659211
ataaatag

SEQ ID NO: 132087 - DNA, 8 bp, Unknown
  misc_feature (1)..( 8): Result.003 file - promoters60/3659211
ataaatta

SEQ ID NO: 132088 - DNA, 7 bp, Unknown
  misc_feature (1)..( 7): Result.003 file - promoters60/3659211
aaaaaag

SEQ ID NO: 132089 - DNA, 7 bp, Unknown
  misc_feature (1)..( 7): Result.003 file - promoters60/3659211
aaagaag

SEQ ID NO: 132090 - DNA, 10 bp, Unknown
  misc_feature (1)..( 10): Result.003 file - promoters60/3659211
gcaaacacaa

SEQ ID NO: 132091 - DNA, 10 bp, Unknown
  misc_feature (1)..( 10): Result.003 file - promoters60/3659211
gcaaaaacaa

SEQ ID NO: 132092 - DNA, 7 bp, Unknown
  misc_feature (1)..( 7): Result.003 file - promoters60/3659211
gaatatt

SEQ ID NO: 132093 - DNA, 7 bp, Unknown
  misc_feature (1)..( 7): Result.003 file - promoters60/3659211
gaaaatt

SEQ ID NO: 132094 - DNA, 6 bp, Unknown
  misc_feature (1)..( 6): Result.003 file - promoters60/3659211
cgtttt

SEQ ID NO: 132095 - DNA, 6 bp, Unknown
  misc_feature (1)..( 6): Result.003 file - promoters60/3659211
cgtttt

SEQ ID NO: 132096 - DNA, 7 bp, Unknown
  misc_feature (1)..( 7): Result.003 file - promoters60/3659211
cgagaat

SEQ ID NO: 132097 - DNA, 7 bp, Unknown
  misc_feature (1)..( 7): Result.003 file - promoters60/3659211
cgagaat

SEQ ID NO: 132098 - DNA, 6 bp, Unknown
  misc_feature (1)..( 6): Result.003 file - promoters60/3659211
gaatca

SEQ ID NO: 132099 - DNA, 6 bp, Unknown
  misc_feature (1)..( 6): Result.003 file - promoters60/3659211
gaatca

SEQ ID NO: 132100 - DNA, 7 bp, Unknown
  misc_feature (1)..( 7): Result.003 file - promoters60/3659211
tccggtt

SEQ ID NO: 132101 - DNA, 7 bp, Unknown
  misc_feature (1)..( 7): Result.003 file - promoters60/3659211
tccagtt

SEQ ID NO: 132102 - DNA, 6 bp, Unknown
  misc_feature (1)..( 6): Result.003 file - promoters60/3659211
tttccg

SEQ ID NO: 132103 - DNA, 6 bp, Unknown
  misc_feature (1)..( 6): Result.003 file - promoters60/3659211
tttccg

SEQ ID NO: 132104 - DNA, 6 bp, Unknown
  misc_feature (1)..( 6): Result.003 file - promoters60/3659211
aaccct

SEQ ID NO: 132105 - DNA, 6 bp, Unknown
  misc_feature (1)..( 6): Result.003 file - promoters60/3659211
aaccct

SEQ ID NO: 132106 - DNA, 11 bp, Unknown
  misc_feature (1)..( 11): Result.003 file - promoters60/3659426
gaaggaagaag

SEQ ID NO: 132107 - DNA, 11 bp, Unknown
  misc_feature (1)..( 11): Result.003 file - promoters60/3659426
cgaggaagaag

SEQ ID NO: 132108 - DNA, 11 bp, Unknown
  misc_feature (1)..( 11): Result.003 file - promoters60/3659426
aaaggaactat

SEQ ID NO: 132109 - DNA, 11 bp, Unknown
  misc_feature (1)..( 11): Result.003 file - promoters60/3659426
aaaagaacaaa

SEQ ID NO: 132110 - DNA, 11 bp, Unknown
  misc_feature (1)..( 11): Result.003 file - promoters60/4254292
aggaataagac

SEQ ID NO: 132111 - DNA, 11 bp, Unknown
  misc_feature (1)..( 11): Result.003 file - promoters60/4254292
agcaataagaa

SEQ ID NO: 132112 - DNA, 11 bp, Unknown
  misc_feature (1)..( 11): Result.003 file - promoters60/4254292
aggaagaagac

SEQ ID NO: 132113 - DNA, 11 bp, Unknown
  misc_feature (1)..( 11): Result.003 file - promoters60/4254292
tagaataaaac

SEQ ID NO: 132114 - DNA, 11 bp, Unknown
  misc_feature (1)..( 11): Result.003 file - promoters60/4254292
tttaaaaaaga

SEQ ID NO: 132115 - DNA, 11 bp, Unknown
  misc_feature (1)..( 11): Result.003 file - promoters60/4254292
cattaaaataa

SEQ ID NO: 132116 - DNA, 9 bp, Unknown
  misc_feature (1)..( 9): Result.003 file - promoters60/4254292
tcccaaaaa

SEQ ID NO: 132117 - DNA, 9 bp, Unknown
  misc_feature (1)..( 9): Result.003 file - promoters60/4254292
tcctaaaat

SEQ ID NO: 132118 - DNA, 9 bp, Unknown
  misc_feature (1)..( 9): Result.003 file - promoters60/4254292
acccaaaat

SEQ ID NO: 132119 - DNA, 9 bp, Unknown
  misc_feature (1)..( 9): Result.003 file - promoters60/4254292
tcccaacac

SEQ ID NO: 132120 - DNA, 8 bp, Unknown
  misc_feature (1)..( 8): Result.003 file - promoters60/4254292
tttaaaat

SEQ ID NO: 132121 - DNA, 9 bp, Unknown
  misc_feature (1)..( 9): Result.003 file - promoters60/4254292
tactaaaaa

SEQ ID NO: 132122 - DNA, 16 bp, Unknown
  misc_feature (1)..( 16): Result.003 file - promoters60/4254292
ttcgtagattgcgtga

SEQ ID NO: 132123 - DNA, 16 bp, Unknown
  misc_feature (1)..( 16): Result.003 file - promoters60/4254292
tttttagtttgtgtgc

SEQ ID NO: 132124 - DNA, 16 bp, Unknown
  misc_feature (1)..( 16): Result.003 file - promoters60/4254292
taaaaatctcgtgtgc

SEQ ID NO: 132125 - DNA, 16 bp, Unknown
  misc_feature (1)..( 16): Result.003 file - promoters60/4254292
tttttattttttattg

SEQ ID NO: 132126 - DNA, 16 bp, Unknown
  misc_feature (1)..( 16): Result.003 file - promoters60/4254292
ccattactttactctt

SEQ ID NO: 132127 - DNA, 16 bp, Unknown
  misc_feature (1)..( 16): Result.003 file - promoters60/4254292
gtctttgattagcaaa

SEQ ID NO: 132128 - DNA, 16 bp, Unknown
  misc_feature (1)..( 16): Result.003 file - promoters60/4254292
caacaactatacaatg

SEQ ID NO: 132129 - DNA, 12 bp, Unknown
  misc_feature (1)..( 12): Result.003 file - promoters60/4254292
tgttattatatt

SEQ ID NO: 132130 - DNA, 12 bp, Unknown
  misc_feature (1)..( 12): Result.003 file - promoters60/4254292
attaattaaatt

SEQ ID NO: 132131 - DNA, 12 bp, Unknown
  misc_feature (1)..( 12): Result.003 file - promoters60/4254292
gaggattaaagg

SEQ ID NO: 132132 - DNA, 12 bp, Unknown
  misc_feature (1)..( 12): Result.003 file - promoters60/4254292
actaattaatgg

SEQ ID NO: 132133 - DNA, 12 bp, Unknown
  misc_feature (1)..( 12): Result.003 file - promoters60/4254292
actgatttttca

SEQ ID NO: 132134 - DNA, 12 bp, Unknown
  misc_feature (1)..( 12): Result.003 file - promoters60/4254292
gccgatgaaagt

SEQ ID NO: 132135 - DNA, 9 bp, Unknown
  misc_feature (1)..( 9): Result.003 file - promoters60/4254426
aacttctaa

SEQ ID NO: 132136 - DNA, 9 bp, Unknown
  misc_feature (1)..( 9): Result.003 file - promoters60/4254426
tccttataa

SEQ ID NO: 132137 - DNA, 9 bp, Unknown
  misc_feature (1)..( 9): Result.003 file - promoters60/4254426
ttcttctat

SEQ ID NO: 132138 - DNA, 9 bp, Unknown
  misc_feature (1)..( 9): Result.003 file - promoters60/4254426
tccctatct

SEQ ID NO: 132139 - DNA, 11 bp, Unknown
  misc_feature (1)..( 11): Result.003 file - promoters60/4254807
tagatttgcta

SEQ ID NO: 132140 - DNA, 11 bp, Unknown
  misc_feature (1)..( 11): Result.003 file - promoters60/4254807
aagaattgagt

SEQ ID NO: 132141 - DNA, 11 bp, Unknown
  misc_feature (1)..( 11): Result.003 file - promoters60/4254807
gccaattcagt

SEQ ID NO: 132142 - DNA, 11 bp, Unknown
  misc_feature (1)..( 11): Result.003 file - promoters60/4254807
aagtattagaa

SEQ ID NO: 132143 - DNA, 11 bp, Unknown
  misc_feature (1)..( 11): Result.003 file - promoters60/4254807
tacaattcggc

SEQ ID NO: 132144 - DNA, 11 bp, Unknown
  misc_feature (1)..( 11): Result.003 file - promoters60/4254807
tggtattaata

SEQ ID NO: 132145 - DNA, 7 bp, Unknown
  misc_feature (1)..( 7): Result.003 file - promoters60/4256562
tttgtta

SEQ ID NO: 132146 - DNA, 7 bp, Unknown
  misc_feature (1)..( 7): Result.003 file - promoters60/4256562
tttatta

SEQ ID NO: 132147 - DNA, 7 bp, Unknown
  misc_feature (1)..( 7): Result.003 file - promoters60/4256562
tttattt

SEQ ID NO: 132148 - DNA, 7 bp, Unknown
  misc_feature (1)..( 7): Result.003 file - promoters60/4256562
attgtta

SEQ ID NO: 132149 - DNA, 7 bp, Unknown
  misc_feature (1)..( 7): Result.003 file - promoters60/4256562
attatta

SEQ ID NO: 132150 - DNA, 7 bp, Unknown
  misc_feature (1)..( 7): Result.003 file - promoters60/4256562
attctta

SEQ ID NO: 132151 - DNA, 12 bp, Unknown
  misc_feature (1)..( 12): Result.003 file - promoters60/4256562
tagataaaacag

SEQ ID NO: 132152 - DNA, 12 bp, Unknown
  misc_feature (1)..( 12): Result.003 file - promoters60/4256562
tagaaaaaaact

SEQ ID NO: 132153 - DNA, 12 bp, Unknown
  misc_feature (1)..( 12): Result.003 file - promoters60/4256562
tggttaaaacag

SEQ ID NO: 132154 - DNA, 12 bp, Unknown
  misc_feature (1)..( 12): Result.003 file - promoters60/4256562
cggaaagaacta

SEQ ID NO: 132155 - DNA, 12 bp, Unknown
  misc_feature (1)..( 12): Result.003 file - promoters60/4256562
ccaaacattaca

SEQ ID NO: 132156 - DNA, 12 bp, Unknown
  misc_feature (1)..( 12): Result.003 file - promoters60/4256562
acaaacgttact

SEQ ID NO: 132157 - DNA, 12 bp, Unknown
  misc_feature (1)..( 12): Result.003 file - promoters60/4256562
ttcagcattaca

SEQ ID NO: 132158 - DNA, 12 bp, Unknown
  misc_feature (1)..( 12): Result.003 file - promoters60/4256562
acaaaggttgtt

SEQ ID NO: 132159 - DNA, 9 bp, Unknown
  misc_feature (1)..( 9): Result.003 file - promoters60/4256562
tcgataaaa

SEQ ID NO: 132160 - DNA, 9 bp, Unknown
  misc_feature (1)..( 9): Result.003 file - promoters60/4256562
cctataaaa

SEQ ID NO: 132161 - DNA, 9 bp, Unknown
  misc_feature (1)..( 9): Result.003 file - promoters60/4256562
tcgttaaaa

SEQ ID NO: 132162 - DNA, 13 bp, Unknown
  misc_feature (1)..( 13): Result.003 file - promoters60/4262222
tttgtaataaatt

SEQ ID NO: 132163 - DNA, 13 bp, Unknown
  misc_feature (1)..( 13): Result.003 file - promoters60/4262222
ctctttatatatt

SEQ ID NO: 132164 - DNA, 13 bp, Unknown
  misc_feature (1)..( 13): Result.003 file - promoters60/4262222
aaaactatacatt

SEQ ID NO: 132165 - DNA, 13 bp, Unknown
  misc_feature (1)..( 13): Result.003 file - promoters60/4262222
aaactcatatccg

SEQ ID NO: 132166 - DNA, 13 bp, Unknown
  misc_feature (1)..( 13): Result.003 file - promoters60/4262222
aatttaatcaatt

SEQ ID NO: 132167 - DNA, 9 bp, Unknown
  misc_feature (1)..( 9): Result.003 file - promoters60/4262222
atattataa

SEQ ID NO: 132168 - DNA, 9 bp, Unknown
  misc_feature (1)..( 9): Result.003 file - promoters60/4262222
aaattatag

SEQ ID NO: 132169 - DNA, 9 bp, Unknown
  misc_feature (1)..( 9): Result.003 file - promoters60/4262222
ttattaaat

SEQ ID NO: 132170 - DNA, 9 bp, Unknown
  misc_feature (1)..( 9): Result.003 file - promoters60/4262222
tttttaaat

SEQ ID NO: 132171 - DNA, 10 bp, Unknown
  misc_feature (1)..( 10): Result.003 file - promoters60/4262222
acatattact

SEQ ID NO: 132172 - DNA, 10 bp, Unknown
  misc_feature (1)..( 10): Result.003 file - promoters60/4262222
ccattttaac

SEQ ID NO: 132173 - DNA, 10 bp, Unknown
  misc_feature (1)..( 10): Result.003 file - promoters60/4262222
acatgttaga

SEQ ID NO: 132174 - DNA, 10 bp, Unknown
  misc_feature (1)..( 10): Result.003 file - promoters60/4262222
aattgttaga

SEQ ID NO: 132175 - DNA, 6 bp, Unknown
  misc_feature (1)..( 6): Result.003 file - promoters60/4262416
aatata

SEQ ID NO: 132176 - DNA, 6 bp, Unknown
  misc_feature (1)..( 6): Result.003 file - promoters60/4262416
aatata

SEQ ID NO: 132177 - DNA, 7 bp, Unknown
  misc_feature (1)..( 7): Result.003 file - promoters60/4262416
ttattat

SEQ ID NO: 132178 - DNA, 7 bp, Unknown
  misc_feature (1)..( 7): Result.003 file - promoters60/4262416
ttaatat

SEQ ID NO: 132179 - DNA, 6 bp, Unknown
  misc_feature (1)..( 6): Result.003 file - promoters60/4262416
tattaa

SEQ ID NO: 132180 - DNA, 6 bp, Unknown
  misc_feature (1)..( 6): Result.003 file - promoters60/4262416
tattaa

SEQ ID NO: 132181 - DNA, 6 bp, Unknown
  misc_feature (1)..( 6): Result.003 file - promoters60/4262416
tatatt

SEQ ID NO: 132182 - DNA, 6 bp, Unknown
  misc_feature (1)..( 6): Result.003 file - promoters60/4262416
tatatt

SEQ ID NO: 132183 - DNA, 7 bp, Unknown
  misc_feature (1)..( 7): Result.003 file - promoters60/4262416
attatca

SEQ ID NO: 132184 - DNA, 7 bp, Unknown
  misc_feature (1)..( 7): Result.003 file - promoters60/4262416
attatca

SEQ ID NO: 132185 - DNA, 6 bp, Unknown
  misc_feature (1)..( 6): Result.003 file - promoters60/4262416
aataaa

SEQ ID NO: 132186 - DNA, 6 bp, Unknown
  misc_feature (1)..( 6): Result.003 file - promoters60/4262416
aataaa

SEQ ID NO: 132187 - DNA, 11 bp, Unknown
  misc_feature (1)..( 11): Result.003 file - promoters60/4262416
ataaactcaaa

SEQ ID NO: 132188 - DNA, 11 bp, Unknown
  misc_feature (1)..( 11): Result.003 file - promoters60/4262416
ataaacgcaaa

SEQ ID NO: 132189 - DNA, 8 bp, Unknown
  misc_feature (1)..( 8): Result.003 file - promoters60/4262416
ctgaaata

SEQ ID NO: 132190 - DNA, 8 bp, Unknown
  misc_feature (1)..( 8): Result.003 file - promoters60/4262416
ctgaaata

SEQ ID NO: 132191 - DNA, 6 bp, Unknown
  misc_feature (1)..( 6): Result.003 file - promoters60/4262416
aaacct

SEQ ID NO: 132192 - DNA, 6 bp, Unknown
  misc_feature (1)..( 6): Result.003 file - promoters60/4262416
aaacct

SEQ ID NO: 132193 - DNA, 6 bp, Unknown
  misc_feature (1)..( 6): Result.003 file - promoters60/4262416
aaatag

SEQ ID NO: 132194 - DNA, 6 bp, Unknown
  misc_feature (1)..( 6): Result.003 file - promoters60/4262416
aaatag

SEQ ID NO: 132195 - DNA, 6 bp, Unknown
  misc_feature (1)..( 6): Result.003 file - promoters60/4262416
aacacg

SEQ ID NO: 132196 - DNA, 6 bp, Unknown
  misc_feature (1)..( 6): Result.003 file - promoters60/4262416
aacacg

SEQ ID NO: 132197 - DNA, 9 bp, Unknown
  misc_feature (1)..( 9): Result.003 file - promoters60/4262416
aatactttg

SEQ ID NO: 132198 - DNA, 9 bp, Unknown
  misc_feature (1)..( 9): Result.003 file - promoters60/4262416
aattctttg

SEQ ID NO: 132199 - DNA, 7 bp, Unknown
  misc_feature (1)..( 7): Result.003 file - promoters60/4262416
acagaaa

SEQ ID NO: 132200 - DNA, 7 bp, Unknown
  misc_feature (1)..( 7): Result.003 file - promoters60/4262416
acaaaaa

SEQ ID NO: 132201 - DNA, 7 bp, Unknown
  misc_feature (1)..( 7): Result.003 file - promoters60/4262416
gtccaat

SEQ ID NO: 132202 - DNA, 7 bp, Unknown
  misc_feature (1)..( 7): Result.003 file - promoters60/4262416
gtctaat

SEQ ID NO: 132203 - DNA, 7 bp, Unknown
  misc_feature (1)..( 7): Result.003 file - promoters60/4262416
aattcat

SEQ ID NO: 132204 - DNA, 7 bp, Unknown
  misc_feature (1)..( 7): Result.003 file - promoters60/4262416
aattcat

SEQ ID NO: 132205 - DNA, 6 bp, Unknown
  misc_feature (1)..( 6): Result.003 file - promoters60/4262416
acagaa

SEQ ID NO: 132206 - DNA, 6 bp, Unknown
  misc_feature (1)..( 6): Result.003 file - promoters60/4262416
acagaa

SEQ ID NO: 132207 - DNA, 9 bp, Unknown
  misc_feature (1)..( 9): Result.003 file - promoters60/4262420
ataatttga

SEQ ID NO: 132208 - DNA, 9 bp, Unknown
  misc_feature (1)..( 9): Result.003 file - promoters60/4262420
ctaattttg

SEQ ID NO: 132209 - DNA, 9 bp, Unknown
  misc_feature (1)..( 9): Result.003 file - promoters60/4262420
atattttta

SEQ ID NO: 132210 - DNA, 9 bp, Unknown
  misc_feature (1)..( 9): Result.003 file - promoters60/4262420
gtaatttga

SEQ ID NO: 132211 - DNA, 10 bp, Unknown
  misc_feature (1)..( 10): Result.003 file - promoters60/4262420
ggattcttac

SEQ ID NO: 132212 - DNA, 10 bp, Unknown
  misc_feature (1)..( 10): Result.003 file - promoters60/4262420
agattctaga

SEQ ID NO: 132213 - DNA, 10 bp, Unknown
  misc_feature (1)..( 10): Result.003 file - promoters60/4262420
tcattcgtac

SEQ ID NO: 132214 - DNA, 11 bp, Unknown
  misc_feature (1)..( 11): Result.003 file - promoters60/4262422
tagtgttaaga

SEQ ID NO: 132215 - DNA, 11 bp, Unknown
  misc_feature (1)..( 11): Result.003 file - promoters60/4262422
tagagttcatt

SEQ ID NO: 132216 - DNA, 11 bp, Unknown
  misc_feature (1)..( 11): Result.003 file - promoters60/4262422
tagttttatcc

SEQ ID NO: 132217 - DNA, 11 bp, Unknown
  misc_feature (1)..( 11): Result.003 file - promoters60/4262422
agtctttgatc

SEQ ID NO: 132218 - DNA, 9 bp, Unknown
  misc_feature (1)..( 9): Result.003 file - promoters60/4262422
gcgattaga

SEQ ID NO: 132219 - DNA, 9 bp, Unknown
  misc_feature (1)..( 9): Result.003 file - promoters60/4262422
atgataaga

SEQ ID NO: 132220 - DNA, 9 bp, Unknown
  misc_feature (1)..( 9): Result.003 file - promoters60/4262422
tggataagt

SEQ ID NO: 132221 - DNA, 9 bp, Unknown
  misc_feature (1)..( 9): Result.003 file - promoters60/4262422
tggataaaa

SEQ ID NO: 132222 - DNA, 12 bp, Unknown
  misc_feature (1)..( 12): Result.003 file - promoters60/4262422
taatttcatttg

SEQ ID NO: 132223 - DNA, 12 bp, Unknown
  misc_feature (1)..( 12): Result.003 file - promoters60/4262422
taatttaatttg

SEQ ID NO: 132224 - DNA, 12 bp, Unknown
  misc_feature (1)..( 12): Result.003 file - promoters60/4262422
tgagttgattat

SEQ ID NO: 132225 - DNA, 12 bp, Unknown
  misc_feature (1)..( 12): Result.003 file - promoters60/4262422
tggtttaatcat

SEQ ID NO: 132226 - DNA, 9 bp, Unknown
  misc_feature (1)..( 9): Result.003 file - promoters60/4262428
aatttaaat

SEQ ID NO: 132227 - DNA, 9 bp, Unknown
  misc_feature (1)..( 9): Result.003 file - promoters60/4262428
tatttaagc

SEQ ID NO: 132228 - DNA, 9 bp, Unknown
  misc_feature (1)..( 9): Result.003 file - promoters60/4262428
aatataaat

SEQ ID NO: 132229 - DNA, 9 bp, Unknown
  misc_feature (1)..( 9): Result.003 file - promoters60/4262428
aataaaaat

SEQ ID NO: 132230 - DNA, 9 bp, Unknown
  misc_feature (1)..( 9): Result.003 file - promoters60/4262428
ttttataaa

SEQ ID NO: 132231 - DNA, 9 bp, Unknown
  misc_feature (1)..( 9): Result.003 file - promoters60/4262428
ttttttaat

SEQ ID NO: 132232 - DNA, 9 bp, Unknown
  misc_feature (1)..( 9): Result.003 file - promoters60/4262428
aaatataaa

SEQ ID NO: 132233 - DNA, 9 bp, Unknown
  misc_feature (1)..( 9): Result.003 file - promoters60/4262428
caatataaa

SEQ ID NO: 132234 - DNA, 14 bp, Unknown
  misc_feature (1)..( 14): Result.003 file - promoters60/4262446
cgaagtttattaat

SEQ ID NO: 132235 - DNA, 14 bp, Unknown
  misc_feature (1)..( 14): Result.003 file - promoters60/4262446
cgaatttttttaag

SEQ ID NO: 132236 - DNA, 14 bp, Unknown
  misc_feature (1)..( 14): Result.003 file - promoters60/4262446
agatcctttttaaa

SEQ ID NO: 132237 - DNA, 14 bp, Unknown
  misc_feature (1)..( 14): Result.003 file - promoters60/4262446
ataaaaatttgaaa

SEQ ID NO: 132238 - DNA, 11 bp, Unknown
  misc_feature (1)..( 11): Result.003 file - promoters60/4262446
ttatttctatt

SEQ ID NO: 132239 - DNA, 11 bp, Unknown
  misc_feature (1)..( 11): Result.003 file - promoters60/4262446
ttatctctatt

SEQ ID NO: 132240 - DNA, 11 bp, Unknown
  misc_feature (1)..( 11): Result.003 file - promoters60/4262446
caatttatatt

SEQ ID NO: 132241 - DNA, 11 bp, Unknown
  misc_feature (1)..( 11): Result.003 file - promoters60/4262446
aaatttctcct

SEQ ID NO: 132242 - DNA, 12 bp, Unknown
  misc_feature (1)..( 12): Result.003 file - promoters60/4262446
tcattaacaaat

SEQ ID NO: 132243 - DNA, 12 bp, Unknown
  misc_feature (1)..( 12): Result.003 file - promoters60/4262446
tttttaaaaaat

SEQ ID NO: 132244 - DNA, 12 bp, Unknown
  misc_feature (1)..( 12): Result.003 file - promoters60/4262446
tataaaacaaaa

SEQ ID NO: 132245 - DNA, 12 bp, Unknown
  misc_feature (1)..( 12): Result.003 file - promoters60/4262446
attaggacaaat

SEQ ID NO: 132246 - DNA, 12 bp, Unknown
  misc_feature (1)..( 12): Result.003 file - promoters60/4262446
tttttaaatttc

SEQ ID NO: 132247 - DNA, 14 bp, Unknown
  misc_feature (1)..( 14): Result.003 file - promoters60/4262446
attttgaaatcatg

SEQ ID NO: 132248 - DNA, 14 bp, Unknown
  misc_feature (1)..( 14): Result.003 file - promoters60/4262446
ttttttaaagttcc

SEQ ID NO: 132249 - DNA, 14 bp, Unknown
  misc_feature (1)..( 14): Result.003 file - promoters60/4262446
attttgacatcata

SEQ ID NO: 132250 - DNA, 14 bp, Unknown
  misc_feature (1)..( 14): Result.003 file - promoters60/4262446
atttataagcaatc

SEQ ID NO: 132251 - DNA, 14 bp, Unknown
  misc_feature (1)..( 14): Result.003 file - promoters60/4262446
caatatacatcata

SEQ ID NO: 132252 - DNA, 14 bp, Unknown
  misc_feature (1)..( 14): Result.003 file - promoters60/4262446
attttgaaatcatg

SEQ ID NO: 132253 - DNA, 14 bp, Unknown
  misc_feature (1)..( 14): Result.003 file - promoters60/4262446
tccaaccaatcata

SEQ ID NO: 132254 - DNA, 14 bp, Unknown
  misc_feature (1)..( 14): Result.003 file - promoters60/4262446
attttgacatcata

SEQ ID NO: 132255 - DNA, 14 bp, Unknown
  misc_feature (1)..( 14): Result.003 file - promoters60/4262446
caatatacatcata

SEQ ID NO: 132256 - DNA, 8 bp, Unknown
  misc_feature (1)..( 8): Result.003 file - promoters60/4262446
taaacttt

SEQ ID NO: 132257 - DNA, 8 bp, Unknown
  misc_feature (1)..( 8): Result.003 file - promoters60/4262446
aaaaattt

SEQ ID NO: 132258 - DNA, 8 bp, Unknown
  misc_feature (1)..( 8): Result.003 file - promoters60/4262446
gaacatta

SEQ ID NO: 132259 - DNA, 8 bp, Unknown
  misc_feature (1)..( 8): Result.003 file - promoters60/4262446
aaaaatgt

SEQ ID NO: 132260 - DNA, 8 bp, Unknown
  misc_feature (1)..( 8): Result.003 file - promoters60/4262446
ttaaattt

SEQ ID NO: 132261 - DNA, 11 bp, Unknown
  misc_feature (1)..( 11): Result.003 file - promoters60/4262446
caaataaaaca

SEQ ID NO: 132262 - DNA, 11 bp, Unknown
  misc_feature (1)..( 11): Result.003 file - promoters60/4262446
attataaaaca

SEQ ID NO: 132263 - DNA, 11 bp, Unknown
  misc_feature (1)..( 11): Result.003 file - promoters60/4262446
gaaaaaaaaaa

SEQ ID NO: 132264 - DNA, 11 bp, Unknown
  misc_feature (1)..( 11): Result.003 file - promoters60/4262446
tttttaaaaaa

SEQ ID NO: 132265 - DNA, 11 bp, Unknown
  misc_feature (1)..( 11): Result.003 file - promoters60/4262446
tttttaaattt

SEQ ID NO: 132266 - DNA, 13 bp, Unknown
  misc_feature (1)..( 13): Result.003 file - promoters60/4262446
tttattaaaacaa

SEQ ID NO: 132267 - DNA, 13 bp, Unknown
  misc_feature (1)..( 13): Result.003 file - promoters60/4262446
tttattaaaatat

SEQ ID NO: 132268 - DNA, 13 bp, Unknown
  misc_feature (1)..( 13): Result.003 file - promoters60/4262446
tatataaaaagaa

SEQ ID NO: 132269 - DNA, 13 bp, Unknown
  misc_feature (1)..( 13): Result.003 file - promoters60/4262446
cttttaaaaagaa

SEQ ID NO: 132270 - DNA, 9 bp, Unknown
  misc_feature (1)..( 9): Result.003 file - promoters60/4262446
caaaaatta

SEQ ID NO: 132271 - DNA, 9 bp, Unknown
  misc_feature (1)..( 9): Result.003 file - promoters60/4262446
ttaaattta

SEQ ID NO: 132272 - DNA, 10 bp, Unknown
  misc_feature (1)..( 10): Result.003 file - promoters60/4262446
ccaataataa

SEQ ID NO: 132273 - DNA, 10 bp, Unknown
  misc_feature (1)..( 10): Result.003 file - promoters60/4262446
cttatattat

SEQ ID NO: 132274 - DNA, 8 bp, Unknown
  misc_feature (1)..( 8): Result.003 file - promoters60/4262562
gagaatct

SEQ ID NO: 132275 - DNA, 8 bp, Unknown
  misc_feature (1)..( 8): Result.003 file - promoters60/4262562
tagattct

SEQ ID NO: 132276 - DNA, 8 bp, Unknown
  misc_feature (1)..( 8): Result.003 file - promoters60/4262562
gagattct

SEQ ID NO: 132277 - DNA, 13 bp, Unknown
  misc_feature (1)..( 13): Result.003 file - promoters60/4262562
agttttgactttt

SEQ ID NO: 132278 - DNA, 13 bp, Unknown
  misc_feature (1)..( 13): Result.003 file - promoters60/4262562
taatttaactttt

SEQ ID NO: 132279 - DNA, 13 bp, Unknown
  misc_feature (1)..( 13): Result.003 file - promoters60/4262562
taattaaacttgg

SEQ ID NO: 132280 - DNA, 9 bp, Unknown
  misc_feature (1)..( 9): Result.003 file - promoters60/4262562
gagtgacaa

SEQ ID NO: 132281 - DNA, 9 bp, Unknown
  misc_feature (1)..( 9): Result.003 file - promoters60/4262562
gagtgacaa

SEQ ID NO: 132282 - DNA, 9 bp, Unknown
  misc_feature (1)..( 9): Result.003 file - promoters60/4262562
atgtgacaa

SEQ ID NO: 132283 - DNA, 8 bp, Unknown
  misc_feature (1)..( 8): Result.003 file - promoters60/4262562
taatcgaa

SEQ ID NO: 132284 - DNA, 8 bp, Unknown
  misc_feature (1)..( 8): Result.003 file - promoters60/4262562
atatcgaa

SEQ ID NO: 132285 - DNA, 8 bp, Unknown
  misc_feature (1)..( 8): Result.003 file - promoters60/4262562
ataccgaa

SEQ ID NO: 132286 - DNA, 8 bp, Unknown
  misc_feature (1)..( 8): Result.003 file - promoters60/4262562
atcgaaat

SEQ ID NO: 132287 - DNA, 8 bp, Unknown
  misc_feature (1)..( 8): Result.003 file - promoters60/4262562
tacgaaat

SEQ ID NO: 132288 - DNA, 8 bp, Unknown
  misc_feature (1)..( 8): Result.003 file - promoters60/4262562
taccaaaa

SEQ ID NO: 132289 - DNA, 8 bp, Unknown
  misc_feature (1)..( 8): Result.003 file - promoters60/4262562
atacttat

SEQ ID NO: 132290 - DNA, 8 bp, Unknown
  misc_feature (1)..( 8): Result.003 file - promoters60/4262562
ataattat

SEQ ID NO: 132291 - DNA, 8 bp, Unknown
  misc_feature (1)..( 8): Result.003 file - promoters60/4262562
atacatat

SEQ ID NO: 132292 - DNA, 7 bp, Unknown
  misc_feature (1)..( 7): Result.003 file - promoters60/4262562
atagatt

SEQ ID NO: 132293 - DNA, 7 bp, Unknown
  misc_feature (1)..( 7): Result.003 file - promoters60/4262562
ctagatt

SEQ ID NO: 132294 - DNA, 7 bp, Unknown
  misc_feature (1)..( 7): Result.003 file - promoters60/4262562
atatatt

SEQ ID NO: 132295 - DNA, 10 bp, Unknown
  misc_feature (1)..( 10): Result.003 file - promoters60/4265699
tttgtctgtt

SEQ ID NO: 132296 - DNA, 10 bp, Unknown
  misc_feature (1)..( 10): Result.003 file - promoters60/4265699
tttgtcggct

SEQ ID NO: 132297 - DNA, 11 bp, Unknown
  misc_feature (1)..( 11): Result.003 file - promoters60/4265699
tttagtcaaaa

SEQ ID NO: 132298 - DNA, 11 bp, Unknown
  misc_feature (1)..( 11): Result.003 file - promoters60/4265699
attagtaaaaa

SEQ ID NO: 132299 - DNA, 9 bp, Unknown
  misc_feature (1)..( 9): Result.003 file - promoters60/4265699
aaaagaggc

SEQ ID NO: 132300 - DNA, 9 bp, Unknown
  misc_feature (1)..( 9): Result.003 file - promoters60/4265699
aaaagaaaa

SEQ ID NO: 132301 - DNA, 9 bp, Unknown
  misc_feature (1)..( 9): Result.003 file - promoters60/4265699
taaataaat

SEQ ID NO: 132302 - DNA, 9 bp, Unknown
  misc_feature (1)..( 9): Result.003 file - promoters60/4265699
aatataaat

SEQ ID NO: 132303 - DNA, 14 bp, Unknown
  misc_feature (1)..( 14): Result.003 file - promoters60/4267125
cttgtcccaataac

SEQ ID NO: 132304 - DNA, 14 bp, Unknown
  misc_feature (1)..( 14): Result.003 file - promoters60/4267125
cttttcccaaaagt

SEQ ID NO: 132305 - DNA, 14 bp, Unknown
  misc_feature (1)..( 14): Result.003 file - promoters60/4267125
ggactcccaagaac

SEQ ID NO: 132306 - DNA, 14 bp, Unknown
  misc_feature (1)..( 14): Result.003 file - promoters60/4267125
gttttccgattcaa

SEQ ID NO: 132307 - DNA, 14 bp, Unknown
  misc_feature (1)..( 14): Result.003 file - promoters60/4267125
tttttcctttacaa

SEQ ID NO: 132308 - DNA, 14 bp, Unknown
  misc_feature (1)..( 14): Result.003 file - promoters60/4267125
cagaagctaagaac

SEQ ID NO: 132309 - DNA, 8 bp, Unknown
  misc_feature (1)..( 8): Result.003 file - promoters60/4270131
ttaataac

SEQ ID NO: 132310 - DNA, 8 bp, Unknown
  misc_feature (1)..( 8): Result.003 file - promoters60/4270131
ttaataac

SEQ ID NO: 132311 - DNA, 8 bp, Unknown
  misc_feature (1)..( 8): Result.003 file - promoters60/4270131
ataataat

SEQ ID NO: 132312 - DNA, 7 bp, Unknown
  misc_feature (1)..( 7): Result.003 file - promoters60/4270131
gcttaga

SEQ ID NO: 132313 - DNA, 7 bp, Unknown
  misc_feature (1)..( 7): Result.003 file - promoters60/4270131
gctgaga

SEQ ID NO: 132314 - DNA, 6 bp, Unknown
  misc_feature (1)..( 6): Result.003 file - promoters60/4270131
tttttt

SEQ ID NO: 132315 - DNA, 6 bp, Unknown
  misc_feature (1)..( 6): Result.003 file - promoters60/4270131
tttttt

SEQ ID NO: 132316 - DNA, 7 bp, Unknown
  misc_feature (1)..( 7): Result.003 file - promoters60/4270131
ttttttt

SEQ ID NO: 132317 - DNA, 7 bp, Unknown
  misc_feature (1)..( 7): Result.003 file - promoters60/4270131
tttgttt

SEQ ID NO: 132318 - DNA, 7 bp, Unknown
  misc_feature (1)..( 7): Result.003 file - promoters60/4270131
tttcttt

SEQ ID NO: 132319 - DNA, 7 bp, Unknown
  misc_feature (1)..( 7): Result.003 file - promoters60/4270131
tttattt

SEQ ID NO: 132320 - DNA, 7 bp, Unknown
  misc_feature (1)..( 7): Result.003 file - promoters60/4270131
ctaattt

SEQ ID NO: 132321 - DNA, 7 bp, Unknown
  misc_feature (1)..( 7): Result.003 file - promoters60/4270131
ctagttt

SEQ ID NO: 132322 - DNA, 9 bp, Unknown
  misc_feature (1)..( 9): Result.003 file - promoters60/4270131
ccgaatttt

SEQ ID NO: 132323 - DNA, 9 bp, Unknown
  misc_feature (1)..( 9): Result.003 file - promoters60/4270131
ccgactttt

SEQ ID NO: 132324 - DNA, 6 bp, Unknown
  misc_feature (1)..( 6): Result.003 file - promoters60/4270131
tttatc

SEQ ID NO: 132325 - DNA, 6 bp, Unknown
  misc_feature (1)..( 6): Result.003 file - promoters60/4270131
tttatc

SEQ ID NO: 132326 - DNA, 6 bp, Unknown
  misc_feature (1)..( 6): Result.003 file - promoters60/4270131
agcaaa

SEQ ID NO: 132327 - DNA, 6 bp, Unknown
  misc_feature (1)..( 6): Result.003 file - promoters60/4270131
agcaaa

SEQ ID NO: 132328 - DNA, 7 bp, Unknown
  misc_feature (1)..( 7): Result.003 file - promoters60/4270131
atgaaca

SEQ ID NO: 132329 - DNA, 7 bp, Unknown
  misc_feature (1)..( 7): Result.003 file - promoters60/4270131
atgtaca

SEQ ID NO: 132330 - DNA, 6 bp, Unknown
  misc_feature (1)..( 6): Result.003 file - promoters60/4270131
tgtttc

SEQ ID NO: 132331 - DNA, 6 bp, Unknown
  misc_feature (1)..( 6): Result.003 file - promoters60/4270131
tgtttc

SEQ ID NO: 132332 - DNA, 6 bp, Unknown
  misc_feature (1)..( 6): Result.003 file - promoters60/4270131
tataaa

SEQ ID NO: 132333 - DNA, 6 bp, Unknown
  misc_feature (1)..( 6): Result.003 file - promoters60/4270131
tataaa

SEQ ID NO: 132334 - DNA, 6 bp, Unknown
  misc_feature (1)..( 6): Result.003 file - promoters60/4270131
tataaa

SEQ ID NO: 132335 - DNA, 6 bp, Unknown
  misc_feature (1)..( 6): Result.003 file - promoters60/4270131
tataaa

SEQ ID NO: 132336 - DNA, 9 bp, Unknown
  misc_feature (1)..( 9): Result.003 file - promoters60/4281576
caaaaaaaa

SEQ ID NO: 132337 - DNA, 9 bp, Unknown
  misc_feature (1)..( 9): Result.003 file - promoters60/4281576
gaaaaaaaa

SEQ ID NO: 132338 - DNA, 9 bp, Unknown
  misc_feature (1)..( 9): Result.003 file - promoters60/4281576
taaaagaaa

SEQ ID NO: 132339 - DNA, 9 bp, Unknown
  misc_feature (1)..( 9): Result.003 file - promoters60/4281576
caacaaatc

SEQ ID NO: 132340 - DNA, 12 bp, Unknown
  misc_feature (1)..( 12): Result.003 file - promoters60/4281576
ttactttctgta

SEQ ID NO: 132341 - DNA, 12 bp, Unknown
  misc_feature (1)..( 12): Result.003 file - promoters60/4281576
ttcttttttgta

SEQ ID NO: 132342 - DNA, 12 bp, Unknown
  misc_feature (1)..( 12): Result.003 file - promoters60/4281576
taattttttggt

SEQ ID NO: 132343 - DNA, 12 bp, Unknown
  misc_feature (1)..( 12): Result.003 file - promoters60/4281576
taatatttttca

SEQ ID NO: 132344 - DNA, 12 bp, Unknown
  misc_feature (1)..( 12): Result.003 file - promoters60/4281576
aaattcttttat

SEQ ID NO: 132345 - DNA, 12 bp, Unknown
  misc_feature (1)..( 12): Result.003 file - promoters60/4281576
gtattatttcag

SEQ ID NO: 132346 - DNA, 13 bp, Unknown
  misc_feature (1)..( 13): Result.003 file - promoters60/4281576
agattctcttatt

SEQ ID NO: 132347 - DNA, 13 bp, Unknown
  misc_feature (1)..( 13): Result.003 file - promoters60/4281576
atattataggaaa

SEQ ID NO: 132348 - DNA, 13 bp, Unknown
  misc_feature (1)..( 13): Result.003 file - promoters60/4281576
ataatattctgct

SEQ ID NO: 132349 - DNA, 9 bp, Unknown
  misc_feature (1)..( 9): Result.003 file - promoters60/4281576
taacaaaac

SEQ ID NO: 132350 - DNA, 9 bp, Unknown
  misc_feature (1)..( 9): Result.003 file - promoters60/4281576
cttcaaaac

SEQ ID NO: 132351 - DNA, 9 bp, Unknown
  misc_feature (1)..( 9): Result.003 file - promoters60/4281576
taataaaat

SEQ ID NO: 132352 - DNA, 9 bp, Unknown
  misc_feature (1)..( 9): Result.003 file - promoters60/4281576
tcataaaaa

SEQ ID NO: 132353 - DNA, 8 bp, Unknown
  misc_feature (1)..( 8): Result.003 file - promoters60/4281576
gtctttct

SEQ ID NO: 132354 - DNA, 8 bp, Unknown
  misc_feature (1)..( 8): Result.003 file - promoters60/4281576
gtccttct

SEQ ID NO: 132355 - DNA, 8 bp, Unknown
  misc_feature (1)..( 8): Result.003 file - promoters60/4281576
gtttttct

SEQ ID NO: 132356 - DNA, 8 bp, Unknown
  misc_feature (1)..( 8): Result.003 file - promoters60/4281576
gtttttgt

SEQ ID NO: 132357 - DNA, 6 bp, Unknown
  misc_feature (1)..( 6): Result.003 file - promoters60/4281645
tatttt

SEQ ID NO: 132358 - DNA, 6 bp, Unknown
  misc_feature (1)..( 6): Result.003 file - promoters60/4281645
tatttt

SEQ ID NO: 132359 - DNA, 7 bp, Unknown
  misc_feature (1)..( 7): Result.003 file - promoters60/4281645
aaaacat

SEQ ID NO: 132360 - DNA, 7 bp, Unknown
  misc_feature (1)..( 7): Result.003 file - promoters60/4281645
aaaccat

SEQ ID NO: 132361 - DNA, 8 bp, Unknown
  misc_feature (1)..( 8): Result.003 file - promoters60/4281645
aatatgat

SEQ ID NO: 132362 - DNA, 8 bp, Unknown
  misc_feature (1)..( 8): Result.003 file - promoters60/4281645
aatgtgat

SEQ ID NO: 132363 - DNA, 8 bp, Unknown
  misc_feature (1)..( 8): Result.003 file - promoters60/4281645
aatatgcc

SEQ ID NO: 132364 - DNA, 7 bp, Unknown
  misc_feature (1)..( 7): Result.003 file - promoters60/4281645
gatgaat

SEQ ID NO: 132365 - DNA, 7 bp, Unknown
  misc_feature (1)..( 7): Result.003 file - promoters60/4281645
gatcaat

SEQ ID NO: 132366 - DNA, 6 bp, Unknown
  misc_feature (1)..( 6): Result.003 file - promoters60/4281645
aaattt

SEQ ID NO: 132367 - DNA, 6 bp, Unknown
  misc_feature (1)..( 6): Result.003 file - promoters60/4281645
aaattt

SEQ ID NO: 132368 - DNA, 6 bp, Unknown
  misc_feature (1)..( 6): Result.003 file - promoters60/4281645
agaaaa

SEQ ID NO: 132369 - DNA, 6 bp, Unknown
  misc_feature (1)..( 6): Result.003 file - promoters60/4281645
agaaaa

SEQ ID NO: 132370 - DNA, 8 bp, Unknown
  misc_feature (1)..( 8): Result.003 file - promoters60/4281645
agaaaatt

SEQ ID NO: 132371 - DNA, 8 bp, Unknown
  misc_feature (1)..( 8): Result.003 file - promoters60/4281645
agaatatt

SEQ ID NO: 132372 - DNA, 10 bp, Unknown
  misc_feature (1)..( 10): Result.003 file - promoters60/4281645
aacaataaaa

SEQ ID NO: 132373 - DNA, 10 bp, Unknown
  misc_feature (1)..( 10): Result.003 file - promoters60/4281645
aacaaaaaaa

SEQ ID NO: 132374 - DNA, 6 bp, Unknown
  misc_feature (1)..( 6): Result.003 file - promoters60/4281645
tgaaaa

SEQ ID NO: 132375 - DNA, 6 bp, Unknown
  misc_feature (1)..( 6): Result.003 file - promoters60/4281645
tgaaaa

SEQ ID NO: 132376 - DNA, 7 bp, Unknown
  misc_feature (1)..( 7): Result.003 file - promoters60/4281645
tgttata

SEQ ID NO: 132377 - DNA, 7 bp, Unknown
  misc_feature (1)..( 7): Result.003 file - promoters60/4281645
tgtgata

SEQ ID NO: 132378 - DNA, 7 bp, Unknown
  misc_feature (1)..( 7): Result.003 file - promoters60/4281645
aaagaac

SEQ ID NO: 132379 - DNA, 7 bp, Unknown
  misc_feature (1)..( 7): Result.003 file - promoters60/4281645
aaacaac

SEQ ID NO: 132380 - DNA, 8 bp, Unknown
  misc_feature (1)..( 8): Result.003 file - promoters60/4281645
ccggagaa

SEQ ID NO: 132381 - DNA, 8 bp, Unknown
  misc_feature (1)..( 8): Result.003 file - promoters60/4281645
ccggcgaa

SEQ ID NO: 132382 - DNA, 7 bp, Unknown
  misc_feature (1)..( 7): Result.003 file - promoters60/4281645
gtaactc

SEQ ID NO: 132383 - DNA, 7 bp, Unknown
  misc_feature (1)..( 7): Result.003 file - promoters60/4281645
gtaactc

SEQ ID NO: 132384 - DNA, 7 bp, Unknown
  misc_feature (1)..( 7): Result.003 file - promoters60/4281645
gtttatg

SEQ ID NO: 132385 - DNA, 7 bp, Unknown
  misc_feature (1)..( 7): Result.003 file - promoters60/4281645
gtttatg

SEQ ID NO: 132386 - DNA, 8 bp, Unknown
  misc_feature (1)..( 8): Result.003 file - promoters60/4281645
aactgaaa

SEQ ID NO: 132387 - DNA, 8 bp, Unknown
  misc_feature (1)..( 8): Result.003 file - promoters60/4281645
aacttaaa

SEQ ID NO: 132388 - DNA, 6 bp, Unknown
  misc_feature (1)..( 6): Result.003 file - promoters60/4281645
caaaaa

SEQ ID NO: 132389 - DNA, 6 bp, Unknown
  misc_feature (1)..( 6): Result.003 file - promoters60/4281645
caaaaa

SEQ ID NO: 132390 - DNA, 7 bp, Unknown
  misc_feature (1)..( 7): Result.003 file - promoters60/4281645
aaaatat

SEQ ID NO: 132391 - DNA, 7 bp, Unknown
  misc_feature (1)..( 7): Result.003 file - promoters60/4281645
aaaatat

SEQ ID NO: 132392 - DNA, 7 bp, Unknown
  misc_feature (1)..( 7): Result.003 file - promoters60/4281645
gtctctc

SEQ ID NO: 132393 - DNA, 7 bp, Unknown
  misc_feature (1)..( 7): Result.003 file - promoters60/4281645
gtctctc

SEQ ID NO: 132394 - DNA, 10 bp, Unknown
  misc_feature (1)..( 10): Result.003 file - promoters60/4281662
actttttaaa

SEQ ID NO: 132395 - DNA, 10 bp, Unknown
  misc_feature (1)..( 10): Result.003 file - promoters60/4281662
actttataat

SEQ ID NO: 132396 - DNA, 10 bp, Unknown
  misc_feature (1)..( 10): Result.003 file - promoters60/4281662
acattaaaat

SEQ ID NO: 132397 - DNA, 10 bp, Unknown
  misc_feature (1)..( 10): Result.003 file - promoters60/4281662
acttcataga

SEQ ID NO: 132398 - DNA, 8 bp, Unknown
  misc_feature (1)..( 8): Result.003 file - promoters60/4281662
aagataat

SEQ ID NO: 132399 - DNA, 8 bp, Unknown
  misc_feature (1)..( 8): Result.003 file - promoters60/4281662
aagatagt

SEQ ID NO: 132400 - DNA, 8 bp, Unknown
  misc_feature (1)..( 8): Result.003 file - promoters60/4281662
aagaaagt

SEQ ID NO: 132401 - DNA, 8 bp, Unknown
  misc_feature (1)..( 8): Result.003 file - promoters60/4281662
attttgtg

SEQ ID NO: 132402 - DNA, 8 bp, Unknown
  misc_feature (1)..( 8): Result.003 file - promoters60/4281662
attatgtc

SEQ ID NO: 132403 - DNA, 8 bp, Unknown
  misc_feature (1)..( 8): Result.003 file - promoters60/4281662
cttatgtc

SEQ ID NO: 132404 - DNA, 9 bp, Unknown
  misc_feature (1)..( 9): Result.003 file - promoters60/4281662
ttttaaaat

SEQ ID NO: 132405 - DNA, 9 bp, Unknown
  misc_feature (1)..( 9): Result.003 file - promoters60/4281662
cattaaaat

SEQ ID NO: 132406 - DNA, 9 bp, Unknown
  misc_feature (1)..( 9): Result.003 file - promoters60/4281662
ctttataat

SEQ ID NO: 132407 - DNA, 10 bp, Unknown
  misc_feature (1)..( 10): Result.003 file - promoters60/4281662
acttcataga

SEQ ID NO: 132408 - DNA, 7 bp, Unknown
  misc_feature (1)..( 7): Result.003 file - promoters60/4281662
tccattg

SEQ ID NO: 132409 - DNA, 7 bp, Unknown
  misc_feature (1)..( 7): Result.003 file - promoters60/4281662
tccattt

SEQ ID NO: 132410 - DNA, 7 bp, Unknown
  misc_feature (1)..( 7): Result.003 file - promoters60/4281662
accattt

SEQ ID NO: 132411 - DNA, 7 bp, Unknown
  misc_feature (1)..( 7): Result.003 file - promoters60/4281683
aacttat

SEQ ID NO: 132412 - DNA, 7 bp, Unknown
  misc_feature (1)..( 7): Result.003 file - promoters60/4281683
aacctat

SEQ ID NO: 132413 - DNA, 6 bp, Unknown
  misc_feature (1)..( 6): Result.003 file - promoters60/4281683
cttttc

SEQ ID NO: 132414 - DNA, 6 bp, Unknown
  misc_feature (1)..( 6): Result.003 file - promoters60/4281683
cttttc

SEQ ID NO: 132415 - DNA, 6 bp, Unknown
  misc_feature (1)..( 6): Result.003 file - promoters60/4281683
cttgaa

SEQ ID NO: 132416 - DNA, 6 bp, Unknown
  misc_feature (1)..( 6): Result.003 file - promoters60/4281683
cttgaa

SEQ ID NO: 132417 - DNA, 9 bp, Unknown
  misc_feature (1)..( 9): Result.003 file - promoters60/4281683
cacaatccc

SEQ ID NO: 132418 - DNA, 9 bp, Unknown
  misc_feature (1)..( 9): Result.003 file - promoters60/4281683
cacattccc

SEQ ID NO: 132419 - DNA, 6 bp, Unknown
  misc_feature (1)..( 6): Result.003 file - promoters60/4281683
agaaaa

SEQ ID NO: 132420 - DNA, 6 bp, Unknown
  misc_feature (1)..( 6): Result.003 file - promoters60/4281683
agaaaa

SEQ ID NO: 132421 - DNA, 12 bp, Unknown
  misc_feature (1)..( 12): Result.003 file - promoters60/4281683
cttttctatttc

SEQ ID NO: 132422 - DNA, 12 bp, Unknown
  misc_feature (1)..( 12): Result.003 file - promoters60/4281683
cttttcaatttc

SEQ ID NO: 132423 - DNA, 7 bp, Unknown
  misc_feature (1)..( 7): Result.003 file - promoters60/4281683
ctacatt

SEQ ID NO: 132424 - DNA, 7 bp, Unknown
  misc_feature (1)..( 7): Result.003 file - promoters60/4281683
ctatatt

SEQ ID NO: 132425 - DNA, 7 bp, Unknown
  misc_feature (1)..( 7): Result.003 file - promoters60/4281683
tttgtat

SEQ ID NO: 132426 - DNA, 7 bp, Unknown
  misc_feature (1)..( 7): Result.003 file - promoters60/4281683
tttgtat

SEQ ID NO: 132427 - DNA, 6 bp, Unknown
  misc_feature (1)..( 6): Result.003 file - promoters60/4281683
atttaa

SEQ ID NO: 132428 - DNA, 6 bp, Unknown
  misc_feature (1)..( 6): Result.003 file - promoters60/4281683
atttaa

SEQ ID NO: 132429 - DNA, 6 bp, Unknown
  misc_feature (1)..( 6): Result.003 file - promoters60/4281683
aactat

SEQ ID NO: 132430 - DNA, 6 bp, Unknown
  misc_feature (1)..( 6): Result.003 file - promoters60/4281683
aactat

SEQ ID NO: 132431 - DNA, 7 bp, Unknown
  misc_feature (1)..( 7): Result.003 file - promoters60/4281683
attcggt

SEQ ID NO: 132432 - DNA, 7 bp, Unknown
  misc_feature (1)..( 7): Result.003 file - promoters60/4281683
attcggt

SEQ ID NO: 132433 - DNA, 6 bp, Unknown
  misc_feature (1)..( 6): Result.003 file - promoters60/4281683
caacca

SEQ ID NO: 132434 - DNA, 6 bp, Unknown
  misc_feature (1)..( 6): Result.003 file - promoters60/4281683
caacca

SEQ ID NO: 132435 - DNA, 6 bp, Unknown
  misc_feature (1)..( 6): Result.003 file - promoters60/4281683
ggctga

SEQ ID NO: 132436 - DNA, 6 bp, Unknown
  misc_feature (1)..( 6): Result.003 file - promoters60/4281683
ggctga

SEQ ID NO: 132437 - DNA, 11 bp, Unknown
  misc_feature (1)..( 11): Result.003 file - promoters60/4281683
aggttctcaga

SEQ ID NO: 132438 - DNA, 11 bp, Unknown
  misc_feature (1)..( 11): Result.003 file - promoters60/4281683
agggtctgaga

SEQ ID NO: 132439 - DNA, 6 bp, Unknown
  misc_feature (1)..( 6): Result.003 file - promoters60/4281683
agattt

SEQ ID NO: 132440 - DNA, 6 bp, Unknown
  misc_feature (1)..( 6): Result.003 file - promoters60/4281683
agattt

SEQ ID NO: 132441 - DNA, 10 bp, Unknown
  misc_feature (1)..( 10): Result.003 file - promoters60/4281690
acaacaaagt

SEQ ID NO: 132442 - DNA, 10 bp, Unknown
  misc_feature (1)..( 10): Result.003 file - promoters60/4281690
aaaacaaacg

SEQ ID NO: 132443 - DNA, 10 bp, Unknown
  misc_feature (1)..( 10): Result.003 file - promoters60/4281690
ggaaaaaaaa

SEQ ID NO: 132444 - DNA, 10 bp, Unknown
  misc_feature (1)..( 10): Result.003 file - promoters60/4281690
ttaaaaaaag

SEQ ID NO: 132445 - DNA, 10 bp, Unknown
  misc_feature (1)..( 10): Result.003 file - promoters60/4281690
aaaacaattc

SEQ ID NO: 132446 - DNA, 10 bp, Unknown
  misc_feature (1)..( 10): Result.003 file - promoters60/4281690
caaacaaatg

SEQ ID NO: 132447 - DNA, 10 bp, Unknown
  misc_feature (1)..( 10): Result.003 file - promoters60/4281690
ataaaaaata

SEQ ID NO: 132448 - DNA, 10 bp, Unknown
  misc_feature (1)..( 10): Result.003 file - promoters60/4281690
ccactatata

SEQ ID NO: 132449 - DNA, 10 bp, Unknown
  misc_feature (1)..( 10): Result.003 file - promoters60/4281690
ccattatata

SEQ ID NO: 132450 - DNA, 10 bp, Unknown
  misc_feature (1)..( 10): Result.003 file - promoters60/4281690
cttttatata

SEQ ID NO: 132451 - DNA, 10 bp, Unknown
  misc_feature (1)..( 10): Result.003 file - promoters60/4281690
cttgtatata

SEQ ID NO: 132452 - DNA, 10 bp, Unknown
  misc_feature (1)..( 10): Result.003 file - promoters60/4281690
cgcctatata

SEQ ID NO: 132453 - DNA, 10 bp, Unknown
  misc_feature (1)..( 10): Result.003 file - promoters60/4281690
tccctataaa

SEQ ID NO: 132454 - DNA, 11 bp, Unknown
  misc_feature (1)..( 11): Result.003 file - promoters60/4281690
aacgaaaaata

SEQ ID NO: 132455 - DNA, 11 bp, Unknown
  misc_feature (1)..( 11): Result.003 file - promoters60/4281690
attataaaata

SEQ ID NO: 132456 - DNA, 11 bp, Unknown
  misc_feature (1)..( 11): Result.003 file - promoters60/4281690
tataaaaaatt

SEQ ID NO: 132457 - DNA, 11 bp, Unknown
  misc_feature (1)..( 11): Result.003 file - promoters60/4281690
attagaaaatt

SEQ ID NO: 132458 - DNA, 11 bp, Unknown
  misc_feature (1)..( 11): Result.003 file - promoters60/4281690
aggagataata

SEQ ID NO: 132459 - DNA, 11 bp, Unknown
  misc_feature (1)..( 11): Result.003 file - promoters60/4281690
catctaacata

SEQ ID NO: 132460 - DNA, 12 bp, Unknown
  misc_feature (1)..( 12): Result.003 file - promoters60/4281690
taaataaaagca

SEQ ID NO: 132461 - DNA, 12 bp, Unknown
  misc_feature (1)..( 12): Result.003 file - promoters60/4281690
attataaaatac

SEQ ID NO: 132462 - DNA, 12 bp, Unknown
  misc_feature (1)..( 12): Result.003 file - promoters60/4281690
attagaaaattt

SEQ ID NO: 132463 - DNA, 12 bp, Unknown
  misc_feature (1)..( 12): Result.003 file - promoters60/4281690
tttacaaacttt

SEQ ID NO: 132464 - DNA, 12 bp, Unknown
  misc_feature (1)..( 12): Result.003 file - promoters60/4281690
aggagataatat

SEQ ID NO: 132465 - DNA, 12 bp, Unknown
  misc_feature (1)..( 12): Result.003 file - promoters60/4281690
ctaacataggca

SEQ ID NO: 132466 - DNA, 8 bp, Unknown
  misc_feature (1)..( 8): Result.003 file - promoters60/4281711
taattaaa

SEQ ID NO: 132467 - DNA, 8 bp, Unknown
  misc_feature (1)..( 8): Result.003 file - promoters60/4281711
gaataaaa

SEQ ID NO: 132468 - DNA, 8 bp, Unknown
  misc_feature (1)..( 8): Result.003 file - promoters60/4281711
taataaac

SEQ ID NO: 132469 - DNA, 8 bp, Unknown
  misc_feature (1)..( 8): Result.003 file - promoters60/4281711
gaagaaat

SEQ ID NO: 132470 - DNA, 9 bp, Unknown
  misc_feature (1)..( 9): Result.003 file - promoters60/4281737
aactaaaat

SEQ ID NO: 132471 - DNA, 9 bp, Unknown
  misc_feature (1)..( 9): Result.003 file - promoters60/4281737
aacaaaaaa

SEQ ID NO: 132472 - DNA, 9 bp, Unknown
  misc_feature (1)..( 9): Result.003 file - promoters60/4281737
aattaaaat

SEQ ID NO: 132473 - DNA, 9 bp, Unknown
  misc_feature (1)..( 9): Result.003 file - promoters60/4281737
cacacaaag

SEQ ID NO: 132474 - DNA, 9 bp, Unknown
  misc_feature (1)..( 9): Result.003 file - promoters60/4281737
gacatagta

SEQ ID NO: 132475 - DNA, 9 bp, Unknown
  misc_feature (1)..( 9): Result.003 file - promoters60/4281737
ttttgtatt

SEQ ID NO: 132476 - DNA, 9 bp, Unknown
  misc_feature (1)..( 9): Result.003 file - promoters60/4281737
ccttgtatt

SEQ ID NO: 132477 - DNA, 9 bp, Unknown
  misc_feature (1)..( 9): Result.003 file - promoters60/4281737
aaatgtatt

SEQ ID NO: 132478 - DNA, 9 bp, Unknown
  misc_feature (1)..( 9): Result.003 file - promoters60/4281737
taatatata

SEQ ID NO: 132479 - DNA, 9 bp, Unknown
  misc_feature (1)..( 9): Result.003 file - promoters60/4281737
aaaagtatt

SEQ ID NO: 132480 - DNA, 9 bp, Unknown
  misc_feature (1)..( 9): Result.003 file - promoters60/4281737
aagtttttg

SEQ ID NO: 132481 - DNA, 9 bp, Unknown
  misc_feature (1)..( 9): Result.003 file - promoters60/4281737
gggtttttt

SEQ ID NO: 132482 - DNA, 9 bp, Unknown
  misc_feature (1)..( 9): Result.003 file - promoters60/4281737
ttgttgttg

SEQ ID NO: 132483 - DNA, 9 bp, Unknown
  misc_feature (1)..( 9): Result.003 file - promoters60/4281737
atgtttttg

SEQ ID NO: 132484 - DNA, 9 bp, Unknown
  misc_feature (1)..( 9): Result.003 file - promoters60/4281737
gggttttag

SEQ ID NO: 132485 - DNA, 9 bp, Unknown
  misc_feature (1)..( 9): Result.003 file - promoters60/4281737
tagttgttc

SEQ ID NO: 132486 - DNA, 14 bp, Unknown
  misc_feature (1)..( 14): Result.003 file - promoters60/4281737
attatcaatgggat

SEQ ID NO: 132487 - DNA, 14 bp, Unknown
  misc_feature (1)..( 14): Result.003 file - promoters60/4281737
tttataaatgtatt

SEQ ID NO: 132488 - DNA, 14 bp, Unknown
  misc_feature (1)..( 14): Result.003 file - promoters60/4281737
aatatatattctga

SEQ ID NO: 132489 - DNA, 14 bp, Unknown
  misc_feature (1)..( 14): Result.003 file - promoters60/4281737
aatttaaaaagaat

SEQ ID NO: 132490 - DNA, 14 bp, Unknown
  misc_feature (1)..( 14): Result.003 file - promoters60/4281737
tattgaaaagtatt

SEQ ID NO: 132491 - DNA, 18 bp, Unknown
  misc_feature (1)..( 18): Result.003 file - promoters60/4281737
cgtaagaaaaaaaaaaaa

SEQ ID NO: 132492 - DNA, 18 bp, Unknown
  misc_feature (1)..( 18): Result.003 file - promoters60/4281737
ttctataaaaaatatcgt

SEQ ID NO: 132493 - DNA, 18 bp, Unknown
  misc_feature (1)..( 18): Result.003 file - promoters60/4281737
atatacaaaaatgtaatt

SEQ ID NO: 132494 - DNA, 18 bp, Unknown
  misc_feature (1)..( 18): Result.003 file - promoters60/4281737
acagaggaaaatttaatt

SEQ ID NO: 132495 - DNA, 18 bp, Unknown
  misc_feature (1)..( 18): Result.003 file - promoters60/4281737
ctatataaaaccaagacg

SEQ ID NO: 132496 - DNA, 18 bp, Unknown
  misc_feature (1)..( 18): Result.003 file - promoters60/4281737
acctattaaagtagagat

SEQ ID NO: 132497 - DNA, 18 bp, Unknown
  misc_feature (1)..( 18): Result.003 file - promoters60/4281737
tagttttaataatgggcc

SEQ ID NO: 132498 - DNA, 17 bp, Unknown
  misc_feature (1)..( 17): Result.003 file - promoters60/4281737
cgggtccaaaggcttcg

SEQ ID NO: 132499 - DNA, 17 bp, Unknown
  misc_feature (1)..( 17): Result.003 file - promoters60/4281737
attttccaaagctcatt

SEQ ID NO: 132500 - DNA, 17 bp, Unknown
  misc_feature (1)..( 17): Result.003 file - promoters60/4281737
ttgcatcaatgcttatt

SEQ ID NO: 132501 - DNA, 17 bp, Unknown
  misc_feature (1)..( 17): Result.003 file - promoters60/4281737
ttagtactacatatgta

SEQ ID NO: 132502 - DNA, 17 bp, Unknown
  misc_feature (1)..( 17): Result.003 file - promoters60/4281737
atggtattactctcatt

SEQ ID NO: 132503 - DNA, 14 bp, Unknown
  misc_feature (1)..( 14): Result.003 file - promoters60/4281737
cacacctcgttttc

SEQ ID NO: 132504 - DNA, 14 bp, Unknown
  misc_feature (1)..( 14): Result.003 file - promoters60/4281737
caaagctcatttaa

SEQ ID NO: 132505 - DNA, 14 bp, Unknown
  misc_feature (1)..( 14): Result.003 file - promoters60/4281737
caatgcttattact

SEQ ID NO: 132506 - DNA, 14 bp, Unknown
  misc_feature (1)..( 14): Result.003 file - promoters60/4281737
cttgttttagtact

SEQ ID NO: 132507 - DNA, 14 bp, Unknown
  misc_feature (1)..( 14): Result.003 file - promoters60/4281737
tgaacctcattcaa

SEQ ID NO: 132508 - DNA, 13 bp, Unknown
  misc_feature (1)..( 13): Result.003 file - promoters60/4281737
aaaatgtaatttt

SEQ ID NO: 132509 - DNA, 13 bp, Unknown
  misc_feature (1)..( 13): Result.003 file - promoters60/4281737
ggatggtagtttt

SEQ ID NO: 132510 - DNA, 13 bp, Unknown
  misc_feature (1)..( 13): Result.003 file - promoters60/4281737
aaaatttaattcc

SEQ ID NO: 132511 - DNA, 13 bp, Unknown
  misc_feature (1)..( 13): Result.003 file - promoters60/4281737
tagagataatttt

SEQ ID NO: 132512 - DNA, 13 bp, Unknown
  misc_feature (1)..( 13): Result.003 file - promoters60/4281737
ttgatttaataaa

SEQ ID NO: 132513 - DNA, 10 bp, Unknown
  misc_feature (1)..( 10): Result.003 file - promoters60/4281744
gaaaaagata

SEQ ID NO: 132514 - DNA, 10 bp, Unknown
  misc_feature (1)..( 10): Result.003 file - promoters60/4281744
gaaatagatt

SEQ ID NO: 132515 - DNA, 10 bp, Unknown
  misc_feature (1)..( 10): Result.003 file - promoters60/4281744
ttagtagatt

SEQ ID NO: 132516 - DNA, 10 bp, Unknown
  misc_feature (1)..( 10): Result.003 file - promoters60/4281744
tatataaatt

SEQ ID NO: 132517 - DNA, 9 bp, Unknown
  misc_feature (1)..( 9): Result.003 file - promoters60/4281773
catataaag

SEQ ID NO: 132518 - DNA, 9 bp, Unknown
  misc_feature (1)..( 9): Result.003 file - promoters60/4281773
catatatac

SEQ ID NO: 132519 - DNA, 9 bp, Unknown
  misc_feature (1)..( 9): Result.003 file - promoters60/4281773
aataaaaag

SEQ ID NO: 132520 - DNA, 9 bp, Unknown
  misc_feature (1)..( 9): Result.003 file - promoters60/4281773
tatataaac

SEQ ID NO: 132521 - DNA, 9 bp, Unknown
  misc_feature (1)..( 9): Result.003 file - promoters60/4281773
tatatatat

SEQ ID NO: 132522 - DNA, 9 bp, Unknown
  misc_feature (1)..( 9): Result.003 file - promoters60/4281773
tatagataa

SEQ ID NO: 132523 - DNA, 12 bp, Unknown
  misc_feature (1)..( 12): Result.003 file - promoters60/4281773
gcaaataaatta

SEQ ID NO: 132524 - DNA, 12 bp, Unknown
  misc_feature (1)..( 12): Result.003 file - promoters60/4281773
ttaaaaaaagta

SEQ ID NO: 132525 - DNA, 12 bp, Unknown
  misc_feature (1)..( 12): Result.003 file - promoters60/4281773
tataatacattt

SEQ ID NO: 132526 - DNA, 12 bp, Unknown
  misc_feature (1)..( 12): Result.003 file - promoters60/4281773
gagaatacatac

SEQ ID NO: 132527 - DNA, 12 bp, Unknown
  misc_feature (1)..( 12): Result.003 file - promoters60/4281773
acataaacattt

SEQ ID NO: 132528 - DNA, 12 bp, Unknown
  misc_feature (1)..( 12): Result.003 file - promoters60/4281773
tataagacagta

SEQ ID NO: 132529 - DNA, 7 bp, Unknown
  misc_feature (1)..( 7): Result.003 file - promoters60/4281799
gcaaaag

SEQ ID NO: 132530 - DNA, 7 bp, Unknown
  misc_feature (1)..( 7): Result.003 file - promoters60/4281799
gcaaaag

SEQ ID NO: 132531 - DNA, 8 bp, Unknown
  misc_feature (1)..( 8): Result.003 file - promoters60/4281799
taaccccg

SEQ ID NO: 132532 - DNA, 8 bp, Unknown
  misc_feature (1)..( 8): Result.003 file - promoters60/4281799
taaacccg

SEQ ID NO: 132533 - DNA, 8 bp, Unknown
  misc_feature (1)..( 8): Result.003 file - promoters60/4281799
acaaattt

SEQ ID NO: 132534 - DNA, 8 bp, Unknown
  misc_feature (1)..( 8): Result.003 file - promoters60/4281799
acacattt

SEQ ID NO: 132535 - DNA, 6 bp, Unknown
  misc_feature (1)..( 6): Result.003 file - promoters60/4281799
ccatta

SEQ ID NO: 132536 - DNA, 6 bp, Unknown
  misc_feature (1)..( 6): Result.003 file - promoters60/4281799
ccatta

SEQ ID NO: 132537 - DNA, 7 bp, Unknown
  misc_feature (1)..( 7): Result.003 file - promoters60/4281799
attctta

SEQ ID NO: 132538 - DNA, 7 bp, Unknown
  misc_feature (1)..( 7): Result.003 file - promoters60/4281799
attatta

SEQ ID NO: 132539 - DNA, 8 bp, Unknown
  misc_feature (1)..( 8): Result.003 file - promoters60/4281799
actcaaaa

SEQ ID NO: 132540 - DNA, 8 bp, Unknown
  misc_feature (1)..( 8): Result.003 file - promoters60/4281799
actaaaaa

SEQ ID NO: 132541 - DNA, 7 bp, Unknown
  misc_feature (1)..( 7): Result.003 file - promoters60/4281799
atatatt

SEQ ID NO: 132542 - DNA, 7 bp, Unknown
  misc_feature (1)..( 7): Result.003 file - promoters60/4281799
atagatt

SEQ ID NO: 132543 - DNA, 6 bp, Unknown
  misc_feature (1)..( 6): Result.003 file - promoters60/4281799
agcaaa

SEQ ID NO: 132544 - DNA, 6 bp, Unknown
  misc_feature (1)..( 6): Result.003 file - promoters60/4281799
agcaaa

SEQ ID NO: 132545 - DNA, 7 bp, Unknown
  misc_feature (1)..( 7): Result.003 file - promoters60/4281799
aaagctt

SEQ ID NO: 132546 - DNA, 7 bp, Unknown
  misc_feature (1)..( 7): Result.003 file - promoters60/4281799
aaaactt

SEQ ID NO: 132547 - DNA, 7 bp, Unknown
  misc_feature (1)..( 7): Result.003 file - promoters60/4281799
aatgtgg

SEQ ID NO: 132548 - DNA, 7 bp, Unknown
  misc_feature (1)..( 7): Result.003 file - promoters60/4281799
aatttgg

SEQ ID NO: 132549 - DNA, 10 bp, Unknown
  misc_feature (1)..( 10): Result.003 file - promoters60/4281799
atgatattca

SEQ ID NO: 132550 - DNA, 10 bp, Unknown
  misc_feature (1)..( 10): Result.003 file - promoters60/4281799
ttgaaattca

SEQ ID NO: 132551 - DNA, 10 bp, Unknown
  misc_feature (1)..( 10): Result.003 file - promoters60/4281799
ttgaaaaagc

SEQ ID NO: 132552 - DNA, 11 bp, Unknown
  misc_feature (1)..( 11): Result.003 file - promoters60/4281799
gttttaataaa

SEQ ID NO: 132553 - DNA, 11 bp, Unknown
  misc_feature (1)..( 11): Result.003 file - promoters60/4281799
gttttattaaa

SEQ ID NO: 132554 - DNA, 9 bp, Unknown
  misc_feature (1)..( 9): Result.003 file - promoters60/4281799
aaatcattt

SEQ ID NO: 132555 - DNA, 9 bp, Unknown
  misc_feature (1)..( 9): Result.003 file - promoters60/4281799
aaatgattt

SEQ ID NO: 132556 - DNA, 7 bp, Unknown
  misc_feature (1)..( 7): Result.003 file - promoters60/4281799
ttttgta

SEQ ID NO: 132557 - DNA, 7 bp, Unknown
  misc_feature (1)..( 7): Result.003 file - promoters60/4281799
ttttgta

SEQ ID NO: 132558 - DNA, 7 bp, Unknown
  misc_feature (1)..( 7): Result.003 file - promoters60/4281799
tgttaat

SEQ ID NO: 132559 - DNA, 7 bp, Unknown
  misc_feature (1)..( 7): Result.003 file - promoters60/4281799
tgtaaat

SEQ ID NO: 132560 - DNA, 7 bp, Unknown
  misc_feature (1)..( 7): Result.003 file - promoters60/4281799
ttttgta

SEQ ID NO: 132561 - DNA, 7 bp, Unknown
  misc_feature (1)..( 7): Result.003 file - promoters60/4281799
tttggta

SEQ ID NO: 132562 - DNA, 7 bp, Unknown
  misc_feature (1)..( 7): Result.003 file - promoters60/4281799
aaataga

SEQ ID NO: 132563 - DNA, 7 bp, Unknown
  misc_feature (1)..( 7): Result.003 file - promoters60/4281799
aaataga

SEQ ID NO: 132564 - DNA, 7 bp, Unknown
  misc_feature (1)..( 7): Result.003 file - promoters60/4281799
tttccaa

SEQ ID NO: 132565 - DNA, 7 bp, Unknown
  misc_feature (1)..( 7): Result.003 file - promoters60/4281799
ttttcaa

SEQ ID NO: 132566 - DNA, 6 bp, Unknown
  misc_feature (1)..( 6): Result.003 file - promoters60/4281799
aaaaat

SEQ ID NO: 132567 - DNA, 6 bp, Unknown
  misc_feature (1)..( 6): Result.003 file - promoters60/4281799
aaaaat

SEQ ID NO: 132568 - DNA, 9 bp, Unknown
  misc_feature (1)..( 9): Result.003 file - promoters60/4281799
aaaagccct

SEQ ID NO: 132569 - DNA, 9 bp, Unknown
  misc_feature (1)..( 9): Result.003 file - promoters60/4281799
aaaatccct

SEQ ID NO: 132570 - DNA, 9 bp, Unknown
  misc_feature (1)..( 9): Result.003 file - promoters60/4281799
tattggaac

SEQ ID NO: 132571 - DNA, 9 bp, Unknown
  misc_feature (1)..( 9): Result.003 file - promoters60/4281799
tattgaaac

SEQ ID NO: 132572 - DNA, 9 bp, Unknown
  misc_feature (1)..( 9): Result.003 file - promoters60/4281837
gtttaatct

SEQ ID NO: 132573 - DNA, 9 bp, Unknown
  misc_feature (1)..( 9): Result.003 file - promoters60/4281837
ttttaatct

SEQ ID NO: 132574 - DNA, 10 bp, Unknown
  misc_feature (1)..( 10): Result.003 file - promoters60/4281837
cttgtaaatg

SEQ ID NO: 132575 - DNA, 10 bp, Unknown
  misc_feature (1)..( 10): Result.003 file - promoters60/4281837
cttgtaatca

SEQ ID NO: 132576 - DNA, 13 bp, Unknown
  misc_feature (1)..( 13): Result.003 file - promoters60/4281837
tatattactctat

SEQ ID NO: 132577 - DNA, 13 bp, Unknown
  misc_feature (1)..( 13): Result.003 file - promoters60/4281837
ttttttactcagc

SEQ ID NO: 132578 - DNA, 13 bp, Unknown
  misc_feature (1)..( 13): Result.003 file - promoters60/4281837
tataatactaatt

SEQ ID NO: 132579 - DNA, 13 bp, Unknown
  misc_feature (1)..( 13): Result.003 file - promoters60/4281837
gtgtctactttat

SEQ ID NO: 132580 - DNA, 9 bp, Unknown
  misc_feature (1)..( 9): Result.003 file - promoters60/4281837
ttgtctgtt

SEQ ID NO: 132581 - DNA, 9 bp, Unknown
  misc_feature (1)..( 9): Result.003 file - promoters60/4281837
ttgtctgtg

SEQ ID NO: 132582 - DNA, 9 bp, Unknown
  misc_feature (1)..( 9): Result.003 file - promoters60/4281837
tcctctgtt

SEQ ID NO: 132583 - DNA, 9 bp, Unknown
  misc_feature (1)..( 9): Result.003 file - promoters60/4281837
aagtcggtg

SEQ ID NO: 132584 - DNA, 10 bp, Unknown
  misc_feature (1)..( 10): Result.003 file - promoters60/4281837
gaaaaaaata

SEQ ID NO: 132585 - DNA, 10 bp, Unknown
  misc_feature (1)..( 10): Result.003 file - promoters60/4281837
caaaaacata

SEQ ID NO: 132586 - DNA, 10 bp, Unknown
  misc_feature (1)..( 10): Result.003 file - promoters60/4281837
taaaaaagtt

SEQ ID NO: 132587 - DNA, 10 bp, Unknown
  misc_feature (1)..( 10): Result.003 file - promoters60/4281837
taaaaaatca

SEQ ID NO: 132588 - DNA, 12 bp, Unknown
  misc_feature (1)..( 12): Result.003 file - promoters60/4281837
ctctatattact

SEQ ID NO: 132589 - DNA, 12 bp, Unknown
  misc_feature (1)..( 12): Result.003 file - promoters60/4281837
ttctatataagg

SEQ ID NO: 132590 - DNA, 12 bp, Unknown
  misc_feature (1)..( 12): Result.003 file - promoters60/4281837
gattataatact

SEQ ID NO: 132591 - DNA, 12 bp, Unknown
  misc_feature (1)..( 12): Result.003 file - promoters60/4281837
tactttattgtc

SEQ ID NO: 132592 - DNA, 9 bp, Unknown
  misc_feature (1)..( 9): Result.003 file - promoters60/4281837
gaaacaaaa

SEQ ID NO: 132593 - DNA, 9 bp, Unknown
  misc_feature (1)..( 9): Result.003 file - promoters60/4281837
aaaaaaaaa

SEQ ID NO: 132594 - DNA, 9 bp, Unknown
  misc_feature (1)..( 9): Result.003 file - promoters60/4281837
gaaccaacc

SEQ ID NO: 132595 - DNA, 9 bp, Unknown
  misc_feature (1)..( 9): Result.003 file - promoters60/4281837
taaatagat

SEQ ID NO: 132596 - DNA, 9 bp, Unknown
  misc_feature (1)..( 9): Result.003 file - promoters60/4281837
ttatttttt

SEQ ID NO: 132597 - DNA, 9 bp, Unknown
  misc_feature (1)..( 9): Result.003 file - promoters60/4281837
ttatcttta

SEQ ID NO: 132598 - DNA, 9 bp, Unknown
  misc_feature (1)..( 9): Result.003 file - promoters60/4281837
atattttag

SEQ ID NO: 132599 - DNA, 10 bp, Unknown
  misc_feature (1)..( 10): Result.003 file - promoters60/4281837
tgatttctta

SEQ ID NO: 132600 - DNA, 10 bp, Unknown
  misc_feature (1)..( 10): Result.003 file - promoters60/4281876
aataaattaa

SEQ ID NO: 132601 - DNA, 10 bp, Unknown
  misc_feature (1)..( 10): Result.003 file - promoters60/4281876
aatacattca

SEQ ID NO: 132602 - DNA, 10 bp, Unknown
  misc_feature (1)..( 10): Result.003 file - promoters60/4281876
aaaaaaagta

SEQ ID NO: 132603 - DNA, 10 bp, Unknown
  misc_feature (1)..( 10): Result.003 file - promoters60/4281876
aatcaatatt

SEQ ID NO: 132604 - DNA, 10 bp, Unknown
  misc_feature (1)..( 10): Result.003 file - promoters60/4281876
aataaaaatg

SEQ ID NO: 132605 - DNA, 10 bp, Unknown
  misc_feature (1)..( 10): Result.003 file - promoters60/4281876
aatacataca

SEQ ID NO: 132606 - DNA, 10 bp, Unknown
  misc_feature (1)..( 10): Result.003 file - promoters60/4281876
aatacacaaa

SEQ ID NO: 132607 - DNA, 10 bp, Unknown
  misc_feature (1)..( 10): Result.003 file - promoters60/4281876
gatcaagatt

SEQ ID NO: 132608 - DNA, 11 bp, Unknown
  misc_feature (1)..( 11): Result.003 file - promoters60/4281925
aaattaaaaca

SEQ ID NO: 132609 - DNA, 11 bp, Unknown
  misc_feature (1)..( 11): Result.003 file - promoters60/4281925
aaaataacaca

SEQ ID NO: 132610 - DNA, 11 bp, Unknown
  misc_feature (1)..( 11): Result.003 file - promoters60/4281925
taatcaaactc

SEQ ID NO: 132611 - DNA, 11 bp, Unknown
  misc_feature (1)..( 11): Result.003 file - promoters60/4281925
caataaaaatg

SEQ ID NO: 132612 - DNA, 11 bp, Unknown
  misc_feature (1)..( 11): Result.003 file - promoters60/4281925
aaattattatg

SEQ ID NO: 132613 - DNA, 10 bp, Unknown
  misc_feature (1)..( 10): Result.003 file - promoters60/4281925
taattttttt

SEQ ID NO: 132614 - DNA, 10 bp, Unknown
  misc_feature (1)..( 10): Result.003 file - promoters60/4281925
taaattttat

SEQ ID NO: 132615 - DNA, 10 bp, Unknown
  misc_feature (1)..( 10): Result.003 file - promoters60/4281925
aaattttgtt

SEQ ID NO: 132616 - DNA, 10 bp, Unknown
  misc_feature (1)..( 10): Result.003 file - promoters60/4281925
ttattttttt

SEQ ID NO: 132617 - DNA, 10 bp, Unknown
  misc_feature (1)..( 10): Result.003 file - promoters60/4281925
tacaagatag

SEQ ID NO: 132618 - DNA, 10 bp, Unknown
  misc_feature (1)..( 10): Result.003 file - promoters60/4281925
tacatgattt

SEQ ID NO: 132619 - DNA, 10 bp, Unknown
  misc_feature (1)..( 10): Result.003 file - promoters60/4281925
cacatgacat

SEQ ID NO: 132620 - DNA, 10 bp, Unknown
  misc_feature (1)..( 10): Result.003 file - promoters60/4281925
ttcatgattt

SEQ ID NO: 132621 - DNA, 11 bp, Unknown
  misc_feature (1)..( 11): Result.003 file - promoters60/4281925
ttataaatgta

SEQ ID NO: 132622 - DNA, 11 bp, Unknown
  misc_feature (1)..( 11): Result.003 file - promoters60/4281925
ctataaatatg

SEQ ID NO: 132623 - DNA, 11 bp, Unknown
  misc_feature (1)..( 11): Result.003 file - promoters60/4281925
atctaaaagta

SEQ ID NO: 132624 - DNA, 11 bp, Unknown
  misc_feature (1)..( 11): Result.003 file - promoters60/4281925
ttataaaaaac

SEQ ID NO: 132625 - DNA, 15 bp, Unknown
  misc_feature (1)..( 15): Result.003 file - promoters60/4281925
aaatttataaatgta

SEQ ID NO: 132626 - DNA, 15 bp, Unknown
  misc_feature (1)..( 15): Result.003 file - promoters60/4281925
taatttacatatcta

SEQ ID NO: 132627 - DNA, 15 bp, Unknown
  misc_feature (1)..( 15): Result.003 file - promoters60/4281925
tattttacttttcat

SEQ ID NO: 132628 - DNA, 15 bp, Unknown
  misc_feature (1)..( 15): Result.003 file - promoters60/4281925
aaattttttacaaga

SEQ ID NO: 132629 - DNA, 17 bp, Unknown
  misc_feature (1)..( 17): Result.003 file - promoters60/4281925
gtgtaatttttttctat

SEQ ID NO: 132630 - DNA, 17 bp, Unknown
  misc_feature (1)..( 17): Result.003 file - promoters60/4281925
aaattttgttttactat

SEQ ID NO: 132631 - DNA, 17 bp, Unknown
  misc_feature (1)..( 17): Result.003 file - promoters60/4281925
aatcattattttttttt

SEQ ID NO: 132632 - DNA, 17 bp, Unknown
  misc_feature (1)..( 17): Result.003 file - promoters60/4281925
atcattaatttgtttat

SEQ ID NO: 132633 - DNA, 11 bp, Unknown
  misc_feature (1)..( 11): Result.003 file - promoters60/4281925
caccatttttc

SEQ ID NO: 132634 - DNA, 11 bp, Unknown
  misc_feature (1)..( 11): Result.003 file - promoters60/4281925
tgaaatttttt

SEQ ID NO: 132635 - DNA, 11 bp, Unknown
  misc_feature (1)..( 11): Result.003 file - promoters60/4281925
aaatattttac

SEQ ID NO: 132636 - DNA, 11 bp, Unknown
  misc_feature (1)..( 11): Result.003 file - promoters60/4281925
aaaaatgttta

SEQ ID NO: 132637 - DNA, 12 bp, Unknown
  misc_feature (1)..( 12): Result.003 file - promoters60/4281961
tagataaaacag

SEQ ID NO: 132638 - DNA, 12 bp, Unknown
  misc_feature (1)..( 12): Result.003 file - promoters60/4281961
tagaaaaaaact

SEQ ID NO: 132639 - DNA, 12 bp, Unknown
  misc_feature (1)..( 12): Result.003 file - promoters60/4281961
tggttaaaacag

SEQ ID NO: 132640 - DNA, 12 bp, Unknown
  misc_feature (1)..( 12): Result.003 file - promoters60/4281961
cggaaagaacta

SEQ ID NO: 132641 - DNA, 12 bp, Unknown
  misc_feature (1)..( 12): Result.003 file - promoters60/4281961
ccaaacattaca

SEQ ID NO: 132642 - DNA, 12 bp, Unknown
  misc_feature (1)..( 12): Result.003 file - promoters60/4281961
acaaacgttact

SEQ ID NO: 132643 - DNA, 12 bp, Unknown
  misc_feature (1)..( 12): Result.003 file - promoters60/4281961
ttcagcattaca

SEQ ID NO: 132644 - DNA, 12 bp, Unknown
  misc_feature (1)..( 12): Result.003 file - promoters60/4281961
acaaaggttgtt

SEQ ID NO: 132645 - DNA, 10 bp, Unknown
  misc_feature (1)..( 10): Result.003 file - promoters60/4281961
tcgataaaat

SEQ ID NO: 132646 - DNA, 10 bp, Unknown
  misc_feature (1)..( 10): Result.003 file - promoters60/4281961
cctataaaag

SEQ ID NO: 132647 - DNA, 10 bp, Unknown
  misc_feature (1)..( 10): Result.003 file - promoters60/4281961
tcgttaaaag

SEQ ID NO: 132648 - DNA, 10 bp, Unknown
  misc_feature (1)..( 10): Result.003 file - promoters60/4281961
tttttaaaat

SEQ ID NO: 132649 - DNA, 10 bp, Unknown
  misc_feature (1)..( 10): Result.003 file - promoters60/4281961
ttcttaaaaa

SEQ ID NO: 132650 - DNA, 6 bp, Unknown
  misc_feature (1)..( 6): Result.003 file - promoters60/4281994
aatttt

SEQ ID NO: 132651 - DNA, 6 bp, Unknown
  misc_feature (1)..( 6): Result.003 file - promoters60/4281994
aatttt

SEQ ID NO: 132652 - DNA, 6 bp, Unknown
  misc_feature (1)..( 6): Result.003 file - promoters60/4281994
ttcaaa

SEQ ID NO: 132653 - DNA, 6 bp, Unknown
  misc_feature (1)..( 6): Result.003 file - promoters60/4281994
ttcaaa

SEQ ID NO: 132654 - DNA, 7 bp, Unknown
  misc_feature (1)..( 7): Result.003 file - promoters60/4281994
attcaaa

SEQ ID NO: 132655 - DNA, 7 bp, Unknown
  misc_feature (1)..( 7): Result.003 file - promoters60/4281994
atttaaa

SEQ ID NO: 132656 - DNA, 7 bp, Unknown
  misc_feature (1)..( 7): Result.003 file - promoters60/4281994
aaacaaa

SEQ ID NO: 132657 - DNA, 7 bp, Unknown
  misc_feature (1)..( 7): Result.003 file - promoters60/4281994
aaataaa

SEQ ID NO: 132658 - DNA, 7 bp, Unknown
  misc_feature (1)..( 7): Result.003 file - promoters60/4281994
aatattt

SEQ ID NO: 132659 - DNA, 7 bp, Unknown
  misc_feature (1)..( 7): Result.003 file - promoters60/4281994
tatattt

SEQ ID NO: 132660 - DNA, 7 bp, Unknown
  misc_feature (1)..( 7): Result.003 file - promoters60/4281994
aatatta

SEQ ID NO: 132661 - DNA, 8 bp, Unknown
  misc_feature (1)..( 8): Result.003 file - promoters60/4281994
agtagaat

SEQ ID NO: 132662 - DNA, 8 bp, Unknown
  misc_feature (1)..( 8): Result.003 file - promoters60/4281994
agtataat

SEQ ID NO: 132663 - DNA, 6 bp, Unknown
  misc_feature (1)..( 6): Result.003 file - promoters60/4281994
tttaaa

SEQ ID NO: 132664 - DNA, 6 bp, Unknown
  misc_feature (1)..( 6): Result.003 file - promoters60/4281994
tttaaa

SEQ ID NO: 132665 - DNA, 9 bp, Unknown
  misc_feature (1)..( 9): Result.003 file - promoters60/4281994
ataaaaatt

SEQ ID NO: 132666 - DNA, 9 bp, Unknown
  misc_feature (1)..( 9): Result.003 file - promoters60/4281994
ataaaatta

SEQ ID NO: 132667 - DNA, 9 bp, Unknown
  misc_feature (1)..( 9): Result.003 file - promoters60/4281994
ataatatta

SEQ ID NO: 132668 - DNA, 9 bp, Unknown
  misc_feature (1)..( 9): Result.003 file - promoters60/4281994
taaaaattt

SEQ ID NO: 132669 - DNA, 9 bp, Unknown
  misc_feature (1)..( 9): Result.003 file - promoters60/4281994
ataaaatta

SEQ ID NO: 132670 - DNA, 9 bp, Unknown
  misc_feature (1)..( 9): Result.003 file - promoters60/4281994
ataatatta

SEQ ID NO: 132671 - DNA, 9 bp, Unknown
  misc_feature (1)..( 9): Result.003 file - promoters60/4281994
attttaaag

SEQ ID NO: 132672 - DNA, 9 bp, Unknown
  misc_feature (1)..( 9): Result.003 file - promoters60/4281994
attttaatt

SEQ ID NO: 132673 - DNA, 9 bp, Unknown
  misc_feature (1)..( 9): Result.003 file - promoters60/4281994
atttcaaag

SEQ ID NO: 132674 - DNA, 7 bp, Unknown
  misc_feature (1)..( 7): Result.003 file - promoters60/4281994
ataatta

SEQ ID NO: 132675 - DNA, 7 bp, Unknown
  misc_feature (1)..( 7): Result.003 file - promoters60/4281994
atattta

SEQ ID NO: 132676 - DNA, 9 bp, Unknown
  misc_feature (1)..( 9): Result.003 file - promoters60/4281994
attaaatta

SEQ ID NO: 132677 - DNA, 9 bp, Unknown
  misc_feature (1)..( 9): Result.003 file - promoters60/4281994
tataactta

SEQ ID NO: 132678 - DNA, 9 bp, Unknown
  misc_feature (1)..( 9): Result.003 file - promoters60/4281994
tataaaact

SEQ ID NO: 132679 - DNA, 6 bp, Unknown
  misc_feature (1)..( 6): Result.003 file - promoters60/4281994
aaatta

SEQ ID NO: 132680 - DNA, 6 bp, Unknown
  misc_feature (1)..( 6): Result.003 file - promoters60/4281994
aaatta

SEQ ID NO: 132681 - DNA, 8 bp, Unknown
  misc_feature (1)..( 8): Result.003 file - promoters60/4281994
tattcata

SEQ ID NO: 132682 - DNA, 8 bp, Unknown
  misc_feature (1)..( 8): Result.003 file - promoters60/4281994
tattaata

SEQ ID NO: 132683 - DNA, 9 bp, Unknown
  misc_feature (1)..( 9): Result.003 file - promoters60/4281994
ataacttat

SEQ ID NO: 132684 - DNA, 9 bp, Unknown
  misc_feature (1)..( 9): Result.003 file - promoters60/4281994
ataatttat

SEQ ID NO: 132685 - DNA, 8 bp, Unknown
  misc_feature (1)..( 8): Result.003 file - promoters60/4281994
aaaaagaa

SEQ ID NO: 132686 - DNA, 8 bp, Unknown
  misc_feature (1)..( 8): Result.003 file - promoters60/4281994
aaaaagaa

SEQ ID NO: 132687 - DNA, 6 bp, Unknown
  misc_feature (1)..( 6): Result.003 file - promoters60/4281994
agtaaa

SEQ ID NO: 132688 - DNA, 6 bp, Unknown
  misc_feature (1)..( 6): Result.003 file - promoters60/4281994
agtaaa

SEQ ID NO: 132689 - DNA, 6 bp, Unknown
  misc_feature (1)..( 6): Result.003 file - promoters60/4281994
aaaaat

SEQ ID NO: 132690 - DNA, 6 bp, Unknown
  misc_feature (1)..( 6): Result.003 file - promoters60/4281994
aaaaat

SEQ ID NO: 132691 - DNA, 6 bp, Unknown
  misc_feature (1)..( 6): Result.003 file - promoters60/4281994
aataaa

SEQ ID NO: 132692 - DNA, 6 bp, Unknown
  misc_feature (1)..( 6): Result.003 file - promoters60/4281994
aataaa

SEQ ID NO: 132693 - DNA, 6 bp, Unknown
  misc_feature (1)..( 6): Result.003 file - promoters60/4281994
taattt

SEQ ID NO: 132694 - DNA, 6 bp, Unknown
  misc_feature (1)..( 6): Result.003 file - promoters60/4281994
taattt

SEQ ID NO: 132695 - DNA, 7 bp, Unknown
  misc_feature (1)..( 7): Result.003 file - promoters60/4281994
attcata

SEQ ID NO: 132696 - DNA, 7 bp, Unknown
  misc_feature (1)..( 7): Result.003 file - promoters60/4281994
attcata

SEQ ID NO: 132697 - DNA, 6 bp, Unknown
  misc_feature (1)..( 6): Result.003 file - promoters60/4281994
ctatat

SEQ ID NO: 132698 - DNA, 6 bp, Unknown
  misc_feature (1)..( 6): Result.003 file - promoters60/4281994
ctatat

SEQ ID NO: 132699 - DNA, 6 bp, Unknown
  misc_feature (1)..( 6): Result.003 file - promoters60/4281994
tatata

SEQ ID NO: 132700 - DNA, 6 bp, Unknown
  misc_feature (1)..( 6): Result.003 file - promoters60/4281994
tatata

SEQ ID NO: 132701 - DNA, 6 bp, Unknown
  misc_feature (1)..( 6): Result.003 file - promoters60/4281994
ttagaa

SEQ ID NO: 132702 - DNA, 6 bp, Unknown
  misc_feature (1)..( 6): Result.003 file - promoters60/4281994
ttagaa

SEQ ID NO: 132703 - DNA, 19 bp, Unknown
  misc_feature (1)..( 19): Result.003 file - promoters60/4281997
aacaaactacaaaagttta

SEQ ID NO: 132704 - DNA, 13 bp, Unknown
  misc_feature (1)..( 13): Result.003 file - promoters60/4281997
cagaaaatgtttt

SEQ ID NO: 132705 - DNA, 19 bp, Unknown
  misc_feature (1)..( 19): Result.003 file - promoters60/4281997
agtttagggaaaatggatc

SEQ ID NO: 132706 - DNA, 19 bp, Unknown
  misc_feature (1)..( 19): Result.003 file - promoters60/4281997
ccaacacattcaatatttt

SEQ ID NO: 132707 - DNA, 15 bp, Unknown
  misc_feature (1)..( 15): Result.003 file - promoters60/4281997
atcactgatccaaca

SEQ ID NO: 132708 - DNA, 15 bp, Unknown
  misc_feature (1)..( 15): Result.003 file - promoters60/4281997
atcactgatccaaca

SEQ ID NO: 132709 - DNA, 15 bp, Unknown
  misc_feature (1)..( 15): Result.003 file - promoters60/4281997
atcactgatccaaca

SEQ ID NO: 132710 - DNA, 7 bp, Unknown
  misc_feature (1)..( 7): Result.003 file - promoters60/4281997
aattatc

SEQ ID NO: 132711 - DNA, 7 bp, Unknown
  misc_feature (1)..( 7): Result.003 file - promoters60/4281997
cattatc

SEQ ID NO: 132712 - DNA, 7 bp, Unknown
  misc_feature (1)..( 7): Result.003 file - promoters60/4281997
cattata

SEQ ID NO: 132713 - DNA, 7 bp, Unknown
  misc_feature (1)..( 7): Result.003 file - promoters60/4281997
aattatc

SEQ ID NO: 132714 - DNA, 10 bp, Unknown
  misc_feature (1)..( 10): Result.003 file - promoters60/4282072
ctataatgaa

SEQ ID NO: 132715 - DNA, 10 bp, Unknown
  misc_feature (1)..( 10): Result.003 file - promoters60/4282072
ctatgatgaa

SEQ ID NO: 132716 - DNA, 6 bp, Unknown
  misc_feature (1)..( 6): Result.003 file - promoters60/4282072
atttgt

SEQ ID NO: 132717 - DNA, 6 bp, Unknown
  misc_feature (1)..( 6): Result.003 file - promoters60/4282072
atttgt

SEQ ID NO: 132718 - DNA, 8 bp, Unknown
  misc_feature (1)..( 8): Result.003 file - promoters60/4282072
tatgtttg

SEQ ID NO: 132719 - DNA, 8 bp, Unknown
  misc_feature (1)..( 8): Result.003 file - promoters60/4282072
tatgtttg

SEQ ID NO: 132720 - DNA, 6 bp, Unknown
  misc_feature (1)..( 6): Result.003 file - promoters60/4282072
actata

SEQ ID NO: 132721 - DNA, 6 bp, Unknown
  misc_feature (1)..( 6): Result.003 file - promoters60/4282072
actata

SEQ ID NO: 132722 - DNA, 7 bp, Unknown
  misc_feature (1)..( 7): Result.003 file - promoters60/4282072
caaaaac

SEQ ID NO: 132723 - DNA, 7 bp, Unknown
  misc_feature (1)..( 7): Result.003 file - promoters60/4282072
caacaac

SEQ ID NO: 132724 - DNA, 7 bp, Unknown
  misc_feature (1)..( 7): Result.003 file - promoters60/4282072
caaaatc

SEQ ID NO: 132725 - DNA, 7 bp, Unknown
  misc_feature (1)..( 7): Result.003 file - promoters60/4282072
caacatc

SEQ ID NO: 132726 - DNA, 9 bp, Unknown
  misc_feature (1)..( 9): Result.003 file - promoters60/4282072
actacaaac

SEQ ID NO: 132727 - DNA, 9 bp, Unknown
  misc_feature (1)..( 9): Result.003 file - promoters60/4282072
actccaaac

SEQ ID NO: 132728 - DNA, 6 bp, Unknown
  misc_feature (1)..( 6): Result.003 file - promoters60/4282072
aaaact

SEQ ID NO: 132729 - DNA, 6 bp, Unknown
  misc_feature (1)..( 6): Result.003 file - promoters60/4282072
aaaact

SEQ ID NO: 132730 - DNA, 8 bp, Unknown
  misc_feature (1)..( 8): Result.003 file - promoters60/4282072
aacaatat

SEQ ID NO: 132731 - DNA, 8 bp, Unknown
  misc_feature (1)..( 8): Result.003 file - promoters60/4282072
aaccatat

SEQ ID NO: 132732 - DNA, 8 bp, Unknown
  misc_feature (1)..( 8): Result.003 file - promoters60/4282072
aggcaaat

SEQ ID NO: 132733 - DNA, 8 bp, Unknown
  misc_feature (1)..( 8): Result.003 file - promoters60/4282072
agggaaat

SEQ ID NO: 132734 - DNA, 10 bp, Unknown
  misc_feature (1)..( 10): Result.003 file - promoters60/4282072
cagtttcgga

SEQ ID NO: 132735 - DNA, 10 bp, Unknown
  misc_feature (1)..( 10): Result.003 file - promoters60/4282072
cagtgtcgga

SEQ ID NO: 132736 - DNA, 9 bp, Unknown
  misc_feature (1)..( 9): Result.003 file - promoters60/4282072
ttttgatta

SEQ ID NO: 132737 - DNA, 9 bp, Unknown
  misc_feature (1)..( 9): Result.003 file - promoters60/4282072
ttttgttta

SEQ ID NO: 132738 - DNA, 6 bp, Unknown
  misc_feature (1)..( 6): Result.003 file - promoters60/4282072
taaaca

SEQ ID NO: 132739 - DNA, 6 bp, Unknown
  misc_feature (1)..( 6): Result.003 file - promoters60/4282072
taaaca

SEQ ID NO: 132740 - DNA, 7 bp, Unknown
  misc_feature (1)..( 7): Result.003 file - promoters60/4282072
taaatct

SEQ ID NO: 132741 - DNA, 7 bp, Unknown
  misc_feature (1)..( 7): Result.003 file - promoters60/4282072
taaatct

SEQ ID NO: 132742 - DNA, 8 bp, Unknown
  misc_feature (1)..( 8): Result.003 file - promoters60/4282072
tacttact

SEQ ID NO: 132743 - DNA, 8 bp, Unknown
  misc_feature (1)..( 8): Result.003 file - promoters60/4282072
tactaact

SEQ ID NO: 132744 - DNA, 10 bp, Unknown
  misc_feature (1)..( 10): Result.003 file - promoters60/4282072
aaaaatgaag

SEQ ID NO: 132745 - DNA, 10 bp, Unknown
  misc_feature (1)..( 10): Result.003 file - promoters60/4282072
aaaaataaag

SEQ ID NO: 132746 - DNA, 7 bp, Unknown
  misc_feature (1)..( 7): Result.003 file - promoters60/4282072
agaaaag

SEQ ID NO: 132747 - DNA, 7 bp, Unknown
  misc_feature (1)..( 7): Result.003 file - promoters60/4282072
agaaaag

SEQ ID NO: 132748 - DNA, 9 bp, Unknown
  misc_feature (1)..( 9): Result.003 file - promoters60/4282072
caaagaaga

SEQ ID NO: 132749 - DNA, 9 bp, Unknown
  misc_feature (1)..( 9): Result.003 file - promoters60/4282072
caaaaaaga

SEQ ID NO: 132750 - DNA, 10 bp, Unknown
  misc_feature (1)..( 10): Result.003 file - promoters60/4282072
attaaaaaaa

SEQ ID NO: 132751 - DNA, 10 bp, Unknown
  misc_feature (1)..( 10): Result.003 file - promoters60/4282072
attaaaaaaa

SEQ ID NO: 132752 - DNA, 7 bp, Unknown
  misc_feature (1)..( 7): Result.003 file - promoters60/4282126
tctgcaa

SEQ ID NO: 132753 - DNA, 7 bp, Unknown
  misc_feature (1)..( 7): Result.003 file - promoters60/4282126
tcttcaa

SEQ ID NO: 132754 - DNA, 8 bp, Unknown
  misc_feature (1)..( 8): Result.003 file - promoters60/4282126
catataca

SEQ ID NO: 132755 - DNA, 8 bp, Unknown
  misc_feature (1)..( 8): Result.003 file - promoters60/4282126
cataaaca

SEQ ID NO: 132756 - DNA, 8 bp, Unknown
  misc_feature (1)..( 8): Result.003 file - promoters60/4282126
tacgattt

SEQ ID NO: 132757 - DNA, 8 bp, Unknown
  misc_feature (1)..( 8): Result.003 file - promoters60/4282126
tacaattt

SEQ ID NO: 132758 - DNA, 6 bp, Unknown
  misc_feature (1)..( 6): Result.003 file - promoters60/4282126
aaacat

SEQ ID NO: 132759 - DNA, 6 bp, Unknown
  misc_feature (1)..( 6): Result.003 file - promoters60/4282126
aaacat

SEQ ID NO: 132760 - DNA, 6 bp, Unknown
  misc_feature (1)..( 6): Result.003 file - promoters60/4282126
taattg

SEQ ID NO: 132761 - DNA, 6 bp, Unknown
  misc_feature (1)..( 6): Result.003 file - promoters60/4282126
taattg

SEQ ID NO: 132762 - DNA, 7 bp, Unknown
  misc_feature (1)..( 7): Result.003 file - promoters60/4282126
ttagcat

SEQ ID NO: 132763 - DNA, 7 bp, Unknown
  misc_feature (1)..( 7): Result.003 file - promoters60/4282126
ttatcat

SEQ ID NO: 132764 - DNA, 11 bp, Unknown
  misc_feature (1)..( 11): Result.003 file - promoters60/4282126
aatttattgtt

SEQ ID NO: 132765 - DNA, 11 bp, Unknown
  misc_feature (1)..( 11): Result.003 file - promoters60/4282126
aatttatagtt

SEQ ID NO: 132766 - DNA, 11 bp, Unknown
  misc_feature (1)..( 11): Result.003 file - promoters60/4282126
tctttatttcc

SEQ ID NO: 132767 - DNA, 8 bp, Unknown
  misc_feature (1)..( 8): Result.003 file - promoters60/4282126
tttgtaat

SEQ ID NO: 132768 - DNA, 8 bp, Unknown
  misc_feature (1)..( 8): Result.003 file - promoters60/4282126
tttctaat

SEQ ID NO: 132769 - DNA, 8 bp, Unknown
  misc_feature (1)..( 8): Result.003 file - promoters60/4282126
tttgcaat

SEQ ID NO: 132770 - DNA, 9 bp, Unknown
  misc_feature (1)..( 9): Result.003 file - promoters60/4282126
aagctaatc

SEQ ID NO: 132771 - DNA, 9 bp, Unknown
  misc_feature (1)..( 9): Result.003 file - promoters60/4282126
aagcaaatc

SEQ ID NO: 132772 - DNA, 7 bp, Unknown
  misc_feature (1)..( 7): Result.003 file - promoters60/4282126
ttttttt

SEQ ID NO: 132773 - DNA, 7 bp, Unknown
  misc_feature (1)..( 7): Result.003 file - promoters60/4282126
tttgttt

SEQ ID NO: 132774 - DNA, 7 bp, Unknown
  misc_feature (1)..( 7): Result.003 file - promoters60/4282126
tttagat

SEQ ID NO: 132775 - DNA, 7 bp, Unknown
  misc_feature (1)..( 7): Result.003 file - promoters60/4282126
ttttgat

SEQ ID NO: 132776 - DNA, 8 bp, Unknown
  misc_feature (1)..( 8): Result.003 file - promoters60/4282126
aagttaga

SEQ ID NO: 132777 - DNA, 8 bp, Unknown
  misc_feature (1)..( 8): Result.003 file - promoters60/4282126
aagtcaga

SEQ ID NO: 132778 - DNA, 7 bp, Unknown
  misc_feature (1)..( 7): Result.003 file - promoters60/4282126
aaattta

SEQ ID NO: 132779 - DNA, 7 bp, Unknown
  misc_feature (1)..( 7): Result.003 file - promoters60/4282126
aaagtta

SEQ ID NO: 132780 - DNA, 7 bp, Unknown
  misc_feature (1)..( 7): Result.003 file - promoters60/4282126
ctcagac

SEQ ID NO: 132781 - DNA, 7 bp, Unknown
  misc_feature (1)..( 7): Result.003 file - promoters60/4282126
ctccgac

SEQ ID NO: 132782 - DNA, 6 bp, Unknown
  misc_feature (1)..( 6): Result.003 file - promoters60/4282126
cgagag

SEQ ID NO: 132783 - DNA, 6 bp, Unknown
  misc_feature (1)..( 6): Result.003 file - promoters60/4282126
cgagag

SEQ ID NO: 132784 - DNA, 8 bp, Unknown
  misc_feature (1)..( 8): Result.003 file - promoters60/4282126
ttgggaga

SEQ ID NO: 132785 - DNA, 8 bp, Unknown
  misc_feature (1)..( 8): Result.003 file - promoters60/4282126
ttgggaga

SEQ ID NO: 132786 - DNA, 6 bp, Unknown
  misc_feature (1)..( 6): Result.003 file - promoters60/4282126
gtgaca

SEQ ID NO: 132787 - DNA, 6 bp, Unknown
  misc_feature (1)..( 6): Result.003 file - promoters60/4282126
gtgaca

SEQ ID NO: 132788 - DNA, 7 bp, Unknown
  misc_feature (1)..( 7): Result.003 file - promoters60/4282126
agaccaa

SEQ ID NO: 132789 - DNA, 7 bp, Unknown
  misc_feature (1)..( 7): Result.003 file - promoters60/4282126
agagcaa

SEQ ID NO: 132790 - DNA, 9 bp, Unknown
  misc_feature (1)..( 9): Result.003 file - promoters60/4282126
aaagtaaac

SEQ ID NO: 132791 - DNA, 9 bp, Unknown
  misc_feature (1)..( 9): Result.003 file - promoters60/4282126
aaactaaac

SEQ ID NO: 132792 - DNA, 7 bp, Unknown
  misc_feature (1)..( 7): Result.003 file - promoters60/4282126
agaggaa

SEQ ID NO: 132793 - DNA, 7 bp, Unknown
  misc_feature (1)..( 7): Result.003 file - promoters60/4282126
agaagaa

SEQ ID NO: 132794 - DNA, 7 bp, Unknown
  misc_feature (1)..( 7): Result.003 file - promoters60/4282145
tcaaatg

SEQ ID NO: 132795 - DNA, 7 bp, Unknown
  misc_feature (1)..( 7): Result.003 file - promoters60/4282145
tcaaatg

SEQ ID NO: 132796 - DNA, 6 bp, Unknown
  misc_feature (1)..( 6): Result.003 file - promoters60/4282145
cataat

SEQ ID NO: 132797 - DNA, 6 bp, Unknown
  misc_feature (1)..( 6): Result.003 file - promoters60/4282145
cataat

SEQ ID NO: 132798 - DNA, 10 bp, Unknown
  misc_feature (1)..( 10): Result.003 file - promoters60/4282145
agagatgatt

SEQ ID NO: 132799 - DNA, 10 bp, Unknown
  misc_feature (1)..( 10): Result.003 file - promoters60/4282145
gaaaatgatt

SEQ ID NO: 132800 - DNA, 10 bp, Unknown
  misc_feature (1)..( 10): Result.003 file - promoters60/4282145
gaaactgata

SEQ ID NO: 132801 - DNA, 8 bp, Unknown
  misc_feature (1)..( 8): Result.003 file - promoters60/4282145
attatacg

SEQ ID NO: 132802 - DNA, 8 bp, Unknown
  misc_feature (1)..( 8): Result.003 file - promoters60/4282145
attagacg

SEQ ID NO: 132803 - DNA, 6 bp, Unknown
  misc_feature (1)..( 6): Result.003 file - promoters60/4282145
caaaaa

SEQ ID NO: 132804 - DNA, 6 bp, Unknown
  misc_feature (1)..( 6): Result.003 file - promoters60/4282145
caaaaa

SEQ ID NO: 132805 - DNA, 8 bp, Unknown
  misc_feature (1)..( 8): Result.003 file - promoters60/4282145
aaattaat

SEQ ID NO: 132806 - DNA, 8 bp, Unknown
  misc_feature (1)..( 8): Result.003 file - promoters60/4282145
aaactaat

SEQ ID NO: 132807 - DNA, 7 bp, Unknown
  misc_feature (1)..( 7): Result.003 file - promoters60/4282145
gttaaac

SEQ ID NO: 132808 - DNA, 7 bp, Unknown
  misc_feature (1)..( 7): Result.003 file - promoters60/4282145
gtttaac

SEQ ID NO: 132809 - DNA, 7 bp, Unknown
  misc_feature (1)..( 7): Result.003 file - promoters60/4282145
attttat

SEQ ID NO: 132810 - DNA, 7 bp, Unknown
  misc_feature (1)..( 7): Result.003 file - promoters60/4282145
attttat

SEQ ID NO: 132811 - DNA, 7 bp, Unknown
  misc_feature (1)..( 7): Result.003 file - promoters60/4282145
tttaaaa

SEQ ID NO: 132812 - DNA, 7 bp, Unknown
  misc_feature (1)..( 7): Result.003 file - promoters60/4282145
tttaaaa

SEQ ID NO: 132813 - DNA, 6 bp, Unknown
  misc_feature (1)..( 6): Result.003 file - promoters60/4282145
aatttg

SEQ ID NO: 132814 - DNA, 6 bp, Unknown
  misc_feature (1)..( 6): Result.003 file - promoters60/4282145
aatttg

SEQ ID NO: 132815 - DNA, 7 bp, Unknown
  misc_feature (1)..( 7): Result.003 file - promoters60/4282145
ttagtaa

SEQ ID NO: 132816 - DNA, 7 bp, Unknown
  misc_feature (1)..( 7): Result.003 file - promoters60/4282145
ttaataa

SEQ ID NO: 132817 - DNA, 7 bp, Unknown
  misc_feature (1)..( 7): Result.003 file - promoters60/4282145
tacgata

SEQ ID NO: 132818 - DNA, 7 bp, Unknown
  misc_feature (1)..( 7): Result.003 file - promoters60/4282145
tacaata

SEQ ID NO: 132819 - DNA, 8 bp, Unknown
  misc_feature (1)..( 8): Result.003 file - promoters60/4282145
acacaaca

SEQ ID NO: 132820 - DNA, 8 bp, Unknown
  misc_feature (1)..( 8): Result.003 file - promoters60/4282145
acaaaaca

SEQ ID NO: 132821 - DNA, 6 bp, Unknown
  misc_feature (1)..( 6): Result.003 file - promoters60/4282145
gacaaa

SEQ ID NO: 132822 - DNA, 6 bp, Unknown
  misc_feature (1)..( 6): Result.003 file - promoters60/4282145
gacaaa

SEQ ID NO: 132823 - DNA, 7 bp, Unknown
  misc_feature (1)..( 7): Result.003 file - promoters60/4282145
atactaa

SEQ ID NO: 132824 - DNA, 7 bp, Unknown
  misc_feature (1)..( 7): Result.003 file - promoters60/4282145
ataataa

SEQ ID NO: 132825 - DNA, 6 bp, Unknown
  misc_feature (1)..( 6): Result.003 file - promoters60/4282145
cttata

SEQ ID NO: 132826 - DNA, 6 bp, Unknown
  misc_feature (1)..( 6): Result.003 file - promoters60/4282145
cttata

SEQ ID NO: 132827 - DNA, 9 bp, Unknown
  misc_feature (1)..( 9): Result.003 file - promoters60/4282145
attttaaaa

SEQ ID NO: 132828 - DNA, 9 bp, Unknown
  misc_feature (1)..( 9): Result.003 file - promoters60/4282145
attttaaaa

SEQ ID NO: 132829 - DNA, 8 bp, Unknown
  misc_feature (1)..( 8): Result.003 file - promoters60/4282145
taataaaa

SEQ ID NO: 132830 - DNA, 8 bp, Unknown
  misc_feature (1)..( 8): Result.003 file - promoters60/4282145
aaattaaa

SEQ ID NO: 132831 - DNA, 8 bp, Unknown
  misc_feature (1)..( 8): Result.003 file - promoters60/4282145
aaagtaat

SEQ ID NO: 132832 - DNA, 6 bp, Unknown
  misc_feature (1)..( 6): Result.003 file - promoters60/4282145
ctacat

SEQ ID NO: 132833 - DNA, 6 bp, Unknown
  misc_feature (1)..( 6): Result.003 file - promoters60/4282145
ctacat

SEQ ID NO: 132834 - DNA, 6 bp, Unknown
  misc_feature (1)..( 6): Result.003 file - promoters60/4282145
aaatta

SEQ ID NO: 132835 - DNA, 6 bp, Unknown
  misc_feature (1)..( 6): Result.003 file - promoters60/4282145
aaatta

SEQ ID NO: 132836 - DNA, 9 bp, Unknown
  misc_feature (1)..( 9): Result.003 file - promoters60/4282145
atccatata

SEQ ID NO: 132837 - DNA, 9 bp, Unknown
  misc_feature (1)..( 9): Result.003 file - promoters60/4282145
atccttata

SEQ ID NO: 132838 - DNA, 7 bp, Unknown
  misc_feature (1)..( 7): Result.003 file - promoters60/4282145
tatgaaa

SEQ ID NO: 132839 - DNA, 7 bp, Unknown
  misc_feature (1)..( 7): Result.003 file - promoters60/4282145
tataaaa

SEQ ID NO: 132840 - DNA, 12 bp, Unknown
  misc_feature (1)..( 12): Result.003 file - promoters60/4282186
ccgagcttgtgc

SEQ ID NO: 132841 - DNA, 12 bp, Unknown
  misc_feature (1)..( 12): Result.003 file - promoters60/4282186
ccgatcttgtat

SEQ ID NO: 132842 - DNA, 12 bp, Unknown
  misc_feature (1)..( 12): Result.003 file - promoters60/4282186
tttgtcttatgc

SEQ ID NO: 132843 - DNA, 6 bp, Unknown
  misc_feature (1)..( 6): Result.003 file - promoters60/4282186
gcgtca

SEQ ID NO: 132844 - DNA, 6 bp, Unknown
  misc_feature (1)..( 6): Result.003 file - promoters60/4282186
gcgtca

SEQ ID NO: 132845 - DNA, 7 bp, Unknown
  misc_feature (1)..( 7): Result.003 file - promoters60/4282186
caaacta

SEQ ID NO: 132846 - DNA, 7 bp, Unknown
  misc_feature (1)..( 7): Result.003 file - promoters60/4282186
caaactt

SEQ ID NO: 132847 - DNA, 7 bp, Unknown
  misc_feature (1)..( 7): Result.003 file - promoters60/4282186
aaaactt

SEQ ID NO: 132848 - DNA, 8 bp, Unknown
  misc_feature (1)..( 8): Result.003 file - promoters60/4282186
caaactct

SEQ ID NO: 132849 - DNA, 8 bp, Unknown
  misc_feature (1)..( 8): Result.003 file - promoters60/4282186
caaaatct

SEQ ID NO: 132850 - DNA, 6 bp, Unknown
  misc_feature (1)..( 6): Result.003 file - promoters60/4282186
tacaca

SEQ ID NO: 132851 - DNA, 6 bp, Unknown
  misc_feature (1)..( 6): Result.003 file - promoters60/4282186
tacaca

SEQ ID NO: 132852 - DNA, 7 bp, Unknown
  misc_feature (1)..( 7): Result.003 file - promoters60/4282186
ttggttt

SEQ ID NO: 132853 - DNA, 7 bp, Unknown
  misc_feature (1)..( 7): Result.003 file - promoters60/4282186
ttgtttt

SEQ ID NO: 132854 - DNA, 6 bp, Unknown
  misc_feature (1)..( 6): Result.003 file - promoters60/4282186
ttggtt

SEQ ID NO: 132855 - DNA, 6 bp, Unknown
  misc_feature (1)..( 6): Result.003 file - promoters60/4282186
ttggtt

SEQ ID NO: 132856 - DNA, 9 bp, Unknown
  misc_feature (1)..( 9): Result.003 file - promoters60/4282186
agccaatca

SEQ ID NO: 132857 - DNA, 9 bp, Unknown
  misc_feature (1)..( 9): Result.003 file - promoters60/4282186
agctaatca

SEQ ID NO: 132858 - DNA, 6 bp, Unknown
  misc_feature (1)..( 6): Result.003 file - promoters60/4282186
tgttta

SEQ ID NO: 132859 - DNA, 6 bp, Unknown
  misc_feature (1)..( 6): Result.003 file - promoters60/4282186
tgttta

SEQ ID NO: 132860 - DNA, 6 bp, Unknown
  misc_feature (1)..( 6): Result.003 file - promoters60/4282186
tgaatt

SEQ ID NO: 132861 - DNA, 6 bp, Unknown
  misc_feature (1)..( 6): Result.003 file - promoters60/4282186
tgaatt

SEQ ID NO: 132862 - DNA, 8 bp, Unknown
  misc_feature (1)..( 8): Result.003 file - promoters60/4282186
ttaacaga

SEQ ID NO: 132863 - DNA, 8 bp, Unknown
  misc_feature (1)..( 8): Result.003 file - promoters60/4282186
ttaaaaga

SEQ ID NO: 132864 - DNA, 8 bp, Unknown
  misc_feature (1)..( 8): Result.003 file - promoters60/4282186
tgtctttc

SEQ ID NO: 132865 - DNA, 8 bp, Unknown
  misc_feature (1)..( 8): Result.003 file - promoters60/4282186
tgtcgttc

SEQ ID NO: 132866 - DNA, 8 bp, Unknown
  misc_feature (1)..( 8): Result.003 file - promoters60/4282186
caaagaaa

SEQ ID NO: 132867 - DNA, 8 bp, Unknown
  misc_feature (1)..( 8): Result.003 file - promoters60/4282186
caaataaa

SEQ ID NO: 132868 - DNA, 6 bp, Unknown
  misc_feature (1)..( 6): Result.003 file - promoters60/4282186
gaaagt

SEQ ID NO: 132869 - DNA, 6 bp, Unknown
  misc_feature (1)..( 6): Result.003 file - promoters60/4282186
gaaagt

SEQ ID NO: 132870 - DNA, 15 bp, Unknown
  misc_feature (1)..( 15): Result.003 file - promoters60/4282186
atcaaattagaaaat

SEQ ID NO: 132871 - DNA, 15 bp, Unknown
  misc_feature (1)..( 15): Result.003 file - promoters60/4282186
atcaaaatagacaat

SEQ ID NO: 132872 - DNA, 7 bp, Unknown
  misc_feature (1)..( 7): Result.003 file - promoters60/4282186
gaaccaa

SEQ ID NO: 132873 - DNA, 7 bp, Unknown
  misc_feature (1)..( 7): Result.003 file - promoters60/4282186
gaaacaa

SEQ ID NO: 132874 - DNA, 8 bp, Unknown
  misc_feature (1)..( 8): Result.003 file - promoters60/4282186
tataaaaa

SEQ ID NO: 132875 - DNA, 8 bp, Unknown
  misc_feature (1)..( 8): Result.003 file - promoters60/4282186
tatataaa

SEQ ID NO: 132876 - DNA, 8 bp, Unknown
  misc_feature (1)..( 8): Result.003 file - promoters60/4282186
tctaatct

SEQ ID NO: 132877 - DNA, 8 bp, Unknown
  misc_feature (1)..( 8): Result.003 file - promoters60/4282186
tctattct

SEQ ID NO: 132878 - DNA, 7 bp, Unknown
  misc_feature (1)..( 7): Result.003 file - promoters60/4282186
aataaaa

SEQ ID NO: 132879 - DNA, 7 bp, Unknown
  misc_feature (1)..( 7): Result.003 file - promoters60/4282186
aattaaa

SEQ ID NO: 132880 - DNA, 9 bp, Unknown
  misc_feature (1)..( 9): Result.003 file - promoters60/4282202
gaagttttg

SEQ ID NO: 132881 - DNA, 9 bp, Unknown
  misc_feature (1)..( 9): Result.003 file - promoters60/4282202
aaagtgttg

SEQ ID NO: 132882 - DNA, 9 bp, Unknown
  misc_feature (1)..( 9): Result.003 file - promoters60/4282202
aaactgttc

SEQ ID NO: 132883 - DNA, 6 bp, Unknown
  misc_feature (1)..( 6): Result.003 file - promoters60/4282202
gagaat

SEQ ID NO: 132884 - DNA, 6 bp, Unknown
  misc_feature (1)..( 6): Result.003 file - promoters60/4282202
gagaat

SEQ ID NO: 132885 - DNA, 8 bp, Unknown
  misc_feature (1)..( 8): Result.003 file - promoters60/4282202
tctaatgg

SEQ ID NO: 132886 - DNA, 8 bp, Unknown
  misc_feature (1)..( 8): Result.003 file - promoters60/4282202
tctaatgg

SEQ ID NO: 132887 - DNA, 8 bp, Unknown
  misc_feature (1)..( 8): Result.003 file - promoters60/4282202
caatttgt

SEQ ID NO: 132888 - DNA, 8 bp, Unknown
  misc_feature (1)..( 8): Result.003 file - promoters60/4282202
taatatgt

SEQ ID NO: 132889 - DNA, 8 bp, Unknown
  misc_feature (1)..( 8): Result.003 file - promoters60/4282202
caatttca

SEQ ID NO: 132890 - DNA, 15 bp, Unknown
  misc_feature (1)..( 15): Result.003 file - promoters60/4282202
aaataaaaaacaaaa

SEQ ID NO: 132891 - DNA, 15 bp, Unknown
  misc_feature (1)..( 15): Result.003 file - promoters60/4282202
aaatagaaaacatac

SEQ ID NO: 132892 - DNA, 15 bp, Unknown
  misc_feature (1)..( 15): Result.003 file - promoters60/4282202
caaccaaaaccatac

SEQ ID NO: 132893 - DNA, 6 bp, Unknown
  misc_feature (1)..( 6): Result.003 file - promoters60/4282202
cctcca

SEQ ID NO: 132894 - DNA, 6 bp, Unknown
  misc_feature (1)..( 6): Result.003 file - promoters60/4282202
cctcca

SEQ ID NO: 132895 - DNA, 6 bp, Unknown
  misc_feature (1)..( 6): Result.003 file - promoters60/4282202
gttttc

SEQ ID NO: 132896 - DNA, 6 bp, Unknown
  misc_feature (1)..( 6): Result.003 file - promoters60/4282202
gttttc

SEQ ID NO: 132897 - DNA, 11 bp, Unknown
  misc_feature (1)..( 11): Result.003 file - promoters60/4282202
agacaactttt

SEQ ID NO: 132898 - DNA, 11 bp, Unknown
  misc_feature (1)..( 11): Result.003 file - promoters60/4282202
agaaaactgtt

SEQ ID NO: 132899 - DNA, 11 bp, Unknown
  misc_feature (1)..( 11): Result.003 file - promoters60/4282202
cagaaagtgtt

SEQ ID NO: 132900 - DNA, 8 bp, Unknown
  misc_feature (1)..( 8): Result.003 file - promoters60/4282202
ttatcgta

SEQ ID NO: 132901 - DNA, 8 bp, Unknown
  misc_feature (1)..( 8): Result.003 file - promoters60/4282202
ttaacgta

SEQ ID NO: 132902 - DNA, 6 bp, Unknown
  misc_feature (1)..( 6): Result.003 file - promoters60/4282202
ttgatt

SEQ ID NO: 132903 - DNA, 6 bp, Unknown
  misc_feature (1)..( 6): Result.003 file - promoters60/4282202
ttgatt

SEQ ID NO: 132904 - DNA, 7 bp, Unknown
  misc_feature (1)..( 7): Result.003 file - promoters60/4282202
gtttttg

SEQ ID NO: 132905 - DNA, 7 bp, Unknown
  misc_feature (1)..( 7): Result.003 file - promoters60/4282202
gttgttg

SEQ ID NO: 132906 - DNA, 6 bp, Unknown
  misc_feature (1)..( 6): Result.003 file - promoters60/4282202
aaatta

SEQ ID NO: 132907 - DNA, 6 bp, Unknown
  misc_feature (1)..( 6): Result.003 file - promoters60/4282202
aaatta

SEQ ID NO: 132908 - DNA, 8 bp, Unknown
  misc_feature (1)..( 8): Result.003 file - promoters60/4282202
tttgatta

SEQ ID NO: 132909 - DNA, 8 bp, Unknown
  misc_feature (1)..( 8): Result.003 file - promoters60/4282202
tttaatta

SEQ ID NO: 132910 - DNA, 6 bp, Unknown
  misc_feature (1)..( 6): Result.003 file - promoters60/4282202
caaaac

SEQ ID NO: 132911 - DNA, 6 bp, Unknown
  misc_feature (1)..( 6): Result.003 file - promoters60/4282202
caaaac

SEQ ID NO: 132912 - DNA, 6 bp, Unknown
  misc_feature (1)..( 6): Result.003 file - promoters60/4282202
ttctta

SEQ ID NO: 132913 - DNA, 6 bp, Unknown
  misc_feature (1)..( 6): Result.003 file - promoters60/4282202
ttctta

SEQ ID NO: 132914 - DNA, 6 bp, Unknown
  misc_feature (1)..( 6): Result.003 file - promoters60/4282202
aacctc

SEQ ID NO: 132915 - DNA, 6 bp, Unknown
  misc_feature (1)..( 6): Result.003 file - promoters60/4282202
aacctc

SEQ ID NO: 132916 - DNA, 6 bp, Unknown
  misc_feature (1)..( 6): Result.003 file - promoters60/4282202
ttggat

SEQ ID NO: 132917 - DNA, 6 bp, Unknown
  misc_feature (1)..( 6): Result.003 file - promoters60/4282202
ttggat

SEQ ID NO: 132918 - DNA, 6 bp, Unknown
  misc_feature (1)..( 6): Result.003 file - promoters60/4282202
tcaaca

SEQ ID NO: 132919 - DNA, 6 bp, Unknown
  misc_feature (1)..( 6): Result.003 file - promoters60/4282202
tcaaca

SEQ ID NO: 132920 - DNA, 6 bp, Unknown
  misc_feature (1)..( 6): Result.003 file - promoters60/4282202
gtttgt

SEQ ID NO: 132921 - DNA, 6 bp, Unknown
  misc_feature (1)..( 6): Result.003 file - promoters60/4282202
gtttgt

SEQ ID NO: 132922 - DNA, 6 bp, Unknown
  misc_feature (1)..( 6): Result.003 file - promoters60/4282202
cttcac

SEQ ID NO: 132923 - DNA, 6 bp, Unknown
  misc_feature (1)..( 6): Result.003 file - promoters60/4282202
cttcac

SEQ ID NO: 132924 - DNA, 9 bp, Unknown
  misc_feature (1)..( 9): Result.003 file - promoters60/4282308
taatattat

SEQ ID NO: 132925 - DNA, 9 bp, Unknown
  misc_feature (1)..( 9): Result.003 file - promoters60/4282308
taatcttat

SEQ ID NO: 132926 - DNA, 8 bp, Unknown
  misc_feature (1)..( 8): Result.003 file - promoters60/4282308
gttacaat

SEQ ID NO: 132927 - DNA, 8 bp, Unknown
  misc_feature (1)..( 8): Result.003 file - promoters60/4282308
gttccaat

SEQ ID NO: 132928 - DNA, 8 bp, Unknown
  misc_feature (1)..( 8): Result.003 file - promoters60/4282308
gttacaag

SEQ ID NO: 132929 - DNA, 7 bp, Unknown
  misc_feature (1)..( 7): Result.003 file - promoters60/4282308
ggaaatt

SEQ ID NO: 132930 - DNA, 7 bp, Unknown
  misc_feature (1)..( 7): Result.003 file - promoters60/4282308
ggatatt

SEQ ID NO: 132931 - DNA, 10 bp, Unknown
  misc_feature (1)..( 10): Result.003 file - promoters60/4282308
caattaatac

SEQ ID NO: 132932 - DNA, 10 bp, Unknown
  misc_feature (1)..( 10): Result.003 file - promoters60/4282308
tgattattac

SEQ ID NO: 132933 - DNA, 10 bp, Unknown
  misc_feature (1)..( 10): Result.003 file - promoters60/4282308
tgattattgc

SEQ ID NO: 132934 - DNA, 14 bp, Unknown
  misc_feature (1)..( 14): Result.003 file - promoters60/4282308
aatgagtaatatac

SEQ ID NO: 132935 - DNA, 14 bp, Unknown
  misc_feature (1)..( 14): Result.003 file - promoters60/4282308
aataagttatatac

SEQ ID NO: 132936 - DNA, 14 bp, Unknown
  misc_feature (1)..( 14): Result.003 file - promoters60/4282308
cctaatttatcatt

SEQ ID NO: 132937 - DNA, 8 bp, Unknown
  misc_feature (1)..( 8): Result.003 file - promoters60/4282308
acaacaca

SEQ ID NO: 132938 - DNA, 8 bp, Unknown
  misc_feature (1)..( 8): Result.003 file - promoters60/4282308
acaagaca

SEQ ID NO: 132939 - DNA, 6 bp, Unknown
  misc_feature (1)..( 6): Result.003 file - promoters60/4282308
tttttt

SEQ ID NO: 132940 - DNA, 6 bp, Unknown
  misc_feature (1)..( 6): Result.003 file - promoters60/4282308
tttttt

SEQ ID NO: 132941 - DNA, 6 bp, Unknown
  misc_feature (1)..( 6): Result.003 file - promoters60/4282308
tcaaaa

SEQ ID NO: 132942 - DNA, 6 bp, Unknown
  misc_feature (1)..( 6): Result.003 file - promoters60/4282308
tcaaaa

SEQ ID NO: 132943 - DNA, 6 bp, Unknown
  misc_feature (1)..( 6): Result.003 file - promoters60/4282308
tcaaaa

SEQ ID NO: 132944 - DNA, 6 bp, Unknown
  misc_feature (1)..( 6): Result.003 file - promoters60/4282308
aagact

SEQ ID NO: 132945 - DNA, 6 bp, Unknown
  misc_feature (1)..( 6): Result.003 file - promoters60/4282308
aagact

SEQ ID NO: 132946 - DNA, 8 bp, Unknown
  misc_feature (1)..( 8): Result.003 file - promoters60/4282308
aatctctc

SEQ ID NO: 132947 - DNA, 8 bp, Unknown
  misc_feature (1)..( 8): Result.003 file - promoters60/4282308
aatttctc

SEQ ID NO: 132948 - DNA, 8 bp, Unknown
  misc_feature (1)..( 8): Result.003 file - promoters60/4282308
ttgcaatg

SEQ ID NO: 132949 - DNA, 8 bp, Unknown
  misc_feature (1)..( 8): Result.003 file - promoters60/4282308
ttgaaatg

SEQ ID NO: 132950 - DNA, 7 bp, Unknown
  misc_feature (1)..( 7): Result.003 file - promoters60/4282308
aaataaa

SEQ ID NO: 132951 - DNA, 7 bp, Unknown
  misc_feature (1)..( 7): Result.003 file - promoters60/4282308
aaataaa

SEQ ID NO: 132952 - DNA, 7 bp, Unknown
  misc_feature (1)..( 7): Result.003 file - promoters60/4282308
atcatgt

SEQ ID NO: 132953 - DNA, 7 bp, Unknown
  misc_feature (1)..( 7): Result.003 file - promoters60/4282308
atcgtgt

SEQ ID NO: 132954 - DNA, 11 bp, Unknown
  misc_feature (1)..( 11): Result.003 file - promoters60/4282308
ttcctcaaaca

SEQ ID NO: 132955 - DNA, 11 bp, Unknown
  misc_feature (1)..( 11): Result.003 file - promoters60/4282308
ttcttcaaaca

SEQ ID NO: 132956 - DNA, 7 bp, Unknown
  misc_feature (1)..( 7): Result.003 file - promoters60/4282308
tccctca

SEQ ID NO: 132957 - DNA, 7 bp, Unknown
  misc_feature (1)..( 7): Result.003 file - promoters60/4282308
tccatca

SEQ ID NO: 132958 - DNA, 6 bp, Unknown
  misc_feature (1)..( 6): Result.003 file - promoters60/4282308
attcat

SEQ ID NO: 132959 - DNA, 6 bp, Unknown
  misc_feature (1)..( 6): Result.003 file - promoters60/4282308
attcat

SEQ ID NO: 132960 - DNA, 7 bp, Unknown
  misc_feature (1)..( 7): Result.003 file - promoters60/4282308
acctaat

SEQ ID NO: 132961 - DNA, 7 bp, Unknown
  misc_feature (1)..( 7): Result.003 file - promoters60/4282308
acctaat

SEQ ID NO: 132962 - DNA, 8 bp, Unknown
  misc_feature (1)..( 8): Result.003 file - promoters60/4282308
ttctggtt

SEQ ID NO: 132963 - DNA, 8 bp, Unknown
  misc_feature (1)..( 8): Result.003 file - promoters60/4282308
ttctagtt

SEQ ID NO: 132964 - DNA, 8 bp, Unknown
  misc_feature (1)..( 8): Result.003 file - promoters60/4282308
tttaccaa

SEQ ID NO: 132965 - DNA, 8 bp, Unknown
  misc_feature (1)..( 8): Result.003 file - promoters60/4282308
ttttccaa

SEQ ID NO: 132966 - DNA, 6 bp, Unknown
  misc_feature (1)..( 6): Result.003 file - promoters60/4282308
caactt

SEQ ID NO: 132967 - DNA, 6 bp, Unknown
  misc_feature (1)..( 6): Result.003 file - promoters60/4282308
caactt

SEQ ID NO: 132968 - DNA, 7 bp, Unknown
  misc_feature (1)..( 7): Result.003 file - promoters60/4282308
gtcaaaa

SEQ ID NO: 132969 - DNA, 7 bp, Unknown
  misc_feature (1)..( 7): Result.003 file - promoters60/4282308
gtcaaaa

SEQ ID NO: 132970 - DNA, 7 bp, Unknown
  misc_feature (1)..( 7): Result.003 file - promoters60/4282308
aaattga

SEQ ID NO: 132971 - DNA, 7 bp, Unknown
  misc_feature (1)..( 7): Result.003 file - promoters60/4282308
aaattga

SEQ ID NO: 132972 - DNA, 7 bp, Unknown
  misc_feature (1)..( 7): Result.003 file - promoters60/4282308
catcagg

SEQ ID NO: 132973 - DNA, 7 bp, Unknown
  misc_feature (1)..( 7): Result.003 file - promoters60/4282308
catgagg

SEQ ID NO: 132974 - DNA, 19 bp, Unknown
  misc_feature (1)..( 19): Result.003 file - promoters60/4282316
aacaaactacaaaagttta

SEQ ID NO: 132975 - DNA, 13 bp, Unknown
  misc_feature (1)..( 13): Result.003 file - promoters60/4282316
cagaaaatgtttt

SEQ ID NO: 132976 - DNA, 19 bp, Unknown
  misc_feature (1)..( 19): Result.003 file - promoters60/4282316
agtttagggaaaatggatc

SEQ ID NO: 132977 - DNA, 19 bp, Unknown
  misc_feature (1)..( 19): Result.003 file - promoters60/4282316
ccaacacattcaatatttt

SEQ ID NO: 132978 - DNA, 15 bp, Unknown
  misc_feature (1)..( 15): Result.003 file - promoters60/4282316
atcactgatccaaca

SEQ ID NO: 132979 - DNA, 15 bp, Unknown
  misc_feature (1)..( 15): Result.003 file - promoters60/4282316
atcactgatccaaca

SEQ ID NO: 132980 - DNA, 15 bp, Unknown
  misc_feature (1)..( 15): Result.003 file - promoters60/4282316
atcactgatccaaca

SEQ ID NO: 132981 - DNA, 7 bp, Unknown
  misc_feature (1)..( 7): Result.003 file - promoters60/4282316
aattatc

SEQ ID NO: 132982 - DNA, 7 bp, Unknown
  misc_feature (1)..( 7): Result.003 file - promoters60/4282316
cattatc

SEQ ID NO: 132983 - DNA, 7 bp, Unknown
  misc_feature (1)..( 7): Result.003 file - promoters60/4282316
cattata

SEQ ID NO: 132984 - DNA, 7 bp, Unknown
  misc_feature (1)..( 7): Result.003 file - promoters60/4282316
aattatc

SEQ ID NO: 132985 - DNA, 6 bp, Unknown
  misc_feature (1)..( 6): Result.003 file - promoters60/4282320
tgtggc

SEQ ID NO: 132986 - DNA, 6 bp, Unknown
  misc_feature (1)..( 6): Result.003 file - promoters60/4282320
tgtggc

SEQ ID NO: 132987 - DNA, 7 bp, Unknown
  misc_feature (1)..( 7): Result.003 file - promoters60/4282320
gagaaaa

SEQ ID NO: 132988 - DNA, 7 bp, Unknown
  misc_feature (1)..( 7): Result.003 file - promoters60/4282320
gagcaaa

SEQ ID NO: 132989 - DNA, 7 bp, Unknown
  misc_feature (1)..( 7): Result.003 file - promoters60/4282320
aagcaga

SEQ ID NO: 132990 - DNA, 7 bp, Unknown
  misc_feature (1)..( 7): Result.003 file - promoters60/4282320
aagaaga

SEQ ID NO: 132991 - DNA, 9 bp, Unknown
  misc_feature (1)..( 9): Result.003 file - promoters60/4282320
cagaggaag

SEQ ID NO: 132992 - DNA, 9 bp, Unknown
  misc_feature (1)..( 9): Result.003 file - promoters60/4282320
cagagaaag

SEQ ID NO: 132993 - DNA, 6 bp, Unknown
  misc_feature (1)..( 6): Result.003 file - promoters60/4282320
aatgga

SEQ ID NO: 132994 - DNA, 6 bp, Unknown
  misc_feature (1)..( 6): Result.003 file - promoters60/4282320
aatgga

SEQ ID NO: 132995 - DNA, 7 bp, Unknown
  misc_feature (1)..( 7): Result.003 file - promoters60/4282320
atatcat

SEQ ID NO: 132996 - DNA, 7 bp, Unknown
  misc_feature (1)..( 7): Result.003 file - promoters60/4282320
atatcat

SEQ ID NO: 132997 - DNA, 7 bp, Unknown
  misc_feature (1)..( 7): Result.003 file - promoters60/4282320
aagattt

SEQ ID NO: 132998 - DNA, 7 bp, Unknown
  misc_feature (1)..( 7): Result.003 file - promoters60/4282320
aagcttt

SEQ ID NO: 132999 - DNA, 7 bp, Unknown
  misc_feature (1)..( 7): Result.003 file - promoters60/4282320
ttaccag

SEQ ID NO: 133000 - DNA, 7 bp, Unknown
  misc_feature (1)..( 7): Result.003 file - promoters60/4282320
ttaacag

SEQ ID NO: 133001 - DNA, 7 bp, Unknown
  misc_feature (1)..( 7): Result.003 file - promoters60/4282320
actggaa

SEQ ID NO: 133002 - DNA, 7 bp, Unknown
  misc_feature (1)..( 7): Result.003 file - promoters60/4282320
actggaa

SEQ ID NO: 133003 - DNA, 6 bp, Unknown
  misc_feature (1)..( 6): Result.003 file - promoters60/4282320
ttctca

SEQ ID NO: 133004 - DNA, 6 bp, Unknown
  misc_feature (1)..( 6): Result.003 file - promoters60/4282320
ttctca

SEQ ID NO: 133005 - DNA, 7 bp, Unknown
  misc_feature (1)..( 7): Result.003 file - promoters60/4282320
ctgaagt

SEQ ID NO: 133006 - DNA, 7 bp, Unknown
  misc_feature (1)..( 7): Result.003 file - promoters60/4282320
ttgaagt

SEQ ID NO: 133007 - DNA, 7 bp, Unknown
  misc_feature (1)..( 7): Result.003 file - promoters60/4282320
ttgaaga

SEQ ID NO: 133008 - DNA, 6 bp, Unknown
  misc_feature (1)..( 6): Result.003 file - promoters60/4282320
atggaa

SEQ ID NO: 133009 - DNA, 6 bp, Unknown
  misc_feature (1)..( 6): Result.003 file - promoters60/4282320
atggaa

SEQ ID NO: 133010 - DNA, 6 bp, Unknown
  misc_feature (1)..( 6): Result.003 file - promoters60/4282320
aaagaa

SEQ ID NO: 133011 - DNA, 6 bp, Unknown
  misc_feature (1)..( 6): Result.003 file - promoters60/4282320
aaagaa

SEQ ID NO: 133012 - DNA, 7 bp, Unknown
  misc_feature (1)..( 7): Result.003 file - promoters60/4282320
tagagaa

SEQ ID NO: 133013 - DNA, 7 bp, Unknown
  misc_feature (1)..( 7): Result.003 file - promoters60/4282320
tagagaa

SEQ ID NO: 133014 - DNA, 7 bp, Unknown
  misc_feature (1)..( 7): Result.003 file - promoters60/4282320
aaggaga

SEQ ID NO: 133015 - DNA, 7 bp, Unknown
  misc_feature (1)..( 7): Result.003 file - promoters60/4282320
aagtaga

SEQ ID NO: 133016 - DNA, 7 bp, Unknown
  misc_feature (1)..( 7): Result.003 file - promoters60/4282320
aaagaag

SEQ ID NO: 133017 - DNA, 7 bp, Unknown
  misc_feature (1)..( 7): Result.003 file - promoters60/4282320
aaagaag

SEQ ID NO: 133018 - DNA, 6 bp, Unknown
  misc_feature (1)..( 6): Result.003 file - promoters60/4282320
caaaag

SEQ ID NO: 133019 - DNA, 6 bp, Unknown
  misc_feature (1)..( 6): Result.003 file - promoters60/4282320
caaaag

SEQ ID NO: 133020 - DNA, 6 bp, Unknown
  misc_feature (1)..( 6): Result.003 file - promoters60/4282320
caacac

SEQ ID NO: 133021 - DNA, 6 bp, Unknown
  misc_feature (1)..( 6): Result.003 file - promoters60/4282320
caacac

SEQ ID NO: 133022 - DNA, 7 bp, Unknown
  misc_feature (1)..( 7): Result.003 file - promoters60/4282320
ctctatt

SEQ ID NO: 133023 - DNA, 7 bp, Unknown
  misc_feature (1)..( 7): Result.003 file - promoters60/4282320
ctccatt

SEQ ID NO: 133024 - DNA, 10 bp, Unknown
  misc_feature (1)..( 10): Result.003 file - promoters60/4282324
tcataattac

SEQ ID NO: 133025 - DNA, 10 bp, Unknown
  misc_feature (1)..( 10): Result.003 file - promoters60/4282324
tcaaaattcg

SEQ ID NO: 133026 - DNA, 10 bp, Unknown
  misc_feature (1)..( 10): Result.003 file - promoters60/4282324
caataattat

SEQ ID NO: 133027 - DNA, 10 bp, Unknown
  misc_feature (1)..( 10): Result.003 file - promoters60/4282324
atctaactat

SEQ ID NO: 133028 - DNA, 10 bp, Unknown
  misc_feature (1)..( 10): Result.003 file - promoters60/4282324
actactaaac

SEQ ID NO: 133029 - DNA, 10 bp, Unknown
  misc_feature (1)..( 10): Result.003 file - promoters60/4282324
aacactaaaa

SEQ ID NO: 133030 - DNA, 10 bp, Unknown
  misc_feature (1)..( 10): Result.003 file - promoters60/4282324
aacaccaaaa

SEQ ID NO: 133031 - DNA, 12 bp, Unknown
  misc_feature (1)..( 12): Result.003 file - promoters60/4282324
taaaattcattt

SEQ ID NO: 133032 - DNA, 10 bp, Unknown
  misc_feature (1)..( 10): Result.003 file - promoters60/4282324
ttattcgttt

SEQ ID NO: 133033 - DNA, 12 bp, Unknown
  misc_feature (1)..( 12): Result.003 file - promoters60/4282324
taaaaatcagac

SEQ ID NO: 133034 - DNA, 16 bp, Unknown
  misc_feature (1)..( 16): Result.003 file - promoters60/4282324
aaaatttctactaaag

SEQ ID NO: 133035 - DNA, 16 bp, Unknown
  misc_feature (1)..( 16): Result.003 file - promoters60/4282324
agattttttaccaaac

SEQ ID NO: 133036 - DNA, 16 bp, Unknown
  misc_feature (1)..( 16): Result.003 file - promoters60/4282324
gttaggtaaactaaag

SEQ ID NO: 133037 - DNA, 16 bp, Unknown
  misc_feature (1)..( 16): Result.003 file - promoters60/4282324
agatttgttagagaga

SEQ ID NO: 133038 - DNA, 7 bp, Unknown
  misc_feature (1)..( 7): Result.003 file - promoters60/4282324
aaaacaa

SEQ ID NO: 133039 - DNA, 7 bp, Unknown
  misc_feature (1)..( 7): Result.003 file - promoters60/4282324
aaaacaa

SEQ ID NO: 133040 - DNA, 7 bp, Unknown
  misc_feature (1)..( 7): Result.003 file - promoters60/4282324
aaaacag

SEQ ID NO: 133041 - DNA, 11 bp, Unknown
  misc_feature (1)..( 11): Result.003 file - promoters60/4282324
ctacaaatcca

SEQ ID NO: 133042 - DNA, 11 bp, Unknown
  misc_feature (1)..( 11): Result.003 file - promoters60/4282324
tataaaatccc

SEQ ID NO: 133043 - DNA, 11 bp, Unknown
  misc_feature (1)..( 11): Result.003 file - promoters60/4282324
ctataaatccc

SEQ ID NO: 133044 - DNA, 11 bp, Unknown
  misc_feature (1)..( 11): Result.003 file - promoters60/4282324
atttaaatccc

SEQ ID NO: 133045 - DNA, 7 bp, Unknown
  misc_feature (1)..( 7): Result.003 file - promoters60/4282327
aaattaa

SEQ ID NO: 133046 - DNA, 7 bp, Unknown
  misc_feature (1)..( 7): Result.003 file - promoters60/4282327
aaagtaa

SEQ ID NO: 133047 - DNA, 7 bp, Unknown
  misc_feature (1)..( 7): Result.003 file - promoters60/4282327
aattagt

SEQ ID NO: 133048 - DNA, 7 bp, Unknown
  misc_feature (1)..( 7): Result.003 file - promoters60/4282327
aataagt

SEQ ID NO: 133049 - DNA, 6 bp, Unknown
  misc_feature (1)..( 6): Result.003 file - promoters60/4282327
gaaaag

SEQ ID NO: 133050 - DNA, 6 bp, Unknown
  misc_feature (1)..( 6): Result.003 file - promoters60/4282327
gaaaag

SEQ ID NO: 133051 - DNA, 6 bp, Unknown
  misc_feature (1)..( 6): Result.003 file - promoters60/4282327
aaaaat

SEQ ID NO: 133052 - DNA, 6 bp, Unknown
  misc_feature (1)..( 6): Result.003 file - promoters60/4282327
aaaaat

SEQ ID NO: 133053 - DNA, 6 bp, Unknown
  misc_feature (1)..( 6): Result.003 file - promoters60/4282327
gtttaa

SEQ ID NO: 133054 - DNA, 6 bp, Unknown
  misc_feature (1)..( 6): Result.003 file - promoters60/4282327
gtttaa

SEQ ID NO: 133055 - DNA, 8 bp, Unknown
  misc_feature (1)..( 8): Result.003 file - promoters60/4282327
gcaacatt

SEQ ID NO: 133056 - DNA, 8 bp, Unknown
  misc_feature (1)..( 8): Result.003 file - promoters60/4282327
gcaagatt

SEQ ID NO: 133057 - DNA, 7 bp, Unknown
  misc_feature (1)..( 7): Result.003 file - promoters60/4282327
attcgtc

SEQ ID NO: 133058 - DNA, 7 bp, Unknown
  misc_feature (1)..( 7): Result.003 file - promoters60/4282327
attggtc

SEQ ID NO: 133059 - DNA, 7 bp, Unknown
  misc_feature (1)..( 7): Result.003 file - promoters60/4282327
aataatt

SEQ ID NO: 133060 - DNA, 7 bp, Unknown
  misc_feature (1)..( 7): Result.003 file - promoters60/4282327
aatgatt

SEQ ID NO: 133061 - DNA, 8 bp, Unknown
  misc_feature (1)..( 8): Result.003 file - promoters60/4282327
tatataaa

SEQ ID NO: 133062 - DNA, 8 bp, Unknown
  misc_feature (1)..( 8): Result.003 file - promoters60/4282327
tatttaaa

SEQ ID NO: 133063 - DNA, 7 bp, Unknown
  misc_feature (1)..( 7): Result.003 file - promoters60/4282327
tatggaa

SEQ ID NO: 133064 - DNA, 7 bp, Unknown
  misc_feature (1)..( 7): Result.003 file - promoters60/4282327
tattgaa

SEQ ID NO: 133065 - DNA, 8 bp, Unknown
  misc_feature (1)..( 8): Result.003 file - promoters60/4282327
attggtta

SEQ ID NO: 133066 - DNA, 8 bp, Unknown
  misc_feature (1)..( 8): Result.003 file - promoters60/4282327
atttgtta

SEQ ID NO: 133067 - DNA, 7 bp, Unknown
  misc_feature (1)..( 7): Result.003 file - promoters60/4282327
tttgtgc

SEQ ID NO: 133068 - DNA, 7 bp, Unknown
  misc_feature (1)..( 7): Result.003 file - promoters60/4282327
tttatgc

SEQ ID NO: 133069 - DNA, 7 bp, Unknown
  misc_feature (1)..( 7): Result.003 file - promoters60/4282327
gacgtat

SEQ ID NO: 133070 - DNA, 7 bp, Unknown
  misc_feature (1)..( 7): Result.003 file - promoters60/4282327
gacttat

SEQ ID NO: 133071 - DNA, 11 bp, Unknown
  misc_feature (1)..( 11): Result.003 file - promoters60/4282327
tttcagtgtaa

SEQ ID NO: 133072 - DNA, 11 bp, Unknown
  misc_feature (1)..( 11): Result.003 file - promoters60/4282327
tttgagtataa

SEQ ID NO: 133073 - DNA, 7 bp, Unknown
  misc_feature (1)..( 7): Result.003 file - promoters60/4282327
aagaaga

SEQ ID NO: 133074 - DNA, 7 bp, Unknown
  misc_feature (1)..( 7): Result.003 file - promoters60/4282327
aaggaga

SEQ ID NO: 133075 - DNA, 13 bp, Unknown
  misc_feature (1)..( 13): Result.003 file - promoters60/4282395
attctgaggagag

SEQ ID NO: 133076 - DNA, 13 bp, Unknown
  misc_feature (1)..( 13): Result.003 file - promoters60/4282395
agttggagtagaa

SEQ ID NO: 133077 - DNA, 13 bp, Unknown
  misc_feature (1)..( 13): Result.003 file - promoters60/4282395
tttcttaggaaag

SEQ ID NO: 133078 - DNA, 13 bp, Unknown
  misc_feature (1)..( 13): Result.003 file - promoters60/4282395
gcccatagtagac

SEQ ID NO: 133079 - DNA, 13 bp, Unknown
  misc_feature (1)..( 13): Result.003 file - promoters60/4282395
aatttttgtagac

SEQ ID NO: 133080 - DNA, 13 bp, Unknown
  misc_feature (1)..( 13): Result.003 file - promoters60/4282395
ttttttaatttgt

SEQ ID NO: 133081 - DNA, 9 bp, Unknown
  misc_feature (1)..( 9): Result.003 file - promoters60/4282395
cacaaaaca

SEQ ID NO: 133082 - DNA, 9 bp, Unknown
  misc_feature (1)..( 9): Result.003 file - promoters60/4282395
cacaaagta

SEQ ID NO: 133083 - DNA, 9 bp, Unknown
  misc_feature (1)..( 9): Result.003 file - promoters60/4282395
cacaaagac

SEQ ID NO: 133084 - DNA, 9 bp, Unknown
  misc_feature (1)..( 9): Result.003 file - promoters60/4282395
aacaaaaac

SEQ ID NO: 133085 - DNA, 9 bp, Unknown
  misc_feature (1)..( 9): Result.003 file - promoters60/4282395
taaaaactc

SEQ ID NO: 133086 - DNA, 9 bp, Unknown
  misc_feature (1)..( 9): Result.003 file - promoters60/4282395
gaaagactt

SEQ ID NO: 133087 - DNA, 12 bp, Unknown
  misc_feature (1)..( 12): Result.003 file - promoters60/4282395
gggtgttaccag

SEQ ID NO: 133088 - DNA, 12 bp, Unknown
  misc_feature (1)..( 12): Result.003 file - promoters60/4282395
gggagttattac

SEQ ID NO: 133089 - DNA, 12 bp, Unknown
  misc_feature (1)..( 12): Result.003 file - promoters60/4282395
tggagttattta

SEQ ID NO: 133090 - DNA, 12 bp, Unknown
  misc_feature (1)..( 12): Result.003 file - promoters60/4282395
tgggattatttt

SEQ ID NO: 133091 - DNA, 12 bp, Unknown
  misc_feature (1)..( 12): Result.003 file - promoters60/4282395
aaaaattatttt

SEQ ID NO: 133092 - DNA, 12 bp, Unknown
  misc_feature (1)..( 12): Result.003 file - promoters60/4282395
ccaaattattga

SEQ ID NO: 133093 - DNA, 11 bp, Unknown
  misc_feature (1)..( 11): Result.003 file - promoters60/4282395
gaaattatttt

SEQ ID NO: 133094 - DNA, 11 bp, Unknown
  misc_feature (1)..( 11): Result.003 file - promoters60/4282395
ggagttattta

SEQ ID NO: 133095 - DNA, 11 bp, Unknown
  misc_feature (1)..( 11): Result.003 file - promoters60/4282395
ggagttattac

SEQ ID NO: 133096 - DNA, 11 bp, Unknown
  misc_feature (1)..( 11): Result.003 file - promoters60/4282395
gggattatttt

SEQ ID NO: 133097 - DNA, 11 bp, Unknown
  misc_feature (1)..( 11): Result.003 file - promoters60/4282395
aaaattatttt

SEQ ID NO: 133098 - DNA, 11 bp, Unknown
  misc_feature (1)..( 11): Result.003 file - promoters60/4282395
caaattattga

SEQ ID NO: 133099 - DNA, 9 bp, Unknown
  misc_feature (1)..( 9): Result.003 file - promoters60/4282414
cagaaatac

SEQ ID NO: 133100 - DNA, 9 bp, Unknown
  misc_feature (1)..( 9): Result.003 file - promoters60/4282414
cagaaactt

SEQ ID NO: 133101 - DNA, 9 bp, Unknown
  misc_feature (1)..( 9): Result.003 file - promoters60/4282414
cagtaatac

SEQ ID NO: 133102 - DNA, 12 bp, Unknown
  misc_feature (1)..( 12): Result.003 file - promoters60/4282414
caaacatgaacc

SEQ ID NO: 133103 - DNA, 12 bp, Unknown
  misc_feature (1)..( 12): Result.003 file - promoters60/4282414
caagcattaacc

SEQ ID NO: 133104 - DNA, 12 bp, Unknown
  misc_feature (1)..( 12): Result.003 file - promoters60/4282414
aaggcagtaact

SEQ ID NO: 133105 - DNA, 9 bp, Unknown
  misc_feature (1)..( 9): Result.003 file - promoters60/4282418
aaactaaaa

SEQ ID NO: 133106 - DNA, 9 bp, Unknown
  misc_feature (1)..( 9): Result.003 file - promoters60/4282418
aaaataaaa

SEQ ID NO: 133107 - DNA, 9 bp, Unknown
  misc_feature (1)..( 9): Result.003 file - promoters60/4282418
aaagtaaac

SEQ ID NO: 133108 - DNA, 9 bp, Unknown
  misc_feature (1)..( 9): Result.003 file - promoters60/4282418
aaacaaaat

SEQ ID NO: 133109 - DNA, 10 bp, Unknown
  misc_feature (1)..( 10): Result.003 file - promoters60/4282418
taaaataaaa

SEQ ID NO: 133110 - DNA, 10 bp, Unknown
  misc_feature (1)..( 10): Result.003 file - promoters60/4282418
aaaaataaaa

SEQ ID NO: 133111 - DNA, 10 bp, Unknown
  misc_feature (1)..( 10): Result.003 file - promoters60/4282418
taatatatta

SEQ ID NO: 133112 - DNA, 13 bp, Unknown
  misc_feature (1)..( 13): Result.003 file - promoters60/4282418
aaaataatatcat

SEQ ID NO: 133113 - DNA, 13 bp, Unknown
  misc_feature (1)..( 13): Result.003 file - promoters60/4282418
aaactaatatcat

SEQ ID NO: 133114 - DNA, 13 bp, Unknown
  misc_feature (1)..( 13): Result.003 file - promoters60/4282418
ttattaaaatcaa

SEQ ID NO: 133115 - DNA, 9 bp, Unknown
  misc_feature (1)..( 9): Result.003 file - promoters60/4282418
taagtaaac

SEQ ID NO: 133116 - DNA, 9 bp, Unknown
  misc_feature (1)..( 9): Result.003 file - promoters60/4282418
taattaaac

SEQ ID NO: 133117 - DNA, 9 bp, Unknown
  misc_feature (1)..( 9): Result.003 file - promoters60/4282418
gaagaaaaa

SEQ ID NO: 133118 - DNA, 7 bp, Unknown
  misc_feature (1)..( 7): Result.003 file - promoters60/4282418
ataaaaa

SEQ ID NO: 133119 - DNA, 7 bp, Unknown
  misc_feature (1)..( 7): Result.003 file - promoters60/4282418
atataaa

SEQ ID NO: 133120 - DNA, 7 bp, Unknown
  misc_feature (1)..( 7): Result.003 file - promoters60/4282418
ttaaaaa

SEQ ID NO: 133121 - DNA, 6 bp, Unknown
  misc_feature (1)..( 6): Result.003 file - promoters60/4282421
tttaat

SEQ ID NO: 133122 - DNA, 6 bp, Unknown
  misc_feature (1)..( 6): Result.003 file - promoters60/4282421
tttaat

SEQ ID NO: 133123 - DNA, 7 bp, Unknown
  misc_feature (1)..( 7): Result.003 file - promoters60/4282421
gctttct

SEQ ID NO: 133124 - DNA, 7 bp, Unknown
  misc_feature (1)..( 7): Result.003 file - promoters60/4282421
gctttct

SEQ ID NO: 133125 - DNA, 8 bp, Unknown
  misc_feature (1)..( 8): Result.003 file - promoters60/4282421
tctattct

SEQ ID NO: 133126 - DNA, 8 bp, Unknown
  misc_feature (1)..( 8): Result.003 file - promoters60/4282421
tctaatct

SEQ ID NO: 133127 - DNA, 6 bp, Unknown
  misc_feature (1)..( 6): Result.003 file - promoters60/4282421
aaaaat

SEQ ID NO: 133128 - DNA, 6 bp, Unknown
  misc_feature (1)..( 6): Result.003 file - promoters60/4282421
aaaaat

SEQ ID NO: 133129 - DNA, 7 bp, Unknown
  misc_feature (1)..( 7): Result.003 file - promoters60/4282421
attagta

SEQ ID NO: 133130 - DNA, 7 bp, Unknown
  misc_feature (1)..( 7): Result.003 file - promoters60/4282421
attagta

SEQ ID NO: 133131 - DNA, 7 bp, Unknown
  misc_feature (1)..( 7): Result.003 file - promoters60/4282421
ttttcat

SEQ ID NO: 133132 - DNA, 7 bp, Unknown
  misc_feature (1)..( 7): Result.003 file - promoters60/4282421
ttttcat

SEQ ID NO: 133133 - DNA, 6 bp, Unknown
  misc_feature (1)..( 6): Result.003 file - promoters60/4282421
atttgt

SEQ ID NO: 133134 - DNA, 6 bp, Unknown
  misc_feature (1)..( 6): Result.003 file - promoters60/4282421
atttgt

SEQ ID NO: 133135 - DNA, 7 bp, Unknown
  misc_feature (1)..( 7): Result.003 file - promoters60/4282421
tactaaa

SEQ ID NO: 133136 - DNA, 7 bp, Unknown
  misc_feature (1)..( 7): Result.003 file - promoters60/4282421
taccaaa

SEQ ID NO: 133137 - DNA, 7 bp, Unknown
  misc_feature (1)..( 7): Result.003 file - promoters60/4282421
cttttta

SEQ ID NO: 133138 - DNA, 7 bp, Unknown
  misc_feature (1)..( 7): Result.003 file - promoters60/4282421
cttctta

SEQ ID NO: 133139 - DNA, 6 bp, Unknown
  misc_feature (1)..( 6): Result.003 file - promoters60/4282421
tgtatt

SEQ ID NO: 133140 - DNA, 6 bp, Unknown
  misc_feature (1)..( 6): Result.003 file - promoters60/4282421
tgtatt

SEQ ID NO: 133141 - DNA, 7 bp, Unknown
  misc_feature (1)..( 7): Result.003 file - promoters60/4282421
tgtatat

SEQ ID NO: 133142 - DNA, 7 bp, Unknown
  misc_feature (1)..( 7): Result.003 file - promoters60/4282421
tgtctat

SEQ ID NO: 133143 - DNA, 8 bp, Unknown
  misc_feature (1)..( 8): Result.003 file - promoters60/4282421
tctggttt

SEQ ID NO: 133144 - DNA, 8 bp, Unknown
  misc_feature (1)..( 8): Result.003 file - promoters60/4282421
tctggttt

SEQ ID NO: 133145 - DNA, 7 bp, Unknown
  misc_feature (1)..( 7): Result.003 file - promoters60/4282421
tttactt

SEQ ID NO: 133146 - DNA, 7 bp, Unknown
  misc_feature (1)..( 7): Result.003 file - promoters60/4282421
tttgctt

SEQ ID NO: 133147 - DNA, 8 bp, Unknown
  misc_feature (1)..( 8): Result.003 file - promoters60/4282421
cttttctc

SEQ ID NO: 133148 - DNA, 8 bp, Unknown
  misc_feature (1)..( 8): Result.003 file - promoters60/4282421
cttgtctc

SEQ ID NO: 133149 - DNA, 7 bp, Unknown
  misc_feature (1)..( 7): Result.003 file - promoters60/4282421
ttgaagc

SEQ ID NO: 133150 - DNA, 7 bp, Unknown
  misc_feature (1)..( 7): Result.003 file - promoters60/4282421
ttgaagc

SEQ ID NO: 133151 - DNA, 6 bp, Unknown
  misc_feature (1)..( 6): Result.003 file - promoters60/4282421
cctttt

SEQ ID NO: 133152 - DNA, 6 bp, Unknown
  misc_feature (1)..( 6): Result.003 file - promoters60/4282421
cctttt

SEQ ID NO: 133153 - DNA, 7 bp, Unknown
  misc_feature (1)..( 7): Result.003 file - promoters60/4282421
ttttttt

SEQ ID NO: 133154 - DNA, 7 bp, Unknown
  misc_feature (1)..( 7): Result.003 file - promoters60/4282421
ttttttt

SEQ ID NO: 133155 - DNA, 7 bp, Unknown
  misc_feature (1)..( 7): Result.003 file - promoters60/4282421
ggcctat

SEQ ID NO: 133156 - DNA, 7 bp, Unknown
  misc_feature (1)..( 7): Result.003 file - promoters60/4282421
ggcctat

SEQ ID NO: 133157 - DNA, 8 bp, Unknown
  misc_feature (1)..( 8): Result.003 file - promoters60/4282436
caataaaa

SEQ ID NO: 133158 - DNA, 8 bp, Unknown
  misc_feature (1)..( 8): Result.003 file - promoters60/4282436
caaaaaaa

SEQ ID NO: 133159 - DNA, 6 bp, Unknown
  misc_feature (1)..( 6): Result.003 file - promoters60/4282436
aaaaca

SEQ ID NO: 133160 - DNA, 6 bp, Unknown
  misc_feature (1)..( 6): Result.003 file - promoters60/4282436
aaaaca

SEQ ID NO: 133161 - DNA, 8 bp, Unknown
  misc_feature (1)..( 8): Result.003 file - promoters60/4282436
gaattaaa

SEQ ID NO: 133162 - DNA, 8 bp, Unknown
  misc_feature (1)..( 8): Result.003 file - promoters60/4282436
gaaataaa

SEQ ID NO: 133163 - DNA, 7 bp, Unknown
  misc_feature (1)..( 7): Result.003 file - promoters60/4282436
caaattt

SEQ ID NO: 133164 - DNA, 7 bp, Unknown
  misc_feature (1)..( 7): Result.003 file - promoters60/4282436
caatttt

SEQ ID NO: 133165 - DNA, 6 bp, Unknown
  misc_feature (1)..( 6): Result.003 file - promoters60/4282436
ttaaaa

SEQ ID NO: 133166 - DNA, 6 bp, Unknown
  misc_feature (1)..( 6): Result.003 file - promoters60/4282436
ttaaaa

SEQ ID NO: 133167 - DNA, 6 bp, Unknown
  misc_feature (1)..( 6): Result.003 file - promoters60/4282436
gtaacg

SEQ ID NO: 133168 - DNA, 6 bp, Unknown
  misc_feature (1)..( 6): Result.003 file - promoters60/4282436
gtaacg

SEQ ID NO: 133169 - DNA, 7 bp, Unknown
  misc_feature (1)..( 7): Result.003 file - promoters60/4282436
gtggtta

SEQ ID NO: 133170 - DNA, 7 bp, Unknown
  misc_feature (1)..( 7): Result.003 file - promoters60/4282436
gtgttta

SEQ ID NO: 133171 - DNA, 10 bp, Unknown
  misc_feature (1)..( 10): Result.003 file - promoters60/4282436
tacgtgtcaa

SEQ ID NO: 133172 - DNA, 10 bp, Unknown
  misc_feature (1)..( 10): Result.003 file - promoters60/4282436
cacgtgtcat

SEQ ID NO: 133173 - DNA, 10 bp, Unknown
  misc_feature (1)..( 10): Result.003 file - promoters60/4282436
tacgtgtcaa

SEQ ID NO: 133174 - DNA, 20 bp, Unknown
  misc_feature (1)..( 20): Result.003 file - promoters60/4282436
ttggttattgcttcaccgcc

SEQ ID NO: 133175 - DNA, 20 bp, Unknown
  misc_feature (1)..( 20): Result.003 file - promoters60/4282436
ttagctattgcttcaccgcc

SEQ ID NO: 133176 - DNA, 20 bp, Unknown
  misc_feature (1)..( 20): Result.003 file - promoters60/4282436
ttggctattgcttccacgcc

SEQ ID NO: 133177 - DNA, 22 bp, Unknown
  misc_feature (1)..( 22): Result.003 file - promoters60/4282436
tctcgtgaccgactcgtcctcg

SEQ ID NO: 133178 - DNA, 22 bp, Unknown
  misc_feature (1)..( 22): Result.003 file - promoters60/4282436
gacctagtcgtcctcgtctttt

SEQ ID NO: 133179 - DNA, 22 bp, Unknown
  misc_feature (1)..( 22): Result.003 file - promoters60/4282436
gaccgagtcgtcctcgtctttt

SEQ ID NO: 133180 - DNA, 19 bp, Unknown
  misc_feature (1)..( 19): Result.003 file - promoters60/4282436
ttcttcttctataaattaa

SEQ ID NO: 133181 - DNA, 19 bp, Unknown
  misc_feature (1)..( 19): Result.003 file - promoters60/4282436
ttcttcttctataaaacaa

SEQ ID NO: 133182 - DNA, 19 bp, Unknown
  misc_feature (1)..( 19): Result.003 file - promoters60/4282436
ttttgcttctataaatcaa

SEQ ID NO: 133183 - DNA, 6 bp, Unknown
  misc_feature (1)..( 6): Result.003 file - promoters60/4282436
gcttct

SEQ ID NO: 133184 - DNA, 6 bp, Unknown
  misc_feature (1)..( 6): Result.003 file - promoters60/4282436
gcttct

SEQ ID NO: 133185 - DNA, 8 bp, Unknown
  misc_feature (1)..( 8): Result.003 file - promoters60/4282436
ttctggcc

SEQ ID NO: 133186 - DNA, 8 bp, Unknown
  misc_feature (1)..( 8): Result.003 file - promoters60/4282436
ttcttgcc

SEQ ID NO: 133187 - DNA, 7 bp, Unknown
  misc_feature (1)..( 7): Result.003 file - promoters60/4282436
tacatat

SEQ ID NO: 133188 - DNA, 7 bp, Unknown
  misc_feature (1)..( 7): Result.003 file - promoters60/4282436
tacttat

SEQ ID NO: 133189 - DNA, 15 bp, Unknown
  misc_feature (1)..( 15): Result.003 file - promoters60/4282436
cgccttagctttctc

SEQ ID NO: 133190 - DNA, 15 bp, Unknown
  misc_feature (1)..( 15): Result.003 file - promoters60/4282436
cgccttagctttctc

SEQ ID NO: 133191 - DNA, 15 bp, Unknown
  misc_feature (1)..( 15): Result.003 file - promoters60/4282436
cgccttagctttctc

SEQ ID NO: 133192 - DNA, 6 bp, Unknown
  misc_feature (1)..( 6): Result.003 file - promoters60/4282436
tttttt

SEQ ID NO: 133193 - DNA, 6 bp, Unknown
  misc_feature (1)..( 6): Result.003 file - promoters60/4282436
tttttt

SEQ ID NO: 133194 - DNA, 9 bp, Unknown
  misc_feature (1)..( 9): Result.003 file - promoters60/4282436
acaaaaagg

SEQ ID NO: 133195 - DNA, 9 bp, Unknown
  misc_feature (1)..( 9): Result.003 file - promoters60/4282436
acacaaagg

SEQ ID NO: 133196 - DNA, 7 bp, Unknown
  misc_feature (1)..( 7): Result.003 file - promoters60/4282436
acgaaga

SEQ ID NO: 133197 - DNA, 7 bp, Unknown
  misc_feature (1)..( 7): Result.003 file - promoters60/4282436
acgcaga

SEQ ID NO: 133198 - DNA, 6 bp, Unknown
  misc_feature (1)..( 6): Result.003 file - promoters60/4282436
gttcaa

SEQ ID NO: 133199 - DNA, 6 bp, Unknown
  misc_feature (1)..( 6): Result.003 file - promoters60/4282436
gttcaa

SEQ ID NO: 133200 - DNA, 6 bp, Unknown
  misc_feature (1)..( 6): Result.003 file - promoters60/4282436
gtatat

SEQ ID NO: 133201 - DNA, 6 bp, Unknown
  misc_feature (1)..( 6): Result.003 file - promoters60/4282436
gtatat

SEQ ID NO: 133202 - DNA, 9 bp, Unknown
  misc_feature (1)..( 9): Result.003 file - promoters60/4282436
atcttatga

SEQ ID NO: 133203 - DNA, 9 bp, Unknown
  misc_feature (1)..( 9): Result.003 file - promoters60/4282436
atctaatga

SEQ ID NO: 133204 - DNA, 6 bp, Unknown
  misc_feature (1)..( 6): Result.003 file - promoters60/4282436
tcagta

SEQ ID NO: 133205 - DNA, 6 bp, Unknown
  misc_feature (1)..( 6): Result.003 file - promoters60/4282436
tcagta

SEQ ID NO: 133206 - DNA, 6 bp, Unknown
  misc_feature (1)..( 6): Result.003 file - promoters60/4282436
aacaac

SEQ ID NO: 133207 - DNA, 6 bp, Unknown
  misc_feature (1)..( 6): Result.003 file - promoters60/4282436
aacaac

SEQ ID NO: 133208 - DNA, 15 bp, Unknown
  misc_feature (1)..( 15): Result.003 file - promoters60/4282436
aatacccaaagagct

SEQ ID NO: 133209 - DNA, 15 bp, Unknown
  misc_feature (1)..( 15): Result.003 file - promoters60/4282436
aatacccaaagagct

SEQ ID NO: 133210 - DNA, 7 bp, Unknown
  misc_feature (1)..( 7): Result.003 file - promoters60/4282450
aatgata

SEQ ID NO: 133211 - DNA, 7 bp, Unknown
  misc_feature (1)..( 7): Result.003 file - promoters60/4282450
aataata

SEQ ID NO: 133212 - DNA, 8 bp, Unknown
  misc_feature (1)..( 8): Result.003 file - promoters60/4282450
aatcataa

SEQ ID NO: 133213 - DNA, 8 bp, Unknown
  misc_feature (1)..( 8): Result.003 file - promoters60/4282450
aataataa

SEQ ID NO: 133214 - DNA, 7 bp, Unknown
  misc_feature (1)..( 7): Result.003 file - promoters60/4282450
tataaaa

SEQ ID NO: 133215 - DNA, 7 bp, Unknown
  misc_feature (1)..( 7): Result.003 file - promoters60/4282450
tataaaa

SEQ ID NO: 133216 - DNA, 7 bp, Unknown
  misc_feature (1)..( 7): Result.003 file - promoters60/4282450
cggagct

SEQ ID NO: 133217 - DNA, 7 bp, Unknown
  misc_feature (1)..( 7): Result.003 file - promoters60/4282450
cggagct

SEQ ID NO: 133218 - DNA, 6 bp, Unknown
  misc_feature (1)..( 6): Result.003 file - promoters60/4282450
cattga

SEQ ID NO: 133219 - DNA, 6 bp, Unknown
  misc_feature (1)..( 6): Result.003 file - promoters60/4282450
cattga

SEQ ID NO: 133220 - DNA, 8 bp, Unknown
  misc_feature (1)..( 8): Result.003 file - promoters60/4282450
tatctaaa

SEQ ID NO: 133221 - DNA, 8 bp, Unknown
  misc_feature (1)..( 8): Result.003 file - promoters60/4282450
tatttaaa

SEQ ID NO: 133222 - DNA, 6 bp, Unknown
  misc_feature (1)..( 6): Result.003 file - promoters60/4282450
tgtttc

SEQ ID NO: 133223 - DNA, 6 bp, Unknown
  misc_feature (1)..( 6): Result.003 file - promoters60/4282450
tgtttc

SEQ ID NO: 133224 - DNA, 6 bp, Unknown
  misc_feature (1)..( 6): Result.003 file - promoters60/4282487
aaattg

SEQ ID NO: 133225 - DNA, 6 bp, Unknown
  misc_feature (1)..( 6): Result.003 file - promoters60/4282487
aaattg

SEQ ID NO: 133226 - DNA, 7 bp, Unknown
  misc_feature (1)..( 7): Result.003 file - promoters60/4282487
taatcgt

SEQ ID NO: 133227 - DNA, 7 bp, Unknown
  misc_feature (1)..( 7): Result.003 file - promoters60/4282487
taagcgt

SEQ ID NO: 133228 - DNA, 6 bp, Unknown
  misc_feature (1)..( 6): Result.003 file - promoters60/4282487
tttagt

SEQ ID NO: 133229 - DNA, 6 bp, Unknown
  misc_feature (1)..( 6): Result.003 file - promoters60/4282487
tttagt

SEQ ID NO: 133230 - DNA, 6 bp, Unknown
  misc_feature (1)..( 6): Result.003 file - promoters60/4282487
tttagt

SEQ ID NO: 133231 - DNA, 7 bp, Unknown
  misc_feature (1)..( 7): Result.003 file - promoters60/4282487
tttgatg

SEQ ID NO: 133232 - DNA, 7 bp, Unknown
  misc_feature (1)..( 7): Result.003 file - promoters60/4282487
tttcatg

SEQ ID NO: 133233 - DNA, 7 bp, Unknown
  misc_feature (1)..( 7): Result.003 file - promoters60/4282487
taatcgt

SEQ ID NO: 133234 - DNA, 7 bp, Unknown
  misc_feature (1)..( 7): Result.003 file - promoters60/4282487
taagcgt

SEQ ID NO: 133235 - DNA, 11 bp, Unknown
  misc_feature (1)..( 11): Result.003 file - promoters60/4282487
tagttgattcg

SEQ ID NO: 133236 - DNA, 11 bp, Unknown
  misc_feature (1)..( 11): Result.003 file - promoters60/4282487
tagtttattcg

SEQ ID NO: 133237 - DNA, 7 bp, Unknown
  misc_feature (1)..( 7): Result.003 file - promoters60/4282487
attaatg

SEQ ID NO: 133238 - DNA, 7 bp, Unknown
  misc_feature (1)..( 7): Result.003 file - promoters60/4282487
gttaatg

SEQ ID NO: 133239 - DNA, 7 bp, Unknown
  misc_feature (1)..( 7): Result.003 file - promoters60/4282487
gttaatt

SEQ ID NO: 133240 - DNA, 10 bp, Unknown
  misc_feature (1)..( 10): Result.003 file - promoters60/4282487
tgaagccaaa

SEQ ID NO: 133241 - DNA, 10 bp, Unknown
  misc_feature (1)..( 10): Result.003 file - promoters60/4282487
tgaaaccaac

SEQ ID NO: 133242 - DNA, 10 bp, Unknown
  misc_feature (1)..( 10): Result.003 file - promoters60/4282487
aagaacaaac

SEQ ID NO: 133243 - DNA, 7 bp, Unknown
  misc_feature (1)..( 7): Result.003 file - promoters60/4282487
caaaaga

SEQ ID NO: 133244 - DNA, 7 bp, Unknown
  misc_feature (1)..( 7): Result.003 file - promoters60/4282487
caaaaga

SEQ ID NO: 133245 - DNA, 6 bp, Unknown
  misc_feature (1)..( 6): Result.003 file - promoters60/4282487
taataa

SEQ ID NO: 133246 - DNA, 6 bp, Unknown
  misc_feature (1)..( 6): Result.003 file - promoters60/4282487
taataa

SEQ ID NO: 133247 - DNA, 6 bp, Unknown
  misc_feature (1)..( 6): Result.003 file - promoters60/4282487
cggttt

SEQ ID NO: 133248 - DNA, 6 bp, Unknown
  misc_feature (1)..( 6): Result.003 file - promoters60/4282487
cggttt

SEQ ID NO: 133249 - DNA, 9 bp, Unknown
  misc_feature (1)..( 9): Result.003 file - promoters60/4282487
cttttaatt

SEQ ID NO: 133250 - DNA, 9 bp, Unknown
  misc_feature (1)..( 9): Result.003 file - promoters60/4282487
cttttgatt

SEQ ID NO: 133251 - DNA, 6 bp, Unknown
  misc_feature (1)..( 6): Result.003 file - promoters60/4282487
aattgt

SEQ ID NO: 133252 - DNA, 6 bp, Unknown
  misc_feature (1)..( 6): Result.003 file - promoters60/4282487
aattgt

SEQ ID NO: 133253 - DNA, 6 bp, Unknown
  misc_feature (1)..( 6): Result.003 file - promoters60/4282487
tatgaa

SEQ ID NO: 133254 - DNA, 6 bp, Unknown
  misc_feature (1)..( 6): Result.003 file - promoters60/4282487
tatgaa

SEQ ID NO: 133255 - DNA, 7 bp, Unknown
  misc_feature (1)..( 7): Result.003 file - promoters60/4282487
aatgttt

SEQ ID NO: 133256 - DNA, 7 bp, Unknown
  misc_feature (1)..( 7): Result.003 file - promoters60/4282487
aatgttt

SEQ ID NO: 133257 - DNA, 6 bp, Unknown
  misc_feature (1)..( 6): Result.003 file - promoters60/4282487
taatat

SEQ ID NO: 133258 - DNA, 6 bp, Unknown
  misc_feature (1)..( 6): Result.003 file - promoters60/4282487
taatat

SEQ ID NO: 133259 - DNA, 7 bp, Unknown
  misc_feature (1)..( 7): Result.003 file - promoters60/4282487
aaattga

SEQ ID NO: 133260 - DNA, 7 bp, Unknown
  misc_feature (1)..( 7): Result.003 file - promoters60/4282487
aaaatga

SEQ ID NO: 133261 - DNA, 7 bp, Unknown
  misc_feature (1)..( 7): Result.003 file - promoters60/4282487
ttttaga

SEQ ID NO: 133262 - DNA, 7 bp, Unknown
  misc_feature (1)..( 7): Result.003 file - promoters60/4282487
tttaaga

SEQ ID NO: 133263 - DNA, 8 bp, Unknown
  misc_feature (1)..( 8): Result.003 file - promoters60/4282487
gaaaacgc

SEQ ID NO: 133264 - DNA, 8 bp, Unknown
  misc_feature (1)..( 8): Result.003 file - promoters60/4282487
gaatacgc

SEQ ID NO: 133265 - DNA, 6 bp, Unknown
  misc_feature (1)..( 6): Result.003 file - promoters60/4282503
agaaat

SEQ ID NO: 133266 - DNA, 6 bp, Unknown
  misc_feature (1)..( 6): Result.003 file - promoters60/4282503
agaaat

SEQ ID NO: 133267 - DNA, 7 bp, Unknown
  misc_feature (1)..( 7): Result.003 file - promoters60/4282503
aagatta

SEQ ID NO: 133268 - DNA, 7 bp, Unknown
  misc_feature (1)..( 7): Result.003 file - promoters60/4282503
aaggtta

SEQ ID NO: 133269 - DNA, 7 bp, Unknown
  misc_feature (1)..( 7): Result.003 file - promoters60/4282503
tttgcaa

SEQ ID NO: 133270 - DNA, 7 bp, Unknown
  misc_feature (1)..( 7): Result.003 file - promoters60/4282503
ttttcaa

SEQ ID NO: 133271 - DNA, 7 bp, Unknown
  misc_feature (1)..( 7): Result.003 file - promoters60/4282503
taaaatt

SEQ ID NO: 133272 - DNA, 7 bp, Unknown
  misc_feature (1)..( 7): Result.003 file - promoters60/4282503
taaaatc

SEQ ID NO: 133273 - DNA, 7 bp, Unknown
  misc_feature (1)..( 7): Result.003 file - promoters60/4282503
caaaatc

SEQ ID NO: 133274 - DNA, 6 bp, Unknown
  misc_feature (1)..( 6): Result.003 file - promoters60/4282503
tataaa

SEQ ID NO: 133275 - DNA, 6 bp, Unknown
  misc_feature (1)..( 6): Result.003 file - promoters60/4282503
tataaa

SEQ ID NO: 133276 - DNA, 6 bp, Unknown
  misc_feature (1)..( 6): Result.003 file - promoters60/4282503
tcaaag

SEQ ID NO: 133277 - DNA, 6 bp, Unknown
  misc_feature (1)..( 6): Result.003 file - promoters60/4282503
tcaaag

SEQ ID NO: 133278 - DNA, 7 bp, Unknown
  misc_feature (1)..( 7): Result.003 file - promoters60/4282503
aaacttt

SEQ ID NO: 133279 - DNA, 7 bp, Unknown
  misc_feature (1)..( 7): Result.003 file - promoters60/4282503
aaaattt

SEQ ID NO: 133280 - DNA, 10 bp, Unknown
  misc_feature (1)..( 10): Result.003 file - promoters60/4282503
tttgaatgcc

SEQ ID NO: 133281 - DNA, 10 bp, Unknown
  misc_feature (1)..( 10): Result.003 file - promoters60/4282503
ttttaataac

SEQ ID NO: 133282 - DNA, 10 bp, Unknown
  misc_feature (1)..( 10): Result.003 file - promoters60/4282503
ttttactaac

SEQ ID NO: 133283 - DNA, 11 bp, Unknown
  misc_feature (1)..( 11): Result.003 file - promoters60/4282503
ccaattatatg

SEQ ID NO: 133284 - DNA, 11 bp, Unknown
  misc_feature (1)..( 11): Result.003 file - promoters60/4282503
tttattaaatg

SEQ ID NO: 133285 - DNA, 11 bp, Unknown
  misc_feature (1)..( 11): Result.003 file - promoters60/4282503
tttactaactt

SEQ ID NO: 133286 - DNA, 6 bp, Unknown
  misc_feature (1)..( 6): Result.003 file - promoters60/4282503
tatata

SEQ ID NO: 133287 - DNA, 6 bp, Unknown
  misc_feature (1)..( 6): Result.003 file - promoters60/4282503
tatata

SEQ ID NO: 133288 - DNA, 6 bp, Unknown
  misc_feature (1)..( 6): Result.003 file - promoters60/4282503
ttatat

SEQ ID NO: 133289 - DNA, 6 bp, Unknown
  misc_feature (1)..( 6): Result.003 file - promoters60/4282503
ttatat

SEQ ID NO: 133290 - DNA, 6 bp, Unknown
  misc_feature (1)..( 6): Result.003 file - promoters60/4282503
tcatat

SEQ ID NO: 133291 - DNA, 6 bp, Unknown
  misc_feature (1)..( 6): Result.003 file - promoters60/4282503
tcatat

SEQ ID NO: 133292 - DNA, 7 bp, Unknown
  misc_feature (1)..( 7): Result.003 file - promoters60/4282503
ttatgtc

SEQ ID NO: 133293 - DNA, 7 bp, Unknown
  misc_feature (1)..( 7): Result.003 file - promoters60/4282503
ttatgtc

SEQ ID NO: 133294 - DNA, 7 bp, Unknown
  misc_feature (1)..( 7): Result.003 file - promoters60/4282503
attggta

SEQ ID NO: 133295 - DNA, 7 bp, Unknown
  misc_feature (1)..( 7): Result.003 file - promoters60/4282503
attagta

SEQ ID NO: 133296 - DNA, 7 bp, Unknown
  misc_feature (1)..( 7): Result.003 file - promoters60/4282503
gattcag

SEQ ID NO: 133297 - DNA, 7 bp, Unknown
  misc_feature (1)..( 7): Result.003 file - promoters60/4282503
gattcag

SEQ ID NO: 133298 - DNA, 7 bp, Unknown
  misc_feature (1)..( 7): Result.003 file - promoters60/4282503
gatggat

SEQ ID NO: 133299 - DNA, 7 bp, Unknown
  misc_feature (1)..( 7): Result.003 file - promoters60/4282503
gatcgat

SEQ ID NO: 133300 - DNA, 7 bp, Unknown
  misc_feature (1)..( 7): Result.003 file - promoters60/4282506
gtggttg

SEQ ID NO: 133301 - DNA, 7 bp, Unknown
  misc_feature (1)..( 7): Result.003 file - promoters60/4282506
gtgattg

SEQ ID NO: 133302 - DNA, 7 bp, Unknown
  misc_feature (1)..( 7): Result.003 file - promoters60/4282506
agaggag

SEQ ID NO: 133303 - DNA, 7 bp, Unknown
  misc_feature (1)..( 7): Result.003 file - promoters60/4282506
agaggag

SEQ ID NO: 133304 - DNA, 6 bp, Unknown
  misc_feature (1)..( 6): Result.003 file - promoters60/4282506
tctttc

SEQ ID NO: 133305 - DNA, 6 bp, Unknown
  misc_feature (1)..( 6): Result.003 file - promoters60/4282506
tctttc

SEQ ID NO: 133306 - DNA, 8 bp, Unknown
  misc_feature (1)..( 8): Result.003 file - promoters60/4282506
cttcttct

SEQ ID NO: 133307 - DNA, 8 bp, Unknown
  misc_feature (1)..( 8): Result.003 file - promoters60/4282506
cttcttct

SEQ ID NO: 133308 - DNA, 6 bp, Unknown
  misc_feature (1)..( 6): Result.003 file - promoters60/4282506
ttctct

SEQ ID NO: 133309 - DNA, 6 bp, Unknown
  misc_feature (1)..( 6): Result.003 file - promoters60/4282506
ttctct

SEQ ID NO: 133310 - DNA, 10 bp, Unknown
  misc_feature (1)..( 10): Result.003 file - promoters60/4282506
caataaactt

SEQ ID NO: 133311 - DNA, 10 bp, Unknown
  misc_feature (1)..( 10): Result.003 file - promoters60/4282506
caataaccaa

SEQ ID NO: 133312 - DNA, 10 bp, Unknown
  misc_feature (1)..( 10): Result.003 file - promoters60/4282506
aaattaccaa

SEQ ID NO: 133313 - DNA, 7 bp, Unknown
  misc_feature (1)..( 7): Result.003 file - promoters60/4282506
tttctaa

SEQ ID NO: 133314 - DNA, 7 bp, Unknown
  misc_feature (1)..( 7): Result.003 file - promoters60/4282506
tttataa

SEQ ID NO: 133315 - DNA, 6 bp, Unknown
  misc_feature (1)..( 6): Result.003 file - promoters60/4282506
tattct

SEQ ID NO: 133316 - DNA, 6 bp, Unknown
  misc_feature (1)..( 6): Result.003 file - promoters60/4282506
tattct

SEQ ID NO: 133317 - DNA, 7 bp, Unknown
  misc_feature (1)..( 7): Result.003 file - promoters60/4282506
ttcttct

SEQ ID NO: 133318 - DNA, 7 bp, Unknown
  misc_feature (1)..( 7): Result.003 file - promoters60/4282506
ttcatct

SEQ ID NO: 133319 - DNA, 7 bp, Unknown
  misc_feature (1)..( 7): Result.003 file - promoters60/4282506
gtatcaa

SEQ ID NO: 133320 - DNA, 7 bp, Unknown
  misc_feature (1)..( 7): Result.003 file - promoters60/4282506
gtatcaa

SEQ ID NO: 133321 - DNA, 8 bp, Unknown
  misc_feature (1)..( 8): Result.003 file - promoters60/4282506
cagctatt

SEQ ID NO: 133322 - DNA, 8 bp, Unknown
  misc_feature (1)..( 8): Result.003 file - promoters60/4282506
cagttatt

SEQ ID NO: 133323 - DNA, 7 bp, Unknown
  misc_feature (1)..( 7): Result.003 file - promoters60/4282506
attgttg

SEQ ID NO: 133324 - DNA, 7 bp, Unknown
  misc_feature (1)..( 7): Result.003 file - promoters60/4282506
atttttg

SEQ ID NO: 133325 - DNA, 8 bp, Unknown
  misc_feature (1)..( 8): Result.003 file - promoters60/4282506
catataaa

SEQ ID NO: 133326 - DNA, 8 bp, Unknown
  misc_feature (1)..( 8): Result.003 file - promoters60/4282506
cataaaaa

SEQ ID NO: 133327 - DNA, 7 bp, Unknown
  misc_feature (1)..( 7): Result.003 file - promoters60/4282506
acagatt

SEQ ID NO: 133328 - DNA, 7 bp, Unknown
  misc_feature (1)..( 7): Result.003 file - promoters60/4282506
acatatt

SEQ ID NO: 133329 - DNA, 7 bp, Unknown
  misc_feature (1)..( 7): Result.003 file - promoters60/4282506
tttagtt

SEQ ID NO: 133330 - DNA, 7 bp, Unknown
  misc_feature (1)..( 7): Result.003 file - promoters60/4282506
ttttgtt

SEQ ID NO: 133331 - DNA, 8 bp, Unknown
  misc_feature (1)..( 8): Result.003 file - promoters60/4282506
ttcacaaa

SEQ ID NO: 133332 - DNA, 8 bp, Unknown
  misc_feature (1)..( 8): Result.003 file - promoters60/4282506
ttcaaaaa

SEQ ID NO: 133333 - DNA, 7 bp, Unknown
  misc_feature (1)..( 7): Result.003 file - promoters60/4282564
attacaa

SEQ ID NO: 133334 - DNA, 7 bp, Unknown
  misc_feature (1)..( 7): Result.003 file - promoters60/4282564
attacaa

SEQ ID NO: 133335 - DNA, 9 bp, Unknown
  misc_feature (1)..( 9): Result.003 file - promoters60/4282564
ttcattcat

SEQ ID NO: 133336 - DNA, 9 bp, Unknown
  misc_feature (1)..( 9): Result.003 file - promoters60/4282564
ttcaatcat

SEQ ID NO: 133337 - DNA, 10 bp, Unknown
  misc_feature (1)..( 10): Result.003 file - promoters60/4282564
aatcaacaaa

SEQ ID NO: 133338 - DNA, 10 bp, Unknown
  misc_feature (1)..( 10): Result.003 file - promoters60/4282564
aatcaataaa

SEQ ID NO: 133339 - DNA, 8 bp, Unknown
  misc_feature (1)..( 8): Result.003 file - promoters60/4282564
ataaaacc

SEQ ID NO: 133340 - DNA, 8 bp, Unknown
  misc_feature (1)..( 8): Result.003 file - promoters60/4282564
ataaaacc

SEQ ID NO: 133341 - DNA, 6 bp, Unknown
  misc_feature (1)..( 6): Result.003 file - promoters60/4282564
attgga

SEQ ID NO: 133342 - DNA, 6 bp, Unknown
  misc_feature (1)..( 6): Result.003 file - promoters60/4282564
attgga

SEQ ID NO: 133343 - DNA, 6 bp, Unknown
  misc_feature (1)..( 6): Result.003 file - promoters60/4282564
aactaa

SEQ ID NO: 133344 - DNA, 6 bp, Unknown
  misc_feature (1)..( 6): Result.003 file - promoters60/4282564
aactaa

SEQ ID NO: 133345 - DNA, 6 bp, Unknown
  misc_feature (1)..( 6): Result.003 file - promoters60/4282564
tgtttc

SEQ ID NO: 133346 - DNA, 6 bp, Unknown
  misc_feature (1)..( 6): Result.003 file - promoters60/4282564
tgtttc

SEQ ID NO: 133347 - DNA, 12 bp, Unknown
  misc_feature (1)..( 12): Result.003 file - promoters60/4282580
ttggttgtttga

SEQ ID NO: 133348 - DNA, 12 bp, Unknown
  misc_feature (1)..( 12): Result.003 file - promoters60/4282580
ttgattgattga

SEQ ID NO: 133349 - DNA, 12 bp, Unknown
  misc_feature (1)..( 12): Result.003 file - promoters60/4282580
ataatttattta

SEQ ID NO: 133350 - DNA, 12 bp, Unknown
  misc_feature (1)..( 12): Result.003 file - promoters60/4282580
atcatttttttc

SEQ ID NO: 133351 - DNA, 8 bp, Unknown
  misc_feature (1)..( 8): Result.003 file - promoters60/4282580
ttttgtag

SEQ ID NO: 133352 - DNA, 8 bp, Unknown
  misc_feature (1)..( 8): Result.003 file - promoters60/4282580
ttttttag

SEQ ID NO: 133353 - DNA, 8 bp, Unknown
  misc_feature (1)..( 8): Result.003 file - promoters60/4282580
tgttttag

SEQ ID NO: 133354 - DNA, 8 bp, Unknown
  misc_feature (1)..( 8): Result.003 file - promoters60/4282580
atttttac

SEQ ID NO: 133355 - DNA, 10 bp, Unknown
  misc_feature (1)..( 10): Result.003 file - promoters60/4282580
tatcttcaaa

SEQ ID NO: 133356 - DNA, 10 bp, Unknown
  misc_feature (1)..( 10): Result.003 file - promoters60/4282580
tattttcagt

SEQ ID NO: 133357 - DNA, 10 bp, Unknown
  misc_feature (1)..( 10): Result.003 file - promoters60/4282580
gattttcatt

SEQ ID NO: 133358 - DNA, 10 bp, Unknown
  misc_feature (1)..( 10): Result.003 file - promoters60/4282580
ttgtttgatt

SEQ ID NO: 133359 - DNA, 8 bp, Unknown
  misc_feature (1)..( 8): Result.003 file - promoters60/4282580
caattttg

SEQ ID NO: 133360 - DNA, 8 bp, Unknown
  misc_feature (1)..( 8): Result.003 file - promoters60/4282580
tgattttg

SEQ ID NO: 133361 - DNA, 8 bp, Unknown
  misc_feature (1)..( 8): Result.003 file - promoters60/4282580
taatttta

SEQ ID NO: 133362 - DNA, 8 bp, Unknown
  misc_feature (1)..( 8): Result.003 file - promoters60/4282580
tgattttg

SEQ ID NO: 133363 - DNA, 10 bp, Unknown
  misc_feature (1)..( 10): Result.003 file - promoters60/4282580
gtttaattga

SEQ ID NO: 133364 - DNA, 10 bp, Unknown
  misc_feature (1)..( 10): Result.003 file - promoters60/4282580
gtttgattgt

SEQ ID NO: 133365 - DNA, 10 bp, Unknown
  misc_feature (1)..( 10): Result.003 file - promoters60/4282580
atttgatttt

SEQ ID NO: 133366 - DNA, 11 bp, Unknown
  misc_feature (1)..( 11): Result.003 file - promoters60/4282580
ataaaatatga

SEQ ID NO: 133367 - DNA, 9 bp, Unknown
  misc_feature (1)..( 9): Result.003 file - promoters60/4282580
atttagatt

SEQ ID NO: 133368 - DNA, 9 bp, Unknown
  misc_feature (1)..( 9): Result.003 file - promoters60/4282580
aattagatc

SEQ ID NO: 133369 - DNA, 9 bp, Unknown
  misc_feature (1)..( 9): Result.003 file - promoters60/4282580
atttatatt

SEQ ID NO: 133370 - DNA, 9 bp, Unknown
  misc_feature (1)..( 9): Result.003 file - promoters60/4282580
tcttatatc

SEQ ID NO: 133371 - DNA, 8 bp, Unknown
  misc_feature (1)..( 8): Result.003 file - promoters60/4282588
aacaaaat

SEQ ID NO: 133372 - DNA, 8 bp, Unknown
  misc_feature (1)..( 8): Result.003 file - promoters60/4282588
aacacaat

SEQ ID NO: 133373 - DNA, 6 bp, Unknown
  misc_feature (1)..( 6): Result.003 file - promoters60/4282588
aatgtg

SEQ ID NO: 133374 - DNA, 6 bp, Unknown
  misc_feature (1)..( 6): Result.003 file - promoters60/4282588
aatgtg

SEQ ID NO: 133375 - DNA, 6 bp, Unknown
  misc_feature (1)..( 6): Result.003 file - promoters60/4282588
acacat

SEQ ID NO: 133376 - DNA, 6 bp, Unknown
  misc_feature (1)..( 6): Result.003 file - promoters60/4282588
acacat

SEQ ID NO: 133377 - DNA, 7 bp, Unknown
  misc_feature (1)..( 7): Result.003 file - promoters60/4282588
caataaa

SEQ ID NO: 133378 - DNA, 7 bp, Unknown
  misc_feature (1)..( 7): Result.003 file - promoters60/4282588
caataat

SEQ ID NO: 133379 - DNA, 7 bp, Unknown
  misc_feature (1)..( 7): Result.003 file - promoters60/4282588
taataaa

SEQ ID NO: 133380 - DNA, 8 bp, Unknown
  misc_feature (1)..( 8): Result.003 file - promoters60/4282588
agaaaaat

SEQ ID NO: 133381 - DNA, 8 bp, Unknown
  misc_feature (1)..( 8): Result.003 file - promoters60/4282588
caaaaaat

SEQ ID NO: 133382 - DNA, 8 bp, Unknown
  misc_feature (1)..( 8): Result.003 file - promoters60/4282588
agaaaaaa

SEQ ID NO: 133383 - DNA, 9 bp, Unknown
  misc_feature (1)..( 9): Result.003 file - promoters60/4282588
aatgaagta

SEQ ID NO: 133384 - DNA, 9 bp, Unknown
  misc_feature (1)..( 9): Result.003 file - promoters60/4282588
aatgacgta

SEQ ID NO: 133385 - DNA, 10 bp, Unknown
  misc_feature (1)..( 10): Result.003 file - promoters60/4282588
gaaaaatcta

SEQ ID NO: 133386 - DNA, 10 bp, Unknown
  misc_feature (1)..( 10): Result.003 file - promoters60/4282588
gaaatatcta

SEQ ID NO: 133387 - DNA, 9 bp, Unknown
  misc_feature (1)..( 9): Result.003 file - promoters60/4282588
ctataaata

SEQ ID NO: 133388 - DNA, 9 bp, Unknown
  misc_feature (1)..( 9): Result.003 file - promoters60/4282588
ctatatata

SEQ ID NO: 133389 - DNA, 9 bp, Unknown
  misc_feature (1)..( 9): Result.003 file - promoters60/4282588
atataaacc

SEQ ID NO: 133390 - DNA, 7 bp, Unknown
  misc_feature (1)..( 7): Result.003 file - promoters60/4282588
tttttaa

SEQ ID NO: 133391 - DNA, 7 bp, Unknown
  misc_feature (1)..( 7): Result.003 file - promoters60/4282588
tttgtaa

SEQ ID NO: 133392 - DNA, 7 bp, Unknown
  misc_feature (1)..( 7): Result.003 file - promoters60/4282588
aataatg

SEQ ID NO: 133393 - DNA, 7 bp, Unknown
  misc_feature (1)..( 7): Result.003 file - promoters60/4282588
aataata

SEQ ID NO: 133394 - DNA, 7 bp, Unknown
  misc_feature (1)..( 7): Result.003 file - promoters60/4282588
cataata

SEQ ID NO: 133395 - DNA, 10 bp, Unknown
  misc_feature (1)..( 10): Result.003 file - promoters60/4282588
gtaaaaacta

SEQ ID NO: 133396 - DNA, 10 bp, Unknown
  misc_feature (1)..( 10): Result.003 file - promoters60/4282588
ataataacta

SEQ ID NO: 133397 - DNA, 10 bp, Unknown
  misc_feature (1)..( 10): Result.003 file - promoters60/4282588
ataataggct

SEQ ID NO: 133398 - DNA, 6 bp, Unknown
  misc_feature (1)..( 6): Result.003 file - promoters60/4282588
aataaa

SEQ ID NO: 133399 - DNA, 6 bp, Unknown
  misc_feature (1)..( 6): Result.003 file - promoters60/4282588
aataaa

SEQ ID NO: 133400 - DNA, 6 bp, Unknown
  misc_feature (1)..( 6): Result.003 file - promoters60/4282588
aaaaac

SEQ ID NO: 133401 - DNA, 6 bp, Unknown
  misc_feature (1)..( 6): Result.003 file - promoters60/4282588
aaaaac

SEQ ID NO: 133402 - DNA, 7 bp, Unknown
  misc_feature (1)..( 7): Result.003 file - promoters60/4282588
aaaaaaa

SEQ ID NO: 133403 - DNA, 7 bp, Unknown
  misc_feature (1)..( 7): Result.003 file - promoters60/4282588
aaataaa

SEQ ID NO: 133404 - DNA, 10 bp, Unknown
  misc_feature (1)..( 10): Result.003 file - promoters60/4282588
aagatatttt

SEQ ID NO: 133405 - DNA, 10 bp, Unknown
  misc_feature (1)..( 10): Result.003 file - promoters60/4282588
ttgatttttt

SEQ ID NO: 133406 - DNA, 10 bp, Unknown
  misc_feature (1)..( 10): Result.003 file - promoters60/4282588
ttgatttttg

SEQ ID NO: 133407 - DNA, 7 bp, Unknown
  misc_feature (1)..( 7): Result.003 file - promoters60/4282588
tttaaaa

SEQ ID NO: 133408 - DNA, 7 bp, Unknown
  misc_feature (1)..( 7): Result.003 file - promoters60/4282588
tttaaaa

SEQ ID NO: 133409 - DNA, 7 bp, Unknown
  misc_feature (1)..( 7): Result.003 file - promoters60/4282588
tttaaac

SEQ ID NO: 133410 - DNA, 7 bp, Unknown
  misc_feature (1)..( 7): Result.003 file - promoters60/4282588
tttaaac

SEQ ID NO: 133411 - DNA, 7 bp, Unknown
  misc_feature (1)..( 7): Result.003 file - promoters60/4282588
actcata

SEQ ID NO: 133412 - DNA, 7 bp, Unknown
  misc_feature (1)..( 7): Result.003 file - promoters60/4282588
actaata

SEQ ID NO: 133413 - DNA, 8 bp, Unknown
  misc_feature (1)..( 8): Result.003 file - promoters60/4282588
tttgaact

SEQ ID NO: 133414 - DNA, 8 bp, Unknown
  misc_feature (1)..( 8): Result.003 file - promoters60/4282588
tttaaact

SEQ ID NO: 133415 - DNA, 6 bp, Unknown
  misc_feature (1)..( 6): Result.003 file - promoters60/4282588
gcataa

SEQ ID NO: 133416 - DNA, 6 bp, Unknown
  misc_feature (1)..( 6): Result.003 file - promoters60/4282588
gcataa

SEQ ID NO: 133417 - DNA, 11 bp, Unknown
  misc_feature (1)..( 11): Result.003 file - promoters60/4282588
aatatttttct

SEQ ID NO: 133418 - DNA, 11 bp, Unknown
  misc_feature (1)..( 11): Result.003 file - promoters60/4282588
aatttttttct

SEQ ID NO: 133419 - DNA, 7 bp, Unknown
  misc_feature (1)..( 7): Result.003 file - promoters60/4282588
aaattta

SEQ ID NO: 133420 - DNA, 7 bp, Unknown
  misc_feature (1)..( 7): Result.003 file - promoters60/4282588
aaaatta

SEQ ID NO: 133421 - DNA, 7 bp, Unknown
  misc_feature (1)..( 7): Result.003 file - promoters60/4282588
aaatata

SEQ ID NO: 133422 - DNA, 7 bp, Unknown
  misc_feature (1)..( 7): Result.003 file - promoters60/4282588
aaaaata

SEQ ID NO: 133423 - DNA, 6 bp, Unknown
  misc_feature (1)..( 6): Result.003 file - promoters60/4282588
tttgac

SEQ ID NO: 133424 - DNA, 6 bp, Unknown
  misc_feature (1)..( 6): Result.003 file - promoters60/4282588
tttgac

SEQ ID NO: 133425 - DNA, 7 bp, Unknown
  misc_feature (1)..( 7): Result.003 file - promoters60/4282588
aaagaag

SEQ ID NO: 133426 - DNA, 7 bp, Unknown
  misc_feature (1)..( 7): Result.003 file - promoters60/4282588
aaaaaag

SEQ ID NO: 133427 - DNA, 9 bp, Unknown
  misc_feature (1)..( 9): Result.003 file - promoters60/4282588
aaaggactc

SEQ ID NO: 133428 - DNA, 9 bp, Unknown
  misc_feature (1)..( 9): Result.003 file - promoters60/4282588
aaaagactc

SEQ ID NO: 133429 - DNA, 6 bp, Unknown
  misc_feature (1)..( 6): Result.003 file - promoters60/4282588
cagccg

SEQ ID NO: 133430 - DNA, 6 bp, Unknown
  misc_feature (1)..( 6): Result.003 file - promoters60/4282588
cagccg

SEQ ID NO: 133431 - DNA, 6 bp, Unknown
  misc_feature (1)..( 6): Result.003 file - promoters60/4282588
tctcct

SEQ ID NO: 133432 - DNA, 6 bp, Unknown
  misc_feature (1)..( 6): Result.003 file - promoters60/4282588
tctcct

SEQ ID NO: 133433 - DNA, 8 bp, Unknown
  misc_feature (1)..( 8): Result.003 file - promoters60/4282611
tttgattc

SEQ ID NO: 133434 - DNA, 8 bp, Unknown
  misc_feature (1)..( 8): Result.003 file - promoters60/4282611
attgattc

SEQ ID NO: 133435 - DNA, 8 bp, Unknown
  misc_feature (1)..( 8): Result.003 file - promoters60/4282611
tttgtttc

SEQ ID NO: 133436 - DNA, 7 bp, Unknown
  misc_feature (1)..( 7): Result.003 file - promoters60/4282611
tacaaat

SEQ ID NO: 133437 - DNA, 7 bp, Unknown
  misc_feature (1)..( 7): Result.003 file - promoters60/4282611
aacaaat

SEQ ID NO: 133438 - DNA, 7 bp, Unknown
  misc_feature (1)..( 7): Result.003 file - promoters60/4282611
aacaaac

SEQ ID NO: 133439 - DNA, 9 bp, Unknown
  misc_feature (1)..( 9): Result.003 file - promoters60/4282611
taagtaaaa

SEQ ID NO: 133440 - DNA, 9 bp, Unknown
  misc_feature (1)..( 9): Result.003 file - promoters60/4282611
taactaaaa

SEQ ID NO: 133441 - DNA, 9 bp, Unknown
  misc_feature (1)..( 9): Result.003 file - promoters60/4282611
taatgactt

SEQ ID NO: 133442 - DNA, 8 bp, Unknown
  misc_feature (1)..( 8): Result.003 file - promoters60/4282611
taaaaacc

SEQ ID NO: 133443 - DNA, 8 bp, Unknown
  misc_feature (1)..( 8): Result.003 file - promoters60/4282611
taataact

SEQ ID NO: 133444 - DNA, 8 bp, Unknown
  misc_feature (1)..( 8): Result.003 file - promoters60/4282611
taatgact

SEQ ID NO: 133445 - DNA, 9 bp, Unknown
  misc_feature (1)..( 9): Result.003 file - promoters60/4282614
gagattcat

SEQ ID NO: 133446 - DNA, 9 bp, Unknown
  misc_feature (1)..( 9): Result.003 file - promoters60/4282614
tttattcat

SEQ ID NO: 133447 - DNA, 9 bp, Unknown
  misc_feature (1)..( 9): Result.003 file - promoters60/4282614
tttcttcac

SEQ ID NO: 133448 - DNA, 9 bp, Unknown
  misc_feature (1)..( 9): Result.003 file - promoters60/4282614
tttcttcac

SEQ ID NO: 133449 - DNA, 9 bp, Unknown
  misc_feature (1)..( 9): Result.003 file - promoters60/4282614
gatttgttt

SEQ ID NO: 133450 - DNA, 9 bp, Unknown
  misc_feature (1)..( 9): Result.003 file - promoters60/4282614
tttttgttg

SEQ ID NO: 133451 - DNA, 9 bp, Unknown
  misc_feature (1)..( 9): Result.003 file - promoters60/4282614
aatttattt

SEQ ID NO: 133452 - DNA, 9 bp, Unknown
  misc_feature (1)..( 9): Result.003 file - promoters60/4282614
gatttgttt

SEQ ID NO: 133453 - DNA, 10 bp, Unknown
  misc_feature (1)..( 10): Result.003 file - promoters60/4282614
aaaatggtaa

SEQ ID NO: 133454 - DNA, 10 bp, Unknown
  misc_feature (1)..( 10): Result.003 file - promoters60/4282614
aaaatgtttt

SEQ ID NO: 133455 - DNA, 10 bp, Unknown
  misc_feature (1)..( 10): Result.003 file - promoters60/4282614
gaaatatttt

SEQ ID NO: 133456 - DNA, 10 bp, Unknown
  misc_feature (1)..( 10): Result.003 file - promoters60/4282614
gaaatatctc

SEQ ID NO: 133457 - DNA, 9 bp, Unknown
  misc_feature (1)..( 9): Result.003 file - promoters60/4282614
actatcata

SEQ ID NO: 133458 - DNA, 9 bp, Unknown
  misc_feature (1)..( 9): Result.003 file - promoters60/4282614
tcaatcata

SEQ ID NO: 133459 - DNA, 9 bp, Unknown
  misc_feature (1)..( 9): Result.003 file - promoters60/4282614
aatatgata

SEQ ID NO: 133460 - DNA, 9 bp, Unknown
  misc_feature (1)..( 9): Result.003 file - promoters60/4282614
tcaaccata

SEQ ID NO: 133461 - DNA, 9 bp, Unknown
  misc_feature (1)..( 9): Result.003 file - promoters60/4282614
aaatttcat

SEQ ID NO: 133462 - DNA, 9 bp, Unknown
  misc_feature (1)..( 9): Result.003 file - promoters60/4282614
taatttcat

SEQ ID NO: 133463 - DNA, 9 bp, Unknown
  misc_feature (1)..( 9): Result.003 file - promoters60/4282614
taatttatt

SEQ ID NO: 133464 - DNA, 9 bp, Unknown
  misc_feature (1)..( 9): Result.003 file - promoters60/4282614
taatctcat

SEQ ID NO: 133465 - DNA, 8 bp, Unknown
  misc_feature (1)..( 8): Result.003 file - promoters60/4282614
caaagaaa

SEQ ID NO: 133466 - DNA, 8 bp, Unknown
  misc_feature (1)..( 8): Result.003 file - promoters60/4282614
aaaagaat

SEQ ID NO: 133467 - DNA, 9 bp, Unknown
  misc_feature (1)..( 9): Result.003 file - promoters60/4282614
tttaagaaa

SEQ ID NO: 133468 - DNA, 9 bp, Unknown
  misc_feature (1)..( 9): Result.003 file - promoters60/4282614
aaatagaac

SEQ ID NO: 133469 - DNA, 12 bp, Unknown
  misc_feature (1)..( 12): Result.003 file - promoters60/4282614
aaaatatgtata

SEQ ID NO: 133470 - DNA, 12 bp, Unknown
  misc_feature (1)..( 12): Result.003 file - promoters60/4282614
aaaatgtgtgtt

SEQ ID NO: 133471 - DNA, 12 bp, Unknown
  misc_feature (1)..( 12): Result.003 file - promoters60/4282614
ttcctatttatt

SEQ ID NO: 133472 - DNA, 12 bp, Unknown
  misc_feature (1)..( 12): Result.003 file - promoters60/4282614
ttgaactttatt

SEQ ID NO: 133473 - DNA, 12 bp, Unknown
  misc_feature (1)..( 12): Result.003 file - promoters60/4282614
aacaaaaagaaa

SEQ ID NO: 133474 - DNA, 12 bp, Unknown
  misc_feature (1)..( 12): Result.003 file - promoters60/4282614
agactaaataaa

SEQ ID NO: 133475 - DNA, 12 bp, Unknown
  misc_feature (1)..( 12): Result.003 file - promoters60/4282614
aacaaaaagaaa

SEQ ID NO: 133476 - DNA, 12 bp, Unknown
  misc_feature (1)..( 12): Result.003 file - promoters60/4282614
ccacacaacaac

SEQ ID NO: 133477 - DNA, 7 bp, Unknown
  misc_feature (1)..( 7): Result.003 file - promoters60/4282626
ataaaaa

SEQ ID NO: 133478 - DNA, 7 bp, Unknown
  misc_feature (1)..( 7): Result.003 file - promoters60/4282626
ataaaaa

SEQ ID NO: 133479 - DNA, 15 bp, Unknown
  misc_feature (1)..( 15): Result.003 file - promoters60/4282626
taaaattaaaatata

SEQ ID NO: 133480 - DNA, 15 bp, Unknown
  misc_feature (1)..( 15): Result.003 file - promoters60/4282626
aaccattgaaagata

SEQ ID NO: 133481 - DNA, 15 bp, Unknown
  misc_feature (1)..( 15): Result.003 file - promoters60/4282626
ataaattaatctgat

SEQ ID NO: 133482 - DNA, 7 bp, Unknown
  misc_feature (1)..( 7): Result.003 file - promoters60/4282626
tagaaag

SEQ ID NO: 133483 - DNA, 7 bp, Unknown
  misc_feature (1)..( 7): Result.003 file - promoters60/4282626
tagaaag

SEQ ID NO: 133484 - DNA, 8 bp, Unknown
  misc_feature (1)..( 8): Result.003 file - promoters60/4282626
gtgtattt

SEQ ID NO: 133485 - DNA, 8 bp, Unknown
  misc_feature (1)..( 8): Result.003 file - promoters60/4282626
gtgtcttt

SEQ ID NO: 133486 - DNA, 7 bp, Unknown
  misc_feature (1)..( 7): Result.003 file - promoters60/4282626
aaattca

SEQ ID NO: 133487 - DNA, 7 bp, Unknown
  misc_feature (1)..( 7): Result.003 file - promoters60/4282626
aaaatca

SEQ ID NO: 133488 - DNA, 8 bp, Unknown
  misc_feature (1)..( 8): Result.003 file - promoters60/4282626
ctttgttg

SEQ ID NO: 133489 - DNA, 8 bp, Unknown
  misc_feature (1)..( 8): Result.003 file - promoters60/4282626
cttagttg

SEQ ID NO: 133490 - DNA, 9 bp, Unknown
  misc_feature (1)..( 9): Result.003 file - promoters60/4282626
aagtaaaaa

SEQ ID NO: 133491 - DNA, 9 bp, Unknown
  misc_feature (1)..( 9): Result.003 file - promoters60/4282626
aagtaaaaa

SEQ ID NO: 133492 - DNA, 9 bp, Unknown
  misc_feature (1)..( 9): Result.003 file - promoters60/4282626
aaaaaataa

SEQ ID NO: 133493 - DNA, 9 bp, Unknown
  misc_feature (1)..( 9): Result.003 file - promoters60/4282626
aaaaactaa

SEQ ID NO: 133494 - DNA, 10 bp, Unknown
  misc_feature (1)..( 10): Result.003 file - promoters60/4282626
aaaaattatt

SEQ ID NO: 133495 - DNA, 10 bp, Unknown
  misc_feature (1)..( 10): Result.003 file - promoters60/4282626
aaaatttatt

SEQ ID NO: 133496 - DNA, 6 bp, Unknown
  misc_feature (1)..( 6): Result.003 file - promoters60/4282626
tattta

SEQ ID NO: 133497 - DNA, 6 bp, Unknown
  misc_feature (1)..( 6): Result.003 file - promoters60/4282626
tattta

SEQ ID NO: 133498 - DNA, 6 bp, Unknown
  misc_feature (1)..( 6): Result.003 file - promoters60/4282626
aaaagt

SEQ ID NO: 133499 - DNA, 6 bp, Unknown
  misc_feature (1)..( 6): Result.003 file - promoters60/4282626
aaaagt

SEQ ID NO: 133500 - DNA, 6 bp, Unknown
  misc_feature (1)..( 6): Result.003 file - promoters60/4282626
gaataa

SEQ ID NO: 133501 - DNA, 6 bp, Unknown
  misc_feature (1)..( 6): Result.003 file - promoters60/4282626
gaataa

SEQ ID NO: 133502 - DNA, 8 bp, Unknown
  misc_feature (1)..( 8): Result.003 file - promoters60/4282626
atatttta

SEQ ID NO: 133503 - DNA, 8 bp, Unknown
  misc_feature (1)..( 8): Result.003 file - promoters60/4282626
ataatttg

SEQ ID NO: 133504 - DNA, 8 bp, Unknown
  misc_feature (1)..( 8): Result.003 file - promoters60/4282626
caaatttg

SEQ ID NO: 133505 - DNA, 8 bp, Unknown
  misc_feature (1)..( 8): Result.003 file - promoters60/4282626
ttaacttg

SEQ ID NO: 133506 - DNA, 8 bp, Unknown
  misc_feature (1)..( 8): Result.003 file - promoters60/4282626
ttaatttg

SEQ ID NO: 133507 - DNA, 6 bp, Unknown
  misc_feature (1)..( 6): Result.003 file - promoters60/4282626
tgtttc

SEQ ID NO: 133508 - DNA, 6 bp, Unknown
  misc_feature (1)..( 6): Result.003 file - promoters60/4282626
tgtttc

SEQ ID NO: 133509 - DNA, 7 bp, Unknown
  misc_feature (1)..( 7): Result.003 file - promoters60/4282626
cgtcttc

SEQ ID NO: 133510 - DNA, 7 bp, Unknown
  misc_feature (1)..( 7): Result.003 file - promoters60/4282626
cgttttc

SEQ ID NO: 133511 - DNA, 7 bp, Unknown
  misc_feature (1)..( 7): Result.003 file - promoters60/4282626
gtattat

SEQ ID NO: 133512 - DNA, 7 bp, Unknown
  misc_feature (1)..( 7): Result.003 file - promoters60/4282626
gtattat

SEQ ID NO: 133513 - DNA, 6 bp, Unknown
  misc_feature (1)..( 6): Result.003 file - promoters60/4282626
aatttg

SEQ ID NO: 133514 - DNA, 6 bp, Unknown
  misc_feature (1)..( 6): Result.003 file - promoters60/4282626
aatttg

SEQ ID NO: 133515 - DNA, 8 bp, Unknown
  misc_feature (1)..( 8): Result.003 file - promoters60/4282641
ttaagaaa

SEQ ID NO: 133516 - DNA, 8 bp, Unknown
  misc_feature (1)..( 8): Result.003 file - promoters60/4282641
ttaagaat

SEQ ID NO: 133517 - DNA, 8 bp, Unknown
  misc_feature (1)..( 8): Result.003 file - promoters60/4282641
aaaagaaa

SEQ ID NO: 133518 - DNA, 7 bp, Unknown
  misc_feature (1)..( 7): Result.003 file - promoters60/4282641
agatttt

SEQ ID NO: 133519 - DNA, 7 bp, Unknown
  misc_feature (1)..( 7): Result.003 file - promoters60/4282641
agaattt

SEQ ID NO: 133520 - DNA, 7 bp, Unknown
  misc_feature (1)..( 7): Result.003 file - promoters60/4282641
tgatttt

SEQ ID NO: 133521 - DNA, 9 bp, Unknown
  misc_feature (1)..( 9): Result.003 file - promoters60/4282641
attttatga

SEQ ID NO: 133522 - DNA, 9 bp, Unknown
  misc_feature (1)..( 9): Result.003 file - promoters60/4282641
cttttttga

SEQ ID NO: 133523 - DNA, 9 bp, Unknown
  misc_feature (1)..( 9): Result.003 file - promoters60/4282641
atttaatgt

SEQ ID NO: 133524 - DNA, 8 bp, Unknown
  misc_feature (1)..( 8): Result.003 file - promoters60/4282641
gttttctt

SEQ ID NO: 133525 - DNA, 8 bp, Unknown
  misc_feature (1)..( 8): Result.003 file - promoters60/4282641
cttttctc

SEQ ID NO: 133526 - DNA, 8 bp, Unknown
  misc_feature (1)..( 8): Result.003 file - promoters60/4282641
cttgtctc

SEQ ID NO: 133527 - DNA, 7 bp, Unknown
  misc_feature (1)..( 7): Result.003 file - promoters60/4282641
tcacttg

SEQ ID NO: 133528 - DNA, 7 bp, Unknown
  misc_feature (1)..( 7): Result.003 file - promoters60/4282641
tcatttg

SEQ ID NO: 133529 - DNA, 7 bp, Unknown
  misc_feature (1)..( 7): Result.003 file - promoters60/4282641
ccatttg

SEQ ID NO: 133530 - DNA, 9 bp, Unknown
  misc_feature (1)..( 9): Result.003 file - promoters60/4282647
atcgtatat

SEQ ID NO: 133531 - DNA, 9 bp, Unknown
  misc_feature (1)..( 9): Result.003 file - promoters60/4282647
atcctatat

SEQ ID NO: 133532 - DNA, 6 bp, Unknown
  misc_feature (1)..( 6): Result.003 file - promoters60/4282647
ttgaat

SEQ ID NO: 133533 - DNA, 6 bp, Unknown
  misc_feature (1)..( 6): Result.003 file - promoters60/4282647
ttgaat

SEQ ID NO: 133534 - DNA, 13 bp, Unknown
  misc_feature (1)..( 13): Result.003 file - promoters60/4282647
ttaatcaagattt

SEQ ID NO: 133535 - DNA, 13 bp, Unknown
  misc_feature (1)..( 13): Result.003 file - promoters60/4282647
ttagtcaaaattt

SEQ ID NO: 133536 - DNA, 9 bp, Unknown
  misc_feature (1)..( 9): Result.003 file - promoters60/4282647
ttttgattt

SEQ ID NO: 133537 - DNA, 9 bp, Unknown
  misc_feature (1)..( 9): Result.003 file - promoters60/4282647
atttgatag

SEQ ID NO: 133538 - DNA, 9 bp, Unknown
  misc_feature (1)..( 9): Result.003 file - promoters60/4282647
ttttggttt

SEQ ID NO: 133539 - DNA, 6 bp, Unknown
  misc_feature (1)..( 6): Result.003 file - promoters60/4282647
ttgatt

SEQ ID NO: 133540 - DNA, 6 bp, Unknown
  misc_feature (1)..( 6): Result.003 file - promoters60/4282647
ttgatt

SEQ ID NO: 133541 - DNA, 7 bp, Unknown
  misc_feature (1)..( 7): Result.003 file - promoters60/4282647
cttcttt

SEQ ID NO: 133542 - DNA, 7 bp, Unknown
  misc_feature (1)..( 7): Result.003 file - promoters60/4282647
cttgttt

SEQ ID NO: 133543 - DNA, 8 bp, Unknown
  misc_feature (1)..( 8): Result.003 file - promoters60/4282647
tatcattt

SEQ ID NO: 133544 - DNA, 8 bp, Unknown
  misc_feature (1)..( 8): Result.003 file - promoters60/4282647
tatcattt

SEQ ID NO: 133545 - DNA, 7 bp, Unknown
  misc_feature (1)..( 7): Result.003 file - promoters60/4282647
ttgtaat

SEQ ID NO: 133546 - DNA, 7 bp, Unknown
  misc_feature (1)..( 7): Result.003 file - promoters60/4282647
ttgaaat

SEQ ID NO: 133547 - DNA, 6 bp, Unknown
  misc_feature (1)..( 6): Result.003 file - promoters60/4282647
aaatat

SEQ ID NO: 133548 - DNA, 6 bp, Unknown
  misc_feature (1)..( 6): Result.003 file - promoters60/4282647
aaatat

SEQ ID NO: 133549 - DNA, 12 bp, Unknown
  misc_feature (1)..( 12): Result.003 file - promoters60/4282647
aacaaacacaac

SEQ ID NO: 133550 - DNA, 12 bp, Unknown
  misc_feature (1)..( 12): Result.003 file - promoters60/4282647
tccaaactcaac

SEQ ID NO: 133551 - DNA, 12 bp, Unknown
  misc_feature (1)..( 12): Result.003 file - promoters60/4282647
aacaatcactct

SEQ ID NO: 133552 - DNA, 8 bp, Unknown
  misc_feature (1)..( 8): Result.003 file - promoters60/4282647
ctaaattt

SEQ ID NO: 133553 - DNA, 8 bp, Unknown
  misc_feature (1)..( 8): Result.003 file - promoters60/4282647
ctaatttt

SEQ ID NO: 133554 - DNA, 10 bp, Unknown
  misc_feature (1)..( 10): Result.003 file - promoters60/4282647
taaaaacctg

SEQ ID NO: 133555 - DNA, 10 bp, Unknown
  misc_feature (1)..( 10): Result.003 file - promoters60/4282647
ataaaatctg

SEQ ID NO: 133556 - DNA, 10 bp, Unknown
  misc_feature (1)..( 10): Result.003 file - promoters60/4282647
taaaaacact

SEQ ID NO: 133557 - DNA, 8 bp, Unknown
  misc_feature (1)..( 8): Result.003 file - promoters60/4282647
gacaactt

SEQ ID NO: 133558 - DNA, 8 bp, Unknown
  misc_feature (1)..( 8): Result.003 file - promoters60/4282647
gactactt

SEQ ID NO: 133559 - DNA, 7 bp, Unknown
  misc_feature (1)..( 7): Result.003 file - promoters60/4282647
atttttt

SEQ ID NO: 133560 - DNA, 7 bp, Unknown
  misc_feature (1)..( 7): Result.003 file - promoters60/4282647
atttttt

SEQ ID NO: 133561 - DNA, 7 bp, Unknown
  misc_feature (1)..( 7): Result.003 file - promoters60/4282647
gtttttt

SEQ ID NO: 133562 - DNA, 8 bp, Unknown
  misc_feature (1)..( 8): Result.003 file - promoters60/4282647
tcagtaat

SEQ ID NO: 133563 - DNA, 8 bp, Unknown
  misc_feature (1)..( 8): Result.003 file - promoters60/4282647
tcattaat

SEQ ID NO: 133564 - DNA, 6 bp, Unknown
  misc_feature (1)..( 6): Result.003 file - promoters60/4282647
tctatt

SEQ ID NO: 133565 - DNA, 6 bp, Unknown
  misc_feature (1)..( 6): Result.003 file - promoters60/4282647
tctatt

SEQ ID NO: 133566 - DNA, 7 bp, Unknown
  misc_feature (1)..( 7): Result.003 file - promoters60/4282647
caacatt

SEQ ID NO: 133567 - DNA, 7 bp, Unknown
  misc_feature (1)..( 7): Result.003 file - promoters60/4282647
caaaatt

SEQ ID NO: 133568 - DNA, 7 bp, Unknown
  misc_feature (1)..( 7): Result.003 file - promoters60/4282647
taccaaa

SEQ ID NO: 133569 - DNA, 7 bp, Unknown
  misc_feature (1)..( 7): Result.003 file - promoters60/4282647
tacaaaa

SEQ ID NO: 133570 - DNA, 7 bp, Unknown
  misc_feature (1)..( 7): Result.003 file - promoters60/4282647
aataaaa

SEQ ID NO: 133571 - DNA, 7 bp, Unknown
  misc_feature (1)..( 7): Result.003 file - promoters60/4282647
aattaaa

SEQ ID NO: 133572 - DNA, 7 bp, Unknown
  misc_feature (1)..( 7): Result.003 file - promoters60/4282647
atataat

SEQ ID NO: 133573 - DNA, 7 bp, Unknown
  misc_feature (1)..( 7): Result.003 file - promoters60/4282647
atataat

SEQ ID NO: 133574 - DNA, 8 bp, Unknown
  misc_feature (1)..( 8): Result.003 file - promoters60/4282647
gttaatac

SEQ ID NO: 133575 - DNA, 8 bp, Unknown
  misc_feature (1)..( 8): Result.003 file - promoters60/4282647
gttcatac

SEQ ID NO: 133576 - DNA, 8 bp, Unknown
  misc_feature (1)..( 8): Result.003 file - promoters60/4282647
tatttttt

SEQ ID NO: 133577 - DNA, 8 bp, Unknown
  misc_feature (1)..( 8): Result.003 file - promoters60/4282647
tattcttt

SEQ ID NO: 133578 - DNA, 8 bp, Unknown
  misc_feature (1)..( 8): Result.003 file - promoters60/4282647
cttttttc

SEQ ID NO: 133579 - DNA, 8 bp, Unknown
  misc_feature (1)..( 8): Result.003 file - promoters60/4282647
ctttattc

SEQ ID NO: 133580 - DNA, 8 bp, Unknown
  misc_feature (1)..( 8): Result.003 file - promoters60/4282647
ttgtggta

SEQ ID NO: 133581 - DNA, 8 bp, Unknown
  misc_feature (1)..( 8): Result.003 file - promoters60/4282647
ttgtcgta

SEQ ID NO: 133582 - DNA, 8 bp, Unknown
  misc_feature (1)..( 8): Result.003 file - promoters60/4282647
cattcatg

SEQ ID NO: 133583 - DNA, 8 bp, Unknown
  misc_feature (1)..( 8): Result.003 file - promoters60/4282647
cattaatg

SEQ ID NO: 133584 - DNA, 6 bp, Unknown
  misc_feature (1)..( 6): Result.003 file - promoters60/4282647
actctc

SEQ ID NO: 133585 - DNA, 6 bp, Unknown
  misc_feature (1)..( 6): Result.003 file - promoters60/4282647
actctc

SEQ ID NO: 133586 - DNA, 15 bp, Unknown
  misc_feature (1)..( 15): Result.003 file - promoters60/4282667
taatatttaaacgta

SEQ ID NO: 133587 - DNA, 15 bp, Unknown
  misc_feature (1)..( 15): Result.003 file - promoters60/4282667
gaatttttgcgagca

SEQ ID NO: 133588 - DNA, 15 bp, Unknown
  misc_feature (1)..( 15): Result.003 file - promoters60/4282667
aggtttttgttttct

SEQ ID NO: 133589 - DNA, 15 bp, Unknown
  misc_feature (1)..( 15): Result.003 file - promoters60/4282667
gaagtttctggtggt

SEQ ID NO: 133590 - DNA, 15 bp, Unknown
  misc_feature (1)..( 15): Result.003 file - promoters60/4282667
taacgtttggttttg

SEQ ID NO: 133591 - DNA, 15 bp, Unknown
  misc_feature (1)..( 15): Result.003 file - promoters60/4282667
ccggcgttggatttg

SEQ ID NO: 133592 - DNA, 10 bp, Unknown
  misc_feature (1)..( 10): Result.003 file - promoters60/4282695
acttcaaaaa

SEQ ID NO: 133593 - DNA, 10 bp, Unknown
  misc_feature (1)..( 10): Result.003 file - promoters60/4282695
acttcaaaaa

SEQ ID NO: 133594 - DNA, 9 bp, Unknown
  misc_feature (1)..( 9): Result.003 file - promoters60/4282695
tctcaaact

SEQ ID NO: 133595 - DNA, 9 bp, Unknown
  misc_feature (1)..( 9): Result.003 file - promoters60/4282695
tctaaaaag

SEQ ID NO: 133596 - DNA, 9 bp, Unknown
  misc_feature (1)..( 9): Result.003 file - promoters60/4282695
tatcatact

SEQ ID NO: 133597 - DNA, 7 bp, Unknown
  misc_feature (1)..( 7): Result.003 file - promoters60/4282695
ttgcaga

SEQ ID NO: 133598 - DNA, 7 bp, Unknown
  misc_feature (1)..( 7): Result.003 file - promoters60/4282695
ttggaga

SEQ ID NO: 133599 - DNA, 8 bp, Unknown
  misc_feature (1)..( 8): Result.003 file - promoters60/4282695
gagcaaaa

SEQ ID NO: 133600 - DNA, 8 bp, Unknown
  misc_feature (1)..( 8): Result.003 file - promoters60/4282695
gagaaaaa

SEQ ID NO: 133601 - DNA, 8 bp, Unknown
  misc_feature (1)..( 8): Result.003 file - promoters60/4282695
aaaagatt

SEQ ID NO: 133602 - DNA, 8 bp, Unknown
  misc_feature (1)..( 8): Result.003 file - promoters60/4282695
aaaaaatt

SEQ ID NO: 133603 - DNA, 7 bp, Unknown
  misc_feature (1)..( 7): Result.003 file - promoters60/4282695
aataatt

SEQ ID NO: 133604 - DNA, 7 bp, Unknown
  misc_feature (1)..( 7): Result.003 file - promoters60/4282695
aattatt

SEQ ID NO: 133605 - DNA, 7 bp, Unknown
  misc_feature (1)..( 7): Result.003 file - promoters60/4282695
atgttgg

SEQ ID NO: 133606 - DNA, 7 bp, Unknown
  misc_feature (1)..( 7): Result.003 file - promoters60/4282695
atggtgg

SEQ ID NO: 133607 - DNA, 7 bp, Unknown
  misc_feature (1)..( 7): Result.003 file - promoters60/4282695
ctcatca

SEQ ID NO: 133608 - DNA, 7 bp, Unknown
  misc_feature (1)..( 7): Result.003 file - promoters60/4282695
ctcgtca

SEQ ID NO: 133609 - DNA, 8 bp, Unknown
  misc_feature (1)..( 8): Result.003 file - promoters60/4282695
ccattcag

SEQ ID NO: 133610 - DNA, 8 bp, Unknown
  misc_feature (1)..( 8): Result.003 file - promoters60/4282695
ccaatcag

SEQ ID NO: 133611 - DNA, 9 bp, Unknown
  misc_feature (1)..( 9): Result.003 file - promoters60/4282695
aatcaatgt

SEQ ID NO: 133612 - DNA, 9 bp, Unknown
  misc_feature (1)..( 9): Result.003 file - promoters60/4282695
aattaatgt

SEQ ID NO: 133613 - DNA, 8 bp, Unknown
  misc_feature (1)..( 8): Result.003 file - promoters60/4282695
catagtca

SEQ ID NO: 133614 - DNA, 8 bp, Unknown
  misc_feature (1)..( 8): Result.003 file - promoters60/4282695
cataatca

SEQ ID NO: 133615 - DNA, 9 bp, Unknown
  misc_feature (1)..( 9): Result.003 file - promoters60/4282695
aaaaaaatg

SEQ ID NO: 133616 - DNA, 9 bp, Unknown
  misc_feature (1)..( 9): Result.003 file - promoters60/4282695
aaaataatg

SEQ ID NO: 133617 - DNA, 8 bp, Unknown
  misc_feature (1)..( 8): Result.003 file - promoters60/4282695
aaaaggaa

SEQ ID NO: 133618 - DNA, 8 bp, Unknown
  misc_feature (1)..( 8): Result.003 file - promoters60/4282695
aaaatgaa

SEQ ID NO: 133619 - DNA, 10 bp, Unknown
  misc_feature (1)..( 10): Result.003 file - promoters60/4282695
aaaaaaagga

SEQ ID NO: 133620 - DNA, 10 bp, Unknown
  misc_feature (1)..( 10): Result.003 file - promoters60/4282695
aaaataagga

SEQ ID NO: 133621 - DNA, 13 bp, Unknown
  misc_feature (1)..( 13): Result.003 file - promoters60/4282744
tttatgaaatttt

SEQ ID NO: 133622 - DNA, 13 bp, Unknown
  misc_feature (1)..( 13): Result.003 file - promoters60/4282744
tttttgaaatcta

SEQ ID NO: 133623 - DNA, 13 bp, Unknown
  misc_feature (1)..( 13): Result.003 file - promoters60/4282744
atagtgacatcta

SEQ ID NO: 133624 - DNA, 10 bp, Unknown
  misc_feature (1)..( 10): Result.003 file - promoters60/4282744
aaaactgtaa

SEQ ID NO: 133625 - DNA, 10 bp, Unknown
  misc_feature (1)..( 10): Result.003 file - promoters60/4282744
aaaactgaag

SEQ ID NO: 133626 - DNA, 10 bp, Unknown
  misc_feature (1)..( 10): Result.003 file - promoters60/4282744
aaaactataa

SEQ ID NO: 133627 - DNA, 9 bp, Unknown
  misc_feature (1)..( 9): Result.003 file - promoters60/4282744
aacaaaaac

SEQ ID NO: 133628 - DNA, 9 bp, Unknown
  misc_feature (1)..( 9): Result.003 file - promoters60/4282744
aacataaac

SEQ ID NO: 133629 - DNA, 9 bp, Unknown
  misc_feature (1)..( 9): Result.003 file - promoters60/4282744
aactaaacc

SEQ ID NO: 133630 - DNA, 8 bp, Unknown
  misc_feature (1)..( 8): Result.003 file - promoters60/4282744
aaataata

SEQ ID NO: 133631 - DNA, 8 bp, Unknown
  misc_feature (1)..( 8): Result.003 file - promoters60/4282744
taataata

SEQ ID NO: 133632 - DNA, 8 bp, Unknown
  misc_feature (1)..( 8): Result.003 file - promoters60/4282744
taaaaatc

SEQ ID NO: 133633 - DNA, 8 bp, Unknown
  misc_feature (1)..( 8): Result.003 file - promoters60/4282744
caaactcc

SEQ ID NO: 133634 - DNA, 8 bp, Unknown
  misc_feature (1)..( 8): Result.003 file - promoters60/4282744
aaaaatcc

SEQ ID NO: 133635 - DNA, 8 bp, Unknown
  misc_feature (1)..( 8): Result.003 file - promoters60/4282744
aaaaattt

SEQ ID NO: 133636 - DNA, 12 bp, Unknown
  misc_feature (1)..( 12): Result.003 file - promoters60/4282748
ttcgtggacaca

SEQ ID NO: 133637 - DNA, 12 bp, Unknown
  misc_feature (1)..( 12): Result.003 file - promoters60/4282748
gatttggagaca

SEQ ID NO: 133638 - DNA, 12 bp, Unknown
  misc_feature (1)..( 12): Result.003 file - promoters60/4282748
ttcgttgactaa

SEQ ID NO: 133639 - DNA, 7 bp, Unknown
  misc_feature (1)..( 7): Result.003 file - promoters60/4282748
ggactat

SEQ ID NO: 133640 - DNA, 7 bp, Unknown
  misc_feature (1)..( 7): Result.003 file - promoters60/4282748
tgactat

SEQ ID NO: 133641 - DNA, 7 bp, Unknown
  misc_feature (1)..( 7): Result.003 file - promoters60/4282748
tgattat

SEQ ID NO: 133642 - DNA, 6 bp, Unknown
  misc_feature (1)..( 6): Result.003 file - promoters60/4282748
gtcaat

SEQ ID NO: 133643 - DNA, 6 bp, Unknown
  misc_feature (1)..( 6): Result.003 file - promoters60/4282748
gtcaat

SEQ ID NO: 133644 - DNA, 9 bp, Unknown
  misc_feature (1)..( 9): Result.003 file - promoters60/4282748
tttattgtt

SEQ ID NO: 133645 - DNA, 9 bp, Unknown
  misc_feature (1)..( 9): Result.003 file - promoters60/4282748
tttcttgtt

SEQ ID NO: 133646 - DNA, 6 bp, Unknown
  misc_feature (1)..( 6): Result.003 file - promoters60/4282748
attgta

SEQ ID NO: 133647 - DNA, 6 bp, Unknown
  misc_feature (1)..( 6): Result.003 file - promoters60/4282748
attgta

SEQ ID NO: 133648 - DNA, 8 bp, Unknown
  misc_feature (1)..( 8): Result.003 file - promoters60/4282748
caaataat

SEQ ID NO: 133649 - DNA, 8 bp, Unknown
  misc_feature (1)..( 8): Result.003 file - promoters60/4282748
caaataat

SEQ ID NO: 133650 - DNA, 6 bp, Unknown
  misc_feature (1)..( 6): Result.003 file - promoters60/4282748
tacaaa

SEQ ID NO: 133651 - DNA, 6 bp, Unknown
  misc_feature (1)..( 6): Result.003 file - promoters60/4282748
tacaaa

SEQ ID NO: 133652 - DNA, 9 bp, Unknown
  misc_feature (1)..( 9): Result.003 file - promoters60/4282748
cataaattc

SEQ ID NO: 133653 - DNA, 9 bp, Unknown
  misc_feature (1)..( 9): Result.003 file - promoters60/4282748
cataaattt

SEQ ID NO: 133654 - DNA, 9 bp, Unknown
  misc_feature (1)..( 9): Result.003 file - promoters60/4282748
tatatattt

SEQ ID NO: 133655 - DNA, 6 bp, Unknown
  misc_feature (1)..( 6): Result.003 file - promoters60/4282748
ttatat

SEQ ID NO: 133656 - DNA, 6 bp, Unknown
  misc_feature (1)..( 6): Result.003 file - promoters60/4282748
ttatat

SEQ ID NO: 133657 - DNA, 6 bp, Unknown
  misc_feature (1)..( 6): Result.003 file - promoters60/4282748
ggtttg

SEQ ID NO: 133658 - DNA, 6 bp, Unknown
  misc_feature (1)..( 6): Result.003 file - promoters60/4282748
ggtttg

SEQ ID NO: 133659 - DNA, 6 bp, Unknown
  misc_feature (1)..( 6): Result.003 file - promoters60/4282748
ggttga

SEQ ID NO: 133660 - DNA, 6 bp, Unknown
  misc_feature (1)..( 6): Result.003 file - promoters60/4282748
ggttga

SEQ ID NO: 133661 - DNA, 6 bp, Unknown
  misc_feature (1)..( 6): Result.003 file - promoters60/4282748
ttattg

SEQ ID NO: 133662 - DNA, 6 bp, Unknown
  misc_feature (1)..( 6): Result.003 file - promoters60/4282748
ttattg

SEQ ID NO: 133663 - DNA, 7 bp, Unknown
  misc_feature (1)..( 7): Result.003 file - promoters60/4282748
ttgtatg

SEQ ID NO: 133664 - DNA, 7 bp, Unknown
  misc_feature (1)..( 7): Result.003 file - promoters60/4282748
ttgtatg

SEQ ID NO: 133665 - DNA, 6 bp, Unknown
  misc_feature (1)..( 6): Result.003 file - promoters60/4282748
cgtgtc

SEQ ID NO: 133666 - DNA, 6 bp, Unknown
  misc_feature (1)..( 6): Result.003 file - promoters60/4282748
cgtgtc

SEQ ID NO: 133667 - DNA, 7 bp, Unknown
  misc_feature (1)..( 7): Result.003 file - promoters60/4282748
aatatat

SEQ ID NO: 133668 - DNA, 7 bp, Unknown
  misc_feature (1)..( 7): Result.003 file - promoters60/4282748
aatttat

SEQ ID NO: 133669 - DNA, 6 bp, Unknown
  misc_feature (1)..( 6): Result.003 file - promoters60/4282788
aaaaaa

SEQ ID NO: 133670 - DNA, 6 bp, Unknown
  misc_feature (1)..( 6): Result.003 file - promoters60/4282788
aaaaaa

SEQ ID NO: 133671 - DNA, 8 bp, Unknown
  misc_feature (1)..( 8): Result.003 file - promoters60/4282788
tgtaaaat

SEQ ID NO: 133672 - DNA, 8 bp, Unknown
  misc_feature (1)..( 8): Result.003 file - promoters60/4282788
tgtgaaat

SEQ ID NO: 133673 - DNA, 6 bp, Unknown
  misc_feature (1)..( 6): Result.003 file - promoters60/4282788
gtaaac

SEQ ID NO: 133674 - DNA, 6 bp, Unknown
  misc_feature (1)..( 6): Result.003 file - promoters60/4282788
gtaaac

SEQ ID NO: 133675 - DNA, 8 bp, Unknown
  misc_feature (1)..( 8): Result.003 file - promoters60/4282788
gataagag

SEQ ID NO: 133676 - DNA, 8 bp, Unknown
  misc_feature (1)..( 8): Result.003 file - promoters60/4282788
gattagag

SEQ ID NO: 133677 - DNA, 6 bp, Unknown
  misc_feature (1)..( 6): Result.003 file - promoters60/4282788
agagtt

SEQ ID NO: 133678 - DNA, 6 bp, Unknown
  misc_feature (1)..( 6): Result.003 file - promoters60/4282788
agagtt

SEQ ID NO: 133679 - DNA, 6 bp, Unknown
  misc_feature (1)..( 6): Result.003 file - promoters60/4282788
tgtctc

SEQ ID NO: 133680 - DNA, 6 bp, Unknown
  misc_feature (1)..( 6): Result.003 file - promoters60/4282788
tgtctc

SEQ ID NO: 133681 - DNA, 8 bp, Unknown
  misc_feature (1)..( 8): Result.003 file - promoters60/4282788
gttgcttt

SEQ ID NO: 133682 - DNA, 8 bp, Unknown
  misc_feature (1)..( 8): Result.003 file - promoters60/4282788
tttgattt

SEQ ID NO: 133683 - DNA, 8 bp, Unknown
  misc_feature (1)..( 8): Result.003 file - promoters60/4282788
tttgattg

SEQ ID NO: 133684 - DNA, 7 bp, Unknown
  misc_feature (1)..( 7): Result.003 file - promoters60/4282788
tctctaa

SEQ ID NO: 133685 - DNA, 7 bp, Unknown
  misc_feature (1)..( 7): Result.003 file - promoters60/4282788
tctgtaa

SEQ ID NO: 133686 - DNA, 6 bp, Unknown
  misc_feature (1)..( 6): Result.003 file - promoters60/4282788
tgtttc

SEQ ID NO: 133687 - DNA, 6 bp, Unknown
  misc_feature (1)..( 6): Result.003 file - promoters60/4282788
tgtttc

SEQ ID NO: 133688 - DNA, 7 bp, Unknown
  misc_feature (1)..( 7): Result.003 file - promoters60/4282788
gttttct

SEQ ID NO: 133689 - DNA, 7 bp, Unknown
  misc_feature (1)..( 7): Result.003 file - promoters60/4282788
gttgtct

SEQ ID NO: 133690 - DNA, 7 bp, Unknown
  misc_feature (1)..( 7): Result.003 file - promoters60/4282788
tatcatt

SEQ ID NO: 133691 - DNA, 7 bp, Unknown
  misc_feature (1)..( 7): Result.003 file - promoters60/4282788
tatgatt

SEQ ID NO: 133692 - DNA, 7 bp, Unknown
  misc_feature (1)..( 7): Result.003 file - promoters60/4282788
gaatttg

SEQ ID NO: 133693 - DNA, 7 bp, Unknown
  misc_feature (1)..( 7): Result.003 file - promoters60/4282788
gaatttg

SEQ ID NO: 133694 - DNA, 7 bp, Unknown
  misc_feature (1)..( 7): Result.003 file - promoters60/4282788
ttagatc

SEQ ID NO: 133695 - DNA, 7 bp, Unknown
  misc_feature (1)..( 7): Result.003 file - promoters60/4282788
ttatatc

SEQ ID NO: 133696 - DNA, 6 bp, Unknown
  misc_feature (1)..( 6): Result.003 file - promoters60/4282788
catttg

SEQ ID NO: 133697 - DNA, 6 bp, Unknown
  misc_feature (1)..( 6): Result.003 file - promoters60/4282788
catttg

SEQ ID NO: 133698 - DNA, 9 bp, Unknown
  misc_feature (1)..( 9): Result.003 file - promoters60/4282795
taatcgttt

SEQ ID NO: 133699 - DNA, 9 bp, Unknown
  misc_feature (1)..( 9): Result.003 file - promoters60/4282795
taagcgtag

SEQ ID NO: 133700 - DNA, 9 bp, Unknown
  misc_feature (1)..( 9): Result.003 file - promoters60/4282795
caatccttt

SEQ ID NO: 133701 - DNA, 7 bp, Unknown
  misc_feature (1)..( 7): Result.003 file - promoters60/4282795
ttttagt

SEQ ID NO: 133702 - DNA, 7 bp, Unknown
  misc_feature (1)..( 7): Result.003 file - promoters60/4282795
gtttagt

SEQ ID NO: 133703 - DNA, 7 bp, Unknown
  misc_feature (1)..( 7): Result.003 file - promoters60/4282795
atttagt

SEQ ID NO: 133704 - DNA, 7 bp, Unknown
  misc_feature (1)..( 7): Result.003 file - promoters60/4282795
ttttaga

SEQ ID NO: 133705 - DNA, 7 bp, Unknown
  misc_feature (1)..( 7): Result.003 file - promoters60/4282795
attaatg

SEQ ID NO: 133706 - DNA, 7 bp, Unknown
  misc_feature (1)..( 7): Result.003 file - promoters60/4282795
gttaatg

SEQ ID NO: 133707 - DNA, 7 bp, Unknown
  misc_feature (1)..( 7): Result.003 file - promoters60/4282795
gttaatt

SEQ ID NO: 133708 - DNA, 11 bp, Unknown
  misc_feature (1)..( 11): Result.003 file - promoters60/4282795
gtgaagccaaa

SEQ ID NO: 133709 - DNA, 11 bp, Unknown
  misc_feature (1)..( 11): Result.003 file - promoters60/4282795
atgaaaccaac

SEQ ID NO: 133710 - DNA, 11 bp, Unknown
  misc_feature (1)..( 11): Result.003 file - promoters60/4282795
aaagaacaaac

SEQ ID NO: 133711 - DNA, 11 bp, Unknown
  misc_feature (1)..( 11): Result.003 file - promoters60/4282795
atgaaaagcta

SEQ ID NO: 133712 - DNA, 12 bp, Unknown
  misc_feature (1)..( 12): Result.003 file - promoters60/4282795
cgggtttatgtt

SEQ ID NO: 133713 - DNA, 12 bp, Unknown
  misc_feature (1)..( 12): Result.003 file - promoters60/4282795
aacctttatgta

SEQ ID NO: 133714 - DNA, 12 bp, Unknown
  misc_feature (1)..( 12): Result.003 file - promoters60/4282795
aacttttaagta

SEQ ID NO: 133715 - DNA, 8 bp, Unknown
  misc_feature (1)..( 8): Result.003 file - promoters60/4282795
cggtttgg

SEQ ID NO: 133716 - DNA, 8 bp, Unknown
  misc_feature (1)..( 8): Result.003 file - promoters60/4282795
cggtttaa

SEQ ID NO: 133717 - DNA, 8 bp, Unknown
  misc_feature (1)..( 8): Result.003 file - promoters60/4282795
tggtctgg

SEQ ID NO: 133718 - DNA, 11 bp, Unknown
  misc_feature (1)..( 11): Result.003 file - promoters60/4282795
tcttttaattg

SEQ ID NO: 133719 - DNA, 11 bp, Unknown
  misc_feature (1)..( 11): Result.003 file - promoters60/4282795
gcttttgattt

SEQ ID NO: 133720 - DNA, 11 bp, Unknown
  misc_feature (1)..( 11): Result.003 file - promoters60/4282795
tgttttgtttt

SEQ ID NO: 133721 - DNA, 9 bp, Unknown
  misc_feature (1)..( 9): Result.003 file - promoters60/4282795
acataatat

SEQ ID NO: 133722 - DNA, 9 bp, Unknown
  misc_feature (1)..( 9): Result.003 file - promoters60/4282795
tattaatat

SEQ ID NO: 133723 - DNA, 9 bp, Unknown
  misc_feature (1)..( 9): Result.003 file - promoters60/4282795
tattgataa

SEQ ID NO: 133724 - DNA, 9 bp, Unknown
  misc_feature (1)..( 9): Result.003 file - promoters60/4282795
ttttagaaa

SEQ ID NO: 133725 - DNA, 9 bp, Unknown
  misc_feature (1)..( 9): Result.003 file - promoters60/4282795
tttaagact

SEQ ID NO: 133726 - DNA, 9 bp, Unknown
  misc_feature (1)..( 9): Result.003 file - promoters60/4282795
aattacaaa

SEQ ID NO: 133727 - DNA, 6 bp, Unknown
  misc_feature (1)..( 6): Result.003 file - promoters60/4282795
tttctt

SEQ ID NO: 133728 - DNA, 6 bp, Unknown
  misc_feature (1)..( 6): Result.003 file - promoters60/4282795
tttctt

SEQ ID NO: 133729 - DNA, 6 bp, Unknown
  misc_feature (1)..( 6): Result.003 file - promoters60/4282795
tttctt

SEQ ID NO: 133730 - DNA, 12 bp, Unknown
  misc_feature (1)..( 12): Result.003 file - promoters60/4282795
aaccaactaaca

SEQ ID NO: 133731 - DNA, 12 bp, Unknown
  misc_feature (1)..( 12): Result.003 file - promoters60/4282795
ttttaactaaca

SEQ ID NO: 133732 - DNA, 12 bp, Unknown
  misc_feature (1)..( 12): Result.003 file - promoters60/4282795
ttttcactaatg

SEQ ID NO: 133733 - DNA, 7 bp, Unknown
  misc_feature (1)..( 7): Result.003 file - promoters60/4282832
aaattta

SEQ ID NO: 133734 - DNA, 7 bp, Unknown
  misc_feature (1)..( 7): Result.003 file - promoters60/4282832
aaattta

SEQ ID NO: 133735 - DNA, 7 bp, Unknown
  misc_feature (1)..( 7): Result.003 file - promoters60/4282832
aaagaaa

SEQ ID NO: 133736 - DNA, 7 bp, Unknown
  misc_feature (1)..( 7): Result.003 file - promoters60/4282832
aaataaa

SEQ ID NO: 133737 - DNA, 7 bp, Unknown
  misc_feature (1)..( 7): Result.003 file - promoters60/4282832
aagaaaa

SEQ ID NO: 133738 - DNA, 7 bp, Unknown
  misc_feature (1)..( 7): Result.003 file - promoters60/4282832
aagaaaa

SEQ ID NO: 133739 - DNA, 7 bp, Unknown
  misc_feature (1)..( 7): Result.003 file - promoters60/4282832
ttagatc

SEQ ID NO: 133740 - DNA, 7 bp, Unknown
  misc_feature (1)..( 7): Result.003 file - promoters60/4282832
ttaaatc

SEQ ID NO: 133741 - DNA, 7 bp, Unknown
  misc_feature (1)..( 7): Result.003 file - promoters60/4282832
aaagtcc

SEQ ID NO: 133742 - DNA, 7 bp, Unknown
  misc_feature (1)..( 7): Result.003 file - promoters60/4282832
aaaatcc

SEQ ID NO: 133743 - DNA, 6 bp, Unknown
  misc_feature (1)..( 6): Result.003 file - promoters60/4282832
agagaa

SEQ ID NO: 133744 - DNA, 6 bp, Unknown
  misc_feature (1)..( 6): Result.003 file - promoters60/4282832
agagaa

SEQ ID NO: 133745 - DNA, 8 bp, Unknown
  misc_feature (1)..( 8): Result.003 file - promoters60/4282832
gttgtgaa

SEQ ID NO: 133746 - DNA, 8 bp, Unknown
  misc_feature (1)..( 8): Result.003 file - promoters60/4282832
gttctgaa

SEQ ID NO: 133747 - DNA, 7 bp, Unknown
  misc_feature (1)..( 7): Result.003 file - promoters60/4282832
ccctgtg

SEQ ID NO: 133748 - DNA, 7 bp, Unknown
  misc_feature (1)..( 7): Result.003 file - promoters60/4282832
ccctgtg

SEQ ID NO: 133749 - DNA, 7 bp, Unknown
  misc_feature (1)..( 7): Result.003 file - promoters60/4282832
ttctcat

SEQ ID NO: 133750 - DNA, 7 bp, Unknown
  misc_feature (1)..( 7): Result.003 file - promoters60/4282832
ttctcat

SEQ ID NO: 133751 - DNA, 8 bp, Unknown
  misc_feature (1)..( 8): Result.003 file - promoters60/4282832
tttagctt

SEQ ID NO: 133752 - DNA, 8 bp, Unknown
  misc_feature (1)..( 8): Result.003 file - promoters60/4282832
tttatctt

SEQ ID NO: 133753 - DNA, 6 bp, Unknown
  misc_feature (1)..( 6): Result.003 file - promoters60/4282832
gaatta

SEQ ID NO: 133754 - DNA, 6 bp, Unknown
  misc_feature (1)..( 6): Result.003 file - promoters60/4282832
gaatta

SEQ ID NO: 133755 - DNA, 6 bp, Unknown
  misc_feature (1)..( 6): Result.003 file - promoters60/4282832
gcggaa

SEQ ID NO: 133756 - DNA, 6 bp, Unknown
  misc_feature (1)..( 6): Result.003 file - promoters60/4282832
gcggaa

SEQ ID NO: 133757 - DNA, 6 bp, Unknown
  misc_feature (1)..( 6): Result.003 file - promoters60/4282832
aaagaa

SEQ ID NO: 133758 - DNA, 6 bp, Unknown
  misc_feature (1)..( 6): Result.003 file - promoters60/4282832
aaagaa

SEQ ID NO: 133759 - DNA, 7 bp, Unknown
  misc_feature (1)..( 7): Result.003 file - promoters60/4282832
tattttc

SEQ ID NO: 133760 - DNA, 7 bp, Unknown
  misc_feature (1)..( 7): Result.003 file - promoters60/4282832
tatcttc

SEQ ID NO: 133761 - DNA, 6 bp, Unknown
  misc_feature (1)..( 6): Result.003 file - promoters60/4282832
tccttg

SEQ ID NO: 133762 - DNA, 6 bp, Unknown
  misc_feature (1)..( 6): Result.003 file - promoters60/4282832
tccttg

SEQ ID NO: 133763 - DNA, 7 bp, Unknown
  misc_feature (1)..( 7): Result.003 file - promoters60/4282832
gatatat

SEQ ID NO: 133764 - DNA, 7 bp, Unknown
  misc_feature (1)..( 7): Result.003 file - promoters60/4282832
gatgtat

SEQ ID NO: 133765 - DNA, 9 bp, Unknown
  misc_feature (1)..( 9): Result.003 file - promoters60/4282859
tctatctga

SEQ ID NO: 133766 - DNA, 9 bp, Unknown
  misc_feature (1)..( 9): Result.003 file - promoters60/4282859
tctctctga

SEQ ID NO: 133767 - DNA, 6 bp, Unknown
  misc_feature (1)..( 6): Result.003 file - promoters60/4282859
gaaaat

SEQ ID NO: 133768 - DNA, 6 bp, Unknown
  misc_feature (1)..( 6): Result.003 file - promoters60/4282859
gaaaat

SEQ ID NO: 133769 - DNA, 7 bp, Unknown
  misc_feature (1)..( 7): Result.003 file - promoters60/4282859
tgaaaaa

SEQ ID NO: 133770 - DNA, 7 bp, Unknown
  misc_feature (1)..( 7): Result.003 file - promoters60/4282859
tgaaaaa

SEQ ID NO: 133771 - DNA, 7 bp, Unknown
  misc_feature (1)..( 7): Result.003 file - promoters60/4282859
atggctc

SEQ ID NO: 133772 - DNA, 7 bp, Unknown
  misc_feature (1)..( 7): Result.003 file - promoters60/4282859
atgactc

SEQ ID NO: 133773 - DNA, 7 bp, Unknown
  misc_feature (1)..( 7): Result.003 file - promoters60/4282859
attctta

SEQ ID NO: 133774 - DNA, 7 bp, Unknown
  misc_feature (1)..( 7): Result.003 file - promoters60/4282859
attttta

SEQ ID NO: 133775 - DNA, 6 bp, Unknown
  misc_feature (1)..( 6): Result.003 file - promoters60/4282859
atttaa

SEQ ID NO: 133776 - DNA, 6 bp, Unknown
  misc_feature (1)..( 6): Result.003 file - promoters60/4282859
atttaa

SEQ ID NO: 133777 - DNA, 6 bp, Unknown
  misc_feature (1)..( 6): Result.003 file - promoters60/4282859
aaaatt

SEQ ID NO: 133778 - DNA, 6 bp, Unknown
  misc_feature (1)..( 6): Result.003 file - promoters60/4282859
aaaatt

SEQ ID NO: 133779 - DNA, 6 bp, Unknown
  misc_feature (1)..( 6): Result.003 file - promoters60/4282859
aaggaa

SEQ ID NO: 133780 - DNA, 6 bp, Unknown
  misc_feature (1)..( 6): Result.003 file - promoters60/4282859
aaggaa

SEQ ID NO: 133781 - DNA, 16 bp, Unknown
  misc_feature (1)..( 16): Result.003 file - promoters60/4282877
caaattgggcccaata

SEQ ID NO: 133782 - DNA, 16 bp, Unknown
  misc_feature (1)..( 16): Result.003 file - promoters60/4282877
aacattaggctttaat

SEQ ID NO: 133783 - DNA, 16 bp, Unknown
  misc_feature (1)..( 16): Result.003 file - promoters60/4282877
acaaatgggcctaatt

SEQ ID NO: 133784 - DNA, 16 bp, Unknown
  misc_feature (1)..( 16): Result.003 file - promoters60/4282877
ataattgggcttttta

SEQ ID NO: 133785 - DNA, 16 bp, Unknown
  misc_feature (1)..( 16): Result.003 file - promoters60/4282877
caaattgggcctaata

SEQ ID NO: 133786 - DNA, 16 bp, Unknown
  misc_feature (1)..( 16): Result.003 file - promoters60/4282877
aagtttgggccaactt

SEQ ID NO: 133787 - DNA, 16 bp, Unknown
  misc_feature (1)..( 16): Result.003 file - promoters60/4282877
gcaaataggcccaatt

SEQ ID NO: 133788 - DNA, 11 bp, Unknown
  misc_feature (1)..( 11): Result.003 file - promoters60/4282877
acagatgcagc

SEQ ID NO: 133789 - DNA, 11 bp, Unknown
  misc_feature (1)..( 11): Result.003 file - promoters60/4282877
ttagatacaga

SEQ ID NO: 133790 - DNA, 11 bp, Unknown
  misc_feature (1)..( 11): Result.003 file - promoters60/4282877
cgaaatgaagc

SEQ ID NO: 133791 - DNA, 11 bp, Unknown
  misc_feature (1)..( 11): Result.003 file - promoters60/4282877
ttatatagtca

SEQ ID NO: 133792 - DNA, 11 bp, Unknown
  misc_feature (1)..( 11): Result.003 file - promoters60/4282877
tgaaatgaaag

SEQ ID NO: 133793 - DNA, 11 bp, Unknown
  misc_feature (1)..( 11): Result.003 file - promoters60/4282877
cttaatcaaat

SEQ ID NO: 133794 - DNA, 12 bp, Unknown
  misc_feature (1)..( 12): Result.003 file - promoters60/4282877
tgaagaagaaga

SEQ ID NO: 133795 - DNA, 12 bp, Unknown
  misc_feature (1)..( 12): Result.003 file - promoters60/4282877
acaagtagaaga

SEQ ID NO: 133796 - DNA, 12 bp, Unknown
  misc_feature (1)..( 12): Result.003 file - promoters60/4282877
gaaagaagggat

SEQ ID NO: 133797 - DNA, 12 bp, Unknown
  misc_feature (1)..( 12): Result.003 file - promoters60/4282877
ccaagaagaaaa

SEQ ID NO: 133798 - DNA, 12 bp, Unknown
  misc_feature (1)..( 12): Result.003 file - promoters60/4282877
acaagtaaaatt

SEQ ID NO: 133799 - DNA, 12 bp, Unknown
  misc_feature (1)..( 12): Result.003 file - promoters60/4282877
aaaagaaataaa

SEQ ID NO: 133800 - DNA, 10 bp, Unknown
  misc_feature (1)..( 10): Result.003 file - promoters60/4282915
tgtttttgtg

SEQ ID NO: 133801 - DNA, 10 bp, Unknown
  misc_feature (1)..( 10): Result.003 file - promoters60/4282915
gatttttgta

SEQ ID NO: 133802 - DNA, 10 bp, Unknown
  misc_feature (1)..( 10): Result.003 file - promoters60/4282915
tgtttttgtg

SEQ ID NO: 133803 - DNA, 10 bp, Unknown
  misc_feature (1)..( 10): Result.003 file - promoters60/4282915
gattttttct

SEQ ID NO: 133804 - DNA, 8 bp, Unknown
  misc_feature (1)..( 8): Result.003 file - promoters60/4282915
tttacaaa

SEQ ID NO: 133805 - DNA, 8 bp, Unknown
  misc_feature (1)..( 8): Result.003 file - promoters60/4282915
gttaaaaa

SEQ ID NO: 133806 - DNA, 9 bp, Unknown
  misc_feature (1)..( 9): Result.003 file - promoters60/4282915
tttcacaat

SEQ ID NO: 133807 - DNA, 9 bp, Unknown
  misc_feature (1)..( 9): Result.003 file - promoters60/4282915
gaatacaaa

SEQ ID NO: 133808 - DNA, 6 bp, Unknown
  misc_feature (1)..( 6): Result.003 file - promoters60/4282915
ccaaaa

SEQ ID NO: 133809 - DNA, 6 bp, Unknown
  misc_feature (1)..( 6): Result.003 file - promoters60/4282915
ccaaaa

SEQ ID NO: 133810 - DNA, 6 bp, Unknown
  misc_feature (1)..( 6): Result.003 file - promoters60/4282915
ccaaaa

SEQ ID NO: 133811 - DNA, 6 bp, Unknown
  misc_feature (1)..( 6): Result.003 file - promoters60/4282915
ccaaaa

SEQ ID NO: 133812 - DNA, 8 bp, Unknown
  misc_feature (1)..( 8): Result.003 file - promoters60/4282915
atttgtta

SEQ ID NO: 133813 - DNA, 8 bp, Unknown
  misc_feature (1)..( 8): Result.003 file - promoters60/4282915
atttgtgt

SEQ ID NO: 133814 - DNA, 8 bp, Unknown
  misc_feature (1)..( 8): Result.003 file - promoters60/4282915
atttgttt

SEQ ID NO: 133815 - DNA, 8 bp, Unknown
  misc_feature (1)..( 8): Result.003 file - promoters60/4282915
atttattt

SEQ ID NO: 133816 - DNA, 10 bp, Unknown
  misc_feature (1)..( 10): Result.003 file - promoters60/4282915
tataatttta

SEQ ID NO: 133817 - DNA, 10 bp, Unknown
  misc_feature (1)..( 10): Result.003 file - promoters60/4282915
tttaatttta

SEQ ID NO: 133818 - DNA, 10 bp, Unknown
  misc_feature (1)..( 10): Result.003 file - promoters60/4282915
tttgattgaa

SEQ ID NO: 133819 - DNA, 10 bp, Unknown
  misc_feature (1)..( 10): Result.003 file - promoters60/4282915
aatgagtgat

SEQ ID NO: 133820 - DNA, 10 bp, Unknown
  misc_feature (1)..( 10): Result.003 file - promoters60/4282915
aaataatgaa

SEQ ID NO: 133821 - DNA, 10 bp, Unknown
  misc_feature (1)..( 10): Result.003 file - promoters60/4282915
gaatactgaa

SEQ ID NO: 133822 - DNA, 10 bp, Unknown
  misc_feature (1)..( 10): Result.003 file - promoters60/4282915
aaataataaa

SEQ ID NO: 133823 - DNA, 10 bp, Unknown
  misc_feature (1)..( 10): Result.003 file - promoters60/4282915
aaatcatatt

SEQ ID NO: 133824 - DNA, 6 bp, Unknown
  misc_feature (1)..( 6): Result.003 file - promoters60/4282939
aagaga

SEQ ID NO: 133825 - DNA, 6 bp, Unknown
  misc_feature (1)..( 6): Result.003 file - promoters60/4282939
aagaga

SEQ ID NO: 133826 - DNA, 6 bp, Unknown
  misc_feature (1)..( 6): Result.003 file - promoters60/4282939
gatcat

SEQ ID NO: 133827 - DNA, 6 bp, Unknown
  misc_feature (1)..( 6): Result.003 file - promoters60/4282939
gatcat

SEQ ID NO: 133828 - DNA, 7 bp, Unknown
  misc_feature (1)..( 7): Result.003 file - promoters60/4282939
tcttcat

SEQ ID NO: 133829 - DNA, 7 bp, Unknown
  misc_feature (1)..( 7): Result.003 file - promoters60/4282939
tctacat

SEQ ID NO: 133830 - DNA, 8 bp, Unknown
  misc_feature (1)..( 8): Result.003 file - promoters60/4282939
attacaaa

SEQ ID NO: 133831 - DNA, 8 bp, Unknown
  misc_feature (1)..( 8): Result.003 file - promoters60/4282939
tttagaaa

SEQ ID NO: 133832 - DNA, 8 bp, Unknown
  misc_feature (1)..( 8): Result.003 file - promoters60/4282939
ttttgaat

SEQ ID NO: 133833 - DNA, 8 bp, Unknown
  misc_feature (1)..( 8): Result.003 file - promoters60/4282939
taaaatta

SEQ ID NO: 133834 - DNA, 8 bp, Unknown
  misc_feature (1)..( 8): Result.003 file - promoters60/4282939
taatatta

SEQ ID NO: 133835 - DNA, 8 bp, Unknown
  misc_feature (1)..( 8): Result.003 file - promoters60/4282939
aattaata

SEQ ID NO: 133836 - DNA, 8 bp, Unknown
  misc_feature (1)..( 8): Result.003 file - promoters60/4282939
aataaata

SEQ ID NO: 133837 - DNA, 10 bp, Unknown
  misc_feature (1)..( 10): Result.003 file - promoters60/4282939
ctataataat

SEQ ID NO: 133838 - DNA, 10 bp, Unknown
  misc_feature (1)..( 10): Result.003 file - promoters60/4282939
ctatattaat

SEQ ID NO: 133839 - DNA, 7 bp, Unknown
  misc_feature (1)..( 7): Result.003 file - promoters60/4282939
ttgtctc

SEQ ID NO: 133840 - DNA, 7 bp, Unknown
  misc_feature (1)..( 7): Result.003 file - promoters60/4282939
ttgcctc

SEQ ID NO: 133841 - DNA, 8 bp, Unknown
  misc_feature (1)..( 8): Result.003 file - promoters60/4282939
agaaaaga

SEQ ID NO: 133842 - DNA, 8 bp, Unknown
  misc_feature (1)..( 8): Result.003 file - promoters60/4282939
agaacaga

SEQ ID NO: 133843 - DNA, 7 bp, Unknown
  misc_feature (1)..( 7): Result.003 file - promoters60/4282939
cataccc

SEQ ID NO: 133844 - DNA, 7 bp, Unknown
  misc_feature (1)..( 7): Result.003 file - promoters60/4282939
catgccc

SEQ ID NO: 133845 - DNA, 7 bp, Unknown
  misc_feature (1)..( 7): Result.003 file - promoters60/4282939
ctgggaa

SEQ ID NO: 133846 - DNA, 7 bp, Unknown
  misc_feature (1)..( 7): Result.003 file - promoters60/4282939
ctgtgaa

SEQ ID NO: 133847 - DNA, 8 bp, Unknown
  misc_feature (1)..( 8): Result.003 file - promoters60/4282939
gttaactc

SEQ ID NO: 133848 - DNA, 8 bp, Unknown
  misc_feature (1)..( 8): Result.003 file - promoters60/4282939
gttatctc

SEQ ID NO: 133849 - DNA, 8 bp, Unknown
  misc_feature (1)..( 8): Result.003 file - promoters60/4282941
ttttaaag

SEQ ID NO: 133850 - DNA, 8 bp, Unknown
  misc_feature (1)..( 8): Result.003 file - promoters60/4282941
atttaaag

SEQ ID NO: 133851 - DNA, 8 bp, Unknown
  misc_feature (1)..( 8): Result.003 file - promoters60/4282941
atttaatt

SEQ ID NO: 133852 - DNA, 8 bp, Unknown
  misc_feature (1)..( 8): Result.003 file - promoters60/4282941
tataattt

SEQ ID NO: 133853 - DNA, 8 bp, Unknown
  misc_feature (1)..( 8): Result.003 file - promoters60/4282941
tatgattt

SEQ ID NO: 133854 - DNA, 8 bp, Unknown
  misc_feature (1)..( 8): Result.003 file - promoters60/4282941
tataatca

SEQ ID NO: 133855 - DNA, 8 bp, Unknown
  misc_feature (1)..( 8): Result.003 file - promoters60/4282941
tgagttcg

SEQ ID NO: 133856 - DNA, 8 bp, Unknown
  misc_feature (1)..( 8): Result.003 file - promoters60/4282941
tgagttcg

SEQ ID NO: 133857 - DNA, 9 bp, Unknown
  misc_feature (1)..( 9): Result.003 file - promoters60/4282941
taaaaattg

SEQ ID NO: 133858 - DNA, 9 bp, Unknown
  misc_feature (1)..( 9): Result.003 file - promoters60/4282941
taaaaattg

SEQ ID NO: 133859 - DNA, 6 bp, Unknown
  misc_feature (1)..( 6): Result.003 file - promoters60/4282941
attggg

SEQ ID NO: 133860 - DNA, 6 bp, Unknown
  misc_feature (1)..( 6): Result.003 file - promoters60/4282941
attggg

SEQ ID NO: 133861 - DNA, 6 bp, Unknown
  misc_feature (1)..( 6): Result.003 file - promoters60/4282941
tgagat

SEQ ID NO: 133862 - DNA, 6 bp, Unknown
  misc_feature (1)..( 6): Result.003 file - promoters60/4282941
tgagat

SEQ ID NO: 133863 - DNA, 12 bp, Unknown
  misc_feature (1)..( 12): Result.003 file - promoters60/4282941
tatttacttttt

SEQ ID NO: 133864 - DNA, 12 bp, Unknown
  misc_feature (1)..( 12): Result.003 file - promoters60/4282941
tatttaattttt

SEQ ID NO: 133865 - DNA, 12 bp, Unknown
  misc_feature (1)..( 12): Result.003 file - promoters60/4282941
catttaaagcat

SEQ ID NO: 133866 - DNA, 9 bp, Unknown
  misc_feature (1)..( 9): Result.003 file - promoters60/4282941
aatataaat

SEQ ID NO: 133867 - DNA, 9 bp, Unknown
  misc_feature (1)..( 9): Result.003 file - promoters60/4282941
aatttaaat

SEQ ID NO: 133868 - DNA, 9 bp, Unknown
  misc_feature (1)..( 9): Result.003 file - promoters60/4282941
taattataa

SEQ ID NO: 133869 - DNA, 9 bp, Unknown
  misc_feature (1)..( 9): Result.003 file - promoters60/4282941
taaatattc

SEQ ID NO: 133870 - DNA, 9 bp, Unknown
  misc_feature (1)..( 9): Result.003 file - promoters60/4282941
cgaatattc

SEQ ID NO: 133871 - DNA, 7 bp, Unknown
  misc_feature (1)..( 7): Result.003 file - promoters60/4282941
ttaaaat

SEQ ID NO: 133872 - DNA, 7 bp, Unknown
  misc_feature (1)..( 7): Result.003 file - promoters60/4282941
ttataat

SEQ ID NO: 133873 - DNA, 6 bp, Unknown
  misc_feature (1)..( 6): Result.003 file - promoters60/4282941
aaataa

SEQ ID NO: 133874 - DNA, 6 bp, Unknown
  misc_feature (1)..( 6): Result.003 file - promoters60/4282941
aaataa

SEQ ID NO: 133875 - DNA, 7 bp, Unknown
  misc_feature (1)..( 7): Result.003 file - promoters60/4282941
cataaaa

SEQ ID NO: 133876 - DNA, 7 bp, Unknown
  misc_feature (1)..( 7): Result.003 file - promoters60/4282941
catgaaa

SEQ ID NO: 133877 - DNA, 6 bp, Unknown
  misc_feature (1)..( 6): Result.003 file - promoters60/4282941
aaaatt

SEQ ID NO: 133878 - DNA, 6 bp, Unknown
  misc_feature (1)..( 6): Result.003 file - promoters60/4282941
aaaatt

SEQ ID NO: 133879 - DNA, 9 bp, Unknown
  misc_feature (1)..( 9): Result.003 file - promoters60/4282941
tttatatta

SEQ ID NO: 133880 - DNA, 9 bp, Unknown
  misc_feature (1)..( 9): Result.003 file - promoters60/4282941
tttatatta

SEQ ID NO: 133881 - DNA, 14 bp, Unknown
  misc_feature (1)..( 14): Result.003 file - promoters60/4282941
aatacaacttatat

SEQ ID NO: 133882 - DNA, 14 bp, Unknown
  misc_feature (1)..( 14): Result.003 file - promoters60/4282941
aattcaaattatat

SEQ ID NO: 133883 - DNA, 6 bp, Unknown
  misc_feature (1)..( 6): Result.003 file - promoters60/4282941
atatta

SEQ ID NO: 133884 - DNA, 6 bp, Unknown
  misc_feature (1)..( 6): Result.003 file - promoters60/4282941
atatta

SEQ ID NO: 133885 - DNA, 8 bp, Unknown
  misc_feature (1)..( 8): Result.003 file - promoters60/4282941
tatgaaac

SEQ ID NO: 133886 - DNA, 8 bp, Unknown
  misc_feature (1)..( 8): Result.003 file - promoters60/4282941
tattaaac

SEQ ID NO: 133887 - DNA, 8 bp, Unknown
  misc_feature (1)..( 8): Result.003 file - promoters60/4282941
tttagaag

SEQ ID NO: 133888 - DNA, 8 bp, Unknown
  misc_feature (1)..( 8): Result.003 file - promoters60/4282941
tttaaaag

SEQ ID NO: 133889 - DNA, 7 bp, Unknown
  misc_feature (1)..( 7): Result.003 file - promoters60/4282941
aatctaa

SEQ ID NO: 133890 - DNA, 7 bp, Unknown
  misc_feature (1)..( 7): Result.003 file - promoters60/4282941
aatgtaa

SEQ ID NO: 133891 - DNA, 9 bp, Unknown
  misc_feature (1)..( 9): Result.003 file - promoters60/4282941
atatttttt

SEQ ID NO: 133892 - DNA, 9 bp, Unknown
  misc_feature (1)..( 9): Result.003 file - promoters60/4282941
atatatttt

SEQ ID NO: 133893 - DNA, 6 bp, Unknown
  misc_feature (1)..( 6): Result.003 file - promoters60/4282941
taaaaa

SEQ ID NO: 133894 - DNA, 6 bp, Unknown
  misc_feature (1)..( 6): Result.003 file - promoters60/4282941
taaaaa

SEQ ID NO: 133895 - DNA, 7 bp, Unknown
  misc_feature (1)..( 7): Result.003 file - promoters60/4282941
atatttt

SEQ ID NO: 133896 - DNA, 7 bp, Unknown
  misc_feature (1)..( 7): Result.003 file - promoters60/4282941
atatttt

SEQ ID NO: 133897 - DNA, 7 bp, Unknown
  misc_feature (1)..( 7): Result.003 file - promoters60/4282941
aatacaa

SEQ ID NO: 133898 - DNA, 7 bp, Unknown
  misc_feature (1)..( 7): Result.003 file - promoters60/4282941
aattcaa

SEQ ID NO: 133899 - DNA, 11 bp, Unknown
  misc_feature (1)..( 11): Result.003 file - promoters60/4283003
aataatttgta

SEQ ID NO: 133900 - DNA, 11 bp, Unknown
  misc_feature (1)..( 11): Result.003 file - promoters60/4283003
aatattttagg

SEQ ID NO: 133901 - DNA, 11 bp, Unknown
  misc_feature (1)..( 11): Result.003 file - promoters60/4283003
aattattggta

SEQ ID NO: 133902 - DNA, 7 bp, Unknown
  misc_feature (1)..( 7): Result.003 file - promoters60/4283003
ttgtaac

SEQ ID NO: 133903 - DNA, 7 bp, Unknown
  misc_feature (1)..( 7): Result.003 file - promoters60/4283003
ttgtaac

SEQ ID NO: 133904 - DNA, 7 bp, Unknown
  misc_feature (1)..( 7): Result.003 file - promoters60/4283003
atagaaa

SEQ ID NO: 133905 - DNA, 7 bp, Unknown
  misc_feature (1)..( 7): Result.003 file - promoters60/4283003
atacaaa

SEQ ID NO: 133906 - DNA, 6 bp, Unknown
  misc_feature (1)..( 6): Result.003 file - promoters60/4283003
aaaaaa

SEQ ID NO: 133907 - DNA, 6 bp, Unknown
  misc_feature (1)..( 6): Result.003 file - promoters60/4283003
aaaaaa

SEQ ID NO: 133908 - DNA, 9 bp, Unknown
  misc_feature (1)..( 9): Result.003 file - promoters60/4283003
atcaatcat

SEQ ID NO: 133909 - DNA, 9 bp, Unknown
  misc_feature (1)..( 9): Result.003 file - promoters60/4283003
atctatcat

SEQ ID NO: 133910 - DNA, 8 bp, Unknown
  misc_feature (1)..( 8): Result.003 file - promoters60/4283003
ttagttta

SEQ ID NO: 133911 - DNA, 8 bp, Unknown
  misc_feature (1)..( 8): Result.003 file - promoters60/4283003
ttagttta

SEQ ID NO: 133912 - DNA, 7 bp, Unknown
  misc_feature (1)..( 7): Result.003 file - promoters60/4283003
aacagaa

SEQ ID NO: 133913 - DNA, 7 bp, Unknown
  misc_feature (1)..( 7): Result.003 file - promoters60/4283003
aacagaa

SEQ ID NO: 133914 - DNA, 6 bp, Unknown
  misc_feature (1)..( 6): Result.003 file - promoters60/4283003
ctctta

SEQ ID NO: 133915 - DNA, 6 bp, Unknown
  misc_feature (1)..( 6): Result.003 file - promoters60/4283003
ctctta

SEQ ID NO: 133916 - DNA, 6 bp, Unknown
  misc_feature (1)..( 6): Result.003 file - promoters60/4283003
atcatt

SEQ ID NO: 133917 - DNA, 6 bp, Unknown
  misc_feature (1)..( 6): Result.003 file - promoters60/4283003
atcatt

SEQ ID NO: 133918 - DNA, 6 bp, Unknown
  misc_feature (1)..( 6): Result.003 file - promoters60/4283003
cattat

SEQ ID NO: 133919 - DNA, 6 bp, Unknown
  misc_feature (1)..( 6): Result.003 file - promoters60/4283003
cattat

SEQ ID NO: 133920 - DNA, 7 bp, Unknown
  misc_feature (1)..( 7): Result.003 file - promoters60/4283003
gaacaaa

SEQ ID NO: 133921 - DNA, 7 bp, Unknown
  misc_feature (1)..( 7): Result.003 file - promoters60/4283003
gaaaaaa

SEQ ID NO: 133922 - DNA, 8 bp, Unknown
  misc_feature (1)..( 8): Result.003 file - promoters60/4283003
aacagtta

SEQ ID NO: 133923 - DNA, 8 bp, Unknown
  misc_feature (1)..( 8): Result.003 file - promoters60/4283003
aacggtta

SEQ ID NO: 133924 - DNA, 11 bp, Unknown
  misc_feature (1)..( 11): Result.003 file - promoters60/4283003
actaaccaaat

SEQ ID NO: 133925 - DNA, 11 bp, Unknown
  misc_feature (1)..( 11): Result.003 file - promoters60/4283003
actgacccaat

SEQ ID NO: 133926 - DNA, 7 bp, Unknown
  misc_feature (1)..( 7): Result.003 file - promoters60/4283003
ttattaa

SEQ ID NO: 133927 - DNA, 7 bp, Unknown
  misc_feature (1)..( 7): Result.003 file - promoters60/4283003
ttagtaa

SEQ ID NO: 133928 - DNA, 6 bp, Unknown
  misc_feature (1)..( 6): Result.003 file - promoters60/4283003
tttatt

SEQ ID NO: 133929 - DNA, 6 bp, Unknown
  misc_feature (1)..( 6): Result.003 file - promoters60/4283003
tttatt

SEQ ID NO: 133930 - DNA, 7 bp, Unknown
  misc_feature (1)..( 7): Result.003 file - promoters60/4283003
aaacaaa

SEQ ID NO: 133931 - DNA, 7 bp, Unknown
  misc_feature (1)..( 7): Result.003 file - promoters60/4283003
aaataaa

SEQ ID NO: 133932 - DNA, 6 bp, Unknown
  misc_feature (1)..( 6): Result.003 file - promoters60/4283003
catgaa

SEQ ID NO: 133933 - DNA, 6 bp, Unknown
  misc_feature (1)..( 6): Result.003 file - promoters60/4283003
catgaa

SEQ ID NO: 133934 - DNA, 6 bp, Unknown
  misc_feature (1)..( 6): Result.003 file - promoters60/4283003
tcccaa

SEQ ID NO: 133935 - DNA, 6 bp, Unknown
  misc_feature (1)..( 6): Result.003 file - promoters60/4283003
tcccaa

SEQ ID NO: 133936 - DNA, 6 bp, Unknown
  misc_feature (1)..( 6): Result.003 file - promoters60/4283003
agaaaa

SEQ ID NO: 133937 - DNA, 6 bp, Unknown
  misc_feature (1)..( 6): Result.003 file - promoters60/4283003
agaaaa

SEQ ID NO: 133938 - DNA, 8 bp, Unknown
  misc_feature (1)..( 8): Result.003 file - promoters60/4283003
gcatccaa

SEQ ID NO: 133939 - DNA, 8 bp, Unknown
  misc_feature (1)..( 8): Result.003 file - promoters60/4283003
gcattcaa

SEQ ID NO: 133940 - DNA, 14 bp, Unknown
  misc_feature (1)..( 14): Result.003 file - promoters60/4283005
ttgagtttaggccg

SEQ ID NO: 133941 - DNA, 14 bp, Unknown
  misc_feature (1)..( 14): Result.003 file - promoters60/4283005
ttaagtctagtaac

SEQ ID NO: 133942 - DNA, 14 bp, Unknown
  misc_feature (1)..( 14): Result.003 file - promoters60/4283005
ataagtttaacgaa

SEQ ID NO: 133943 - DNA, 14 bp, Unknown
  misc_feature (1)..( 14): Result.003 file - promoters60/4283005
ttgattttaaacta

SEQ ID NO: 133944 - DNA, 14 bp, Unknown
  misc_feature (1)..( 14): Result.003 file - promoters60/4283005
aagtttctaggaac

SEQ ID NO: 133945 - DNA, 16 bp, Unknown
  misc_feature (1)..( 16): Result.003 file - promoters60/4283005
aaaaaaaataagaatg

SEQ ID NO: 133946 - DNA, 16 bp, Unknown
  misc_feature (1)..( 16): Result.003 file - promoters60/4283005
ctagactttaacaata

SEQ ID NO: 133947 - DNA, 16 bp, Unknown
  misc_feature (1)..( 16): Result.003 file - promoters60/4283005
aaagaaaataataata

SEQ ID NO: 133948 - DNA, 16 bp, Unknown
  misc_feature (1)..( 16): Result.003 file - promoters60/4283005
cgtcaaaaaaaaaata

SEQ ID NO: 133949 - DNA, 8 bp, Unknown
  misc_feature (1)..( 8): Result.003 file - promoters60/4283005
caaaatta

SEQ ID NO: 133950 - DNA, 8 bp, Unknown
  misc_feature (1)..( 8): Result.003 file - promoters60/4283005
aaaaattt

SEQ ID NO: 133951 - DNA, 9 bp, Unknown
  misc_feature (1)..( 9): Result.003 file - promoters60/4283005
aaaaactta

SEQ ID NO: 133952 - DNA, 9 bp, Unknown
  misc_feature (1)..( 9): Result.003 file - promoters60/4283005
ctaaacttc

SEQ ID NO: 133953 - DNA, 12 bp, Unknown
  misc_feature (1)..( 12): Result.003 file - promoters60/4283005
acaaaaaaaata

SEQ ID NO: 133954 - DNA, 12 bp, Unknown
  misc_feature (1)..( 12): Result.003 file - promoters60/4283005
tcaaaaaaaaaa

SEQ ID NO: 133955 - DNA, 12 bp, Unknown
  misc_feature (1)..( 12): Result.003 file - promoters60/4283005
ccaaataaaata

SEQ ID NO: 133956 - DNA, 12 bp, Unknown
  misc_feature (1)..( 12): Result.003 file - promoters60/4283005
ccaaaaaaagaa

SEQ ID NO: 133957 - DNA, 35 bp, Unknown
  misc_feature (1)..( 35): Result.003 file - promoters60/4283005
agaagccgagttgagtctaaagactaaaaagtaaa

SEQ ID NO: 133958 - DNA, 35 bp, Unknown
  misc_feature (1)..( 35): Result.003 file - promoters60/4283005
tttcatttttctgagtctcctaagtgttacgcgtg

SEQ ID NO: 133959 - DNA, 35 bp, Unknown
  misc_feature (1)..( 35): Result.003 file - promoters60/4283005
tttcatttttcttagtctcataagtgttacgcgtg

SEQ ID NO: 133960 - DNA, 35 bp, Unknown
  misc_feature (1)..( 35): Result.003 file - promoters60/4283005
acataacccgttttttccttcttttaccccttatc

SEQ ID NO: 133961 - DNA, 9 bp, Unknown
  misc_feature (1)..( 9): Result.003 file - promoters60/4283005
tatatatag

SEQ ID NO: 133962 - DNA, 9 bp, Unknown
  misc_feature (1)..( 9): Result.003 file - promoters60/4283005
tatataaat

SEQ ID NO: 133963 - DNA, 9 bp, Unknown
  misc_feature (1)..( 9): Result.003 file - promoters60/4283005
tataaatat

SEQ ID NO: 133964 - DNA, 9 bp, Unknown
  misc_feature (1)..( 9): Result.003 file - promoters60/4283005
tatatatag

SEQ ID NO: 133965 - DNA, 9 bp, Unknown
  misc_feature (1)..( 9): Result.003 file - promoters60/4283005
tatacaaat

SEQ ID NO: 133966 - DNA, 9 bp, Unknown
  misc_feature (1)..( 9): Result.003 file - promoters60/4283005
aagaataca

SEQ ID NO: 133967 - DNA, 9 bp, Unknown
  misc_feature (1)..( 9): Result.003 file - promoters60/4283005
gagaaaaca

SEQ ID NO: 133968 - DNA, 9 bp, Unknown
  misc_feature (1)..( 9): Result.003 file - promoters60/4283005
gagaaagat

SEQ ID NO: 133969 - DNA, 9 bp, Unknown
  misc_feature (1)..( 9): Result.003 file - promoters60/4283005
gagaaaaac

SEQ ID NO: 133970 - DNA, 11 bp, Unknown
  misc_feature (1)..( 11): Result.003 file - promoters60/4283005
tttactaagct

SEQ ID NO: 133971 - DNA, 11 bp, Unknown
  misc_feature (1)..( 11): Result.003 file - promoters60/4283005
attaataactt

SEQ ID NO: 133972 - DNA, 11 bp, Unknown
  misc_feature (1)..( 11): Result.003 file - promoters60/4283005
tttgctacttt

SEQ ID NO: 133973 - DNA, 11 bp, Unknown
  misc_feature (1)..( 11): Result.003 file - promoters60/4283005
taaaatatctt

SEQ ID NO: 133974 - DNA, 12 bp, Unknown
  misc_feature (1)..( 12): Result.003 file - promoters60/4283005
aaaaatttaatt

SEQ ID NO: 133975 - DNA, 12 bp, Unknown
  misc_feature (1)..( 12): Result.003 file - promoters60/4283005
actaatttaatt

SEQ ID NO: 133976 - DNA, 12 bp, Unknown
  misc_feature (1)..( 12): Result.003 file - promoters60/4283005
aaaaacttacca

SEQ ID NO: 133977 - DNA, 12 bp, Unknown
  misc_feature (1)..( 12): Result.003 file - promoters60/4283005
cagattttaata

SEQ ID NO: 133978 - DNA, 7 bp, Unknown
  misc_feature (1)..( 7): Result.003 file - promoters60/4283013
cgcagca

SEQ ID NO: 133979 - DNA, 7 bp, Unknown
  misc_feature (1)..( 7): Result.003 file - promoters60/4283013
cgcagca

SEQ ID NO: 133980 - DNA, 7 bp, Unknown
  misc_feature (1)..( 7): Result.003 file - promoters60/4283013
atatata

SEQ ID NO: 133981 - DNA, 7 bp, Unknown
  misc_feature (1)..( 7): Result.003 file - promoters60/4283013
atagata

SEQ ID NO: 133982 - DNA, 7 bp, Unknown
  misc_feature (1)..( 7): Result.003 file - promoters60/4283013
caaagtt

SEQ ID NO: 133983 - DNA, 7 bp, Unknown
  misc_feature (1)..( 7): Result.003 file - promoters60/4283013
caaggtt

SEQ ID NO: 133984 - DNA, 6 bp, Unknown
  misc_feature (1)..( 6): Result.003 file - promoters60/4283013
atatta

SEQ ID NO: 133985 - DNA, 6 bp, Unknown
  misc_feature (1)..( 6): Result.003 file - promoters60/4283013
atatta

SEQ ID NO: 133986 - DNA, 9 bp, Unknown
  misc_feature (1)..( 9): Result.003 file - promoters60/4283013
gttttgttc

SEQ ID NO: 133987 - DNA, 9 bp, Unknown
  misc_feature (1)..( 9): Result.003 file - promoters60/4283013
gttatgtca

SEQ ID NO: 133988 - DNA, 9 bp, Unknown
  misc_feature (1)..( 9): Result.003 file - promoters60/4283013
attatttca

SEQ ID NO: 133989 - DNA, 7 bp, Unknown
  misc_feature (1)..( 7): Result.003 file - promoters60/4283013
tacaata

SEQ ID NO: 133990 - DNA, 7 bp, Unknown
  misc_feature (1)..( 7): Result.003 file - promoters60/4283013
tacgata

SEQ ID NO: 133991 - DNA, 7 bp, Unknown
  misc_feature (1)..( 7): Result.003 file - promoters60/4283013
atggaga

SEQ ID NO: 133992 - DNA, 7 bp, Unknown
  misc_feature (1)..( 7): Result.003 file - promoters60/4283013
atgaaga

SEQ ID NO: 133993 - DNA, 7 bp, Unknown
  misc_feature (1)..( 7): Result.003 file - promoters60/4283013
tcgtcat

SEQ ID NO: 133994 - DNA, 7 bp, Unknown
  misc_feature (1)..( 7): Result.003 file - promoters60/4283013
tcgtcat

SEQ ID NO: 133995 - DNA, 7 bp, Unknown
  misc_feature (1)..( 7): Result.003 file - promoters60/4283013
caacttg

SEQ ID NO: 133996 - DNA, 7 bp, Unknown
  misc_feature (1)..( 7): Result.003 file - promoters60/4283013
caagttg

SEQ ID NO: 133997 - DNA, 7 bp, Unknown
  misc_feature (1)..( 7): Result.003 file - promoters60/4283013
atataca

SEQ ID NO: 133998 - DNA, 7 bp, Unknown
  misc_feature (1)..( 7): Result.003 file - promoters60/4283013
ataaaca

SEQ ID NO: 133999 - DNA, 7 bp, Unknown
  misc_feature (1)..( 7): Result.003 file - promoters60/4283013
ataaacc

SEQ ID NO: 134000 - DNA, 7 bp, Unknown
  misc_feature (1)..( 7): Result.003 file - promoters60/4283013
ctttcct

SEQ ID NO: 134001 - DNA, 7 bp, Unknown
  misc_feature (1)..( 7): Result.003 file - promoters60/4283013
ctttcct

SEQ ID NO: 134002 - DNA, 7 bp, Unknown
  misc_feature (1)..( 7): Result.003 file - promoters60/4283013
tcataat

SEQ ID NO: 134003 - DNA, 7 bp, Unknown
  misc_feature (1)..( 7): Result.003 file - promoters60/4283013
tcacaat

SEQ ID NO: 134004 - DNA, 8 bp, Unknown
  misc_feature (1)..( 8): Result.003 file - promoters60/4283013
tcaattat

SEQ ID NO: 134005 - DNA, 8 bp, Unknown
  misc_feature (1)..( 8): Result.003 file - promoters60/4283013
tcaattat

SEQ ID NO: 134006 - DNA, 9 bp, Unknown
  misc_feature (1)..( 9): Result.003 file - promoters60/4283017
ttattaaat

SEQ ID NO: 134007 - DNA, 9 bp, Unknown
  misc_feature (1)..( 9): Result.003 file - promoters60/4283017
ttattcaat

SEQ ID NO: 134008 - DNA, 9 bp, Unknown
  misc_feature (1)..( 9): Result.003 file - promoters60/4283017
gcattcaat

SEQ ID NO: 134009 - DNA, 6 bp, Unknown
  misc_feature (1)..( 6): Result.003 file - promoters60/4283017
tcccac

SEQ ID NO: 134010 - DNA, 6 bp, Unknown
  misc_feature (1)..( 6): Result.003 file - promoters60/4283017
tcccac

SEQ ID NO: 134011 - DNA, 7 bp, Unknown
  misc_feature (1)..( 7): Result.003 file - promoters60/4283017
taatcat

SEQ ID NO: 134012 - DNA, 7 bp, Unknown
  misc_feature (1)..( 7): Result.003 file - promoters60/4283017
taaccat

SEQ ID NO: 134013 - DNA, 6 bp, Unknown
  misc_feature (1)..( 6): Result.003 file - promoters60/4283017
attttc

SEQ ID NO: 134014 - DNA, 6 bp, Unknown
  misc_feature (1)..( 6): Result.003 file - promoters60/4283017
attttc

SEQ ID NO: 134015 - DNA, 6 bp, Unknown
  misc_feature (1)..( 6): Result.003 file - promoters60/4283017
tgaatt

SEQ ID NO: 134016 - DNA, 6 bp, Unknown
  misc_feature (1)..( 6): Result.003 file - promoters60/4283017
tgaatt

SEQ ID NO: 134017 - DNA, 6 bp, Unknown
  misc_feature (1)..( 6): Result.003 file - promoters60/4283017
gattat

SEQ ID NO: 134018 - DNA, 6 bp, Unknown
  misc_feature (1)..( 6): Result.003 file - promoters60/4283017
gattat

SEQ ID NO: 134019 - DNA, 6 bp, Unknown
  misc_feature (1)..( 6): Result.003 file - promoters60/4283017
tgtatt

SEQ ID NO: 134020 - DNA, 6 bp, Unknown
  misc_feature (1)..( 6): Result.003 file - promoters60/4283017
tgtatt

SEQ ID NO: 134021 - DNA, 7 bp, Unknown
  misc_feature (1)..( 7): Result.003 file - promoters60/4283017
tattaac

SEQ ID NO: 134022 - DNA, 7 bp, Unknown
  misc_feature (1)..( 7): Result.003 file - promoters60/4283017
tataaac

SEQ ID NO: 134023 - DNA, 9 bp, Unknown
  misc_feature (1)..( 9): Result.003 file - promoters60/4283017
aaaatatct

SEQ ID NO: 134024 - DNA, 9 bp, Unknown
  misc_feature (1)..( 9): Result.003 file - promoters60/4283017
aaaagatct

SEQ ID NO: 134025 - DNA, 6 bp, Unknown
  misc_feature (1)..( 6): Result.003 file - promoters60/4283017
atcttc

SEQ ID NO: 134026 - DNA, 6 bp, Unknown
  misc_feature (1)..( 6): Result.003 file - promoters60/4283017
atcttc

SEQ ID NO: 134027 - DNA, 6 bp, Unknown
  misc_feature (1)..( 6): Result.003 file - promoters60/4283041
cattca

SEQ ID NO: 134028 - DNA, 6 bp, Unknown
  misc_feature (1)..( 6): Result.003 file - promoters60/4283041
cattca

SEQ ID NO: 134029 - DNA, 6 bp, Unknown
  misc_feature (1)..( 6): Result.003 file - promoters60/4283041
tcacaa

SEQ ID NO: 134030 - DNA, 6 bp, Unknown
  misc_feature (1)..( 6): Result.003 file - promoters60/4283041
tcacaa

SEQ ID NO: 134031 - DNA, 7 bp, Unknown
  misc_feature (1)..( 7): Result.003 file - promoters60/4283041
ttattta

SEQ ID NO: 134032 - DNA, 7 bp, Unknown
  misc_feature (1)..( 7): Result.003 file - promoters60/4283041
ttattta

SEQ ID NO: 134033 - DNA, 13 bp, Unknown
  misc_feature (1)..( 13): Result.003 file - promoters60/4283041
aaaaaaagaaaaa

SEQ ID NO: 134034 - DNA, 13 bp, Unknown
  misc_feature (1)..( 13): Result.003 file - promoters60/4283041
gccaaaagagtaa

SEQ ID NO: 134035 - DNA, 13 bp, Unknown
  misc_feature (1)..( 13): Result.003 file - promoters60/4283041
aaaaaaagaaaaa

SEQ ID NO: 134036 - DNA, 7 bp, Unknown
  misc_feature (1)..( 7): Result.003 file - promoters60/4283041
aagtgaa

SEQ ID NO: 134037 - DNA, 7 bp, Unknown
  misc_feature (1)..( 7): Result.003 file - promoters60/4283041
aagggaa

SEQ ID NO: 134038 - DNA, 6 bp, Unknown
  misc_feature (1)..( 6): Result.003 file - promoters60/4283041
tcgaaa

SEQ ID NO: 134039 - DNA, 6 bp, Unknown
  misc_feature (1)..( 6): Result.003 file - promoters60/4283041
tcgaaa

SEQ ID NO: 134040 - DNA, 11 bp, Unknown
  misc_feature (1)..( 11): Result.003 file - promoters60/4283041
aacacaccaaa

SEQ ID NO: 134041 - DNA, 11 bp, Unknown
  misc_feature (1)..( 11): Result.003 file - promoters60/4283041
aacccactaaa

SEQ ID NO: 134042 - DNA, 7 bp, Unknown
  misc_feature (1)..( 7): Result.003 file - promoters60/4283041
aaaaaaa

SEQ ID NO: 134043 - DNA, 7 bp, Unknown
  misc_feature (1)..( 7): Result.003 file - promoters60/4283041
aaaaaaa

SEQ ID NO: 134044 - DNA, 7 bp, Unknown
  misc_feature (1)..( 7): Result.003 file - promoters60/4283041
aatcaaa

SEQ ID NO: 134045 - DNA, 7 bp, Unknown
  misc_feature (1)..( 7): Result.003 file - promoters60/4283041
aataaaa

SEQ ID NO: 134046 - DNA, 6 bp, Unknown
  misc_feature (1)..( 6): Result.003 file - promoters60/4283041
agtaaa

SEQ ID NO: 134047 - DNA, 6 bp, Unknown
  misc_feature (1)..( 6): Result.003 file - promoters60/4283041
agtaaa

SEQ ID NO: 134048 - DNA, 7 bp, Unknown
  misc_feature (1)..( 7): Result.003 file - promoters60/4283041
aatcggg

SEQ ID NO: 134049 - DNA, 7 bp, Unknown
  misc_feature (1)..( 7): Result.003 file - promoters60/4283041
aattggg

SEQ ID NO: 134050 - DNA, 8 bp, Unknown
  misc_feature (1)..( 8): Result.003 file - promoters60/4283041
gaaagaaa

SEQ ID NO: 134051 - DNA, 8 bp, Unknown
  misc_feature (1)..( 8): Result.003 file - promoters60/4283041
gaaacaaa

SEQ ID NO: 134052 - DNA, 10 bp, Unknown
  misc_feature (1)..( 10): Result.003 file - promoters60/4283041
ggaaaagaaa

SEQ ID NO: 134053 - DNA, 10 bp, Unknown
  misc_feature (1)..( 10): Result.003 file - promoters60/4283041
ggaaatgaaa

SEQ ID NO: 134054 - DNA, 7 bp, Unknown
  misc_feature (1)..( 7): Result.003 file - promoters60/4283041
cccacta

SEQ ID NO: 134055 - DNA, 7 bp, Unknown
  misc_feature (1)..( 7): Result.003 file - promoters60/4283041
cccacta

SEQ ID NO: 134056 - DNA, 9 bp, Unknown
  misc_feature (1)..( 9): Result.003 file - promoters60/4283041
aaagaaaag

SEQ ID NO: 134057 - DNA, 9 bp, Unknown
  misc_feature (1)..( 9): Result.003 file - promoters60/4283041
aaagtaaag

SEQ ID NO: 134058 - DNA, 7 bp, Unknown
  misc_feature (1)..( 7): Result.003 file - promoters60/4283041
gtatata

SEQ ID NO: 134059 - DNA, 7 bp, Unknown
  misc_feature (1)..( 7): Result.003 file - promoters60/4283041
gtatata

SEQ ID NO: 134060 - DNA, 9 bp, Unknown
  misc_feature (1)..( 9): Result.003 file - promoters60/4283105
atacgatag

SEQ ID NO: 134061 - DNA, 9 bp, Unknown
  misc_feature (1)..( 9): Result.003 file - promoters60/4283105
atactatag

SEQ ID NO: 134062 - DNA, 7 bp, Unknown
  misc_feature (1)..( 7): Result.003 file - promoters60/4283105
actattt

SEQ ID NO: 134063 - DNA, 7 bp, Unknown
  misc_feature (1)..( 7): Result.003 file - promoters60/4283105
actattt

SEQ ID NO: 134064 - DNA, 9 bp, Unknown
  misc_feature (1)..( 9): Result.003 file - promoters60/4283105
ttaatctaa

SEQ ID NO: 134065 - DNA, 9 bp, Unknown
  misc_feature (1)..( 9): Result.003 file - promoters60/4283105
ttaatctaa

SEQ ID NO: 134066 - DNA, 10 bp, Unknown
  misc_feature (1)..( 10): Result.003 file - promoters60/4283105
attcgttttc

SEQ ID NO: 134067 - DNA, 10 bp, Unknown
  misc_feature (1)..( 10): Result.003 file - promoters60/4283105
atttgttttc

SEQ ID NO: 134068 - DNA, 7 bp, Unknown
  misc_feature (1)..( 7): Result.003 file - promoters60/4283105
tttcaca

SEQ ID NO: 134069 - DNA, 7 bp, Unknown
  misc_feature (1)..( 7): Result.003 file - promoters60/4283105
tttaaca

SEQ ID NO: 134070 - DNA, 7 bp, Unknown
  misc_feature (1)..( 7): Result.003 file - promoters60/4283105
acaaatt

SEQ ID NO: 134071 - DNA, 7 bp, Unknown
  misc_feature (1)..( 7): Result.003 file - promoters60/4283105
acagatt

SEQ ID NO: 134072 - DNA, 7 bp, Unknown
  misc_feature (1)..( 7): Result.003 file - promoters60/4283105
cattaaa

SEQ ID NO: 134073 - DNA, 7 bp, Unknown
  misc_feature (1)..( 7): Result.003 file - promoters60/4283105
cataaaa

SEQ ID NO: 134074 - DNA, 7 bp, Unknown
  misc_feature (1)..( 7): Result.003 file - promoters60/4283105
tcaaaac

SEQ ID NO: 134075 - DNA, 7 bp, Unknown
  misc_feature (1)..( 7): Result.003 file - promoters60/4283105
tcaaaac

SEQ ID NO: 134076 - DNA, 8 bp, Unknown
  misc_feature (1)..( 8): Result.003 file - promoters60/4283105
accaatca

SEQ ID NO: 134077 - DNA, 8 bp, Unknown
  misc_feature (1)..( 8): Result.003 file - promoters60/4283105
accattca

SEQ ID NO: 134078 - DNA, 6 bp, Unknown
  misc_feature (1)..( 6): Result.003 file - promoters60/4283105
agaaag

SEQ ID NO: 134079 - DNA, 6 bp, Unknown
  misc_feature (1)..( 6): Result.003 file - promoters60/4283105
agaaag

SEQ ID NO: 134080 - DNA, 6 bp, Unknown
  misc_feature (1)..( 6): Result.003 file - promoters60/4283105
aataat

SEQ ID NO: 134081 - DNA, 6 bp, Unknown
  misc_feature (1)..( 6): Result.003 file - promoters60/4283105
aataat

SEQ ID NO: 134082 - DNA, 8 bp, Unknown
  misc_feature (1)..( 8): Result.003 file - promoters60/4283105
tctactaa

SEQ ID NO: 134083 - DNA, 8 bp, Unknown
  misc_feature (1)..( 8): Result.003 file - promoters60/4283105
tcttctaa

SEQ ID NO: 134084 - DNA, 7 bp, Unknown
  misc_feature (1)..( 7): Result.003 file - promoters60/4283105
tgataca

SEQ ID NO: 134085 - DNA, 7 bp, Unknown
  misc_feature (1)..( 7): Result.003 file - promoters60/4283105
tgaaaca

SEQ ID NO: 134086 - DNA, 7 bp, Unknown
  misc_feature (1)..( 7): Result.003 file - promoters60/4283105
tagtgaa

SEQ ID NO: 134087 - DNA, 7 bp, Unknown
  misc_feature (1)..( 7): Result.003 file - promoters60/4283105
tagagaa

SEQ ID NO: 134088 - DNA, 6 bp, Unknown
  misc_feature (1)..( 6): Result.003 file - promoters60/4283105
aacact

SEQ ID NO: 134089 - DNA, 6 bp, Unknown
  misc_feature (1)..( 6): Result.003 file - promoters60/4283105
aacact

SEQ ID NO: 134090 - DNA, 6 bp, Unknown
  misc_feature (1)..( 6): Result.003 file - promoters60/4283105
ttctta

SEQ ID NO: 134091 - DNA, 6 bp, Unknown
  misc_feature (1)..( 6): Result.003 file - promoters60/4283105
ttctta

SEQ ID NO: 134092 - DNA, 6 bp, Unknown
  misc_feature (1)..( 6): Result.003 file - promoters60/4283105
gtcata

SEQ ID NO: 134093 - DNA, 6 bp, Unknown
  misc_feature (1)..( 6): Result.003 file - promoters60/4283105
gtcata

SEQ ID NO: 134094 - DNA, 8 bp, Unknown
  misc_feature (1)..( 8): Result.003 file - promoters60/4283105
caaaacaa

SEQ ID NO: 134095 - DNA, 8 bp, Unknown
  misc_feature (1)..( 8): Result.003 file - promoters60/4283105
caacacaa

SEQ ID NO: 134096 - DNA, 7 bp, Unknown
  misc_feature (1)..( 7): Result.003 file - promoters60/4283105
ttacaca

SEQ ID NO: 134097 - DNA, 7 bp, Unknown
  misc_feature (1)..( 7): Result.003 file - promoters60/4283105
ttaaaca

SEQ ID NO: 134098 - DNA, 6 bp, Unknown
  misc_feature (1)..( 6): Result.003 file - promoters60/4283105
attctt

SEQ ID NO: 134099 - DNA, 6 bp, Unknown
  misc_feature (1)..( 6): Result.003 file - promoters60/4283105
attctt

SEQ ID NO: 134100 - DNA, 9 bp, Unknown
  misc_feature (1)..( 9): Result.003 file - promoters60/4283218
tatttaaac

SEQ ID NO: 134101 - DNA, 9 bp, Unknown
  misc_feature (1)..( 9): Result.003 file - promoters60/4283218
tatataata

SEQ ID NO: 134102 - DNA, 9 bp, Unknown
  misc_feature (1)..( 9): Result.003 file - promoters60/4283218
tatataatg

SEQ ID NO: 134103 - DNA, 9 bp, Unknown
  misc_feature (1)..( 9): Result.003 file - promoters60/4283218
tatataaac

SEQ ID NO: 134104 - DNA, 9 bp, Unknown
  misc_feature (1)..( 9): Result.003 file - promoters60/4283218
tttttacat

SEQ ID NO: 134105 - DNA, 9 bp, Unknown
  misc_feature (1)..( 9): Result.003 file - promoters60/4283218
ttttttcat

SEQ ID NO: 134106 - DNA, 9 bp, Unknown
  misc_feature (1)..( 9): Result.003 file - promoters60/4283218
ttttttggt

SEQ ID NO: 134107 - DNA, 9 bp, Unknown
  misc_feature (1)..( 9): Result.003 file - promoters60/4283218
gattttcac

SEQ ID NO: 134108 - DNA, 7 bp, Unknown
  misc_feature (1)..( 7): Result.003 file - promoters60/4283222
tttactt

SEQ ID NO: 134109 - DNA, 7 bp, Unknown
  misc_feature (1)..( 7): Result.003 file - promoters60/4283222
tttactt

SEQ ID NO: 134110 - DNA, 9 bp, Unknown
  misc_feature (1)..( 9): Result.003 file - promoters60/4283222
aaatacaaa

SEQ ID NO: 134111 - DNA, 9 bp, Unknown
  misc_feature (1)..( 9): Result.003 file - promoters60/4283222
tcataaaaa

SEQ ID NO: 134112 - DNA, 9 bp, Unknown
  misc_feature (1)..( 9): Result.003 file - promoters60/4283222
gaaaacaca

SEQ ID NO: 134113 - DNA, 9 bp, Unknown
  misc_feature (1)..( 9): Result.003 file - promoters60/4283222
aaatatttt

SEQ ID NO: 134114 - DNA, 9 bp, Unknown
  misc_feature (1)..( 9): Result.003 file - promoters60/4283222
aaagatttt

SEQ ID NO: 134115 - DNA, 9 bp, Unknown
  misc_feature (1)..( 9): Result.003 file - promoters60/4283222
aaatattta

SEQ ID NO: 134116 - DNA, 6 bp, Unknown
  misc_feature (1)..( 6): Result.003 file - promoters60/4283222
ttttat

SEQ ID NO: 134117 - DNA, 6 bp, Unknown
  misc_feature (1)..( 6): Result.003 file - promoters60/4283222
ttttat

SEQ ID NO: 134118 - DNA, 6 bp, Unknown
  misc_feature (1)..( 6): Result.003 file - promoters60/4283222
aataat

SEQ ID NO: 134119 - DNA, 6 bp, Unknown
  misc_feature (1)..( 6): Result.003 file - promoters60/4283222
aataat

SEQ ID NO: 134120 - DNA, 6 bp, Unknown
  misc_feature (1)..( 6): Result.003 file - promoters60/4283222
aataat

SEQ ID NO: 134121 - DNA, 9 bp, Unknown
  misc_feature (1)..( 9): Result.003 file - promoters60/4283222
aaaagattt

SEQ ID NO: 134122 - DNA, 9 bp, Unknown
  misc_feature (1)..( 9): Result.003 file - promoters60/4283222
taaaaattt

SEQ ID NO: 134123 - DNA, 9 bp, Unknown
  misc_feature (1)..( 9): Result.003 file - promoters60/4283222
taataatgt

SEQ ID NO: 134124 - DNA, 7 bp, Unknown
  misc_feature (1)..( 7): Result.003 file - promoters60/4283222
atttatt

SEQ ID NO: 134125 - DNA, 7 bp, Unknown
  misc_feature (1)..( 7): Result.003 file - promoters60/4283222
atttata

SEQ ID NO: 134126 - DNA, 7 bp, Unknown
  misc_feature (1)..( 7): Result.003 file - promoters60/4283222
attaatt

SEQ ID NO: 134127 - DNA, 6 bp, Unknown
  misc_feature (1)..( 6): Result.003 file - promoters60/4283222
acaaaa

SEQ ID NO: 134128 - DNA, 6 bp, Unknown
  misc_feature (1)..( 6): Result.003 file - promoters60/4283222
acaaaa

SEQ ID NO: 134129 - DNA, 6 bp, Unknown
  misc_feature (1)..( 6): Result.003 file - promoters60/4283222
atacaa

SEQ ID NO: 134130 - DNA, 6 bp, Unknown
  misc_feature (1)..( 6): Result.003 file - promoters60/4283222
atacaa

SEQ ID NO: 134131 - DNA, 9 bp, Unknown
  misc_feature (1)..( 9): Result.003 file - promoters60/4283222
taaacattg

SEQ ID NO: 134132 - DNA, 9 bp, Unknown
  misc_feature (1)..( 9): Result.003 file - promoters60/4283222
taaaaattg

SEQ ID NO: 134133 - DNA, 9 bp, Unknown
  misc_feature (1)..( 9): Result.003 file - promoters60/4283222
taaacttga

SEQ ID NO: 134134 - DNA, 6 bp, Unknown
  misc_feature (1)..( 6): Result.003 file - promoters60/4283222
ccaaat

SEQ ID NO: 134135 - DNA, 6 bp, Unknown
  misc_feature (1)..( 6): Result.003 file - promoters60/4283222
ccaaat

SEQ ID NO: 134136 - DNA, 8 bp, Unknown
  misc_feature (1)..( 8): Result.003 file - promoters60/4283222
aaattgaa

SEQ ID NO: 134137 - DNA, 8 bp, Unknown
  misc_feature (1)..( 8): Result.003 file - promoters60/4283222
aaattgaa

SEQ ID NO: 134138 - DNA, 6 bp, Unknown
  misc_feature (1)..( 6): Result.003 file - promoters60/4283222
attttt

SEQ ID NO: 134139 - DNA, 6 bp, Unknown
  misc_feature (1)..( 6): Result.003 file - promoters60/4283222
attttt

SEQ ID NO: 134140 - DNA, 6 bp, Unknown
  misc_feature (1)..( 6): Result.003 file - promoters60/4283222
ttacta

SEQ ID NO: 134141 - DNA, 6 bp, Unknown
  misc_feature (1)..( 6): Result.003 file - promoters60/4283222
ttacta

SEQ ID NO: 134142 - DNA, 6 bp, Unknown
  misc_feature (1)..( 6): Result.003 file - promoters60/4283222
atttgc

SEQ ID NO: 134143 - DNA, 6 bp, Unknown
  misc_feature (1)..( 6): Result.003 file - promoters60/4283222
atttgc

SEQ ID NO: 134144 - DNA, 7 bp, Unknown
  misc_feature (1)..( 7): Result.003 file - promoters60/4283222
tttgtcg

SEQ ID NO: 134145 - DNA, 7 bp, Unknown
  misc_feature (1)..( 7): Result.003 file - promoters60/4283222
tttatcg

SEQ ID NO: 134146 - DNA, 6 bp, Unknown
  misc_feature (1)..( 6): Result.003 file - promoters60/4283222
attttt

SEQ ID NO: 134147 - DNA, 6 bp, Unknown
  misc_feature (1)..( 6): Result.003 file - promoters60/4283222
attttt

SEQ ID NO: 134148 - DNA, 6 bp, Unknown
  misc_feature (1)..( 6): Result.003 file - promoters60/4283222
tccatt

SEQ ID NO: 134149 - DNA, 6 bp, Unknown
  misc_feature (1)..( 6): Result.003 file - promoters60/4283222
tccatt

SEQ ID NO: 134150 - DNA, 6 bp, Unknown
  misc_feature (1)..( 6): Result.003 file - promoters60/4283222
aattat

SEQ ID NO: 134151 - DNA, 6 bp, Unknown
  misc_feature (1)..( 6): Result.003 file - promoters60/4283222
aattat

SEQ ID NO: 134152 - DNA, 8 bp, Unknown
  misc_feature (1)..( 8): Result.003 file - promoters60/4283222
tgtgtaga

SEQ ID NO: 134153 - DNA, 8 bp, Unknown
  misc_feature (1)..( 8): Result.003 file - promoters60/4283222
tgtggaga

SEQ ID NO: 134154 - DNA, 6 bp, Unknown
  misc_feature (1)..( 6): Result.003 file - promoters60/4283222
agacta

SEQ ID NO: 134155 - DNA, 6 bp, Unknown
  misc_feature (1)..( 6): Result.003 file - promoters60/4283222
agacta

SEQ ID NO: 134156 - DNA, 7 bp, Unknown
  misc_feature (1)..( 7): Result.003 file - promoters60/4283222
aaatatc

SEQ ID NO: 134157 - DNA, 7 bp, Unknown
  misc_feature (1)..( 7): Result.003 file - promoters60/4283222
aaagatc

SEQ ID NO: 134158 - DNA, 6 bp, Unknown
  misc_feature (1)..( 6): Result.003 file - promoters60/4283222
agtgat

SEQ ID NO: 134159 - DNA, 6 bp, Unknown
  misc_feature (1)..( 6): Result.003 file - promoters60/4283222
agtgat

SEQ ID NO: 134160 - DNA, 7 bp, Unknown
  misc_feature (1)..( 7): Result.003 file - promoters60/4283222
ttcttta

SEQ ID NO: 134161 - DNA, 7 bp, Unknown
  misc_feature (1)..( 7): Result.003 file - promoters60/4283222
ttcgtta

SEQ ID NO: 134162 - DNA, 6 bp, Unknown
  misc_feature (1)..( 6): Result.003 file - promoters60/4283222
ttgcca

SEQ ID NO: 134163 - DNA, 6 bp, Unknown
  misc_feature (1)..( 6): Result.003 file - promoters60/4283222
ttgcca

SEQ ID NO: 134164 - DNA, 6 bp, Unknown
  misc_feature (1)..( 6): Result.003 file - promoters60/4283222
aatatt

SEQ ID NO: 134165 - DNA, 6 bp, Unknown
  misc_feature (1)..( 6): Result.003 file - promoters60/4283222
aatatt

SEQ ID NO: 134166 - DNA, 9 bp, Unknown
  misc_feature (1)..( 9): Result.003 file - promoters60/4283222
aaaacaatt

SEQ ID NO: 134167 - DNA, 9 bp, Unknown
  misc_feature (1)..( 9): Result.003 file - promoters60/4283222
aaaataatt

SEQ ID NO: 134168 - DNA, 7 bp, Unknown
  misc_feature (1)..( 7): Result.003 file - promoters60/4283222
aagttat

SEQ ID NO: 134169 - DNA, 7 bp, Unknown
  misc_feature (1)..( 7): Result.003 file - promoters60/4283222
aagatat

SEQ ID NO: 134170 - DNA, 9 bp, Unknown
  misc_feature (1)..( 9): Result.003 file - promoters60/4283222
atttttgct

SEQ ID NO: 134171 - DNA, 9 bp, Unknown
  misc_feature (1)..( 9): Result.003 file - promoters60/4283222
attcttgct

SEQ ID NO: 134172 - DNA, 8 bp, Unknown
  misc_feature (1)..( 8): Result.003 file - promoters60/4283240
aaatcttg

SEQ ID NO: 134173 - DNA, 8 bp, Unknown
  misc_feature (1)..( 8): Result.003 file - promoters60/4283240
taattttg

SEQ ID NO: 134174 - DNA, 8 bp, Unknown
  misc_feature (1)..( 8): Result.003 file - promoters60/4283240
taatttat

SEQ ID NO: 134175 - DNA, 8 bp, Unknown
  misc_feature (1)..( 8): Result.003 file - promoters60/4283240
aaatttaa

SEQ ID NO: 134176 - DNA, 9 bp, Unknown
  misc_feature (1)..( 9): Result.003 file - promoters60/4283240
aaatataaa

SEQ ID NO: 134177 - DNA, 9 bp, Unknown
  misc_feature (1)..( 9): Result.003 file - promoters60/4283240
aaatattat

SEQ ID NO: 134178 - DNA, 9 bp, Unknown
  misc_feature (1)..( 9): Result.003 file - promoters60/4283240
aaatttaag

SEQ ID NO: 134179 - DNA, 10 bp, Unknown
  misc_feature (1)..( 10): Result.003 file - promoters60/4283240
aaagtataaa

SEQ ID NO: 134180 - DNA, 10 bp, Unknown
  misc_feature (1)..( 10): Result.003 file - promoters60/4283240
ctaatttatt

SEQ ID NO: 134181 - DNA, 8 bp, Unknown
  misc_feature (1)..( 8): Result.003 file - promoters60/4283240
aatattta

SEQ ID NO: 134182 - DNA, 8 bp, Unknown
  misc_feature (1)..( 8): Result.003 file - promoters60/4283240
gatatttt

SEQ ID NO: 134183 - DNA, 8 bp, Unknown
  misc_feature (1)..( 8): Result.003 file - promoters60/4283240
gatatttt

SEQ ID NO: 134184 - DNA, 8 bp, Unknown
  misc_feature (1)..( 8): Result.003 file - promoters60/4283240
gatttttt

SEQ ID NO: 134185 - DNA, 8 bp, Unknown
  misc_feature (1)..( 8): Result.003 file - promoters60/4283293
tttctttc

SEQ ID NO: 134186 - DNA, 8 bp, Unknown
  misc_feature (1)..( 8): Result.003 file - promoters60/4283293
tttatttc

SEQ ID NO: 134187 - DNA, 8 bp, Unknown
  misc_feature (1)..( 8): Result.003 file - promoters60/4283293
cttatttt

SEQ ID NO: 134188 - DNA, 7 bp, Unknown
  misc_feature (1)..( 7): Result.003 file - promoters60/4283293
aatttaa

SEQ ID NO: 134189 - DNA, 7 bp, Unknown
  misc_feature (1)..( 7): Result.003 file - promoters60/4283293
tatttaa

SEQ ID NO: 134190 - DNA, 7 bp, Unknown
  misc_feature (1)..( 7): Result.003 file - promoters60/4283293
tatttaa

SEQ ID NO: 134191 - DNA, 8 bp, Unknown
  misc_feature (1)..( 8): Result.003 file - promoters60/4283297
caaagaaa

SEQ ID NO: 134192 - DNA, 8 bp, Unknown
  misc_feature (1)..( 8): Result.003 file - promoters60/4283297
taaataaa

SEQ ID NO: 134193 - DNA, 8 bp, Unknown
  misc_feature (1)..( 8): Result.003 file - promoters60/4283297
caatgaag

SEQ ID NO: 134194 - DNA, 8 bp, Unknown
  misc_feature (1)..( 8): Result.003 file - promoters60/4283297
aaaataaa

SEQ ID NO: 134195 - DNA, 9 bp, Unknown
  misc_feature (1)..( 9): Result.003 file - promoters60/4283297
ctaaatcat

SEQ ID NO: 134196 - DNA, 9 bp, Unknown
  misc_feature (1)..( 9): Result.003 file - promoters60/4283297
taaaatcat

SEQ ID NO: 134197 - DNA, 9 bp, Unknown
  misc_feature (1)..( 9): Result.003 file - promoters60/4283297
taaaatcta

SEQ ID NO: 134198 - DNA, 11 bp, Unknown
  misc_feature (1)..( 11): Result.003 file - promoters60/4283297
aaatatggaaa

SEQ ID NO: 134199 - DNA, 11 bp, Unknown
  misc_feature (1)..( 11): Result.003 file - promoters60/4283297
aaatattggac

SEQ ID NO: 134200 - DNA, 11 bp, Unknown
  misc_feature (1)..( 11): Result.003 file - promoters60/4283297
caatatggaaa

SEQ ID NO: 134201 - DNA, 12 bp, Unknown
  misc_feature (1)..( 12): Result.003 file - promoters60/4283338
ttaccattgaaa

SEQ ID NO: 134202 - DNA, 12 bp, Unknown
  misc_feature (1)..( 12): Result.003 file - promoters60/4283338
acccaattgaac

SEQ ID NO: 134203 - DNA, 12 bp, Unknown
  misc_feature (1)..( 12): Result.003 file - promoters60/4283338
acccaattgaac

SEQ ID NO: 134204 - DNA, 12 bp, Unknown
  misc_feature (1)..( 12): Result.003 file - promoters60/4283338
taaccgttgagc

SEQ ID NO: 134205 - DNA, 12 bp, Unknown
  misc_feature (1)..( 12): Result.003 file - promoters60/4283338
taatcgttaatt

SEQ ID NO: 134206 - DNA, 12 bp, Unknown
  misc_feature (1)..( 12): Result.003 file - promoters60/4283338
accggattaaac

SEQ ID NO: 134207 - DNA, 12 bp, Unknown
  misc_feature (1)..( 12): Result.003 file - promoters60/4283338
gaaaaaatcaaa

SEQ ID NO: 134208 - DNA, 12 bp, Unknown
  misc_feature (1)..( 12): Result.003 file - promoters60/4283338
gaaaaatgtaaa

SEQ ID NO: 134209 - DNA, 12 bp, Unknown
  misc_feature (1)..( 12): Result.003 file - promoters60/4283338
caaaaaataaat

SEQ ID NO: 134210 - DNA, 12 bp, Unknown
  misc_feature (1)..( 12): Result.003 file - promoters60/4283338
gaacaaaggagg

SEQ ID NO: 134211 - DNA, 12 bp, Unknown
  misc_feature (1)..( 12): Result.003 file - promoters60/4283338
gaagaaattttt

SEQ ID NO: 134212 - DNA, 12 bp, Unknown
  misc_feature (1)..( 12): Result.003 file - promoters60/4283338
acacaaaaggag

SEQ ID NO: 134213 - DNA, 12 bp, Unknown
  misc_feature (1)..( 12): Result.003 file - promoters60/4283338
attgaaatataa

SEQ ID NO: 134214 - DNA, 14 bp, Unknown
  misc_feature (1)..( 14): Result.003 file - promoters60/4283378
tgcattagttcttc

SEQ ID NO: 134215 - DNA, 14 bp, Unknown
  misc_feature (1)..( 14): Result.003 file - promoters60/4283378
taaatttgttatgt

SEQ ID NO: 134216 - DNA, 14 bp, Unknown
  misc_feature (1)..( 14): Result.003 file - promoters60/4283378
gttattagttaacc

SEQ ID NO: 134217 - DNA, 14 bp, Unknown
  misc_feature (1)..( 14): Result.003 file - promoters60/4283378
gttattagttaacc

SEQ ID NO: 134218 - DNA, 14 bp, Unknown
  misc_feature (1)..( 14): Result.003 file - promoters60/4283378
taaattttttaaaa

SEQ ID NO: 134219 - DNA, 14 bp, Unknown
  misc_feature (1)..( 14): Result.003 file - promoters60/4283378
tatacgttttaaaa

SEQ ID NO: 134220 - DNA, 14 bp, Unknown
  misc_feature (1)..( 14): Result.003 file - promoters60/4283378
gaaatttcctcgct

SEQ ID NO: 134221 - DNA, 16 bp, Unknown
  misc_feature (1)..( 16): Result.003 file - promoters60/4283378
attcgaatttttcaat

SEQ ID NO: 134222 - DNA, 16 bp, Unknown
  misc_feature (1)..( 16): Result.003 file - promoters60/4283378
tttagtctattttaat

SEQ ID NO: 134223 - DNA, 16 bp, Unknown
  misc_feature (1)..( 16): Result.003 file - promoters60/4283378
atttgaaattttcata

SEQ ID NO: 134224 - DNA, 16 bp, Unknown
  misc_feature (1)..( 16): Result.003 file - promoters60/4283378
caatcccaattctaac

SEQ ID NO: 134225 - DNA, 16 bp, Unknown
  misc_feature (1)..( 16): Result.003 file - promoters60/4283378
tagaaaagaatgaaat

SEQ ID NO: 134226 - DNA, 16 bp, Unknown
  misc_feature (1)..( 16): Result.003 file - promoters60/4283378
atttgaaaatttcata

SEQ ID NO: 134227 - DNA, 11 bp, Unknown
  misc_feature (1)..( 11): Result.003 file - promoters60/4283378
ttttgaagaat

SEQ ID NO: 134228 - DNA, 11 bp, Unknown
  misc_feature (1)..( 11): Result.003 file - promoters60/4283378
ttttgatgaat

SEQ ID NO: 134229 - DNA, 11 bp, Unknown
  misc_feature (1)..( 11): Result.003 file - promoters60/4283378
gtttgaatcgt

SEQ ID NO: 134230 - DNA, 11 bp, Unknown
  misc_feature (1)..( 11): Result.003 file - promoters60/4283378
atttgctgaat

SEQ ID NO: 134231 - DNA, 11 bp, Unknown
  misc_feature (1)..( 11): Result.003 file - promoters60/4283378
aaaagatgaag

SEQ ID NO: 134232 - DNA, 11 bp, Unknown
  misc_feature (1)..( 11): Result.003 file - promoters60/4283378
tttcgatgtat

SEQ ID NO: 134233 - DNA, 21 bp, Unknown
  misc_feature (1)..( 21): Result.003 file - promoters60/4283378
ccataaaaatgttagatagga

SEQ ID NO: 134234 - DNA, 21 bp, Unknown
  misc_feature (1)..( 21): Result.003 file - promoters60/4283378
tttcataaattttaaaattat

SEQ ID NO: 134235 - DNA, 21 bp, Unknown
  misc_feature (1)..( 21): Result.003 file - promoters60/4283378
tgtgttaaatatgaatattac

SEQ ID NO: 134236 - DNA, 22 bp, Unknown
  misc_feature (1)..( 22): Result.003 file - promoters60/4283378
ttatgtaaattttgaaataatt

SEQ ID NO: 134237 - DNA, 22 bp, Unknown
  misc_feature (1)..( 22): Result.003 file - promoters60/4283378
tctgagaaatagatttgaaaaa

SEQ ID NO: 134238 - DNA, 22 bp, Unknown
  misc_feature (1)..( 22): Result.003 file - promoters60/4283378
atttttaaattttttaaaatat

SEQ ID NO: 134239 - DNA, 23 bp, Unknown
  misc_feature (1)..( 23): Result.003 file - promoters60/4283378
attgtgaaataattttgttttat

SEQ ID NO: 134240 - DNA, 11 bp, Unknown
  misc_feature (1)..( 11): Result.003 file - promoters60/4283378
cttatataaac

SEQ ID NO: 134241 - DNA, 11 bp, Unknown
  misc_feature (1)..( 11): Result.003 file - promoters60/4283378
tatatataata

SEQ ID NO: 134242 - DNA, 11 bp, Unknown
  misc_feature (1)..( 11): Result.003 file - promoters60/4283378
agtatataaac

SEQ ID NO: 134243 - DNA, 11 bp, Unknown
  misc_feature (1)..( 11): Result.003 file - promoters60/4283378
tataaataaaa

SEQ ID NO: 134244 - DNA, 11 bp, Unknown
  misc_feature (1)..( 11): Result.003 file - promoters60/4283378
tgtatataaat

SEQ ID NO: 134245 - DNA, 11 bp, Unknown
  misc_feature (1)..( 11): Result.003 file - promoters60/4283378
tgtatataaat

SEQ ID NO: 134246 - DNA, 11 bp, Unknown
  misc_feature (1)..( 11): Result.003 file - promoters60/4283378
gataaatatcc

SEQ ID NO: 134247 - DNA, 12 bp, Unknown
  misc_feature (1)..( 12): Result.003 file - promoters60/4283378
tatataaacaaa

SEQ ID NO: 134248 - DNA, 12 bp, Unknown
  misc_feature (1)..( 12): Result.003 file - promoters60/4283378
ataataaccaaa

SEQ ID NO: 134249 - DNA, 12 bp, Unknown
  misc_feature (1)..( 12): Result.003 file - promoters60/4283378
tatataaactct

SEQ ID NO: 134250 - DNA, 12 bp, Unknown
  misc_feature (1)..( 12): Result.003 file - promoters60/4283378
tttataaataaa

SEQ ID NO: 134251 - DNA, 12 bp, Unknown
  misc_feature (1)..( 12): Result.003 file - promoters60/4283378
tatataaatgac

SEQ ID NO: 134252 - DNA, 12 bp, Unknown
  misc_feature (1)..( 12): Result.003 file - promoters60/4283378
tatataaatgac

SEQ ID NO: 134253 - DNA, 10 bp, Unknown
  misc_feature (1)..( 10): Result.003 file - promoters60/4283378
caaaatttgt

SEQ ID NO: 134254 - DNA, 10 bp, Unknown
  misc_feature (1)..( 10): Result.003 file - promoters60/4283378
caatatttta

SEQ ID NO: 134255 - DNA, 10 bp, Unknown
  misc_feature (1)..( 10): Result.003 file - promoters60/4283378
gaatatgttt

SEQ ID NO: 134256 - DNA, 10 bp, Unknown
  misc_feature (1)..( 10): Result.003 file - promoters60/4283378
aattatttta

SEQ ID NO: 134257 - DNA, 11 bp, Unknown
  misc_feature (1)..( 11): Result.003 file - promoters60/4283378
atttagtttga

SEQ ID NO: 134258 - DNA, 11 bp, Unknown
  misc_feature (1)..( 11): Result.003 file - promoters60/4283378
agatagtatat

SEQ ID NO: 134259 - DNA, 11 bp, Unknown
  misc_feature (1)..( 11): Result.003 file - promoters60/4283378
agatagtatat

SEQ ID NO: 134260 - DNA, 6 bp, Unknown
  misc_feature (1)..( 6): Result.003 file - promoters60/4283390
tctcga

SEQ ID NO: 134261 - DNA, 6 bp, Unknown
  misc_feature (1)..( 6): Result.003 file - promoters60/4283390
tctcga

SEQ ID NO: 134262 - DNA, 9 bp, Unknown
  misc_feature (1)..( 9): Result.003 file - promoters60/4283390
gccattgct

SEQ ID NO: 134263 - DNA, 9 bp, Unknown
  misc_feature (1)..( 9): Result.003 file - promoters60/4283390
gccatggct

SEQ ID NO: 134264 - DNA, 6 bp, Unknown
  misc_feature (1)..( 6): Result.003 file - promoters60/4283390
aaaagc

SEQ ID NO: 134265 - DNA, 6 bp, Unknown
  misc_feature (1)..( 6): Result.003 file - promoters60/4283390
aaaagc

SEQ ID NO: 134266 - DNA, 8 bp, Unknown
  misc_feature (1)..( 8): Result.003 file - promoters60/4283390
aatagatt

SEQ ID NO: 134267 - DNA, 8 bp, Unknown
  misc_feature (1)..( 8): Result.003 file - promoters60/4283390
aataaatt

SEQ ID NO: 134268 - DNA, 8 bp, Unknown
  misc_feature (1)..( 8): Result.003 file - promoters60/4283390
tctaaatt

SEQ ID NO: 134269 - DNA, 9 bp, Unknown
  misc_feature (1)..( 9): Result.003 file - promoters60/4283390
attatgtat

SEQ ID NO: 134270 - DNA, 9 bp, Unknown
  misc_feature (1)..( 9): Result.003 file - promoters60/4283390
attttgtat

SEQ ID NO: 134271 - DNA, 6 bp, Unknown
  misc_feature (1)..( 6): Result.003 file - promoters60/4283390
aaactt

SEQ ID NO: 134272 - DNA, 6 bp, Unknown
  misc_feature (1)..( 6): Result.003 file - promoters60/4283390
aaactt

SEQ ID NO: 134273 - DNA, 11 bp, Unknown
  misc_feature (1)..( 11): Result.003 file - promoters60/4283390
aagtgaagaac

SEQ ID NO: 134274 - DNA, 11 bp, Unknown
  misc_feature (1)..( 11): Result.003 file - promoters60/4283390
aagcgaacaac

SEQ ID NO: 134275 - DNA, 6 bp, Unknown
  misc_feature (1)..( 6): Result.003 file - promoters60/4283390
aaatta

SEQ ID NO: 134276 - DNA, 6 bp, Unknown
  misc_feature (1)..( 6): Result.003 file - promoters60/4283390
aaatta

SEQ ID NO: 134277 - DNA, 7 bp, Unknown
  misc_feature (1)..( 7): Result.003 file - promoters60/4283390
attacaa

SEQ ID NO: 134278 - DNA, 7 bp, Unknown
  misc_feature (1)..( 7): Result.003 file - promoters60/4283390
atttcaa

SEQ ID NO: 134279 - DNA, 6 bp, Unknown
  misc_feature (1)..( 6): Result.003 file - promoters60/4283390
acattc

SEQ ID NO: 134280 - DNA, 6 bp, Unknown
  misc_feature (1)..( 6): Result.003 file - promoters60/4283390
acattc

SEQ ID NO: 134281 - DNA, 8 bp, Unknown
  misc_feature (1)..( 8): Result.003 file - promoters60/4283390
aaagagtt

SEQ ID NO: 134282 - DNA, 8 bp, Unknown
  misc_feature (1)..( 8): Result.003 file - promoters60/4283390
aaagtgtt

SEQ ID NO: 134283 - DNA, 7 bp, Unknown
  misc_feature (1)..( 7): Result.003 file - promoters60/4283397
attataa

SEQ ID NO: 134284 - DNA, 7 bp, Unknown
  misc_feature (1)..( 7): Result.003 file - promoters60/4283397
attttaa

SEQ ID NO: 134285 - DNA, 7 bp, Unknown
  misc_feature (1)..( 7): Result.003 file - promoters60/4283397
attttaa

SEQ ID NO: 134286 - DNA, 9 bp, Unknown
  misc_feature (1)..( 9): Result.003 file - promoters60/4283397
ttttaaaaa

SEQ ID NO: 134287 - DNA, 9 bp, Unknown
  misc_feature (1)..( 9): Result.003 file - promoters60/4283397
ttttacaaa

SEQ ID NO: 134288 - DNA, 6 bp, Unknown
  misc_feature (1)..( 6): Result.003 file - promoters60/4283397
aatcaa

SEQ ID NO: 134289 - DNA, 6 bp, Unknown
  misc_feature (1)..( 6): Result.003 file - promoters60/4283397
aatcaa

SEQ ID NO: 134290 - DNA, 6 bp, Unknown
  misc_feature (1)..( 6): Result.003 file - promoters60/4283397
aatttt

SEQ ID NO: 134291 - DNA, 6 bp, Unknown
  misc_feature (1)..( 6): Result.003 file - promoters60/4283397
aatttt

SEQ ID NO: 134292 - DNA, 6 bp, Unknown
  misc_feature (1)..( 6): Result.003 file - promoters60/4283397
catata

SEQ ID NO: 134293 - DNA, 6 bp, Unknown
  misc_feature (1)..( 6): Result.003 file - promoters60/4283397
catata

SEQ ID NO: 134294 - DNA, 8 bp, Unknown
  misc_feature (1)..( 8): Result.003 file - promoters60/4283397
atttctaa

SEQ ID NO: 134295 - DNA, 8 bp, Unknown
  misc_feature (1)..( 8): Result.003 file - promoters60/4283397
atttctaa

SEQ ID NO: 134296 - DNA, 7 bp, Unknown
  misc_feature (1)..( 7): Result.003 file - promoters60/4283397
tttattt

SEQ ID NO: 134297 - DNA, 7 bp, Unknown
  misc_feature (1)..( 7): Result.003 file - promoters60/4283397
tttattt

SEQ ID NO: 134298 - DNA, 11 bp, Unknown
  misc_feature (1)..( 11): Result.003 file - promoters60/4283397
aaaaaaaattt

SEQ ID NO: 134299 - DNA, 11 bp, Unknown
  misc_feature (1)..( 11): Result.003 file - promoters60/4283397
aaacaaaattt

SEQ ID NO: 134300 - DNA, 10 bp, Unknown
  misc_feature (1)..( 10): Result.003 file - promoters60/4283397
aataaaaaaa

SEQ ID NO: 134301 - DNA, 10 bp, Unknown
  misc_feature (1)..( 10): Result.003 file - promoters60/4283397
aataataaaa

SEQ ID NO: 134302 - DNA, 10 bp, Unknown
  misc_feature (1)..( 10): Result.003 file - promoters60/4283397
cggaaaaaag

SEQ ID NO: 134303 - DNA, 6 bp, Unknown
  misc_feature (1)..( 6): Result.003 file - promoters60/4283397
aatttt

SEQ ID NO: 134304 - DNA, 6 bp, Unknown
  misc_feature (1)..( 6): Result.003 file - promoters60/4283397
aatttt

SEQ ID NO: 134305 - DNA, 9 bp, Unknown
  misc_feature (1)..( 9): Result.003 file - promoters60/4283397
ttttcaaaa

SEQ ID NO: 134306 - DNA, 9 bp, Unknown
  misc_feature (1)..( 9): Result.003 file - promoters60/4283397
tttacaaaa

SEQ ID NO: 134307 - DNA, 6 bp, Unknown
  misc_feature (1)..( 6): Result.003 file - promoters60/4283397
ttctaa

SEQ ID NO: 134308 - DNA, 6 bp, Unknown
  misc_feature (1)..( 6): Result.003 file - promoters60/4283397
ttctaa

SEQ ID NO: 134309 - DNA, 7 bp, Unknown
  misc_feature (1)..( 7): Result.003 file - promoters60/4283397
ataaaaa

SEQ ID NO: 134310 - DNA, 7 bp, Unknown
  misc_feature (1)..( 7): Result.003 file - promoters60/4283397
atagaaa

SEQ ID NO: 134311 - DNA, 8 bp, Unknown
  misc_feature (1)..( 8): Result.003 file - promoters60/4283397
caaagagt

SEQ ID NO: 134312 - DNA, 8 bp, Unknown
  misc_feature (1)..( 8): Result.003 file - promoters60/4283397
aaaagagg

SEQ ID NO: 134313 - DNA, 8 bp, Unknown
  misc_feature (1)..( 8): Result.003 file - promoters60/4283397
aaaataga

SEQ ID NO: 134314 - DNA, 6 bp, Unknown
  misc_feature (1)..( 6): Result.003 file - promoters60/4283397
ttttgt

SEQ ID NO: 134315 - DNA, 6 bp, Unknown
  misc_feature (1)..( 6): Result.003 file - promoters60/4283397
ttttgt

SEQ ID NO: 134316 - DNA, 6 bp, Unknown
  misc_feature (1)..( 6): Result.003 file - promoters60/4283397
tgtttt

SEQ ID NO: 134317 - DNA, 6 bp, Unknown
  misc_feature (1)..( 6): Result.003 file - promoters60/4283397
tgtttt

SEQ ID NO: 134318 - DNA, 7 bp, Unknown
  misc_feature (1)..( 7): Result.003 file - promoters60/4283397
gtaatgt

SEQ ID NO: 134319 - DNA, 7 bp, Unknown
  misc_feature (1)..( 7): Result.003 file - promoters60/4283397
gtattgt

SEQ ID NO: 134320 - DNA, 6 bp, Unknown
  misc_feature (1)..( 6): Result.003 file - promoters60/4283397
ccccca

SEQ ID NO: 134321 - DNA, 6 bp, Unknown
  misc_feature (1)..( 6): Result.003 file - promoters60/4283397
ccccca

SEQ ID NO: 134322 - DNA, 6 bp, Unknown
  misc_feature (1)..( 6): Result.003 file - promoters60/4283425
tcttct

SEQ ID NO: 134323 - DNA, 6 bp, Unknown
  misc_feature (1)..( 6): Result.003 file - promoters60/4283425
tcttct

SEQ ID NO: 134324 - DNA, 9 bp, Unknown
  misc_feature (1)..( 9): Result.003 file - promoters60/4283425
ccaaaaata

SEQ ID NO: 134325 - DNA, 9 bp, Unknown
  misc_feature (1)..( 9): Result.003 file - promoters60/4283425
ccaaaaaaa

SEQ ID NO: 134326 - DNA, 9 bp, Unknown
  misc_feature (1)..( 9): Result.003 file - promoters60/4283425
aaaaacata

SEQ ID NO: 134327 - DNA, 6 bp, Unknown
  misc_feature (1)..( 6): Result.003 file - promoters60/4283425
cataga

SEQ ID NO: 134328 - DNA, 6 bp, Unknown
  misc_feature (1)..( 6): Result.003 file - promoters60/4283425
cataga

SEQ ID NO: 134329 - DNA, 6 bp, Unknown
  misc_feature (1)..( 6): Result.003 file - promoters60/4283425
gaaaaa

SEQ ID NO: 134330 - DNA, 6 bp, Unknown
  misc_feature (1)..( 6): Result.003 file - promoters60/4283425
gaaaaa

SEQ ID NO: 134331 - DNA, 9 bp, Unknown
  misc_feature (1)..( 9): Result.003 file - promoters60/4283425
ggtctaaag

SEQ ID NO: 134332 - DNA, 9 bp, Unknown
  misc_feature (1)..( 9): Result.003 file - promoters60/4283425
agtcttaag

SEQ ID NO: 134333 - DNA, 9 bp, Unknown
  misc_feature (1)..( 9): Result.003 file - promoters60/4283425
ggtcaaaaa

SEQ ID NO: 134334 - DNA, 8 bp, Unknown
  misc_feature (1)..( 8): Result.003 file - promoters60/4283425
tataatat

SEQ ID NO: 134335 - DNA, 8 bp, Unknown
  misc_feature (1)..( 8): Result.003 file - promoters60/4283425
tatattat

SEQ ID NO: 134336 - DNA, 10 bp, Unknown
  misc_feature (1)..( 10): Result.003 file - promoters60/4283425
agttagattt

SEQ ID NO: 134337 - DNA, 10 bp, Unknown
  misc_feature (1)..( 10): Result.003 file - promoters60/4283425
agttggattt

SEQ ID NO: 134338 - DNA, 9 bp, Unknown
  misc_feature (1)..( 9): Result.003 file - promoters60/4283425
tatacatgt

SEQ ID NO: 134339 - DNA, 9 bp, Unknown
  misc_feature (1)..( 9): Result.003 file - promoters60/4283425
tatacatgt

SEQ ID NO: 134340 - DNA, 11 bp, Unknown
  misc_feature (1)..( 11): Result.003 file - promoters60/4283425
aaaccatatta

SEQ ID NO: 134341 - DNA, 11 bp, Unknown
  misc_feature (1)..( 11): Result.003 file - promoters60/4283425
aaaccatatta

SEQ ID NO: 134342 - DNA, 6 bp, Unknown
  misc_feature (1)..( 6): Result.003 file - promoters60/4283425
gacaaa

SEQ ID NO: 134343 - DNA, 6 bp, Unknown
  misc_feature (1)..( 6): Result.003 file - promoters60/4283425
gacaaa

SEQ ID NO: 134344 - DNA, 6 bp, Unknown
  misc_feature (1)..( 6): Result.003 file - promoters60/4283425
aaaaaa

SEQ ID NO: 134345 - DNA, 6 bp, Unknown
  misc_feature (1)..( 6): Result.003 file - promoters60/4283425
aaaaaa

SEQ ID NO: 134346 - DNA, 6 bp, Unknown
  misc_feature (1)..( 6): Result.003 file - promoters60/4283425
agacaa

SEQ ID NO: 134347 - DNA, 6 bp, Unknown
  misc_feature (1)..( 6): Result.003 file - promoters60/4283425
agacaa

SEQ ID NO: 134348 - DNA, 6 bp, Unknown
  misc_feature (1)..( 6): Result.003 file - promoters60/4283425
agagac

SEQ ID NO: 134349 - DNA, 6 bp, Unknown
  misc_feature (1)..( 6): Result.003 file - promoters60/4283425
agagac

SEQ ID NO: 134350 - DNA, 7 bp, Unknown
  misc_feature (1)..( 7): Result.003 file - promoters60/4283425
tcttatt

SEQ ID NO: 134351 - DNA, 7 bp, Unknown
  misc_feature (1)..( 7): Result.003 file - promoters60/4283425
tcttatt

SEQ ID NO: 134352 - DNA, 6 bp, Unknown
  misc_feature (1)..( 6): Result.003 file - promoters60/4283425
catatt

SEQ ID NO: 134353 - DNA, 6 bp, Unknown
  misc_feature (1)..( 6): Result.003 file - promoters60/4283425
catatt

SEQ ID NO: 134354 - DNA, 6 bp, Unknown
  misc_feature (1)..( 6): Result.003 file - promoters60/4283425
tatttt

SEQ ID NO: 134355 - DNA, 6 bp, Unknown
  misc_feature (1)..( 6): Result.003 file - promoters60/4283425
tatttt

SEQ ID NO: 134356 - DNA, 7 bp, Unknown
  misc_feature (1)..( 7): Result.003 file - promoters60/4283425
ttttttt

SEQ ID NO: 134357 - DNA, 7 bp, Unknown
  misc_feature (1)..( 7): Result.003 file - promoters60/4283425
ttttttt

SEQ ID NO: 134358 - DNA, 9 bp, Unknown
  misc_feature (1)..( 9): Result.003 file - promoters60/4283425
caatatttt

SEQ ID NO: 134359 - DNA, 9 bp, Unknown
  misc_feature (1)..( 9): Result.003 file - promoters60/4283425
caatctttt

SEQ ID NO: 134360 - DNA, 8 bp, Unknown
  misc_feature (1)..( 8): Result.003 file - promoters60/4283425
caacaaaa

SEQ ID NO: 134361 - DNA, 8 bp, Unknown
  misc_feature (1)..( 8): Result.003 file - promoters60/4283425
caagaaaa

SEQ ID NO: 134362 - DNA, 6 bp, Unknown
  misc_feature (1)..( 6): Result.003 file - promoters60/4283425
aaaaaa

SEQ ID NO: 134363 - DNA, 6 bp, Unknown
  misc_feature (1)..( 6): Result.003 file - promoters60/4283425
aaaaaa

SEQ ID NO: 134364 - DNA, 11 bp, Unknown
  misc_feature (1)..( 11): Result.003 file - promoters60/4283425
ttcttattttt

SEQ ID NO: 134365 - DNA, 11 bp, Unknown
  misc_feature (1)..( 11): Result.003 file - promoters60/4283425
ttcatatcttt

SEQ ID NO: 134366 - DNA, 7 bp, Unknown
  misc_feature (1)..( 7): Result.003 file - promoters60/4283425
cactgtt

SEQ ID NO: 134367 - DNA, 7 bp, Unknown
  misc_feature (1)..( 7): Result.003 file - promoters60/4283425
cacagtt

SEQ ID NO: 134368 - DNA, 8 bp, Unknown
  misc_feature (1)..( 8): Result.003 file - promoters60/4283425
gcgtaaat

SEQ ID NO: 134369 - DNA, 8 bp, Unknown
  misc_feature (1)..( 8): Result.003 file - promoters60/4283425
gcgaaaat

SEQ ID NO: 134370 - DNA, 7 bp, Unknown
  misc_feature (1)..( 7): Result.003 file - promoters60/4283425
ataaata

SEQ ID NO: 134371 - DNA, 7 bp, Unknown
  misc_feature (1)..( 7): Result.003 file - promoters60/4283425
atacata

SEQ ID NO: 134372 - DNA, 10 bp, Unknown
  misc_feature (1)..( 10): Result.003 file - promoters60/4283425
tatatatata

SEQ ID NO: 134373 - DNA, 10 bp, Unknown
  misc_feature (1)..( 10): Result.003 file - promoters60/4283425
tataaatata

SEQ ID NO: 134374 - DNA, 6 bp, Unknown
  misc_feature (1)..( 6): Result.003 file - promoters60/4283510
tagctc

SEQ ID NO: 134375 - DNA, 6 bp, Unknown
  misc_feature (1)..( 6): Result.003 file - promoters60/4283510
tagctc

SEQ ID NO: 134376 - DNA, 6 bp, Unknown
  misc_feature (1)..( 6): Result.003 file - promoters60/4283510
tagctc

SEQ ID NO: 134377 - DNA, 9 bp, Unknown
  misc_feature (1)..( 9): Result.003 file - promoters60/4283510
tttcttttc

SEQ ID NO: 134378 - DNA, 9 bp, Unknown
  misc_feature (1)..( 9): Result.003 file - promoters60/4283510
tttctcttc

SEQ ID NO: 134379 - DNA, 9 bp, Unknown
  misc_feature (1)..( 9): Result.003 file - promoters60/4283510
tttctcgac

SEQ ID NO: 134380 - DNA, 8 bp, Unknown
  misc_feature (1)..( 8): Result.003 file - promoters60/4283510
atttttca

SEQ ID NO: 134381 - DNA, 8 bp, Unknown
  misc_feature (1)..( 8): Result.003 file - promoters60/4283510
atttttca

SEQ ID NO: 134382 - DNA, 8 bp, Unknown
  misc_feature (1)..( 8): Result.003 file - promoters60/4283510
ttttatca

SEQ ID NO: 134383 - DNA, 8 bp, Unknown
  misc_feature (1)..( 8): Result.003 file - promoters60/4283614
tatattat

SEQ ID NO: 134384 - DNA, 8 bp, Unknown
  misc_feature (1)..( 8): Result.003 file - promoters60/4283614
tattttat

SEQ ID NO: 134385 - DNA, 6 bp, Unknown
  misc_feature (1)..( 6): Result.003 file - promoters60/4283614
acatgg

SEQ ID NO: 134386 - DNA, 6 bp, Unknown
  misc_feature (1)..( 6): Result.003 file - promoters60/4283614
acatgg

SEQ ID NO: 134387 - DNA, 7 bp, Unknown
  misc_feature (1)..( 7): Result.003 file - promoters60/4283614
ttgatga

SEQ ID NO: 134388 - DNA, 7 bp, Unknown
  misc_feature (1)..( 7): Result.003 file - promoters60/4283614
ttgatga

SEQ ID NO: 134389 - DNA, 9 bp, Unknown
  misc_feature (1)..( 9): Result.003 file - promoters60/4283614
gaccataaa

SEQ ID NO: 134390 - DNA, 9 bp, Unknown
  misc_feature (1)..( 9): Result.003 file - promoters60/4283614
aaccctaaa

SEQ ID NO: 134391 - DNA, 9 bp, Unknown
  misc_feature (1)..( 9): Result.003 file - promoters60/4283614
aaccctcac

SEQ ID NO: 134392 - DNA, 8 bp, Unknown
  misc_feature (1)..( 8): Result.003 file - promoters60/4283614
tactaacg

SEQ ID NO: 134393 - DNA, 8 bp, Unknown
  misc_feature (1)..( 8): Result.003 file - promoters60/4283614
tacaaacg

SEQ ID NO: 134394 - DNA, 6 bp, Unknown
  misc_feature (1)..( 6): Result.003 file - promoters60/4283614
tgaaaa

SEQ ID NO: 134395 - DNA, 6 bp, Unknown
  misc_feature (1)..( 6): Result.003 file - promoters60/4283614
tgaaaa

SEQ ID NO: 134396 - DNA, 7 bp, Unknown
  misc_feature (1)..( 7): Result.003 file - promoters60/4283614
aacctga

SEQ ID NO: 134397 - DNA, 7 bp, Unknown
  misc_feature (1)..( 7): Result.003 file - promoters60/4283614
aacctga

SEQ ID NO: 134398 - DNA, 8 bp, Unknown
  misc_feature (1)..( 8): Result.003 file - promoters60/4283614
atgacaat

SEQ ID NO: 134399 - DNA, 8 bp, Unknown
  misc_feature (1)..( 8): Result.003 file - promoters60/4283614
atgaaaat

SEQ ID NO: 134400 - DNA, 7 bp, Unknown
  misc_feature (1)..( 7): Result.003 file - promoters60/4283614
tctatcc

SEQ ID NO: 134401 - DNA, 7 bp, Unknown
  misc_feature (1)..( 7): Result.003 file - promoters60/4283614
tctctcc

SEQ ID NO: 134402 - DNA, 7 bp, Unknown
  misc_feature (1)..( 7): Result.003 file - promoters60/4283614
caaacta

SEQ ID NO: 134403 - DNA, 7 bp, Unknown
  misc_feature (1)..( 7): Result.003 file - promoters60/4283614
caaacta

SEQ ID NO: 134404 - DNA, 6 bp, Unknown
  misc_feature (1)..( 6): Result.003 file - promoters60/4283614
aaaaat

SEQ ID NO: 134405 - DNA, 6 bp, Unknown
  misc_feature (1)..( 6): Result.003 file - promoters60/4283614
aaaaat

SEQ ID NO: 134406 - DNA, 6 bp, Unknown
  misc_feature (1)..( 6): Result.003 file - promoters60/4283614
aaatta

SEQ ID NO: 134407 - DNA, 6 bp, Unknown
  misc_feature (1)..( 6): Result.003 file - promoters60/4283614
aaatta

SEQ ID NO: 134408 - DNA, 7 bp, Unknown
  misc_feature (1)..( 7): Result.003 file - promoters60/4283614
cttcttt

SEQ ID NO: 134409 - DNA, 7 bp, Unknown
  misc_feature (1)..( 7): Result.003 file - promoters60/4283614
ctttttt

SEQ ID NO: 134410 - DNA, 6 bp, Unknown
  misc_feature (1)..( 6): Result.003 file - promoters60/4283614
gaatca

SEQ ID NO: 134411 - DNA, 6 bp, Unknown
  misc_feature (1)..( 6): Result.003 file - promoters60/4283614
gaatca

SEQ ID NO: 134412 - DNA, 7 bp, Unknown
  misc_feature (1)..( 7): Result.003 file - promoters60/4283614
tccggtt

SEQ ID NO: 134413 - DNA, 7 bp, Unknown
  misc_feature (1)..( 7): Result.003 file - promoters60/4283614
tccagtt

SEQ ID NO: 134414 - DNA, 6 bp, Unknown
  misc_feature (1)..( 6): Result.003 file - promoters60/4283614
tttccg

SEQ ID NO: 134415 - DNA, 6 bp, Unknown
  misc_feature (1)..( 6): Result.003 file - promoters60/4283614
tttccg

SEQ ID NO: 134416 - DNA, 6 bp, Unknown
  misc_feature (1)..( 6): Result.003 file - promoters60/4283614
ataaat

SEQ ID NO: 134417 - DNA, 6 bp, Unknown
  misc_feature (1)..( 6): Result.003 file - promoters60/4283614
ataaat

SEQ ID NO: 134418 - DNA, 9 bp, Unknown
  misc_feature (1)..( 9): Result.003 file - promoters60/4283616
tatgtttgc

SEQ ID NO: 134419 - DNA, 9 bp, Unknown
  misc_feature (1)..( 9): Result.003 file - promoters60/4283616
tatctttta

SEQ ID NO: 134420 - DNA, 9 bp, Unknown
  misc_feature (1)..( 9): Result.003 file - promoters60/4283616
atcgtttgt

SEQ ID NO: 134421 - DNA, 9 bp, Unknown
  misc_feature (1)..( 9): Result.003 file - promoters60/4283616
tctcttttt

SEQ ID NO: 134422 - DNA, 12 bp, Unknown
  misc_feature (1)..( 12): Result.003 file - promoters60/4283616
aactcaccgtgc

SEQ ID NO: 134423 - DNA, 12 bp, Unknown
  misc_feature (1)..( 12): Result.003 file - promoters60/4283616
tactctccgttt

SEQ ID NO: 134424 - DNA, 12 bp, Unknown
  misc_feature (1)..( 12): Result.003 file - promoters60/4283616
tacgctcacttt

SEQ ID NO: 134425 - DNA, 12 bp, Unknown
  misc_feature (1)..( 12): Result.003 file - promoters60/4283616
tgtaatcctttt

SEQ ID NO: 134426 - DNA, 17 bp, Unknown
  misc_feature (1)..( 17): Result.003 file - promoters60/4283616
taaaaataaactagtaa

SEQ ID NO: 134427 - DNA, 17 bp, Unknown
  misc_feature (1)..( 17): Result.003 file - promoters60/4283616
acaaattaaacaagtaa

SEQ ID NO: 134428 - DNA, 17 bp, Unknown
  misc_feature (1)..( 17): Result.003 file - promoters60/4283616
taaaaattataccaaga

SEQ ID NO: 134429 - DNA, 17 bp, Unknown
  misc_feature (1)..( 17): Result.003 file - promoters60/4283616
aagaattaaaacgcgtc

SEQ ID NO: 134430 - DNA, 8 bp, Unknown
  misc_feature (1)..( 8): Result.003 file - promoters60/4283616
tagggttt

SEQ ID NO: 134431 - DNA, 8 bp, Unknown
  misc_feature (1)..( 8): Result.003 file - promoters60/4283616
tagggttt

SEQ ID NO: 134432 - DNA, 8 bp, Unknown
  misc_feature (1)..( 8): Result.003 file - promoters60/4283616
tagagttt

SEQ ID NO: 134433 - DNA, 8 bp, Unknown
  misc_feature (1)..( 8): Result.003 file - promoters60/4283616
aagtgttg

SEQ ID NO: 134434 - DNA, 9 bp, Unknown
  misc_feature (1)..( 9): Result.003 file - promoters60/4283616
gacaaaaga

SEQ ID NO: 134435 - DNA, 9 bp, Unknown
  misc_feature (1)..( 9): Result.003 file - promoters60/4283616
gactaaaga

SEQ ID NO: 134436 - DNA, 9 bp, Unknown
  misc_feature (1)..( 9): Result.003 file - promoters60/4283616
gaccaaaga

SEQ ID NO: 134437 - DNA, 9 bp, Unknown
  misc_feature (1)..( 9): Result.003 file - promoters60/4283616
gactacaga

SEQ ID NO: 134438 - DNA, 8 bp, Unknown
  misc_feature (1)..( 8): Result.003 file - promoters60/4283624
tttgcatt

SEQ ID NO: 134439 - DNA, 8 bp, Unknown
  misc_feature (1)..( 8): Result.003 file - promoters60/4283624
attgcata

SEQ ID NO: 134440 - DNA, 8 bp, Unknown
  misc_feature (1)..( 8): Result.003 file - promoters60/4283624
tttgaatt

SEQ ID NO: 134441 - DNA, 11 bp, Unknown
  misc_feature (1)..( 11): Result.003 file - promoters60/4283624
tatttttaaaa

SEQ ID NO: 134442 - DNA, 11 bp, Unknown
  misc_feature (1)..( 11): Result.003 file - promoters60/4283624
aatttctaaaa

SEQ ID NO: 134443 - DNA, 11 bp, Unknown
  misc_feature (1)..( 11): Result.003 file - promoters60/4283624
tatttttcaat

SEQ ID NO: 134444 - DNA, 11 bp, Unknown
  misc_feature (1)..( 11): Result.003 file - promoters60/4283624
gcagtttaata

SEQ ID NO: 134445 - DNA, 11 bp, Unknown
  misc_feature (1)..( 11): Result.003 file - promoters60/4283624
aaactttaata

SEQ ID NO: 134446 - DNA, 11 bp, Unknown
  misc_feature (1)..( 11): Result.003 file - promoters60/4283624
aaattttaaaa

SEQ ID NO: 134447 - DNA, 7 bp, Unknown
  misc_feature (1)..( 7): Result.003 file - promoters60/4283624
ccactta

SEQ ID NO: 134448 - DNA, 7 bp, Unknown
  misc_feature (1)..( 7): Result.003 file - promoters60/4283624
tcactta

SEQ ID NO: 134449 - DNA, 7 bp, Unknown
  misc_feature (1)..( 7): Result.003 file - promoters60/4283624
tcaatta

SEQ ID NO: 134450 - DNA, 15 bp, Unknown
  misc_feature (1)..( 15): Result.003 file - promoters60/4304982
ataaagtaatttaat

SEQ ID NO: 134451 - DNA, 15 bp, Unknown
  misc_feature (1)..( 15): Result.003 file - promoters60/4304982
aaacagtagtttcca

SEQ ID NO: 134452 - DNA, 15 bp, Unknown
  misc_feature (1)..( 15): Result.003 file - promoters60/4304982
ataaattaattaatt

SEQ ID NO: 134453 - DNA, 15 bp, Unknown
  misc_feature (1)..( 15): Result.003 file - promoters60/4304982
tttgttgagtttcga

SEQ ID NO: 134454 - DNA, 15 bp, Unknown
  misc_feature (1)..( 15): Result.003 file - promoters60/4304982
acgattctgtttcga

SEQ ID NO: 134455 - DNA, 15 bp, Unknown
  misc_feature (1)..( 15): Result.003 file - promoters60/4304982
tcaagataaataaat

SEQ ID NO: 134456 - DNA, 15 bp, Unknown
  misc_feature (1)..( 15): Result.003 file - promoters60/4304982
tacgaaaaaaaaaaa

SEQ ID NO: 134457 - DNA, 11 bp, Unknown
  misc_feature (1)..( 11): Result.003 file - promoters60/4378608
tttttaaattt

SEQ ID NO: 134458 - DNA, 11 bp, Unknown
  misc_feature (1)..( 11): Result.003 file - promoters60/4378608
tttttaaccgt

SEQ ID NO: 134459 - DNA, 11 bp, Unknown
  misc_feature (1)..( 11): Result.003 file - promoters60/4378608
attttacattt

SEQ ID NO: 134460 - DNA, 11 bp, Unknown
  misc_feature (1)..( 11): Result.003 file - promoters60/4378608
tgtttaacaaa

SEQ ID NO: 134461 - DNA, 11 bp, Unknown
  misc_feature (1)..( 11): Result.003 file - promoters60/4378608
gataagtaaag

SEQ ID NO: 134462 - DNA, 11 bp, Unknown
  misc_feature (1)..( 11): Result.003 file - promoters60/4378608
gataagcaaaa

SEQ ID NO: 134463 - DNA, 11 bp, Unknown
  misc_feature (1)..( 11): Result.003 file - promoters60/4378608
tctttgtaaag

SEQ ID NO: 134464 - DNA, 11 bp, Unknown
  misc_feature (1)..( 11): Result.003 file - promoters60/4378608
aaccagaaaag

SEQ ID NO: 134465 - DNA, 9 bp, Unknown
  misc_feature (1)..( 9): Result.003 file - promoters60/4378608
catttcaat

SEQ ID NO: 134466 - DNA, 9 bp, Unknown
  misc_feature (1)..( 9): Result.003 file - promoters60/4378608
cattccaat

SEQ ID NO: 134467 - DNA, 9 bp, Unknown
  misc_feature (1)..( 9): Result.003 file - promoters60/4378608
gtcttcaat

SEQ ID NO: 134468 - DNA, 9 bp, Unknown
  misc_feature (1)..( 9): Result.003 file - promoters60/4378608
gtatccaat

SEQ ID NO: 134469 - DNA, 9 bp, Unknown
  misc_feature (1)..( 9): Result.003 file - promoters60/4378608
ctctccaag

SEQ ID NO: 134470 - DNA, 9 bp, Unknown
  misc_feature (1)..( 9): Result.003 file - promoters60/4378608
aattttcaa

SEQ ID NO: 134471 - DNA, 9 bp, Unknown
  misc_feature (1)..( 9): Result.003 file - promoters60/4378608
aattttttt

SEQ ID NO: 134472 - DNA, 9 bp, Unknown
  misc_feature (1)..( 9): Result.003 file - promoters60/4378608
gatttacaa

SEQ ID NO: 134473 - DNA, 9 bp, Unknown
  misc_feature (1)..( 9): Result.003 file - promoters60/4378608
attttacat

SEQ ID NO: 134474 - DNA, 11 bp, Unknown
  misc_feature (1)..( 11): Result.003 file - promoters60/4577400
ccagaattaag

SEQ ID NO: 134475 - DNA, 11 bp, Unknown
  misc_feature (1)..( 11): Result.003 file - promoters60/4577400
ccataattagt

SEQ ID NO: 134476 - DNA, 11 bp, Unknown
  misc_feature (1)..( 11): Result.003 file - promoters60/4577400
atgtaattaag

SEQ ID NO: 134477 - DNA, 11 bp, Unknown
  misc_feature (1)..( 11): Result.003 file - promoters60/4577400
atatatttata

SEQ ID NO: 134478 - DNA, 11 bp, Unknown
  misc_feature (1)..( 11): Result.003 file - promoters60/4577400
aaaacattaag

SEQ ID NO: 134479 - DNA, 9 bp, Unknown
  misc_feature (1)..( 9): Result.003 file - promoters60/4577400
gtaaaaata

SEQ ID NO: 134480 - DNA, 9 bp, Unknown
  misc_feature (1)..( 9): Result.003 file - promoters60/4577400
ctaataatt

SEQ ID NO: 134481 - DNA, 9 bp, Unknown
  misc_feature (1)..( 9): Result.003 file - promoters60/4577400
gtaaaatta

SEQ ID NO: 134482 - DNA, 9 bp, Unknown
  misc_feature (1)..( 9): Result.003 file - promoters60/4577400
tacataatt

SEQ ID NO: 134483 - DNA, 11 bp, Unknown
  misc_feature (1)..( 11): Result.003 file - promoters60/4607678
tttatattaag

SEQ ID NO: 134484 - DNA, 11 bp, Unknown
  misc_feature (1)..( 11): Result.003 file - promoters60/4607678
cttatattaga

SEQ ID NO: 134485 - DNA, 11 bp, Unknown
  misc_feature (1)..( 11): Result.003 file - promoters60/4607678
tttaaatttta

SEQ ID NO: 134486 - DNA, 11 bp, Unknown
  misc_feature (1)..( 11): Result.003 file - promoters60/4607678
ataatataaag

SEQ ID NO: 134487 - DNA, 11 bp, Unknown
  misc_feature (1)..( 11): Result.003 file - promoters60/4607678
cctatataaag

SEQ ID NO: 134488 - DNA, 11 bp, Unknown
  misc_feature (1)..( 11): Result.003 file - promoters60/4607678
tttaaagcttt

SEQ ID NO: 134489 - DNA, 10 bp, Unknown
  misc_feature (1)..( 10): Result.003 file - promoters60/4607678
ttcaatttca

SEQ ID NO: 134490 - DNA, 10 bp, Unknown
  misc_feature (1)..( 10): Result.003 file - promoters60/4607678
aaaaatctca

SEQ ID NO: 134491 - DNA, 10 bp, Unknown
  misc_feature (1)..( 10): Result.003 file - promoters60/4607678
ttctatttct

SEQ ID NO: 134492 - DNA, 10 bp, Unknown
  misc_feature (1)..( 10): Result.003 file - promoters60/4607678
ttctatttat

SEQ ID NO: 134493 - DNA, 10 bp, Unknown
  misc_feature (1)..( 10): Result.003 file - promoters60/4607678
ttctattcga

SEQ ID NO: 134494 - DNA, 8 bp, Unknown
  misc_feature (1)..( 8): Result.003 file - promoters60/4607678
ttcaattg

SEQ ID NO: 134495 - DNA, 8 bp, Unknown
  misc_feature (1)..( 8): Result.003 file - promoters60/4607678
ttctattc

SEQ ID NO: 134496 - DNA, 8 bp, Unknown
  misc_feature (1)..( 8): Result.003 file - promoters60/4607678
gacaattg

SEQ ID NO: 134497 - DNA, 8 bp, Unknown
  misc_feature (1)..( 8): Result.003 file - promoters60/4607678
ttctattt

SEQ ID NO: 134498 - DNA, 13 bp, Unknown
  misc_feature (1)..( 13): Result.003 file - promoters60/4607678
tcactttcagcat

SEQ ID NO: 134499 - DNA, 13 bp, Unknown
  misc_feature (1)..( 13): Result.003 file - promoters60/4607678
tcattttaaaaac

SEQ ID NO: 134500 - DNA, 13 bp, Unknown
  misc_feature (1)..( 13): Result.003 file - promoters60/4607678
atattttcaaaag

SEQ ID NO: 134501 - DNA, 13 bp, Unknown
  misc_feature (1)..( 13): Result.003 file - promoters60/4607678
tgattttcacaag

SEQ ID NO: 134502 - DNA, 14 bp, Unknown
  misc_feature (1)..( 14): Result.003 file - promoters60/4607678
aataatttgaatgg

SEQ ID NO: 134503 - DNA, 14 bp, Unknown
  misc_feature (1)..( 14): Result.003 file - promoters60/4607678
aatattttcaaaag

SEQ ID NO: 134504 - DNA, 14 bp, Unknown
  misc_feature (1)..( 14): Result.003 file - promoters60/4607678
gtcattttaaaaac

SEQ ID NO: 134505 - DNA, 14 bp, Unknown
  misc_feature (1)..( 14): Result.003 file - promoters60/4607678
atgattttcacaag

SEQ ID NO: 134506 - DNA, 12 bp, Unknown
  misc_feature (1)..( 12): Result.003 file - promoters60/4607678
caatgatgattt

SEQ ID NO: 134507 - DNA, 12 bp, Unknown
  misc_feature (1)..( 12): Result.003 file - promoters60/4607678
aaataatgtttt

SEQ ID NO: 134508 - DNA, 12 bp, Unknown
  misc_feature (1)..( 12): Result.003 file - promoters60/4607678
caattatgtgat

SEQ ID NO: 134509 - DNA, 12 bp, Unknown
  misc_feature (1)..( 12): Result.003 file - promoters60/4607678
caatatttacac

SEQ ID NO: 134510 - DNA, 9 bp, Unknown
  misc_feature (1)..( 9): Result.003 file - promoters60/4607678
tttgaaaat

SEQ ID NO: 134511 - DNA, 11 bp, Unknown
  misc_feature (1)..( 11): Result.003 file - promoters60/4607678
cattttaaaaa

SEQ ID NO: 134512 - DNA, 11 bp, Unknown
  misc_feature (1)..( 11): Result.003 file - promoters60/4607678
attttcaaaag

SEQ ID NO: 134513 - DNA, 11 bp, Unknown
  misc_feature (1)..( 11): Result.003 file - promoters60/4607678
attttcacaag

SEQ ID NO: 134514 - DNA, 15 bp, Unknown
  misc_feature (1)..( 15): Result.003 file - promoters60/4607678
taagttttccaacat

SEQ ID NO: 134515 - DNA, 15 bp, Unknown
  misc_feature (1)..( 15): Result.003 file - promoters60/4607678
cacaaactccatcat

SEQ ID NO: 134516 - DNA, 15 bp, Unknown
  misc_feature (1)..( 15): Result.003 file - promoters60/4607678
tttggtttacaagta

SEQ ID NO: 134517 - DNA, 15 bp, Unknown
  misc_feature (1)..( 15): Result.003 file - promoters60/4607678
tttgggttacaattt

SEQ ID NO: 134518 - DNA, 9 bp, Unknown
  misc_feature (1)..( 9): Result.003 file - promoters60/4607678
tttacacta

SEQ ID NO: 134519 - DNA, 9 bp, Unknown
  misc_feature (1)..( 9): Result.003 file - promoters60/4607678
tttacaaga

SEQ ID NO: 134520 - DNA, 9 bp, Unknown
  misc_feature (1)..( 9): Result.003 file - promoters60/4607678
tttatactc

SEQ ID NO: 134521 - DNA, 9 bp, Unknown
  misc_feature (1)..( 9): Result.003 file - promoters60/4607678
attagaaga

SEQ ID NO: 134522 - DNA, 8 bp, Unknown
  misc_feature (1)..( 8): Result.003 file - promoters60/4607692
aaaaatta

SEQ ID NO: 134523 - DNA, 8 bp, Unknown
  misc_feature (1)..( 8): Result.003 file - promoters60/4607692
taaaattt

SEQ ID NO: 134524 - DNA, 9 bp, Unknown
  misc_feature (1)..( 9): Result.003 file - promoters60/4607692
caaagatta

SEQ ID NO: 134525 - DNA, 9 bp, Unknown
  misc_feature (1)..( 9): Result.003 file - promoters60/4607692
ctaaaattt

SEQ ID NO: 134526 - DNA, 9 bp, Unknown
  misc_feature (1)..( 9): Result.003 file - promoters60/4607692
gtataatag

SEQ ID NO: 134527 - DNA, 9 bp, Unknown
  misc_feature (1)..( 9): Result.003 file - promoters60/4607692
gaaaatatc

SEQ ID NO: 134528 - DNA, 9 bp, Unknown
  misc_feature (1)..( 9): Result.003 file - promoters60/4607692
ttaaatatg

SEQ ID NO: 134529 - DNA, 9 bp, Unknown
  misc_feature (1)..( 9): Result.003 file - promoters60/4607692
ttaaagatc

SEQ ID NO: 134530 - DNA, 9 bp, Unknown
  misc_feature (1)..( 9): Result.003 file - promoters60/4607692
ttatatata

SEQ ID NO: 134531 - DNA, 10 bp, Unknown
  misc_feature (1)..( 10): Result.003 file - promoters60/4607692
tttatttctt

SEQ ID NO: 134532 - DNA, 10 bp, Unknown
  misc_feature (1)..( 10): Result.003 file - promoters60/4607692
tttacttcaa

SEQ ID NO: 134533 - DNA, 10 bp, Unknown
  misc_feature (1)..( 10): Result.003 file - promoters60/4607692
tttgtatcta

SEQ ID NO: 134534 - DNA, 10 bp, Unknown
  misc_feature (1)..( 10): Result.003 file - promoters60/4607692
ataacttgta

SEQ ID NO: 134535 - DNA, 12 bp, Unknown
  misc_feature (1)..( 12): Result.003 file - promoters60/4607692
taaaaaaactaa

SEQ ID NO: 134536 - DNA, 12 bp, Unknown
  misc_feature (1)..( 12): Result.003 file - promoters60/4607692
taaataaattaa

SEQ ID NO: 134537 - DNA, 12 bp, Unknown
  misc_feature (1)..( 12): Result.003 file - promoters60/4607692
aagaaaaacgtt

SEQ ID NO: 134538 - DNA, 12 bp, Unknown
  misc_feature (1)..( 12): Result.003 file - promoters60/4607692
gaaaaacacgtg

SEQ ID NO: 134539 - DNA, 11 bp, Unknown
  misc_feature (1)..( 11): Result.003 file - promoters60/4607692
aataaaattaa

SEQ ID NO: 134540 - DNA, 11 bp, Unknown
  misc_feature (1)..( 11): Result.003 file - promoters60/4607692
tatataatatt

SEQ ID NO: 134541 - DNA, 11 bp, Unknown
  misc_feature (1)..( 11): Result.003 file - promoters60/4607692
aattaaattaa

SEQ ID NO: 134542 - DNA, 11 bp, Unknown
  misc_feature (1)..( 11): Result.003 file - promoters60/4607692
aagaaaattaa

SEQ ID NO: 134543 - DNA, 11 bp, Unknown
  misc_feature (1)..( 11): Result.003 file - promoters60/4607692
gattaaatatg

SEQ ID NO: 134544 - DNA, 9 bp, Unknown
  misc_feature (1)..( 9): Result.003 file - promoters60/4607692
gaataaaag

SEQ ID NO: 134545 - DNA, 9 bp, Unknown
  misc_feature (1)..( 9): Result.003 file - promoters60/4607692
aaataaaaa

SEQ ID NO: 134546 - DNA, 9 bp, Unknown
  misc_feature (1)..( 9): Result.003 file - promoters60/4607692
tactaaaaa

SEQ ID NO: 134547 - DNA, 9 bp, Unknown
  misc_feature (1)..( 9): Result.003 file - promoters60/4607692
aaataagaa

SEQ ID NO: 134548 - DNA, 9 bp, Unknown
  misc_feature (1)..( 9): Result.003 file - promoters60/4607692
tgataagaa

SEQ ID NO: 134549 - DNA, 11 bp, Unknown
  misc_feature (1)..( 11): Result.003 file - promoters60/4607692
acaaatttatt

SEQ ID NO: 134550 - DNA, 11 bp, Unknown
  misc_feature (1)..( 11): Result.003 file - promoters60/4607692
acacatttttt

SEQ ID NO: 134551 - DNA, 11 bp, Unknown
  misc_feature (1)..( 11): Result.003 file - promoters60/4607692
tccaattaatt

SEQ ID NO: 134552 - DNA, 11 bp, Unknown
  misc_feature (1)..( 11): Result.003 file - promoters60/4607692
taaaatttcgt

SEQ ID NO: 134553 - DNA, 8 bp, Unknown
  misc_feature (1)..( 8): Result.003 file - promoters60/4607692
aaaaagaa

SEQ ID NO: 134554 - DNA, 8 bp, Unknown
  misc_feature (1)..( 8): Result.003 file - promoters60/4607692
aaaaagtt

SEQ ID NO: 134555 - DNA, 9 bp, Unknown
  misc_feature (1)..( 9): Result.003 file - promoters60/4607692
aaataagaa

SEQ ID NO: 134556 - DNA, 9 bp, Unknown
  misc_feature (1)..( 9): Result.003 file - promoters60/4607692
tgataagaa

SEQ ID NO: 134557 - DNA, 9 bp, Unknown
  misc_feature (1)..( 9): Result.003 file - promoters60/4608096
catataaag

SEQ ID NO: 134558 - DNA, 9 bp, Unknown
  misc_feature (1)..( 9): Result.003 file - promoters60/4608096
catatatac

SEQ ID NO: 134559 - DNA, 9 bp, Unknown
  misc_feature (1)..( 9): Result.003 file - promoters60/4608096
aataaaaag

SEQ ID NO: 134560 - DNA, 9 bp, Unknown
  misc_feature (1)..( 9): Result.003 file - promoters60/4608096
tatatatat

SEQ ID NO: 134561 - DNA, 9 bp, Unknown
  misc_feature (1)..( 9): Result.003 file - promoters60/4608096
tatagataa

SEQ ID NO: 134562 - DNA, 9 bp, Unknown
  misc_feature (1)..( 9): Result.003 file - promoters60/4608096
tataaaacc

SEQ ID NO: 134563 - DNA, 10 bp, Unknown
  misc_feature (1)..( 10): Result.003 file - promoters60/4608104
aaaacgaaga

SEQ ID NO: 134564 - DNA, 10 bp, Unknown
  misc_feature (1)..( 10): Result.003 file - promoters60/4608104
taaaagaaat

SEQ ID NO: 134565 - DNA, 10 bp, Unknown
  misc_feature (1)..( 10): Result.003 file - promoters60/4608104
tgtaagaaaa

SEQ ID NO: 134566 - DNA, 10 bp, Unknown
  misc_feature (1)..( 10): Result.003 file - promoters60/4608104
tatgagaaaa

SEQ ID NO: 134567 - DNA, 11 bp, Unknown
  misc_feature (1)..( 11): Result.003 file - promoters60/4608104
taattgacaaa

SEQ ID NO: 134568 - DNA, 11 bp, Unknown
  misc_feature (1)..( 11): Result.003 file - promoters60/4608104
tttaagtaaat

SEQ ID NO: 134569 - DNA, 11 bp, Unknown
  misc_feature (1)..( 11): Result.003 file - promoters60/4608104
gttaggtaaac

SEQ ID NO: 134570 - DNA, 11 bp, Unknown
  misc_feature (1)..( 11): Result.003 file - promoters60/4608104
tttatgtaact

SEQ ID NO: 134571 - DNA, 16 bp, Unknown
  misc_feature (1)..( 16): Result.003 file - promoters60/4608104
gaactaatagccagtg

SEQ ID NO: 134572 - DNA, 16 bp, Unknown
  misc_feature (1)..( 16): Result.003 file - promoters60/4608104
aaacaaatagaaaaag

SEQ ID NO: 134573 - DNA, 16 bp, Unknown
  misc_feature (1)..( 16): Result.003 file - promoters60/4608104
attttaatagacacat

SEQ ID NO: 134574 - DNA, 16 bp, Unknown
  misc_feature (1)..( 16): Result.003 file - promoters60/4608104
ctacatataccgagaa

SEQ ID NO: 134575 - DNA, 16 bp, Unknown
  misc_feature (1)..( 16): Result.003 file - promoters60/4608104
aaacagaaaatatgca

SEQ ID NO: 134576 - DNA, 16 bp, Unknown
  misc_feature (1)..( 16): Result.003 file - promoters60/4608104
agaattatgttactag

SEQ ID NO: 134577 - DNA, 16 bp, Unknown
  misc_feature (1)..( 16): Result.003 file - promoters60/4608104
gattttatagagaagg

SEQ ID NO: 134578 - DNA, 12 bp, Unknown
  misc_feature (1)..( 12): Result.003 file - promoters60/4608104
aacgaagaggaa

SEQ ID NO: 134579 - DNA, 12 bp, Unknown
  misc_feature (1)..( 12): Result.003 file - promoters60/4608104
taagaaaaggat

SEQ ID NO: 134580 - DNA, 13 bp, Unknown
  misc_feature (1)..( 13): Result.003 file - promoters60/4608104
gggccaagatgaa

SEQ ID NO: 134581 - DNA, 12 bp, Unknown
  misc_feature (1)..( 12): Result.003 file - promoters60/4608104
tgagaaaactat

SEQ ID NO: 134582 - DNA, 13 bp, Unknown
  misc_feature (1)..( 13): Result.003 file - promoters60/4608104
attgacaaatata

SEQ ID NO: 134583 - DNA, 13 bp, Unknown
  misc_feature (1)..( 13): Result.003 file - promoters60/4608104
taagtaaattttc

SEQ ID NO: 134584 - DNA, 13 bp, Unknown
  misc_feature (1)..( 13): Result.003 file - promoters60/4608104
aatgaattaatta

SEQ ID NO: 134585 - DNA, 9 bp, Unknown
  misc_feature (1)..( 9): Result.003 file - promoters60/4608104
aaaaatttc

SEQ ID NO: 134586 - DNA, 9 bp, Unknown
  misc_feature (1)..( 9): Result.003 file - promoters60/4608104
taaaattaa

SEQ ID NO: 134587 - DNA, 9 bp, Unknown
  misc_feature (1)..( 9): Result.003 file - promoters60/4608104
aaaaatgaa

SEQ ID NO: 134588 - DNA, 9 bp, Unknown
  misc_feature (1)..( 9): Result.003 file - promoters60/4608104
gaaaataac

SEQ ID NO: 134589 - DNA, 9 bp, Unknown
  misc_feature (1)..( 9): Result.003 file - promoters60/4608104
aaaaaaact

SEQ ID NO: 134590 - DNA, 9 bp, Unknown
  misc_feature (1)..( 9): Result.003 file - promoters60/4608104
gaaaccttc

SEQ ID NO: 134591 - DNA, 10 bp, Unknown
  misc_feature (1)..( 10): Result.003 file - promoters60/4608104
cgagaaaaat

SEQ ID NO: 134592 - DNA, 10 bp, Unknown
  misc_feature (1)..( 10): Result.003 file - promoters60/4608104
tgagaaaata

SEQ ID NO: 134593 - DNA, 10 bp, Unknown
  misc_feature (1)..( 10): Result.003 file - promoters60/4608104
caagaaaaaa

SEQ ID NO: 134594 - DNA, 10 bp, Unknown
  misc_feature (1)..( 10): Result.003 file - promoters60/4608104
cacgaaaaag

SEQ ID NO: 134595 - DNA, 11 bp, Unknown
  misc_feature (1)..( 11): Result.003 file - promoters60/4608104
aataaaataat

SEQ ID NO: 134596 - DNA, 11 bp, Unknown
  misc_feature (1)..( 11): Result.003 file - promoters60/4608104
tgagaaacaga

SEQ ID NO: 134597 - DNA, 11 bp, Unknown
  misc_feature (1)..( 11): Result.003 file - promoters60/4608104
aaaacaaaacc

SEQ ID NO: 134598 - DNA, 11 bp, Unknown
  misc_feature (1)..( 11): Result.003 file - promoters60/4608104
aaaagaaaaaa

SEQ ID NO: 134599 - DNA, 11 bp, Unknown
  misc_feature (1)..( 11): Result.003 file - promoters60/4608104
aaaataaaata

SEQ ID NO: 134600 - DNA, 11 bp, Unknown
  misc_feature (1)..( 11): Result.003 file - promoters60/4608104
atgagaaaata

SEQ ID NO: 134601 - DNA, 11 bp, Unknown
  misc_feature (1)..( 11): Result.003 file - promoters60/4608104
ttgagaaacag

SEQ ID NO: 134602 - DNA, 11 bp, Unknown
  misc_feature (1)..( 11): Result.003 file - promoters60/4608104
acaagaaaaaa

SEQ ID NO: 134603 - DNA, 8 bp, Unknown
  misc_feature (1)..( 8): Result.003 file - promoters60/4608140
tgtttttg

SEQ ID NO: 134604 - DNA, 8 bp, Unknown
  misc_feature (1)..( 8): Result.003 file - promoters60/4608140
catttttg

SEQ ID NO: 134605 - DNA, 8 bp, Unknown
  misc_feature (1)..( 8): Result.003 file - promoters60/4608140
catatttg

SEQ ID NO: 134606 - DNA, 7 bp, Unknown
  misc_feature (1)..( 7): Result.003 file - promoters60/4608140
ttgttaa

SEQ ID NO: 134607 - DNA, 7 bp, Unknown
  misc_feature (1)..( 7): Result.003 file - promoters60/4608140
ttgctaa

SEQ ID NO: 134608 - DNA, 7 bp, Unknown
  misc_feature (1)..( 7): Result.003 file - promoters60/4608140
ttggtaa

SEQ ID NO: 134609 - DNA, 10 bp, Unknown
  misc_feature (1)..( 10): Result.003 file - promoters60/4608140
tgtaaaaatt

SEQ ID NO: 134610 - DNA, 10 bp, Unknown
  misc_feature (1)..( 10): Result.003 file - promoters60/4608140
gctaaaaatc

SEQ ID NO: 134611 - DNA, 10 bp, Unknown
  misc_feature (1)..( 10): Result.003 file - promoters60/4608140
tgtaaaaatt

SEQ ID NO: 134612 - DNA, 7 bp, Unknown
  misc_feature (1)..( 7): Result.003 file - promoters60/4608140
aaaattt

SEQ ID NO: 134613 - DNA, 7 bp, Unknown
  misc_feature (1)..( 7): Result.003 file - promoters60/4608140
aaaatta

SEQ ID NO: 134614 - DNA, 7 bp, Unknown
  misc_feature (1)..( 7): Result.003 file - promoters60/4608140
aaagtta

SEQ ID NO: 134615 - DNA, 8 bp, Unknown
  misc_feature (1)..( 8): Result.003 file - promoters60/4608140
aaaacaat

SEQ ID NO: 134616 - DNA, 8 bp, Unknown
  misc_feature (1)..( 8): Result.003 file - promoters60/4608140
aaaagaat

SEQ ID NO: 134617 - DNA, 8 bp, Unknown
  misc_feature (1)..( 8): Result.003 file - promoters60/4608140
gaaacaaa

SEQ ID NO: 134618 - DNA, 10 bp, Unknown
  misc_feature (1)..( 10): Result.003 file - promoters60/4608140
agagacaaat

SEQ ID NO: 134619 - DNA, 10 bp, Unknown
  misc_feature (1)..( 10): Result.003 file - promoters60/4608140
agatacaaaa

SEQ ID NO: 134620 - DNA, 10 bp, Unknown
  misc_feature (1)..( 10): Result.003 file - promoters60/4608140
attgactaat

SEQ ID NO: 134621 - DNA, 9 bp, Unknown
  misc_feature (1)..( 9): Result.003 file - promoters60/4608140
tctttggat

SEQ ID NO: 134622 - DNA, 9 bp, Unknown
  misc_feature (1)..( 9): Result.003 file - promoters60/4608140
tgtttggaa

SEQ ID NO: 134623 - DNA, 9 bp, Unknown
  misc_feature (1)..( 9): Result.003 file - promoters60/4608140
tctttagat

SEQ ID NO: 134624 - DNA, 8 bp, Unknown
  misc_feature (1)..( 8): Result.003 file - promoters60/4608140
catgtttt

SEQ ID NO: 134625 - DNA, 8 bp, Unknown
  misc_feature (1)..( 8): Result.003 file - promoters60/4608140
catatttg

SEQ ID NO: 134626 - DNA, 8 bp, Unknown
  misc_feature (1)..( 8): Result.003 file - promoters60/4608140
catttttg

SEQ ID NO: 134627 - DNA, 8 bp, Unknown
  misc_feature (1)..( 8): Result.003 file - promoters60/4608140
gttttttt

SEQ ID NO: 134628 - DNA, 8 bp, Unknown
  misc_feature (1)..( 8): Result.003 file - promoters60/4608140
attttttt

SEQ ID NO: 134629 - DNA, 8 bp, Unknown
  misc_feature (1)..( 8): Result.003 file - promoters60/4608140
atttttat

SEQ ID NO: 134630 - DNA, 11 bp, Unknown
  misc_feature (1)..( 11): Result.003 file - promoters60/4608961
aactattttga

SEQ ID NO: 134631 - DNA, 11 bp, Unknown
  misc_feature (1)..( 11): Result.003 file - promoters60/4608961
gcatattttat

SEQ ID NO: 134632 - DNA, 11 bp, Unknown
  misc_feature (1)..( 11): Result.003 file - promoters60/4608961
atgcattttta

SEQ ID NO: 134633 - DNA, 11 bp, Unknown
  misc_feature (1)..( 11): Result.003 file - promoters60/4608961
aactattatat

SEQ ID NO: 134634 - DNA, 11 bp, Unknown
  misc_feature (1)..( 11): Result.003 file - promoters60/4608961
atgcttttaat

SEQ ID NO: 134635 - DNA, 11 bp, Unknown
  misc_feature (1)..( 11): Result.003 file - promoters60/4608961
atatatgatac

SEQ ID NO: 134636 - DNA, 12 bp, Unknown
  misc_feature (1)..( 12): Result.003 file - promoters60/4608961
ctttgcttacaa

SEQ ID NO: 134637 - DNA, 12 bp, Unknown
  misc_feature (1)..( 12): Result.003 file - promoters60/4608961
agttgtttatat

SEQ ID NO: 134638 - DNA, 12 bp, Unknown
  misc_feature (1)..( 12): Result.003 file - promoters60/4608961
tcatgtttaatc

SEQ ID NO: 134639 - DNA, 12 bp, Unknown
  misc_feature (1)..( 12): Result.003 file - promoters60/4608961
cattttttatcc

SEQ ID NO: 134640 - DNA, 12 bp, Unknown
  misc_feature (1)..( 12): Result.003 file - promoters60/4608961
atgcttttaatc

SEQ ID NO: 134641 - DNA, 12 bp, Unknown
  misc_feature (1)..( 12): Result.003 file - promoters60/4608961
ttttgtttcgtt

SEQ ID NO: 134642 - DNA, 12 bp, Unknown
  misc_feature (1)..( 12): Result.003 file - promoters60/4608961
tgttattcaagt

SEQ ID NO: 134643 - DNA, 10 bp, Unknown
  misc_feature (1)..( 10): Result.003 file - promoters60/4608961
tatctatatg

SEQ ID NO: 134644 - DNA, 10 bp, Unknown
  misc_feature (1)..( 10): Result.003 file - promoters60/4608961
tgattatatg

SEQ ID NO: 134645 - DNA, 10 bp, Unknown
  misc_feature (1)..( 10): Result.003 file - promoters60/4608961
tgagtatatt

SEQ ID NO: 134646 - DNA, 10 bp, Unknown
  misc_feature (1)..( 10): Result.003 file - promoters60/4608961
tgactatgca

SEQ ID NO: 134647 - DNA, 10 bp, Unknown
  misc_feature (1)..( 10): Result.003 file - promoters60/4608961
aaagtataat

SEQ ID NO: 134648 - DNA, 10 bp, Unknown
  misc_feature (1)..( 10): Result.003 file - promoters60/4608961
gtactatgta

SEQ ID NO: 134649 - DNA, 10 bp, Unknown
  misc_feature (1)..( 10): Result.003 file - promoters60/4608961
atatgcagaa

SEQ ID NO: 134650 - DNA, 10 bp, Unknown
  misc_feature (1)..( 10): Result.003 file - promoters60/4608961
ctatgtagat

SEQ ID NO: 134651 - DNA, 10 bp, Unknown
  misc_feature (1)..( 10): Result.003 file - promoters60/4608961
ctatgcattt

SEQ ID NO: 134652 - DNA, 10 bp, Unknown
  misc_feature (1)..( 10): Result.003 file - promoters60/4608961
tcatgctttt

SEQ ID NO: 134653 - DNA, 10 bp, Unknown
  misc_feature (1)..( 10): Result.003 file - promoters60/4608961
atatgtacaa

SEQ ID NO: 134654 - DNA, 10 bp, Unknown
  misc_feature (1)..( 10): Result.003 file - promoters60/4608961
ttatttgtta

SEQ ID NO: 134655 - DNA, 13 bp, Unknown
  misc_feature (1)..( 13): Result.003 file - promoters60/4608961
catgtttaatctg

SEQ ID NO: 134656 - DNA, 13 bp, Unknown
  misc_feature (1)..( 13): Result.003 file - promoters60/4608961
tgcttttaatctc

SEQ ID NO: 134657 - DNA, 13 bp, Unknown
  misc_feature (1)..( 13): Result.003 file - promoters60/4608961
cattttttatcca

SEQ ID NO: 134658 - DNA, 13 bp, Unknown
  misc_feature (1)..( 13): Result.003 file - promoters60/4608961
agttgtttatata

SEQ ID NO: 134659 - DNA, 13 bp, Unknown
  misc_feature (1)..( 13): Result.003 file - promoters60/4608961
acatgttattcaa

SEQ ID NO: 134660 - DNA, 13 bp, Unknown
  misc_feature (1)..( 13): Result.003 file - promoters60/4608961
cattttgtttcgt

SEQ ID NO: 134661 - DNA, 13 bp, Unknown
  misc_feature (1)..( 13): Result.003 file - promoters60/4608965
agacaaagtatct

SEQ ID NO: 134662 - DNA, 13 bp, Unknown
  misc_feature (1)..( 13): Result.003 file - promoters60/4608965
taaaaaattatct

SEQ ID NO: 134663 - DNA, 12 bp, Unknown
  misc_feature (1)..( 12): Result.003 file - promoters60/4608965
cacaaagttccc

SEQ ID NO: 134664 - DNA, 13 bp, Unknown
  misc_feature (1)..( 13): Result.003 file - promoters60/4608965
acttaaatttacg

SEQ ID NO: 134665 - DNA, 12 bp, Unknown
  misc_feature (1)..( 12): Result.003 file - promoters60/4608965
taaaaattatac

SEQ ID NO: 134666 - DNA, 12 bp, Unknown
  misc_feature (1)..( 12): Result.003 file - promoters60/4608965
tccaatgttaac

SEQ ID NO: 134667 - DNA, 13 bp, Unknown
  misc_feature (1)..( 13): Result.003 file - promoters60/4608965
taaataattaatc

SEQ ID NO: 134668 - DNA, 9 bp, Unknown
  misc_feature (1)..( 9): Result.003 file - promoters60/4608985
gaaaatatt

SEQ ID NO: 134669 - DNA, 9 bp, Unknown
  misc_feature (1)..( 9): Result.003 file - promoters60/4608985
aaaaataag

SEQ ID NO: 134670 - DNA, 9 bp, Unknown
  misc_feature (1)..( 9): Result.003 file - promoters60/4608985
aaaaattaa

SEQ ID NO: 134671 - DNA, 9 bp, Unknown
  misc_feature (1)..( 9): Result.003 file - promoters60/4608985
tcaaatatt

SEQ ID NO: 134672 - DNA, 9 bp, Unknown
  misc_feature (1)..( 9): Result.003 file - promoters60/4608985
aaacatatt

SEQ ID NO: 134673 - DNA, 9 bp, Unknown
  misc_feature (1)..( 9): Result.003 file - promoters60/4608985
taaaatttc

SEQ ID NO: 134674 - DNA, 9 bp, Unknown
  misc_feature (1)..( 9): Result.003 file - promoters60/4608985
caaaattca

SEQ ID NO: 134675 - DNA, 12 bp, Unknown
  misc_feature (1)..( 12): Result.003 file - promoters60/4608985
aaaataaataaa

SEQ ID NO: 134676 - DNA, 12 bp, Unknown
  misc_feature (1)..( 12): Result.003 file - promoters60/4608985
ttaataaagcta

SEQ ID NO: 134677 - DNA, 12 bp, Unknown
  misc_feature (1)..( 12): Result.003 file - promoters60/4608985
aaaattaatatt

SEQ ID NO: 134678 - DNA, 12 bp, Unknown
  misc_feature (1)..( 12): Result.003 file - promoters60/4608985
gaccttaaaaaa

SEQ ID NO: 134679 - DNA, 12 bp, Unknown
  misc_feature (1)..( 12): Result.003 file - promoters60/4608985
gagataatattt

SEQ ID NO: 134680 - DNA, 12 bp, Unknown
  misc_feature (1)..( 12): Result.003 file - promoters60/4608985
attataaaatac

SEQ ID NO: 134681 - DNA, 12 bp, Unknown
  misc_feature (1)..( 12): Result.003 file - promoters60/4608985
catctaacatag

SEQ ID NO: 134682 - DNA, 12 bp, Unknown
  misc_feature (1)..( 12): Result.003 file - promoters60/4608985
aaatttacaaac

SEQ ID NO: 134683 - DNA, 10 bp, Unknown
  misc_feature (1)..( 10): Result.003 file - promoters60/4608985
aaaacaaacg

SEQ ID NO: 134684 - DNA, 10 bp, Unknown
  misc_feature (1)..( 10): Result.003 file - promoters60/4608985
aaaaaaaaga

SEQ ID NO: 134685 - DNA, 10 bp, Unknown
  misc_feature (1)..( 10): Result.003 file - promoters60/4608985
taaataaatt

SEQ ID NO: 134686 - DNA, 10 bp, Unknown
  misc_feature (1)..( 10): Result.003 file - promoters60/4608985
caaacaaatg

SEQ ID NO: 134687 - DNA, 10 bp, Unknown
  misc_feature (1)..( 10): Result.003 file - promoters60/4608985
taaaaaaaga

SEQ ID NO: 134688 - DNA, 10 bp, Unknown
  misc_feature (1)..( 10): Result.003 file - promoters60/4608985
aaaacaattc

SEQ ID NO: 134689 - DNA, 10 bp, Unknown
  misc_feature (1)..( 10): Result.003 file - promoters60/4608985
gaaagaagac

SEQ ID NO: 134690 - DNA, 12 bp, Unknown
  misc_feature (1)..( 12): Result.003 file - promoters60/4608985
ttacaaaactac

SEQ ID NO: 134691 - DNA, 12 bp, Unknown
  misc_feature (1)..( 12): Result.003 file - promoters60/4608985
atacaaaaaaag

SEQ ID NO: 134692 - DNA, 12 bp, Unknown
  misc_feature (1)..( 12): Result.003 file - promoters60/4608985
tcccaaaaataa

SEQ ID NO: 134693 - DNA, 12 bp, Unknown
  misc_feature (1)..( 12): Result.003 file - promoters60/4608985
ttcctaaaatca

SEQ ID NO: 134694 - DNA, 12 bp, Unknown
  misc_feature (1)..( 12): Result.003 file - promoters60/4608985
aaacataagttt

SEQ ID NO: 134695 - DNA, 12 bp, Unknown
  misc_feature (1)..( 12): Result.003 file - promoters60/4608985
aaacatattgag

SEQ ID NO: 134696 - DNA, 12 bp, Unknown
  misc_feature (1)..( 12): Result.003 file - promoters60/4608985
ttatatatgttt

SEQ ID NO: 134697 - DNA, 12 bp, Unknown
  misc_feature (1)..( 12): Result.003 file - promoters60/4608985
ttgagtttaggc

SEQ ID NO: 134698 - DNA, 12 bp, Unknown
  misc_feature (1)..( 12): Result.003 file - promoters60/4608985
gatagtttaaaa

SEQ ID NO: 134699 - DNA, 12 bp, Unknown
  misc_feature (1)..( 12): Result.003 file - promoters60/4608985
ataagtttcaaa

SEQ ID NO: 134700 - DNA, 12 bp, Unknown
  misc_feature (1)..( 12): Result.003 file - promoters60/4608985
tgaagtatcatc

SEQ ID NO: 134701 - DNA, 13 bp, Unknown
  misc_feature (1)..( 13): Result.003 file - promoters60/4608985
aacaattctaatt

SEQ ID NO: 134702 - DNA, 13 bp, Unknown
  misc_feature (1)..( 13): Result.003 file - promoters60/4608985
atatgtttatatg

SEQ ID NO: 134703 - DNA, 13 bp, Unknown
  misc_feature (1)..( 13): Result.003 file - promoters60/4608985
aataaataaaagc

SEQ ID NO: 134704 - DNA, 13 bp, Unknown
  misc_feature (1)..( 13): Result.003 file - promoters60/4608985
aaacaataaaatt

SEQ ID NO: 134705 - DNA, 13 bp, Unknown
  misc_feature (1)..( 13): Result.003 file - promoters60/4608985
acattataaaata

SEQ ID NO: 134706 - DNA, 13 bp, Unknown
  misc_feature (1)..( 13): Result.003 file - promoters60/4608985
aaacagtaaaacc

SEQ ID NO: 134707 - DNA, 13 bp, Unknown
  misc_feature (1)..( 13): Result.003 file - promoters60/4608985
aggagataatatt

SEQ ID NO: 134708 - DNA, 13 bp, Unknown
  misc_feature (1)..( 13): Result.003 file - promoters60/4608985
aaaaaatcaaaat

SEQ ID NO: 134709 - DNA, 13 bp, Unknown
  misc_feature (1)..( 13): Result.003 file - promoters60/4608985
accatctaacata

SEQ ID NO: 134710 - DNA, 14 bp, Unknown
  misc_feature (1)..( 14): Result.003 file - promoters60/4608985
aaaatttacaaact

SEQ ID NO: 134711 - DNA, 9 bp, Unknown
  misc_feature (1)..( 9): Result.003 file - promoters60/4608985
gtttgttta

SEQ ID NO: 134712 - DNA, 9 bp, Unknown
  misc_feature (1)..( 9): Result.003 file - promoters60/4608985
ttttatttc

SEQ ID NO: 134713 - DNA, 9 bp, Unknown
  misc_feature (1)..( 9): Result.003 file - promoters60/4608985
ttttgtttc

SEQ ID NO: 134714 - DNA, 9 bp, Unknown
  misc_feature (1)..( 9): Result.003 file - promoters60/4608985
atttttttc

SEQ ID NO: 134715 - DNA, 9 bp, Unknown
  misc_feature (1)..( 9): Result.003 file - promoters60/4608985
ttttctttc

SEQ ID NO: 134716 - DNA, 9 bp, Unknown
  misc_feature (1)..( 9): Result.003 file - promoters60/4608985
ttttatttt

SEQ ID NO: 134717 - DNA, 11 bp, Unknown
  misc_feature (1)..( 11): Result.003 file - promoters60/4608985
gtttccaatat

SEQ ID NO: 134718 - DNA, 11 bp, Unknown
  misc_feature (1)..( 11): Result.003 file - promoters60/4608985
gtttcaaatac

SEQ ID NO: 134719 - DNA, 12 bp, Unknown
  misc_feature (1)..( 12): Result.003 file - promoters60/4608985
gagatcaaatag

SEQ ID NO: 134720 - DNA, 11 bp, Unknown
  misc_feature (1)..( 11): Result.003 file - promoters60/4608985
ttttcaacttt

SEQ ID NO: 134721 - DNA, 12 bp, Unknown
  misc_feature (1)..( 12): Result.003 file - promoters60/4608985
gcctggaaatag

SEQ ID NO: 134722 - DNA, 12 bp, Unknown
  misc_feature (1)..( 12): Result.003 file - promoters60/4608985
atttacaactga

SEQ ID NO: 134723 - DNA, 10 bp, Unknown
  misc_feature (1)..( 10): Result.003 file - promoters60/4608985
acgaaaaata

SEQ ID NO: 134724 - DNA, 10 bp, Unknown
  misc_feature (1)..( 10): Result.003 file - promoters60/4608985
ttataaaata

SEQ ID NO: 134725 - DNA, 9 bp, Unknown
  misc_feature (1)..( 9): Result.003 file - promoters60/4608985
taaaaaatt

SEQ ID NO: 134726 - DNA, 9 bp, Unknown
  misc_feature (1)..( 9): Result.003 file - promoters60/4608985
taaaaaatc

SEQ ID NO: 134727 - DNA, 10 bp, Unknown
  misc_feature (1)..( 10): Result.003 file - promoters60/4608985
ttaataaagc

SEQ ID NO: 134728 - DNA, 10 bp, Unknown
  misc_feature (1)..( 10): Result.003 file - promoters60/4608985
tcaaacaata

SEQ ID NO: 134729 - DNA, 11 bp, Unknown
  misc_feature (1)..( 11): Result.003 file - promoters60/4608985
catctaacata

SEQ ID NO: 134730 - DNA, 10 bp, Unknown
  misc_feature (1)..( 10): Result.003 file - promoters60/4608985
tgaaaaacaa

SEQ ID NO: 134731 - DNA, 10 bp, Unknown
  misc_feature (1)..( 10): Result.003 file - promoters60/4608985
agaaaaaata

SEQ ID NO: 134732 - DNA, 10 bp, Unknown
  misc_feature (1)..( 10): Result.003 file - promoters60/4608985
tgaaaatctc

SEQ ID NO: 134733 - DNA, 10 bp, Unknown
  misc_feature (1)..( 10): Result.003 file - promoters60/4608985
ggaaaaaaaa

SEQ ID NO: 134734 - DNA, 10 bp, Unknown
  misc_feature (1)..( 10): Result.003 file - promoters60/4608985
ttaaaaaata

SEQ ID NO: 134735 - DNA, 10 bp, Unknown
  misc_feature (1)..( 10): Result.003 file - promoters60/4608985
ccaaaatata

SEQ ID NO: 134736 - DNA, 10 bp, Unknown
  misc_feature (1)..( 10): Result.003 file - promoters60/4608985
caaaacaatt

SEQ ID NO: 134737 - DNA, 9 bp, Unknown
  misc_feature (1)..( 9): Result.003 file - promoters60/4610292
caattaaat

SEQ ID NO: 134738 - DNA, 9 bp, Unknown
  misc_feature (1)..( 9): Result.003 file - promoters60/4610292
caaataaaa

SEQ ID NO: 134739 - DNA, 9 bp, Unknown
  misc_feature (1)..( 9): Result.003 file - promoters60/4610292
gaattaaat

SEQ ID NO: 134740 - DNA, 13 bp, Unknown
  misc_feature (1)..( 13): Result.003 file - promoters60/4610551
tatgggccgtaat

SEQ ID NO: 134741 - DNA, 13 bp, Unknown
  misc_feature (1)..( 13): Result.003 file - promoters60/4610551
aatgggcctaatt

SEQ ID NO: 134742 - DNA, 13 bp, Unknown
  misc_feature (1)..( 13): Result.003 file - promoters60/4610551
aatgggctgggcc

SEQ ID NO: 134743 - DNA, 13 bp, Unknown
  misc_feature (1)..( 13): Result.003 file - promoters60/4610551
tttgggcttctta

SEQ ID NO: 134744 - DNA, 13 bp, Unknown
  misc_feature (1)..( 13): Result.003 file - promoters60/4610551
aataggcccaaca

SEQ ID NO: 134745 - DNA, 13 bp, Unknown
  misc_feature (1)..( 13): Result.003 file - promoters60/4610551
attgggcttttta

SEQ ID NO: 134746 - DNA, 6 bp, Unknown
  misc_feature (1)..( 6): Result.003 file - promoters60/4610628
aaaaca

SEQ ID NO: 134747 - DNA, 6 bp, Unknown
  misc_feature (1)..( 6): Result.003 file - promoters60/4610628
aaaaca

SEQ ID NO: 134748 - DNA, 7 bp, Unknown
  misc_feature (1)..( 7): Result.003 file - promoters60/4610628
atcatga

SEQ ID NO: 134749 - DNA, 7 bp, Unknown
  misc_feature (1)..( 7): Result.003 file - promoters60/4610628
atcttga

SEQ ID NO: 134750 - DNA, 6 bp, Unknown
  misc_feature (1)..( 6): Result.003 file - promoters60/4610628
gtttta

SEQ ID NO: 134751 - DNA, 6 bp, Unknown
  misc_feature (1)..( 6): Result.003 file - promoters60/4610628
gtttta

SEQ ID NO: 134752 - DNA, 7 bp, Unknown
  misc_feature (1)..( 7): Result.003 file - promoters60/4610628
tttatgt

SEQ ID NO: 134753 - DNA, 7 bp, Unknown
  misc_feature (1)..( 7): Result.003 file - promoters60/4610628
tttatgt

SEQ ID NO: 134754 - DNA, 7 bp, Unknown
  misc_feature (1)..( 7): Result.003 file - promoters60/4610628
ttaaaac

SEQ ID NO: 134755 - DNA, 7 bp, Unknown
  misc_feature (1)..( 7): Result.003 file - promoters60/4610628
ttataac

SEQ ID NO: 134756 - DNA, 8 bp, Unknown
  misc_feature (1)..( 8): Result.003 file - promoters60/4610628
tctgtttg

SEQ ID NO: 134757 - DNA, 8 bp, Unknown
  misc_feature (1)..( 8): Result.003 file - promoters60/4610628
tctgtttg

SEQ ID NO: 134758 - DNA, 8 bp, Unknown
  misc_feature (1)..( 8): Result.003 file - promoters60/4610628
tctgttgt

SEQ ID NO: 134759 - DNA, 8 bp, Unknown
  misc_feature (1)..( 8): Result.003 file - promoters60/4610628
aaaaacat

SEQ ID NO: 134760 - DNA, 8 bp, Unknown
  misc_feature (1)..( 8): Result.003 file - promoters60/4610628
aaaaacat

SEQ ID NO: 134761 - DNA, 7 bp, Unknown
  misc_feature (1)..( 7): Result.003 file - promoters60/4610628
aaccaat

SEQ ID NO: 134762 - DNA, 7 bp, Unknown
  misc_feature (1)..( 7): Result.003 file - promoters60/4610628
aaccaat

SEQ ID NO: 134763 - DNA, 6 bp, Unknown
  misc_feature (1)..( 6): Result.003 file - promoters60/4610628
cctata

SEQ ID NO: 134764 - DNA, 6 bp, Unknown
  misc_feature (1)..( 6): Result.003 file - promoters60/4610628
cctata

SEQ ID NO: 134765 - DNA, 15 bp, Unknown
  misc_feature (1)..( 15): Result.003 file - promoters60/4610628
aaggcaggctgtcac

SEQ ID NO: 134766 - DNA, 15 bp, Unknown
  misc_feature (1)..( 15): Result.003 file - promoters60/4610628
aaggcaggctgtcac

SEQ ID NO: 134767 - DNA, 27 bp, Unknown
  misc_feature (1)..( 27): Result.003 file - promoters60/4610628
tggcggaccccaacaaattatcaaatc

SEQ ID NO: 134768 - DNA, 27 bp, Unknown
  misc_feature (1)..( 27): Result.003 file - promoters60/4610628
tggcggaccccaaccaattatcaaatc

SEQ ID NO: 134769 - DNA, 8 bp, Unknown
  misc_feature (1)..( 8): Result.003 file - promoters60/4610628
aataaatt

SEQ ID NO: 134770 - DNA, 8 bp, Unknown
  misc_feature (1)..( 8): Result.003 file - promoters60/4610628
aatcaatt

SEQ ID NO: 134771 - DNA, 8 bp, Unknown
  misc_feature (1)..( 8): Result.003 file - promoters60/4610628
ccatccat

SEQ ID NO: 134772 - DNA, 8 bp, Unknown
  misc_feature (1)..( 8): Result.003 file - promoters60/4610628
ccatgcat

SEQ ID NO: 134773 - DNA, 8 bp, Unknown
  misc_feature (1)..( 8): Result.003 file - promoters60/4610628
tatagtat

SEQ ID NO: 134774 - DNA, 8 bp, Unknown
  misc_feature (1)..( 8): Result.003 file - promoters60/4610628
tatattat

SEQ ID NO: 134775 - DNA, 7 bp, Unknown
  misc_feature (1)..( 7): Result.003 file - promoters60/4610628
aaacgtg

SEQ ID NO: 134776 - DNA, 7 bp, Unknown
  misc_feature (1)..( 7): Result.003 file - promoters60/4610628
aaatgtg

SEQ ID NO: 134777 - DNA, 6 bp, Unknown
  misc_feature (1)..( 6): Result.003 file - promoters60/4610628
caaaaa

SEQ ID NO: 134778 - DNA, 6 bp, Unknown
  misc_feature (1)..( 6): Result.003 file - promoters60/4610628
caaaaa

SEQ ID NO: 134779 - DNA, 8 bp, Unknown
  misc_feature (1)..( 8): Result.003 file - promoters60/4610628
caataagt

SEQ ID NO: 134780 - DNA, 8 bp, Unknown
  misc_feature (1)..( 8): Result.003 file - promoters60/4610628
caatgagt

SEQ ID NO: 134781 - DNA, 7 bp, Unknown
  misc_feature (1)..( 7): Result.003 file - promoters60/4610628
tccaatt

SEQ ID NO: 134782 - DNA, 7 bp, Unknown
  misc_feature (1)..( 7): Result.003 file - promoters60/4610628
tcccatt

SEQ ID NO: 134783 - DNA, 6 bp, Unknown
  misc_feature (1)..( 6): Result.003 file - promoters60/4610628
ttttta

SEQ ID NO: 134784 - DNA, 6 bp, Unknown
  misc_feature (1)..( 6): Result.003 file - promoters60/4610628
ttttta

SEQ ID NO: 134785 - DNA, 8 bp, Unknown
  misc_feature (1)..( 8): Result.003 file - promoters60/4610628
gtaagtta

SEQ ID NO: 134786 - DNA, 8 bp, Unknown
  misc_feature (1)..( 8): Result.003 file - promoters60/4610628
gtaagtta

SEQ ID NO: 134787 - DNA, 7 bp, Unknown
  misc_feature (1)..( 7): Result.003 file - promoters60/4610628
aatcaaa

SEQ ID NO: 134788 - DNA, 7 bp, Unknown
  misc_feature (1)..( 7): Result.003 file - promoters60/4610628
aatgaaa

SEQ ID NO: 134789 - DNA, 8 bp, Unknown
  misc_feature (1)..( 8): Result.003 file - promoters60/4611225
tgtttgta

SEQ ID NO: 134790 - DNA, 8 bp, Unknown
  misc_feature (1)..( 8): Result.003 file - promoters60/4611225
tgtctgta

SEQ ID NO: 134791 - DNA, 7 bp, Unknown
  misc_feature (1)..( 7): Result.003 file - promoters60/4611225
attcttt

SEQ ID NO: 134792 - DNA, 7 bp, Unknown
  misc_feature (1)..( 7): Result.003 file - promoters60/4611225
attattt

SEQ ID NO: 134793 - DNA, 6 bp, Unknown
  misc_feature (1)..( 6): Result.003 file - promoters60/4611225
tcgttt

SEQ ID NO: 134794 - DNA, 6 bp, Unknown
  misc_feature (1)..( 6): Result.003 file - promoters60/4611225
tcgttt

SEQ ID NO: 134795 - DNA, 8 bp, Unknown
  misc_feature (1)..( 8): Result.003 file - promoters60/4611225
gtttactt

SEQ ID NO: 134796 - DNA, 8 bp, Unknown
  misc_feature (1)..( 8): Result.003 file - promoters60/4611225
gttgactt

SEQ ID NO: 134797 - DNA, 6 bp, Unknown
  misc_feature (1)..( 6): Result.003 file - promoters60/4611225
tttcaa

SEQ ID NO: 134798 - DNA, 6 bp, Unknown
  misc_feature (1)..( 6): Result.003 file - promoters60/4611225
tttcaa

SEQ ID NO: 134799 - DNA, 6 bp, Unknown
  misc_feature (1)..( 6): Result.003 file - promoters60/4611225
tctttc

SEQ ID NO: 134800 - DNA, 6 bp, Unknown
  misc_feature (1)..( 6): Result.003 file - promoters60/4611225
tctttc

SEQ ID NO: 134801 - DNA, 9 bp, Unknown
  misc_feature (1)..( 9): Result.003 file - promoters60/4611225
caaaaaaac

SEQ ID NO: 134802 - DNA, 9 bp, Unknown
  misc_feature (1)..( 9): Result.003 file - promoters60/4611225
caaaataac

SEQ ID NO: 134803 - DNA, 6 bp, Unknown
  misc_feature (1)..( 6): Result.003 file - promoters60/4611225
aacaaa

SEQ ID NO: 134804 - DNA, 6 bp, Unknown
  misc_feature (1)..( 6): Result.003 file - promoters60/4611225
aacaaa

SEQ ID NO: 134805 - DNA, 12 bp, Unknown
  misc_feature (1)..( 12): Result.003 file - promoters60/4611225
tcatcaattttt

SEQ ID NO: 134806 - DNA, 12 bp, Unknown
  misc_feature (1)..( 12): Result.003 file - promoters60/4611225
tcatcaatcttt

SEQ ID NO: 134807 - DNA, 7 bp, Unknown
  misc_feature (1)..( 7): Result.003 file - promoters60/4611225
aacaaaa

SEQ ID NO: 134808 - DNA, 7 bp, Unknown
  misc_feature (1)..( 7): Result.003 file - promoters60/4611225
aacaaaa

SEQ ID NO: 134809 - DNA, 7 bp, Unknown
  misc_feature (1)..( 7): Result.003 file - promoters60/4611225
tattcat

SEQ ID NO: 134810 - DNA, 7 bp, Unknown
  misc_feature (1)..( 7): Result.003 file - promoters60/4611225
tatgcat

SEQ ID NO: 134811 - DNA, 7 bp, Unknown
  misc_feature (1)..( 7): Result.003 file - promoters60/4611225
acatatc

SEQ ID NO: 134812 - DNA, 7 bp, Unknown
  misc_feature (1)..( 7): Result.003 file - promoters60/4611225
acagatc

SEQ ID NO: 134813 - DNA, 6 bp, Unknown
  misc_feature (1)..( 6): Result.003 file - promoters60/4611225
tattta

SEQ ID NO: 134814 - DNA, 6 bp, Unknown
  misc_feature (1)..( 6): Result.003 file - promoters60/4611225
tattta

SEQ ID NO: 134815 - DNA, 7 bp, Unknown
  misc_feature (1)..( 7): Result.003 file - promoters60/4611225
cttattc

SEQ ID NO: 134816 - DNA, 7 bp, Unknown
  misc_feature (1)..( 7): Result.003 file - promoters60/4611225
cttcttc

SEQ ID NO: 134817 - DNA, 6 bp, Unknown
  misc_feature (1)..( 6): Result.003 file - promoters60/4611225
aatatc

SEQ ID NO: 134818 - DNA, 6 bp, Unknown
  misc_feature (1)..( 6): Result.003 file - promoters60/4611225
aatatc

SEQ ID NO: 134819 - DNA, 7 bp, Unknown
  misc_feature (1)..( 7): Result.003 file - promoters60/4611225
caggaaa

SEQ ID NO: 134820 - DNA, 7 bp, Unknown
  misc_feature (1)..( 7): Result.003 file - promoters60/4611225
cagaaaa

SEQ ID NO: 134821 - DNA, 6 bp, Unknown
  misc_feature (1)..( 6): Result.003 file - promoters60/4611225
aataaa

SEQ ID NO: 134822 - DNA, 6 bp, Unknown
  misc_feature (1)..( 6): Result.003 file - promoters60/4611225
aataaa

SEQ ID NO: 134823 - DNA, 10 bp, Unknown
  misc_feature (1)..( 10): Result.003 file - promoters60/4701809
tccatcgaat

SEQ ID NO: 134824 - DNA, 10 bp, Unknown
  misc_feature (1)..( 10): Result.003 file - promoters60/4701809
caaatcaaat

SEQ ID NO: 134825 - DNA, 10 bp, Unknown
  misc_feature (1)..( 10): Result.003 file - promoters60/4701809
tccctcgaac

SEQ ID NO: 134826 - DNA, 10 bp, Unknown
  misc_feature (1)..( 10): Result.003 file - promoters60/4701809
gtaatcaatc

SEQ ID NO: 134827 - DNA, 10 bp, Unknown
  misc_feature (1)..( 10): Result.003 file - promoters60/4701809
aaaaccaaag

SEQ ID NO: 134828 - DNA, 10 bp, Unknown
  misc_feature (1)..( 10): Result.003 file - promoters60/4701809
gggtccaaag

SEQ ID NO: 134829 - DNA, 9 bp, Unknown
  misc_feature (1)..( 9): Result.003 file - promoters60/4701809
gtaatcaat

SEQ ID NO: 134830 - DNA, 9 bp, Unknown
  misc_feature (1)..( 9): Result.003 file - promoters60/4701809
aaaatgaat

SEQ ID NO: 134831 - DNA, 9 bp, Unknown
  misc_feature (1)..( 9): Result.003 file - promoters60/4701809
caaatcaaa

SEQ ID NO: 134832 - DNA, 9 bp, Unknown
  misc_feature (1)..( 9): Result.003 file - promoters60/4701809
tgcatcaat

SEQ ID NO: 134833 - DNA, 9 bp, Unknown
  misc_feature (1)..( 9): Result.003 file - promoters60/4701809
aaaacgaat

SEQ ID NO: 134834 - DNA, 9 bp, Unknown
  misc_feature (1)..( 9): Result.003 file - promoters60/4701809
aaaaccaaa

SEQ ID NO: 134835 - DNA, 11 bp, Unknown
  misc_feature (1)..( 11): Result.003 file - promoters60/4766314
caacgaagtaa

SEQ ID NO: 134836 - DNA, 11 bp, Unknown
  misc_feature (1)..( 11): Result.003 file - promoters60/4766314
atacgaagaat

SEQ ID NO: 134837 - DNA, 11 bp, Unknown
  misc_feature (1)..( 11): Result.003 file - promoters60/4766314
aatcgaattaa

SEQ ID NO: 134838 - DNA, 11 bp, Unknown
  misc_feature (1)..( 11): Result.003 file - promoters60/4766314
cgacgaaatac

SEQ ID NO: 134839 - DNA, 8 bp, Unknown
  misc_feature (1)..( 8): Result.003 file - promoters60/4766314
aaatcgat

SEQ ID NO: 134840 - DNA, 8 bp, Unknown
  misc_feature (1)..( 8): Result.003 file - promoters60/4766314
aaaacgac

SEQ ID NO: 134841 - DNA, 8 bp, Unknown
  misc_feature (1)..( 8): Result.003 file - promoters60/4766314
aaaaagac

SEQ ID NO: 134842 - DNA, 10 bp, Unknown
  misc_feature (1)..( 10): Result.003 file - promoters60/4766314
aattagattt

SEQ ID NO: 134843 - DNA, 10 bp, Unknown
  misc_feature (1)..( 10): Result.003 file - promoters60/4766314
aatgagattt

SEQ ID NO: 134844 - DNA, 10 bp, Unknown
  misc_feature (1)..( 10): Result.003 file - promoters60/4766314
aatgacattt

SEQ ID NO: 134845 - DNA, 8 bp, Unknown
  misc_feature (1)..( 8): Result.003 file - promoters60/4766314
aatggtat

SEQ ID NO: 134846 - DNA, 8 bp, Unknown
  misc_feature (1)..( 8): Result.003 file - promoters60/4766314
tatgttat

SEQ ID NO: 134847 - DNA, 8 bp, Unknown
  misc_feature (1)..( 8): Result.003 file - promoters60/4766314
tatgttaa

SEQ ID NO: 134848 - DNA, 8 bp, Unknown
  misc_feature (1)..( 8): Result.003 file - promoters60/4766314
aaaactat

SEQ ID NO: 134849 - DNA, 8 bp, Unknown
  misc_feature (1)..( 8): Result.003 file - promoters60/4766314
aaaaatat

SEQ ID NO: 134850 - DNA, 8 bp, Unknown
  misc_feature (1)..( 8): Result.003 file - promoters60/4766314
aacaatga

SEQ ID NO: 134851 - DNA, 14 bp, Unknown
  misc_feature (1)..( 14): Result.003 file - promoters60/4766320
ttaatttcaatctt

SEQ ID NO: 134852 - DNA, 14 bp, Unknown
  misc_feature (1)..( 14): Result.003 file - promoters60/4766320
ttaatttggaatct

SEQ ID NO: 134853 - DNA, 14 bp, Unknown
  misc_feature (1)..( 14): Result.003 file - promoters60/4766320
aaaatttcaaatga

SEQ ID NO: 134854 - DNA, 14 bp, Unknown
  misc_feature (1)..( 14): Result.003 file - promoters60/4766320
ctaatttccaaaga

SEQ ID NO: 134855 - DNA, 14 bp, Unknown
  misc_feature (1)..( 14): Result.003 file - promoters60/4766320
ctattttccaatga

SEQ ID NO: 134856 - DNA, 10 bp, Unknown
  misc_feature (1)..( 10): Result.003 file - promoters60/4766320
tatttggtta

SEQ ID NO: 134857 - DNA, 10 bp, Unknown
  misc_feature (1)..( 10): Result.003 file - promoters60/4766320
cattttgtta

SEQ ID NO: 134858 - DNA, 10 bp, Unknown
  misc_feature (1)..( 10): Result.003 file - promoters60/4766320
cattttgaca

SEQ ID NO: 134859 - DNA, 10 bp, Unknown
  misc_feature (1)..( 10): Result.003 file - promoters60/4766320
acttttgaga

SEQ ID NO: 134860 - DNA, 10 bp, Unknown
  misc_feature (1)..( 10): Result.003 file - promoters60/4766320
caatcttatc

SEQ ID NO: 134861 - DNA, 10 bp, Unknown
  misc_feature (1)..( 10): Result.003 file - promoters60/4766320
caatcttatc

SEQ ID NO: 134862 - DNA, 10 bp, Unknown
  misc_feature (1)..( 10): Result.003 file - promoters60/4766320
aaattttaac

SEQ ID NO: 134863 - DNA, 10 bp, Unknown
  misc_feature (1)..( 10): Result.003 file - promoters60/4766320
aaatttgtca

SEQ ID NO: 134864 - DNA, 7 bp, Unknown
  misc_feature (1)..( 7): Result.003 file - promoters60/4766320
ttaaaaa

SEQ ID NO: 134865 - DNA, 7 bp, Unknown
  misc_feature (1)..( 7): Result.003 file - promoters60/4766320
ttaaaat

SEQ ID NO: 134866 - DNA, 7 bp, Unknown
  misc_feature (1)..( 7): Result.003 file - promoters60/4766320
gtaaaat

SEQ ID NO: 134867 - DNA, 7 bp, Unknown
  misc_feature (1)..( 7): Result.003 file - promoters60/4766320
ttaaaaa

SEQ ID NO: 134868 - DNA, 7 bp, Unknown
  misc_feature (1)..( 7): Result.003 file - promoters60/4766324
actggag

SEQ ID NO: 134869 - DNA, 7 bp, Unknown
  misc_feature (1)..( 7): Result.003 file - promoters60/4766324
actcgag

SEQ ID NO: 134870 - DNA, 7 bp, Unknown
  misc_feature (1)..( 7): Result.003 file - promoters60/4766324
actcgaa

SEQ ID NO: 134871 - DNA, 8 bp, Unknown
  misc_feature (1)..( 8): Result.003 file - promoters60/4766324
caatcaaa

SEQ ID NO: 134872 - DNA, 8 bp, Unknown
  misc_feature (1)..( 8): Result.003 file - promoters60/4766324
caattaaa

SEQ ID NO: 134873 - DNA, 8 bp, Unknown
  misc_feature (1)..( 8): Result.003 file - promoters60/4766324
aaatcaat

SEQ ID NO: 134874 - DNA, 9 bp, Unknown
  misc_feature (1)..( 9): Result.003 file - promoters60/4766324
actatatat

SEQ ID NO: 134875 - DNA, 9 bp, Unknown
  misc_feature (1)..( 9): Result.003 file - promoters60/4766324
tctatataa

SEQ ID NO: 134876 - DNA, 9 bp, Unknown
  misc_feature (1)..( 9): Result.003 file - promoters60/4766324
actatataa

SEQ ID NO: 134877 - DNA, 9 bp, Unknown
  misc_feature (1)..( 9): Result.003 file - promoters60/4766324
ctaatataa

SEQ ID NO: 134878 - DNA, 8 bp, Unknown
  misc_feature (1)..( 8): Result.003 file - promoters60/4766324
cattttta

SEQ ID NO: 134879 - DNA, 8 bp, Unknown
  misc_feature (1)..( 8): Result.003 file - promoters60/4766324
catttttt

SEQ ID NO: 134880 - DNA, 8 bp, Unknown
  misc_feature (1)..( 8): Result.003 file - promoters60/4766324
tttttttt

SEQ ID NO: 134881 - DNA, 8 bp, Unknown
  misc_feature (1)..( 8): Result.003 file - promoters60/4766324
attgtaag

SEQ ID NO: 134882 - DNA, 8 bp, Unknown
  misc_feature (1)..( 8): Result.003 file - promoters60/4766324
attttaaa

SEQ ID NO: 134883 - DNA, 8 bp, Unknown
  misc_feature (1)..( 8): Result.003 file - promoters60/4766324
cgtttaaa

SEQ ID NO: 134884 - DNA, 7 bp, Unknown
  misc_feature (1)..( 7): Result.003 file - promoters60/4766324
tttaata

SEQ ID NO: 134885 - DNA, 7 bp, Unknown
  misc_feature (1)..( 7): Result.003 file - promoters60/4766324
ttttata

SEQ ID NO: 134886 - DNA, 7 bp, Unknown
  misc_feature (1)..( 7): Result.003 file - promoters60/4766324
tttaatt

SEQ ID NO: 134887 - DNA, 7 bp, Unknown
  misc_feature (1)..( 7): Result.003 file - promoters60/4766335
taattaa

SEQ ID NO: 134888 - DNA, 7 bp, Unknown
  misc_feature (1)..( 7): Result.003 file - promoters60/4766335
taactaa

SEQ ID NO: 134889 - DNA, 6 bp, Unknown
  misc_feature (1)..( 6): Result.003 file - promoters60/4766335
aatgta

SEQ ID NO: 134890 - DNA, 6 bp, Unknown
  misc_feature (1)..( 6): Result.003 file - promoters60/4766335
aatgta

SEQ ID NO: 134891 - DNA, 9 bp, Unknown
  misc_feature (1)..( 9): Result.003 file - promoters60/4766335
accttaaac

SEQ ID NO: 134892 - DNA, 9 bp, Unknown
  misc_feature (1)..( 9): Result.003 file - promoters60/4766335
accttaaac

SEQ ID NO: 134893 - DNA, 7 bp, Unknown
  misc_feature (1)..( 7): Result.003 file - promoters60/4766335
atctagt

SEQ ID NO: 134894 - DNA, 7 bp, Unknown
  misc_feature (1)..( 7): Result.003 file - promoters60/4766335
atcaagt

SEQ ID NO: 134895 - DNA, 12 bp, Unknown
  misc_feature (1)..( 12): Result.003 file - promoters60/4766335
tagttaaatgaa

SEQ ID NO: 134896 - DNA, 12 bp, Unknown
  misc_feature (1)..( 12): Result.003 file - promoters60/4766335
tagtcaaagctg

SEQ ID NO: 134897 - DNA, 12 bp, Unknown
  misc_feature (1)..( 12): Result.003 file - promoters60/4766335
caattacatgaa

SEQ ID NO: 134898 - DNA, 9 bp, Unknown
  misc_feature (1)..( 9): Result.003 file - promoters60/4766335
ttaaatgaa

SEQ ID NO: 134899 - DNA, 9 bp, Unknown
  misc_feature (1)..( 9): Result.003 file - promoters60/4766335
agaaatgat

SEQ ID NO: 134900 - DNA, 9 bp, Unknown
  misc_feature (1)..( 9): Result.003 file - promoters60/4766335
ttacatgaa

SEQ ID NO: 134901 - DNA, 7 bp, Unknown
  misc_feature (1)..( 7): Result.003 file - promoters60/4766335
aataatt

SEQ ID NO: 134902 - DNA, 7 bp, Unknown
  misc_feature (1)..( 7): Result.003 file - promoters60/4766335
aatcatt

SEQ ID NO: 134903 - DNA, 9 bp, Unknown
  misc_feature (1)..( 9): Result.003 file - promoters60/4766335
ttggagcct

SEQ ID NO: 134904 - DNA, 9 bp, Unknown
  misc_feature (1)..( 9): Result.003 file - promoters60/4766335
ttggtgcct

SEQ ID NO: 134905 - DNA, 7 bp, Unknown
  misc_feature (1)..( 7): Result.003 file - promoters60/4766335
aaaacat

SEQ ID NO: 134906 - DNA, 7 bp, Unknown
  misc_feature (1)..( 7): Result.003 file - promoters60/4766335
aaaccat

SEQ ID NO: 134907 - DNA, 9 bp, Unknown
  misc_feature (1)..( 9): Result.003 file - promoters60/4766335
tctataaat

SEQ ID NO: 134908 - DNA, 9 bp, Unknown
  misc_feature (1)..( 9): Result.003 file - promoters60/4766335
tctataaat

SEQ ID NO: 134909 - DNA, 9 bp, Unknown
  misc_feature (1)..( 9): Result.003 file - promoters60/4766335
tttataaaa

SEQ ID NO: 134910 - DNA, 7 bp, Unknown
  misc_feature (1)..( 7): Result.003 file - promoters60/4766335
tttccct

SEQ ID NO: 134911 - DNA, 7 bp, Unknown
  misc_feature (1)..( 7): Result.003 file - promoters60/4766335
tttgcct

SEQ ID NO: 134912 - DNA, 9 bp, Unknown
  misc_feature (1)..( 9): Result.003 file - promoters60/4766335
ttatttgga

SEQ ID NO: 134913 - DNA, 9 bp, Unknown
  misc_feature (1)..( 9): Result.003 file - promoters60/4766335
ttatgtgga

SEQ ID NO: 134914 - DNA, 11 bp, Unknown
  misc_feature (1)..( 11): Result.003 file - promoters60/4766335
cgatacttgtc

SEQ ID NO: 134915 - DNA, 11 bp, Unknown
  misc_feature (1)..( 11): Result.003 file - promoters60/4766335
cgaaactggtc

SEQ ID NO: 134916 - DNA, 8 bp, Unknown
  misc_feature (1)..( 8): Result.003 file - promoters60/4766335
gaactcat

SEQ ID NO: 134917 - DNA, 8 bp, Unknown
  misc_feature (1)..( 8): Result.003 file - promoters60/4766335
gaagtcat

SEQ ID NO: 134918 - DNA, 7 bp, Unknown
  misc_feature (1)..( 7): Result.003 file - promoters60/4766335
agaagaa

SEQ ID NO: 134919 - DNA, 7 bp, Unknown
  misc_feature (1)..( 7): Result.003 file - promoters60/4766335
agaagaa

SEQ ID NO: 134920 - DNA, 6 bp, Unknown
  misc_feature (1)..( 6): Result.003 file - promoters60/4766335
gtgtaa

SEQ ID NO: 134921 - DNA, 6 bp, Unknown
  misc_feature (1)..( 6): Result.003 file - promoters60/4766335
gtgtaa

SEQ ID NO: 134922 - DNA, 9 bp, Unknown
  misc_feature (1)..( 9): Result.003 file - promoters60/4766335
aaacaaaaa

SEQ ID NO: 134923 - DNA, 9 bp, Unknown
  misc_feature (1)..( 9): Result.003 file - promoters60/4766335
aaagaaaaa

SEQ ID NO: 134924 - DNA, 8 bp, Unknown
  misc_feature (1)..( 8): Result.003 file - promoters60/4766335
aaagtttg

SEQ ID NO: 134925 - DNA, 8 bp, Unknown
  misc_feature (1)..( 8): Result.003 file - promoters60/4766335
aaaatttg

SEQ ID NO: 134926 - DNA, 6 bp, Unknown
  misc_feature (1)..( 6): Result.003 file - promoters60/4766335
taagat

SEQ ID NO: 134927 - DNA, 6 bp, Unknown
  misc_feature (1)..( 6): Result.003 file - promoters60/4766335
taagat

SEQ ID NO: 134928 - DNA, 7 bp, Unknown
  misc_feature (1)..( 7): Result.003 file - promoters60/4766335
ctaatct

SEQ ID NO: 134929 - DNA, 7 bp, Unknown
  misc_feature (1)..( 7): Result.003 file - promoters60/4766335
ctattct

SEQ ID NO: 134930 - DNA, 6 bp, Unknown
  misc_feature (1)..( 6): Result.003 file - promoters60/4766335
agaaat

SEQ ID NO: 134931 - DNA, 6 bp, Unknown
  misc_feature (1)..( 6): Result.003 file - promoters60/4766335
agaaat

SEQ ID NO: 134932 - DNA, 6 bp, Unknown
  misc_feature (1)..( 6): Result.003 file - promoters60/4766335
ttcgtg

SEQ ID NO: 134933 - DNA, 6 bp, Unknown
  misc_feature (1)..( 6): Result.003 file - promoters60/4766335
ttcgtg

SEQ ID NO: 134934 - DNA, 6 bp, Unknown
  misc_feature (1)..( 6): Result.003 file - promoters60/4766335
catcac

SEQ ID NO: 134935 - DNA, 6 bp, Unknown
  misc_feature (1)..( 6): Result.003 file - promoters60/4766335
catcac

SEQ ID NO: 134936 - DNA, 6 bp, Unknown
  misc_feature (1)..( 6): Result.003 file - promoters60/4766357
ggtact

SEQ ID NO: 134937 - DNA, 6 bp, Unknown
  misc_feature (1)..( 6): Result.003 file - promoters60/4766357
ggtact

SEQ ID NO: 134938 - DNA, 7 bp, Unknown
  misc_feature (1)..( 7): Result.003 file - promoters60/4766357
atacaaa

SEQ ID NO: 134939 - DNA, 7 bp, Unknown
  misc_feature (1)..( 7): Result.003 file - promoters60/4766357
atataaa

SEQ ID NO: 134940 - DNA, 8 bp, Unknown
  misc_feature (1)..( 8): Result.003 file - promoters60/4766357
ccatatac

SEQ ID NO: 134941 - DNA, 8 bp, Unknown
  misc_feature (1)..( 8): Result.003 file - promoters60/4766357
ccatttac

SEQ ID NO: 134942 - DNA, 7 bp, Unknown
  misc_feature (1)..( 7): Result.003 file - promoters60/4766357
tataatc

SEQ ID NO: 134943 - DNA, 7 bp, Unknown
  misc_feature (1)..( 7): Result.003 file - promoters60/4766357
tatgatc

SEQ ID NO: 134944 - DNA, 7 bp, Unknown
  misc_feature (1)..( 7): Result.003 file - promoters60/4766357
tttcaaa

SEQ ID NO: 134945 - DNA, 7 bp, Unknown
  misc_feature (1)..( 7): Result.003 file - promoters60/4766357
tttcaaa

SEQ ID NO: 134946 - DNA, 6 bp, Unknown
  misc_feature (1)..( 6): Result.003 file - promoters60/4766357
cagaag

SEQ ID NO: 134947 - DNA, 6 bp, Unknown
  misc_feature (1)..( 6): Result.003 file - promoters60/4766357
cagaag

SEQ ID NO: 134948 - DNA, 7 bp, Unknown
  misc_feature (1)..( 7): Result.003 file - promoters60/4766357
aagtaat

SEQ ID NO: 134949 - DNA, 7 bp, Unknown
  misc_feature (1)..( 7): Result.003 file - promoters60/4766357
aagaaat

SEQ ID NO: 134950 - DNA, 7 bp, Unknown
  misc_feature (1)..( 7): Result.003 file - promoters60/4766357
ccaaaaa

SEQ ID NO: 134951 - DNA, 7 bp, Unknown
  misc_feature (1)..( 7): Result.003 file - promoters60/4766357
ccaaaaa

SEQ ID NO: 134952 - DNA, 8 bp, Unknown
  misc_feature (1)..( 8): Result.003 file - promoters60/4766365
tccttttt

SEQ ID NO: 134953 - DNA, 8 bp, Unknown
  misc_feature (1)..( 8): Result.003 file - promoters60/4766365
tccctttc

SEQ ID NO: 134954 - DNA, 8 bp, Unknown
  misc_feature (1)..( 8): Result.003 file - promoters60/4766365
atcttttt

SEQ ID NO: 134955 - DNA, 8 bp, Unknown
  misc_feature (1)..( 8): Result.003 file - promoters60/4766365
gaataaaa

SEQ ID NO: 134956 - DNA, 8 bp, Unknown
  misc_feature (1)..( 8): Result.003 file - promoters60/4766365
aaataaaa

SEQ ID NO: 134957 - DNA, 8 bp, Unknown
  misc_feature (1)..( 8): Result.003 file - promoters60/4766365
aaacaaaa

SEQ ID NO: 134958 - DNA, 8 bp, Unknown
  misc_feature (1)..( 8): Result.003 file - promoters60/4766365
gaatctat

SEQ ID NO: 134959 - DNA, 8 bp, Unknown
  misc_feature (1)..( 8): Result.003 file - promoters60/4766365
taatatat

SEQ ID NO: 134960 - DNA, 8 bp, Unknown
  misc_feature (1)..( 8): Result.003 file - promoters60/4766365
gaatctag

SEQ ID NO: 134961 - DNA, 9 bp, Unknown
  misc_feature (1)..( 9): Result.003 file - promoters60/4766365
tgtcttgat

SEQ ID NO: 134962 - DNA, 9 bp, Unknown
  misc_feature (1)..( 9): Result.003 file - promoters60/4766365
tatcttgaa

SEQ ID NO: 134963 - DNA, 9 bp, Unknown
  misc_feature (1)..( 9): Result.003 file - promoters60/4766365
tgtgttgat

SEQ ID NO: 134964 - DNA, 7 bp, Unknown
  misc_feature (1)..( 7): Result.003 file - promoters60/4766376
gacaaac

SEQ ID NO: 134965 - DNA, 7 bp, Unknown
  misc_feature (1)..( 7): Result.003 file - promoters60/4766376
gacaaaa

SEQ ID NO: 134966 - DNA, 7 bp, Unknown
  misc_feature (1)..( 7): Result.003 file - promoters60/4766376
gacaaaa

SEQ ID NO: 134967 - DNA, 9 bp, Unknown
  misc_feature (1)..( 9): Result.003 file - promoters60/4766395
ctttgtttt

SEQ ID NO: 134968 - DNA, 9 bp, Unknown
  misc_feature (1)..( 9): Result.003 file - promoters60/4766395
atttttttt

SEQ ID NO: 134969 - DNA, 9 bp, Unknown
  misc_feature (1)..( 9): Result.003 file - promoters60/4766395
atatattta

SEQ ID NO: 134970 - DNA, 7 bp, Unknown
  misc_feature (1)..( 7): Result.003 file - promoters60/4766395
gtttttt

SEQ ID NO: 134971 - DNA, 7 bp, Unknown
  misc_feature (1)..( 7): Result.003 file - promoters60/4766395
gttgttt

SEQ ID NO: 134972 - DNA, 8 bp, Unknown
  misc_feature (1)..( 8): Result.003 file - promoters60/4766395
aaaatata

SEQ ID NO: 134973 - DNA, 8 bp, Unknown
  misc_feature (1)..( 8): Result.003 file - promoters60/4766395
aaactata

SEQ ID NO: 134974 - DNA, 6 bp, Unknown
  misc_feature (1)..( 6): Result.003 file - promoters60/4766395
aaagaa

SEQ ID NO: 134975 - DNA, 6 bp, Unknown
  misc_feature (1)..( 6): Result.003 file - promoters60/4766395
aaagaa

SEQ ID NO: 134976 - DNA, 6 bp, Unknown
  misc_feature (1)..( 6): Result.003 file - promoters60/4766395
ttatca

SEQ ID NO: 134977 - DNA, 6 bp, Unknown
  misc_feature (1)..( 6): Result.003 file - promoters60/4766395
ttatca

SEQ ID NO: 134978 - DNA, 6 bp, Unknown
  misc_feature (1)..( 6): Result.003 file - promoters60/4766395
ataaac

SEQ ID NO: 134979 - DNA, 6 bp, Unknown
  misc_feature (1)..( 6): Result.003 file - promoters60/4766395
ataaac

SEQ ID NO: 134980 - DNA, 6 bp, Unknown
  misc_feature (1)..( 6): Result.003 file - promoters60/4766395
cacatg

SEQ ID NO: 134981 - DNA, 6 bp, Unknown
  misc_feature (1)..( 6): Result.003 file - promoters60/4766395
cacatg

SEQ ID NO: 134982 - DNA, 6 bp, Unknown
  misc_feature (1)..( 6): Result.003 file - promoters60/4766395
tctcca

SEQ ID NO: 134983 - DNA, 6 bp, Unknown
  misc_feature (1)..( 6): Result.003 file - promoters60/4766395
tctcca

SEQ ID NO: 134984 - DNA, 8 bp, Unknown
  misc_feature (1)..( 8): Result.003 file - promoters60/4766395
tatacata

SEQ ID NO: 134985 - DNA, 8 bp, Unknown
  misc_feature (1)..( 8): Result.003 file - promoters60/4766395
tataaata

SEQ ID NO: 134986 - DNA, 7 bp, Unknown
  misc_feature (1)..( 7): Result.003 file - promoters60/4766395
ttaaatt

SEQ ID NO: 134987 - DNA, 7 bp, Unknown
  misc_feature (1)..( 7): Result.003 file - promoters60/4766395
ttaaatt

SEQ ID NO: 134988 - DNA, 8 bp, Unknown
  misc_feature (1)..( 8): Result.003 file - promoters60/4766395
aaaataat

SEQ ID NO: 134989 - DNA, 8 bp, Unknown
  misc_feature (1)..( 8): Result.003 file - promoters60/4766395
aaaataat

SEQ ID NO: 134990 - DNA, 6 bp, Unknown
  misc_feature (1)..( 6): Result.003 file - promoters60/4766395
atattt

SEQ ID NO: 134991 - DNA, 6 bp, Unknown
  misc_feature (1)..( 6): Result.003 file - promoters60/4766395
atattt

SEQ ID NO: 134992 - DNA, 6 bp, Unknown
  misc_feature (1)..( 6): Result.003 file - promoters60/4766395
atatat

SEQ ID NO: 134993 - DNA, 6 bp, Unknown
  misc_feature (1)..( 6): Result.003 file - promoters60/4766395
atatat

SEQ ID NO: 134994 - DNA, 6 bp, Unknown
  misc_feature (1)..( 6): Result.003 file - promoters60/4766395
aaatct

SEQ ID NO: 134995 - DNA, 6 bp, Unknown
  misc_feature (1)..( 6): Result.003 file - promoters60/4766395
aaatct

SEQ ID NO: 134996 - DNA, 7 bp, Unknown
  misc_feature (1)..( 7): Result.003 file - promoters60/4766395
aaaaatt

SEQ ID NO: 134997 - DNA, 7 bp, Unknown
  misc_feature (1)..( 7): Result.003 file - promoters60/4766395
aaaaatt

SEQ ID NO: 134998 - DNA, 6 bp, Unknown
  misc_feature (1)..( 6): Result.003 file - promoters60/4766395
aaaaaa

SEQ ID NO: 134999 - DNA, 6 bp, Unknown
  misc_feature (1)..( 6): Result.003 file - promoters60/4766395
aaaaaa

SEQ ID NO: 135000 - DNA, 7 bp, Unknown
  misc_feature (1)..( 7): Result.003 file - promoters60/4766395
aaagtta

SEQ ID NO: 135001 - DNA, 7 bp, Unknown
  misc_feature (1)..( 7): Result.003 file - promoters60/4766395
aaattta

SEQ ID NO: 135002 - DNA, 8 bp, Unknown
  misc_feature (1)..( 8): Result.003 file - promoters60/4766395
aaatttaa

SEQ ID NO: 135003 - DNA, 8 bp, Unknown
  misc_feature (1)..( 8): Result.003 file - promoters60/4766395
aaatgtaa

SEQ ID NO: 135004 - DNA, 6 bp, Unknown
  misc_feature (1)..( 6): Result.003 file - promoters60/4766421
ttaact

SEQ ID NO: 135005 - DNA, 6 bp, Unknown
  misc_feature (1)..( 6): Result.003 file - promoters60/4766421
ttaact

SEQ ID NO: 135006 - DNA, 8 bp, Unknown
  misc_feature (1)..( 8): Result.003 file - promoters60/4766421
ttacaata

SEQ ID NO: 135007 - DNA, 8 bp, Unknown
  misc_feature (1)..( 8): Result.003 file - promoters60/4766421
ttaaaatt

SEQ ID NO: 135008 - DNA, 8 bp, Unknown
  misc_feature (1)..( 8): Result.003 file - promoters60/4766421
tcaaaatt

SEQ ID NO: 135009 - DNA, 7 bp, Unknown
  misc_feature (1)..( 7): Result.003 file - promoters60/4766421
atgtttt

SEQ ID NO: 135010 - DNA, 7 bp, Unknown
  misc_feature (1)..( 7): Result.003 file - promoters60/4766421
atgtttt

SEQ ID NO: 135011 - DNA, 7 bp, Unknown
  misc_feature (1)..( 7): Result.003 file - promoters60/4766421
atgcttt

SEQ ID NO: 135012 - DNA, 8 bp, Unknown
  misc_feature (1)..( 8): Result.003 file - promoters60/4766421
aatcagat

SEQ ID NO: 135013 - DNA, 8 bp, Unknown
  misc_feature (1)..( 8): Result.003 file - promoters60/4766421
aatctgat

SEQ ID NO: 135014 - DNA, 7 bp, Unknown
  misc_feature (1)..( 7): Result.003 file - promoters60/4766421
tggagcc

SEQ ID NO: 135015 - DNA, 7 bp, Unknown
  misc_feature (1)..( 7): Result.003 file - promoters60/4766421
tggggcc

SEQ ID NO: 135016 - DNA, 6 bp, Unknown
  misc_feature (1)..( 6): Result.003 file - promoters60/4766421
tatctg

SEQ ID NO: 135017 - DNA, 6 bp, Unknown
  misc_feature (1)..( 6): Result.003 file - promoters60/4766421
tatctg

SEQ ID NO: 135018 - DNA, 6 bp, Unknown
  misc_feature (1)..( 6): Result.003 file - promoters60/4766421
tagata

SEQ ID NO: 135019 - DNA, 6 bp, Unknown
  misc_feature (1)..( 6): Result.003 file - promoters60/4766421
tagata

SEQ ID NO: 135020 - DNA, 9 bp, Unknown
  misc_feature (1)..( 9): Result.003 file - promoters60/4766421
taatgattc

SEQ ID NO: 135021 - DNA, 9 bp, Unknown
  misc_feature (1)..( 9): Result.003 file - promoters60/4766421
aattgattc

SEQ ID NO: 135022 - DNA, 9 bp, Unknown
  misc_feature (1)..( 9): Result.003 file - promoters60/4766421
aatttattt

SEQ ID NO: 135023 - DNA, 7 bp, Unknown
  misc_feature (1)..( 7): Result.003 file - promoters60/4766421
caatatt

SEQ ID NO: 135024 - DNA, 7 bp, Unknown
  misc_feature (1)..( 7): Result.003 file - promoters60/4766421
caaaatt

SEQ ID NO: 135025 - DNA, 7 bp, Unknown
  misc_feature (1)..( 7): Result.003 file - promoters60/4766421
taaaatt

SEQ ID NO: 135026 - DNA, 10 bp, Unknown
  misc_feature (1)..( 10): Result.003 file - promoters60/4766421
attatccatt

SEQ ID NO: 135027 - DNA, 10 bp, Unknown
  misc_feature (1)..( 10): Result.003 file - promoters60/4766421
attctccatt

SEQ ID NO: 135028 - DNA, 6 bp, Unknown
  misc_feature (1)..( 6): Result.003 file - promoters60/4766421
acagtg

SEQ ID NO: 135029 - DNA, 6 bp, Unknown
  misc_feature (1)..( 6): Result.003 file - promoters60/4766421
acagtg

SEQ ID NO: 135030 - DNA, 6 bp, Unknown
  misc_feature (1)..( 6): Result.003 file - promoters60/4766421
gaactt

SEQ ID NO: 135031 - DNA, 6 bp, Unknown
  misc_feature (1)..( 6): Result.003 file - promoters60/4766421
gaactt

SEQ ID NO: 135032 - DNA, 9 bp, Unknown
  misc_feature (1)..( 9): Result.003 file - promoters60/4766421
gataatttg

SEQ ID NO: 135033 - DNA, 9 bp, Unknown
  misc_feature (1)..( 9): Result.003 file - promoters60/4766421
gatgatttg

SEQ ID NO: 135034 - DNA, 8 bp, Unknown
  misc_feature (1)..( 8): Result.003 file - promoters60/4766421
ttcacaga

SEQ ID NO: 135035 - DNA, 8 bp, Unknown
  misc_feature (1)..( 8): Result.003 file - promoters60/4766421
ttcacaga

SEQ ID NO: 135036 - DNA, 6 bp, Unknown
  misc_feature (1)..( 6): Result.003 file - promoters60/4766421
tcttgt

SEQ ID NO: 135037 - DNA, 6 bp, Unknown
  misc_feature (1)..( 6): Result.003 file - promoters60/4766421
tcttgt

SEQ ID NO: 135038 - DNA, 6 bp, Unknown
  misc_feature (1)..( 6): Result.003 file - promoters60/4766421
gtgtgc

SEQ ID NO: 135039 - DNA, 6 bp, Unknown
  misc_feature (1)..( 6): Result.003 file - promoters60/4766421
gtgtgc

SEQ ID NO: 135040 - DNA, 6 bp, Unknown
  misc_feature (1)..( 6): Result.003 file - promoters60/4766429
ttcaca

SEQ ID NO: 135041 - DNA, 6 bp, Unknown
  misc_feature (1)..( 6): Result.003 file - promoters60/4766429
ttcaca

SEQ ID NO: 135042 - DNA, 6 bp, Unknown
  misc_feature (1)..( 6): Result.003 file - promoters60/4766429
agcttt

SEQ ID NO: 135043 - DNA, 6 bp, Unknown
  misc_feature (1)..( 6): Result.003 file - promoters60/4766429
agcttt

SEQ ID NO: 135044 - DNA, 6 bp, Unknown
  misc_feature (1)..( 6): Result.003 file - promoters60/4766429
ttttca

SEQ ID NO: 135045 - DNA, 6 bp, Unknown
  misc_feature (1)..( 6): Result.003 file - promoters60/4766429
ttttca

SEQ ID NO: 135046 - DNA, 6 bp, Unknown
  misc_feature (1)..( 6): Result.003 file - promoters60/4766429
ttccaa

SEQ ID NO: 135047 - DNA, 6 bp, Unknown
  misc_feature (1)..( 6): Result.003 file - promoters60/4766429
ttccaa

SEQ ID NO: 135048 - DNA, 6 bp, Unknown
  misc_feature (1)..( 6): Result.003 file - promoters60/4766429
aatcat

SEQ ID NO: 135049 - DNA, 6 bp, Unknown
  misc_feature (1)..( 6): Result.003 file - promoters60/4766429
aatcat

SEQ ID NO: 135050 - DNA, 6 bp, Unknown
  misc_feature (1)..( 6): Result.003 file - promoters60/4766429
catttt

SEQ ID NO: 135051 - DNA, 6 bp, Unknown
  misc_feature (1)..( 6): Result.003 file - promoters60/4766429
catttt

SEQ ID NO: 135052 - DNA, 8 bp, Unknown
  misc_feature (1)..( 8): Result.003 file - promoters60/4766429
tttattaa

SEQ ID NO: 135053 - DNA, 8 bp, Unknown
  misc_feature (1)..( 8): Result.003 file - promoters60/4766429
tttcttaa

SEQ ID NO: 135054 - DNA, 7 bp, Unknown
  misc_feature (1)..( 7): Result.003 file - promoters60/4766429
aagaaac

SEQ ID NO: 135055 - DNA, 7 bp, Unknown
  misc_feature (1)..( 7): Result.003 file - promoters60/4766429
aagaaac

SEQ ID NO: 135056 - DNA, 7 bp, Unknown
  misc_feature (1)..( 7): Result.003 file - promoters60/4766429
ctctata

SEQ ID NO: 135057 - DNA, 7 bp, Unknown
  misc_feature (1)..( 7): Result.003 file - promoters60/4766429
ctctata

SEQ ID NO: 135058 - DNA, 9 bp, Unknown
  misc_feature (1)..( 9): Result.003 file - promoters60/4766429
aagaagaaa

SEQ ID NO: 135059 - DNA, 9 bp, Unknown
  misc_feature (1)..( 9): Result.003 file - promoters60/4766429
aagaaaaaa

SEQ ID NO: 135060 - DNA, 7 bp, Unknown
  misc_feature (1)..( 7): Result.003 file - promoters60/4766429
caatctt

SEQ ID NO: 135061 - DNA, 7 bp, Unknown
  misc_feature (1)..( 7): Result.003 file - promoters60/4766429
caaactt

SEQ ID NO: 135062 - DNA, 7 bp, Unknown
  misc_feature (1)..( 7): Result.003 file - promoters60/4766447
catcatt

SEQ ID NO: 135063 - DNA, 7 bp, Unknown
  misc_feature (1)..( 7): Result.003 file - promoters60/4766447
aatcatt

SEQ ID NO: 135064 - DNA, 7 bp, Unknown
  misc_feature (1)..( 7): Result.003 file - promoters60/4766447
aataatt

SEQ ID NO: 135065 - DNA, 9 bp, Unknown
  misc_feature (1)..( 9): Result.003 file - promoters60/4766447
atcttattc

SEQ ID NO: 135066 - DNA, 9 bp, Unknown
  misc_feature (1)..( 9): Result.003 file - promoters60/4766447
atcttaaat

SEQ ID NO: 135067 - DNA, 9 bp, Unknown
  misc_feature (1)..( 9): Result.003 file - promoters60/4766447
ttctaattc

SEQ ID NO: 135068 - DNA, 11 bp, Unknown
  misc_feature (1)..( 11): Result.003 file - promoters60/4766447
tttttggaaac

SEQ ID NO: 135069 - DNA, 11 bp, Unknown
  misc_feature (1)..( 11): Result.003 file - promoters60/4766447
tttatggtttc

SEQ ID NO: 135070 - DNA, 11 bp, Unknown
  misc_feature (1)..( 11): Result.003 file - promoters60/4766447
attagggtttc

SEQ ID NO: 135071 - DNA, 8 bp, Unknown
  misc_feature (1)..( 8): Result.003 file - promoters60/4766447
atgtctaa

SEQ ID NO: 135072 - DNA, 8 bp, Unknown
  misc_feature (1)..( 8): Result.003 file - promoters60/4766447
ttgtataa

SEQ ID NO: 135073 - DNA, 8 bp, Unknown
  misc_feature (1)..( 8): Result.003 file - promoters60/4766447
ttgtatgc

SEQ ID NO: 135074 - DNA, 8 bp, Unknown
  misc_feature (1)..( 8): Result.003 file - promoters60/4766447
tcaatcaa

SEQ ID NO: 135075 - DNA, 8 bp, Unknown
  misc_feature (1)..( 8): Result.003 file - promoters60/4766447
ccaagcaa

SEQ ID NO: 135076 - DNA, 8 bp, Unknown
  misc_feature (1)..( 8): Result.003 file - promoters60/4766447
tcaaacaa

SEQ ID NO: 135077 - DNA, 7 bp, Unknown
  misc_feature (1)..( 7): Result.003 file - promoters60/4766447
tttgttt

SEQ ID NO: 135078 - DNA, 7 bp, Unknown
  misc_feature (1)..( 7): Result.003 file - promoters60/4766447
tttattt

SEQ ID NO: 135079 - DNA, 7 bp, Unknown
  misc_feature (1)..( 7): Result.003 file - promoters60/4766447
attattt

SEQ ID NO: 135080 - DNA, 11 bp, Unknown
  misc_feature (1)..( 11): Result.003 file - promoters60/4766447
attccactttt

SEQ ID NO: 135081 - DNA, 11 bp, Unknown
  misc_feature (1)..( 11): Result.003 file - promoters60/4766447
aatccaatttt

SEQ ID NO: 135082 - DNA, 11 bp, Unknown
  misc_feature (1)..( 11): Result.003 file - promoters60/4766447
aatacaaaaaa

SEQ ID NO: 135083 - DNA, 11 bp, Unknown
  misc_feature (1)..( 11): Result.003 file - promoters60/4766477
atcaataaact

SEQ ID NO: 135084 - DNA, 11 bp, Unknown
  misc_feature (1)..( 11): Result.003 file - promoters60/4766477
gtcaacaaaat

SEQ ID NO: 135085 - DNA, 11 bp, Unknown
  misc_feature (1)..( 11): Result.003 file - promoters60/4766477
acacacaattt

SEQ ID NO: 135086 - DNA, 11 bp, Unknown
  misc_feature (1)..( 11): Result.003 file - promoters60/4766477
gaaaacaaaat

SEQ ID NO: 135087 - DNA, 11 bp, Unknown
  misc_feature (1)..( 11): Result.003 file - promoters60/4766477
aaaaataactg

SEQ ID NO: 135088 - DNA, 11 bp, Unknown
  misc_feature (1)..( 11): Result.003 file - promoters60/4766477
aataacaaata

SEQ ID NO: 135089 - DNA, 10 bp, Unknown
  misc_feature (1)..( 10): Result.003 file - promoters60/4766477
acttcttctc

SEQ ID NO: 135090 - DNA, 10 bp, Unknown
  misc_feature (1)..( 10): Result.003 file - promoters60/4766477
actgcttcgc

SEQ ID NO: 135091 - DNA, 10 bp, Unknown
  misc_feature (1)..( 10): Result.003 file - promoters60/4766477
actgcttgtt

SEQ ID NO: 135092 - DNA, 10 bp, Unknown
  misc_feature (1)..( 10): Result.003 file - promoters60/4766477
gtttcttctc

SEQ ID NO: 135093 - DNA, 10 bp, Unknown
  misc_feature (1)..( 10): Result.003 file - promoters60/4766477
attttttctt

SEQ ID NO: 135094 - DNA, 10 bp, Unknown
  misc_feature (1)..( 10): Result.003 file - promoters60/4766477
tctgattgga

SEQ ID NO: 135095 - DNA, 13 bp, Unknown
  misc_feature (1)..( 13): Result.003 file - promoters60/4766477
caacaatgtacaa

SEQ ID NO: 135096 - DNA, 13 bp, Unknown
  misc_feature (1)..( 13): Result.003 file - promoters60/4766477
caataatttacat

SEQ ID NO: 135097 - DNA, 13 bp, Unknown
  misc_feature (1)..( 13): Result.003 file - promoters60/4766477
ttacaatttacaa

SEQ ID NO: 135098 - DNA, 13 bp, Unknown
  misc_feature (1)..( 13): Result.003 file - promoters60/4766477
taacaatatatat

SEQ ID NO: 135099 - DNA, 13 bp, Unknown
  misc_feature (1)..( 13): Result.003 file - promoters60/4766477
agatattttaaaa

SEQ ID NO: 135100 - DNA, 13 bp, Unknown
  misc_feature (1)..( 13): Result.003 file - promoters60/4766477
taataatggttct

SEQ ID NO: 135101 - DNA, 13 bp, Unknown
  misc_feature (1)..( 13): Result.003 file - promoters60/4766477
tgaaaatttatac

SEQ ID NO: 135102 - DNA, 15 bp, Unknown
  misc_feature (1)..( 15): Result.003 file - promoters60/4766487
tgtcatattcgtcgc

SEQ ID NO: 135103 - DNA, 15 bp, Unknown
  misc_feature (1)..( 15): Result.003 file - promoters60/4766487
gttcaaattcaaaat

SEQ ID NO: 135104 - DNA, 15 bp, Unknown
  misc_feature (1)..( 15): Result.003 file - promoters60/4766487
tgtcacattccatct

SEQ ID NO: 135105 - DNA, 15 bp, Unknown
  misc_feature (1)..( 15): Result.003 file - promoters60/4766487
tgaaaaattcaacaa

SEQ ID NO: 135106 - DNA, 15 bp, Unknown
  misc_feature (1)..( 15): Result.003 file - promoters60/4766487
gtacgacttcgacaa

SEQ ID NO: 135107 - DNA, 9 bp, Unknown
  misc_feature (1)..( 9): Result.003 file - promoters60/4766487
caaagaaac

SEQ ID NO: 135108 - DNA, 9 bp, Unknown
  misc_feature (1)..( 9): Result.003 file - promoters60/4766487
caatgaaat

SEQ ID NO: 135109 - DNA, 9 bp, Unknown
  misc_feature (1)..( 9): Result.003 file - promoters60/4766487
aaaataaaa

SEQ ID NO: 135110 - DNA, 9 bp, Unknown
  misc_feature (1)..( 9): Result.003 file - promoters60/4766487
ataataaaa

SEQ ID NO: 135111 - DNA, 9 bp, Unknown
  misc_feature (1)..( 9): Result.003 file - promoters60/4766487
agaataaaa

SEQ ID NO: 135112 - DNA, 12 bp, Unknown
  misc_feature (1)..( 12): Result.003 file - promoters60/4766487
caaaagcactga

SEQ ID NO: 135113 - DNA, 12 bp, Unknown
  misc_feature (1)..( 12): Result.003 file - promoters60/4766487
aaaaagcaaaaa

SEQ ID NO: 135114 - DNA, 13 bp, Unknown
  misc_feature (1)..( 13): Result.003 file - promoters60/4766487
taagaagaaaaaa

SEQ ID NO: 135115 - DNA, 13 bp, Unknown
  misc_feature (1)..( 13): Result.003 file - promoters60/4766487
gaagaagattgtt

SEQ ID NO: 135116 - DNA, 13 bp, Unknown
  misc_feature (1)..( 13): Result.003 file - promoters60/4766487
catgaagatatat

SEQ ID NO: 135117 - DNA, 7 bp, Unknown
  misc_feature (1)..( 7): Result.003 file - promoters60/4766490
ttttttg

SEQ ID NO: 135118 - DNA, 7 bp, Unknown
  misc_feature (1)..( 7): Result.003 file - promoters60/4766490
tttgttg

SEQ ID NO: 135119 - DNA, 6 bp, Unknown
  misc_feature (1)..( 6): Result.003 file - promoters60/4766490
caaaaa

SEQ ID NO: 135120 - DNA, 6 bp, Unknown
  misc_feature (1)..( 6): Result.003 file - promoters60/4766490
caaaaa

SEQ ID NO: 135121 - DNA, 10 bp, Unknown
  misc_feature (1)..( 10): Result.003 file - promoters60/4766490
tttgaaaaga

SEQ ID NO: 135122 - DNA, 10 bp, Unknown
  misc_feature (1)..( 10): Result.003 file - promoters60/4766490
aaaaaaaaga

SEQ ID NO: 135123 - DNA, 11 bp, Unknown
  misc_feature (1)..( 11): Result.003 file - promoters60/4766490
gaagaaacaga

SEQ ID NO: 135124 - DNA, 8 bp, Unknown
  misc_feature (1)..( 8): Result.003 file - promoters60/4766490
caattatt

SEQ ID NO: 135125 - DNA, 8 bp, Unknown
  misc_feature (1)..( 8): Result.003 file - promoters60/4766490
caactatt

SEQ ID NO: 135126 - DNA, 7 bp, Unknown
  misc_feature (1)..( 7): Result.003 file - promoters60/4766490
ttttatg

SEQ ID NO: 135127 - DNA, 7 bp, Unknown
  misc_feature (1)..( 7): Result.003 file - promoters60/4766490
tttcatg

SEQ ID NO: 135128 - DNA, 6 bp, Unknown
  misc_feature (1)..( 6): Result.003 file - promoters60/4766490
taaaaa

SEQ ID NO: 135129 - DNA, 6 bp, Unknown
  misc_feature (1)..( 6): Result.003 file - promoters60/4766490
taaaaa

SEQ ID NO: 135130 - DNA, 8 bp, Unknown
  misc_feature (1)..( 8): Result.003 file - promoters60/4766490
tcgacatg

SEQ ID NO: 135131 - DNA, 8 bp, Unknown
  misc_feature (1)..( 8): Result.003 file - promoters60/4766490
tcgacatg

SEQ ID NO: 135132 - DNA, 7 bp, Unknown
  misc_feature (1)..( 7): Result.003 file - promoters60/4766490
acgtggt

SEQ ID NO: 135133 - DNA, 7 bp, Unknown
  misc_feature (1)..( 7): Result.003 file - promoters60/4766490
acgtggt

SEQ ID NO: 135134 - DNA, 6 bp, Unknown
  misc_feature (1)..( 6): Result.003 file - promoters60/4766490
ggtgga

SEQ ID NO: 135135 - DNA, 6 bp, Unknown
  misc_feature (1)..( 6): Result.003 file - promoters60/4766490
ggtgga

SEQ ID NO: 135136 - DNA, 6 bp, Unknown
  misc_feature (1)..( 6): Result.003 file - promoters60/4766490
aaagaa

SEQ ID NO: 135137 - DNA, 6 bp, Unknown
  misc_feature (1)..( 6): Result.003 file - promoters60/4766490
aaagaa

SEQ ID NO: 135138 - DNA, 6 bp, Unknown
  misc_feature (1)..( 6): Result.003 file - promoters60/4766490
acaaca

SEQ ID NO: 135139 - DNA, 6 bp, Unknown
  misc_feature (1)..( 6): Result.003 file - promoters60/4766490
acaaca

SEQ ID NO: 135140 - DNA, 12 bp, Unknown
  misc_feature (1)..( 12): Result.003 file - promoters60/4766490
tgaaaagatgaa

SEQ ID NO: 135141 - DNA, 12 bp, Unknown
  misc_feature (1)..( 12): Result.003 file - promoters60/4766490
acacaagaagaa

SEQ ID NO: 135142 - DNA, 12 bp, Unknown
  misc_feature (1)..( 12): Result.003 file - promoters60/4766490
gaaaaaaaagaa

SEQ ID NO: 135143 - DNA, 9 bp, Unknown
  misc_feature (1)..( 9): Result.003 file - promoters60/4766490
atgataaga

SEQ ID NO: 135144 - DNA, 9 bp, Unknown
  misc_feature (1)..( 9): Result.003 file - promoters60/4766490
atgatgaga

SEQ ID NO: 135145 - DNA, 6 bp, Unknown
  misc_feature (1)..( 6): Result.003 file - promoters60/4766490
aataaa

SEQ ID NO: 135146 - DNA, 6 bp, Unknown
  misc_feature (1)..( 6): Result.003 file - promoters60/4766490
aataaa

SEQ ID NO: 135147 - DNA, 6 bp, Unknown
  misc_feature (1)..( 6): Result.003 file - promoters60/4766490
aactag

SEQ ID NO: 135148 - DNA, 6 bp, Unknown
  misc_feature (1)..( 6): Result.003 file - promoters60/4766490
aactag

SEQ ID NO: 135149 - DNA, 7 bp, Unknown
  misc_feature (1)..( 7): Result.003 file - promoters60/4766490
aattttg

SEQ ID NO: 135150 - DNA, 7 bp, Unknown
  misc_feature (1)..( 7): Result.003 file - promoters60/4766490
aatgttg

SEQ ID NO: 135151 - DNA, 8 bp, Unknown
  misc_feature (1)..( 8): Result.003 file - promoters60/4766490
tggtaaag

SEQ ID NO: 135152 - DNA, 8 bp, Unknown
  misc_feature (1)..( 8): Result.003 file - promoters60/4766490
tggcaaag

SEQ ID NO: 135153 - DNA, 7 bp, Unknown
  misc_feature (1)..( 7): Result.003 file - promoters60/4766490
cgttttc

SEQ ID NO: 135154 - DNA, 7 bp, Unknown
  misc_feature (1)..( 7): Result.003 file - promoters60/4766490
cgtcttc

SEQ ID NO: 135155 - DNA, 7 bp, Unknown
  misc_feature (1)..( 7): Result.003 file - promoters60/4766553
catatat

SEQ ID NO: 135156 - DNA, 7 bp, Unknown
  misc_feature (1)..( 7): Result.003 file - promoters60/4766553
catttat

SEQ ID NO: 135157 - DNA, 6 bp, Unknown
  misc_feature (1)..( 6): Result.003 file - promoters60/4766553
tttact

SEQ ID NO: 135158 - DNA, 6 bp, Unknown
  misc_feature (1)..( 6): Result.003 file - promoters60/4766553
tttact

SEQ ID NO: 135159 - DNA, 6 bp, Unknown
  misc_feature (1)..( 6): Result.003 file - promoters60/4766553
tgtttt

SEQ ID NO: 135160 - DNA, 6 bp, Unknown
  misc_feature (1)..( 6): Result.003 file - promoters60/4766553
tgtttt

SEQ ID NO: 135161 - DNA, 8 bp, Unknown
  misc_feature (1)..( 8): Result.003 file - promoters60/4766553
tctgataa

SEQ ID NO: 135162 - DNA, 8 bp, Unknown
  misc_feature (1)..( 8): Result.003 file - promoters60/4766553
tctgataa

SEQ ID NO: 135163 - DNA, 7 bp, Unknown
  misc_feature (1)..( 7): Result.003 file - promoters60/4766553
ttaattt

SEQ ID NO: 135164 - DNA, 7 bp, Unknown
  misc_feature (1)..( 7): Result.003 file - promoters60/4766553
ttaattt

SEQ ID NO: 135165 - DNA, 7 bp, Unknown
  misc_feature (1)..( 7): Result.003 file - promoters60/4766553
gcaggat

SEQ ID NO: 135166 - DNA, 7 bp, Unknown
  misc_feature (1)..( 7): Result.003 file - promoters60/4766553
gcatgat

SEQ ID NO: 135167 - DNA, 8 bp, Unknown
  misc_feature (1)..( 8): Result.003 file - promoters60/4766553
gtagagaa

SEQ ID NO: 135168 - DNA, 8 bp, Unknown
  misc_feature (1)..( 8): Result.003 file - promoters60/4766553
gtagagaa

SEQ ID NO: 135169 - DNA, 6 bp, Unknown
  misc_feature (1)..( 6): Result.003 file - promoters60/4766553
agaaga

SEQ ID NO: 135170 - DNA, 6 bp, Unknown
  misc_feature (1)..( 6): Result.003 file - promoters60/4766553
agaaga

SEQ ID NO: 135171 - DNA, 6 bp, Unknown
  misc_feature (1)..( 6): Result.003 file - promoters60/4766553
gtgatt

SEQ ID NO: 135172 - DNA, 6 bp, Unknown
  misc_feature (1)..( 6): Result.003 file - promoters60/4766553
gtgatt

SEQ ID NO: 135173 - DNA, 13 bp, Unknown
  misc_feature (1)..( 13): Result.003 file - promoters60/4766578
gtttcaatattgg

SEQ ID NO: 135174 - DNA, 13 bp, Unknown
  misc_feature (1)..( 13): Result.003 file - promoters60/4766578
attttaattttgg

SEQ ID NO: 135175 - DNA, 13 bp, Unknown
  misc_feature (1)..( 13): Result.003 file - promoters60/4766578
tttttgattaatg

SEQ ID NO: 135176 - DNA, 14 bp, Unknown
  misc_feature (1)..( 14): Result.003 file - promoters60/4766578
tttcttgaattatc

SEQ ID NO: 135177 - DNA, 7 bp, Unknown
  misc_feature (1)..( 7): Result.003 file - promoters60/4766578
ataatta

SEQ ID NO: 135178 - DNA, 7 bp, Unknown
  misc_feature (1)..( 7): Result.003 file - promoters60/4766578
atactta

SEQ ID NO: 135179 - DNA, 7 bp, Unknown
  misc_feature (1)..( 7): Result.003 file - promoters60/4766578
gtaatta

SEQ ID NO: 135180 - DNA, 7 bp, Unknown
  misc_feature (1)..( 7): Result.003 file - promoters60/4766578
atattta

SEQ ID NO: 135181 - DNA, 7 bp, Unknown
  misc_feature (1)..( 7): Result.003 file - promoters60/4766578
gtaatta

SEQ ID NO: 135182 - DNA, 11 bp, Unknown
  misc_feature (1)..( 11): Result.003 file - promoters60/4766578
ttattttatag

SEQ ID NO: 135183 - DNA, 11 bp, Unknown
  misc_feature (1)..( 11): Result.003 file - promoters60/4766578
acattttatag

SEQ ID NO: 135184 - DNA, 11 bp, Unknown
  misc_feature (1)..( 11): Result.003 file - promoters60/4766578
tgattttagac

SEQ ID NO: 135185 - DNA, 11 bp, Unknown
  misc_feature (1)..( 11): Result.003 file - promoters60/4766578
acattttgaag

SEQ ID NO: 135186 - DNA, 10 bp, Unknown
  misc_feature (1)..( 10): Result.003 file - promoters60/4766578
taaaataaag

SEQ ID NO: 135187 - DNA, 10 bp, Unknown
  misc_feature (1)..( 10): Result.003 file - promoters60/4766578
caaaaaaaaa

SEQ ID NO: 135188 - DNA, 10 bp, Unknown
  misc_feature (1)..( 10): Result.003 file - promoters60/4766578
taaaataaaa

SEQ ID NO: 135189 - DNA, 11 bp, Unknown
  misc_feature (1)..( 11): Result.003 file - promoters60/4766578
accaatgaaat

SEQ ID NO: 135190 - DNA, 7 bp, Unknown
  misc_feature (1)..( 7): Result.003 file - promoters60/4766578
gaaaaaa

SEQ ID NO: 135191 - DNA, 7 bp, Unknown
  misc_feature (1)..( 7): Result.003 file - promoters60/4766578
gaaaaaa

SEQ ID NO: 135192 - DNA, 7 bp, Unknown
  misc_feature (1)..( 7): Result.003 file - promoters60/4766578
taaaaaa

SEQ ID NO: 135193 - DNA, 7 bp, Unknown
  misc_feature (1)..( 7): Result.003 file - promoters60/4766578
ataaaaa

SEQ ID NO: 135194 - DNA, 7 bp, Unknown
  misc_feature (1)..( 7): Result.003 file - promoters60/4766602
ccctaac

SEQ ID NO: 135195 - DNA, 7 bp, Unknown
  misc_feature (1)..( 7): Result.003 file - promoters60/4766602
ccctaac

SEQ ID NO: 135196 - DNA, 9 bp, Unknown
  misc_feature (1)..( 9): Result.003 file - promoters60/4766602
actatatat

SEQ ID NO: 135197 - DNA, 9 bp, Unknown
  misc_feature (1)..( 9): Result.003 file - promoters60/4766602
actatataa

SEQ ID NO: 135198 - DNA, 9 bp, Unknown
  misc_feature (1)..( 9): Result.003 file - promoters60/4766602
ctaatataa

SEQ ID NO: 135199 - DNA, 9 bp, Unknown
  misc_feature (1)..( 9): Result.003 file - promoters60/4766602
aggaaaaaa

SEQ ID NO: 135200 - DNA, 9 bp, Unknown
  misc_feature (1)..( 9): Result.003 file - promoters60/4766602
aggacaaaa

SEQ ID NO: 135201 - DNA, 8 bp, Unknown
  misc_feature (1)..( 8): Result.003 file - promoters60/4766602
tgtaaaac

SEQ ID NO: 135202 - DNA, 8 bp, Unknown
  misc_feature (1)..( 8): Result.003 file - promoters60/4766602
tgtataac

SEQ ID NO: 135203 - DNA, 6 bp, Unknown
  misc_feature (1)..( 6): Result.003 file - promoters60/4766602
attgat

SEQ ID NO: 135204 - DNA, 6 bp, Unknown
  misc_feature (1)..( 6): Result.003 file - promoters60/4766602
attgat

SEQ ID NO: 135205 - DNA, 6 bp, Unknown
  misc_feature (1)..( 6): Result.003 file - promoters60/4766602
attcat

SEQ ID NO: 135206 - DNA, 6 bp, Unknown
  misc_feature (1)..( 6): Result.003 file - promoters60/4766602
attcat

SEQ ID NO: 135207 - DNA, 6 bp, Unknown
  misc_feature (1)..( 6): Result.003 file - promoters60/4766602
atataa

SEQ ID NO: 135208 - DNA, 6 bp, Unknown
  misc_feature (1)..( 6): Result.003 file - promoters60/4766602
atataa

SEQ ID NO: 135209 - DNA, 8 bp, Unknown
  misc_feature (1)..( 8): Result.003 file - promoters60/4766602
tggcaata

SEQ ID NO: 135210 - DNA, 8 bp, Unknown
  misc_feature (1)..( 8): Result.003 file - promoters60/4766602
tggaaata

SEQ ID NO: 135211 - DNA, 7 bp, Unknown
  misc_feature (1)..( 7): Result.003 file - promoters60/4766602
taatttg

SEQ ID NO: 135212 - DNA, 7 bp, Unknown
  misc_feature (1)..( 7): Result.003 file - promoters60/4766602
taatttg

SEQ ID NO: 135213 - DNA, 6 bp, Unknown
  misc_feature (1)..( 6): Result.003 file - promoters60/4766602
aatcaa

SEQ ID NO: 135214 - DNA, 6 bp, Unknown
  misc_feature (1)..( 6): Result.003 file - promoters60/4766602
aatcaa

SEQ ID NO: 135215 - DNA, 8 bp, Unknown
  misc_feature (1)..( 8): Result.003 file - promoters60/4766602
cattttta

SEQ ID NO: 135216 - DNA, 8 bp, Unknown
  misc_feature (1)..( 8): Result.003 file - promoters60/4766602
catttttt

SEQ ID NO: 135217 - DNA, 8 bp, Unknown
  misc_feature (1)..( 8): Result.003 file - promoters60/4766602
tttttttt

SEQ ID NO: 135218 - DNA, 8 bp, Unknown
  misc_feature (1)..( 8): Result.003 file - promoters60/4766602
attgtaag

SEQ ID NO: 135219 - DNA, 8 bp, Unknown
  misc_feature (1)..( 8): Result.003 file - promoters60/4766602
attttaaa

SEQ ID NO: 135220 - DNA, 8 bp, Unknown
  misc_feature (1)..( 8): Result.003 file - promoters60/4766602
cgtttaaa

SEQ ID NO: 135221 - DNA, 8 bp, Unknown
  misc_feature (1)..( 8): Result.003 file - promoters60/4766602
gtagttaa

SEQ ID NO: 135222 - DNA, 8 bp, Unknown
  misc_feature (1)..( 8): Result.003 file - promoters60/4766602
gtatttaa

SEQ ID NO: 135223 - DNA, 6 bp, Unknown
  misc_feature (1)..( 6): Result.003 file - promoters60/4766602
ttttta

SEQ ID NO: 135224 - DNA, 6 bp, Unknown
  misc_feature (1)..( 6): Result.003 file - promoters60/4766602
ttttta

SEQ ID NO: 135225 - DNA, 6 bp, Unknown
  misc_feature (1)..( 6): Result.003 file - promoters60/4766602
aacgta

SEQ ID NO: 135226 - DNA, 6 bp, Unknown
  misc_feature (1)..( 6): Result.003 file - promoters60/4766602
aacgta

SEQ ID NO: 135227 - DNA, 6 bp, Unknown
  misc_feature (1)..( 6): Result.003 file - promoters60/4766602
atttag

SEQ ID NO: 135228 - DNA, 6 bp, Unknown
  misc_feature (1)..( 6): Result.003 file - promoters60/4766602
atttag

SEQ ID NO: 135229 - DNA, 7 bp, Unknown
  misc_feature (1)..( 7): Result.003 file - promoters60/4766602
atccaaa

SEQ ID NO: 135230 - DNA, 7 bp, Unknown
  misc_feature (1)..( 7): Result.003 file - promoters60/4766602
atcgaaa

SEQ ID NO: 135231 - DNA, 11 bp, Unknown
  misc_feature (1)..( 11): Result.003 file - promoters60/4766620
tttgaatcaaa

SEQ ID NO: 135232 - DNA, 11 bp, Unknown
  misc_feature (1)..( 11): Result.003 file - promoters60/4766620
tttgcatcaaa

SEQ ID NO: 135233 - DNA, 6 bp, Unknown
  misc_feature (1)..( 6): Result.003 file - promoters60/4766620
attttg

SEQ ID NO: 135234 - DNA, 6 bp, Unknown
  misc_feature (1)..( 6): Result.003 file - promoters60/4766620
attttg

SEQ ID NO: 135235 - DNA, 7 bp, Unknown
  misc_feature (1)..( 7): Result.003 file - promoters60/4766620
taaaaat

SEQ ID NO: 135236 - DNA, 7 bp, Unknown
  misc_feature (1)..( 7): Result.003 file - promoters60/4766620
taaaaat

SEQ ID NO: 135237 - DNA, 8 bp, Unknown
  misc_feature (1)..( 8): Result.003 file - promoters60/4766620
atttcggc

SEQ ID NO: 135238 - DNA, 8 bp, Unknown
  misc_feature (1)..( 8): Result.003 file - promoters60/4766620
atttgggc

SEQ ID NO: 135239 - DNA, 7 bp, Unknown
  misc_feature (1)..( 7): Result.003 file - promoters60/4766620
aactgaa

SEQ ID NO: 135240 - DNA, 7 bp, Unknown
  misc_feature (1)..( 7): Result.003 file - promoters60/4766620
aactgaa

SEQ ID NO: 135241 - DNA, 7 bp, Unknown
  misc_feature (1)..( 7): Result.003 file - promoters60/4766620
tttggtg

SEQ ID NO: 135242 - DNA, 7 bp, Unknown
  misc_feature (1)..( 7): Result.003 file - promoters60/4766620
ttttgtg

SEQ ID NO: 135243 - DNA, 7 bp, Unknown
  misc_feature (1)..( 7): Result.003 file - promoters60/4766620
gtttatc

SEQ ID NO: 135244 - DNA, 7 bp, Unknown
  misc_feature (1)..( 7): Result.003 file - promoters60/4766620
gtttatc

SEQ ID NO: 135245 - DNA, 7 bp, Unknown
  misc_feature (1)..( 7): Result.003 file - promoters60/4766620
atcgtac

SEQ ID NO: 135246 - DNA, 7 bp, Unknown
  misc_feature (1)..( 7): Result.003 file - promoters60/4766620
atcttac

SEQ ID NO: 135247 - DNA, 6 bp, Unknown
  misc_feature (1)..( 6): Result.003 file - promoters60/4766620
ataaat

SEQ ID NO: 135248 - DNA, 6 bp, Unknown
  misc_feature (1)..( 6): Result.003 file - promoters60/4766620
ataaat

SEQ ID NO: 135249 - DNA, 7 bp, Unknown
  misc_feature (1)..( 7): Result.003 file - promoters60/4766620
ggtacaa

SEQ ID NO: 135250 - DNA, 7 bp, Unknown
  misc_feature (1)..( 7): Result.003 file - promoters60/4766620
ggttcaa

SEQ ID NO: 135251 - DNA, 8 bp, Unknown
  misc_feature (1)..( 8): Result.003 file - promoters60/4766620
cagtggat

SEQ ID NO: 135252 - DNA, 8 bp, Unknown
  misc_feature (1)..( 8): Result.003 file - promoters60/4766620
cagttgat

SEQ ID NO: 135253 - DNA, 6 bp, Unknown
  misc_feature (1)..( 6): Result.003 file - promoters60/4766620
aaattc

SEQ ID NO: 135254 - DNA, 6 bp, Unknown
  misc_feature (1)..( 6): Result.003 file - promoters60/4766620
aaattc

SEQ ID NO: 135255 - DNA, 7 bp, Unknown
  misc_feature (1)..( 7): Result.003 file - promoters60/4766620
aaatgac

SEQ ID NO: 135256 - DNA, 7 bp, Unknown
  misc_feature (1)..( 7): Result.003 file - promoters60/4766620
aaaggac

SEQ ID NO: 135257 - DNA, 6 bp, Unknown
  misc_feature (1)..( 6): Result.003 file - promoters60/4766620
taattt

SEQ ID NO: 135258 - DNA, 6 bp, Unknown
  misc_feature (1)..( 6): Result.003 file - promoters60/4766620
taattt

SEQ ID NO: 135259 - DNA, 10 bp, Unknown
  misc_feature (1)..( 10): Result.003 file - promoters60/4766624
ggaaatattt

SEQ ID NO: 135260 - DNA, 10 bp, Unknown
  misc_feature (1)..( 10): Result.003 file - promoters60/4766624
ggagatagag

SEQ ID NO: 135261 - DNA, 10 bp, Unknown
  misc_feature (1)..( 10): Result.003 file - promoters60/4766624
tgagaaagag

SEQ ID NO: 135262 - DNA, 10 bp, Unknown
  misc_feature (1)..( 10): Result.003 file - promoters60/4766624
ttctgtgata

SEQ ID NO: 135263 - DNA, 10 bp, Unknown
  misc_feature (1)..( 10): Result.003 file - promoters60/4766624
acctgagatt

SEQ ID NO: 135264 - DNA, 10 bp, Unknown
  misc_feature (1)..( 10): Result.003 file - promoters60/4766624
ctttgaaatt

SEQ ID NO: 135265 - DNA, 10 bp, Unknown
  misc_feature (1)..( 10): Result.003 file - promoters60/4766624
accggagaga

SEQ ID NO: 135266 - DNA, 10 bp, Unknown
  misc_feature (1)..( 10): Result.003 file - promoters60/4766624
tcaaatctat

SEQ ID NO: 135267 - DNA, 10 bp, Unknown
  misc_feature (1)..( 10): Result.003 file - promoters60/4766624
tcaactctat

SEQ ID NO: 135268 - DNA, 10 bp, Unknown
  misc_feature (1)..( 10): Result.003 file - promoters60/4766624
tcacctctaa

SEQ ID NO: 135269 - DNA, 8 bp, Unknown
  misc_feature (1)..( 8): Result.003 file - promoters60/4766624
gaacatga

SEQ ID NO: 135270 - DNA, 8 bp, Unknown
  misc_feature (1)..( 8): Result.003 file - promoters60/4766624
gaacattt

SEQ ID NO: 135271 - DNA, 8 bp, Unknown
  misc_feature (1)..( 8): Result.003 file - promoters60/4766624
caacgttt

SEQ ID NO: 135272 - DNA, 7 bp, Unknown
  misc_feature (1)..( 7): Result.003 file - promoters60/4766628
ctcctca

SEQ ID NO: 135273 - DNA, 7 bp, Unknown
  misc_feature (1)..( 7): Result.003 file - promoters60/4766628
ctcatca

SEQ ID NO: 135274 - DNA, 7 bp, Unknown
  misc_feature (1)..( 7): Result.003 file - promoters60/4766628
tatggaa

SEQ ID NO: 135275 - DNA, 7 bp, Unknown
  misc_feature (1)..( 7): Result.003 file - promoters60/4766628
tatcgaa

SEQ ID NO: 135276 - DNA, 6 bp, Unknown
  misc_feature (1)..( 6): Result.003 file - promoters60/4766628
agttga

SEQ ID NO: 135277 - DNA, 6 bp, Unknown
  misc_feature (1)..( 6): Result.003 file - promoters60/4766628
agttga

SEQ ID NO: 135278 - DNA, 8 bp, Unknown
  misc_feature (1)..( 8): Result.003 file - promoters60/4766628
caaaaaaa

SEQ ID NO: 135279 - DNA, 8 bp, Unknown
  misc_feature (1)..( 8): Result.003 file - promoters60/4766628
caaagaaa

SEQ ID NO: 135280 - DNA, 8 bp, Unknown
  misc_feature (1)..( 8): Result.003 file - promoters60/4766628
gtttcgtt

SEQ ID NO: 135281 - DNA, 8 bp, Unknown
  misc_feature (1)..( 8): Result.003 file - promoters60/4766628
gtttcgtt

SEQ ID NO: 135282 - DNA, 6 bp, Unknown
  misc_feature (1)..( 6): Result.003 file - promoters60/4766628
ccgact

SEQ ID NO: 135283 - DNA, 6 bp, Unknown
  misc_feature (1)..( 6): Result.003 file - promoters60/4766628
ccgact

SEQ ID NO: 135284 - DNA, 7 bp, Unknown
  misc_feature (1)..( 7): Result.003 file - promoters60/4766628
tatcttg

SEQ ID NO: 135285 - DNA, 7 bp, Unknown
  misc_feature (1)..( 7): Result.003 file - promoters60/4766628
tattttg

SEQ ID NO: 135286 - DNA, 7 bp, Unknown
  misc_feature (1)..( 7): Result.003 file - promoters60/4766628
aactaac

SEQ ID NO: 135287 - DNA, 7 bp, Unknown
  misc_feature (1)..( 7): Result.003 file - promoters60/4766628
aaccaac

SEQ ID NO: 135288 - DNA, 7 bp, Unknown
  misc_feature (1)..( 7): Result.003 file - promoters60/4766628
ttttcaa

SEQ ID NO: 135289 - DNA, 7 bp, Unknown
  misc_feature (1)..( 7): Result.003 file - promoters60/4766628
ttttcaa

SEQ ID NO: 135290 - DNA, 7 bp, Unknown
  misc_feature (1)..( 7): Result.003 file - promoters60/4766628
tttgtta

SEQ ID NO: 135291 - DNA, 7 bp, Unknown
  misc_feature (1)..( 7): Result.003 file - promoters60/4766628
tttatta

SEQ ID NO: 135292 - DNA, 7 bp, Unknown
  misc_feature (1)..( 7): Result.003 file - promoters60/4766628
tccccaa

SEQ ID NO: 135293 - DNA, 7 bp, Unknown
  misc_feature (1)..( 7): Result.003 file - promoters60/4766628
tccccaa

SEQ ID NO: 135294 - DNA, 6 bp, Unknown
  misc_feature (1)..( 6): Result.003 file - promoters60/4766628
cggaag

SEQ ID NO: 135295 - DNA, 6 bp, Unknown
  misc_feature (1)..( 6): Result.003 file - promoters60/4766628
cggaag

SEQ ID NO: 135296 - DNA, 9 bp, Unknown
  misc_feature (1)..( 9): Result.003 file - promoters60/4766628
tcatctttt

SEQ ID NO: 135297 - DNA, 9 bp, Unknown
  misc_feature (1)..( 9): Result.003 file - promoters60/4766628
tcatatttt

SEQ ID NO: 135298 - DNA, 6 bp, Unknown
  misc_feature (1)..( 6): Result.003 file - promoters60/4766654
tcttat

SEQ ID NO: 135299 - DNA, 6 bp, Unknown
  misc_feature (1)..( 6): Result.003 file - promoters60/4766654
tcttat

SEQ ID NO: 135300 - DNA, 7 bp, Unknown
  misc_feature (1)..( 7): Result.003 file - promoters60/4766654
gataaac

SEQ ID NO: 135301 - DNA, 7 bp, Unknown
  misc_feature (1)..( 7): Result.003 file - promoters60/4766654
gataaaa

SEQ ID NO: 135302 - DNA, 8 bp, Unknown
  misc_feature (1)..( 8): Result.003 file - promoters60/4766654
aatagaaa

SEQ ID NO: 135303 - DNA, 7 bp, Unknown
  misc_feature (1)..( 7): Result.003 file - promoters60/4766654
ttacttt

SEQ ID NO: 135304 - DNA, 7 bp, Unknown
  misc_feature (1)..( 7): Result.003 file - promoters60/4766654
ttatttt

SEQ ID NO: 135305 - DNA, 7 bp, Unknown
  misc_feature (1)..( 7): Result.003 file - promoters60/4766654
tttatat

SEQ ID NO: 135306 - DNA, 7 bp, Unknown
  misc_feature (1)..( 7): Result.003 file - promoters60/4766654
tttatat

SEQ ID NO: 135307 - DNA, 7 bp, Unknown
  misc_feature (1)..( 7): Result.003 file - promoters60/4766654
tttgtat

SEQ ID NO: 135308 - DNA, 7 bp, Unknown
  misc_feature (1)..( 7): Result.003 file - promoters60/4766654
ataatta

SEQ ID NO: 135309 - DNA, 7 bp, Unknown
  misc_feature (1)..( 7): Result.003 file - promoters60/4766654
atagtta

SEQ ID NO: 135310 - DNA, 8 bp, Unknown
  misc_feature (1)..( 8): Result.003 file - promoters60/4766654
gtttataa

SEQ ID NO: 135311 - DNA, 8 bp, Unknown
  misc_feature (1)..( 8): Result.003 file - promoters60/4766654
gttgataa

SEQ ID NO: 135312 - DNA, 8 bp, Unknown
  misc_feature (1)..( 8): Result.003 file - promoters60/4766654
ctttctaa

SEQ ID NO: 135313 - DNA, 8 bp, Unknown
  misc_feature (1)..( 8): Result.003 file - promoters60/4766654
aacactat

SEQ ID NO: 135314 - DNA, 8 bp, Unknown
  misc_feature (1)..( 8): Result.003 file - promoters60/4766654
aacacttt

SEQ ID NO: 135315 - DNA, 8 bp, Unknown
  misc_feature (1)..( 8): Result.003 file - promoters60/4766654
tacaattt

SEQ ID NO: 135316 - DNA, 6 bp, Unknown
  misc_feature (1)..( 6): Result.003 file - promoters60/4766654
aatcta

SEQ ID NO: 135317 - DNA, 6 bp, Unknown
  misc_feature (1)..( 6): Result.003 file - promoters60/4766654
aatcta

SEQ ID NO: 135318 - DNA, 6 bp, Unknown
  misc_feature (1)..( 6): Result.003 file - promoters60/4766654
tatata

SEQ ID NO: 135319 - DNA, 6 bp, Unknown
  misc_feature (1)..( 6): Result.003 file - promoters60/4766654
tatata

SEQ ID NO: 135320 - DNA, 6 bp, Unknown
  misc_feature (1)..( 6): Result.003 file - promoters60/4766654
ataaat

SEQ ID NO: 135321 - DNA, 6 bp, Unknown
  misc_feature (1)..( 6): Result.003 file - promoters60/4766654
ataaat

SEQ ID NO: 135322 - DNA, 6 bp, Unknown
  misc_feature (1)..( 6): Result.003 file - promoters60/4766654
ttgaat

SEQ ID NO: 135323 - DNA, 6 bp, Unknown
  misc_feature (1)..( 6): Result.003 file - promoters60/4766654
ttgaat

SEQ ID NO: 135324 - DNA, 6 bp, Unknown
  misc_feature (1)..( 6): Result.003 file - promoters60/4766654
aatcac

SEQ ID NO: 135325 - DNA, 6 bp, Unknown
  misc_feature (1)..( 6): Result.003 file - promoters60/4766654
aatcac

SEQ ID NO: 135326 - DNA, 7 bp, Unknown
  misc_feature (1)..( 7): Result.003 file - promoters60/4766654
tatactc

SEQ ID NO: 135327 - DNA, 7 bp, Unknown
  misc_feature (1)..( 7): Result.003 file - promoters60/4766654
tattctc

SEQ ID NO: 135328 - DNA, 8 bp, Unknown
  misc_feature (1)..( 8): Result.003 file - promoters60/4766654
agcattgc

SEQ ID NO: 135329 - DNA, 8 bp, Unknown
  misc_feature (1)..( 8): Result.003 file - promoters60/4766654
agctttgc

SEQ ID NO: 135330 - DNA, 6 bp, Unknown
  misc_feature (1)..( 6): Result.003 file - promoters60/4766654
acttgt

SEQ ID NO: 135331 - DNA, 6 bp, Unknown
  misc_feature (1)..( 6): Result.003 file - promoters60/4766654
acttgt

SEQ ID NO: 135332 - DNA, 9 bp, Unknown
  misc_feature (1)..( 9): Result.003 file - promoters60/4766654
aatgaacac

SEQ ID NO: 135333 - DNA, 9 bp, Unknown
  misc_feature (1)..( 9): Result.003 file - promoters60/4766654
aataaacac

SEQ ID NO: 135334 - DNA, 6 bp, Unknown
  misc_feature (1)..( 6): Result.003 file - promoters60/4766654
attcga

SEQ ID NO: 135335 - DNA, 6 bp, Unknown
  misc_feature (1)..( 6): Result.003 file - promoters60/4766654
attcga

SEQ ID NO: 135336 - DNA, 7 bp, Unknown
  misc_feature (1)..( 7): Result.003 file - promoters60/4766654
atataat

SEQ ID NO: 135337 - DNA, 7 bp, Unknown
  misc_feature (1)..( 7): Result.003 file - promoters60/4766654
atacaat

SEQ ID NO: 135338 - DNA, 7 bp, Unknown
  misc_feature (1)..( 7): Result.003 file - promoters60/4766654
acacaaa

SEQ ID NO: 135339 - DNA, 7 bp, Unknown
  misc_feature (1)..( 7): Result.003 file - promoters60/4766654
acaaaaa

SEQ ID NO: 135340 - DNA, 8 bp, Unknown
  misc_feature (1)..( 8): Result.003 file - promoters60/4766712
gtttcttc

SEQ ID NO: 135341 - DNA, 8 bp, Unknown
  misc_feature (1)..( 8): Result.003 file - promoters60/4766712
aattcttc

SEQ ID NO: 135342 - DNA, 8 bp, Unknown
  misc_feature (1)..( 8): Result.003 file - promoters60/4766712
ttttcttt

SEQ ID NO: 135343 - DNA, 8 bp, Unknown
  misc_feature (1)..( 8): Result.003 file - promoters60/4766712
ttttctgg

SEQ ID NO: 135344 - DNA, 8 bp, Unknown
  misc_feature (1)..( 8): Result.003 file - promoters60/4766712
atttattt

SEQ ID NO: 135345 - DNA, 8 bp, Unknown
  misc_feature (1)..( 8): Result.003 file - promoters60/4766712
ttttctag

SEQ ID NO: 135346 - DNA, 6 bp, Unknown
  misc_feature (1)..( 6): Result.003 file - promoters60/4766727
taacca

SEQ ID NO: 135347 - DNA, 6 bp, Unknown
  misc_feature (1)..( 6): Result.003 file - promoters60/4766727
taacca

SEQ ID NO: 135348 - DNA, 11 bp, Unknown
  misc_feature (1)..( 11): Result.003 file - promoters60/4766727
aaattacttac

SEQ ID NO: 135349 - DNA, 11 bp, Unknown
  misc_feature (1)..( 11): Result.003 file - promoters60/4766727
atattactata

SEQ ID NO: 135350 - DNA, 11 bp, Unknown
  misc_feature (1)..( 11): Result.003 file - promoters60/4766727
atagtacaata

SEQ ID NO: 135351 - DNA, 9 bp, Unknown
  misc_feature (1)..( 9): Result.003 file - promoters60/4766727
actaatgat

SEQ ID NO: 135352 - DNA, 9 bp, Unknown
  misc_feature (1)..( 9): Result.003 file - promoters60/4766727
tataatgat

SEQ ID NO: 135353 - DNA, 9 bp, Unknown
  misc_feature (1)..( 9): Result.003 file - promoters60/4766727
aataattac

SEQ ID NO: 135354 - DNA, 7 bp, Unknown
  misc_feature (1)..( 7): Result.003 file - promoters60/4766727
ggtttaa

SEQ ID NO: 135355 - DNA, 7 bp, Unknown
  misc_feature (1)..( 7): Result.003 file - promoters60/4766727
ggtttaa

SEQ ID NO: 135356 - DNA, 7 bp, Unknown
  misc_feature (1)..( 7): Result.003 file - promoters60/4766727
tttcttt

SEQ ID NO: 135357 - DNA, 7 bp, Unknown
  misc_feature (1)..( 7): Result.003 file - promoters60/4766727
ttttttt

SEQ ID NO: 135358 - DNA, 7 bp, Unknown
  misc_feature (1)..( 7): Result.003 file - promoters60/4766727
ccatttt

SEQ ID NO: 135359 - DNA, 7 bp, Unknown
  misc_feature (1)..( 7): Result.003 file - promoters60/4766727
ccatttt

SEQ ID NO: 135360 - DNA, 6 bp, Unknown
  misc_feature (1)..( 6): Result.003 file - promoters60/4766727
acataa

SEQ ID NO: 135361 - DNA, 6 bp, Unknown
  misc_feature (1)..( 6): Result.003 file - promoters60/4766727
acataa

SEQ ID NO: 135362 - DNA, 10 bp, Unknown
  misc_feature (1)..( 10): Result.003 file - promoters60/4766727
acatacatta

SEQ ID NO: 135363 - DNA, 10 bp, Unknown
  misc_feature (1)..( 10): Result.003 file - promoters60/4766727
atataaatta

SEQ ID NO: 135364 - DNA, 10 bp, Unknown
  misc_feature (1)..( 10): Result.003 file - promoters60/4766727
atatgaatca

SEQ ID NO: 135365 - DNA, 7 bp, Unknown
  misc_feature (1)..( 7): Result.003 file - promoters60/4766727
atattat

SEQ ID NO: 135366 - DNA, 7 bp, Unknown
  misc_feature (1)..( 7): Result.003 file - promoters60/4766727
atattat

SEQ ID NO: 135367 - DNA, 11 bp, Unknown
  misc_feature (1)..( 11): Result.003 file - promoters60/4766727
tagattttttt

SEQ ID NO: 135368 - DNA, 11 bp, Unknown
  misc_feature (1)..( 11): Result.003 file - promoters60/4766727
tagattttttt

SEQ ID NO: 135369 - DNA, 6 bp, Unknown
  misc_feature (1)..( 6): Result.003 file - promoters60/4766727
taaaaa

SEQ ID NO: 135370 - DNA, 6 bp, Unknown
  misc_feature (1)..( 6): Result.003 file - promoters60/4766727
taaaaa

SEQ ID NO: 135371 - DNA, 6 bp, Unknown
  misc_feature (1)..( 6): Result.003 file - promoters60/4766727
aaaaca

SEQ ID NO: 135372 - DNA, 6 bp, Unknown
  misc_feature (1)..( 6): Result.003 file - promoters60/4766727
aaaaca

SEQ ID NO: 135373 - DNA, 11 bp, Unknown
  misc_feature (1)..( 11): Result.003 file - promoters60/4766727
aaatggcccaa

SEQ ID NO: 135374 - DNA, 11 bp, Unknown
  misc_feature (1)..( 11): Result.003 file - promoters60/4766727
aaaaggcccaa

SEQ ID NO: 135375 - DNA, 6 bp, Unknown
  misc_feature (1)..( 6): Result.003 file - promoters60/4766727
atcaaa

SEQ ID NO: 135376 - DNA, 6 bp, Unknown
  misc_feature (1)..( 6): Result.003 file - promoters60/4766727
atcaaa

SEQ ID NO: 135377 - DNA, 6 bp, Unknown
  misc_feature (1)..( 6): Result.003 file - promoters60/4766727
tacaac

SEQ ID NO: 135378 - DNA, 6 bp, Unknown
  misc_feature (1)..( 6): Result.003 file - promoters60/4766727
tacaac

SEQ ID NO: 135379 - DNA, 7 bp, Unknown
  misc_feature (1)..( 7): Result.003 file - promoters60/4766727
taatatc

SEQ ID NO: 135380 - DNA, 7 bp, Unknown
  misc_feature (1)..( 7): Result.003 file - promoters60/4766727
taacatc

SEQ ID NO: 135381 - DNA, 8 bp, Unknown
  misc_feature (1)..( 8): Result.003 file - promoters60/4766727
atagcaca

SEQ ID NO: 135382 - DNA, 8 bp, Unknown
  misc_feature (1)..( 8): Result.003 file - promoters60/4766727
atagtaca

SEQ ID NO: 135383 - DNA, 8 bp, Unknown
  misc_feature (1)..( 8): Result.003 file - promoters60/4766727
atcaaata

SEQ ID NO: 135384 - DNA, 8 bp, Unknown
  misc_feature (1)..( 8): Result.003 file - promoters60/4766727
atcagata

SEQ ID NO: 135385 - DNA, 6 bp, Unknown
  misc_feature (1)..( 6): Result.003 file - promoters60/4766727
taaaaa

SEQ ID NO: 135386 - DNA, 6 bp, Unknown
  misc_feature (1)..( 6): Result.003 file - promoters60/4766727
taaaaa

SEQ ID NO: 135387 - DNA, 7 bp, Unknown
  misc_feature (1)..( 7): Result.003 file - promoters60/4766727
aaaatat

SEQ ID NO: 135388 - DNA, 7 bp, Unknown
  misc_feature (1)..( 7): Result.003 file - promoters60/4766727
aaaatat

SEQ ID NO: 135389 - DNA, 7 bp, Unknown
  misc_feature (1)..( 7): Result.003 file - promoters60/4766727
aaagaag

SEQ ID NO: 135390 - DNA, 7 bp, Unknown
  misc_feature (1)..( 7): Result.003 file - promoters60/4766727
aaaaaag

SEQ ID NO: 135391 - DNA, 8 bp, Unknown
  misc_feature (1)..( 8): Result.003 file - promoters60/4766727
aaatatag

SEQ ID NO: 135392 - DNA, 8 bp, Unknown
  misc_feature (1)..( 8): Result.003 file - promoters60/4766727
aaacatag

SEQ ID NO: 135393 - DNA, 10 bp, Unknown
  misc_feature (1)..( 10): Result.003 file - promoters60/4766738
aatactaaaa

SEQ ID NO: 135394 - DNA, 10 bp, Unknown
  misc_feature (1)..( 10): Result.003 file - promoters60/4766738
aatattaaga

SEQ ID NO: 135395 - DNA, 10 bp, Unknown
  misc_feature (1)..( 10): Result.003 file - promoters60/4766738
gatagtaaaa

SEQ ID NO: 135396 - DNA, 6 bp, Unknown
  misc_feature (1)..( 6): Result.003 file - promoters60/4766738
aagaat

SEQ ID NO: 135397 - DNA, 6 bp, Unknown
  misc_feature (1)..( 6): Result.003 file - promoters60/4766738
aagaat

SEQ ID NO: 135398 - DNA, 6 bp, Unknown
  misc_feature (1)..( 6): Result.003 file - promoters60/4766738
cttttt

SEQ ID NO: 135399 - DNA, 6 bp, Unknown
  misc_feature (1)..( 6): Result.003 file - promoters60/4766738
cttttt

SEQ ID NO: 135400 - DNA, 6 bp, Unknown
  misc_feature (1)..( 6): Result.003 file - promoters60/4766738
ttagta

SEQ ID NO: 135401 - DNA, 6 bp, Unknown
  misc_feature (1)..( 6): Result.003 file - promoters60/4766738
ttagta

SEQ ID NO: 135402 - DNA, 6 bp, Unknown
  misc_feature (1)..( 6): Result.003 file - promoters60/4766738
ggttga

SEQ ID NO: 135403 - DNA, 6 bp, Unknown
  misc_feature (1)..( 6): Result.003 file - promoters60/4766738
ggttga

SEQ ID NO: 135404 - DNA, 7 bp, Unknown
  misc_feature (1)..( 7): Result.003 file - promoters60/4766738
aaacgaa

SEQ ID NO: 135405 - DNA, 7 bp, Unknown
  misc_feature (1)..( 7): Result.003 file - promoters60/4766738
aaaagaa

SEQ ID NO: 135406 - DNA, 10 bp, Unknown
  misc_feature (1)..( 10): Result.003 file - promoters60/4766738
agaaaagaag

SEQ ID NO: 135407 - DNA, 10 bp, Unknown
  misc_feature (1)..( 10): Result.003 file - promoters60/4766738
agaaaaaaag

SEQ ID NO: 135408 - DNA, 8 bp, Unknown
  misc_feature (1)..( 8): Result.003 file - promoters60/4766738
ttattgtc

SEQ ID NO: 135409 - DNA, 8 bp, Unknown
  misc_feature (1)..( 8): Result.003 file - promoters60/4766738
ttaatgtc

SEQ ID NO: 135410 - DNA, 6 bp, Unknown
  misc_feature (1)..( 6): Result.003 file - promoters60/4766738
gtttcc

SEQ ID NO: 135411 - DNA, 6 bp, Unknown
  misc_feature (1)..( 6): Result.003 file - promoters60/4766738
gtttcc

SEQ ID NO: 135412 - DNA, 7 bp, Unknown
  misc_feature (1)..( 7): Result.003 file - promoters60/4766738
catcact

SEQ ID NO: 135413 - DNA, 7 bp, Unknown
  misc_feature (1)..( 7): Result.003 file - promoters60/4766738
cattact

SEQ ID NO: 135414 - DNA, 6 bp, Unknown
  misc_feature (1)..( 6): Result.003 file - promoters60/4766738
tattct

SEQ ID NO: 135415 - DNA, 6 bp, Unknown
  misc_feature (1)..( 6): Result.003 file - promoters60/4766738
tattct

SEQ ID NO: 135416 - DNA, 7 bp, Unknown
  misc_feature (1)..( 7): Result.003 file - promoters60/4766738
cttatct

SEQ ID NO: 135417 - DNA, 7 bp, Unknown
  misc_feature (1)..( 7): Result.003 file - promoters60/4766738
cttgtct

SEQ ID NO: 135418 - DNA, 6 bp, Unknown
  misc_feature (1)..( 6): Result.003 file - promoters60/4766738
tctgaa

SEQ ID NO: 135419 - DNA, 6 bp, Unknown
  misc_feature (1)..( 6): Result.003 file - promoters60/4766738
tctgaa

SEQ ID NO: 135420 - DNA, 7 bp, Unknown
  misc_feature (1)..( 7): Result.003 file - promoters60/4766738
tatcatt

SEQ ID NO: 135421 - DNA, 7 bp, Unknown
  misc_feature (1)..( 7): Result.003 file - promoters60/4766738
tatgatt

SEQ ID NO: 135422 - DNA, 7 bp, Unknown
  misc_feature (1)..( 7): Result.003 file - promoters60/4766738
gaatttg

SEQ ID NO: 135423 - DNA, 7 bp, Unknown
  misc_feature (1)..( 7): Result.003 file - promoters60/4766738
gaatttg

SEQ ID NO: 135424 - DNA, 7 bp, Unknown
  misc_feature (1)..( 7): Result.003 file - promoters60/4766738
tttgatt

SEQ ID NO: 135425 - DNA, 7 bp, Unknown
  misc_feature (1)..( 7): Result.003 file - promoters60/4766738
tttgatt

SEQ ID NO: 135426 - DNA, 7 bp, Unknown
  misc_feature (1)..( 7): Result.003 file - promoters60/4766738
ttagatc

SEQ ID NO: 135427 - DNA, 7 bp, Unknown
  misc_feature (1)..( 7): Result.003 file - promoters60/4766738
ttatatc

SEQ ID NO: 135428 - DNA, 6 bp, Unknown
  misc_feature (1)..( 6): Result.003 file - promoters60/4766738
catttg

SEQ ID NO: 135429 - DNA, 6 bp, Unknown
  misc_feature (1)..( 6): Result.003 file - promoters60/4766738
catttg

SEQ ID NO: 135430 - DNA, 8 bp, Unknown
  misc_feature (1)..( 8): Result.003 file - promoters60/4766754
attatatg

SEQ ID NO: 135431 - DNA, 8 bp, Unknown
  misc_feature (1)..( 8): Result.003 file - promoters60/4766754
attacatg

SEQ ID NO: 135432 - DNA, 6 bp, Unknown
  misc_feature (1)..( 6): Result.003 file - promoters60/4766754
gacatt

SEQ ID NO: 135433 - DNA, 6 bp, Unknown
  misc_feature (1)..( 6): Result.003 file - promoters60/4766754
gacatt

SEQ ID NO: 135434 - DNA, 7 bp, Unknown
  misc_feature (1)..( 7): Result.003 file - promoters60/4766754
atatttt

SEQ ID NO: 135435 - DNA, 7 bp, Unknown
  misc_feature (1)..( 7): Result.003 file - promoters60/4766754
atatttt

SEQ ID NO: 135436 - DNA, 6 bp, Unknown
  misc_feature (1)..( 6): Result.003 file - promoters60/4766754
ataaat

SEQ ID NO: 135437 - DNA, 6 bp, Unknown
  misc_feature (1)..( 6): Result.003 file - promoters60/4766754
ataaat

SEQ ID NO: 135438 - DNA, 16 bp, Unknown
  misc_feature (1)..( 16): Result.003 file - promoters60/4766754
tgttaatttttttttg

SEQ ID NO: 135439 - DNA, 16 bp, Unknown
  misc_feature (1)..( 16): Result.003 file - promoters60/4766754
tgtttatttatttttg

SEQ ID NO: 135440 - DNA, 6 bp, Unknown
  misc_feature (1)..( 6): Result.003 file - promoters60/4766754
ccaaaa

SEQ ID NO: 135441 - DNA, 6 bp, Unknown
  misc_feature (1)..( 6): Result.003 file - promoters60/4766754
ccaaaa

SEQ ID NO: 135442 - DNA, 8 bp, Unknown
  misc_feature (1)..( 8): Result.003 file - promoters60/4766754
agtataaa

SEQ ID NO: 135443 - DNA, 8 bp, Unknown
  misc_feature (1)..( 8): Result.003 file - promoters60/4766754
agtatata

SEQ ID NO: 135444 - DNA, 8 bp, Unknown
  misc_feature (1)..( 8): Result.003 file - promoters60/4766754
tgtatata

SEQ ID NO: 135445 - DNA, 6 bp, Unknown
  misc_feature (1)..( 6): Result.003 file - promoters60/4766754
tataaa

SEQ ID NO: 135446 - DNA, 6 bp, Unknown
  misc_feature (1)..( 6): Result.003 file - promoters60/4766754
tataaa

SEQ ID NO: 135447 - DNA, 7 bp, Unknown
  misc_feature (1)..( 7): Result.003 file - promoters60/4766754
tggctaa

SEQ ID NO: 135448 - DNA, 7 bp, Unknown
  misc_feature (1)..( 7): Result.003 file - promoters60/4766754
tggataa

SEQ ID NO: 135449 - DNA, 7 bp, Unknown
  misc_feature (1)..( 7): Result.003 file - promoters60/4766754
ggtgttg

SEQ ID NO: 135450 - DNA, 7 bp, Unknown
  misc_feature (1)..( 7): Result.003 file - promoters60/4766754
ggttttg

SEQ ID NO: 135451 - DNA, 7 bp, Unknown
  misc_feature (1)..( 7): Result.003 file - promoters60/4766754
aattaat

SEQ ID NO: 135452 - DNA, 7 bp, Unknown
  misc_feature (1)..( 7): Result.003 file - promoters60/4766754
aattaat

SEQ ID NO: 135453 - DNA, 8 bp, Unknown
  misc_feature (1)..( 8): Result.003 file - promoters60/4766754
ttttttgg

SEQ ID NO: 135454 - DNA, 8 bp, Unknown
  misc_feature (1)..( 8): Result.003 file - promoters60/4766754
tttgttgg

SEQ ID NO: 135455 - DNA, 7 bp, Unknown
  misc_feature (1)..( 7): Result.003 file - promoters60/4766754
tcgaatt

SEQ ID NO: 135456 - DNA, 7 bp, Unknown
  misc_feature (1)..( 7): Result.003 file - promoters60/4766754
tcgtatt

SEQ ID NO: 135457 - DNA, 6 bp, Unknown
  misc_feature (1)..( 6): Result.003 file - promoters60/4766754
agtaaa

SEQ ID NO: 135458 - DNA, 6 bp, Unknown
  misc_feature (1)..( 6): Result.003 file - promoters60/4766754
agtaaa

SEQ ID NO: 135459 - DNA, 7 bp, Unknown
  misc_feature (1)..( 7): Result.003 file - promoters60/4766754
aatcggg

SEQ ID NO: 135460 - DNA, 7 bp, Unknown
  misc_feature (1)..( 7): Result.003 file - promoters60/4766754
aattggg

SEQ ID NO: 135461 - DNA, 8 bp, Unknown
  misc_feature (1)..( 8): Result.003 file - promoters60/4766754
gaaagaaa

SEQ ID NO: 135462 - DNA, 8 bp, Unknown
  misc_feature (1)..( 8): Result.003 file - promoters60/4766754
gaaacaaa

SEQ ID NO: 135463 - DNA, 10 bp, Unknown
  misc_feature (1)..( 10): Result.003 file - promoters60/4766754
ggaaaagaaa

SEQ ID NO: 135464 - DNA, 10 bp, Unknown
  misc_feature (1)..( 10): Result.003 file - promoters60/4766754
ggaaatgaaa

SEQ ID NO: 135465 - DNA, 7 bp, Unknown
  misc_feature (1)..( 7): Result.003 file - promoters60/4766754
cccacta

SEQ ID NO: 135466 - DNA, 7 bp, Unknown
  misc_feature (1)..( 7): Result.003 file - promoters60/4766754
cccacta

SEQ ID NO: 135467 - DNA, 9 bp, Unknown
  misc_feature (1)..( 9): Result.003 file - promoters60/4766754
aaagaaaag

SEQ ID NO: 135468 - DNA, 9 bp, Unknown
  misc_feature (1)..( 9): Result.003 file - promoters60/4766754
aaagtaaag

SEQ ID NO: 135469 - DNA, 9 bp, Unknown
  misc_feature (1)..( 9): Result.003 file - promoters60/4766776
aaaaatgaa

SEQ ID NO: 135470 - DNA, 9 bp, Unknown
  misc_feature (1)..( 9): Result.003 file - promoters60/4766776
aaaaaagaa

SEQ ID NO: 135471 - DNA, 6 bp, Unknown
  misc_feature (1)..( 6): Result.003 file - promoters60/4766776
gtgtaa

SEQ ID NO: 135472 - DNA, 6 bp, Unknown
  misc_feature (1)..( 6): Result.003 file - promoters60/4766776
gtgtaa

SEQ ID NO: 135473 - DNA, 7 bp, Unknown
  misc_feature (1)..( 7): Result.003 file - promoters60/4766776
gaagaaa

SEQ ID NO: 135474 - DNA, 7 bp, Unknown
  misc_feature (1)..( 7): Result.003 file - promoters60/4766776
gaagaaa

SEQ ID NO: 135475 - DNA, 8 bp, Unknown
  misc_feature (1)..( 8): Result.003 file - promoters60/4766776
ttttatca

SEQ ID NO: 135476 - DNA, 8 bp, Unknown
  misc_feature (1)..( 8): Result.003 file - promoters60/4766776
ttttgtca

SEQ ID NO: 135477 - DNA, 9 bp, Unknown
  misc_feature (1)..( 9): Result.003 file - promoters60/4766776
atatatatc

SEQ ID NO: 135478 - DNA, 9 bp, Unknown
  misc_feature (1)..( 9): Result.003 file - promoters60/4766776
atatttatt

SEQ ID NO: 135479 - DNA, 9 bp, Unknown
  misc_feature (1)..( 9): Result.003 file - promoters60/4766776
ctatgtatc

SEQ ID NO: 135480 - DNA, 6 bp, Unknown
  misc_feature (1)..( 6): Result.003 file - promoters60/4766776
aaatat

SEQ ID NO: 135481 - DNA, 6 bp, Unknown
  misc_feature (1)..( 6): Result.003 file - promoters60/4766776
aaatat

SEQ ID NO: 135482 - DNA, 6 bp, Unknown
  misc_feature (1)..( 6): Result.003 file - promoters60/4766776
aaatat

SEQ ID NO: 135483 - DNA, 8 bp, Unknown
  misc_feature (1)..( 8): Result.003 file - promoters60/4766776
atatatac

SEQ ID NO: 135484 - DNA, 8 bp, Unknown
  misc_feature (1)..( 8): Result.003 file - promoters60/4766776
atatgtac

SEQ ID NO: 135485 - DNA, 8 bp, Unknown
  misc_feature (1)..( 8): Result.003 file - promoters60/4766776
aaatcaat

SEQ ID NO: 135486 - DNA, 8 bp, Unknown
  misc_feature (1)..( 8): Result.003 file - promoters60/4766776
aaaacaac

SEQ ID NO: 135487 - DNA, 8 bp, Unknown
  misc_feature (1)..( 8): Result.003 file - promoters60/4766776
aaattaat

SEQ ID NO: 135488 - DNA, 7 bp, Unknown
  misc_feature (1)..( 7): Result.003 file - promoters60/4766776
aatcaaa

SEQ ID NO: 135489 - DNA, 7 bp, Unknown
  misc_feature (1)..( 7): Result.003 file - promoters60/4766776
aatcaaa

SEQ ID NO: 135490 - DNA, 7 bp, Unknown
  misc_feature (1)..( 7): Result.003 file - promoters60/4766776
attcaat

SEQ ID NO: 135491 - DNA, 7 bp, Unknown
  misc_feature (1)..( 7): Result.003 file - promoters60/4766776
attaaat

SEQ ID NO: 135492 - DNA, 7 bp, Unknown
  misc_feature (1)..( 7): Result.003 file - promoters60/4766776
acacgta

SEQ ID NO: 135493 - DNA, 7 bp, Unknown
  misc_feature (1)..( 7): Result.003 file - promoters60/4766776
acacgta

SEQ ID NO: 135494 - DNA, 7 bp, Unknown
  misc_feature (1)..( 7): Result.003 file - promoters60/4766776
tttttat

SEQ ID NO: 135495 - DNA, 7 bp, Unknown
  misc_feature (1)..( 7): Result.003 file - promoters60/4766776
tttatat

SEQ ID NO: 135496 - DNA, 12 bp, Unknown
  misc_feature (1)..( 12): Result.003 file - promoters60/4766776
atcttaagatat

SEQ ID NO: 135497 - DNA, 12 bp, Unknown
  misc_feature (1)..( 12): Result.003 file - promoters60/4766776
atcttaaaatat

SEQ ID NO: 135498 - DNA, 12 bp, Unknown
  misc_feature (1)..( 12): Result.003 file - promoters60/4766776
cgccaaaaatat

SEQ ID NO: 135499 - DNA, 7 bp, Unknown
  misc_feature (1)..( 7): Result.003 file - promoters60/4766776
ataataa

SEQ ID NO: 135500 - DNA, 7 bp, Unknown
  misc_feature (1)..( 7): Result.003 file - promoters60/4766776
atattaa

SEQ ID NO: 135501 - DNA, 7 bp, Unknown
  misc_feature (1)..( 7): Result.003 file - promoters60/4766776
aaatata

SEQ ID NO: 135502 - DNA, 7 bp, Unknown
  misc_feature (1)..( 7): Result.003 file - promoters60/4766776
aaaaata

SEQ ID NO: 135503 - DNA, 6 bp, Unknown
  misc_feature (1)..( 6): Result.003 file - promoters60/4766776
agacac

SEQ ID NO: 135504 - DNA, 6 bp, Unknown
  misc_feature (1)..( 6): Result.003 file - promoters60/4766776
agacac

SEQ ID NO: 135505 - DNA, 7 bp, Unknown
  misc_feature (1)..( 7): Result.003 file - promoters60/4766776
tccatct

SEQ ID NO: 135506 - DNA, 7 bp, Unknown
  misc_feature (1)..( 7): Result.003 file - promoters60/4766776
tccctct

SEQ ID NO: 135507 - DNA, 7 bp, Unknown
  misc_feature (1)..( 7): Result.003 file - promoters60/4766776
tctaacc

SEQ ID NO: 135508 - DNA, 7 bp, Unknown
  misc_feature (1)..( 7): Result.003 file - promoters60/4766776
tctcacc

SEQ ID NO: 135509 - DNA, 6 bp, Unknown
  misc_feature (1)..( 6): Result.003 file - promoters60/4766776
aaataa

SEQ ID NO: 135510 - DNA, 6 bp, Unknown
  misc_feature (1)..( 6): Result.003 file - promoters60/4766776
aaataa

SEQ ID NO: 135511 - DNA, 6 bp, Unknown
  misc_feature (1)..( 6): Result.003 file - promoters60/4766776
aattca

SEQ ID NO: 135512 - DNA, 6 bp, Unknown
  misc_feature (1)..( 6): Result.003 file - promoters60/4766776
aattca

SEQ ID NO: 135513 - DNA, 10 bp, Unknown
  misc_feature (1)..( 10): Result.003 file - promoters60/4766776
aaaatcttta

SEQ ID NO: 135514 - DNA, 10 bp, Unknown
  misc_feature (1)..( 10): Result.003 file - promoters60/4766776
aaattcttta

SEQ ID NO: 135515 - DNA, 10 bp, Unknown
  misc_feature (1)..( 10): Result.003 file - promoters60/4766784
acaagatttg

SEQ ID NO: 135516 - DNA, 10 bp, Unknown
  misc_feature (1)..( 10): Result.003 file - promoters60/4766784
acaagttttt

SEQ ID NO: 135517 - DNA, 10 bp, Unknown
  misc_feature (1)..( 10): Result.003 file - promoters60/4766784
cctagaattg

SEQ ID NO: 135518 - DNA, 6 bp, Unknown
  misc_feature (1)..( 6): Result.003 file - promoters60/4766784
tccata

SEQ ID NO: 135519 - DNA, 6 bp, Unknown
  misc_feature (1)..( 6): Result.003 file - promoters60/4766784
tccata

SEQ ID NO: 135520 - DNA, 7 bp, Unknown
  misc_feature (1)..( 7): Result.003 file - promoters60/4766784
atcaaga

SEQ ID NO: 135521 - DNA, 7 bp, Unknown
  misc_feature (1)..( 7): Result.003 file - promoters60/4766784
atcgaga

SEQ ID NO: 135522 - DNA, 6 bp, Unknown
  misc_feature (1)..( 6): Result.003 file - promoters60/4766784
ctgaaa

SEQ ID NO: 135523 - DNA, 6 bp, Unknown
  misc_feature (1)..( 6): Result.003 file - promoters60/4766784
ctgaaa

SEQ ID NO: 135524 - DNA, 7 bp, Unknown
  misc_feature (1)..( 7): Result.003 file - promoters60/4766784
ccagatt

SEQ ID NO: 135525 - DNA, 7 bp, Unknown
  misc_feature (1)..( 7): Result.003 file - promoters60/4766784
ccacatt

SEQ ID NO: 135526 - DNA, 6 bp, Unknown
  misc_feature (1)..( 6): Result.003 file - promoters60/4766784
attaat

SEQ ID NO: 135527 - DNA, 6 bp, Unknown
  misc_feature (1)..( 6): Result.003 file - promoters60/4766784
attaat

SEQ ID NO: 135528 - DNA, 6 bp, Unknown
  misc_feature (1)..( 6): Result.003 file - promoters60/4766784
ttaatt

SEQ ID NO: 135529 - DNA, 6 bp, Unknown
  misc_feature (1)..( 6): Result.003 file - promoters60/4766784
ttaatt

SEQ ID NO: 135530 - DNA, 6 bp, Unknown
  misc_feature (1)..( 6): Result.003 file - promoters60/4766784
tttgac

SEQ ID NO: 135531 - DNA, 6 bp, Unknown
  misc_feature (1)..( 6): Result.003 file - promoters60/4766784
tttgac

SEQ ID NO: 135532 - DNA, 6 bp, Unknown
  misc_feature (1)..( 6): Result.003 file - promoters60/4766784
caaaaa

SEQ ID NO: 135533 - DNA, 6 bp, Unknown
  misc_feature (1)..( 6): Result.003 file - promoters60/4766784
caaaaa

SEQ ID NO: 135534 - DNA, 6 bp, Unknown
  misc_feature (1)..( 6): Result.003 file - promoters60/4766784
ttttta

SEQ ID NO: 135535 - DNA, 6 bp, Unknown
  misc_feature (1)..( 6): Result.003 file - promoters60/4766784
ttttta

SEQ ID NO: 135536 - DNA, 10 bp, Unknown
  misc_feature (1)..( 10): Result.003 file - promoters60/4766784
tatattatta

SEQ ID NO: 135537 - DNA, 10 bp, Unknown
  misc_feature (1)..( 10): Result.003 file - promoters60/4766784
tatattctta

SEQ ID NO: 135538 - DNA, 7 bp, Unknown
  misc_feature (1)..( 7): Result.003 file - promoters60/4766784
aaaataa

SEQ ID NO: 135539 - DNA, 7 bp, Unknown
  misc_feature (1)..( 7): Result.003 file - promoters60/4766784
aaattaa

SEQ ID NO: 135540 - DNA, 7 bp, Unknown
  misc_feature (1)..( 7): Result.003 file - promoters60/4766784
tgttaaa

SEQ ID NO: 135541 - DNA, 7 bp, Unknown
  misc_feature (1)..( 7): Result.003 file - promoters60/4766784
tgttaaa

SEQ ID NO: 135542 - DNA, 7 bp, Unknown
  misc_feature (1)..( 7): Result.003 file - promoters60/4766784
aatataa

SEQ ID NO: 135543 - DNA, 7 bp, Unknown
  misc_feature (1)..( 7): Result.003 file - promoters60/4766784
aatgtaa

SEQ ID NO: 135544 - DNA, 6 bp, Unknown
  misc_feature (1)..( 6): Result.003 file - promoters60/4766784
ataaaa

SEQ ID NO: 135545 - DNA, 6 bp, Unknown
  misc_feature (1)..( 6): Result.003 file - promoters60/4766784
ataaaa

SEQ ID NO: 135546 - DNA, 6 bp, Unknown
  misc_feature (1)..( 6): Result.003 file - promoters60/4766816
gattta

SEQ ID NO: 135547 - DNA, 6 bp, Unknown
  misc_feature (1)..( 6): Result.003 file - promoters60/4766816
gattta

SEQ ID NO: 135548 - DNA, 7 bp, Unknown
  misc_feature (1)..( 7): Result.003 file - promoters60/4766816
aaaatat

SEQ ID NO: 135549 - DNA, 7 bp, Unknown
  misc_feature (1)..( 7): Result.003 file - promoters60/4766816
aaaatat

SEQ ID NO: 135550 - DNA, 7 bp, Unknown
  misc_feature (1)..( 7): Result.003 file - promoters60/4766816
tatacaa

SEQ ID NO: 135551 - DNA, 7 bp, Unknown
  misc_feature (1)..( 7): Result.003 file - promoters60/4766816
tatgcaa

SEQ ID NO: 135552 - DNA, 7 bp, Unknown
  misc_feature (1)..( 7): Result.003 file - promoters60/4766816
tatattt

SEQ ID NO: 135553 - DNA, 7 bp, Unknown
  misc_feature (1)..( 7): Result.003 file - promoters60/4766816
tatattt

SEQ ID NO: 135554 - DNA, 6 bp, Unknown
  misc_feature (1)..( 6): Result.003 file - promoters60/4766816
tatact

SEQ ID NO: 135555 - DNA, 6 bp, Unknown
  misc_feature (1)..( 6): Result.003 file - promoters60/4766816
tatact

SEQ ID NO: 135556 - DNA, 7 bp, Unknown
  misc_feature (1)..( 7): Result.003 file - promoters60/4766816
tttttaa

SEQ ID NO: 135557 - DNA, 7 bp, Unknown
  misc_feature (1)..( 7): Result.003 file - promoters60/4766816
tttttaa

SEQ ID NO: 135558 - DNA, 7 bp, Unknown
  misc_feature (1)..( 7): Result.003 file - promoters60/4766816
taatttt

SEQ ID NO: 135559 - DNA, 7 bp, Unknown
  misc_feature (1)..( 7): Result.003 file - promoters60/4766816
taatttt

SEQ ID NO: 135560 - DNA, 9 bp, Unknown
  misc_feature (1)..( 9): Result.003 file - promoters60/4766816
ttttaataa

SEQ ID NO: 135561 - DNA, 9 bp, Unknown
  misc_feature (1)..( 9): Result.003 file - promoters60/4766816
tttttataa

SEQ ID NO: 135562 - DNA, 6 bp, Unknown
  misc_feature (1)..( 6): Result.003 file - promoters60/4766816
aaaact

SEQ ID NO: 135563 - DNA, 6 bp, Unknown
  misc_feature (1)..( 6): Result.003 file - promoters60/4766816
aaaact

SEQ ID NO: 135564 - DNA, 6 bp, Unknown
  misc_feature (1)..( 6): Result.003 file - promoters60/4766816
aataaa

SEQ ID NO: 135565 - DNA, 6 bp, Unknown
  misc_feature (1)..( 6): Result.003 file - promoters60/4766816
aataaa

SEQ ID NO: 135566 - DNA, 6 bp, Unknown
  misc_feature (1)..( 6): Result.003 file - promoters60/4766816
tctctc

SEQ ID NO: 135567 - DNA, 6 bp, Unknown
  misc_feature (1)..( 6): Result.003 file - promoters60/4766816
tctctc

SEQ ID NO: 135568 - DNA, 9 bp, Unknown
  misc_feature (1)..( 9): Result.003 file - promoters60/4766816
taaatttgg

SEQ ID NO: 135569 - DNA, 9 bp, Unknown
  misc_feature (1)..( 9): Result.003 file - promoters60/4766816
caaatatgg

SEQ ID NO: 135570 - DNA, 9 bp, Unknown
  misc_feature (1)..( 9): Result.003 file - promoters60/4766816
caaatatgc

SEQ ID NO: 135571 - DNA, 7 bp, Unknown
  misc_feature (1)..( 7): Result.003 file - promoters60/4766816
tatattt

SEQ ID NO: 135572 - DNA, 7 bp, Unknown
  misc_feature (1)..( 7): Result.003 file - promoters60/4766816
tatattt

SEQ ID NO: 135573 - DNA, 7 bp, Unknown
  misc_feature (1)..( 7): Result.003 file - promoters60/4766816
agtactt

SEQ ID NO: 135574 - DNA, 7 bp, Unknown
  misc_feature (1)..( 7): Result.003 file - promoters60/4766816
agtactt

SEQ ID NO: 135575 - DNA, 11 bp, Unknown
  misc_feature (1)..( 11): Result.003 file - promoters60/4766826
aaacaaatttt

SEQ ID NO: 135576 - DNA, 11 bp, Unknown
  misc_feature (1)..( 11): Result.003 file - promoters60/4766826
aaaccaatttt

SEQ ID NO: 135577 - DNA, 11 bp, Unknown
  misc_feature (1)..( 11): Result.003 file - promoters60/4766826
catcaaattag

SEQ ID NO: 135578 - DNA, 11 bp, Unknown
  misc_feature (1)..( 11): Result.003 file - promoters60/4766826
attcaaacctt

SEQ ID NO: 135579 - DNA, 8 bp, Unknown
  misc_feature (1)..( 8): Result.003 file - promoters60/4766835
cggttcaa

SEQ ID NO: 135580 - DNA, 8 bp, Unknown
  misc_feature (1)..( 8): Result.003 file - promoters60/4766835
aagttcaa

SEQ ID NO: 135581 - DNA, 8 bp, Unknown
  misc_feature (1)..( 8): Result.003 file - promoters60/4766835
aaggtcag

SEQ ID NO: 135582 - DNA, 7 bp, Unknown
  misc_feature (1)..( 7): Result.003 file - promoters60/4766835
atccaaa

SEQ ID NO: 135583 - DNA, 7 bp, Unknown
  misc_feature (1)..( 7): Result.003 file - promoters60/4766835
atcaaaa

SEQ ID NO: 135584 - DNA, 7 bp, Unknown
  misc_feature (1)..( 7): Result.003 file - promoters60/4766835
atctaaa

SEQ ID NO: 135585 - DNA, 8 bp, Unknown
  misc_feature (1)..( 8): Result.003 file - promoters60/4766835
aaacaaaa

SEQ ID NO: 135586 - DNA, 8 bp, Unknown
  misc_feature (1)..( 8): Result.003 file - promoters60/4766835
aaacaact

SEQ ID NO: 135587 - DNA, 8 bp, Unknown
  misc_feature (1)..( 8): Result.003 file - promoters60/4766835
aaagaaaa

SEQ ID NO: 135588 - DNA, 8 bp, Unknown
  misc_feature (1)..( 8): Result.003 file - promoters60/4766835
ttaaaatt

SEQ ID NO: 135589 - DNA, 8 bp, Unknown
  misc_feature (1)..( 8): Result.003 file - promoters60/4766835
ataaaatg

SEQ ID NO: 135590 - DNA, 8 bp, Unknown
  misc_feature (1)..( 8): Result.003 file - promoters60/4766835
agaaaaaa

SEQ ID NO: 135591 - DNA, 8 bp, Unknown
  misc_feature (1)..( 8): Result.003 file - promoters60/4766835
taaatgta

SEQ ID NO: 135592 - DNA, 8 bp, Unknown
  misc_feature (1)..( 8): Result.003 file - promoters60/4766835
aaaaagta

SEQ ID NO: 135593 - DNA, 8 bp, Unknown
  misc_feature (1)..( 8): Result.003 file - promoters60/4766835
aaaaagaa

SEQ ID NO: 135594 - DNA, 10 bp, Unknown
  misc_feature (1)..( 10): Result.003 file - promoters60/4766835
aaataattga

SEQ ID NO: 135595 - DNA, 10 bp, Unknown
  misc_feature (1)..( 10): Result.003 file - promoters60/4766835
aaaaaatgtt

SEQ ID NO: 135596 - DNA, 10 bp, Unknown
  misc_feature (1)..( 10): Result.003 file - promoters60/4766835
aaataaatga

SEQ ID NO: 135597 - DNA, 7 bp, Unknown
  misc_feature (1)..( 7): Result.003 file - promoters60/4766835
ttaattc

SEQ ID NO: 135598 - DNA, 7 bp, Unknown
  misc_feature (1)..( 7): Result.003 file - promoters60/4766835
ttaattt

SEQ ID NO: 135599 - DNA, 7 bp, Unknown
  misc_feature (1)..( 7): Result.003 file - promoters60/4766835
taaattt

SEQ ID NO: 135600 - DNA, 8 bp, Unknown
  misc_feature (1)..( 8): Result.003 file - promoters60/4766835
cattaaat

SEQ ID NO: 135601 - DNA, 8 bp, Unknown
  misc_feature (1)..( 8): Result.003 file - promoters60/4766835
cataaaaa

SEQ ID NO: 135602 - DNA, 8 bp, Unknown
  misc_feature (1)..( 8): Result.003 file - promoters60/4766835
gctaaaaa

SEQ ID NO: 135603 - DNA, 8 bp, Unknown
  misc_feature (1)..( 8): Result.003 file - promoters60/4766835
acaaataa

SEQ ID NO: 135604 - DNA, 8 bp, Unknown
  misc_feature (1)..( 8): Result.003 file - promoters60/4766835
acacataa

SEQ ID NO: 135605 - DNA, 8 bp, Unknown
  misc_feature (1)..( 8): Result.003 file - promoters60/4766835
acacattt

SEQ ID NO: 135606 - DNA, 7 bp, Unknown
  misc_feature (1)..( 7): Result.003 file - promoters60/4766835
ttttcag

SEQ ID NO: 135607 - DNA, 7 bp, Unknown
  misc_feature (1)..( 7): Result.003 file - promoters60/4766835
ttttcag

SEQ ID NO: 135608 - DNA, 7 bp, Unknown
  misc_feature (1)..( 7): Result.003 file - promoters60/4766835
ttttcat

SEQ ID NO: 135609 - DNA, 14 bp, Unknown
  misc_feature (1)..( 14): Result.003 file - promoters60/4766862
ttttggtgagaaga

SEQ ID NO: 135610 - DNA, 14 bp, Unknown
  misc_feature (1)..( 14): Result.003 file - promoters60/4766862
gacacaagagaaga

SEQ ID NO: 135611 - DNA, 14 bp, Unknown
  misc_feature (1)..( 14): Result.003 file - promoters60/4766862
tttgggtgagaatc

SEQ ID NO: 135612 - DNA, 14 bp, Unknown
  misc_feature (1)..( 14): Result.003 file - promoters60/4766862
tgaattttagaaga

SEQ ID NO: 135613 - DNA, 14 bp, Unknown
  misc_feature (1)..( 14): Result.003 file - promoters60/4766862
cgcggtcgagaata

SEQ ID NO: 135614 - DNA, 14 bp, Unknown
  misc_feature (1)..( 14): Result.003 file - promoters60/4766862
tcgttgagagcata

SEQ ID NO: 135615 - DNA, 8 bp, Unknown
  misc_feature (1)..( 8): Result.003 file - promoters60/4766866
aacattta

SEQ ID NO: 135616 - DNA, 8 bp, Unknown
  misc_feature (1)..( 8): Result.003 file - promoters60/4766866
aacctttg

SEQ ID NO: 135617 - DNA, 8 bp, Unknown
  misc_feature (1)..( 8): Result.003 file - promoters60/4766866
gacatttt

SEQ ID NO: 135618 - DNA, 8 bp, Unknown
  misc_feature (1)..( 8): Result.003 file - promoters60/4766866
cccctttg

SEQ ID NO: 135619 - DNA, 11 bp, Unknown
  misc_feature (1)..( 11): Result.003 file - promoters60/4766866
tttaaattaaa

SEQ ID NO: 135620 - DNA, 11 bp, Unknown
  misc_feature (1)..( 11): Result.003 file - promoters60/4766866
tgattattaaa

SEQ ID NO: 135621 - DNA, 11 bp, Unknown
  misc_feature (1)..( 11): Result.003 file - promoters60/4766866
gaaaaaataat

SEQ ID NO: 135622 - DNA, 11 bp, Unknown
  misc_feature (1)..( 11): Result.003 file - promoters60/4766866
ttttaattaat

SEQ ID NO: 135623 - DNA, 14 bp, Unknown
  misc_feature (1)..( 14): Result.003 file - promoters60/4766866
caagacatttagac

SEQ ID NO: 135624 - DNA, 14 bp, Unknown
  misc_feature (1)..( 14): Result.003 file - promoters60/4766866
gttggaatttagat

SEQ ID NO: 135625 - DNA, 14 bp, Unknown
  misc_feature (1)..( 14): Result.003 file - promoters60/4766866
aaaagaaattaacc

SEQ ID NO: 135626 - DNA, 14 bp, Unknown
  misc_feature (1)..( 14): Result.003 file - promoters60/4766866
aaaagaaaataaaa

SEQ ID NO: 135627 - DNA, 14 bp, Unknown
  misc_feature (1)..( 14): Result.003 file - promoters60/4766866
aagggaaatgaaat

SEQ ID NO: 135628 - DNA, 12 bp, Unknown
  misc_feature (1)..( 12): Result.003 file - promoters60/4766866
tttaaagacaca

SEQ ID NO: 135629 - DNA, 12 bp, Unknown
  misc_feature (1)..( 12): Result.003 file - promoters60/4766866
agataagacaac

SEQ ID NO: 135630 - DNA, 12 bp, Unknown
  misc_feature (1)..( 12): Result.003 file - promoters60/4766866
ttttgagacaaa

SEQ ID NO: 135631 - DNA, 12 bp, Unknown
  misc_feature (1)..( 12): Result.003 file - promoters60/4766866
ttgaaacaaaaa

SEQ ID NO: 135632 - DNA, 12 bp, Unknown
  misc_feature (1)..( 12): Result.003 file - promoters60/4766866
gagaaagaaagc

SEQ ID NO: 135633 - DNA, 6 bp, Unknown
  misc_feature (1)..( 6): Result.003 file - promoters60/4766870
atgaag

SEQ ID NO: 135634 - DNA, 6 bp, Unknown
  misc_feature (1)..( 6): Result.003 file - promoters60/4766870
atgaag

SEQ ID NO: 135635 - DNA, 7 bp, Unknown
  misc_feature (1)..( 7): Result.003 file - promoters60/4766870
tgaagtt

SEQ ID NO: 135636 - DNA, 7 bp, Unknown
  misc_feature (1)..( 7): Result.003 file - promoters60/4766870
tgatgtt

SEQ ID NO: 135637 - DNA, 6 bp, Unknown
  misc_feature (1)..( 6): Result.003 file - promoters60/4766870
gatgaa

SEQ ID NO: 135638 - DNA, 6 bp, Unknown
  misc_feature (1)..( 6): Result.003 file - promoters60/4766870
gatgaa

SEQ ID NO: 135639 - DNA, 7 bp, Unknown
  misc_feature (1)..( 7): Result.003 file - promoters60/4766870
gattttt

SEQ ID NO: 135640 - DNA, 7 bp, Unknown
  misc_feature (1)..( 7): Result.003 file - promoters60/4766870
gattttg

SEQ ID NO: 135641 - DNA, 7 bp, Unknown
  misc_feature (1)..( 7): Result.003 file - promoters60/4766870
gatgttg

SEQ ID NO: 135642 - DNA, 6 bp, Unknown
  misc_feature (1)..( 6): Result.003 file - promoters60/4766870
tctttg

SEQ ID NO: 135643 - DNA, 6 bp, Unknown
  misc_feature (1)..( 6): Result.003 file - promoters60/4766870
tctttg

SEQ ID NO: 135644 - DNA, 7 bp, Unknown
  misc_feature (1)..( 7): Result.003 file - promoters60/4766870
gtttgag

SEQ ID NO: 135645 - DNA, 7 bp, Unknown
  misc_feature (1)..( 7): Result.003 file - promoters60/4766870
gtttgag

SEQ ID NO: 135646 - DNA, 7 bp, Unknown
  misc_feature (1)..( 7): Result.003 file - promoters60/4766870
atgttga

SEQ ID NO: 135647 - DNA, 7 bp, Unknown
  misc_feature (1)..( 7): Result.003 file - promoters60/4766870
atgatga

SEQ ID NO: 135648 - DNA, 8 bp, Unknown
  misc_feature (1)..( 8): Result.003 file - promoters60/4766870
attgtttt

SEQ ID NO: 135649 - DNA, 8 bp, Unknown
  misc_feature (1)..( 8): Result.003 file - promoters60/4766870
attttttt

SEQ ID NO: 135650 - DNA, 8 bp, Unknown
  misc_feature (1)..( 8): Result.003 file - promoters60/4766870
tgattatt

SEQ ID NO: 135651 - DNA, 8 bp, Unknown
  misc_feature (1)..( 8): Result.003 file - promoters60/4766870
tgagtatt

SEQ ID NO: 135652 - DNA, 8 bp, Unknown
  misc_feature (1)..( 8): Result.003 file - promoters60/4766870
aagatgat

SEQ ID NO: 135653 - DNA, 8 bp, Unknown
  misc_feature (1)..( 8): Result.003 file - promoters60/4766870
aagaggat

SEQ ID NO: 135654 - DNA, 10 bp, Unknown
  misc_feature (1)..( 10): Result.003 file - promoters60/4766870
tttatttata

SEQ ID NO: 135655 - DNA, 10 bp, Unknown
  misc_feature (1)..( 10): Result.003 file - promoters60/4766870
tttttttata

SEQ ID NO: 135656 - DNA, 7 bp, Unknown
  misc_feature (1)..( 7): Result.003 file - promoters60/4766870
tcttaaa

SEQ ID NO: 135657 - DNA, 7 bp, Unknown
  misc_feature (1)..( 7): Result.003 file - promoters60/4766870
tctaaaa

SEQ ID NO: 135658 - DNA, 6 bp, Unknown
  misc_feature (1)..( 6): Result.003 file - promoters60/4766924
gttggt

SEQ ID NO: 135659 - DNA, 6 bp, Unknown
  misc_feature (1)..( 6): Result.003 file - promoters60/4766924
gttggt

SEQ ID NO: 135660 - DNA, 6 bp, Unknown
  misc_feature (1)..( 6): Result.003 file - promoters60/4766924
tagatc

SEQ ID NO: 135661 - DNA, 6 bp, Unknown
  misc_feature (1)..( 6): Result.003 file - promoters60/4766924
tagatc

SEQ ID NO: 135662 - DNA, 6 bp, Unknown
  misc_feature (1)..( 6): Result.003 file - promoters60/4766924
ttttat

SEQ ID NO: 135663 - DNA, 6 bp, Unknown
  misc_feature (1)..( 6): Result.003 file - promoters60/4766924
ttttat

SEQ ID NO: 135664 - DNA, 6 bp, Unknown
  misc_feature (1)..( 6): Result.003 file - promoters60/4766924
tatata

SEQ ID NO: 135665 - DNA, 6 bp, Unknown
  misc_feature (1)..( 6): Result.003 file - promoters60/4766924
tatata

SEQ ID NO: 135666 - DNA, 8 bp, Unknown
  misc_feature (1)..( 8): Result.003 file - promoters60/4766924
acccacca

SEQ ID NO: 135667 - DNA, 8 bp, Unknown
  misc_feature (1)..( 8): Result.003 file - promoters60/4766924
accaacca

SEQ ID NO: 135668 - DNA, 7 bp, Unknown
  misc_feature (1)..( 7): Result.003 file - promoters60/4766924
tgggatc

SEQ ID NO: 135669 - DNA, 7 bp, Unknown
  misc_feature (1)..( 7): Result.003 file - promoters60/4766924
tggtatc

SEQ ID NO: 135670 - DNA, 7 bp, Unknown
  misc_feature (1)..( 7): Result.003 file - promoters60/4766924
gtctaaa

SEQ ID NO: 135671 - DNA, 7 bp, Unknown
  misc_feature (1)..( 7): Result.003 file - promoters60/4766924
gtcaaaa

SEQ ID NO: 135672 - DNA, 11 bp, Unknown
  misc_feature (1)..( 11): Result.003 file - promoters60/4766977
gaacattaata

SEQ ID NO: 135673 - DNA, 11 bp, Unknown
  misc_feature (1)..( 11): Result.003 file - promoters60/4766977
ccacaataatt

SEQ ID NO: 135674 - DNA, 11 bp, Unknown
  misc_feature (1)..( 11): Result.003 file - promoters60/4766977
ggacaataata

SEQ ID NO: 135675 - DNA, 11 bp, Unknown
  misc_feature (1)..( 11): Result.003 file - promoters60/4766977
ccaaaattaca

SEQ ID NO: 135676 - DNA, 12 bp, Unknown
  misc_feature (1)..( 12): Result.003 file - promoters60/4766977
agtataaaatac

SEQ ID NO: 135677 - DNA, 12 bp, Unknown
  misc_feature (1)..( 12): Result.003 file - promoters60/4766977
tttttaatatat

SEQ ID NO: 135678 - DNA, 12 bp, Unknown
  misc_feature (1)..( 12): Result.003 file - promoters60/4766977
cagaaaaaatac

SEQ ID NO: 135679 - DNA, 12 bp, Unknown
  misc_feature (1)..( 12): Result.003 file - promoters60/4766977
taagtagaaaac

SEQ ID NO: 135680 - DNA, 12 bp, Unknown
  misc_feature (1)..( 12): Result.003 file - promoters60/4766977
agagaaaaaaca

SEQ ID NO: 135681 - DNA, 10 bp, Unknown
  misc_feature (1)..( 10): Result.003 file - promoters60/4766977
actaatttta

SEQ ID NO: 135682 - DNA, 10 bp, Unknown
  misc_feature (1)..( 10): Result.003 file - promoters60/4766977
actaagtttg

SEQ ID NO: 135683 - DNA, 10 bp, Unknown
  misc_feature (1)..( 10): Result.003 file - promoters60/4766977
tctaattact

SEQ ID NO: 135684 - DNA, 10 bp, Unknown
  misc_feature (1)..( 10): Result.003 file - promoters60/4766977
tggtatttta

SEQ ID NO: 135685 - DNA, 9 bp, Unknown
  misc_feature (1)..( 9): Result.003 file - promoters60/4766977
aaccaaaat

SEQ ID NO: 135686 - DNA, 9 bp, Unknown
  misc_feature (1)..( 9): Result.003 file - promoters60/4766977
aactaaaaa

SEQ ID NO: 135687 - DNA, 9 bp, Unknown
  misc_feature (1)..( 9): Result.003 file - promoters60/4766977
acctaaact

SEQ ID NO: 135688 - DNA, 9 bp, Unknown
  misc_feature (1)..( 9): Result.003 file - promoters60/4766977
tgctatact

SEQ ID NO: 135689 - DNA, 10 bp, Unknown
  misc_feature (1)..( 10): Result.003 file - promoters60/4766977
aaaatatatt

SEQ ID NO: 135690 - DNA, 10 bp, Unknown
  misc_feature (1)..( 10): Result.003 file - promoters60/4766977
aaaatacttt

SEQ ID NO: 135691 - DNA, 10 bp, Unknown
  misc_feature (1)..( 10): Result.003 file - promoters60/4766977
gaaatatatg

SEQ ID NO: 135692 - DNA, 10 bp, Unknown
  misc_feature (1)..( 10): Result.003 file - promoters60/4766977
atcatatatg

SEQ ID NO: 135693 - DNA, 13 bp, Unknown
  misc_feature (1)..( 13): Result.003 file - promoters60/4766977
atactttatcgtc

SEQ ID NO: 135694 - DNA, 13 bp, Unknown
  misc_feature (1)..( 13): Result.003 file - promoters60/4766977
tttctttttcgag

SEQ ID NO: 135695 - DNA, 13 bp, Unknown
  misc_feature (1)..( 13): Result.003 file - promoters60/4766977
tgtattttttttt

SEQ ID NO: 135696 - DNA, 13 bp, Unknown
  misc_feature (1)..( 13): Result.003 file - promoters60/4766977
aacgtttataaga

SEQ ID NO: 135697 - DNA, 13 bp, Unknown
  misc_feature (1)..( 13): Result.003 file - promoters60/4766977
attatttttactc

SEQ ID NO: 135698 - DNA, 12 bp, Unknown
  misc_feature (1)..( 12): Result.003 file - promoters60/4766977
actataaataga

SEQ ID NO: 135699 - DNA, 12 bp, Unknown
  misc_feature (1)..( 12): Result.003 file - promoters60/4766977
tctataaaaaaa

SEQ ID NO: 135700 - DNA, 12 bp, Unknown
  misc_feature (1)..( 12): Result.003 file - promoters60/4766977
aatataaataac

SEQ ID NO: 135701 - DNA, 12 bp, Unknown
  misc_feature (1)..( 12): Result.003 file - promoters60/4766977
tctataaatata

SEQ ID NO: 135702 - DNA, 12 bp, Unknown
  misc_feature (1)..( 12): Result.003 file - promoters60/4766977
tatataaatagt

SEQ ID NO: 135703 - DNA, 12 bp, Unknown
  misc_feature (1)..( 12): Result.003 file - promoters60/4766977
aatataaatact

SEQ ID NO: 135704 - DNA, 9 bp, Unknown
  misc_feature (1)..( 9): Result.003 file - promoters60/4766977
ttaagcttg

SEQ ID NO: 135705 - DNA, 9 bp, Unknown
  misc_feature (1)..( 9): Result.003 file - promoters60/4766977
ataaactta

SEQ ID NO: 135706 - DNA, 9 bp, Unknown
  misc_feature (1)..( 9): Result.003 file - promoters60/4766977
ataaagtta

SEQ ID NO: 135707 - DNA, 9 bp, Unknown
  misc_feature (1)..( 9): Result.003 file - promoters60/4766977
ttaaccttt

SEQ ID NO: 135708 - DNA, 9 bp, Unknown
  misc_feature (1)..( 9): Result.003 file - promoters60/4766977
ttaaaatga

SEQ ID NO: 135709 - DNA, 9 bp, Unknown
  misc_feature (1)..( 9): Result.003 file - promoters60/4766977
ttaaaatta

SEQ ID NO: 135710 - DNA, 9 bp, Unknown
  misc_feature (1)..( 9): Result.003 file - promoters60/4766977
ataaagtta

SEQ ID NO: 135711 - DNA, 9 bp, Unknown
  misc_feature (1)..( 9): Result.003 file - promoters60/4766977
aaaaaataa

SEQ ID NO: 135712 - DNA, 11 bp, Unknown
  misc_feature (1)..( 11): Result.003 file - promoters60/4767038
ctttttttttt

SEQ ID NO: 135713 - DNA, 11 bp, Unknown
  misc_feature (1)..( 11): Result.003 file - promoters60/4767038
cttcttttttt

SEQ ID NO: 135714 - DNA, 11 bp, Unknown
  misc_feature (1)..( 11): Result.003 file - promoters60/4767038
ctttttttttc

SEQ ID NO: 135715 - DNA, 9 bp, Unknown
  misc_feature (1)..( 9): Result.003 file - promoters60/4767038
aactatttt

SEQ ID NO: 135716 - DNA, 9 bp, Unknown
  misc_feature (1)..( 9): Result.003 file - promoters60/4767038
atctatttt

SEQ ID NO: 135717 - DNA, 9 bp, Unknown
  misc_feature (1)..( 9): Result.003 file - promoters60/4767038
atcaattta

SEQ ID NO: 135718 - DNA, 8 bp, Unknown
  misc_feature (1)..( 8): Result.003 file - promoters60/4767050
ttagaatt

SEQ ID NO: 135719 - DNA, 8 bp, Unknown
  misc_feature (1)..( 8): Result.003 file - promoters60/4767050
ttataatt

SEQ ID NO: 135720 - DNA, 8 bp, Unknown
  misc_feature (1)..( 8): Result.003 file - promoters60/4767050
atagaaaa

SEQ ID NO: 135721 - DNA, 8 bp, Unknown
  misc_feature (1)..( 8): Result.003 file - promoters60/4767050
atataaat

SEQ ID NO: 135722 - DNA, 8 bp, Unknown
  misc_feature (1)..( 8): Result.003 file - promoters60/4767050
aaataaat

SEQ ID NO: 135723 - DNA, 6 bp, Unknown
  misc_feature (1)..( 6): Result.003 file - promoters60/4767050
aagaag

SEQ ID NO: 135724 - DNA, 6 bp, Unknown
  misc_feature (1)..( 6): Result.003 file - promoters60/4767050
aagaag

SEQ ID NO: 135725 - DNA, 7 bp, Unknown
  misc_feature (1)..( 7): Result.003 file - promoters60/4767050
tctgcaa

SEQ ID NO: 135726 - DNA, 7 bp, Unknown
  misc_feature (1)..( 7): Result.003 file - promoters60/4767050
tctgcaa

SEQ ID NO: 135727 - DNA, 9 bp, Unknown
  misc_feature (1)..( 9): Result.003 file - promoters60/4767050
agattgttc

SEQ ID NO: 135728 - DNA, 9 bp, Unknown
  misc_feature (1)..( 9): Result.003 file - promoters60/4767050
agatggttc

SEQ ID NO: 135729 - DNA, 8 bp, Unknown
  misc_feature (1)..( 8): Result.003 file - promoters60/4767050
gatcagag

SEQ ID NO: 135730 - DNA, 8 bp, Unknown
  misc_feature (1)..( 8): Result.003 file - promoters60/4767050
gatcagag

SEQ ID NO: 135731 - DNA, 6 bp, Unknown
  misc_feature (1)..( 6): Result.003 file - promoters60/4767050
agagaa

SEQ ID NO: 135732 - DNA, 6 bp, Unknown
  misc_feature (1)..( 6): Result.003 file - promoters60/4767050
agagaa

SEQ ID NO: 135733 - DNA, 6 bp, Unknown
  misc_feature (1)..( 6): Result.003 file - promoters60/4767050
gatgaa

SEQ ID NO: 135734 - DNA, 6 bp, Unknown
  misc_feature (1)..( 6): Result.003 file - promoters60/4767050
gatgaa

SEQ ID NO: 135735 - DNA, 6 bp, Unknown
  misc_feature (1)..( 6): Result.003 file - promoters60/4767050
atttag

SEQ ID NO: 135736 - DNA, 6 bp, Unknown
  misc_feature (1)..( 6): Result.003 file - promoters60/4767050
atttag

SEQ ID NO: 135737 - DNA, 8 bp, Unknown
  misc_feature (1)..( 8): Result.003 file - promoters60/4767050
aaagtaaa

SEQ ID NO: 135738 - DNA, 8 bp, Unknown
  misc_feature (1)..( 8): Result.003 file - promoters60/4767050
aaactaaa

SEQ ID NO: 135739 - DNA, 6 bp, Unknown
  misc_feature (1)..( 6): Result.003 file - promoters60/4767050
gaatca

SEQ ID NO: 135740 - DNA, 6 bp, Unknown
  misc_feature (1)..( 6): Result.003 file - promoters60/4767050
gaatca

SEQ ID NO: 135741 - DNA, 7 bp, Unknown
  misc_feature (1)..( 7): Result.003 file - promoters60/4767050
tccggtt

SEQ ID NO: 135742 - DNA, 7 bp, Unknown
  misc_feature (1)..( 7): Result.003 file - promoters60/4767050
tccagtt

SEQ ID NO: 135743 - DNA, 6 bp, Unknown
  misc_feature (1)..( 6): Result.003 file - promoters60/4767050
tttccg

SEQ ID NO: 135744 - DNA, 6 bp, Unknown
  misc_feature (1)..( 6): Result.003 file - promoters60/4767050
tttccg

SEQ ID NO: 135745 - DNA, 6 bp, Unknown
  misc_feature (1)..( 6): Result.003 file - promoters60/4767050
aaccct

SEQ ID NO: 135746 - DNA, 6 bp, Unknown
  misc_feature (1)..( 6): Result.003 file - promoters60/4767050
aaccct

SEQ ID NO: 135747 - DNA, 6 bp, Unknown
  misc_feature (1)..( 6): Result.003 file - promoters60/4767059
tagatc

SEQ ID NO: 135748 - DNA, 6 bp, Unknown
  misc_feature (1)..( 6): Result.003 file - promoters60/4767059
tagatc

SEQ ID NO: 135749 - DNA, 6 bp, Unknown
  misc_feature (1)..( 6): Result.003 file - promoters60/4767059
acttct

SEQ ID NO: 135750 - DNA, 6 bp, Unknown
  misc_feature (1)..( 6): Result.003 file - promoters60/4767059
acttct

SEQ ID NO: 135751 - DNA, 7 bp, Unknown
  misc_feature (1)..( 7): Result.003 file - promoters60/4767059
taaattt

SEQ ID NO: 135752 - DNA, 7 bp, Unknown
  misc_feature (1)..( 7): Result.003 file - promoters60/4767059
gaaattt

SEQ ID NO: 135753 - DNA, 7 bp, Unknown
  misc_feature (1)..( 7): Result.003 file - promoters60/4767059
taaatta

SEQ ID NO: 135754 - DNA, 6 bp, Unknown
  misc_feature (1)..( 6): Result.003 file - promoters60/4767059
aaagac

SEQ ID NO: 135755 - DNA, 6 bp, Unknown
  misc_feature (1)..( 6): Result.003 file - promoters60/4767059
aaagac

SEQ ID NO: 135756 - DNA, 8 bp, Unknown
  misc_feature (1)..( 8): Result.003 file - promoters60/4767059
ttggtaga

SEQ ID NO: 135757 - DNA, 8 bp, Unknown
  misc_feature (1)..( 8): Result.003 file - promoters60/4767059
ttggaaga

SEQ ID NO: 135758 - DNA, 8 bp, Unknown
  misc_feature (1)..( 8): Result.003 file - promoters60/4767059
gaattttg

SEQ ID NO: 135759 - DNA, 8 bp, Unknown
  misc_feature (1)..( 8): Result.003 file - promoters60/4767059
gaactttg

SEQ ID NO: 135760 - DNA, 8 bp, Unknown
  misc_feature (1)..( 8): Result.003 file - promoters60/4767059
gaacttct

SEQ ID NO: 135761 - DNA, 8 bp, Unknown
  misc_feature (1)..( 8): Result.003 file - promoters60/4767059
ttaaatgc

SEQ ID NO: 135762 - DNA, 8 bp, Unknown
  misc_feature (1)..( 8): Result.003 file - promoters60/4767059
ttaactgc

SEQ ID NO: 135763 - DNA, 8 bp, Unknown
  misc_feature (1)..( 8): Result.003 file - promoters60/4767059
taataaat

SEQ ID NO: 135764 - DNA, 8 bp, Unknown
  misc_feature (1)..( 8): Result.003 file - promoters60/4767059
taacaaat

SEQ ID NO: 135765 - DNA, 6 bp, Unknown
  misc_feature (1)..( 6): Result.003 file - promoters60/4767059
gatatg

SEQ ID NO: 135766 - DNA, 6 bp, Unknown
  misc_feature (1)..( 6): Result.003 file - promoters60/4767059
gatatg

SEQ ID NO: 135767 - DNA, 6 bp, Unknown
  misc_feature (1)..( 6): Result.003 file - promoters60/4767059
taattt

SEQ ID NO: 135768 - DNA, 6 bp, Unknown
  misc_feature (1)..( 6): Result.003 file - promoters60/4767059
taattt

SEQ ID NO: 135769 - DNA, 7 bp, Unknown
  misc_feature (1)..( 7): Result.003 file - promoters60/4767059
tataatt

SEQ ID NO: 135770 - DNA, 7 bp, Unknown
  misc_feature (1)..( 7): Result.003 file - promoters60/4767059
tattatt

SEQ ID NO: 135771 - DNA, 8 bp, Unknown
  misc_feature (1)..( 8): Result.003 file - promoters60/4767059
ataaaatt

SEQ ID NO: 135772 - DNA, 8 bp, Unknown
  misc_feature (1)..( 8): Result.003 file - promoters60/4767059
atataatt

SEQ ID NO: 135773 - DNA, 8 bp, Unknown
  misc_feature (1)..( 8): Result.003 file - promoters60/4767059
aaagtcaa

SEQ ID NO: 135774 - DNA, 8 bp, Unknown
  misc_feature (1)..( 8): Result.003 file - promoters60/4767059
aaaatcaa

SEQ ID NO: 135775 - DNA, 8 bp, Unknown
  misc_feature (1)..( 8): Result.003 file - promoters60/4767059
attcggtt

SEQ ID NO: 135776 - DNA, 8 bp, Unknown
  misc_feature (1)..( 8): Result.003 file - promoters60/4767059
attcagtt

SEQ ID NO: 135777 - DNA, 10 bp, Unknown
  misc_feature (1)..( 10): Result.003 file - promoters60/4767059
gtcgttttca

SEQ ID NO: 135778 - DNA, 10 bp, Unknown
  misc_feature (1)..( 10): Result.003 file - promoters60/4767059
gtcgttttca

SEQ ID NO: 135779 - DNA, 6 bp, Unknown
  misc_feature (1)..( 6): Result.003 file - promoters60/4767059
aaaaaa

SEQ ID NO: 135780 - DNA, 6 bp, Unknown
  misc_feature (1)..( 6): Result.003 file - promoters60/4767059
aaaaaa

SEQ ID NO: 135781 - DNA, 7 bp, Unknown
  misc_feature (1)..( 7): Result.003 file - promoters60/4767059
gatgaaa

SEQ ID NO: 135782 - DNA, 7 bp, Unknown
  misc_feature (1)..( 7): Result.003 file - promoters60/4767059
gatcaaa

SEQ ID NO: 135783 - DNA, 6 bp, Unknown
  misc_feature (1)..( 6): Result.003 file - promoters60/4767059
attaat

SEQ ID NO: 135784 - DNA, 6 bp, Unknown
  misc_feature (1)..( 6): Result.003 file - promoters60/4767059
attaat

SEQ ID NO: 135785 - DNA, 6 bp, Unknown
  misc_feature (1)..( 6): Result.003 file - promoters60/4767059
atttca

SEQ ID NO: 135786 - DNA, 6 bp, Unknown
  misc_feature (1)..( 6): Result.003 file - promoters60/4767059
atttca

SEQ ID NO: 135787 - DNA, 10 bp, Unknown
  misc_feature (1)..( 10): Result.003 file - promoters60/4767059
catgaattta

SEQ ID NO: 135788 - DNA, 10 bp, Unknown
  misc_feature (1)..( 10): Result.003 file - promoters60/4767059
cataaattta

SEQ ID NO: 135789 - DNA, 7 bp, Unknown
  misc_feature (1)..( 7): Result.003 file - promoters60/4767059
aggccca

SEQ ID NO: 135790 - DNA, 7 bp, Unknown
  misc_feature (1)..( 7): Result.003 file - promoters60/4767059
aggccca

SEQ ID NO: 135791 - DNA, 7 bp, Unknown
  misc_feature (1)..( 7): Result.003 file - promoters60/4767063
aaaatga

SEQ ID NO: 135792 - DNA, 7 bp, Unknown
  misc_feature (1)..( 7): Result.003 file - promoters60/4767063
aaactga

SEQ ID NO: 135793 - DNA, 7 bp, Unknown
  misc_feature (1)..( 7): Result.003 file - promoters60/4767063
caaatga

SEQ ID NO: 135794 - DNA, 7 bp, Unknown
  misc_feature (1)..( 7): Result.003 file - promoters60/4767063
tttcttc

SEQ ID NO: 135795 - DNA, 7 bp, Unknown
  misc_feature (1)..( 7): Result.003 file - promoters60/4767063
tttcttt

SEQ ID NO: 135796 - DNA, 7 bp, Unknown
  misc_feature (1)..( 7): Result.003 file - promoters60/4767063
tttattt

SEQ ID NO: 135797 - DNA, 6 bp, Unknown
  misc_feature (1)..( 6): Result.003 file - promoters60/4767063
cgcttt

SEQ ID NO: 135798 - DNA, 6 bp, Unknown
  misc_feature (1)..( 6): Result.003 file - promoters60/4767063
cgcttt

SEQ ID NO: 135799 - DNA, 7 bp, Unknown
  misc_feature (1)..( 7): Result.003 file - promoters60/4767063
tttcgta

SEQ ID NO: 135800 - DNA, 7 bp, Unknown
  misc_feature (1)..( 7): Result.003 file - promoters60/4767063
tttagta

SEQ ID NO: 135801 - DNA, 10 bp, Unknown
  misc_feature (1)..( 10): Result.003 file - promoters60/4767063
ttgctgtttt

SEQ ID NO: 135802 - DNA, 10 bp, Unknown
  misc_feature (1)..( 10): Result.003 file - promoters60/4767063
ttgctttttt

SEQ ID NO: 135803 - DNA, 8 bp, Unknown
  misc_feature (1)..( 8): Result.003 file - promoters60/4767063
ttttgtct

SEQ ID NO: 135804 - DNA, 8 bp, Unknown
  misc_feature (1)..( 8): Result.003 file - promoters60/4767063
ttttttct

SEQ ID NO: 135805 - DNA, 11 bp, Unknown
  misc_feature (1)..( 11): Result.003 file - promoters60/4767063
ttttgtaattt

SEQ ID NO: 135806 - DNA, 11 bp, Unknown
  misc_feature (1)..( 11): Result.003 file - promoters60/4767063
tttagtatttt

SEQ ID NO: 135807 - DNA, 7 bp, Unknown
  misc_feature (1)..( 7): Result.003 file - promoters60/4767063
tttataa

SEQ ID NO: 135808 - DNA, 7 bp, Unknown
  misc_feature (1)..( 7): Result.003 file - promoters60/4767063
tttttaa

SEQ ID NO: 135809 - DNA, 9 bp, Unknown
  misc_feature (1)..( 9): Result.003 file - promoters60/4767063
attttatgt

SEQ ID NO: 135810 - DNA, 9 bp, Unknown
  misc_feature (1)..( 9): Result.003 file - promoters60/4767063
atttcatga

SEQ ID NO: 135811 - DNA, 9 bp, Unknown
  misc_feature (1)..( 9): Result.003 file - promoters60/4767063
gacttatgt

SEQ ID NO: 135812 - DNA, 11 bp, Unknown
  misc_feature (1)..( 11): Result.003 file - promoters60/4767063
attaattataa

SEQ ID NO: 135813 - DNA, 11 bp, Unknown
  misc_feature (1)..( 11): Result.003 file - promoters60/4767063
tgaaattataa

SEQ ID NO: 135814 - DNA, 11 bp, Unknown
  misc_feature (1)..( 11): Result.003 file - promoters60/4767063
attaattaatt

SEQ ID NO: 135815 - DNA, 8 bp, Unknown
  misc_feature (1)..( 8): Result.003 file - promoters60/4767063
attgtaaa

SEQ ID NO: 135816 - DNA, 8 bp, Unknown
  misc_feature (1)..( 8): Result.003 file - promoters60/4767063
attttaaa

SEQ ID NO: 135817 - DNA, 7 bp, Unknown
  misc_feature (1)..( 7): Result.003 file - promoters60/4767063
tctccaa

SEQ ID NO: 135818 - DNA, 7 bp, Unknown
  misc_feature (1)..( 7): Result.003 file - promoters60/4767063
tctccaa

SEQ ID NO: 135819 - DNA, 6 bp, Unknown
  misc_feature (1)..( 6): Result.003 file - promoters60/4767063
tagagg

SEQ ID NO: 135820 - DNA, 6 bp, Unknown
  misc_feature (1)..( 6): Result.003 file - promoters60/4767063
tagagg

SEQ ID NO: 135821 - DNA, 6 bp, Unknown
  misc_feature (1)..( 6): Result.003 file - promoters60/4767063
atgaga

SEQ ID NO: 135822 - DNA, 6 bp, Unknown
  misc_feature (1)..( 6): Result.003 file - promoters60/4767063
atgaga

SEQ ID NO: 135823 - DNA, 6 bp, Unknown
  misc_feature (1)..( 6): Result.003 file - promoters60/4767063
tgtgaa

SEQ ID NO: 135824 - DNA, 6 bp, Unknown
  misc_feature (1)..( 6): Result.003 file - promoters60/4767063
tgtgaa

SEQ ID NO: 135825 - DNA, 6 bp, Unknown
  misc_feature (1)..( 6): Result.003 file - promoters60/4767063
ttttgt

SEQ ID NO: 135826 - DNA, 6 bp, Unknown
  misc_feature (1)..( 6): Result.003 file - promoters60/4767063
ttttgt

SEQ ID NO: 135827 - DNA, 6 bp, Unknown
  misc_feature (1)..( 6): Result.003 file - promoters60/4767063
aataag

SEQ ID NO: 135828 - DNA, 6 bp, Unknown
  misc_feature (1)..( 6): Result.003 file - promoters60/4767063
aataag

SEQ ID NO: 135829 - DNA, 7 bp, Unknown
  misc_feature (1)..( 7): Result.003 file - promoters60/4767063
aaaaaaa

SEQ ID NO: 135830 - DNA, 7 bp, Unknown
  misc_feature (1)..( 7): Result.003 file - promoters60/4767063
aaaaaaa

SEQ ID NO: 135831 - DNA, 11 bp, Unknown
  misc_feature (1)..( 11): Result.003 file - promoters60/4767063
attcattaatt

SEQ ID NO: 135832 - DNA, 11 bp, Unknown
  misc_feature (1)..( 11): Result.003 file - promoters60/4767063
attaattaatt

SEQ ID NO: 135833 - DNA, 6 bp, Unknown
  misc_feature (1)..( 6): Result.003 file - promoters60/4767063
agtagt

SEQ ID NO: 135834 - DNA, 6 bp, Unknown
  misc_feature (1)..( 6): Result.003 file - promoters60/4767063
agtagt

SEQ ID NO: 135835 - DNA, 6 bp, Unknown
  misc_feature (1)..( 6): Result.003 file - promoters60/4767063
accaaa

SEQ ID NO: 135836 - DNA, 6 bp, Unknown
  misc_feature (1)..( 6): Result.003 file - promoters60/4767063
accaaa

SEQ ID NO: 135837 - DNA, 7 bp, Unknown
  misc_feature (1)..( 7): Result.003 file - promoters60/4767063
gttaacc

SEQ ID NO: 135838 - DNA, 7 bp, Unknown
  misc_feature (1)..( 7): Result.003 file - promoters60/4767063
gttaacc

SEQ ID NO: 135839 - DNA, 8 bp, Unknown
  misc_feature (1)..( 8): Result.003 file - promoters60/4767063
aaattata

SEQ ID NO: 135840 - DNA, 8 bp, Unknown
  misc_feature (1)..( 8): Result.003 file - promoters60/4767063
aaatgata

SEQ ID NO: 135841 - DNA, 10 bp, Unknown
  misc_feature (1)..( 10): Result.003 file - promoters60/4767063
caacttagac

SEQ ID NO: 135842 - DNA, 10 bp, Unknown
  misc_feature (1)..( 10): Result.003 file - promoters60/4767063
caaattagac

SEQ ID NO: 135843 - DNA, 9 bp, Unknown
  misc_feature (1)..( 9): Result.003 file - promoters60/4767063
ttcattttt

SEQ ID NO: 135844 - DNA, 9 bp, Unknown
  misc_feature (1)..( 9): Result.003 file - promoters60/4767063
ttcatcttt

SEQ ID NO: 135845 - DNA, 8 bp, Unknown
  misc_feature (1)..( 8): Result.003 file - promoters60/4767066
tttaatca

SEQ ID NO: 135846 - DNA, 8 bp, Unknown
  misc_feature (1)..( 8): Result.003 file - promoters60/4767066
cttagtca

SEQ ID NO: 135847 - DNA, 8 bp, Unknown
  misc_feature (1)..( 8): Result.003 file - promoters60/4767066
agtaatga

SEQ ID NO: 135848 - DNA, 9 bp, Unknown
  misc_feature (1)..( 9): Result.003 file - promoters60/4767066
aatttttca

SEQ ID NO: 135849 - DNA, 9 bp, Unknown
  misc_feature (1)..( 9): Result.003 file - promoters60/4767066
gatttttac

SEQ ID NO: 135850 - DNA, 9 bp, Unknown
  misc_feature (1)..( 9): Result.003 file - promoters60/4767066
tattattca

SEQ ID NO: 135851 - DNA, 9 bp, Unknown
  misc_feature (1)..( 9): Result.003 file - promoters60/4767066
tattattga

SEQ ID NO: 135852 - DNA, 8 bp, Unknown
  misc_feature (1)..( 8): Result.003 file - promoters60/4767066
tattgatc

SEQ ID NO: 135853 - DNA, 8 bp, Unknown
  misc_feature (1)..( 8): Result.003 file - promoters60/4767066
cattgatg

SEQ ID NO: 135854 - DNA, 8 bp, Unknown
  misc_feature (1)..( 8): Result.003 file - promoters60/4767066
catttatg

SEQ ID NO: 135855 - DNA, 8 bp, Unknown
  misc_feature (1)..( 8): Result.003 file - promoters60/4767066
aattttta

SEQ ID NO: 135856 - DNA, 8 bp, Unknown
  misc_feature (1)..( 8): Result.003 file - promoters60/4767066
aatttttt

SEQ ID NO: 135857 - DNA, 9 bp, Unknown
  misc_feature (1)..( 9): Result.003 file - promoters60/4767066
gctttcttt

SEQ ID NO: 135858 - DNA, 6 bp, Unknown
  misc_feature (1)..( 6): Result.003 file - promoters60/4767066
tttttt

SEQ ID NO: 135859 - DNA, 6 bp, Unknown
  misc_feature (1)..( 6): Result.003 file - promoters60/4767066
tttttt

SEQ ID NO: 135860 - DNA, 7 bp, Unknown
  misc_feature (1)..( 7): Result.003 file - promoters60/4767066
tttcttt

SEQ ID NO: 135861 - DNA, 13 bp, Unknown
  misc_feature (1)..( 13): Result.003 file - promoters60/4767066
gtgactaattctt

SEQ ID NO: 135862 - DNA, 13 bp, Unknown
  misc_feature (1)..( 13): Result.003 file - promoters60/4767066
tttgcaaattctc

SEQ ID NO: 135863 - DNA, 14 bp, Unknown
  misc_feature (1)..( 14): Result.003 file - promoters60/4767066
tttttcaatttctc

SEQ ID NO: 135864 - DNA, 8 bp, Unknown
  misc_feature (1)..( 8): Result.003 file - promoters60/4767066
caaaaact

SEQ ID NO: 135865 - DNA, 8 bp, Unknown
  misc_feature (1)..( 8): Result.003 file - promoters60/4767066
gcaaaact

SEQ ID NO: 135866 - DNA, 8 bp, Unknown
  misc_feature (1)..( 8): Result.003 file - promoters60/4767066
caaaaact

SEQ ID NO: 135867 - DNA, 9 bp, Unknown
  misc_feature (1)..( 9): Result.003 file - promoters60/4767066
taaaacatt

SEQ ID NO: 135868 - DNA, 9 bp, Unknown
  misc_feature (1)..( 9): Result.003 file - promoters60/4767066
aaaaacaaa

SEQ ID NO: 135869 - DNA, 9 bp, Unknown
  misc_feature (1)..( 9): Result.003 file - promoters60/4767066
aaaaagaaa

SEQ ID NO: 135870 - DNA, 7 bp, Unknown
  misc_feature (1)..( 7): Result.003 file - promoters60/4767066
gagaaat

SEQ ID NO: 135871 - DNA, 7 bp, Unknown
  misc_feature (1)..( 7): Result.003 file - promoters60/4767066
aagaaat

SEQ ID NO: 135872 - DNA, 7 bp, Unknown
  misc_feature (1)..( 7): Result.003 file - promoters60/4767066
taaaaaa

SEQ ID NO: 135873 - DNA, 11 bp, Unknown
  misc_feature (1)..( 11): Result.003 file - promoters60/4767144
aaaaaattaaa

SEQ ID NO: 135874 - DNA, 11 bp, Unknown
  misc_feature (1)..( 11): Result.003 file - promoters60/4767144
aaaatatttat

SEQ ID NO: 135875 - DNA, 11 bp, Unknown
  misc_feature (1)..( 11): Result.003 file - promoters60/4767144
taaaaattaaa

SEQ ID NO: 135876 - DNA, 11 bp, Unknown
  misc_feature (1)..( 11): Result.003 file - promoters60/4767144
cgaagattaaa

SEQ ID NO: 135877 - DNA, 13 bp, Unknown
  misc_feature (1)..( 13): Result.003 file - promoters60/4767144
aaaaattaaacaa

SEQ ID NO: 135878 - DNA, 13 bp, Unknown
  misc_feature (1)..( 13): Result.003 file - promoters60/4767144
gataataaaatat

SEQ ID NO: 135879 - DNA, 13 bp, Unknown
  misc_feature (1)..( 13): Result.003 file - promoters60/4767144
gaagattaaacaa

SEQ ID NO: 135880 - DNA, 13 bp, Unknown
  misc_feature (1)..( 13): Result.003 file - promoters60/4767144
aaaaattaaaatc

SEQ ID NO: 135881 - DNA, 12 bp, Unknown
  misc_feature (1)..( 12): Result.003 file - promoters60/4767144
ttaatagagaga

SEQ ID NO: 135882 - DNA, 12 bp, Unknown
  misc_feature (1)..( 12): Result.003 file - promoters60/4767144
ttgtgagataga

SEQ ID NO: 135883 - DNA, 12 bp, Unknown
  misc_feature (1)..( 12): Result.003 file - promoters60/4767144
atttttgatata

SEQ ID NO: 135884 - DNA, 12 bp, Unknown
  misc_feature (1)..( 12): Result.003 file - promoters60/4767144
atttttaaccaa

SEQ ID NO: 135885 - DNA, 10 bp, Unknown
  misc_feature (1)..( 10): Result.003 file - promoters60/4767144
atattgctta

SEQ ID NO: 135886 - DNA, 10 bp, Unknown
  misc_feature (1)..( 10): Result.003 file - promoters60/4767144
atatttcttg

SEQ ID NO: 135887 - DNA, 10 bp, Unknown
  misc_feature (1)..( 10): Result.003 file - promoters60/4767144
ccgttgctta

SEQ ID NO: 135888 - DNA, 10 bp, Unknown
  misc_feature (1)..( 10): Result.003 file - promoters60/4767144
tctattcttg

SEQ ID NO: 135889 - DNA, 6 bp, Unknown
  misc_feature (1)..( 6): Result.003 file - promoters60/4767148
acaatt

SEQ ID NO: 135890 - DNA, 6 bp, Unknown
  misc_feature (1)..( 6): Result.003 file - promoters60/4767148
acaatt

SEQ ID NO: 135891 - DNA, 6 bp, Unknown
  misc_feature (1)..( 6): Result.003 file - promoters60/4767148
atctgt

SEQ ID NO: 135892 - DNA, 6 bp, Unknown
  misc_feature (1)..( 6): Result.003 file - promoters60/4767148
atctgt

SEQ ID NO: 135893 - DNA, 8 bp, Unknown
  misc_feature (1)..( 8): Result.003 file - promoters60/4767148
attgatat

SEQ ID NO: 135894 - DNA, 8 bp, Unknown
  misc_feature (1)..( 8): Result.003 file - promoters60/4767148
attcatat

SEQ ID NO: 135895 - DNA, 6 bp, Unknown
  misc_feature (1)..( 6): Result.003 file - promoters60/4767148
acaaat

SEQ ID NO: 135896 - DNA, 6 bp, Unknown
  misc_feature (1)..( 6): Result.003 file - promoters60/4767148
acaaat

SEQ ID NO: 135897 - DNA, 7 bp, Unknown
  misc_feature (1)..( 7): Result.003 file - promoters60/4767148
atttcta

SEQ ID NO: 135898 - DNA, 7 bp, Unknown
  misc_feature (1)..( 7): Result.003 file - promoters60/4767148
atttctt

SEQ ID NO: 135899 - DNA, 7 bp, Unknown
  misc_feature (1)..( 7): Result.003 file - promoters60/4767148
attcctt

SEQ ID NO: 135900 - DNA, 7 bp, Unknown
  misc_feature (1)..( 7): Result.003 file - promoters60/4767148
tacaaaa

SEQ ID NO: 135901 - DNA, 7 bp, Unknown
  misc_feature (1)..( 7): Result.003 file - promoters60/4767148
tacaaaa

SEQ ID NO: 135902 - DNA, 6 bp, Unknown
  misc_feature (1)..( 6): Result.003 file - promoters60/4767148
ttctaa

SEQ ID NO: 135903 - DNA, 6 bp, Unknown
  misc_feature (1)..( 6): Result.003 file - promoters60/4767148
ttctaa

SEQ ID NO: 135904 - DNA, 8 bp, Unknown
  misc_feature (1)..( 8): Result.003 file - promoters60/4767148
tattgatt

SEQ ID NO: 135905 - DNA, 8 bp, Unknown
  misc_feature (1)..( 8): Result.003 file - promoters60/4767148
tatttatt

SEQ ID NO: 135906 - DNA, 12 bp, Unknown
  misc_feature (1)..( 12): Result.003 file - promoters60/4767148
agtaactttaga

SEQ ID NO: 135907 - DNA, 12 bp, Unknown
  misc_feature (1)..( 12): Result.003 file - promoters60/4767148
agtaaatttgac

SEQ ID NO: 135908 - DNA, 12 bp, Unknown
  misc_feature (1)..( 12): Result.003 file - promoters60/4767148
aacaaatttgac

SEQ ID NO: 135909 - DNA, 6 bp, Unknown
  misc_feature (1)..( 6): Result.003 file - promoters60/4767148
tatgct

SEQ ID NO: 135910 - DNA, 6 bp, Unknown
  misc_feature (1)..( 6): Result.003 file - promoters60/4767148
tatgct

SEQ ID NO: 135911 - DNA, 6 bp, Unknown
  misc_feature (1)..( 6): Result.003 file - promoters60/4767148
tatgaa

SEQ ID NO: 135912 - DNA, 6 bp, Unknown
  misc_feature (1)..( 6): Result.003 file - promoters60/4767148
tatgaa

SEQ ID NO: 135913 - DNA, 6 bp, Unknown
  misc_feature (1)..( 6): Result.003 file - promoters60/4767148
taaata

SEQ ID NO: 135914 - DNA, 6 bp, Unknown
  misc_feature (1)..( 6): Result.003 file - promoters60/4767148
taaata

SEQ ID NO: 135915 - DNA, 6 bp, Unknown
  misc_feature (1)..( 6): Result.003 file - promoters60/4767148
ttatta

SEQ ID NO: 135916 - DNA, 6 bp, Unknown
  misc_feature (1)..( 6): Result.003 file - promoters60/4767148
ttatta

SEQ ID NO: 135917 - DNA, 6 bp, Unknown
  misc_feature (1)..( 6): Result.003 file - promoters60/4767148
attata

SEQ ID NO: 135918 - DNA, 6 bp, Unknown
  misc_feature (1)..( 6): Result.003 file - promoters60/4767148
attata

SEQ ID NO: 135919 - DNA, 7 bp, Unknown
  misc_feature (1)..( 7): Result.003 file - promoters60/4767148
atagctt

SEQ ID NO: 135920 - DNA, 7 bp, Unknown
  misc_feature (1)..( 7): Result.003 file - promoters60/4767148
ataactt

SEQ ID NO: 135921 - DNA, 6 bp, Unknown
  misc_feature (1)..( 6): Result.003 file - promoters60/4767148
aaattt

SEQ ID NO: 135922 - DNA, 6 bp, Unknown
  misc_feature (1)..( 6): Result.003 file - promoters60/4767148
aaattt

SEQ ID NO: 135923 - DNA, 7 bp, Unknown
  misc_feature (1)..( 7): Result.003 file - promoters60/4767148
aaacagt

SEQ ID NO: 135924 - DNA, 7 bp, Unknown
  misc_feature (1)..( 7): Result.003 file - promoters60/4767148
aaaaagt

SEQ ID NO: 135925 - DNA, 8 bp, Unknown
  misc_feature (1)..( 8): Result.003 file - promoters60/4767148
gttttaaa

SEQ ID NO: 135926 - DNA, 8 bp, Unknown
  misc_feature (1)..( 8): Result.003 file - promoters60/4767148
gttttaaa

SEQ ID NO: 135927 - DNA, 7 bp, Unknown
  misc_feature (1)..( 7): Result.003 file - promoters60/4767195
aaaataa

SEQ ID NO: 135928 - DNA, 7 bp, Unknown
  misc_feature (1)..( 7): Result.003 file - promoters60/4767195
aaactaa

SEQ ID NO: 135929 - DNA, 7 bp, Unknown
  misc_feature (1)..( 7): Result.003 file - promoters60/4767195
atactaa

SEQ ID NO: 135930 - DNA, 7 bp, Unknown
  misc_feature (1)..( 7): Result.003 file - promoters60/4767195
atactaa

SEQ ID NO: 135931 - DNA, 10 bp, Unknown
  misc_feature (1)..( 10): Result.003 file - promoters60/4767195
ttctaaaatt

SEQ ID NO: 135932 - DNA, 10 bp, Unknown
  misc_feature (1)..( 10): Result.003 file - promoters60/4767195
ttctaatatt

SEQ ID NO: 135933 - DNA, 7 bp, Unknown
  misc_feature (1)..( 7): Result.003 file - promoters60/4767195
ttatttt

SEQ ID NO: 135934 - DNA, 7 bp, Unknown
  misc_feature (1)..( 7): Result.003 file - promoters60/4767195
ttaattt

SEQ ID NO: 135935 - DNA, 8 bp, Unknown
  misc_feature (1)..( 8): Result.003 file - promoters60/4767195
tctataag

SEQ ID NO: 135936 - DNA, 8 bp, Unknown
  misc_feature (1)..( 8): Result.003 file - promoters60/4767195
tctataag

SEQ ID NO: 135937 - DNA, 7 bp, Unknown
  misc_feature (1)..( 7): Result.003 file - promoters60/4767195
tgaagat

SEQ ID NO: 135938 - DNA, 7 bp, Unknown
  misc_feature (1)..( 7): Result.003 file - promoters60/4767195
tgaagaa

SEQ ID NO: 135939 - DNA, 7 bp, Unknown
  misc_feature (1)..( 7): Result.003 file - promoters60/4767195
agaagat

SEQ ID NO: 135940 - DNA, 6 bp, Unknown
  misc_feature (1)..( 6): Result.003 file - promoters60/4767195
aatttt

SEQ ID NO: 135941 - DNA, 6 bp, Unknown
  misc_feature (1)..( 6): Result.003 file - promoters60/4767195
aatttt

SEQ ID NO: 135942 - DNA, 8 bp, Unknown
  misc_feature (1)..( 8): Result.003 file - promoters60/4767195
tgggccta

SEQ ID NO: 135943 - DNA, 8 bp, Unknown
  misc_feature (1)..( 8): Result.003 file - promoters60/4767195
tgggccta

SEQ ID NO: 135944 - DNA, 6 bp, Unknown
  misc_feature (1)..( 6): Result.003 file - promoters60/4767195
gcattt

SEQ ID NO: 135945 - DNA, 6 bp, Unknown
  misc_feature (1)..( 6): Result.003 file - promoters60/4767195
gcattt

SEQ ID NO: 135946 - DNA, 6 bp, Unknown
  misc_feature (1)..( 6): Result.003 file - promoters60/4767195
gaattt

SEQ ID NO: 135947 - DNA, 6 bp, Unknown
  misc_feature (1)..( 6): Result.003 file - promoters60/4767195
gaattt

SEQ ID NO: 135948 - DNA, 7 bp, Unknown
  misc_feature (1)..( 7): Result.003 file - promoters60/4767195
tttctaa

SEQ ID NO: 135949 - DNA, 7 bp, Unknown
  misc_feature (1)..( 7): Result.003 file - promoters60/4767195
tttgtaa

SEQ ID NO: 135950 - DNA, 7 bp, Unknown
  misc_feature (1)..( 7): Result.003 file - promoters60/4767195
tttattt

SEQ ID NO: 135951 - DNA, 7 bp, Unknown
  misc_feature (1)..( 7): Result.003 file - promoters60/4767195
tttgttt

SEQ ID NO: 135952 - DNA, 6 bp, Unknown
  misc_feature (1)..( 6): Result.003 file - promoters60/4767195
acattt

SEQ ID NO: 135953 - DNA, 6 bp, Unknown
  misc_feature (1)..( 6): Result.003 file - promoters60/4767195
acattt

SEQ ID NO: 135954 - DNA, 6 bp, Unknown
  misc_feature (1)..( 6): Result.003 file - promoters60/4767195
cacatg

SEQ ID NO: 135955 - DNA, 6 bp, Unknown
  misc_feature (1)..( 6): Result.003 file - promoters60/4767195
cacatg

SEQ ID NO: 135956 - DNA, 6 bp, Unknown
  misc_feature (1)..( 6): Result.003 file - promoters60/4767195
gagatt

SEQ ID NO: 135957 - DNA, 6 bp, Unknown
  misc_feature (1)..( 6): Result.003 file - promoters60/4767195
gagatt

SEQ ID NO: 135958 - DNA, 6 bp, Unknown
  misc_feature (1)..( 6): Result.003 file - promoters60/4767195
ttgggt

SEQ ID NO: 135959 - DNA, 6 bp, Unknown
  misc_feature (1)..( 6): Result.003 file - promoters60/4767195
ttgggt

SEQ ID NO: 135960 - DNA, 6 bp, Unknown
  misc_feature (1)..( 6): Result.003 file - promoters60/4767195
agatga

SEQ ID NO: 135961 - DNA, 6 bp, Unknown
  misc_feature (1)..( 6): Result.003 file - promoters60/4767195
agatga

SEQ ID NO: 135962 - DNA, 9 bp, Unknown
  misc_feature (1)..( 9): Result.003 file - promoters60/4767195
ggttaatgg

SEQ ID NO: 135963 - DNA, 9 bp, Unknown
  misc_feature (1)..( 9): Result.003 file - promoters60/4767195
ggtttatgg

SEQ ID NO: 135964 - DNA, 10 bp, Unknown
  misc_feature (1)..( 10): Result.003 file - promoters60/4767298
tatttcattt

SEQ ID NO: 135965 - DNA, 10 bp, Unknown
  misc_feature (1)..( 10): Result.003 file - promoters60/4767298
tatatcacaa

SEQ ID NO: 135966 - DNA, 10 bp, Unknown
  misc_feature (1)..( 10): Result.003 file - promoters60/4767298
tatttccttc

SEQ ID NO: 135967 - DNA, 10 bp, Unknown
  misc_feature (1)..( 10): Result.003 file - promoters60/4767298
tatgtcacta

SEQ ID NO: 135968 - DNA, 10 bp, Unknown
  misc_feature (1)..( 10): Result.003 file - promoters60/4767298
aatatcaata

SEQ ID NO: 135969 - DNA, 10 bp, Unknown
  misc_feature (1)..( 10): Result.003 file - promoters60/4767298
aatctcaata

SEQ ID NO: 135970 - DNA, 11 bp, Unknown
  misc_feature (1)..( 11): Result.003 file - promoters60/4767298
tcctaaaatca

SEQ ID NO: 135971 - DNA, 11 bp, Unknown
  misc_feature (1)..( 11): Result.003 file - promoters60/4767298
ttttaaaatat

SEQ ID NO: 135972 - DNA, 11 bp, Unknown
  misc_feature (1)..( 11): Result.003 file - promoters60/4767298
cattaaaatat

SEQ ID NO: 135973 - DNA, 11 bp, Unknown
  misc_feature (1)..( 11): Result.003 file - promoters60/4767298
tcctaaaatag

SEQ ID NO: 135974 - DNA, 11 bp, Unknown
  misc_feature (1)..( 11): Result.003 file - promoters60/4767298
atgaaaaataa

SEQ ID NO: 135975 - DNA, 11 bp, Unknown
  misc_feature (1)..( 11): Result.003 file - promoters60/4767298
atctaatatat

SEQ ID NO: 135976 - DNA, 13 bp, Unknown
  misc_feature (1)..( 13): Result.003 file - promoters60/4767298
gacattataaaat

SEQ ID NO: 135977 - DNA, 13 bp, Unknown
  misc_feature (1)..( 13): Result.003 file - promoters60/4767298
ctttttataatca

SEQ ID NO: 135978 - DNA, 13 bp, Unknown
  misc_feature (1)..( 13): Result.003 file - promoters60/4767298
tgaattctaaaat

SEQ ID NO: 135979 - DNA, 13 bp, Unknown
  misc_feature (1)..( 13): Result.003 file - promoters60/4767298
ctttttttaacaa

SEQ ID NO: 135980 - DNA, 13 bp, Unknown
  misc_feature (1)..( 13): Result.003 file - promoters60/4767298
tgtcttttatcaa

SEQ ID NO: 135981 - DNA, 13 bp, Unknown
  misc_feature (1)..( 13): Result.003 file - promoters60/4767298
aatcttttgacag

SEQ ID NO: 135982 - DNA, 7 bp, Unknown
  misc_feature (1)..( 7): Result.003 file - promoters60/4767318
aaattat

SEQ ID NO: 135983 - DNA, 7 bp, Unknown
  misc_feature (1)..( 7): Result.003 file - promoters60/4767318
aaaatat

SEQ ID NO: 135984 - DNA, 7 bp, Unknown
  misc_feature (1)..( 7): Result.003 file - promoters60/4767318
agagtaa

SEQ ID NO: 135985 - DNA, 7 bp, Unknown
  misc_feature (1)..( 7): Result.003 file - promoters60/4767318
agattaa

SEQ ID NO: 135986 - DNA, 7 bp, Unknown
  misc_feature (1)..( 7): Result.003 file - promoters60/4767318
aaagact

SEQ ID NO: 135987 - DNA, 7 bp, Unknown
  misc_feature (1)..( 7): Result.003 file - promoters60/4767318
aaatact

SEQ ID NO: 135988 - DNA, 13 bp, Unknown
  misc_feature (1)..( 13): Result.003 file - promoters60/4767318
tttagttttcctt

SEQ ID NO: 135989 - DNA, 13 bp, Unknown
  misc_feature (1)..( 13): Result.003 file - promoters60/4767318
ttttgttttcctt

SEQ ID NO: 135990 - DNA, 10 bp, Unknown
  misc_feature (1)..( 10): Result.003 file - promoters60/4767318
aaatacacaa

SEQ ID NO: 135991 - DNA, 10 bp, Unknown
  misc_feature (1)..( 10): Result.003 file - promoters60/4767318
aaaaacacaa

SEQ ID NO: 135992 - DNA, 10 bp, Unknown
  misc_feature (1)..( 10): Result.003 file - promoters60/4767318
aaacacacgc

SEQ ID NO: 135993 - DNA, 8 bp, Unknown
  misc_feature (1)..( 8): Result.003 file - promoters60/4767318
tgttattt

SEQ ID NO: 135994 - DNA, 8 bp, Unknown
  misc_feature (1)..( 8): Result.003 file - promoters60/4767318
tgtaattt

SEQ ID NO: 135995 - DNA, 7 bp, Unknown
  misc_feature (1)..( 7): Result.003 file - promoters60/4767318
cttaaac

SEQ ID NO: 135996 - DNA, 7 bp, Unknown
  misc_feature (1)..( 7): Result.003 file - promoters60/4767318
cttcaac

SEQ ID NO: 135997 - DNA, 6 bp, Unknown
  misc_feature (1)..( 6): Result.003 file - promoters60/4767318
cattaa

SEQ ID NO: 135998 - DNA, 6 bp, Unknown
  misc_feature (1)..( 6): Result.003 file - promoters60/4767318
cattaa

SEQ ID NO: 135999 - DNA, 6 bp, Unknown
  misc_feature (1)..( 6): Result.003 file - promoters60/4767318
ctaaaa

SEQ ID NO: 136000 - DNA, 6 bp, Unknown
  misc_feature (1)..( 6): Result.003 file - promoters60/4767318
ctaaaa

SEQ ID NO: 136001 - DNA, 6 bp, Unknown
  misc_feature (1)..( 6): Result.003 file - promoters60/4767318
gtattt

SEQ ID NO: 136002 - DNA, 6 bp, Unknown
  misc_feature (1)..( 6): Result.003 file - promoters60/4767318
gtattt

SEQ ID NO: 136003 - DNA, 7 bp, Unknown
  misc_feature (1)..( 7): Result.003 file - promoters60/4767318
ttataaa

SEQ ID NO: 136004 - DNA, 7 bp, Unknown
  misc_feature (1)..( 7): Result.003 file - promoters60/4767318
ttataaa

SEQ ID NO: 136005 - DNA, 8 bp, Unknown
  misc_feature (1)..( 8): Result.003 file - promoters60/4767318
cttctctt

SEQ ID NO: 136006 - DNA, 8 bp, Unknown
  misc_feature (1)..( 8): Result.003 file - promoters60/4767318
cttttctt

SEQ ID NO: 136007 - DNA, 9 bp, Unknown
  misc_feature (1)..( 9): Result.003 file - promoters60/4767318
tttaattag

SEQ ID NO: 136008 - DNA, 9 bp, Unknown
  misc_feature (1)..( 9): Result.003 file - promoters60/4767318
tttacttaa

SEQ ID NO: 136009 - DNA, 9 bp, Unknown
  misc_feature (1)..( 9): Result.003 file - promoters60/4767318
ttttcttaa

SEQ ID NO: 136010 - DNA, 6 bp, Unknown
  misc_feature (1)..( 6): Result.003 file - promoters60/4767318
cttgtt

SEQ ID NO: 136011 - DNA, 6 bp, Unknown
  misc_feature (1)..( 6): Result.003 file - promoters60/4767318
cttgtt

SEQ ID NO: 136012 - DNA, 8 bp, Unknown
  misc_feature (1)..( 8): Result.003 file - promoters60/4767318
acaagatt

SEQ ID NO: 136013 - DNA, 8 bp, Unknown
  misc_feature (1)..( 8): Result.003 file - promoters60/4767318
acatgatt

SEQ ID NO: 136014 - DNA, 7 bp, Unknown
  misc_feature (1)..( 7): Result.003 file - promoters60/4767318
tacgttt

SEQ ID NO: 136015 - DNA, 7 bp, Unknown
  misc_feature (1)..( 7): Result.003 file - promoters60/4767318
tactttt

SEQ ID NO: 136016 - DNA, 7 bp, Unknown
  misc_feature (1)..( 7): Result.003 file - promoters60/4767318
taagtta

SEQ ID NO: 136017 - DNA, 7 bp, Unknown
  misc_feature (1)..( 7): Result.003 file - promoters60/4767318
taaatta

SEQ ID NO: 136018 - DNA, 8 bp, Unknown
  misc_feature (1)..( 8): Result.003 file - promoters60/4767318
gaaactaa

SEQ ID NO: 136019 - DNA, 8 bp, Unknown
  misc_feature (1)..( 8): Result.003 file - promoters60/4767318
gaatctaa

SEQ ID NO: 136020 - DNA, 8 bp, Unknown
  misc_feature (1)..( 8): Result.003 file - promoters60/4767318
gtcttcat

SEQ ID NO: 136021 - DNA, 8 bp, Unknown
  misc_feature (1)..( 8): Result.003 file - promoters60/4767318
gtcttcat

SEQ ID NO: 136022 - DNA, 6 bp, Unknown
  misc_feature (1)..( 6): Result.003 file - promoters60/4767318
ttatta

SEQ ID NO: 136023 - DNA, 6 bp, Unknown
  misc_feature (1)..( 6): Result.003 file - promoters60/4767318
ttatta

SEQ ID NO: 136024 - DNA, 7 bp, Unknown
  misc_feature (1)..( 7): Result.003 file - promoters60/4767318
ttaatat

SEQ ID NO: 136025 - DNA, 7 bp, Unknown
  misc_feature (1)..( 7): Result.003 file - promoters60/4767318
ttattat

SEQ ID NO: 136026 - DNA, 7 bp, Unknown
  misc_feature (1)..( 7): Result.003 file - promoters60/4767318
acaaaat

SEQ ID NO: 136027 - DNA, 7 bp, Unknown
  misc_feature (1)..( 7): Result.003 file - promoters60/4767318
acaaaat

SEQ ID NO: 136028 - DNA, 11 bp, Unknown
  misc_feature (1)..( 11): Result.003 file - promoters60/4767330
aacatttcctt

SEQ ID NO: 136029 - DNA, 11 bp, Unknown
  misc_feature (1)..( 11): Result.003 file - promoters60/4767330
aacatttcttt

SEQ ID NO: 136030 - DNA, 11 bp, Unknown
  misc_feature (1)..( 11): Result.003 file - promoters60/4767330
ataatttattt

SEQ ID NO: 136031 - DNA, 6 bp, Unknown
  misc_feature (1)..( 6): Result.003 file - promoters60/4767330
tttgtt

SEQ ID NO: 136032 - DNA, 6 bp, Unknown
  misc_feature (1)..( 6): Result.003 file - promoters60/4767330
tttgtt

SEQ ID NO: 136033 - DNA, 11 bp, Unknown
  misc_feature (1)..( 11): Result.003 file - promoters60/4767330
atttttgtttg

SEQ ID NO: 136034 - DNA, 11 bp, Unknown
  misc_feature (1)..( 11): Result.003 file - promoters60/4767330
atttctgtttg

SEQ ID NO: 136035 - DNA, 7 bp, Unknown
  misc_feature (1)..( 7): Result.003 file - promoters60/4767330
aaagaac

SEQ ID NO: 136036 - DNA, 7 bp, Unknown
  misc_feature (1)..( 7): Result.003 file - promoters60/4767330
aaataac

SEQ ID NO: 136037 - DNA, 6 bp, Unknown
  misc_feature (1)..( 6): Result.003 file - promoters60/4767330
ttaatt

SEQ ID NO: 136038 - DNA, 6 bp, Unknown
  misc_feature (1)..( 6): Result.003 file - promoters60/4767330
ttaatt

SEQ ID NO: 136039 - DNA, 6 bp, Unknown
  misc_feature (1)..( 6): Result.003 file - promoters60/4767330
acaaat

SEQ ID NO: 136040 - DNA, 6 bp, Unknown
  misc_feature (1)..( 6): Result.003 file - promoters60/4767330
acaaat

SEQ ID NO: 136041 - DNA, 7 bp, Unknown
  misc_feature (1)..( 7): Result.003 file - promoters60/4767330
agtttat

SEQ ID NO: 136042 - DNA, 7 bp, Unknown
  misc_feature (1)..( 7): Result.003 file - promoters60/4767330
agtatat

SEQ ID NO: 136043 - DNA, 7 bp, Unknown
  misc_feature (1)..( 7): Result.003 file - promoters60/4767330
tattttt

SEQ ID NO: 136044 - DNA, 7 bp, Unknown
  misc_feature (1)..( 7): Result.003 file - promoters60/4767330
tatattt

SEQ ID NO: 136045 - DNA, 6 bp, Unknown
  misc_feature (1)..( 6): Result.003 file - promoters60/4767330
ttttct

SEQ ID NO: 136046 - DNA, 6 bp, Unknown
  misc_feature (1)..( 6): Result.003 file - promoters60/4767330
ttttct

SEQ ID NO: 136047 - DNA, 8 bp, Unknown
  misc_feature (1)..( 8): Result.003 file - promoters60/4767330
caattatt

SEQ ID NO: 136048 - DNA, 8 bp, Unknown
  misc_feature (1)..( 8): Result.003 file - promoters60/4767330
caattatt

SEQ ID NO: 136049 - DNA, 8 bp, Unknown
  misc_feature (1)..( 8): Result.003 file - promoters60/4767330
caattttt

SEQ ID NO: 136050 - DNA, 8 bp, Unknown
  misc_feature (1)..( 8): Result.003 file - promoters60/4767330
caatattt

SEQ ID NO: 136051 - DNA, 8 bp, Unknown
  misc_feature (1)..( 8): Result.003 file - promoters60/4767330
cgatattt

SEQ ID NO: 136052 - DNA, 6 bp, Unknown
  misc_feature (1)..( 6): Result.003 file - promoters60/4767330
taatta

SEQ ID NO: 136053 - DNA, 6 bp, Unknown
  misc_feature (1)..( 6): Result.003 file - promoters60/4767330
taatta

SEQ ID NO: 136054 - DNA, 8 bp, Unknown
  misc_feature (1)..( 8): Result.003 file - promoters60/4767330
tttagatt

SEQ ID NO: 136055 - DNA, 8 bp, Unknown
  misc_feature (1)..( 8): Result.003 file - promoters60/4767330
tttatatt

SEQ ID NO: 136056 - DNA, 6 bp, Unknown
  misc_feature (1)..( 6): Result.003 file - promoters60/4767330
ataata

SEQ ID NO: 136057 - DNA, 6 bp, Unknown
  misc_feature (1)..( 6): Result.003 file - promoters60/4767330
ataata

SEQ ID NO: 136058 - DNA, 6 bp, Unknown
  misc_feature (1)..( 6): Result.003 file - promoters60/4767330
attttt

SEQ ID NO: 136059 - DNA, 6 bp, Unknown
  misc_feature (1)..( 6): Result.003 file - promoters60/4767330
attttt

SEQ ID NO: 136060 - DNA, 6 bp, Unknown
  misc_feature (1)..( 6): Result.003 file - promoters60/4767330
aataaa

SEQ ID NO: 136061 - DNA, 6 bp, Unknown
  misc_feature (1)..( 6): Result.003 file - promoters60/4767330
aataaa

SEQ ID NO: 136062 - DNA, 6 bp, Unknown
  misc_feature (1)..( 6): Result.003 file - promoters60/4767330
aaattt

SEQ ID NO: 136063 - DNA, 6 bp, Unknown
  misc_feature (1)..( 6): Result.003 file - promoters60/4767330
aaattt

SEQ ID NO: 136064 - DNA, 10 bp, Unknown
  misc_feature (1)..( 10): Result.003 file - promoters60/4767330
ccccaaaacc

SEQ ID NO: 136065 - DNA, 10 bp, Unknown
  misc_feature (1)..( 10): Result.003 file - promoters60/4767330
ccctaaaacc

SEQ ID NO: 136066 - DNA, 7 bp, Unknown
  misc_feature (1)..( 7): Result.003 file - promoters60/4767330
aaacgta

SEQ ID NO: 136067 - DNA, 7 bp, Unknown
  misc_feature (1)..( 7): Result.003 file - promoters60/4767330
aaatgta

SEQ ID NO: 136068 - DNA, 9 bp, Unknown
  misc_feature (1)..( 9): Result.003 file - promoters60/4767330
aatatgttt

SEQ ID NO: 136069 - DNA, 9 bp, Unknown
  misc_feature (1)..( 9): Result.003 file - promoters60/4767330
aatatattt

SEQ ID NO: 136070 - DNA, 8 bp, Unknown
  misc_feature (1)..( 8): Result.003 file - promoters60/4767330
taaaataa

SEQ ID NO: 136071 - DNA, 8 bp, Unknown
  misc_feature (1)..( 8): Result.003 file - promoters60/4767330
taaaataa

SEQ ID NO: 136072 - DNA, 7 bp, Unknown
  misc_feature (1)..( 7): Result.003 file - promoters60/4767330
aaacaat

SEQ ID NO: 136073 - DNA, 7 bp, Unknown
  misc_feature (1)..( 7): Result.003 file - promoters60/4767330
aaaaaat

SEQ ID NO: 136074 - DNA, 8 bp, Unknown
  misc_feature (1)..( 8): Result.003 file - promoters60/4767330
tttcaata

SEQ ID NO: 136075 - DNA, 8 bp, Unknown
  misc_feature (1)..( 8): Result.003 file - promoters60/4767330
tttcaata

SEQ ID NO: 136076 - DNA, 6 bp, Unknown
  misc_feature (1)..( 6): Result.003 file - promoters60/4767333
gacaaa

SEQ ID NO: 136077 - DNA, 6 bp, Unknown
  misc_feature (1)..( 6): Result.003 file - promoters60/4767333
gacaaa

SEQ ID NO: 136078 - DNA, 7 bp, Unknown
  misc_feature (1)..( 7): Result.003 file - promoters60/4767333
tttcttt

SEQ ID NO: 136079 - DNA, 7 bp, Unknown
  misc_feature (1)..( 7): Result.003 file - promoters60/4767333
tttgttt

SEQ ID NO: 136080 - DNA, 10 bp, Unknown
  misc_feature (1)..( 10): Result.003 file - promoters60/4767333
atcaaaaaag

SEQ ID NO: 136081 - DNA, 10 bp, Unknown
  misc_feature (1)..( 10): Result.003 file - promoters60/4767333
atcgaaatta

SEQ ID NO: 136082 - DNA, 10 bp, Unknown
  misc_feature (1)..( 10): Result.003 file - promoters60/4767333
cgcgaaacga

SEQ ID NO: 136083 - DNA, 8 bp, Unknown
  misc_feature (1)..( 8): Result.003 file - promoters60/4767333
aaacataa

SEQ ID NO: 136084 - DNA, 8 bp, Unknown
  misc_feature (1)..( 8): Result.003 file - promoters60/4767333
aaacgtaa

SEQ ID NO: 136085 - DNA, 6 bp, Unknown
  misc_feature (1)..( 6): Result.003 file - promoters60/4767333
gaaaat

SEQ ID NO: 136086 - DNA, 6 bp, Unknown
  misc_feature (1)..( 6): Result.003 file - promoters60/4767333
gaaaat

SEQ ID NO: 136087 - DNA, 6 bp, Unknown
  misc_feature (1)..( 6): Result.003 file - promoters60/4767333
aggtct

SEQ ID NO: 136088 - DNA, 6 bp, Unknown
  misc_feature (1)..( 6): Result.003 file - promoters60/4767333
aggtct

SEQ ID NO: 136089 - DNA, 7 bp, Unknown
  misc_feature (1)..( 7): Result.003 file - promoters60/4767333
ggtttct

SEQ ID NO: 136090 - DNA, 7 bp, Unknown
  misc_feature (1)..( 7): Result.003 file - promoters60/4767333
ggtttct

SEQ ID NO: 136091 - DNA, 6 bp, Unknown
  misc_feature (1)..( 6): Result.003 file - promoters60/4767333
agtttt

SEQ ID NO: 136092 - DNA, 6 bp, Unknown
  misc_feature (1)..( 6): Result.003 file - promoters60/4767333
agtttt

SEQ ID NO: 136093 - DNA, 7 bp, Unknown
  misc_feature (1)..( 7): Result.003 file - promoters60/4767333
taaaatc

SEQ ID NO: 136094 - DNA, 7 bp, Unknown
  misc_feature (1)..( 7): Result.003 file - promoters60/4767333
taagatc

SEQ ID NO: 136095 - DNA, 7 bp, Unknown
  misc_feature (1)..( 7): Result.003 file - promoters60/4767333
aaaccct

SEQ ID NO: 136096 - DNA, 7 bp, Unknown
  misc_feature (1)..( 7): Result.003 file - promoters60/4767333
aaaacct

SEQ ID NO: 136097 - DNA, 6 bp, Unknown
  misc_feature (1)..( 6): Result.003 file - promoters60/4767333
accatt

SEQ ID NO: 136098 - DNA, 6 bp, Unknown
  misc_feature (1)..( 6): Result.003 file - promoters60/4767333
accatt

SEQ ID NO: 136099 - DNA, 9 bp, Unknown
  misc_feature (1)..( 9): Result.003 file - promoters60/4767379
aaaaataaa

SEQ ID NO: 136100 - DNA, 9 bp, Unknown
  misc_feature (1)..( 9): Result.003 file - promoters60/4767379
aaaaatata

SEQ ID NO: 136101 - DNA, 9 bp, Unknown
  misc_feature (1)..( 9): Result.003 file - promoters60/4767379
aaaattaat

SEQ ID NO: 136102 - DNA, 9 bp, Unknown
  misc_feature (1)..( 9): Result.003 file - promoters60/4767379
taaaataca

SEQ ID NO: 136103 - DNA, 9 bp, Unknown
  misc_feature (1)..( 9): Result.003 file - promoters60/4767379
gataatatt

SEQ ID NO: 136104 - DNA, 9 bp, Unknown
  misc_feature (1)..( 9): Result.003 file - promoters60/4767379
aatattatt

SEQ ID NO: 136105 - DNA, 9 bp, Unknown
  misc_feature (1)..( 9): Result.003 file - promoters60/4767379
aataaaagc

SEQ ID NO: 136106 - DNA, 9 bp, Unknown
  misc_feature (1)..( 9): Result.003 file - promoters60/4767379
tataaaaaa

SEQ ID NO: 136107 - DNA, 9 bp, Unknown
  misc_feature (1)..( 9): Result.003 file - promoters60/4767379
aataaaatt

SEQ ID NO: 136108 - DNA, 9 bp, Unknown
  misc_feature (1)..( 9): Result.003 file - promoters60/4767379
tataaaata

SEQ ID NO: 136109 - DNA, 9 bp, Unknown
  misc_feature (1)..( 9): Result.003 file - promoters60/4767379
gataatatt

SEQ ID NO: 136110 - DNA, 9 bp, Unknown
  misc_feature (1)..( 9): Result.003 file - promoters60/4767379
aatattatt

SEQ ID NO: 136111 - DNA, 12 bp, Unknown
  misc_feature (1)..( 12): Result.003 file - promoters60/4767379
tgaaaaacaaac

SEQ ID NO: 136112 - DNA, 12 bp, Unknown
  misc_feature (1)..( 12): Result.003 file - promoters60/4767379
tgaaaaaaaaaa

SEQ ID NO: 136113 - DNA, 12 bp, Unknown
  misc_feature (1)..( 12): Result.003 file - promoters60/4767379
ctataaataaat

SEQ ID NO: 136114 - DNA, 12 bp, Unknown
  misc_feature (1)..( 12): Result.003 file - promoters60/4767379
agtcaaacaaat

SEQ ID NO: 136115 - DNA, 12 bp, Unknown
  misc_feature (1)..( 12): Result.003 file - promoters60/4767379
gtttaatgaaat

SEQ ID NO: 136116 - DNA, 12 bp, Unknown
  misc_feature (1)..( 12): Result.003 file - promoters60/4767379
tgtgaaacaaat

SEQ ID NO: 136117 - DNA, 12 bp, Unknown
  misc_feature (1)..( 12): Result.003 file - promoters60/4767379
ctggtcataaat

SEQ ID NO: 136118 - DNA, 10 bp, Unknown
  misc_feature (1)..( 10): Result.003 file - promoters60/4767379
gtttgtttaa

SEQ ID NO: 136119 - DNA, 10 bp, Unknown
  misc_feature (1)..( 10): Result.003 file - promoters60/4767379
ataggtttaa

SEQ ID NO: 136120 - DNA, 10 bp, Unknown
  misc_feature (1)..( 10): Result.003 file - promoters60/4767379
atttctttaa

SEQ ID NO: 136121 - DNA, 10 bp, Unknown
  misc_feature (1)..( 10): Result.003 file - promoters60/4767379
ttttgtttct

SEQ ID NO: 136122 - DNA, 10 bp, Unknown
  misc_feature (1)..( 10): Result.003 file - promoters60/4767379
ctttttttgc

SEQ ID NO: 136123 - DNA, 10 bp, Unknown
  misc_feature (1)..( 10): Result.003 file - promoters60/4767379
ttttgtactc

SEQ ID NO: 136124 - DNA, 11 bp, Unknown
  misc_feature (1)..( 11): Result.003 file - promoters60/4767379
cattatatata

SEQ ID NO: 136125 - DNA, 11 bp, Unknown
  misc_feature (1)..( 11): Result.003 file - promoters60/4767379
acatatataaa

SEQ ID NO: 136126 - DNA, 11 bp, Unknown
  misc_feature (1)..( 11): Result.003 file - promoters60/4767379
gcctatatata

SEQ ID NO: 136127 - DNA, 11 bp, Unknown
  misc_feature (1)..( 11): Result.003 file - promoters60/4767379
ccttataaata

SEQ ID NO: 136128 - DNA, 11 bp, Unknown
  misc_feature (1)..( 11): Result.003 file - promoters60/4767379
ccttaaaaacc

SEQ ID NO: 136129 - DNA, 11 bp, Unknown
  misc_feature (1)..( 11): Result.003 file - promoters60/4767379
ccttaaaaaga

SEQ ID NO: 136130 - DNA, 12 bp, Unknown
  misc_feature (1)..( 12): Result.003 file - promoters60/4767379
attacaaaacta

SEQ ID NO: 136131 - DNA, 12 bp, Unknown
  misc_feature (1)..( 12): Result.003 file - promoters60/4767379
tatacaaaaaaa

SEQ ID NO: 136132 - DNA, 12 bp, Unknown
  misc_feature (1)..( 12): Result.003 file - promoters60/4767379
ttgacaaataaa

SEQ ID NO: 136133 - DNA, 12 bp, Unknown
  misc_feature (1)..( 12): Result.003 file - promoters60/4767379
tatacaagaaca

SEQ ID NO: 136134 - DNA, 10 bp, Unknown
  misc_feature (1)..( 10): Result.003 file - promoters60/4767379
tgaaaaaacg

SEQ ID NO: 136135 - DNA, 12 bp, Unknown
  misc_feature (1)..( 12): Result.003 file - promoters60/4767379
ggaacaaaggag

SEQ ID NO: 136136 - DNA, 10 bp, Unknown
  misc_feature (1)..( 10): Result.003 file - promoters60/4767379
atattattag

SEQ ID NO: 136137 - DNA, 10 bp, Unknown
  misc_feature (1)..( 10): Result.003 file - promoters60/4767379
atattattag

SEQ ID NO: 136138 - DNA, 10 bp, Unknown
  misc_feature (1)..( 10): Result.003 file - promoters60/4767379
ttattatatt

SEQ ID NO: 136139 - DNA, 10 bp, Unknown
  misc_feature (1)..( 10): Result.003 file - promoters60/4767379
atataattat

SEQ ID NO: 136140 - DNA, 10 bp, Unknown
  misc_feature (1)..( 10): Result.003 file - promoters60/4767379
aaattattta

SEQ ID NO: 136141 - DNA, 10 bp, Unknown
  misc_feature (1)..( 10): Result.003 file - promoters60/4767379
atacaatgaa

SEQ ID NO: 136142 - DNA, 10 bp, Unknown
  misc_feature (1)..( 10): Result.003 file - promoters60/4767379
aattaaaatc

SEQ ID NO: 136143 - DNA, 10 bp, Unknown
  misc_feature (1)..( 10): Result.003 file - promoters60/4767379
cgttaaaaat

SEQ ID NO: 136144 - DNA, 10 bp, Unknown
  misc_feature (1)..( 10): Result.003 file - promoters60/4767379
taataaaaaa

SEQ ID NO: 136145 - DNA, 10 bp, Unknown
  misc_feature (1)..( 10): Result.003 file - promoters60/4767379
ccagaaaaaa

SEQ ID NO: 136146 - DNA, 10 bp, Unknown
  misc_feature (1)..( 10): Result.003 file - promoters60/4767379
gaacaaatgt

SEQ ID NO: 136147 - DNA, 11 bp, Unknown
  misc_feature (1)..( 11): Result.003 file - promoters60/4767379
tttcaaagaaa

SEQ ID NO: 136148 - DNA, 13 bp, Unknown
  misc_feature (1)..( 13): Result.003 file - promoters60/4767379
ttgagtctaaaga

SEQ ID NO: 136149 - DNA, 13 bp, Unknown
  misc_feature (1)..( 13): Result.003 file - promoters60/4767379
aaaagtccaaaat

SEQ ID NO: 136150 - DNA, 13 bp, Unknown
  misc_feature (1)..( 13): Result.003 file - promoters60/4767379
tttggtcaaaacg

SEQ ID NO: 136151 - DNA, 13 bp, Unknown
  misc_feature (1)..( 13): Result.003 file - promoters60/4767379
ttgactctcttct

SEQ ID NO: 136152 - DNA, 13 bp, Unknown
  misc_feature (1)..( 13): Result.003 file - promoters60/4767379
cctaatccaaaat

SEQ ID NO: 136153 - DNA, 13 bp, Unknown
  misc_feature (1)..( 13): Result.003 file - promoters60/4767379
ttcactccaaaga

SEQ ID NO: 136154 - DNA, 9 bp, Unknown
  misc_feature (1)..( 9): Result.003 file - promoters60/4767379
caaaatgaa

SEQ ID NO: 136155 - DNA, 9 bp, Unknown
  misc_feature (1)..( 9): Result.003 file - promoters60/4767379
aaaaaagaa

SEQ ID NO: 136156 - DNA, 9 bp, Unknown
  misc_feature (1)..( 9): Result.003 file - promoters60/4767379
gaaaaaaaa

SEQ ID NO: 136157 - DNA, 9 bp, Unknown
  misc_feature (1)..( 9): Result.003 file - promoters60/4767379
ataaataaa

SEQ ID NO: 136158 - DNA, 9 bp, Unknown
  misc_feature (1)..( 9): Result.003 file - promoters60/4767379
ataaatgta

SEQ ID NO: 136159 - DNA, 9 bp, Unknown
  misc_feature (1)..( 9): Result.003 file - promoters60/4767379
tcaaacaaa

SEQ ID NO: 136160 - DNA, 10 bp, Unknown
  misc_feature (1)..( 10): Result.003 file - promoters60/4767379
tttctttttg

SEQ ID NO: 136161 - DNA, 10 bp, Unknown
  misc_feature (1)..( 10): Result.003 file - promoters60/4767379
taaatttttg

SEQ ID NO: 136162 - DNA, 10 bp, Unknown
  misc_feature (1)..( 10): Result.003 file - promoters60/4767379
ttcattttaa

SEQ ID NO: 136163 - DNA, 10 bp, Unknown
  misc_feature (1)..( 10): Result.003 file - promoters60/4767379
ttaatcttta

SEQ ID NO: 136164 - DNA, 10 bp, Unknown
  misc_feature (1)..( 10): Result.003 file - promoters60/4767379
caaatgtttg

SEQ ID NO: 136165 - DNA, 10 bp, Unknown
  misc_feature (1)..( 10): Result.003 file - promoters60/4767379
tggatctttt

SEQ ID NO: 136166 - DNA, 14 bp, Unknown
  misc_feature (1)..( 14): Result.003 file - promoters60/4767379
ctttaacagctagc

SEQ ID NO: 136167 - DNA, 14 bp, Unknown
  misc_feature (1)..( 14): Result.003 file - promoters60/4767379
gaataaaagctcaa

SEQ ID NO: 136168 - DNA, 14 bp, Unknown
  misc_feature (1)..( 14): Result.003 file - promoters60/4767379
cacaaacagcagac

SEQ ID NO: 136169 - DNA, 14 bp, Unknown
  misc_feature (1)..( 14): Result.003 file - promoters60/4767379
aggtaacagttttc

SEQ ID NO: 136170 - DNA, 14 bp, Unknown
  misc_feature (1)..( 14): Result.003 file - promoters60/4767379
aattaaaaaggaag

SEQ ID NO: 136171 - DNA, 14 bp, Unknown
  misc_feature (1)..( 14): Result.003 file - promoters60/4767379
acattaaagcccaa

SEQ ID NO: 136172 - DNA, 11 bp, Unknown
  misc_feature (1)..( 11): Result.003 file - promoters60/4767379
accaaaaaaga

SEQ ID NO: 136173 - DNA, 11 bp, Unknown
  misc_feature (1)..( 11): Result.003 file - promoters60/4767379
agttaaaaagt

SEQ ID NO: 136174 - DNA, 11 bp, Unknown
  misc_feature (1)..( 11): Result.003 file - promoters60/4767379
atcgaaataga

SEQ ID NO: 136175 - DNA, 11 bp, Unknown
  misc_feature (1)..( 11): Result.003 file - promoters60/4767379
agttaaaaaat

SEQ ID NO: 136176 - DNA, 11 bp, Unknown
  misc_feature (1)..( 11): Result.003 file - promoters60/4767379
atttacaaaca

SEQ ID NO: 136177 - DNA, 11 bp, Unknown
  misc_feature (1)..( 11): Result.003 file - promoters60/4767379
ctttacaacca

SEQ ID NO: 136178 - DNA, 8 bp, Unknown
  misc_feature (1)..( 8): Result.003 file - promoters60/4767402
acaaaatc

SEQ ID NO: 136179 - DNA, 8 bp, Unknown
  misc_feature (1)..( 8): Result.003 file - promoters60/4767402
acataatt

SEQ ID NO: 136180 - DNA, 8 bp, Unknown
  misc_feature (1)..( 8): Result.003 file - promoters60/4767402
aaataaaa

SEQ ID NO: 136181 - DNA, 9 bp, Unknown
  misc_feature (1)..( 9): Result.003 file - promoters60/4767402
tattttatt

SEQ ID NO: 136182 - DNA, 9 bp, Unknown
  misc_feature (1)..( 9): Result.003 file - promoters60/4767402
gattttatt

SEQ ID NO: 136183 - DNA, 9 bp, Unknown
  misc_feature (1)..( 9): Result.003 file - promoters60/4767402
ttttttaaa

SEQ ID NO: 136184 - DNA, 9 bp, Unknown
  misc_feature (1)..( 9): Result.003 file - promoters60/4767402
ctttttcca

SEQ ID NO: 136185 - DNA, 9 bp, Unknown
  misc_feature (1)..( 9): Result.003 file - promoters60/4767402
ctttttatt

SEQ ID NO: 136186 - DNA, 9 bp, Unknown
  misc_feature (1)..( 9): Result.003 file - promoters60/4767402
ttttttttt

SEQ ID NO: 136187 - DNA, 9 bp, Unknown
  misc_feature (1)..( 9): Result.003 file - promoters60/4767402
atttgtttt

SEQ ID NO: 136188 - DNA, 8 bp, Unknown
  misc_feature (1)..( 8): Result.003 file - promoters60/4767402
tctttcaa

SEQ ID NO: 136189 - DNA, 8 bp, Unknown
  misc_feature (1)..( 8): Result.003 file - promoters60/4767402
tctgtcac

SEQ ID NO: 136190 - DNA, 8 bp, Unknown
  misc_feature (1)..( 8): Result.003 file - promoters60/4767402
tttttcaa

SEQ ID NO: 136191 - DNA, 9 bp, Unknown
  misc_feature (1)..( 9): Result.003 file - promoters60/4767402
attttgtta

SEQ ID NO: 136192 - DNA, 9 bp, Unknown
  misc_feature (1)..( 9): Result.003 file - promoters60/4767402
atttagtta

SEQ ID NO: 136193 - DNA, 9 bp, Unknown
  misc_feature (1)..( 9): Result.003 file - promoters60/4767402
gttttgtga

SEQ ID NO: 136194 - DNA, 6 bp, Unknown
  misc_feature (1)..( 6): Result.003 file - promoters60/4767410
ttttta

SEQ ID NO: 136195 - DNA, 6 bp, Unknown
  misc_feature (1)..( 6): Result.003 file - promoters60/4767410
ttttta

SEQ ID NO: 136196 - DNA, 8 bp, Unknown
  misc_feature (1)..( 8): Result.003 file - promoters60/4767410
taaattga

SEQ ID NO: 136197 - DNA, 8 bp, Unknown
  misc_feature (1)..( 8): Result.003 file - promoters60/4767410
taagttga

SEQ ID NO: 136198 - DNA, 7 bp, Unknown
  misc_feature (1)..( 7): Result.003 file - promoters60/4767410
tatgaaa

SEQ ID NO: 136199 - DNA, 7 bp, Unknown
  misc_feature (1)..( 7): Result.003 file - promoters60/4767410
tatgaaa

SEQ ID NO: 136200 - DNA, 7 bp, Unknown
  misc_feature (1)..( 7): Result.003 file - promoters60/4767410
tattaaa

SEQ ID NO: 136201 - DNA, 8 bp, Unknown
  misc_feature (1)..( 8): Result.003 file - promoters60/4767410
agttaaag

SEQ ID NO: 136202 - DNA, 8 bp, Unknown
  misc_feature (1)..( 8): Result.003 file - promoters60/4767410
tgttaaag

SEQ ID NO: 136203 - DNA, 8 bp, Unknown
  misc_feature (1)..( 8): Result.003 file - promoters60/4767410
agtaaaaa

SEQ ID NO: 136204 - DNA, 9 bp, Unknown
  misc_feature (1)..( 9): Result.003 file - promoters60/4767410
tcttagtct

SEQ ID NO: 136205 - DNA, 9 bp, Unknown
  misc_feature (1)..( 9): Result.003 file - promoters60/4767410
tcttaatct

SEQ ID NO: 136206 - DNA, 9 bp, Unknown
  misc_feature (1)..( 9): Result.003 file - promoters60/4767410
ggttttgtt

SEQ ID NO: 136207 - DNA, 9 bp, Unknown
  misc_feature (1)..( 9): Result.003 file - promoters60/4767410
ggatttgtt

SEQ ID NO: 136208 - DNA, 9 bp, Unknown
  misc_feature (1)..( 9): Result.003 file - promoters60/4767410
ggacttgtg

SEQ ID NO: 136209 - DNA, 7 bp, Unknown
  misc_feature (1)..( 7): Result.003 file - promoters60/4767410
tcctttt

SEQ ID NO: 136210 - DNA, 7 bp, Unknown
  misc_feature (1)..( 7): Result.003 file - promoters60/4767410
tccattt

SEQ ID NO: 136211 - DNA, 6 bp, Unknown
  misc_feature (1)..( 6): Result.003 file - promoters60/4767410
tttctt

SEQ ID NO: 136212 - DNA, 6 bp, Unknown
  misc_feature (1)..( 6): Result.003 file - promoters60/4767410
tttctt

SEQ ID NO: 136213 - DNA, 7 bp, Unknown
  misc_feature (1)..( 7): Result.003 file - promoters60/4767410
aaaatat

SEQ ID NO: 136214 - DNA, 7 bp, Unknown
  misc_feature (1)..( 7): Result.003 file - promoters60/4767410
aaaatat

SEQ ID NO: 136215 - DNA, 7 bp, Unknown
  misc_feature (1)..( 7): Result.003 file - promoters60/4767410
actgcat

SEQ ID NO: 136216 - DNA, 7 bp, Unknown
  misc_feature (1)..( 7): Result.003 file - promoters60/4767410
acttcat

SEQ ID NO: 136217 - DNA, 7 bp, Unknown
  misc_feature (1)..( 7): Result.003 file - promoters60/4767410
ccatcca

SEQ ID NO: 136218 - DNA, 7 bp, Unknown
  misc_feature (1)..( 7): Result.003 file - promoters60/4767410
ccagcca

SEQ ID NO: 136219 - DNA, 6 bp, Unknown
  misc_feature (1)..( 6): Result.003 file - promoters60/4767410
atacaa

SEQ ID NO: 136220 - DNA, 6 bp, Unknown
  misc_feature (1)..( 6): Result.003 file - promoters60/4767410
atacaa

SEQ ID NO: 136221 - DNA, 6 bp, Unknown
  misc_feature (1)..( 6): Result.003 file - promoters60/4767410
atgtct

SEQ ID NO: 136222 - DNA, 6 bp, Unknown
  misc_feature (1)..( 6): Result.003 file - promoters60/4767410
atgtct

SEQ ID NO: 136223 - DNA, 7 bp, Unknown
  misc_feature (1)..( 7): Result.003 file - promoters60/4767410
ttggaga

SEQ ID NO: 136224 - DNA, 7 bp, Unknown
  misc_feature (1)..( 7): Result.003 file - promoters60/4767410
ttggaga

SEQ ID NO: 136225 - DNA, 6 bp, Unknown
  misc_feature (1)..( 6): Result.003 file - promoters60/4767410
gaagat

SEQ ID NO: 136226 - DNA, 6 bp, Unknown
  misc_feature (1)..( 6): Result.003 file - promoters60/4767410
gaagat

SEQ ID NO: 136227 - DNA, 6 bp, Unknown
  misc_feature (1)..( 6): Result.003 file - promoters60/4767410
gatcga

SEQ ID NO: 136228 - DNA, 6 bp, Unknown
  misc_feature (1)..( 6): Result.003 file - promoters60/4767410
gatcga

SEQ ID NO: 136229 - DNA, 6 bp, Unknown
  misc_feature (1)..( 6): Result.003 file - promoters60/4767410
aaatgc

SEQ ID NO: 136230 - DNA, 6 bp, Unknown
  misc_feature (1)..( 6): Result.003 file - promoters60/4767410
aaatgc

SEQ ID NO: 136231 - DNA, 9 bp, Unknown
  misc_feature (1)..( 9): Result.003 file - promoters60/4767442
tttgttgcg

SEQ ID NO: 136232 - DNA, 9 bp, Unknown
  misc_feature (1)..( 9): Result.003 file - promoters60/4767442
tttgtttta

SEQ ID NO: 136233 - DNA, 9 bp, Unknown
  misc_feature (1)..( 9): Result.003 file - promoters60/4767442
tttgttagt

SEQ ID NO: 136234 - DNA, 9 bp, Unknown
  misc_feature (1)..( 9): Result.003 file - promoters60/4767442
cttgtatta

SEQ ID NO: 136235 - DNA, 12 bp, Unknown
  misc_feature (1)..( 12): Result.003 file - promoters60/4767452
gaaaaagatatg

SEQ ID NO: 136236 - DNA, 12 bp, Unknown
  misc_feature (1)..( 12): Result.003 file - promoters60/4767452
caaaaagacggc

SEQ ID NO: 136237 - DNA, 12 bp, Unknown
  misc_feature (1)..( 12): Result.003 file - promoters60/4767452
caaaaacctctg

SEQ ID NO: 136238 - DNA, 12 bp, Unknown
  misc_feature (1)..( 12): Result.003 file - promoters60/4767452
aaaaaaaaaaaa

SEQ ID NO: 136239 - DNA, 8 bp, Unknown
  misc_feature (1)..( 8): Result.003 file - promoters60/4767452
tatattta

SEQ ID NO: 136240 - DNA, 8 bp, Unknown
  misc_feature (1)..( 8): Result.003 file - promoters60/4767452
aatatttt

SEQ ID NO: 136241 - DNA, 8 bp, Unknown
  misc_feature (1)..( 8): Result.003 file - promoters60/4767452
tataatta

SEQ ID NO: 136242 - DNA, 8 bp, Unknown
  misc_feature (1)..( 8): Result.003 file - promoters60/4767452
attatttt

SEQ ID NO: 136243 - DNA, 10 bp, Unknown
  misc_feature (1)..( 10): Result.003 file - promoters60/4767452
taatataagg

SEQ ID NO: 136244 - DNA, 10 bp, Unknown
  misc_feature (1)..( 10): Result.003 file - promoters60/4767452
ttttataagc

SEQ ID NO: 136245 - DNA, 10 bp, Unknown
  misc_feature (1)..( 10): Result.003 file - promoters60/4767452
ttttttaaaa

SEQ ID NO: 136246 - DNA, 10 bp, Unknown
  misc_feature (1)..( 10): Result.003 file - promoters60/4767452
agagataagc

SEQ ID NO: 136247 - DNA, 12 bp, Unknown
  misc_feature (1)..( 12): Result.003 file - promoters60/4767452
tctcaaaatcaa

SEQ ID NO: 136248 - DNA, 12 bp, Unknown
  misc_feature (1)..( 12): Result.003 file - promoters60/4767452
attcaagatcaa

SEQ ID NO: 136249 - DNA, 12 bp, Unknown
  misc_feature (1)..( 12): Result.003 file - promoters60/4767452
tcttcaaatcat

SEQ ID NO: 136250 - DNA, 12 bp, Unknown
  misc_feature (1)..( 12): Result.003 file - promoters60/4767452
tctgaaaatgga

SEQ ID NO: 136251 - DNA, 11 bp, Unknown
  misc_feature (1)..( 11): Result.003 file - promoters60/4767452
agaaacagaga

SEQ ID NO: 136252 - DNA, 11 bp, Unknown
  misc_feature (1)..( 11): Result.003 file - promoters60/4767452
aaaaaaagaaa

SEQ ID NO: 136253 - DNA, 11 bp, Unknown
  misc_feature (1)..( 11): Result.003 file - promoters60/4767452
aataacagatg

SEQ ID NO: 136254 - DNA, 11 bp, Unknown
  misc_feature (1)..( 11): Result.003 file - promoters60/4767452
aaaaacaaaaa

SEQ ID NO: 136255 - DNA, 11 bp, Unknown
  misc_feature (1)..( 11): Result.003 file - promoters60/4767487
aataaataaaa

SEQ ID NO: 136256 - DNA, 11 bp, Unknown
  misc_feature (1)..( 11): Result.003 file - promoters60/4767487
tttaattaaac

SEQ ID NO: 136257 - DNA, 11 bp, Unknown
  misc_feature (1)..( 11): Result.003 file - promoters60/4767487
ggaaaacaaaa

SEQ ID NO: 136258 - DNA, 11 bp, Unknown
  misc_feature (1)..( 11): Result.003 file - promoters60/4767487
atgaatgaaac

SEQ ID NO: 136259 - DNA, 11 bp, Unknown
  misc_feature (1)..( 11): Result.003 file - promoters60/4767487
tgtaattagaa

SEQ ID NO: 136260 - DNA, 11 bp, Unknown
  misc_feature (1)..( 11): Result.003 file - promoters60/4767487
tttcatttcca

SEQ ID NO: 136261 - DNA, 11 bp, Unknown
  misc_feature (1)..( 11): Result.003 file - promoters60/4767487
cttcattttta

SEQ ID NO: 136262 - DNA, 12 bp, Unknown
  misc_feature (1)..( 12): Result.003 file - promoters60/4767487
gtatattttcta

SEQ ID NO: 136263 - DNA, 12 bp, Unknown
  misc_feature (1)..( 12): Result.003 file - promoters60/4767487
tacgattttctt

SEQ ID NO: 136264 - DNA, 12 bp, Unknown
  misc_feature (1)..( 12): Result.003 file - promoters60/4767487
gtaaattttgta

SEQ ID NO: 136265 - DNA, 12 bp, Unknown
  misc_feature (1)..( 12): Result.003 file - promoters60/4767487
cttctatttcta

SEQ ID NO: 136266 - DNA, 12 bp, Unknown
  misc_feature (1)..( 12): Result.003 file - promoters60/4767487
acaaaatttatg

SEQ ID NO: 136267 - DNA, 12 bp, Unknown
  misc_feature (1)..( 12): Result.003 file - promoters60/4767487
aaacctttttat

SEQ ID NO: 136268 - DNA, 11 bp, Unknown
  misc_feature (1)..( 11): Result.003 file - promoters60/4767490
tcatatttgaa

SEQ ID NO: 136269 - DNA, 11 bp, Unknown
  misc_feature (1)..( 11): Result.003 file - promoters60/4767490
tcatatttatt

SEQ ID NO: 136270 - DNA, 11 bp, Unknown
  misc_feature (1)..( 11): Result.003 file - promoters60/4767490
aaatatatatt

SEQ ID NO: 136271 - DNA, 14 bp, Unknown
  misc_feature (1)..( 14): Result.003 file - promoters60/4767490
tttgtaaatttttt

SEQ ID NO: 136272 - DNA, 14 bp, Unknown
  misc_feature (1)..( 14): Result.003 file - promoters60/4767490
tttataaacttttt

SEQ ID NO: 136273 - DNA, 14 bp, Unknown
  misc_feature (1)..( 14): Result.003 file - promoters60/4767490
attaatcatttttg

SEQ ID NO: 136274 - DNA, 14 bp, Unknown
  misc_feature (1)..( 14): Result.003 file - promoters60/4767490
actttaaagtttaa

SEQ ID NO: 136275 - DNA, 10 bp, Unknown
  misc_feature (1)..( 10): Result.003 file - promoters60/4767490
ttgtccatat

SEQ ID NO: 136276 - DNA, 10 bp, Unknown
  misc_feature (1)..( 10): Result.003 file - promoters60/4767490
atgtccatat

SEQ ID NO: 136277 - DNA, 10 bp, Unknown
  misc_feature (1)..( 10): Result.003 file - promoters60/4767490
atgtcctaat

SEQ ID NO: 136278 - DNA, 14 bp, Unknown
  misc_feature (1)..( 14): Result.003 file - promoters60/4767490
aaaaaatatttttg

SEQ ID NO: 136279 - DNA, 14 bp, Unknown
  misc_feature (1)..( 14): Result.003 file - promoters60/4767490
attaatcatttttg

SEQ ID NO: 136280 - DNA, 14 bp, Unknown
  misc_feature (1)..( 14): Result.003 file - promoters60/4767490
aaaaaatactttaa

SEQ ID NO: 136281 - DNA, 14 bp, Unknown
  misc_feature (1)..( 14): Result.003 file - promoters60/4767490
taggattactttat

SEQ ID NO: 136282 - DNA, 12 bp, Unknown
  misc_feature (1)..( 12): Result.003 file - promoters60/4767490
aattaaccctct

SEQ ID NO: 136283 - DNA, 12 bp, Unknown
  misc_feature (1)..( 12): Result.003 file - promoters60/4767490
tattgacccaca

SEQ ID NO: 136284 - DNA, 12 bp, Unknown
  misc_feature (1)..( 12): Result.003 file - promoters60/4767490
aatttatgttga

SEQ ID NO: 136285 - DNA, 9 bp, Unknown
  misc_feature (1)..( 9): Result.003 file - promoters60/4767490
catatgatc

SEQ ID NO: 136286 - DNA, 9 bp, Unknown
  misc_feature (1)..( 9): Result.003 file - promoters60/4767490
taaatgatc

SEQ ID NO: 136287 - DNA, 9 bp, Unknown
  misc_feature (1)..( 9): Result.003 file - promoters60/4767490
taattgatt

SEQ ID NO: 136288 - DNA, 6 bp, Unknown
  misc_feature (1)..( 6): Result.003 file - promoters60/4767505
cgagtc

SEQ ID NO: 136289 - DNA, 6 bp, Unknown
  misc_feature (1)..( 6): Result.003 file - promoters60/4767505
cgagtc

SEQ ID NO: 136290 - DNA, 6 bp, Unknown
  misc_feature (1)..( 6): Result.003 file - promoters60/4767505
gaaatt

SEQ ID NO: 136291 - DNA, 6 bp, Unknown
  misc_feature (1)..( 6): Result.003 file - promoters60/4767505
gaaatt

SEQ ID NO: 136292 - DNA, 7 bp, Unknown
  misc_feature (1)..( 7): Result.003 file - promoters60/4767505
gactgaa

SEQ ID NO: 136293 - DNA, 7 bp, Unknown
  misc_feature (1)..( 7): Result.003 file - promoters60/4767505
gacagaa

SEQ ID NO: 136294 - DNA, 8 bp, Unknown
  misc_feature (1)..( 8): Result.003 file - promoters60/4767505
aaagatca

SEQ ID NO: 136295 - DNA, 8 bp, Unknown
  misc_feature (1)..( 8): Result.003 file - promoters60/4767505
aaagatca

SEQ ID NO: 136296 - DNA, 6 bp, Unknown
  misc_feature (1)..( 6): Result.003 file - promoters60/4767505
tagtag

SEQ ID NO: 136297 - DNA, 6 bp, Unknown
  misc_feature (1)..( 6): Result.003 file - promoters60/4767505
tagtag

SEQ ID NO: 136298 - DNA, 6 bp, Unknown
  misc_feature (1)..( 6): Result.003 file - promoters60/4767505
cctttt

SEQ ID NO: 136299 - DNA, 6 bp, Unknown
  misc_feature (1)..( 6): Result.003 file - promoters60/4767505
cctttt

SEQ ID NO: 136300 - DNA, 6 bp, Unknown
  misc_feature (1)..( 6): Result.003 file - promoters60/4767505
tttgat

SEQ ID NO: 136301 - DNA, 6 bp, Unknown
  misc_feature (1)..( 6): Result.003 file - promoters60/4767505
tttgat

SEQ ID NO: 136302 - DNA, 8 bp, Unknown
  misc_feature (1)..( 8): Result.003 file - promoters60/4767505
tttaacta

SEQ ID NO: 136303 - DNA, 8 bp, Unknown
  misc_feature (1)..( 8): Result.003 file - promoters60/4767505
tttatcta

SEQ ID NO: 136304 - DNA, 8 bp, Unknown
  misc_feature (1)..( 8): Result.003 file - promoters60/4767505
ctattttt

SEQ ID NO: 136305 - DNA, 8 bp, Unknown
  misc_feature (1)..( 8): Result.003 file - promoters60/4767505
ctatcttt

SEQ ID NO: 136306 - DNA, 8 bp, Unknown
  misc_feature (1)..( 8): Result.003 file - promoters60/4767505
cactaacc

SEQ ID NO: 136307 - DNA, 8 bp, Unknown
  misc_feature (1)..( 8): Result.003 file - promoters60/4767505
cactaacc

SEQ ID NO: 136308 - DNA, 7 bp, Unknown
  misc_feature (1)..( 7): Result.003 file - promoters60/4767505
aatcggt

SEQ ID NO: 136309 - DNA, 7 bp, Unknown
  misc_feature (1)..( 7): Result.003 file - promoters60/4767505
aattggt

SEQ ID NO: 136310 - DNA, 6 bp, Unknown
  misc_feature (1)..( 6): Result.003 file - promoters60/4767505
gacctc

SEQ ID NO: 136311 - DNA, 6 bp, Unknown
  misc_feature (1)..( 6): Result.003 file - promoters60/4767505
gacctc

SEQ ID NO: 136312 - DNA, 8 bp, Unknown
  misc_feature (1)..( 8): Result.003 file - promoters60/4767505
ttttaata

SEQ ID NO: 136313 - DNA, 8 bp, Unknown
  misc_feature (1)..( 8): Result.003 file - promoters60/4767505
ttttaata

SEQ ID NO: 136314 - DNA, 9 bp, Unknown
  misc_feature (1)..( 9): Result.003 file - promoters60/4767505
tcttgttta

SEQ ID NO: 136315 - DNA, 9 bp, Unknown
  misc_feature (1)..( 9): Result.003 file - promoters60/4767505
tctttttta

SEQ ID NO: 136316 - DNA, 7 bp, Unknown
  misc_feature (1)..( 7): Result.003 file - promoters60/4767505
aaacata

SEQ ID NO: 136317 - DNA, 7 bp, Unknown
  misc_feature (1)..( 7): Result.003 file - promoters60/4767505
aaatata

SEQ ID NO: 136318 - DNA, 7 bp, Unknown
  misc_feature (1)..( 7): Result.003 file - promoters60/4767505
caagata

SEQ ID NO: 136319 - DNA, 7 bp, Unknown
  misc_feature (1)..( 7): Result.003 file - promoters60/4767505
caacata

SEQ ID NO: 136320 - DNA, 7 bp, Unknown
  misc_feature (1)..( 7): Result.003 file - promoters60/4767505
ttaaaaa

SEQ ID NO: 136321 - DNA, 7 bp, Unknown
  misc_feature (1)..( 7): Result.003 file - promoters60/4767505
ttacaaa

SEQ ID NO: 136322 - DNA, 8 bp, Unknown
  misc_feature (1)..( 8): Result.003 file - promoters60/4767505
gtgaaaaa

SEQ ID NO: 136323 - DNA, 8 bp, Unknown
  misc_feature (1)..( 8): Result.003 file - promoters60/4767505
gtgaaaaa

SEQ ID NO: 136324 - DNA, 8 bp, Unknown
  misc_feature (1)..( 8): Result.003 file - promoters60/4767505
tattaata

SEQ ID NO: 136325 - DNA, 8 bp, Unknown
  misc_feature (1)..( 8): Result.003 file - promoters60/4767505
tataaata

SEQ ID NO: 136326 - DNA, 9 bp, Unknown
  misc_feature (1)..( 9): Result.003 file - promoters60/4767515
acagacaat

SEQ ID NO: 136327 - DNA, 9 bp, Unknown
  misc_feature (1)..( 9): Result.003 file - promoters60/4767515
taagaaaat

SEQ ID NO: 136328 - DNA, 9 bp, Unknown
  misc_feature (1)..( 9): Result.003 file - promoters60/4767515
gcagtcaaa

SEQ ID NO: 136329 - DNA, 9 bp, Unknown
  misc_feature (1)..( 9): Result.003 file - promoters60/4767515
actgacaat

SEQ ID NO: 136330 - DNA, 9 bp, Unknown
  misc_feature (1)..( 9): Result.003 file - promoters60/4767515
caaggaaag

SEQ ID NO: 136331 - DNA, 9 bp, Unknown
  misc_feature (1)..( 9): Result.003 file - promoters60/4767515
caagtaaaa

SEQ ID NO: 136332 - DNA, 12 bp, Unknown
  misc_feature (1)..( 12): Result.003 file - promoters60/4767515
tacgaaaatggc

SEQ ID NO: 136333 - DNA, 12 bp, Unknown
  misc_feature (1)..( 12): Result.003 file - promoters60/4767515
aacgaaattagt

SEQ ID NO: 136334 - DNA, 12 bp, Unknown
  misc_feature (1)..( 12): Result.003 file - promoters60/4767515
tactaaaagttt

SEQ ID NO: 136335 - DNA, 12 bp, Unknown
  misc_feature (1)..( 12): Result.003 file - promoters60/4767515
cacgaaatccat

SEQ ID NO: 136336 - DNA, 12 bp, Unknown
  misc_feature (1)..( 12): Result.003 file - promoters60/4767515
tgagaaacccaa

SEQ ID NO: 136337 - DNA, 12 bp, Unknown
  misc_feature (1)..( 12): Result.003 file - promoters60/4767515
aaaaaaacacaa

SEQ ID NO: 136338 - DNA, 17 bp, Unknown
  misc_feature (1)..( 17): Result.003 file - promoters60/4767515
tcacttttatgggccgt

SEQ ID NO: 136339 - DNA, 17 bp, Unknown
  misc_feature (1)..( 17): Result.003 file - promoters60/4767515
attattttatttttttt

SEQ ID NO: 136340 - DNA, 17 bp, Unknown
  misc_feature (1)..( 17): Result.003 file - promoters60/4767515
ctcattttaatgggccg

SEQ ID NO: 136341 - DNA, 17 bp, Unknown
  misc_feature (1)..( 17): Result.003 file - promoters60/4767515
agccttgtatttacttt

SEQ ID NO: 136342 - DNA, 17 bp, Unknown
  misc_feature (1)..( 17): Result.003 file - promoters60/4767515
cccttttgatttaactc

SEQ ID NO: 136343 - DNA, 17 bp, Unknown
  misc_feature (1)..( 17): Result.003 file - promoters60/4767515
aaattaaaaatgggtct

SEQ ID NO: 136344 - DNA, 8 bp, Unknown
  misc_feature (1)..( 8): Result.003 file - promoters60/4767515
agaagaaa

SEQ ID NO: 136345 - DNA, 8 bp, Unknown
  misc_feature (1)..( 8): Result.003 file - promoters60/4767515
tgaagaac

SEQ ID NO: 136346 - DNA, 9 bp, Unknown
  misc_feature (1)..( 9): Result.003 file - promoters60/4767515
tcaaagaaa

SEQ ID NO: 136347 - DNA, 8 bp, Unknown
  misc_feature (1)..( 8): Result.003 file - promoters60/4767515
agaacaac

SEQ ID NO: 136348 - DNA, 9 bp, Unknown
  misc_feature (1)..( 9): Result.003 file - promoters60/4767515
agagacaaa

SEQ ID NO: 136349 - DNA, 9 bp, Unknown
  misc_feature (1)..( 9): Result.003 file - promoters60/4767515
gctaacaac

SEQ ID NO: 136350 - DNA, 8 bp, Unknown
  misc_feature (1)..( 8): Result.003 file - promoters60/4767519
atttattt

SEQ ID NO: 136351 - DNA, 8 bp, Unknown
  misc_feature (1)..( 8): Result.003 file - promoters60/4767519
attgattt

SEQ ID NO: 136352 - DNA, 7 bp, Unknown
  misc_feature (1)..( 7): Result.003 file - promoters60/4767519
aaacatt

SEQ ID NO: 136353 - DNA, 7 bp, Unknown
  misc_feature (1)..( 7): Result.003 file - promoters60/4767519
aaaaatt

SEQ ID NO: 136354 - DNA, 8 bp, Unknown
  misc_feature (1)..( 8): Result.003 file - promoters60/4767519
aaatcata

SEQ ID NO: 136355 - DNA, 7 bp, Unknown
  misc_feature (1)..( 7): Result.003 file - promoters60/4767519
tttttaa

SEQ ID NO: 136356 - DNA, 7 bp, Unknown
  misc_feature (1)..( 7): Result.003 file - promoters60/4767519
tttataa

SEQ ID NO: 136357 - DNA, 7 bp, Unknown
  misc_feature (1)..( 7): Result.003 file - promoters60/4767519
aaataaa

SEQ ID NO: 136358 - DNA, 7 bp, Unknown
  misc_feature (1)..( 7): Result.003 file - promoters60/4767519
aaataaa

SEQ ID NO: 136359 - DNA, 7 bp, Unknown
  misc_feature (1)..( 7): Result.003 file - promoters60/4767519
aaataat

SEQ ID NO: 136360 - DNA, 7 bp, Unknown
  misc_feature (1)..( 7): Result.003 file - promoters60/4767519
ttatata

SEQ ID NO: 136361 - DNA, 7 bp, Unknown
  misc_feature (1)..( 7): Result.003 file - promoters60/4767519
ttatata

SEQ ID NO: 136362 - DNA, 7 bp, Unknown
  misc_feature (1)..( 7): Result.003 file - promoters60/4767519
gatttat

SEQ ID NO: 136363 - DNA, 7 bp, Unknown
  misc_feature (1)..( 7): Result.003 file - promoters60/4767519
gatatat

SEQ ID NO: 136364 - DNA, 7 bp, Unknown
  misc_feature (1)..( 7): Result.003 file - promoters60/4767519
aagttat

SEQ ID NO: 136365 - DNA, 10 bp, Unknown
  misc_feature (1)..( 10): Result.003 file - promoters60/4767519
aacactttat

SEQ ID NO: 136366 - DNA, 10 bp, Unknown
  misc_feature (1)..( 10): Result.003 file - promoters60/4767519
aacactatat

SEQ ID NO: 136367 - DNA, 6 bp, Unknown
  misc_feature (1)..( 6): Result.003 file - promoters60/4767519
tcttta

SEQ ID NO: 136368 - DNA, 6 bp, Unknown
  misc_feature (1)..( 6): Result.003 file - promoters60/4767519
tcttta

SEQ ID NO: 136369 - DNA, 6 bp, Unknown
  misc_feature (1)..( 6): Result.003 file - promoters60/4767519
atcttt

SEQ ID NO: 136370 - DNA, 6 bp, Unknown
  misc_feature (1)..( 6): Result.003 file - promoters60/4767519
atcttt

SEQ ID NO: 136371 - DNA, 8 bp, Unknown
  misc_feature (1)..( 8): Result.003 file - promoters60/4767519
atttaaat

SEQ ID NO: 136372 - DNA, 8 bp, Unknown
  misc_feature (1)..( 8): Result.003 file - promoters60/4767519
atttcaat

SEQ ID NO: 136373 - DNA, 7 bp, Unknown
  misc_feature (1)..( 7): Result.003 file - promoters60/4767519
atttaag

SEQ ID NO: 136374 - DNA, 7 bp, Unknown
  misc_feature (1)..( 7): Result.003 file - promoters60/4767519
atttaag

SEQ ID NO: 136375 - DNA, 11 bp, Unknown
  misc_feature (1)..( 11): Result.003 file - promoters60/4767519
ataattttata

SEQ ID NO: 136376 - DNA, 11 bp, Unknown
  misc_feature (1)..( 11): Result.003 file - promoters60/4767519
ataattatatg

SEQ ID NO: 136377 - DNA, 11 bp, Unknown
  misc_feature (1)..( 11): Result.003 file - promoters60/4767519
ttaggtatatg

SEQ ID NO: 136378 - DNA, 7 bp, Unknown
  misc_feature (1)..( 7): Result.003 file - promoters60/4767519
taaatac

SEQ ID NO: 136379 - DNA, 7 bp, Unknown
  misc_feature (1)..( 7): Result.003 file - promoters60/4767519
taagtac

SEQ ID NO: 136380 - DNA, 8 bp, Unknown
  misc_feature (1)..( 8): Result.003 file - promoters60/4767519
tgagaaaa

SEQ ID NO: 136381 - DNA, 8 bp, Unknown
  misc_feature (1)..( 8): Result.003 file - promoters60/4767519
tgaaaaaa

SEQ ID NO: 136382 - DNA, 7 bp, Unknown
  misc_feature (1)..( 7): Result.003 file - promoters60/4767519
taacatt

SEQ ID NO: 136383 - DNA, 7 bp, Unknown
  misc_feature (1)..( 7): Result.003 file - promoters60/4767519
taacatt

SEQ ID NO: 136384 - DNA, 6 bp, Unknown
  misc_feature (1)..( 6): Result.003 file - promoters60/4767519
tgataa

SEQ ID NO: 136385 - DNA, 6 bp, Unknown
  misc_feature (1)..( 6): Result.003 file - promoters60/4767519
tgataa

SEQ ID NO: 136386 - DNA, 9 bp, Unknown
  misc_feature (1)..( 9): Result.003 file - promoters60/4767519
aataaaaat

SEQ ID NO: 136387 - DNA, 9 bp, Unknown
  misc_feature (1)..( 9): Result.003 file - promoters60/4767519
aatagaaat

SEQ ID NO: 136388 - DNA, 7 bp, Unknown
  misc_feature (1)..( 7): Result.003 file - promoters60/4767519
tagaaac

SEQ ID NO: 136389 - DNA, 7 bp, Unknown
  misc_feature (1)..( 7): Result.003 file - promoters60/4767519
tagaaac

SEQ ID NO: 136390 - DNA, 6 bp, Unknown
  misc_feature (1)..( 6): Result.003 file - promoters60/4767519
aacgta

SEQ ID NO: 136391 - DNA, 6 bp, Unknown
  misc_feature (1)..( 6): Result.003 file - promoters60/4767519
aacgta

SEQ ID NO: 136392 - DNA, 10 bp, Unknown
  misc_feature (1)..( 10): Result.003 file - promoters60/4767519
gtatcaaaat

SEQ ID NO: 136393 - DNA, 10 bp, Unknown
  misc_feature (1)..( 10): Result.003 file - promoters60/4767519
gtatcataat

SEQ ID NO: 136394 - DNA, 10 bp, Unknown
  misc_feature (1)..( 10): Result.003 file - promoters60/4767539
atctctgcag

SEQ ID NO: 136395 - DNA, 10 bp, Unknown
  misc_feature (1)..( 10): Result.003 file - promoters60/4767539
gtctctgcag

SEQ ID NO: 136396 - DNA, 10 bp, Unknown
  misc_feature (1)..( 10): Result.003 file - promoters60/4767539
atctctttgg

SEQ ID NO: 136397 - DNA, 7 bp, Unknown
  misc_feature (1)..( 7): Result.003 file - promoters60/4767539
tttgtct

SEQ ID NO: 136398 - DNA, 7 bp, Unknown
  misc_feature (1)..( 7): Result.003 file - promoters60/4767539
tttatct

SEQ ID NO: 136399 - DNA, 7 bp, Unknown
  misc_feature (1)..( 7): Result.003 file - promoters60/4767539
agatatt

SEQ ID NO: 136400 - DNA, 7 bp, Unknown
  misc_feature (1)..( 7): Result.003 file - promoters60/4767539
agatatt

SEQ ID NO: 136401 - DNA, 7 bp, Unknown
  misc_feature (1)..( 7): Result.003 file - promoters60/4767539
tttacaa

SEQ ID NO: 136402 - DNA, 7 bp, Unknown
  misc_feature (1)..( 7): Result.003 file - promoters60/4767539
ttttcaa

SEQ ID NO: 136403 - DNA, 7 bp, Unknown
  misc_feature (1)..( 7): Result.003 file - promoters60/4767539
agtttat

SEQ ID NO: 136404 - DNA, 7 bp, Unknown
  misc_feature (1)..( 7): Result.003 file - promoters60/4767539
agtttat

SEQ ID NO: 136405 - DNA, 6 bp, Unknown
  misc_feature (1)..( 6): Result.003 file - promoters60/4767539
ttatcc

SEQ ID NO: 136406 - DNA, 6 bp, Unknown
  misc_feature (1)..( 6): Result.003 file - promoters60/4767539
ttatcc

SEQ ID NO: 136407 - DNA, 8 bp, Unknown
  misc_feature (1)..( 8): Result.003 file - promoters60/4767539
tttggatg

SEQ ID NO: 136408 - DNA, 8 bp, Unknown
  misc_feature (1)..( 8): Result.003 file - promoters60/4767539
gttgtatg

SEQ ID NO: 136409 - DNA, 8 bp, Unknown
  misc_feature (1)..( 8): Result.003 file - promoters60/4767539
gttgtaac

SEQ ID NO: 136410 - DNA, 6 bp, Unknown
  misc_feature (1)..( 6): Result.003 file - promoters60/4767539
tatttt

SEQ ID NO: 136411 - DNA, 6 bp, Unknown
  misc_feature (1)..( 6): Result.003 file - promoters60/4767539
tatttt

SEQ ID NO: 136412 - DNA, 6 bp, Unknown
  misc_feature (1)..( 6): Result.003 file - promoters60/4767539
acattc

SEQ ID NO: 136413 - DNA, 6 bp, Unknown
  misc_feature (1)..( 6): Result.003 file - promoters60/4767539
acattc

SEQ ID NO: 136414 - DNA, 6 bp, Unknown
  misc_feature (1)..( 6): Result.003 file - promoters60/4767539
ttttga

SEQ ID NO: 136415 - DNA, 6 bp, Unknown
  misc_feature (1)..( 6): Result.003 file - promoters60/4767539
ttttga

SEQ ID NO: 136416 - DNA, 7 bp, Unknown
  misc_feature (1)..( 7): Result.003 file - promoters60/4767539
taaaact

SEQ ID NO: 136417 - DNA, 7 bp, Unknown
  misc_feature (1)..( 7): Result.003 file - promoters60/4767539
taatact

SEQ ID NO: 136418 - DNA, 7 bp, Unknown
  misc_feature (1)..( 7): Result.003 file - promoters60/4767539
aaactgt

SEQ ID NO: 136419 - DNA, 7 bp, Unknown
  misc_feature (1)..( 7): Result.003 file - promoters60/4767539
aaactgt

SEQ ID NO: 136420 - DNA, 7 bp, Unknown
  misc_feature (1)..( 7): Result.003 file - promoters60/4767539
aaacata

SEQ ID NO: 136421 - DNA, 7 bp, Unknown
  misc_feature (1)..( 7): Result.003 file - promoters60/4767539
aaaaata

SEQ ID NO: 136422 - DNA, 7 bp, Unknown
  misc_feature (1)..( 7): Result.003 file - promoters60/4767539
gaagaaa

SEQ ID NO: 136423 - DNA, 7 bp, Unknown
  misc_feature (1)..( 7): Result.003 file - promoters60/4767539
gaataaa

SEQ ID NO: 136424 - DNA, 9 bp, Unknown
  misc_feature (1)..( 9): Result.003 file - promoters60/4767539
cacaatcta

SEQ ID NO: 136425 - DNA, 9 bp, Unknown
  misc_feature (1)..( 9): Result.003 file - promoters60/4767539
cactatcta

SEQ ID NO: 136426 - DNA, 6 bp, Unknown
  misc_feature (1)..( 6): Result.003 file - promoters60/4767545
tccatt

SEQ ID NO: 136427 - DNA, 6 bp, Unknown
  misc_feature (1)..( 6): Result.003 file - promoters60/4767545
tccatt

SEQ ID NO: 136428 - DNA, 7 bp, Unknown
  misc_feature (1)..( 7): Result.003 file - promoters60/4767545
ttttatg

SEQ ID NO: 136429 - DNA, 7 bp, Unknown
  misc_feature (1)..( 7): Result.003 file - promoters60/4767545
ttttatg

SEQ ID NO: 136430 - DNA, 7 bp, Unknown
  misc_feature (1)..( 7): Result.003 file - promoters60/4767545
tttgaaa

SEQ ID NO: 136431 - DNA, 7 bp, Unknown
  misc_feature (1)..( 7): Result.003 file - promoters60/4767545
tttcaaa

SEQ ID NO: 136432 - DNA, 7 bp, Unknown
  misc_feature (1)..( 7): Result.003 file - promoters60/4767545
aaattgt

SEQ ID NO: 136433 - DNA, 7 bp, Unknown
  misc_feature (1)..( 7): Result.003 file - promoters60/4767545
aaaatgt

SEQ ID NO: 136434 - DNA, 8 bp, Unknown
  misc_feature (1)..( 8): Result.003 file - promoters60/4767545
ttgaaaat

SEQ ID NO: 136435 - DNA, 8 bp, Unknown
  misc_feature (1)..( 8): Result.003 file - promoters60/4767545
atgaaaag

SEQ ID NO: 136436 - DNA, 8 bp, Unknown
  misc_feature (1)..( 8): Result.003 file - promoters60/4767545
atgaaaag

SEQ ID NO: 136437 - DNA, 7 bp, Unknown
  misc_feature (1)..( 7): Result.003 file - promoters60/4767545
ataagtt

SEQ ID NO: 136438 - DNA, 7 bp, Unknown
  misc_feature (1)..( 7): Result.003 file - promoters60/4767545
atatgtt

SEQ ID NO: 136439 - DNA, 7 bp, Unknown
  misc_feature (1)..( 7): Result.003 file - promoters60/4767545
ctttctt

SEQ ID NO: 136440 - DNA, 7 bp, Unknown
  misc_feature (1)..( 7): Result.003 file - promoters60/4767545
ctttctt

SEQ ID NO: 136441 - DNA, 7 bp, Unknown
  misc_feature (1)..( 7): Result.003 file - promoters60/4767545
ctcctct

SEQ ID NO: 136442 - DNA, 7 bp, Unknown
  misc_feature (1)..( 7): Result.003 file - promoters60/4767545
ctcatct

SEQ ID NO: 136443 - DNA, 8 bp, Unknown
  misc_feature (1)..( 8): Result.003 file - promoters60/4767545
atttaaaa

SEQ ID NO: 136444 - DNA, 8 bp, Unknown
  misc_feature (1)..( 8): Result.003 file - promoters60/4767545
attaaaaa

SEQ ID NO: 136445 - DNA, 6 bp, Unknown
  misc_feature (1)..( 6): Result.003 file - promoters60/4767545
tgatta

SEQ ID NO: 136446 - DNA, 6 bp, Unknown
  misc_feature (1)..( 6): Result.003 file - promoters60/4767545
tgatta

SEQ ID NO: 136447 - DNA, 7 bp, Unknown
  misc_feature (1)..( 7): Result.003 file - promoters60/4767545
atgtgga

SEQ ID NO: 136448 - DNA, 7 bp, Unknown
  misc_feature (1)..( 7): Result.003 file - promoters60/4767545
atgcgga

SEQ ID NO: 136449 - DNA, 8 bp, Unknown
  misc_feature (1)..( 8): Result.003 file - promoters60/4767545
aaaataaa

SEQ ID NO: 136450 - DNA, 8 bp, Unknown
  misc_feature (1)..( 8): Result.003 file - promoters60/4767545
aaattaaa

SEQ ID NO: 136451 - DNA, 8 bp, Unknown
  misc_feature (1)..( 8): Result.003 file - promoters60/4767545
ttgaaaaa

SEQ ID NO: 136452 - DNA, 8 bp, Unknown
  misc_feature (1)..( 8): Result.003 file - promoters60/4767545
atgaaaag

SEQ ID NO: 136453 - DNA, 8 bp, Unknown
  misc_feature (1)..( 8): Result.003 file - promoters60/4767545
atgaaaag

SEQ ID NO: 136454 - DNA, 7 bp, Unknown
  misc_feature (1)..( 7): Result.003 file - promoters60/4767545
aaacaaa

SEQ ID NO: 136455 - DNA, 7 bp, Unknown
  misc_feature (1)..( 7): Result.003 file - promoters60/4767545
aaagaaa

SEQ ID NO: 136456 - DNA, 7 bp, Unknown
  misc_feature (1)..( 7): Result.003 file - promoters60/4767545
aatgcaa

SEQ ID NO: 136457 - DNA, 7 bp, Unknown
  misc_feature (1)..( 7): Result.003 file - promoters60/4767545
aatccaa

SEQ ID NO: 136458 - DNA, 6 bp, Unknown
  misc_feature (1)..( 6): Result.003 file - promoters60/4767545
aaataa

SEQ ID NO: 136459 - DNA, 6 bp, Unknown
  misc_feature (1)..( 6): Result.003 file - promoters60/4767545
aaataa

SEQ ID NO: 136460 - DNA, 7 bp, Unknown
  misc_feature (1)..( 7): Result.003 file - promoters60/4767545
aaataat

SEQ ID NO: 136461 - DNA, 7 bp, Unknown
  misc_feature (1)..( 7): Result.003 file - promoters60/4767545
aaaaaat

SEQ ID NO: 136462 - DNA, 7 bp, Unknown
  misc_feature (1)..( 7): Result.003 file - promoters60/4767545
caaaatc

SEQ ID NO: 136463 - DNA, 7 bp, Unknown
  misc_feature (1)..( 7): Result.003 file - promoters60/4767545
caagatc

SEQ ID NO: 136464 - DNA, 6 bp, Unknown
  misc_feature (1)..( 6): Result.003 file - promoters60/4767545
cttctc

SEQ ID NO: 136465 - DNA, 6 bp, Unknown
  misc_feature (1)..( 6): Result.003 file - promoters60/4767545
cttctc

SEQ ID NO: 136466 - DNA, 6 bp, Unknown
  misc_feature (1)..( 6): Result.003 file - promoters60/4767545
gagttt

SEQ ID NO: 136467 - DNA, 6 bp, Unknown
  misc_feature (1)..( 6): Result.003 file - promoters60/4767545
gagttt

SEQ ID NO: 136468 - DNA, 6 bp, Unknown
  misc_feature (1)..( 6): Result.003 file - promoters60/4767545
tttcga

SEQ ID NO: 136469 - DNA, 6 bp, Unknown
  misc_feature (1)..( 6): Result.003 file - promoters60/4767545
tttcga

SEQ ID NO: 136470 - DNA, 8 bp, Unknown
  misc_feature (1)..( 8): Result.003 file - promoters60/4767552
aacaaaaa

SEQ ID NO: 136471 - DNA, 8 bp, Unknown
  misc_feature (1)..( 8): Result.003 file - promoters60/4767552
aacaaaaa

SEQ ID NO: 136472 - DNA, 7 bp, Unknown
  misc_feature (1)..( 7): Result.003 file - promoters60/4767552
taacaaa

SEQ ID NO: 136473 - DNA, 7 bp, Unknown
  misc_feature (1)..( 7): Result.003 file - promoters60/4767552
taagaaa

SEQ ID NO: 136474 - DNA, 7 bp, Unknown
  misc_feature (1)..( 7): Result.003 file - promoters60/4767552
aaatgtg

SEQ ID NO: 136475 - DNA, 7 bp, Unknown
  misc_feature (1)..( 7): Result.003 file - promoters60/4767552
aaaagtg

SEQ ID NO: 136476 - DNA, 13 bp, Unknown
  misc_feature (1)..( 13): Result.003 file - promoters60/4767552
ataatactataat

SEQ ID NO: 136477 - DNA, 13 bp, Unknown
  misc_feature (1)..( 13): Result.003 file - promoters60/4767552
ataatcctaaaat

SEQ ID NO: 136478 - DNA, 7 bp, Unknown
  misc_feature (1)..( 7): Result.003 file - promoters60/4767552
caaacta

SEQ ID NO: 136479 - DNA, 7 bp, Unknown
  misc_feature (1)..( 7): Result.003 file - promoters60/4767552
caatcta

SEQ ID NO: 136480 - DNA, 10 bp, Unknown
  misc_feature (1)..( 10): Result.003 file - promoters60/4767552
atattataaa

SEQ ID NO: 136481 - DNA, 10 bp, Unknown
  misc_feature (1)..( 10): Result.003 file - promoters60/4767552
atatcataaa

SEQ ID NO: 136482 - DNA, 6 bp, Unknown
  misc_feature (1)..( 6): Result.003 file - promoters60/4767552
tcagag

SEQ ID NO: 136483 - DNA, 6 bp, Unknown
  misc_feature (1)..( 6): Result.003 file - promoters60/4767552
tcagag

SEQ ID NO: 136484 - DNA, 6 bp, Unknown
  misc_feature (1)..( 6): Result.003 file - promoters60/4767552
tcattt

SEQ ID NO: 136485 - DNA, 6 bp, Unknown
  misc_feature (1)..( 6): Result.003 file - promoters60/4767552
tcattt

SEQ ID NO: 136486 - DNA, 9 bp, Unknown
  misc_feature (1)..( 9): Result.003 file - promoters60/4767552
ttgtaagtg

SEQ ID NO: 136487 - DNA, 9 bp, Unknown
  misc_feature (1)..( 9): Result.003 file - promoters60/4767552
ttgtgagtg

SEQ ID NO: 136488 - DNA, 6 bp, Unknown
  misc_feature (1)..( 6): Result.003 file - promoters60/4767552
cataga

SEQ ID NO: 136489 - DNA, 6 bp, Unknown
  misc_feature (1)..( 6): Result.003 file - promoters60/4767552
cataga

SEQ ID NO: 136490 - DNA, 6 bp, Unknown
  misc_feature (1)..( 6): Result.003 file - promoters60/4767552
ataaaa

SEQ ID NO: 136491 - DNA, 6 bp, Unknown
  misc_feature (1)..( 6): Result.003 file - promoters60/4767552
ataaaa

SEQ ID NO: 136492 - DNA, 6 bp, Unknown
  misc_feature (1)..( 6): Result.003 file - promoters60/4767552
taggtt

SEQ ID NO: 136493 - DNA, 6 bp, Unknown
  misc_feature (1)..( 6): Result.003 file - promoters60/4767552
taggtt

SEQ ID NO: 136494 - DNA, 7 bp, Unknown
  misc_feature (1)..( 7): Result.003 file - promoters60/4767552
agaaata

SEQ ID NO: 136495 - DNA, 7 bp, Unknown
  misc_feature (1)..( 7): Result.003 file - promoters60/4767552
agagata

SEQ ID NO: 136496 - DNA, 7 bp, Unknown
  misc_feature (1)..( 7): Result.003 file - promoters60/4767552
agatatt

SEQ ID NO: 136497 - DNA, 7 bp, Unknown
  misc_feature (1)..( 7): Result.003 file - promoters60/4767552
tcaaaat

SEQ ID NO: 136498 - DNA, 7 bp, Unknown
  misc_feature (1)..( 7): Result.003 file - promoters60/4767552
tcagaat

SEQ ID NO: 136499 - DNA, 6 bp, Unknown
  misc_feature (1)..( 6): Result.003 file - promoters60/4767552
atttct

SEQ ID NO: 136500 - DNA, 6 bp, Unknown
  misc_feature (1)..( 6): Result.003 file - promoters60/4767552
atttct

SEQ ID NO: 136501 - DNA, 8 bp, Unknown
  misc_feature (1)..( 8): Result.003 file - promoters60/4767552
tgtctact

SEQ ID NO: 136502 - DNA, 8 bp, Unknown
  misc_feature (1)..( 8): Result.003 file - promoters60/4767552
tgtcaact

SEQ ID NO: 136503 - DNA, 7 bp, Unknown
  misc_feature (1)..( 7): Result.003 file - promoters60/4767552
tcaagag

SEQ ID NO: 136504 - DNA, 7 bp, Unknown
  misc_feature (1)..( 7): Result.003 file - promoters60/4767552
tcacgag

SEQ ID NO: 136505 - DNA, 10 bp, Unknown
  misc_feature (1)..( 10): Result.003 file - promoters60/4767578
taatttatct

SEQ ID NO: 136506 - DNA, 10 bp, Unknown
  misc_feature (1)..( 10): Result.003 file - promoters60/4767578
gattttatct

SEQ ID NO: 136507 - DNA, 10 bp, Unknown
  misc_feature (1)..( 10): Result.003 file - promoters60/4767578
taatgtatac

SEQ ID NO: 136508 - DNA, 11 bp, Unknown
  misc_feature (1)..( 11): Result.003 file - promoters60/4767578
aacaaaatgta

SEQ ID NO: 136509 - DNA, 11 bp, Unknown
  misc_feature (1)..( 11): Result.003 file - promoters60/4767578
aacaaaataca

SEQ ID NO: 136510 - DNA, 11 bp, Unknown
  misc_feature (1)..( 11): Result.003 file - promoters60/4767578
atgtaaattgt

SEQ ID NO: 136511 - DNA, 9 bp, Unknown
  misc_feature (1)..( 9): Result.003 file - promoters60/4767578
tgtcttcat

SEQ ID NO: 136512 - DNA, 9 bp, Unknown
  misc_feature (1)..( 9): Result.003 file - promoters60/4767578
tgtattcat

SEQ ID NO: 136513 - DNA, 6 bp, Unknown
  misc_feature (1)..( 6): Result.003 file - promoters60/4767578
aaattt

SEQ ID NO: 136514 - DNA, 6 bp, Unknown
  misc_feature (1)..( 6): Result.003 file - promoters60/4767578
aaattt

SEQ ID NO: 136515 - DNA, 6 bp, Unknown
  misc_feature (1)..( 6): Result.003 file - promoters60/4767578
aaatca

SEQ ID NO: 136516 - DNA, 6 bp, Unknown
  misc_feature (1)..( 6): Result.003 file - promoters60/4767578
aaatca

SEQ ID NO: 136517 - DNA, 7 bp, Unknown
  misc_feature (1)..( 7): Result.003 file - promoters60/4767578
aatttat

SEQ ID NO: 136518 - DNA, 7 bp, Unknown
  misc_feature (1)..( 7): Result.003 file - promoters60/4767578
aatgtat

SEQ ID NO: 136519 - DNA, 7 bp, Unknown
  misc_feature (1)..( 7): Result.003 file - promoters60/4767578
aattaca

SEQ ID NO: 136520 - DNA, 7 bp, Unknown
  misc_feature (1)..( 7): Result.003 file - promoters60/4767578
aatgaca

SEQ ID NO: 136521 - DNA, 8 bp, Unknown
  misc_feature (1)..( 8): Result.003 file - promoters60/4767578
tactatat

SEQ ID NO: 136522 - DNA, 8 bp, Unknown
  misc_feature (1)..( 8): Result.003 file - promoters60/4767578
tactttat

SEQ ID NO: 136523 - DNA, 6 bp, Unknown
  misc_feature (1)..( 6): Result.003 file - promoters60/4767578
ttatat

SEQ ID NO: 136524 - DNA, 6 bp, Unknown
  misc_feature (1)..( 6): Result.003 file - promoters60/4767578
ttatat

SEQ ID NO: 136525 - DNA, 7 bp, Unknown
  misc_feature (1)..( 7): Result.003 file - promoters60/4767578
aaaaaaa

SEQ ID NO: 136526 - DNA, 7 bp, Unknown
  misc_feature (1)..( 7): Result.003 file - promoters60/4767578
aaagaaa

SEQ ID NO: 136527 - DNA, 8 bp, Unknown
  misc_feature (1)..( 8): Result.003 file - promoters60/4767578
aagaaaaa

SEQ ID NO: 136528 - DNA, 8 bp, Unknown
  misc_feature (1)..( 8): Result.003 file - promoters60/4767578
aagaaaaa

SEQ ID NO: 136529 - DNA, 6 bp, Unknown
  misc_feature (1)..( 6): Result.003 file - promoters60/4767578
tcttct

SEQ ID NO: 136530 - DNA, 6 bp, Unknown
  misc_feature (1)..( 6): Result.003 file - promoters60/4767578
tcttct

SEQ ID NO: 136531 - DNA, 6 bp, Unknown
  misc_feature (1)..( 6): Result.003 file - promoters60/4767578
ttctct

SEQ ID NO: 136532 - DNA, 6 bp, Unknown
  misc_feature (1)..( 6): Result.003 file - promoters60/4767578
ttctct

SEQ ID NO: 136533 - DNA, 7 bp, Unknown
  misc_feature (1)..( 7): Result.003 file - promoters60/4767578
aattttg

SEQ ID NO: 136534 - DNA, 7 bp, Unknown
  misc_feature (1)..( 7): Result.003 file - promoters60/4767578
aattttg

SEQ ID NO: 136535 - DNA, 7 bp, Unknown
  misc_feature (1)..( 7): Result.003 file - promoters60/4767578
atatcat

SEQ ID NO: 136536 - DNA, 7 bp, Unknown
  misc_feature (1)..( 7): Result.003 file - promoters60/4767578
atatcat

SEQ ID NO: 136537 - DNA, 8 bp, Unknown
  misc_feature (1)..( 8): Result.003 file - promoters60/4767578
gtcattta

SEQ ID NO: 136538 - DNA, 8 bp, Unknown
  misc_feature (1)..( 8): Result.003 file - promoters60/4767578
gtcactta

SEQ ID NO: 136539 - DNA, 7 bp, Unknown
  misc_feature (1)..( 7): Result.003 file - promoters60/4767578
tcgtaat

SEQ ID NO: 136540 - DNA, 7 bp, Unknown
  misc_feature (1)..( 7): Result.003 file - promoters60/4767578
tcgaaat

SEQ ID NO: 136541 - DNA, 6 bp, Unknown
  misc_feature (1)..( 6): Result.003 file - promoters60/4767610
aatatt

SEQ ID NO: 136542 - DNA, 6 bp, Unknown
  misc_feature (1)..( 6): Result.003 file - promoters60/4767610
aatatt

SEQ ID NO: 136543 - DNA, 7 bp, Unknown
  misc_feature (1)..( 7): Result.003 file - promoters60/4767610
atggagt

SEQ ID NO: 136544 - DNA, 7 bp, Unknown
  misc_feature (1)..( 7): Result.003 file - promoters60/4767610
atgtagt

SEQ ID NO: 136545 - DNA, 7 bp, Unknown
  misc_feature (1)..( 7): Result.003 file - promoters60/4767610
acgtgta

SEQ ID NO: 136546 - DNA, 7 bp, Unknown
  misc_feature (1)..( 7): Result.003 file - promoters60/4767610
acgtgta

SEQ ID NO: 136547 - DNA, 10 bp, Unknown
  misc_feature (1)..( 10): Result.003 file - promoters60/4767610
aactatacaa

SEQ ID NO: 136548 - DNA, 10 bp, Unknown
  misc_feature (1)..( 10): Result.003 file - promoters60/4767610
aactattcaa

SEQ ID NO: 136549 - DNA, 7 bp, Unknown
  misc_feature (1)..( 7): Result.003 file - promoters60/4767610
tgtatac

SEQ ID NO: 136550 - DNA, 7 bp, Unknown
  misc_feature (1)..( 7): Result.003 file - promoters60/4767610
tgtatac

SEQ ID NO: 136551 - DNA, 8 bp, Unknown
  misc_feature (1)..( 8): Result.003 file - promoters60/4767610
tatcttaa

SEQ ID NO: 136552 - DNA, 8 bp, Unknown
  misc_feature (1)..( 8): Result.003 file - promoters60/4767610
tattttaa

SEQ ID NO: 136553 - DNA, 8 bp, Unknown
  misc_feature (1)..( 8): Result.003 file - promoters60/4767610
tattttat

SEQ ID NO: 136554 - DNA, 6 bp, Unknown
  misc_feature (1)..( 6): Result.003 file - promoters60/4767610
aagaca

SEQ ID NO: 136555 - DNA, 6 bp, Unknown
  misc_feature (1)..( 6): Result.003 file - promoters60/4767610
aagaca

SEQ ID NO: 136556 - DNA, 9 bp, Unknown
  misc_feature (1)..( 9): Result.003 file - promoters60/4767610
aataaatat

SEQ ID NO: 136557 - DNA, 9 bp, Unknown
  misc_feature (1)..( 9): Result.003 file - promoters60/4767610
cttaattat

SEQ ID NO: 136558 - DNA, 9 bp, Unknown
  misc_feature (1)..( 9): Result.003 file - promoters60/4767610
cttgatttg

SEQ ID NO: 136559 - DNA, 13 bp, Unknown
  misc_feature (1)..( 13): Result.003 file - promoters60/4767610
tatacagtataca

SEQ ID NO: 136560 - DNA, 13 bp, Unknown
  misc_feature (1)..( 13): Result.003 file - promoters60/4767610
tatacattataca

SEQ ID NO: 136561 - DNA, 6 bp, Unknown
  misc_feature (1)..( 6): Result.003 file - promoters60/4767610
taataa

SEQ ID NO: 136562 - DNA, 6 bp, Unknown
  misc_feature (1)..( 6): Result.003 file - promoters60/4767610
taataa

SEQ ID NO: 136563 - DNA, 6 bp, Unknown
  misc_feature (1)..( 6): Result.003 file - promoters60/4767610
ttttat

SEQ ID NO: 136564 - DNA, 6 bp, Unknown
  misc_feature (1)..( 6): Result.003 file - promoters60/4767610
ttttat

SEQ ID NO: 136565 - DNA, 6 bp, Unknown
  misc_feature (1)..( 6): Result.003 file - promoters60/4767610
tatata

SEQ ID NO: 136566 - DNA, 6 bp, Unknown
  misc_feature (1)..( 6): Result.003 file - promoters60/4767610
tatata

SEQ ID NO: 136567 - DNA, 8 bp, Unknown
  misc_feature (1)..( 8): Result.003 file - promoters60/4767610
acccacca

SEQ ID NO: 136568 - DNA, 8 bp, Unknown
  misc_feature (1)..( 8): Result.003 file - promoters60/4767610
accaacca

SEQ ID NO: 136569 - DNA, 7 bp, Unknown
  misc_feature (1)..( 7): Result.003 file - promoters60/4767610
atataat

SEQ ID NO: 136570 - DNA, 7 bp, Unknown
  misc_feature (1)..( 7): Result.003 file - promoters60/4767610
atataat

SEQ ID NO: 136571 - DNA, 6 bp, Unknown
  misc_feature (1)..( 6): Result.003 file - promoters60/4767610
aatcca

SEQ ID NO: 136572 - DNA, 6 bp, Unknown
  misc_feature (1)..( 6): Result.003 file - promoters60/4767610
aatcca

SEQ ID NO: 136573 - DNA, 8 bp, Unknown
  misc_feature (1)..( 8): Result.003 file - promoters60/4767610
aaaaaatg

SEQ ID NO: 136574 - DNA, 8 bp, Unknown
  misc_feature (1)..( 8): Result.003 file - promoters60/4767610
aaaacatg

SEQ ID NO: 136575 - DNA, 10 bp, Unknown
  misc_feature (1)..( 10): Result.003 file - promoters60/4767638
tcataaatag

SEQ ID NO: 136576 - DNA, 10 bp, Unknown
  misc_feature (1)..( 10): Result.003 file - promoters60/4767638
ttataattag

SEQ ID NO: 136577 - DNA, 10 bp, Unknown
  misc_feature (1)..( 10): Result.003 file - promoters60/4767638
agataattaa

SEQ ID NO: 136578 - DNA, 10 bp, Unknown
  misc_feature (1)..( 10): Result.003 file - promoters60/4767638
ttatgattga

SEQ ID NO: 136579 - DNA, 9 bp, Unknown
  misc_feature (1)..( 9): Result.003 file - promoters60/4767638
acaattaaa

SEQ ID NO: 136580 - DNA, 9 bp, Unknown
  misc_feature (1)..( 9): Result.003 file - promoters60/4767638
tcaaataaa

SEQ ID NO: 136581 - DNA, 9 bp, Unknown
  misc_feature (1)..( 9): Result.003 file - promoters60/4767638
acaataaaa

SEQ ID NO: 136582 - DNA, 9 bp, Unknown
  misc_feature (1)..( 9): Result.003 file - promoters60/4767638
atgataaaa

SEQ ID NO: 136583 - DNA, 6 bp, Unknown
  misc_feature (1)..( 6): Result.003 file - promoters60/4767659
gaaaaa

SEQ ID NO: 136584 - DNA, 6 bp, Unknown
  misc_feature (1)..( 6): Result.003 file - promoters60/4767659
gaaaaa

SEQ ID NO: 136585 - DNA, 6 bp, Unknown
  misc_feature (1)..( 6): Result.003 file - promoters60/4767659
aaaata

SEQ ID NO: 136586 - DNA, 6 bp, Unknown
  misc_feature (1)..( 6): Result.003 file - promoters60/4767659
aaaata

SEQ ID NO: 136587 - DNA, 7 bp, Unknown
  misc_feature (1)..( 7): Result.003 file - promoters60/4767659
tcacata

SEQ ID NO: 136588 - DNA, 7 bp, Unknown
  misc_feature (1)..( 7): Result.003 file - promoters60/4767659
tcaaata

SEQ ID NO: 136589 - DNA, 7 bp, Unknown
  misc_feature (1)..( 7): Result.003 file - promoters60/4767659
ttgtaag

SEQ ID NO: 136590 - DNA, 7 bp, Unknown
  misc_feature (1)..( 7): Result.003 file - promoters60/4767659
ttgtaag

SEQ ID NO: 136591 - DNA, 7 bp, Unknown
  misc_feature (1)..( 7): Result.003 file - promoters60/4767659
attttag

SEQ ID NO: 136592 - DNA, 7 bp, Unknown
  misc_feature (1)..( 7): Result.003 file - promoters60/4767659
attttag

SEQ ID NO: 136593 - DNA, 8 bp, Unknown
  misc_feature (1)..( 8): Result.003 file - promoters60/4767659
aaaaggaa

SEQ ID NO: 136594 - DNA, 8 bp, Unknown
  misc_feature (1)..( 8): Result.003 file - promoters60/4767659
aaatggaa

SEQ ID NO: 136595 - DNA, 7 bp, Unknown
  misc_feature (1)..( 7): Result.003 file - promoters60/4767659
ttagttg

SEQ ID NO: 136596 - DNA, 7 bp, Unknown
  misc_feature (1)..( 7): Result.003 file - promoters60/4767659
ttatttg

SEQ ID NO: 136597 - DNA, 8 bp, Unknown
  misc_feature (1)..( 8): Result.003 file - promoters60/4767659
aaatcctt

SEQ ID NO: 136598 - DNA, 8 bp, Unknown
  misc_feature (1)..( 8): Result.003 file - promoters60/4767659
aaagcctt

SEQ ID NO: 136599 - DNA, 6 bp, Unknown
  misc_feature (1)..( 6): Result.003 file - promoters60/4767659
aaaatt

SEQ ID NO: 136600 - DNA, 6 bp, Unknown
  misc_feature (1)..( 6): Result.003 file - promoters60/4767659
aaaatt

SEQ ID NO: 136601 - DNA, 7 bp, Unknown
  misc_feature (1)..( 7): Result.003 file - promoters60/4767659
cttctca

SEQ ID NO: 136602 - DNA, 7 bp, Unknown
  misc_feature (1)..( 7): Result.003 file - promoters60/4767659
cttatca

SEQ ID NO: 136603 - DNA, 6 bp, Unknown
  misc_feature (1)..( 6): Result.003 file - promoters60/4767659
gagaag

SEQ ID NO: 136604 - DNA, 6 bp, Unknown
  misc_feature (1)..( 6): Result.003 file - promoters60/4767659
gagaag

SEQ ID NO: 136605 - DNA, 7 bp, Unknown
  misc_feature (1)..( 7): Result.003 file - promoters60/4767659
acatgaa

SEQ ID NO: 136606 - DNA, 7 bp, Unknown
  misc_feature (1)..( 7): Result.003 file - promoters60/4767659
acatgaa

SEQ ID NO: 136607 - DNA, 6 bp, Unknown
  misc_feature (1)..( 6): Result.003 file - promoters60/4767659
cctaat

SEQ ID NO: 136608 - DNA, 6 bp, Unknown
  misc_feature (1)..( 6): Result.003 file - promoters60/4767659
cctaat

SEQ ID NO: 136609 - DNA, 6 bp, Unknown
  misc_feature (1)..( 6): Result.003 file - promoters60/4767659
acaagt

SEQ ID NO: 136610 - DNA, 6 bp, Unknown
  misc_feature (1)..( 6): Result.003 file - promoters60/4767659
acaagt

SEQ ID NO: 136611 - DNA, 6 bp, Unknown
  misc_feature (1)..( 6): Result.003 file - promoters60/4767659
ttctgt

SEQ ID NO: 136612 - DNA, 6 bp, Unknown
  misc_feature (1)..( 6): Result.003 file - promoters60/4767659
ttctgt

SEQ ID NO: 136613 - DNA, 9 bp, Unknown
  misc_feature (1)..( 9): Result.003 file - promoters60/4767659
ggccagaaa

SEQ ID NO: 136614 - DNA, 9 bp, Unknown
  misc_feature (1)..( 9): Result.003 file - promoters60/4767659
ggcaagaaa

SEQ ID NO: 136615 - DNA, 8 bp, Unknown
  misc_feature (1)..( 8): Result.003 file - promoters60/4767659
agtgacta

SEQ ID NO: 136616 - DNA, 8 bp, Unknown
  misc_feature (1)..( 8): Result.003 file - promoters60/4767659
agtgtcta

SEQ ID NO: 136617 - DNA, 7 bp, Unknown
  misc_feature (1)..( 7): Result.003 file - promoters60/4767659
ttcatat

SEQ ID NO: 136618 - DNA, 7 bp, Unknown
  misc_feature (1)..( 7): Result.003 file - promoters60/4767659
ttcttat

SEQ ID NO: 136619 - DNA, 9 bp, Unknown
  misc_feature (1)..( 9): Result.003 file - promoters60/4767663
aattaaaat

SEQ ID NO: 136620 - DNA, 9 bp, Unknown
  misc_feature (1)..( 9): Result.003 file - promoters60/4767663
aatgaaaaa

SEQ ID NO: 136621 - DNA, 9 bp, Unknown
  misc_feature (1)..( 9): Result.003 file - promoters60/4767663
cgttaaaaa

SEQ ID NO: 136622 - DNA, 9 bp, Unknown
  misc_feature (1)..( 9): Result.003 file - promoters60/4767663
tcagaaaaa

SEQ ID NO: 136623 - DNA, 9 bp, Unknown
  misc_feature (1)..( 9): Result.003 file - promoters60/4767663
aatcaaata

SEQ ID NO: 136624 - DNA, 9 bp, Unknown
  misc_feature (1)..( 9): Result.003 file - promoters60/4767663
tatgaaatt

SEQ ID NO: 136625 - DNA, 9 bp, Unknown
  misc_feature (1)..( 9): Result.003 file - promoters60/4767663
ttatatata

SEQ ID NO: 136626 - DNA, 9 bp, Unknown
  misc_feature (1)..( 9): Result.003 file - promoters60/4767663
ttatatata

SEQ ID NO: 136627 - DNA, 9 bp, Unknown
  misc_feature (1)..( 9): Result.003 file - promoters60/4767663
gtatatata

SEQ ID NO: 136628 - DNA, 9 bp, Unknown
  misc_feature (1)..( 9): Result.003 file - promoters60/4767663
ctatatata

SEQ ID NO: 136629 - DNA, 9 bp, Unknown
  misc_feature (1)..( 9): Result.003 file - promoters60/4767663
atatatata

SEQ ID NO: 136630 - DNA, 9 bp, Unknown
  misc_feature (1)..( 9): Result.003 file - promoters60/4767663
atatttata

SEQ ID NO: 136631 - DNA, 11 bp, Unknown
  misc_feature (1)..( 11): Result.003 file - promoters60/4767663
tatccaaaatg

SEQ ID NO: 136632 - DNA, 11 bp, Unknown
  misc_feature (1)..( 11): Result.003 file - promoters60/4767663
tatacaaacta

SEQ ID NO: 136633 - DNA, 11 bp, Unknown
  misc_feature (1)..( 11): Result.003 file - promoters60/4767663
catacacattc

SEQ ID NO: 136634 - DNA, 11 bp, Unknown
  misc_feature (1)..( 11): Result.003 file - promoters60/4767663
cgtacacatag

SEQ ID NO: 136635 - DNA, 11 bp, Unknown
  misc_feature (1)..( 11): Result.003 file - promoters60/4767663
tacacacacac

SEQ ID NO: 136636 - DNA, 11 bp, Unknown
  misc_feature (1)..( 11): Result.003 file - promoters60/4767663
tttacaaaaat

SEQ ID NO: 136637 - DNA, 12 bp, Unknown
  misc_feature (1)..( 12): Result.003 file - promoters60/4767663
acatattctgaa

SEQ ID NO: 136638 - DNA, 12 bp, Unknown
  misc_feature (1)..( 12): Result.003 file - promoters60/4767663
ataaattttgag

SEQ ID NO: 136639 - DNA, 12 bp, Unknown
  misc_feature (1)..( 12): Result.003 file - promoters60/4767663
tcaaatattgcg

SEQ ID NO: 136640 - DNA, 12 bp, Unknown
  misc_feature (1)..( 12): Result.003 file - promoters60/4767663
taagcttttagt

SEQ ID NO: 136641 - DNA, 12 bp, Unknown
  misc_feature (1)..( 12): Result.003 file - promoters60/4767663
aaaaagtttatt

SEQ ID NO: 136642 - DNA, 12 bp, Unknown
  misc_feature (1)..( 12): Result.003 file - promoters60/4767663
aaaaagttgcaa

SEQ ID NO: 136643 - DNA, 14 bp, Unknown
  misc_feature (1)..( 14): Result.003 file - promoters60/4767663
ttagatatatttaa

SEQ ID NO: 136644 - DNA, 14 bp, Unknown
  misc_feature (1)..( 14): Result.003 file - promoters60/4767663
ttatatatgtttat

SEQ ID NO: 136645 - DNA, 14 bp, Unknown
  misc_feature (1)..( 14): Result.003 file - promoters60/4767663
aaacataagtttca

SEQ ID NO: 136646 - DNA, 14 bp, Unknown
  misc_feature (1)..( 14): Result.003 file - promoters60/4767663
caagtgaagtatca

SEQ ID NO: 136647 - DNA, 14 bp, Unknown
  misc_feature (1)..( 14): Result.003 file - promoters60/4767663
aaaaaaaagtttat

SEQ ID NO: 136648 - DNA, 14 bp, Unknown
  misc_feature (1)..( 14): Result.003 file - promoters60/4767663
tctgataaattttg

SEQ ID NO: 136649 - DNA, 14 bp, Unknown
  misc_feature (1)..( 14): Result.003 file - promoters60/4767663
tagaaaaagttgca

SEQ ID NO: 136650 - DNA, 6 bp, Unknown
  misc_feature (1)..( 6): Result.003 file - promoters60/4767679
agacaa

SEQ ID NO: 136651 - DNA, 6 bp, Unknown
  misc_feature (1)..( 6): Result.003 file - promoters60/4767679
agacaa

SEQ ID NO: 136652 - DNA, 7 bp, Unknown
  misc_feature (1)..( 7): Result.003 file - promoters60/4767679
taaaagt

SEQ ID NO: 136653 - DNA, 7 bp, Unknown
  misc_feature (1)..( 7): Result.003 file - promoters60/4767679
taagagt

SEQ ID NO: 136654 - DNA, 8 bp, Unknown
  misc_feature (1)..( 8): Result.003 file - promoters60/4767679
ggagtatt

SEQ ID NO: 136655 - DNA, 8 bp, Unknown
  misc_feature (1)..( 8): Result.003 file - promoters60/4767679
ggactatt

SEQ ID NO: 136656 - DNA, 8 bp, Unknown
  misc_feature (1)..( 8): Result.003 file - promoters60/4767679
tacaatca

SEQ ID NO: 136657 - DNA, 8 bp, Unknown
  misc_feature (1)..( 8): Result.003 file - promoters60/4767679
aacaatca

SEQ ID NO: 136658 - DNA, 8 bp, Unknown
  misc_feature (1)..( 8): Result.003 file - promoters60/4767679
aacaattc

SEQ ID NO: 136659 - DNA, 8 bp, Unknown
  misc_feature (1)..( 8): Result.003 file - promoters60/4767679
tatatata

SEQ ID NO: 136660 - DNA, 8 bp, Unknown
  misc_feature (1)..( 8): Result.003 file - promoters60/4767679
tataaata

SEQ ID NO: 136661 - DNA, 6 bp, Unknown
  misc_feature (1)..( 6): Result.003 file - promoters60/4767679
atatca

SEQ ID NO: 136662 - DNA, 6 bp, Unknown
  misc_feature (1)..( 6): Result.003 file - promoters60/4767679
atatca

SEQ ID NO: 136663 - DNA, 6 bp, Unknown
  misc_feature (1)..( 6): Result.003 file - promoters60/4767679
ttttct

SEQ ID NO: 136664 - DNA, 6 bp, Unknown
  misc_feature (1)..( 6): Result.003 file - promoters60/4767679
ttttct

SEQ ID NO: 136665 - DNA, 6 bp, Unknown
  misc_feature (1)..( 6): Result.003 file - promoters60/4767679
aaaaaa

SEQ ID NO: 136666 - DNA, 6 bp, Unknown
  misc_feature (1)..( 6): Result.003 file - promoters60/4767679
aaaaaa

SEQ ID NO: 136667 - DNA, 10 bp, Unknown
  misc_feature (1)..( 10): Result.003 file - promoters60/4767679
caaaaaatta

SEQ ID NO: 136668 - DNA, 10 bp, Unknown
  misc_feature (1)..( 10): Result.003 file - promoters60/4767679
caaataatta

SEQ ID NO: 136669 - DNA, 14 bp, Unknown
  misc_feature (1)..( 14): Result.003 file - promoters60/4767679
aaatagaataaaaa

SEQ ID NO: 136670 - DNA, 14 bp, Unknown
  misc_feature (1)..( 14): Result.003 file - promoters60/4767679
aaaaagaaaaaaaa

SEQ ID NO: 136671 - DNA, 9 bp, Unknown
  misc_feature (1)..( 9): Result.003 file - promoters60/4767679
ggttaaaat

SEQ ID NO: 136672 - DNA, 9 bp, Unknown
  misc_feature (1)..( 9): Result.003 file - promoters60/4767679
ggttgaaat

SEQ ID NO: 136673 - DNA, 7 bp, Unknown
  misc_feature (1)..( 7): Result.003 file - promoters60/4767679
caataat

SEQ ID NO: 136674 - DNA, 7 bp, Unknown
  misc_feature (1)..( 7): Result.003 file - promoters60/4767679
caataat

SEQ ID NO: 136675 - DNA, 6 bp, Unknown
  misc_feature (1)..( 6): Result.003 file - promoters60/4767679
agaaat

SEQ ID NO: 136676 - DNA, 6 bp, Unknown
  misc_feature (1)..( 6): Result.003 file - promoters60/4767679
agaaat

SEQ ID NO: 136677 - DNA, 6 bp, Unknown
  misc_feature (1)..( 6): Result.003 file - promoters60/4767679
aataga

SEQ ID NO: 136678 - DNA, 6 bp, Unknown
  misc_feature (1)..( 6): Result.003 file - promoters60/4767679
aataga

SEQ ID NO: 136679 - DNA, 7 bp, Unknown
  misc_feature (1)..( 7): Result.003 file - promoters60/4767679
tatttca

SEQ ID NO: 136680 - DNA, 7 bp, Unknown
  misc_feature (1)..( 7): Result.003 file - promoters60/4767679
tatgtca

SEQ ID NO: 136681 - DNA, 7 bp, Unknown
  misc_feature (1)..( 7): Result.003 file - promoters60/4767679
acaagga

SEQ ID NO: 136682 - DNA, 7 bp, Unknown
  misc_feature (1)..( 7): Result.003 file - promoters60/4767679
acaggga

SEQ ID NO: 136683 - DNA, 6 bp, Unknown
  misc_feature (1)..( 6): Result.003 file - promoters60/4767679
taattt

SEQ ID NO: 136684 - DNA, 6 bp, Unknown
  misc_feature (1)..( 6): Result.003 file - promoters60/4767679
taattt

SEQ ID NO: 136685 - DNA, 7 bp, Unknown
  misc_feature (1)..( 7): Result.003 file - promoters60/4767679
tttctga

SEQ ID NO: 136686 - DNA, 7 bp, Unknown
  misc_feature (1)..( 7): Result.003 file - promoters60/4767679
tttatga

SEQ ID NO: 136687 - DNA, 6 bp, Unknown
  misc_feature (1)..( 6): Result.003 file - promoters60/4767679
atgaaa

SEQ ID NO: 136688 - DNA, 6 bp, Unknown
  misc_feature (1)..( 6): Result.003 file - promoters60/4767679
atgaaa

SEQ ID NO: 136689 - DNA, 8 bp, Unknown
  misc_feature (1)..( 8): Result.003 file - promoters60/4767679
aaaaacaa

SEQ ID NO: 136690 - DNA, 8 bp, Unknown
  misc_feature (1)..( 8): Result.003 file - promoters60/4767679
aaacacaa

SEQ ID NO: 136691 - DNA, 6 bp, Unknown
  misc_feature (1)..( 6): Result.003 file - promoters60/4767679
ttaatg

SEQ ID NO: 136692 - DNA, 6 bp, Unknown
  misc_feature (1)..( 6): Result.003 file - promoters60/4767679
ttaatg

SEQ ID NO: 136693 - DNA, 14 bp, Unknown
  misc_feature (1)..( 14): Result.003 file - promoters60/4767683
tatattaaattttt

SEQ ID NO: 136694 - DNA, 14 bp, Unknown
  misc_feature (1)..( 14): Result.003 file - promoters60/4767683
tatataaaaaaaaa

SEQ ID NO: 136695 - DNA, 14 bp, Unknown
  misc_feature (1)..( 14): Result.003 file - promoters60/4767683
tatatagatagcta

SEQ ID NO: 136696 - DNA, 14 bp, Unknown
  misc_feature (1)..( 14): Result.003 file - promoters60/4767683
agaataaaagaaaa

SEQ ID NO: 136697 - DNA, 14 bp, Unknown
  misc_feature (1)..( 14): Result.003 file - promoters60/4767683
ttgataaaggaagt

SEQ ID NO: 136698 - DNA, 11 bp, Unknown
  misc_feature (1)..( 11): Result.003 file - promoters60/4767683
caaaatcaaat

SEQ ID NO: 136699 - DNA, 11 bp, Unknown
  misc_feature (1)..( 11): Result.003 file - promoters60/4767683
ggaaagcaatg

SEQ ID NO: 136700 - DNA, 11 bp, Unknown
  misc_feature (1)..( 11): Result.003 file - promoters60/4767683
aaaaagaaatg

SEQ ID NO: 136701 - DNA, 11 bp, Unknown
  misc_feature (1)..( 11): Result.003 file - promoters60/4767683
aaaaaaaaatg

SEQ ID NO: 136702 - DNA, 9 bp, Unknown
  misc_feature (1)..( 9): Result.003 file - promoters60/4767683
caagcagag

SEQ ID NO: 136703 - DNA, 9 bp, Unknown
  misc_feature (1)..( 9): Result.003 file - promoters60/4767683
aaagaagag

SEQ ID NO: 136704 - DNA, 9 bp, Unknown
  misc_feature (1)..( 9): Result.003 file - promoters60/4767683
agggaagag

SEQ ID NO: 136705 - DNA, 9 bp, Unknown
  misc_feature (1)..( 9): Result.003 file - promoters60/4767683
aaaaaagaa

SEQ ID NO: 136706 - DNA, 17 bp, Unknown
  misc_feature (1)..( 17): Result.003 file - promoters60/4767683
cagagaggcaaaatcaa

SEQ ID NO: 136707 - DNA, 17 bp, Unknown
  misc_feature (1)..( 17): Result.003 file - promoters60/4767683
atacaccccaaaatatc

SEQ ID NO: 136708 - DNA, 17 bp, Unknown
  misc_feature (1)..( 17): Result.003 file - promoters60/4767683
tgagtagtgtaaattat

SEQ ID NO: 136709 - DNA, 17 bp, Unknown
  misc_feature (1)..( 17): Result.003 file - promoters60/4767683
agtaatgtcaattttga

SEQ ID NO: 136710 - DNA, 17 bp, Unknown
  misc_feature (1)..( 17): Result.003 file - promoters60/4767683
ttttagtttaaaatagg

SEQ ID NO: 136711 - DNA, 8 bp, Unknown
  misc_feature (1)..( 8): Result.003 file - promoters60/4767683
tttagact

SEQ ID NO: 136712 - DNA, 8 bp, Unknown
  misc_feature (1)..( 8): Result.003 file - promoters60/4767683
attatact

SEQ ID NO: 136713 - DNA, 8 bp, Unknown
  misc_feature (1)..( 8): Result.003 file - promoters60/4767683
ttttgaca

SEQ ID NO: 136714 - DNA, 8 bp, Unknown
  misc_feature (1)..( 8): Result.003 file - promoters60/4767683
attataag

SEQ ID NO: 136715 - DNA, 9 bp, Unknown
  misc_feature (1)..( 9): Result.003 file - promoters60/4767701
ttttgttac

SEQ ID NO: 136716 - DNA, 9 bp, Unknown
  misc_feature (1)..( 9): Result.003 file - promoters60/4767701
cattgttaa

SEQ ID NO: 136717 - DNA, 9 bp, Unknown
  misc_feature (1)..( 9): Result.003 file - promoters60/4767701
atttgatac

SEQ ID NO: 136718 - DNA, 9 bp, Unknown
  misc_feature (1)..( 9): Result.003 file - promoters60/4767701
aattgtttg

SEQ ID NO: 136719 - DNA, 9 bp, Unknown
  misc_feature (1)..( 9): Result.003 file - promoters60/4767701
cattttttc

SEQ ID NO: 136720 - DNA, 9 bp, Unknown
  misc_feature (1)..( 9): Result.003 file - promoters60/4767701
aatttttcg

SEQ ID NO: 136721 - DNA, 9 bp, Unknown
  misc_feature (1)..( 9): Result.003 file - promoters60/4767701
atttgatcg

SEQ ID NO: 136722 - DNA, 9 bp, Unknown
  misc_feature (1)..( 9): Result.003 file - promoters60/4767705
atactaatt

SEQ ID NO: 136723 - DNA, 9 bp, Unknown
  misc_feature (1)..( 9): Result.003 file - promoters60/4767705
ataataatt

SEQ ID NO: 136724 - DNA, 9 bp, Unknown
  misc_feature (1)..( 9): Result.003 file - promoters60/4767705
agaataatg

SEQ ID NO: 136725 - DNA, 13 bp, Unknown
  misc_feature (1)..( 13): Result.003 file - promoters60/4767705
ttatttttttaaa

SEQ ID NO: 136726 - DNA, 13 bp, Unknown
  misc_feature (1)..( 13): Result.003 file - promoters60/4767705
ttatatttttaat

SEQ ID NO: 136727 - DNA, 13 bp, Unknown
  misc_feature (1)..( 13): Result.003 file - promoters60/4767705
caatgcatttaaa

SEQ ID NO: 136728 - DNA, 7 bp, Unknown
  misc_feature (1)..( 7): Result.003 file - promoters60/4767705
ttaaaaa

SEQ ID NO: 136729 - DNA, 7 bp, Unknown
  misc_feature (1)..( 7): Result.003 file - promoters60/4767705
ctaaaaa

SEQ ID NO: 136730 - DNA, 7 bp, Unknown
  misc_feature (1)..( 7): Result.003 file - promoters60/4767705
ttaaaat

SEQ ID NO: 136731 - DNA, 9 bp, Unknown
  misc_feature (1)..( 9): Result.003 file - promoters60/4767705
ctaaattga

SEQ ID NO: 136732 - DNA, 9 bp, Unknown
  misc_feature (1)..( 9): Result.003 file - promoters60/4767705
aaaaattga

SEQ ID NO: 136733 - DNA, 9 bp, Unknown
  misc_feature (1)..( 9): Result.003 file - promoters60/4767705
aaaaattct

SEQ ID NO: 136734 - DNA, 10 bp, Unknown
  misc_feature (1)..( 10): Result.003 file - promoters60/4767705
taatgaaagc

SEQ ID NO: 136735 - DNA, 10 bp, Unknown
  misc_feature (1)..( 10): Result.003 file - promoters60/4767705
aaatgaaaaa

SEQ ID NO: 136736 - DNA, 10 bp, Unknown
  misc_feature (1)..( 10): Result.003 file - promoters60/4767705
aaaagaaaaa

SEQ ID NO: 136737 - DNA, 10 bp, Unknown
  misc_feature (1)..( 10): Result.003 file - promoters60/4767705
aatttatctg

SEQ ID NO: 136738 - DNA, 10 bp, Unknown
  misc_feature (1)..( 10): Result.003 file - promoters60/4767705
ggtttctctg

SEQ ID NO: 136739 - DNA, 10 bp, Unknown
  misc_feature (1)..( 10): Result.003 file - promoters60/4767705
aatgtatacg

SEQ ID NO: 136740 - DNA, 7 bp, Unknown
  misc_feature (1)..( 7): Result.003 file - promoters60/4767705
attggat

SEQ ID NO: 136741 - DNA, 7 bp, Unknown
  misc_feature (1)..( 7): Result.003 file - promoters60/4767705
attcgat

SEQ ID NO: 136742 - DNA, 7 bp, Unknown
  misc_feature (1)..( 7): Result.003 file - promoters60/4767705
attggac

SEQ ID NO: 136743 - DNA, 8 bp, Unknown
  misc_feature (1)..( 8): Result.003 file - promoters60/4767705
gataaaat

SEQ ID NO: 136744 - DNA, 8 bp, Unknown
  misc_feature (1)..( 8): Result.003 file - promoters60/4767705
gataaaaa

SEQ ID NO: 136745 - DNA, 8 bp, Unknown
  misc_feature (1)..( 8): Result.003 file - promoters60/4767705
actaaaaa

SEQ ID NO: 136746 - DNA, 7 bp, Unknown
  misc_feature (1)..( 7): Result.003 file - promoters60/4767705
attattt

SEQ ID NO: 136747 - DNA, 7 bp, Unknown
  misc_feature (1)..( 7): Result.003 file - promoters60/4767705
tttattt

SEQ ID NO: 136748 - DNA, 7 bp, Unknown
  misc_feature (1)..( 7): Result.003 file - promoters60/4767705
attaatt

SEQ ID NO: 136749 - DNA, 8 bp, Unknown
  misc_feature (1)..( 8): Result.003 file - promoters60/4767705
caaataat

SEQ ID NO: 136750 - DNA, 8 bp, Unknown
  misc_feature (1)..( 8): Result.003 file - promoters60/4767705
taaaaaat

SEQ ID NO: 136751 - DNA, 8 bp, Unknown
  misc_feature (1)..( 8): Result.003 file - promoters60/4767705
taaaaatt

SEQ ID NO: 136752 - DNA, 6 bp, Unknown
  misc_feature (1)..( 6): Result.003 file - promoters60/4767705
aagaaa

SEQ ID NO: 136753 - DNA, 6 bp, Unknown
  misc_feature (1)..( 6): Result.003 file - promoters60/4767705
aagaaa

SEQ ID NO: 136754 - DNA, 6 bp, Unknown
  misc_feature (1)..( 6): Result.003 file - promoters60/4767705
aagaaa

SEQ ID NO: 136755 - DNA, 8 bp, Unknown
  misc_feature (1)..( 8): Result.003 file - promoters60/4767705
aaatgtaa

SEQ ID NO: 136756 - DNA, 8 bp, Unknown
  misc_feature (1)..( 8): Result.003 file - promoters60/4767705
aaaagtaa

SEQ ID NO: 136757 - DNA, 8 bp, Unknown
  misc_feature (1)..( 8): Result.003 file - promoters60/4767705
aaattaaa

SEQ ID NO: 136758 - DNA, 9 bp, Unknown
  misc_feature (1)..( 9): Result.003 file - promoters60/4767715
tttggtaaa

SEQ ID NO: 136759 - DNA, 9 bp, Unknown
  misc_feature (1)..( 9): Result.003 file - promoters60/4767715
aatggtaaa

SEQ ID NO: 136760 - DNA, 9 bp, Unknown
  misc_feature (1)..( 9): Result.003 file - promoters60/4767715
ttttgtagt

SEQ ID NO: 136761 - DNA, 8 bp, Unknown
  misc_feature (1)..( 8): Result.003 file - promoters60/4767715
aaagttaa

SEQ ID NO: 136762 - DNA, 8 bp, Unknown
  misc_feature (1)..( 8): Result.003 file - promoters60/4767715
aaatttaa

SEQ ID NO: 136763 - DNA, 7 bp, Unknown
  misc_feature (1)..( 7): Result.003 file - promoters60/4767715
tttttaa

SEQ ID NO: 136764 - DNA, 7 bp, Unknown
  misc_feature (1)..( 7): Result.003 file - promoters60/4767715
tttttaa

SEQ ID NO: 136765 - DNA, 11 bp, Unknown
  misc_feature (1)..( 11): Result.003 file - promoters60/4767715
aaaaacaacaa

SEQ ID NO: 136766 - DNA, 11 bp, Unknown
  misc_feature (1)..( 11): Result.003 file - promoters60/4767715
aaaaaaaacaa

SEQ ID NO: 136767 - DNA, 9 bp, Unknown
  misc_feature (1)..( 9): Result.003 file - promoters60/4767715
aaacaaaaa

SEQ ID NO: 136768 - DNA, 9 bp, Unknown
  misc_feature (1)..( 9): Result.003 file - promoters60/4767715
aaaaaaaaa

SEQ ID NO: 136769 - DNA, 9 bp, Unknown
  misc_feature (1)..( 9): Result.003 file - promoters60/4767715
aaaccaatt

SEQ ID NO: 136770 - DNA, 6 bp, Unknown
  misc_feature (1)..( 6): Result.003 file - promoters60/4767715
actttt

SEQ ID NO: 136771 - DNA, 6 bp, Unknown
  misc_feature (1)..( 6): Result.003 file - promoters60/4767715
actttt

SEQ ID NO: 136772 - DNA, 6 bp, Unknown
  misc_feature (1)..( 6): Result.003 file - promoters60/4767715
gaaaat

SEQ ID NO: 136773 - DNA, 6 bp, Unknown
  misc_feature (1)..( 6): Result.003 file - promoters60/4767715
gaaaat

SEQ ID NO: 136774 - DNA, 6 bp, Unknown
  misc_feature (1)..( 6): Result.003 file - promoters60/4767715
gtttga

SEQ ID NO: 136775 - DNA, 6 bp, Unknown
  misc_feature (1)..( 6): Result.003 file - promoters60/4767715
gtttga

SEQ ID NO: 136776 - DNA, 9 bp, Unknown
  misc_feature (1)..( 9): Result.003 file - promoters60/4767715
attttgttg

SEQ ID NO: 136777 - DNA, 9 bp, Unknown
  misc_feature (1)..( 9): Result.003 file - promoters60/4767715
atttttttg

SEQ ID NO: 136778 - DNA, 6 bp, Unknown
  misc_feature (1)..( 6): Result.003 file - promoters60/4767715
gttgtg

SEQ ID NO: 136779 - DNA, 6 bp, Unknown
  misc_feature (1)..( 6): Result.003 file - promoters60/4767715
gttgtg

SEQ ID NO: 136780 - DNA, 7 bp, Unknown
  misc_feature (1)..( 7): Result.003 file - promoters60/4767715
aaaagtt

SEQ ID NO: 136781 - DNA, 7 bp, Unknown
  misc_feature (1)..( 7): Result.003 file - promoters60/4767715
aaatgtt

SEQ ID NO: 136782 - DNA, 7 bp, Unknown
  misc_feature (1)..( 7): Result.003 file - promoters60/4767715
gtattat

SEQ ID NO: 136783 - DNA, 7 bp, Unknown
  misc_feature (1)..( 7): Result.003 file - promoters60/4767715
gtattat

SEQ ID NO: 136784 - DNA, 10 bp, Unknown
  misc_feature (1)..( 10): Result.003 file - promoters60/4767715
acctgctcat

SEQ ID NO: 136785 - DNA, 10 bp, Unknown
  misc_feature (1)..( 10): Result.003 file - promoters60/4767715
accttctcat

SEQ ID NO: 136786 - DNA, 7 bp, Unknown
  misc_feature (1)..( 7): Result.003 file - promoters60/4767715
ttcttct

SEQ ID NO: 136787 - DNA, 7 bp, Unknown
  misc_feature (1)..( 7): Result.003 file - promoters60/4767715
ttcttct

SEQ ID NO: 136788 - DNA, 10 bp, Unknown
  misc_feature (1)..( 10): Result.003 file - promoters60/4767748
caaaacacat

SEQ ID NO: 136789 - DNA, 10 bp, Unknown
  misc_feature (1)..( 10): Result.003 file - promoters60/4767748
caaaacatcc

SEQ ID NO: 136790 - DNA, 10 bp, Unknown
  misc_feature (1)..( 10): Result.003 file - promoters60/4767748
taaaacaaaa

SEQ ID NO: 136791 - DNA, 10 bp, Unknown
  misc_feature (1)..( 10): Result.003 file - promoters60/4767748
caaaaccgtt

SEQ ID NO: 136792 - DNA, 10 bp, Unknown
  misc_feature (1)..( 10): Result.003 file - promoters60/4767748
gcaaataaat

SEQ ID NO: 136793 - DNA, 10 bp, Unknown
  misc_feature (1)..( 10): Result.003 file - promoters60/4767748
ctaaacaaaa

SEQ ID NO: 136794 - DNA, 7 bp, Unknown
  misc_feature (1)..( 7): Result.003 file - promoters60/4767764
gcaaaag

SEQ ID NO: 136795 - DNA, 7 bp, Unknown
  misc_feature (1)..( 7): Result.003 file - promoters60/4767764
gcagaag

SEQ ID NO: 136796 - DNA, 6 bp, Unknown
  misc_feature (1)..( 6): Result.003 file - promoters60/4767764
tttaaa

SEQ ID NO: 136797 - DNA, 6 bp, Unknown
  misc_feature (1)..( 6): Result.003 file - promoters60/4767764
tttaaa

SEQ ID NO: 136798 - DNA, 7 bp, Unknown
  misc_feature (1)..( 7): Result.003 file - promoters60/4767764
tttcaaa

SEQ ID NO: 136799 - DNA, 7 bp, Unknown
  misc_feature (1)..( 7): Result.003 file - promoters60/4767764
aaacatt

SEQ ID NO: 136800 - DNA, 7 bp, Unknown
  misc_feature (1)..( 7): Result.003 file - promoters60/4767764
aaagatt

SEQ ID NO: 136801 - DNA, 7 bp, Unknown
  misc_feature (1)..( 7): Result.003 file - promoters60/4767764
tcaaatt

SEQ ID NO: 136802 - DNA, 7 bp, Unknown
  misc_feature (1)..( 7): Result.003 file - promoters60/4767764
tcagatt

SEQ ID NO: 136803 - DNA, 6 bp, Unknown
  misc_feature (1)..( 6): Result.003 file - promoters60/4767764
aaaata

SEQ ID NO: 136804 - DNA, 6 bp, Unknown
  misc_feature (1)..( 6): Result.003 file - promoters60/4767764
aaaata

SEQ ID NO: 136805 - DNA, 7 bp, Unknown
  misc_feature (1)..( 7): Result.003 file - promoters60/4767764
tgagacg

SEQ ID NO: 136806 - DNA, 7 bp, Unknown
  misc_feature (1)..( 7): Result.003 file - promoters60/4767764
tgagacg

SEQ ID NO: 136807 - DNA, 8 bp, Unknown
  misc_feature (1)..( 8): Result.003 file - promoters60/4767764
gaacaagg

SEQ ID NO: 136808 - DNA, 8 bp, Unknown
  misc_feature (1)..( 8): Result.003 file - promoters60/4767764
gaaaaagg

SEQ ID NO: 136809 - DNA, 6 bp, Unknown
  misc_feature (1)..( 6): Result.003 file - promoters60/4767764
aagcaa

SEQ ID NO: 136810 - DNA, 6 bp, Unknown
  misc_feature (1)..( 6): Result.003 file - promoters60/4767764
aagcaa

SEQ ID NO: 136811 - DNA, 15 bp, Unknown
  misc_feature (1)..( 15): Result.003 file - promoters60/4767764
aaattgtttcaaacg

SEQ ID NO: 136812 - DNA, 15 bp, Unknown
  misc_feature (1)..( 15): Result.003 file - promoters60/4767764
aaattgtatacatat

SEQ ID NO: 136813 - DNA, 15 bp, Unknown
  misc_feature (1)..( 15): Result.003 file - promoters60/4767764
gcattggatagatat

SEQ ID NO: 136814 - DNA, 9 bp, Unknown
  misc_feature (1)..( 9): Result.003 file - promoters60/4767764
ttaatatct

SEQ ID NO: 136815 - DNA, 9 bp, Unknown
  misc_feature (1)..( 9): Result.003 file - promoters60/4767764
ttaatattt

SEQ ID NO: 136816 - DNA, 9 bp, Unknown
  misc_feature (1)..( 9): Result.003 file - promoters60/4767764
ataatcttt

SEQ ID NO: 136817 - DNA, 6 bp, Unknown
  misc_feature (1)..( 6): Result.003 file - promoters60/4767764
acaaaa

SEQ ID NO: 136818 - DNA, 6 bp, Unknown
  misc_feature (1)..( 6): Result.003 file - promoters60/4767764
acaaaa

SEQ ID NO: 136819 - DNA, 8 bp, Unknown
  misc_feature (1)..( 8): Result.003 file - promoters60/4767764
aagtcaaa

SEQ ID NO: 136820 - DNA, 8 bp, Unknown
  misc_feature (1)..( 8): Result.003 file - promoters60/4767764
aagtgaaa

SEQ ID NO: 136821 - DNA, 9 bp, Unknown
  misc_feature (1)..( 9): Result.003 file - promoters60/4767764
aaatactac

SEQ ID NO: 136822 - DNA, 9 bp, Unknown
  misc_feature (1)..( 9): Result.003 file - promoters60/4767764
taatgctac

SEQ ID NO: 136823 - DNA, 9 bp, Unknown
  misc_feature (1)..( 9): Result.003 file - promoters60/4767764
taacgctta

SEQ ID NO: 136824 - DNA, 8 bp, Unknown
  misc_feature (1)..( 8): Result.003 file - promoters60/4767764
tattttac

SEQ ID NO: 136825 - DNA, 8 bp, Unknown
  misc_feature (1)..( 8): Result.003 file - promoters60/4767764
tatattac

SEQ ID NO: 136826 - DNA, 6 bp, Unknown
  misc_feature (1)..( 6): Result.003 file - promoters60/4767764
tatttt

SEQ ID NO: 136827 - DNA, 6 bp, Unknown
  misc_feature (1)..( 6): Result.003 file - promoters60/4767764
tatttt

SEQ ID NO: 136828 - DNA, 6 bp, Unknown
  misc_feature (1)..( 6): Result.003 file - promoters60/4767764
gaacat

SEQ ID NO: 136829 - DNA, 6 bp, Unknown
  misc_feature (1)..( 6): Result.003 file - promoters60/4767764
gaacat

SEQ ID NO: 136830 - DNA, 6 bp, Unknown
  misc_feature (1)..( 6): Result.003 file - promoters60/4767764
tttata

SEQ ID NO: 136831 - DNA, 6 bp, Unknown
  misc_feature (1)..( 6): Result.003 file - promoters60/4767764
tttata

SEQ ID NO: 136832 - DNA, 8 bp, Unknown
  misc_feature (1)..( 8): Result.003 file - promoters60/4767764
aatcttta

SEQ ID NO: 136833 - DNA, 8 bp, Unknown
  misc_feature (1)..( 8): Result.003 file - promoters60/4767764
aatgttta

SEQ ID NO: 136834 - DNA, 6 bp, Unknown
  misc_feature (1)..( 6): Result.003 file - promoters60/4767764
aacaac

SEQ ID NO: 136835 - DNA, 6 bp, Unknown
  misc_feature (1)..( 6): Result.003 file - promoters60/4767764
aacaac

SEQ ID NO: 136836 - DNA, 8 bp, Unknown
  misc_feature (1)..( 8): Result.003 file - promoters60/4767764
gtaataat

SEQ ID NO: 136837 - DNA, 8 bp, Unknown
  misc_feature (1)..( 8): Result.003 file - promoters60/4767764
gtattaat

SEQ ID NO: 136838 - DNA, 8 bp, Unknown
  misc_feature (1)..( 8): Result.003 file - promoters60/4767767
cacagtat

SEQ ID NO: 136839 - DNA, 8 bp, Unknown
  misc_feature (1)..( 8): Result.003 file - promoters60/4767767
aacattat

SEQ ID NO: 136840 - DNA, 8 bp, Unknown
  misc_feature (1)..( 8): Result.003 file - promoters60/4767767
aaccttaa

SEQ ID NO: 136841 - DNA, 9 bp, Unknown
  misc_feature (1)..( 9): Result.003 file - promoters60/4767767
acttaaata

SEQ ID NO: 136842 - DNA, 9 bp, Unknown
  misc_feature (1)..( 9): Result.003 file - promoters60/4767767
actaaaata

SEQ ID NO: 136843 - DNA, 8 bp, Unknown
  misc_feature (1)..( 8): Result.003 file - promoters60/4767767
aatctata

SEQ ID NO: 136844 - DNA, 8 bp, Unknown
  misc_feature (1)..( 8): Result.003 file - promoters60/4767767
aatccata

SEQ ID NO: 136845 - DNA, 8 bp, Unknown
  misc_feature (1)..( 8): Result.003 file - promoters60/4767767
tatctatt

SEQ ID NO: 136846 - DNA, 7 bp, Unknown
  misc_feature (1)..( 7): Result.003 file - promoters60/4767767
aatgcaa

SEQ ID NO: 136847 - DNA, 7 bp, Unknown
  misc_feature (1)..( 7): Result.003 file - promoters60/4767767
aattcaa

SEQ ID NO: 136848 - DNA, 6 bp, Unknown
  misc_feature (1)..( 6): Result.003 file - promoters60/4767767
atcaca

SEQ ID NO: 136849 - DNA, 6 bp, Unknown
  misc_feature (1)..( 6): Result.003 file - promoters60/4767767
atcaca

SEQ ID NO: 136850 - DNA, 7 bp, Unknown
  misc_feature (1)..( 7): Result.003 file - promoters60/4767767
ttgaaaa

SEQ ID NO: 136851 - DNA, 7 bp, Unknown
  misc_feature (1)..( 7): Result.003 file - promoters60/4767767
ttggaaa

SEQ ID NO: 136852 - DNA, 7 bp, Unknown
  misc_feature (1)..( 7): Result.003 file - promoters60/4767767
aaccttg

SEQ ID NO: 136853 - DNA, 7 bp, Unknown
  misc_feature (1)..( 7): Result.003 file - promoters60/4767767
aacctta

SEQ ID NO: 136854 - DNA, 7 bp, Unknown
  misc_feature (1)..( 7): Result.003 file - promoters60/4767767
aacatta

SEQ ID NO: 136855 - DNA, 9 bp, Unknown
  misc_feature (1)..( 9): Result.003 file - promoters60/4767767
tttgattat

SEQ ID NO: 136856 - DNA, 9 bp, Unknown
  misc_feature (1)..( 9): Result.003 file - promoters60/4767767
catgaatat

SEQ ID NO: 136857 - DNA, 9 bp, Unknown
  misc_feature (1)..( 9): Result.003 file - promoters60/4767767
catcaatct

SEQ ID NO: 136858 - DNA, 7 bp, Unknown
  misc_feature (1)..( 7): Result.003 file - promoters60/4767767
ttataat

SEQ ID NO: 136859 - DNA, 7 bp, Unknown
  misc_feature (1)..( 7): Result.003 file - promoters60/4767767
ttagaat

SEQ ID NO: 136860 - DNA, 8 bp, Unknown
  misc_feature (1)..( 8): Result.003 file - promoters60/4767767
tttggagt

SEQ ID NO: 136861 - DNA, 8 bp, Unknown
  misc_feature (1)..( 8): Result.003 file - promoters60/4767767
tttgaagt

SEQ ID NO: 136862 - DNA, 7 bp, Unknown
  misc_feature (1)..( 7): Result.003 file - promoters60/4767767
acaaaaa

SEQ ID NO: 136863 - DNA, 7 bp, Unknown
  misc_feature (1)..( 7): Result.003 file - promoters60/4767767
acaaaaa

SEQ ID NO: 136864 - DNA, 6 bp, Unknown
  misc_feature (1)..( 6): Result.003 file - promoters60/4767767
aagcat

SEQ ID NO: 136865 - DNA, 6 bp, Unknown
  misc_feature (1)..( 6): Result.003 file - promoters60/4767767
aagcat

SEQ ID NO: 136866 - DNA, 7 bp, Unknown
  misc_feature (1)..( 7): Result.003 file - promoters60/4767767
ctaaatt

SEQ ID NO: 136867 - DNA, 7 bp, Unknown
  misc_feature (1)..( 7): Result.003 file - promoters60/4767767
ctagatt

SEQ ID NO: 136868 - DNA, 6 bp, Unknown
  misc_feature (1)..( 6): Result.003 file - promoters60/4767767
aataaa

SEQ ID NO: 136869 - DNA, 6 bp, Unknown
  misc_feature (1)..( 6): Result.003 file - promoters60/4767767
aataaa

SEQ ID NO: 136870 - DNA, 10 bp, Unknown
  misc_feature (1)..( 10): Result.003 file - promoters60/4767767
aaataaaaaa

SEQ ID NO: 136871 - DNA, 10 bp, Unknown
  misc_feature (1)..( 10): Result.003 file - promoters60/4767767
aaacaaaaaa

SEQ ID NO: 136872 - DNA, 6 bp, Unknown
  misc_feature (1)..( 6): Result.003 file - promoters60/4767767
tttcaa

SEQ ID NO: 136873 - DNA, 6 bp, Unknown
  misc_feature (1)..( 6): Result.003 file - promoters60/4767767
tttcaa

SEQ ID NO: 136874 - DNA, 6 bp, Unknown
  misc_feature (1)..( 6): Result.003 file - promoters60/4767767
aaaatg

SEQ ID NO: 136875 - DNA, 6 bp, Unknown
  misc_feature (1)..( 6): Result.003 file - promoters60/4767767
aaaatg

SEQ ID NO: 136876 - DNA, 6 bp, Unknown
  misc_feature (1)..( 6): Result.003 file - promoters60/4767767
gaaatt

SEQ ID NO: 136877 - DNA, 6 bp, Unknown
  misc_feature (1)..( 6): Result.003 file - promoters60/4767767
gaaatt

SEQ ID NO: 136878 - DNA, 8 bp, Unknown
  misc_feature (1)..( 8): Result.003 file - promoters60/4767767
aattcagc

SEQ ID NO: 136879 - DNA, 8 bp, Unknown
  misc_feature (1)..( 8): Result.003 file - promoters60/4767767
aattaagc

SEQ ID NO: 136880 - DNA, 7 bp, Unknown
  misc_feature (1)..( 7): Result.003 file - promoters60/4767767
aatattt

SEQ ID NO: 136881 - DNA, 7 bp, Unknown
  misc_feature (1)..( 7): Result.003 file - promoters60/4767767
aatcttt

SEQ ID NO: 136882 - DNA, 8 bp, Unknown
  misc_feature (1)..( 8): Result.003 file - promoters60/4767767
aaccctag

SEQ ID NO: 136883 - DNA, 8 bp, Unknown
  misc_feature (1)..( 8): Result.003 file - promoters60/4767767
aacgctag

SEQ ID NO: 136884 - DNA, 9 bp, Unknown
  misc_feature (1)..( 9): Result.003 file - promoters60/4767767
ttattgata

SEQ ID NO: 136885 - DNA, 9 bp, Unknown
  misc_feature (1)..( 9): Result.003 file - promoters60/4767767
ttatggata

SEQ ID NO: 136886 - DNA, 11 bp, Unknown
  misc_feature (1)..( 11): Result.003 file - promoters60/4767795
aaaatcataat

SEQ ID NO: 136887 - DNA, 11 bp, Unknown
  misc_feature (1)..( 11): Result.003 file - promoters60/4767795
aaactcaaaat

SEQ ID NO: 136888 - DNA, 11 bp, Unknown
  misc_feature (1)..( 11): Result.003 file - promoters60/4767795
ccaatcattag

SEQ ID NO: 136889 - DNA, 10 bp, Unknown
  misc_feature (1)..( 10): Result.003 file - promoters60/4767795
tgattagcaa

SEQ ID NO: 136890 - DNA, 10 bp, Unknown
  misc_feature (1)..( 10): Result.003 file - promoters60/4767795
tgattagtta

SEQ ID NO: 136891 - DNA, 10 bp, Unknown
  misc_feature (1)..( 10): Result.003 file - promoters60/4767795
tcattagtta

SEQ ID NO: 136892 - DNA, 8 bp, Unknown
  misc_feature (1)..( 8): Result.003 file - promoters60/4767795
ttagcaat

SEQ ID NO: 136893 - DNA, 8 bp, Unknown
  misc_feature (1)..( 8): Result.003 file - promoters60/4767795
ttagaaat

SEQ ID NO: 136894 - DNA, 6 bp, Unknown
  misc_feature (1)..( 6): Result.003 file - promoters60/4767795
atattt

SEQ ID NO: 136895 - DNA, 6 bp, Unknown
  misc_feature (1)..( 6): Result.003 file - promoters60/4767795
atattt

SEQ ID NO: 136896 - DNA, 6 bp, Unknown
  misc_feature (1)..( 6): Result.003 file - promoters60/4767795
ttccaa

SEQ ID NO: 136897 - DNA, 6 bp, Unknown
  misc_feature (1)..( 6): Result.003 file - promoters60/4767795
ttccaa

SEQ ID NO: 136898 - DNA, 6 bp, Unknown
  misc_feature (1)..( 6): Result.003 file - promoters60/4767795
catttt

SEQ ID NO: 136899 - DNA, 6 bp, Unknown
  misc_feature (1)..( 6): Result.003 file - promoters60/4767795
catttt

SEQ ID NO: 136900 - DNA, 8 bp, Unknown
  misc_feature (1)..( 8): Result.003 file - promoters60/4767795
tttattaa

SEQ ID NO: 136901 - DNA, 8 bp, Unknown
  misc_feature (1)..( 8): Result.003 file - promoters60/4767795
tttcttaa

SEQ ID NO: 136902 - DNA, 8 bp, Unknown
  misc_feature (1)..( 8): Result.003 file - promoters60/4767795
tttcataa

SEQ ID NO: 136903 - DNA, 7 bp, Unknown
  misc_feature (1)..( 7): Result.003 file - promoters60/4767795
aagaaac

SEQ ID NO: 136904 - DNA, 7 bp, Unknown
  misc_feature (1)..( 7): Result.003 file - promoters60/4767795
aagaaac

SEQ ID NO: 136905 - DNA, 7 bp, Unknown
  misc_feature (1)..( 7): Result.003 file - promoters60/4767795
ctctata

SEQ ID NO: 136906 - DNA, 7 bp, Unknown
  misc_feature (1)..( 7): Result.003 file - promoters60/4767795
ctctata

SEQ ID NO: 136907 - DNA, 8 bp, Unknown
  misc_feature (1)..( 8): Result.003 file - promoters60/4767795
gttatatt

SEQ ID NO: 136908 - DNA, 8 bp, Unknown
  misc_feature (1)..( 8): Result.003 file - promoters60/4767795
gttaaatt

SEQ ID NO: 136909 - DNA, 10 bp, Unknown
  misc_feature (1)..( 10): Result.003 file - promoters60/4767795
tttccatttt

SEQ ID NO: 136910 - DNA, 10 bp, Unknown
  misc_feature (1)..( 10): Result.003 file - promoters60/4767795
tttccaattt

SEQ ID NO: 136911 - DNA, 7 bp, Unknown
  misc_feature (1)..( 7): Result.003 file - promoters60/4767795
ttgattc

SEQ ID NO: 136912 - DNA, 7 bp, Unknown
  misc_feature (1)..( 7): Result.003 file - promoters60/4767795
ttgtttc

SEQ ID NO: 136913 - DNA, 7 bp, Unknown
  misc_feature (1)..( 7): Result.003 file - promoters60/4767795
aaacaaa

SEQ ID NO: 136914 - DNA, 7 bp, Unknown
  misc_feature (1)..( 7): Result.003 file - promoters60/4767795
aaaaaaa

SEQ ID NO: 136915 - DNA, 6 bp, Unknown
  misc_feature (1)..( 6): Result.003 file - promoters60/4767795
aaaata

SEQ ID NO: 136916 - DNA, 6 bp, Unknown
  misc_feature (1)..( 6): Result.003 file - promoters60/4767795
aaaata

SEQ ID NO: 136917 - DNA, 8 bp, Unknown
  misc_feature (1)..( 8): Result.003 file - promoters60/4767795
ttagagtt

SEQ ID NO: 136918 - DNA, 8 bp, Unknown
  misc_feature (1)..( 8): Result.003 file - promoters60/4767795
ttacagtt

SEQ ID NO: 136919 - DNA, 12 bp, Unknown
  misc_feature (1)..( 12): Result.003 file - promoters60/4767837
acaacaaaaaat

SEQ ID NO: 136920 - DNA, 12 bp, Unknown
  misc_feature (1)..( 12): Result.003 file - promoters60/4767837
acaaaaaacaat

SEQ ID NO: 136921 - DNA, 12 bp, Unknown
  misc_feature (1)..( 12): Result.003 file - promoters60/4767837
ctaaaaaaccgg

SEQ ID NO: 136922 - DNA, 9 bp, Unknown
  misc_feature (1)..( 9): Result.003 file - promoters60/4767837
ttcttcaat

SEQ ID NO: 136923 - DNA, 9 bp, Unknown
  misc_feature (1)..( 9): Result.003 file - promoters60/4767837
ttctacaat

SEQ ID NO: 136924 - DNA, 9 bp, Unknown
  misc_feature (1)..( 9): Result.003 file - promoters60/4767837
ctcttcata

SEQ ID NO: 136925 - DNA, 13 bp, Unknown
  misc_feature (1)..( 13): Result.003 file - promoters60/4767884
tagggtaagagag

SEQ ID NO: 136926 - DNA, 13 bp, Unknown
  misc_feature (1)..( 13): Result.003 file - promoters60/4767884
tggtgtaagaaaa

SEQ ID NO: 136927 - DNA, 13 bp, Unknown
  misc_feature (1)..( 13): Result.003 file - promoters60/4767884
ccgactaaaaaaa

SEQ ID NO: 136928 - DNA, 13 bp, Unknown
  misc_feature (1)..( 13): Result.003 file - promoters60/4767884
aattctaaaatct

SEQ ID NO: 136929 - DNA, 13 bp, Unknown
  misc_feature (1)..( 13): Result.003 file - promoters60/4767884
caaactaaaatat

SEQ ID NO: 136930 - DNA, 13 bp, Unknown
  misc_feature (1)..( 13): Result.003 file - promoters60/4767884
aattcttaaattt

SEQ ID NO: 136931 - DNA, 12 bp, Unknown
  misc_feature (1)..( 12): Result.003 file - promoters60/4767884
agagaaagaaag

SEQ ID NO: 136932 - DNA, 12 bp, Unknown
  misc_feature (1)..( 12): Result.003 file - promoters60/4767884
agaaaaaattca

SEQ ID NO: 136933 - DNA, 12 bp, Unknown
  misc_feature (1)..( 12): Result.003 file - promoters60/4767884
taaaaaaatctt

SEQ ID NO: 136934 - DNA, 12 bp, Unknown
  misc_feature (1)..( 12): Result.003 file - promoters60/4767884
ttaaaaaataat

SEQ ID NO: 136935 - DNA, 12 bp, Unknown
  misc_feature (1)..( 12): Result.003 file - promoters60/4767884
ttctaaaatctt

SEQ ID NO: 136936 - DNA, 12 bp, Unknown
  misc_feature (1)..( 12): Result.003 file - promoters60/4767884
atcatcaatctt

SEQ ID NO: 136937 - DNA, 12 bp, Unknown
  misc_feature (1)..( 12): Result.003 file - promoters60/4767884
tatattcgattc

SEQ ID NO: 136938 - DNA, 12 bp, Unknown
  misc_feature (1)..( 12): Result.003 file - promoters60/4767884
aatatttgatac

SEQ ID NO: 136939 - DNA, 12 bp, Unknown
  misc_feature (1)..( 12): Result.003 file - promoters60/4767884
gataattgttac

SEQ ID NO: 136940 - DNA, 12 bp, Unknown
  misc_feature (1)..( 12): Result.003 file - promoters60/4767884
cataattcaacg

SEQ ID NO: 136941 - DNA, 12 bp, Unknown
  misc_feature (1)..( 12): Result.003 file - promoters60/4767884
aatctttttttt

SEQ ID NO: 136942 - DNA, 12 bp, Unknown
  misc_feature (1)..( 12): Result.003 file - promoters60/4767884
taaattttatat

SEQ ID NO: 136943 - DNA, 13 bp, Unknown
  misc_feature (1)..( 13): Result.003 file - promoters60/4767892
ttagacgtgttta

SEQ ID NO: 136944 - DNA, 13 bp, Unknown
  misc_feature (1)..( 13): Result.003 file - promoters60/4767892
aaccacgtgtccg

SEQ ID NO: 136945 - DNA, 13 bp, Unknown
  misc_feature (1)..( 13): Result.003 file - promoters60/4767892
ttaaacgtgttta

SEQ ID NO: 136946 - DNA, 14 bp, Unknown
  misc_feature (1)..( 14): Result.003 file - promoters60/4767892
acatcattacatgc

SEQ ID NO: 136947 - DNA, 14 bp, Unknown
  misc_feature (1)..( 14): Result.003 file - promoters60/4767892
acattattacgaaa

SEQ ID NO: 136948 - DNA, 14 bp, Unknown
  misc_feature (1)..( 14): Result.003 file - promoters60/4767892
tgattaatactaaa

SEQ ID NO: 136949 - DNA, 14 bp, Unknown
  misc_feature (1)..( 14): Result.003 file - promoters60/4767892
cgcaacttacaaaa

SEQ ID NO: 136950 - DNA, 8 bp, Unknown
  misc_feature (1)..( 8): Result.003 file - promoters60/4767892
acaaacaa

SEQ ID NO: 136951 - DNA, 8 bp, Unknown
  misc_feature (1)..( 8): Result.003 file - promoters60/4767892
acaaacac

SEQ ID NO: 136952 - DNA, 8 bp, Unknown
  misc_feature (1)..( 8): Result.003 file - promoters60/4767892
ccaaaaaa

SEQ ID NO: 136953 - DNA, 8 bp, Unknown
  misc_feature (1)..( 8): Result.003 file - promoters60/4767892
agataaaa

SEQ ID NO: 136954 - DNA, 8 bp, Unknown
  misc_feature (1)..( 8): Result.003 file - promoters60/4767892
agaaaaaa

SEQ ID NO: 136955 - DNA, 8 bp, Unknown
  misc_feature (1)..( 8): Result.003 file - promoters60/4767892
agaaaaac

SEQ ID NO: 136956 - DNA, 8 bp, Unknown
  misc_feature (1)..( 8): Result.003 file - promoters60/4767892
tgttaaca

SEQ ID NO: 136957 - DNA, 8 bp, Unknown
  misc_feature (1)..( 8): Result.003 file - promoters60/4767892
tgtaaact

SEQ ID NO: 136958 - DNA, 8 bp, Unknown
  misc_feature (1)..( 8): Result.003 file - promoters60/4767892
cgtatact

SEQ ID NO: 136959 - DNA, 14 bp, Unknown
  misc_feature (1)..( 14): Result.003 file - promoters60/4767892
attattacgaaaac

SEQ ID NO: 136960 - DNA, 14 bp, Unknown
  misc_feature (1)..( 14): Result.003 file - promoters60/4767892
caacttacaaaaac

SEQ ID NO: 136961 - DNA, 14 bp, Unknown
  misc_feature (1)..( 14): Result.003 file - promoters60/4767892
attaatactaaata

SEQ ID NO: 136962 - DNA, 6 bp, Unknown
  misc_feature (1)..( 6): Result.003 file - promoters60/4767933
aaccct

SEQ ID NO: 136963 - DNA, 6 bp, Unknown
  misc_feature (1)..( 6): Result.003 file - promoters60/4767933
aaccct

SEQ ID NO: 136964 - DNA, 6 bp, Unknown
  misc_feature (1)..( 6): Result.003 file - promoters60/4767933
gcccaa

SEQ ID NO: 136965 - DNA, 6 bp, Unknown
  misc_feature (1)..( 6): Result.003 file - promoters60/4767933
gcccaa

SEQ ID NO: 136966 - DNA, 7 bp, Unknown
  misc_feature (1)..( 7): Result.003 file - promoters60/4767933
caataaa

SEQ ID NO: 136967 - DNA, 7 bp, Unknown
  misc_feature (1)..( 7): Result.003 file - promoters60/4767933
caaaaaa

SEQ ID NO: 136968 - DNA, 6 bp, Unknown
  misc_feature (1)..( 6): Result.003 file - promoters60/4767933
ttttca

SEQ ID NO: 136969 - DNA, 6 bp, Unknown
  misc_feature (1)..( 6): Result.003 file - promoters60/4767933
ttttca

SEQ ID NO: 136970 - DNA, 8 bp, Unknown
  misc_feature (1)..( 8): Result.003 file - promoters60/4767933
atccaaaa

SEQ ID NO: 136971 - DNA, 8 bp, Unknown
  misc_feature (1)..( 8): Result.003 file - promoters60/4767933
atccaaat

SEQ ID NO: 136972 - DNA, 8 bp, Unknown
  misc_feature (1)..( 8): Result.003 file - promoters60/4767933
atcgaaaa

SEQ ID NO: 136973 - DNA, 6 bp, Unknown
  misc_feature (1)..( 6): Result.003 file - promoters60/4767933
aatttc

SEQ ID NO: 136974 - DNA, 6 bp, Unknown
  misc_feature (1)..( 6): Result.003 file - promoters60/4767933
aatttc

SEQ ID NO: 136975 - DNA, 7 bp, Unknown
  misc_feature (1)..( 7): Result.003 file - promoters60/4767933
tatggac

SEQ ID NO: 136976 - DNA, 7 bp, Unknown
  misc_feature (1)..( 7): Result.003 file - promoters60/4767933
tattgac

SEQ ID NO: 136977 - DNA, 10 bp, Unknown
  misc_feature (1)..( 10): Result.003 file - promoters60/4767933
aaattgaaac

SEQ ID NO: 136978 - DNA, 10 bp, Unknown
  misc_feature (1)..( 10): Result.003 file - promoters60/4767933
aaatggaaac

SEQ ID NO: 136979 - DNA, 7 bp, Unknown
  misc_feature (1)..( 7): Result.003 file - promoters60/4767933
agtgaaa

SEQ ID NO: 136980 - DNA, 7 bp, Unknown
  misc_feature (1)..( 7): Result.003 file - promoters60/4767933
agtgaaa

SEQ ID NO: 136981 - DNA, 8 bp, Unknown
  misc_feature (1)..( 8): Result.003 file - promoters60/4767933
agtgggta

SEQ ID NO: 136982 - DNA, 8 bp, Unknown
  misc_feature (1)..( 8): Result.003 file - promoters60/4767933
agtcggta

SEQ ID NO: 136983 - DNA, 11 bp, Unknown
  misc_feature (1)..( 11): Result.003 file - promoters60/4767933
caatatgtaaa

SEQ ID NO: 136984 - DNA, 11 bp, Unknown
  misc_feature (1)..( 11): Result.003 file - promoters60/4767933
caatatggaaa

SEQ ID NO: 136985 - DNA, 8 bp, Unknown
  misc_feature (1)..( 8): Result.003 file - promoters60/4767933
attttgtc

SEQ ID NO: 136986 - DNA, 8 bp, Unknown
  misc_feature (1)..( 8): Result.003 file - promoters60/4767933
attttgtc

SEQ ID NO: 136987 - DNA, 6 bp, Unknown
  misc_feature (1)..( 6): Result.003 file - promoters60/4767933
tttttg

SEQ ID NO: 136988 - DNA, 6 bp, Unknown
  misc_feature (1)..( 6): Result.003 file - promoters60/4767933
tttttg

SEQ ID NO: 136989 - DNA, 8 bp, Unknown
  misc_feature (1)..( 8): Result.003 file - promoters60/4767933
aagaaaat

SEQ ID NO: 136990 - DNA, 8 bp, Unknown
  misc_feature (1)..( 8): Result.003 file - promoters60/4767933
aagaaaat

SEQ ID NO: 136991 - DNA, 10 bp, Unknown
  misc_feature (1)..( 10): Result.003 file - promoters60/4767933
aaataaaaat

SEQ ID NO: 136992 - DNA, 10 bp, Unknown
  misc_feature (1)..( 10): Result.003 file - promoters60/4767933
aaataataat

SEQ ID NO: 136993 - DNA, 6 bp, Unknown
  misc_feature (1)..( 6): Result.003 file - promoters60/4767933
aacaat

SEQ ID NO: 136994 - DNA, 6 bp, Unknown
  misc_feature (1)..( 6): Result.003 file - promoters60/4767933
aacaat

SEQ ID NO: 136995 - DNA, 9 bp, Unknown
  misc_feature (1)..( 9): Result.003 file - promoters60/4767944
agatacgaa

SEQ ID NO: 136996 - DNA, 9 bp, Unknown
  misc_feature (1)..( 9): Result.003 file - promoters60/4767944
agatgcgaa

SEQ ID NO: 136997 - DNA, 9 bp, Unknown
  misc_feature (1)..( 9): Result.003 file - promoters60/4767944
tttggtttg

SEQ ID NO: 136998 - DNA, 9 bp, Unknown
  misc_feature (1)..( 9): Result.003 file - promoters60/4767944
tttgatttg

SEQ ID NO: 136999 - DNA, 6 bp, Unknown
  misc_feature (1)..( 6): Result.003 file - promoters60/4767944
ttacga

SEQ ID NO: 137000 - DNA, 6 bp, Unknown
  misc_feature (1)..( 6): Result.003 file - promoters60/4767944
ttacga

SEQ ID NO: 137001 - DNA, 7 bp, Unknown
  misc_feature (1)..( 7): Result.003 file - promoters60/4767944
ccaaaac

SEQ ID NO: 137002 - DNA, 7 bp, Unknown
  misc_feature (1)..( 7): Result.003 file - promoters60/4767944
ccaaaac

SEQ ID NO: 137003 - DNA, 7 bp, Unknown
  misc_feature (1)..( 7): Result.003 file - promoters60/4767944
acaaaac

SEQ ID NO: 137004 - DNA, 8 bp, Unknown
  misc_feature (1)..( 8): Result.003 file - promoters60/4767944
caaaactt

SEQ ID NO: 137005 - DNA, 8 bp, Unknown
  misc_feature (1)..( 8): Result.003 file - promoters60/4767944
aaaacctt

SEQ ID NO: 137006 - DNA, 8 bp, Unknown
  misc_feature (1)..( 8): Result.003 file - promoters60/4767944
caaaacat

SEQ ID NO: 137007 - DNA, 7 bp, Unknown
  misc_feature (1)..( 7): Result.003 file - promoters60/4767944
actgtag

SEQ ID NO: 137008 - DNA, 7 bp, Unknown
  misc_feature (1)..( 7): Result.003 file - promoters60/4767944
actttag

SEQ ID NO: 137009 - DNA, 8 bp, Unknown
  misc_feature (1)..( 8): Result.003 file - promoters60/4767944
gataaatg

SEQ ID NO: 137010 - DNA, 8 bp, Unknown
  misc_feature (1)..( 8): Result.003 file - promoters60/4767944
gatagatg

SEQ ID NO: 137011 - DNA, 8 bp, Unknown
  misc_feature (1)..( 8): Result.003 file - promoters60/4767944
gattgatc

SEQ ID NO: 137012 - DNA, 8 bp, Unknown
  misc_feature (1)..( 8): Result.003 file - promoters60/4767944
aaaacatg

SEQ ID NO: 137013 - DNA, 8 bp, Unknown
  misc_feature (1)..( 8): Result.003 file - promoters60/4767944
aaaacatg

SEQ ID NO: 137014 - DNA, 7 bp, Unknown
  misc_feature (1)..( 7): Result.003 file - promoters60/4767944
aatgaat

SEQ ID NO: 137015 - DNA, 7 bp, Unknown
  misc_feature (1)..( 7): Result.003 file - promoters60/4767944
aataaat

SEQ ID NO: 137016 - DNA, 7 bp, Unknown
  misc_feature (1)..( 7): Result.003 file - promoters60/4767944
tccaata

SEQ ID NO: 137017 - DNA, 7 bp, Unknown
  misc_feature (1)..( 7): Result.003 file - promoters60/4767944
tccaata

SEQ ID NO: 137018 - DNA, 9 bp, Unknown
  misc_feature (1)..( 9): Result.003 file - promoters60/4767944
tatacatca

SEQ ID NO: 137019 - DNA, 9 bp, Unknown
  misc_feature (1)..( 9): Result.003 file - promoters60/4767944
tataaatca

SEQ ID NO: 137020 - DNA, 6 bp, Unknown
  misc_feature (1)..( 6): Result.003 file - promoters60/4767944
gaaaaa

SEQ ID NO: 137021 - DNA, 6 bp, Unknown
  misc_feature (1)..( 6): Result.003 file - promoters60/4767944
gaaaaa

SEQ ID NO: 137022 - DNA, 7 bp, Unknown
  misc_feature (1)..( 7): Result.003 file - promoters60/4767944
aatatat

SEQ ID NO: 137023 - DNA, 7 bp, Unknown
  misc_feature (1)..( 7): Result.003 file - promoters60/4767944
aatttat

SEQ ID NO: 137024 - DNA, 7 bp, Unknown
  misc_feature (1)..( 7): Result.003 file - promoters60/4767944
ccaaaac

SEQ ID NO: 137025 - DNA, 7 bp, Unknown
  misc_feature (1)..( 7): Result.003 file - promoters60/4767944
ccaaaac

SEQ ID NO: 137026 - DNA, 7 bp, Unknown
  misc_feature (1)..( 7): Result.003 file - promoters60/4767944
accgaat

SEQ ID NO: 137027 - DNA, 7 bp, Unknown
  misc_feature (1)..( 7): Result.003 file - promoters60/4767944
accaaat

SEQ ID NO: 137028 - DNA, 9 bp, Unknown
  misc_feature (1)..( 9): Result.003 file - promoters60/4767952
agaaagaaa

SEQ ID NO: 137029 - DNA, 9 bp, Unknown
  misc_feature (1)..( 9): Result.003 file - promoters60/4767952
ggaatgaat

SEQ ID NO: 137030 - DNA, 9 bp, Unknown
  misc_feature (1)..( 9): Result.003 file - promoters60/4767952
agaaagtgt

SEQ ID NO: 137031 - DNA, 9 bp, Unknown
  misc_feature (1)..( 9): Result.003 file - promoters60/4767952
taaaagaaa

SEQ ID NO: 137032 - DNA, 8 bp, Unknown
  misc_feature (1)..( 8): Result.003 file - promoters60/4767952
gaatgttt

SEQ ID NO: 137033 - DNA, 8 bp, Unknown
  misc_feature (1)..( 8): Result.003 file - promoters60/4767952
aaatgttg

SEQ ID NO: 137034 - DNA, 8 bp, Unknown
  misc_feature (1)..( 8): Result.003 file - promoters60/4767952
taatgttt

SEQ ID NO: 137035 - DNA, 8 bp, Unknown
  misc_feature (1)..( 8): Result.003 file - promoters60/4767952
aaaggttg

SEQ ID NO: 137036 - DNA, 10 bp, Unknown
  misc_feature (1)..( 10): Result.003 file - promoters60/4767952
ataaattaaa

SEQ ID NO: 137037 - DNA, 10 bp, Unknown
  misc_feature (1)..( 10): Result.003 file - promoters60/4767952
tttaatcaaa

SEQ ID NO: 137038 - DNA, 10 bp, Unknown
  misc_feature (1)..( 10): Result.003 file - promoters60/4767952
ataaataaaa

SEQ ID NO: 137039 - DNA, 10 bp, Unknown
  misc_feature (1)..( 10): Result.003 file - promoters60/4767952
attgataaat

SEQ ID NO: 137040 - DNA, 9 bp, Unknown
  misc_feature (1)..( 9): Result.003 file - promoters60/4767952
aatgaaacg

SEQ ID NO: 137041 - DNA, 9 bp, Unknown
  misc_feature (1)..( 9): Result.003 file - promoters60/4767952
aattaaatt

SEQ ID NO: 137042 - DNA, 9 bp, Unknown
  misc_feature (1)..( 9): Result.003 file - promoters60/4767952
tattaaatg

SEQ ID NO: 137043 - DNA, 9 bp, Unknown
  misc_feature (1)..( 9): Result.003 file - promoters60/4767952
ttttacatt

SEQ ID NO: 137044 - DNA, 9 bp, Unknown
  misc_feature (1)..( 9): Result.003 file - promoters60/4767952
tattaaatg

SEQ ID NO: 137045 - DNA, 9 bp, Unknown
  misc_feature (1)..( 9): Result.003 file - promoters60/4767952
ataaataaa

SEQ ID NO: 137046 - DNA, 9 bp, Unknown
  misc_feature (1)..( 9): Result.003 file - promoters60/4767952
ataaataaa

SEQ ID NO: 137047 - DNA, 9 bp, Unknown
  misc_feature (1)..( 9): Result.003 file - promoters60/4767952
acaaaaaaa

SEQ ID NO: 137048 - DNA, 9 bp, Unknown
  misc_feature (1)..( 9): Result.003 file - promoters60/4767952
ataaatgca

SEQ ID NO: 137049 - DNA, 11 bp, Unknown
  misc_feature (1)..( 11): Result.003 file - promoters60/4767952
aaaaaagaaag

SEQ ID NO: 137050 - DNA, 11 bp, Unknown
  misc_feature (1)..( 11): Result.003 file - promoters60/4767952
aaagaagaacg

SEQ ID NO: 137051 - DNA, 11 bp, Unknown
  misc_feature (1)..( 11): Result.003 file - promoters60/4767952
aatgaataacg

SEQ ID NO: 137052 - DNA, 11 bp, Unknown
  misc_feature (1)..( 11): Result.003 file - promoters60/4767952
ataaaagaaaa

SEQ ID NO: 137053 - DNA, 8 bp, Unknown
  misc_feature (1)..( 8): Result.003 file - promoters60/4767952
cgacgaaa

SEQ ID NO: 137054 - DNA, 8 bp, Unknown
  misc_feature (1)..( 8): Result.003 file - promoters60/4767952
agaccaaa

SEQ ID NO: 137055 - DNA, 8 bp, Unknown
  misc_feature (1)..( 8): Result.003 file - promoters60/4767952
agatcaat

SEQ ID NO: 137056 - DNA, 8 bp, Unknown
  misc_feature (1)..( 8): Result.003 file - promoters60/4767952
ggatcaaa

SEQ ID NO: 137057 - DNA, 11 bp, Unknown
  misc_feature (1)..( 11): Result.003 file - promoters60/4767952
attatgttaac

SEQ ID NO: 137058 - DNA, 11 bp, Unknown
  misc_feature (1)..( 11): Result.003 file - promoters60/4767952
aaaatgttaaa

SEQ ID NO: 137059 - DNA, 11 bp, Unknown
  misc_feature (1)..( 11): Result.003 file - promoters60/4767952
tgattgttaac

SEQ ID NO: 137060 - DNA, 11 bp, Unknown
  misc_feature (1)..( 11): Result.003 file - promoters60/4767952
aaaatgttgtt

SEQ ID NO: 137061 - DNA, 9 bp, Unknown
  misc_feature (1)..( 9): Result.003 file - promoters60/4767952
ttatcgatt

SEQ ID NO: 137062 - DNA, 9 bp, Unknown
  misc_feature (1)..( 9): Result.003 file - promoters60/4767952
agatcaatt

SEQ ID NO: 137063 - DNA, 9 bp, Unknown
  misc_feature (1)..( 9): Result.003 file - promoters60/4767952
agaccaaaa

SEQ ID NO: 137064 - DNA, 9 bp, Unknown
  misc_feature (1)..( 9): Result.003 file - promoters60/4767952
ggatcaaag

SEQ ID NO: 137065 - DNA, 8 bp, Unknown
  misc_feature (1)..( 8): Result.003 file - promoters60/4767956
caaccatt

SEQ ID NO: 137066 - DNA, 8 bp, Unknown
  misc_feature (1)..( 8): Result.003 file - promoters60/4767956
caaacata

SEQ ID NO: 137067 - DNA, 8 bp, Unknown
  misc_feature (1)..( 8): Result.003 file - promoters60/4767956
aaaacata

SEQ ID NO: 137068 - DNA, 8 bp, Unknown
  misc_feature (1)..( 8): Result.003 file - promoters60/4767956
caaacaaa

SEQ ID NO: 137069 - DNA, 10 bp, Unknown
  misc_feature (1)..( 10): Result.003 file - promoters60/4767972
gaaaatgaaa

SEQ ID NO: 137070 - DNA, 10 bp, Unknown
  misc_feature (1)..( 10): Result.003 file - promoters60/4767972
tgaaacgaat

SEQ ID NO: 137071 - DNA, 10 bp, Unknown
  misc_feature (1)..( 10): Result.003 file - promoters60/4767972
gaaaatgatt

SEQ ID NO: 137072 - DNA, 10 bp, Unknown
  misc_feature (1)..( 10): Result.003 file - promoters60/4767972
ttgaaccaat

SEQ ID NO: 137073 - DNA, 11 bp, Unknown
  misc_feature (1)..( 11): Result.003 file - promoters60/4767972
gaagataaaca

SEQ ID NO: 137074 - DNA, 11 bp, Unknown
  misc_feature (1)..( 11): Result.003 file - promoters60/4767972
gaaaatataca

SEQ ID NO: 137075 - DNA, 11 bp, Unknown
  misc_feature (1)..( 11): Result.003 file - promoters60/4767972
taaagtattta

SEQ ID NO: 137076 - DNA, 7 bp, Unknown
  misc_feature (1)..( 7): Result.003 file - promoters60/4767972
attaacc

SEQ ID NO: 137077 - DNA, 7 bp, Unknown
  misc_feature (1)..( 7): Result.003 file - promoters60/4767972
attaacc

SEQ ID NO: 137078 - DNA, 7 bp, Unknown
  misc_feature (1)..( 7): Result.003 file - promoters60/4767972
attaacc

SEQ ID NO: 137079 - DNA, 9 bp, Unknown
  misc_feature (1)..( 9): Result.003 file - promoters60/4767972
actgtcata

SEQ ID NO: 137080 - DNA, 9 bp, Unknown
  misc_feature (1)..( 9): Result.003 file - promoters60/4767972
actttcata

SEQ ID NO: 137081 - DNA, 9 bp, Unknown
  misc_feature (1)..( 9): Result.003 file - promoters60/4767972
actttaata

SEQ ID NO: 137082 - DNA, 6 bp, Unknown
  misc_feature (1)..( 6): Result.003 file - promoters60/4767976
aacatt

SEQ ID NO: 137083 - DNA, 6 bp, Unknown
  misc_feature (1)..( 6): Result.003 file - promoters60/4767976
aacatt

SEQ ID NO: 137084 - DNA, 8 bp, Unknown
  misc_feature (1)..( 8): Result.003 file - promoters60/4767976
tgtattaa

SEQ ID NO: 137085 - DNA, 8 bp, Unknown
  misc_feature (1)..( 8): Result.003 file - promoters60/4767976
tgtgttaa

SEQ ID NO: 137086 - DNA, 7 bp, Unknown
  misc_feature (1)..( 7): Result.003 file - promoters60/4767976
tttgtaa

SEQ ID NO: 137087 - DNA, 7 bp, Unknown
  misc_feature (1)..( 7): Result.003 file - promoters60/4767976
tttgtaa

SEQ ID NO: 137088 - DNA, 7 bp, Unknown
  misc_feature (1)..( 7): Result.003 file - promoters60/4767976
gaaaatt

SEQ ID NO: 137089 - DNA, 7 bp, Unknown
  misc_feature (1)..( 7): Result.003 file - promoters60/4767976
gaatatt

SEQ ID NO: 137090 - DNA, 9 bp, Unknown
  misc_feature (1)..( 9): Result.003 file - promoters60/4767976
ttatcttcc

SEQ ID NO: 137091 - DNA, 9 bp, Unknown
  misc_feature (1)..( 9): Result.003 file - promoters60/4767976
ttatgttcc

SEQ ID NO: 137092 - DNA, 8 bp, Unknown
  misc_feature (1)..( 8): Result.003 file - promoters60/4767976
attattgc

SEQ ID NO: 137093 - DNA, 8 bp, Unknown
  misc_feature (1)..( 8): Result.003 file - promoters60/4767976
atttttgc

SEQ ID NO: 137094 - DNA, 7 bp, Unknown
  misc_feature (1)..( 7): Result.003 file - promoters60/4767976
aataagc

SEQ ID NO: 137095 - DNA, 7 bp, Unknown
  misc_feature (1)..( 7): Result.003 file - promoters60/4767976
aatgagc

SEQ ID NO: 137096 - DNA, 6 bp, Unknown
  misc_feature (1)..( 6): Result.003 file - promoters60/4767976
taaagg

SEQ ID NO: 137097 - DNA, 6 bp, Unknown
  misc_feature (1)..( 6): Result.003 file - promoters60/4767976
taaagg

SEQ ID NO: 137098 - DNA, 7 bp, Unknown
  misc_feature (1)..( 7): Result.003 file - promoters60/4767976
aaatata

SEQ ID NO: 137099 - DNA, 7 bp, Unknown
  misc_feature (1)..( 7): Result.003 file - promoters60/4767976
aaagata

SEQ ID NO: 137100 - DNA, 7 bp, Unknown
  misc_feature (1)..( 7): Result.003 file - promoters60/4767976
tttcaat

SEQ ID NO: 137101 - DNA, 7 bp, Unknown
  misc_feature (1)..( 7): Result.003 file - promoters60/4767976
ttttaat

SEQ ID NO: 137102 - DNA, 8 bp, Unknown
  misc_feature (1)..( 8): Result.003 file - promoters60/4767976
gtttggtc

SEQ ID NO: 137103 - DNA, 8 bp, Unknown
  misc_feature (1)..( 8): Result.003 file - promoters60/4767976
gttgggtc

SEQ ID NO: 137104 - DNA, 6 bp, Unknown
  misc_feature (1)..( 6): Result.003 file - promoters60/4767976
aacatt

SEQ ID NO: 137105 - DNA, 6 bp, Unknown
  misc_feature (1)..( 6): Result.003 file - promoters60/4767976
aacatt

SEQ ID NO: 137106 - DNA, 7 bp, Unknown
  misc_feature (1)..( 7): Result.003 file - promoters60/4767976
cactaaa

SEQ ID NO: 137107 - DNA, 7 bp, Unknown
  misc_feature (1)..( 7): Result.003 file - promoters60/4767976
cactaaa

SEQ ID NO: 137108 - DNA, 6 bp, Unknown
  misc_feature (1)..( 6): Result.003 file - promoters60/4767976
ccatta

SEQ ID NO: 137109 - DNA, 6 bp, Unknown
  misc_feature (1)..( 6): Result.003 file - promoters60/4767976
ccatta

SEQ ID NO: 137110 - DNA, 7 bp, Unknown
  misc_feature (1)..( 7): Result.003 file - promoters60/4767976
ctatata

SEQ ID NO: 137111 - DNA, 7 bp, Unknown
  misc_feature (1)..( 7): Result.003 file - promoters60/4767976
gtatata

SEQ ID NO: 137112 - DNA, 7 bp, Unknown
  misc_feature (1)..( 7): Result.003 file - promoters60/4767976
gtatata

SEQ ID NO: 137113 - DNA, 6 bp, Unknown
  misc_feature (1)..( 6): Result.003 file - promoters60/4767976
agtaaa

SEQ ID NO: 137114 - DNA, 6 bp, Unknown
  misc_feature (1)..( 6): Result.003 file - promoters60/4767976
agtaaa

SEQ ID NO: 137115 - DNA, 7 bp, Unknown
  misc_feature (1)..( 7): Result.003 file - promoters60/4767976
aatcggg

SEQ ID NO: 137116 - DNA, 7 bp, Unknown
  misc_feature (1)..( 7): Result.003 file - promoters60/4767976
aattggg

SEQ ID NO: 137117 - DNA, 8 bp, Unknown
  misc_feature (1)..( 8): Result.003 file - promoters60/4767976
gaaagaaa

SEQ ID NO: 137118 - DNA, 8 bp, Unknown
  misc_feature (1)..( 8): Result.003 file - promoters60/4767976
gaaacaaa

SEQ ID NO: 137119 - DNA, 10 bp, Unknown
  misc_feature (1)..( 10): Result.003 file - promoters60/4767976
ggaaaagaaa

SEQ ID NO: 137120 - DNA, 10 bp, Unknown
  misc_feature (1)..( 10): Result.003 file - promoters60/4767976
ggaaatgaaa

SEQ ID NO: 137121 - DNA, 7 bp, Unknown
  misc_feature (1)..( 7): Result.003 file - promoters60/4767976
cccacta

SEQ ID NO: 137122 - DNA, 7 bp, Unknown
  misc_feature (1)..( 7): Result.003 file - promoters60/4767976
cccacta

SEQ ID NO: 137123 - DNA, 9 bp, Unknown
  misc_feature (1)..( 9): Result.003 file - promoters60/4767976
aaagaaaag

SEQ ID NO: 137124 - DNA, 9 bp, Unknown
  misc_feature (1)..( 9): Result.003 file - promoters60/4767976
aaagtaaag

SEQ ID NO: 137125 - DNA, 7 bp, Unknown
  misc_feature (1)..( 7): Result.003 file - promoters60/4767982
taaaaat

SEQ ID NO: 137126 - DNA, 7 bp, Unknown
  misc_feature (1)..( 7): Result.003 file - promoters60/4767982
aaaaaat

SEQ ID NO: 137127 - DNA, 7 bp, Unknown
  misc_feature (1)..( 7): Result.003 file - promoters60/4767982
taaaaag

SEQ ID NO: 137128 - DNA, 7 bp, Unknown
  misc_feature (1)..( 7): Result.003 file - promoters60/4767982
caaaaat

SEQ ID NO: 137129 - DNA, 9 bp, Unknown
  misc_feature (1)..( 9): Result.003 file - promoters60/4767982
ctgtgtttt

SEQ ID NO: 137130 - DNA, 9 bp, Unknown
  misc_feature (1)..( 9): Result.003 file - promoters60/4767982
ctgtgtgag

SEQ ID NO: 137131 - DNA, 9 bp, Unknown
  misc_feature (1)..( 9): Result.003 file - promoters60/4767982
atgtttttt

SEQ ID NO: 137132 - DNA, 9 bp, Unknown
  misc_feature (1)..( 9): Result.003 file - promoters60/4767982
atgttttag

SEQ ID NO: 137133 - DNA, 6 bp, Unknown
  misc_feature (1)..( 6): Result.003 file - promoters60/4767986
aataat

SEQ ID NO: 137134 - DNA, 6 bp, Unknown
  misc_feature (1)..( 6): Result.003 file - promoters60/4767986
aataat

SEQ ID NO: 137135 - DNA, 6 bp, Unknown
  misc_feature (1)..( 6): Result.003 file - promoters60/4767986
aataat

SEQ ID NO: 137136 - DNA, 6 bp, Unknown
  misc_feature (1)..( 6): Result.003 file - promoters60/4767986
aataat

SEQ ID NO: 137137 - DNA, 6 bp, Unknown
  misc_feature (1)..( 6): Result.003 file - promoters60/4767986
aataat

SEQ ID NO: 137138 - DNA, 6 bp, Unknown
  misc_feature (1)..( 6): Result.003 file - promoters60/4767986
aataat

SEQ ID NO: 137139 - DNA, 8 bp, Unknown
  misc_feature (1)..( 8): Result.003 file - promoters60/4767986
taatcaaa

SEQ ID NO: 137140 - DNA, 8 bp, Unknown
  misc_feature (1)..( 8): Result.003 file - promoters60/4767986
taaacaaa

SEQ ID NO: 137141 - DNA, 6 bp, Unknown
  misc_feature (1)..( 6): Result.003 file - promoters60/4767986
aatcaa

SEQ ID NO: 137142 - DNA, 6 bp, Unknown
  misc_feature (1)..( 6): Result.003 file - promoters60/4767986
aatcaa

SEQ ID NO: 137143 - DNA, 6 bp, Unknown
  misc_feature (1)..( 6): Result.003 file - promoters60/4767986
tcttta

SEQ ID NO: 137144 - DNA, 6 bp, Unknown
  misc_feature (1)..( 6): Result.003 file - promoters60/4767986
tcttta

SEQ ID NO: 137145 - DNA, 6 bp, Unknown
  misc_feature (1)..( 6): Result.003 file - promoters60/4767986
tgtttc

SEQ ID NO: 137146 - DNA, 6 bp, Unknown
  misc_feature (1)..( 6): Result.003 file - promoters60/4767986
tgtttc

SEQ ID NO: 137147 - DNA, 9 bp, Unknown
  misc_feature (1)..( 9): Result.003 file - promoters60/4767994
attctttga

SEQ ID NO: 137148 - DNA, 9 bp, Unknown
  misc_feature (1)..( 9): Result.003 file - promoters60/4767994
atttttttc

SEQ ID NO: 137149 - DNA, 9 bp, Unknown
  misc_feature (1)..( 9): Result.003 file - promoters60/4767994
atttttcct

SEQ ID NO: 137150 - DNA, 9 bp, Unknown
  misc_feature (1)..( 9): Result.003 file - promoters60/4767994
gtttgttca

SEQ ID NO: 137151 - DNA, 7 bp, Unknown
  misc_feature (1)..( 7): Result.003 file - promoters60/4767994
cttttta

SEQ ID NO: 137152 - DNA, 7 bp, Unknown
  misc_feature (1)..( 7): Result.003 file - promoters60/4767994
cttttta

SEQ ID NO: 137153 - DNA, 7 bp, Unknown
  misc_feature (1)..( 7): Result.003 file - promoters60/4767994
ctttttt

SEQ ID NO: 137154 - DNA, 7 bp, Unknown
  misc_feature (1)..( 7): Result.003 file - promoters60/4767994
cttttta

SEQ ID NO: 137155 - DNA, 14 bp, Unknown
  misc_feature (1)..( 14): Result.003 file - promoters60/4767994
aaaaaaaaagtgga

SEQ ID NO: 137156 - DNA, 14 bp, Unknown
  misc_feature (1)..( 14): Result.003 file - promoters60/4767994
ccgtcaaaattgga

SEQ ID NO: 137157 - DNA, 14 bp, Unknown
  misc_feature (1)..( 14): Result.003 file - promoters60/4767994
aaaaaaaaagtgat

SEQ ID NO: 137158 - DNA, 14 bp, Unknown
  misc_feature (1)..( 14): Result.003 file - promoters60/4767994
atactaaaagaaat

SEQ ID NO: 137159 - DNA, 11 bp, Unknown
  misc_feature (1)..( 11): Result.003 file - promoters60/4767994
aaataaacaaa

SEQ ID NO: 137160 - DNA, 11 bp, Unknown
  misc_feature (1)..( 11): Result.003 file - promoters60/4767994
aaagaaataaa

SEQ ID NO: 137161 - DNA, 11 bp, Unknown
  misc_feature (1)..( 11): Result.003 file - promoters60/4767994
aaaaaaaaaaa

SEQ ID NO: 137162 - DNA, 11 bp, Unknown
  misc_feature (1)..( 11): Result.003 file - promoters60/4767994
gaagaaaccgg

SEQ ID NO: 137163 - DNA, 9 bp, Unknown
  misc_feature (1)..( 9): Result.003 file - promoters60/4768007
aaaaataaa

SEQ ID NO: 137164 - DNA, 9 bp, Unknown
  misc_feature (1)..( 9): Result.003 file - promoters60/4768007
aaaaatata

SEQ ID NO: 137165 - DNA, 9 bp, Unknown
  misc_feature (1)..( 9): Result.003 file - promoters60/4768007
aaaattaat

SEQ ID NO: 137166 - DNA, 9 bp, Unknown
  misc_feature (1)..( 9): Result.003 file - promoters60/4768007
aaagaaaaa

SEQ ID NO: 137167 - DNA, 9 bp, Unknown
  misc_feature (1)..( 9): Result.003 file - promoters60/4768007
aaagatatc

SEQ ID NO: 137168 - DNA, 9 bp, Unknown
  misc_feature (1)..( 9): Result.003 file - promoters60/4768007
gataatatt

SEQ ID NO: 137169 - DNA, 9 bp, Unknown
  misc_feature (1)..( 9): Result.003 file - promoters60/4768007
aaagattta

SEQ ID NO: 137170 - DNA, 11 bp, Unknown
  misc_feature (1)..( 11): Result.003 file - promoters60/4768007
taaataaaagc

SEQ ID NO: 137171 - DNA, 11 bp, Unknown
  misc_feature (1)..( 11): Result.003 file - promoters60/4768007
gatataaaaaa

SEQ ID NO: 137172 - DNA, 11 bp, Unknown
  misc_feature (1)..( 11): Result.003 file - promoters60/4768007
acaataaaatt

SEQ ID NO: 137173 - DNA, 11 bp, Unknown
  misc_feature (1)..( 11): Result.003 file - promoters60/4768007
taaagaaaaag

SEQ ID NO: 137174 - DNA, 11 bp, Unknown
  misc_feature (1)..( 11): Result.003 file - promoters60/4768007
ggtatcaaaca

SEQ ID NO: 137175 - DNA, 11 bp, Unknown
  misc_feature (1)..( 11): Result.003 file - promoters60/4768007
gagataatatt

SEQ ID NO: 137176 - DNA, 11 bp, Unknown
  misc_feature (1)..( 11): Result.003 file - promoters60/4768007
tgaaaaacaaa

SEQ ID NO: 137177 - DNA, 11 bp, Unknown
  misc_feature (1)..( 11): Result.003 file - promoters60/4768007
tgaaaaaaaaa

SEQ ID NO: 137178 - DNA, 11 bp, Unknown
  misc_feature (1)..( 11): Result.003 file - promoters60/4768007
ctataaataaa

SEQ ID NO: 137179 - DNA, 11 bp, Unknown
  misc_feature (1)..( 11): Result.003 file - promoters60/4768007
agtcaaacaaa

SEQ ID NO: 137180 - DNA, 11 bp, Unknown
  misc_feature (1)..( 11): Result.003 file - promoters60/4768007
tgtgaaacaaa

SEQ ID NO: 137181 - DNA, 11 bp, Unknown
  misc_feature (1)..( 11): Result.003 file - promoters60/4768007
aatcaatcaaa

SEQ ID NO: 137182 - DNA, 20 bp, Unknown
  misc_feature (1)..( 20): Result.003 file - promoters60/4768007
aatgtttgtttaacaaaaaa

SEQ ID NO: 137183 - DNA, 20 bp, Unknown
  misc_feature (1)..( 20): Result.003 file - promoters60/4768007
agaataggtttaagaacttt

SEQ ID NO: 137184 - DNA, 20 bp, Unknown
  misc_feature (1)..( 20): Result.003 file - promoters60/4768007
tttatttctttaaactatga

SEQ ID NO: 137185 - DNA, 20 bp, Unknown
  misc_feature (1)..( 20): Result.003 file - promoters60/4768007
ttagatggattaattctttt

SEQ ID NO: 137186 - DNA, 20 bp, Unknown
  misc_feature (1)..( 20): Result.003 file - promoters60/4768007
caaacaaacaaaattatttt

SEQ ID NO: 137187 - DNA, 20 bp, Unknown
  misc_feature (1)..( 20): Result.003 file - promoters60/4768007
aaagttactttatgtttcgt

SEQ ID NO: 137188 - DNA, 13 bp, Unknown
  misc_feature (1)..( 13): Result.003 file - promoters60/4768007
tccattatatata

SEQ ID NO: 137189 - DNA, 13 bp, Unknown
  misc_feature (1)..( 13): Result.003 file - promoters60/4768007
atacatatataaa

SEQ ID NO: 137190 - DNA, 13 bp, Unknown
  misc_feature (1)..( 13): Result.003 file - promoters60/4768007
acgcctatatata

SEQ ID NO: 137191 - DNA, 13 bp, Unknown
  misc_feature (1)..( 13): Result.003 file - promoters60/4768007
tttcttatatctt

SEQ ID NO: 137192 - DNA, 13 bp, Unknown
  misc_feature (1)..( 13): Result.003 file - promoters60/4768007
tcctttatattct

SEQ ID NO: 137193 - DNA, 13 bp, Unknown
  misc_feature (1)..( 13): Result.003 file - promoters60/4768007
agtgagatataat

SEQ ID NO: 137194 - DNA, 13 bp, Unknown
  misc_feature (1)..( 13): Result.003 file - promoters60/4768007
tcctttttagttc

SEQ ID NO: 137195 - DNA, 15 bp, Unknown
  misc_feature (1)..( 15): Result.003 file - promoters60/4768007
aaatattaaccttga

SEQ ID NO: 137196 - DNA, 15 bp, Unknown
  misc_feature (1)..( 15): Result.003 file - promoters60/4768007
aaaaattaaatgcta

SEQ ID NO: 137197 - DNA, 15 bp, Unknown
  misc_feature (1)..( 15): Result.003 file - promoters60/4768007
caaaattgaccctga

SEQ ID NO: 137198 - DNA, 15 bp, Unknown
  misc_feature (1)..( 15): Result.003 file - promoters60/4768007
aaagatttatattat

SEQ ID NO: 137199 - DNA, 15 bp, Unknown
  misc_feature (1)..( 15): Result.003 file - promoters60/4768007
taaaatttcataacc

SEQ ID NO: 137200 - DNA, 15 bp, Unknown
  misc_feature (1)..( 15): Result.003 file - promoters60/4768007
aaagatatcaagtgg

SEQ ID NO: 137201 - DNA, 10 bp, Unknown
  misc_feature (1)..( 10): Result.003 file - promoters60/4768007
ttcatatgtt

SEQ ID NO: 137202 - DNA, 10 bp, Unknown
  misc_feature (1)..( 10): Result.003 file - promoters60/4768007
ttcataaaat

SEQ ID NO: 137203 - DNA, 10 bp, Unknown
  misc_feature (1)..( 10): Result.003 file - promoters60/4768007
gtcattaaat

SEQ ID NO: 137204 - DNA, 10 bp, Unknown
  misc_feature (1)..( 10): Result.003 file - promoters60/4768007
gacatttaat

SEQ ID NO: 137205 - DNA, 10 bp, Unknown
  misc_feature (1)..( 10): Result.003 file - promoters60/4768007
ttcagaaatg

SEQ ID NO: 137206 - DNA, 10 bp, Unknown
  misc_feature (1)..( 10): Result.003 file - promoters60/4768007
ttcttaatat

SEQ ID NO: 137207 - DNA, 11 bp, Unknown
  misc_feature (1)..( 11): Result.003 file - promoters60/4768007
taacaaaaaaa

SEQ ID NO: 137208 - DNA, 11 bp, Unknown
  misc_feature (1)..( 11): Result.003 file - promoters60/4768007
taataaaaaac

SEQ ID NO: 137209 - DNA, 11 bp, Unknown
  misc_feature (1)..( 11): Result.003 file - promoters60/4768007
caactaaagta

SEQ ID NO: 137210 - DNA, 11 bp, Unknown
  misc_feature (1)..( 11): Result.003 file - promoters60/4768007
aaacaaaggaa

SEQ ID NO: 137211 - DNA, 11 bp, Unknown
  misc_feature (1)..( 11): Result.003 file - promoters60/4768007
aacaaaaaaaa

SEQ ID NO: 137212 - DNA, 11 bp, Unknown
  misc_feature (1)..( 11): Result.003 file - promoters60/4768007
ctggaaacact

SEQ ID NO: 137213 - DNA, 9 bp, Unknown
  misc_feature (1)..( 9): Result.003 file - promoters60/4768007
aatatttaa

SEQ ID NO: 137214 - DNA, 9 bp, Unknown
  misc_feature (1)..( 9): Result.003 file - promoters60/4768007
aatatttag

SEQ ID NO: 137215 - DNA, 9 bp, Unknown
  misc_feature (1)..( 9): Result.003 file - promoters60/4768007
aatatttca

SEQ ID NO: 137216 - DNA, 9 bp, Unknown
  misc_feature (1)..( 9): Result.003 file - promoters60/4768007
gctatttat

SEQ ID NO: 137217 - DNA, 9 bp, Unknown
  misc_feature (1)..( 9): Result.003 file - promoters60/4768007
aatctttaa

SEQ ID NO: 137218 - DNA, 9 bp, Unknown
  misc_feature (1)..( 9): Result.003 file - promoters60/4768007
gatctttta

SEQ ID NO: 137219 - DNA, 11 bp, Unknown
  misc_feature (1)..( 11): Result.003 file - promoters60/4768007
gaaacaaaaaa

SEQ ID NO: 137220 - DNA, 11 bp, Unknown
  misc_feature (1)..( 11): Result.003 file - promoters60/4768007
gaaacaagaaa

SEQ ID NO: 137221 - DNA, 11 bp, Unknown
  misc_feature (1)..( 11): Result.003 file - promoters60/4768007
gtaataaaaaa

SEQ ID NO: 137222 - DNA, 11 bp, Unknown
  misc_feature (1)..( 11): Result.003 file - promoters60/4768007
caaacaaaatt

SEQ ID NO: 137223 - DNA, 11 bp, Unknown
  misc_feature (1)..( 11): Result.003 file - promoters60/4768007
taaacaaagga

SEQ ID NO: 137224 - DNA, 11 bp, Unknown
  misc_feature (1)..( 11): Result.003 file - promoters60/4768007
gaaacacttat

SEQ ID NO: 137225 - DNA, 9 bp, Unknown
  misc_feature (1)..( 9): Result.003 file - promoters60/4768039
attcctaaa

SEQ ID NO: 137226 - DNA, 9 bp, Unknown
  misc_feature (1)..( 9): Result.003 file - promoters60/4768039
atttctaaa

SEQ ID NO: 137227 - DNA, 9 bp, Unknown
  misc_feature (1)..( 9): Result.003 file - promoters60/4768039
ttttttaac

SEQ ID NO: 137228 - DNA, 10 bp, Unknown
  misc_feature (1)..( 10): Result.003 file - promoters60/4768039
gataatattt

SEQ ID NO: 137229 - DNA, 10 bp, Unknown
  misc_feature (1)..( 10): Result.003 file - promoters60/4768039
tataatatct

SEQ ID NO: 137230 - DNA, 10 bp, Unknown
  misc_feature (1)..( 10): Result.003 file - promoters60/4768039
tattatagat

SEQ ID NO: 137231 - DNA, 10 bp, Unknown
  misc_feature (1)..( 10): Result.003 file - promoters60/4768039
cattatcgat

SEQ ID NO: 137232 - DNA, 11 bp, Unknown
  misc_feature (1)..( 11): Result.003 file - promoters60/4768039
ggaagaaaaag

SEQ ID NO: 137233 - DNA, 11 bp, Unknown
  misc_feature (1)..( 11): Result.003 file - promoters60/4768039
caaaaaaaaag

SEQ ID NO: 137234 - DNA, 11 bp, Unknown
  misc_feature (1)..( 11): Result.003 file - promoters60/4768039
caaacaaaaat

SEQ ID NO: 137235 - DNA, 10 bp, Unknown
  misc_feature (1)..( 10): Result.003 file - promoters60/4768039
tgcaagtttc

SEQ ID NO: 137236 - DNA, 10 bp, Unknown
  misc_feature (1)..( 10): Result.003 file - promoters60/4768039
tgcaactttg

SEQ ID NO: 137237 - DNA, 10 bp, Unknown
  misc_feature (1)..( 10): Result.003 file - promoters60/4768039
caaaactttg

SEQ ID NO: 137238 - DNA, 11 bp, Unknown
  misc_feature (1)..( 11): Result.003 file - promoters60/4768039
ttaatataata

SEQ ID NO: 137239 - DNA, 11 bp, Unknown
  misc_feature (1)..( 11): Result.003 file - promoters60/4768039
ttattatagat

SEQ ID NO: 137240 - DNA, 11 bp, Unknown
  misc_feature (1)..( 11): Result.003 file - promoters60/4768039
acattatcgat

SEQ ID NO: 137241 - DNA, 6 bp, Unknown
  misc_feature (1)..( 6): Result.003 file - promoters60/4768066
gataaa

SEQ ID NO: 137242 - DNA, 6 bp, Unknown
  misc_feature (1)..( 6): Result.003 file - promoters60/4768066
gataaa

SEQ ID NO: 137243 - DNA, 6 bp, Unknown
  misc_feature (1)..( 6): Result.003 file - promoters60/4768066
tttatt

SEQ ID NO: 137244 - DNA, 6 bp, Unknown
  misc_feature (1)..( 6): Result.003 file - promoters60/4768066
tttatt

SEQ ID NO: 137245 - DNA, 7 bp, Unknown
  misc_feature (1)..( 7): Result.003 file - promoters60/4768066
gttttaa

SEQ ID NO: 137246 - DNA, 7 bp, Unknown
  misc_feature (1)..( 7): Result.003 file - promoters60/4768066
gttgtaa

SEQ ID NO: 137247 - DNA, 6 bp, Unknown
  misc_feature (1)..( 6): Result.003 file - promoters60/4768066
taacgt

SEQ ID NO: 137248 - DNA, 6 bp, Unknown
  misc_feature (1)..( 6): Result.003 file - promoters60/4768066
taacgt

SEQ ID NO: 137249 - DNA, 7 bp, Unknown
  misc_feature (1)..( 7): Result.003 file - promoters60/4768066
aaattaa

SEQ ID NO: 137250 - DNA, 7 bp, Unknown
  misc_feature (1)..( 7): Result.003 file - promoters60/4768066
aaaataa

SEQ ID NO: 137251 - DNA, 10 bp, Unknown
  misc_feature (1)..( 10): Result.003 file - promoters60/4768066
taaaaaaaaa

SEQ ID NO: 137252 - DNA, 10 bp, Unknown
  misc_feature (1)..( 10): Result.003 file - promoters60/4768066
taaaaagaaa

SEQ ID NO: 137253 - DNA, 6 bp, Unknown
  misc_feature (1)..( 6): Result.003 file - promoters60/4768066
gtatat

SEQ ID NO: 137254 - DNA, 6 bp, Unknown
  misc_feature (1)..( 6): Result.003 file - promoters60/4768066
gtatat

SEQ ID NO: 137255 - DNA, 6 bp, Unknown
  misc_feature (1)..( 6): Result.003 file - promoters60/4768066
gtatat

SEQ ID NO: 137256 - DNA, 6 bp, Unknown
  misc_feature (1)..( 6): Result.003 file - promoters60/4768066
taaaca

SEQ ID NO: 137257 - DNA, 6 bp, Unknown
  misc_feature (1)..( 6): Result.003 file - promoters60/4768066
taaaca

SEQ ID NO: 137258 - DNA, 8 bp, Unknown
  misc_feature (1)..( 8): Result.003 file - promoters60/4768066
ggattagg

SEQ ID NO: 137259 - DNA, 8 bp, Unknown
  misc_feature (1)..( 8): Result.003 file - promoters60/4768066
ggattagg

SEQ ID NO: 137260 - DNA, 6 bp, Unknown
  misc_feature (1)..( 6): Result.003 file - promoters60/4768066
ttttgt

SEQ ID NO: 137261 - DNA, 6 bp, Unknown
  misc_feature (1)..( 6): Result.003 file - promoters60/4768066
ttttgt

SEQ ID NO: 137262 - DNA, 7 bp, Unknown
  misc_feature (1)..( 7): Result.003 file - promoters60/4768066
taattaa

SEQ ID NO: 137263 - DNA, 7 bp, Unknown
  misc_feature (1)..( 7): Result.003 file - promoters60/4768066
taattaa

SEQ ID NO: 137264 - DNA, 11 bp, Unknown
  misc_feature (1)..( 11): Result.003 file - promoters60/4768066
ttacctaaacc

SEQ ID NO: 137265 - DNA, 11 bp, Unknown
  misc_feature (1)..( 11): Result.003 file - promoters60/4768066
ttaactaaacc

SEQ ID NO: 137266 - DNA, 7 bp, Unknown
  misc_feature (1)..( 7): Result.003 file - promoters60/4768066
actcaac

SEQ ID NO: 137267 - DNA, 7 bp, Unknown
  misc_feature (1)..( 7): Result.003 file - promoters60/4768066
actaaac

SEQ ID NO: 137268 - DNA, 8 bp, Unknown
  misc_feature (1)..( 8): Result.003 file - promoters60/4768066
tcttaatt

SEQ ID NO: 137269 - DNA, 8 bp, Unknown
  misc_feature (1)..( 8): Result.003 file - promoters60/4768066
tctaaatt

SEQ ID NO: 137270 - DNA, 7 bp, Unknown
  misc_feature (1)..( 7): Result.003 file - promoters60/4768066
tagataa

SEQ ID NO: 137271 - DNA, 7 bp, Unknown
  misc_feature (1)..( 7): Result.003 file - promoters60/4768066
tagataa

SEQ ID NO: 137272 - DNA, 6 bp, Unknown
  misc_feature (1)..( 6): Result.003 file - promoters60/4768066
attaat

SEQ ID NO: 137273 - DNA, 6 bp, Unknown
  misc_feature (1)..( 6): Result.003 file - promoters60/4768066
attaat

SEQ ID NO: 137274 - DNA, 6 bp, Unknown
  misc_feature (1)..( 6): Result.003 file - promoters60/4768066
agtaaa

SEQ ID NO: 137275 - DNA, 6 bp, Unknown
  misc_feature (1)..( 6): Result.003 file - promoters60/4768066
agtaaa

SEQ ID NO: 137276 - DNA, 7 bp, Unknown
  misc_feature (1)..( 7): Result.003 file - promoters60/4768066
aatcggg

SEQ ID NO: 137277 - DNA, 7 bp, Unknown
  misc_feature (1)..( 7): Result.003 file - promoters60/4768066
aattggg

SEQ ID NO: 137278 - DNA, 8 bp, Unknown
  misc_feature (1)..( 8): Result.003 file - promoters60/4768066
gaaagaaa

SEQ ID NO: 137279 - DNA, 8 bp, Unknown
  misc_feature (1)..( 8): Result.003 file - promoters60/4768066
gaaacaaa

SEQ ID NO: 137280 - DNA, 10 bp, Unknown
  misc_feature (1)..( 10): Result.003 file - promoters60/4768066
ggaaaagaaa

SEQ ID NO: 137281 - DNA, 10 bp, Unknown
  misc_feature (1)..( 10): Result.003 file - promoters60/4768066
ggaaatgaaa

SEQ ID NO: 137282 - DNA, 7 bp, Unknown
  misc_feature (1)..( 7): Result.003 file - promoters60/4768066
cccacta

SEQ ID NO: 137283 - DNA, 7 bp, Unknown
  misc_feature (1)..( 7): Result.003 file - promoters60/4768066
cccacta

SEQ ID NO: 137284 - DNA, 9 bp, Unknown
  misc_feature (1)..( 9): Result.003 file - promoters60/4768066
aaagaaaag

SEQ ID NO: 137285 - DNA, 9 bp, Unknown
  misc_feature (1)..( 9): Result.003 file - promoters60/4768066
aaagtaaag

SEQ ID NO: 137286 - DNA, 7 bp, Unknown
  misc_feature (1)..( 7): Result.003 file - promoters60/4768147
tcttttt

SEQ ID NO: 137287 - DNA, 7 bp, Unknown
  misc_feature (1)..( 7): Result.003 file - promoters60/4768147
tcttttt

SEQ ID NO: 137288 - DNA, 13 bp, Unknown
  misc_feature (1)..( 13): Result.003 file - promoters60/4768147
ctctactttctcc

SEQ ID NO: 137289 - DNA, 13 bp, Unknown
  misc_feature (1)..( 13): Result.003 file - promoters60/4768147
caataatttttcc

SEQ ID NO: 137290 - DNA, 13 bp, Unknown
  misc_feature (1)..( 13): Result.003 file - promoters60/4768147
ataatgtttgagt

SEQ ID NO: 137291 - DNA, 6 bp, Unknown
  misc_feature (1)..( 6): Result.003 file - promoters60/4768147
acattg

SEQ ID NO: 137292 - DNA, 6 bp, Unknown
  misc_feature (1)..( 6): Result.003 file - promoters60/4768147
acattg

SEQ ID NO: 137293 - DNA, 7 bp, Unknown
  misc_feature (1)..( 7): Result.003 file - promoters60/4768147
tattata

SEQ ID NO: 137294 - DNA, 7 bp, Unknown
  misc_feature (1)..( 7): Result.003 file - promoters60/4768147
tattatg

SEQ ID NO: 137295 - DNA, 7 bp, Unknown
  misc_feature (1)..( 7): Result.003 file - promoters60/4768147
tattata

SEQ ID NO: 137296 - DNA, 10 bp, Unknown
  misc_feature (1)..( 10): Result.003 file - promoters60/4768147
aaaacaataa

SEQ ID NO: 137297 - DNA, 10 bp, Unknown
  misc_feature (1)..( 10): Result.003 file - promoters60/4768147
taaataataa

SEQ ID NO: 137298 - DNA, 10 bp, Unknown
  misc_feature (1)..( 10): Result.003 file - promoters60/4768147
aaaacacaaa

SEQ ID NO: 137299 - DNA, 6 bp, Unknown
  misc_feature (1)..( 6): Result.003 file - promoters60/4768147
acttga

SEQ ID NO: 137300 - DNA, 6 bp, Unknown
  misc_feature (1)..( 6): Result.003 file - promoters60/4768147
acttga

SEQ ID NO: 137301 - DNA, 7 bp, Unknown
  misc_feature (1)..( 7): Result.003 file - promoters60/4768147
taggttg

SEQ ID NO: 137302 - DNA, 7 bp, Unknown
  misc_feature (1)..( 7): Result.003 file - promoters60/4768147
tagtttg

SEQ ID NO: 137303 - DNA, 6 bp, Unknown
  misc_feature (1)..( 6): Result.003 file - promoters60/4768147
attttt

SEQ ID NO: 137304 - DNA, 6 bp, Unknown
  misc_feature (1)..( 6): Result.003 file - promoters60/4768147
attttt

SEQ ID NO: 137305 - DNA, 7 bp, Unknown
  misc_feature (1)..( 7): Result.003 file - promoters60/4768147
caaaaaa

SEQ ID NO: 137306 - DNA, 7 bp, Unknown
  misc_feature (1)..( 7): Result.003 file - promoters60/4768147
caaaaaa

SEQ ID NO: 137307 - DNA, 8 bp, Unknown
  misc_feature (1)..( 8): Result.003 file - promoters60/4768147
tctcaaaa

SEQ ID NO: 137308 - DNA, 8 bp, Unknown
  misc_feature (1)..( 8): Result.003 file - promoters60/4768147
tctaaaaa

SEQ ID NO: 137309 - DNA, 7 bp, Unknown
  misc_feature (1)..( 7): Result.003 file - promoters60/4768147
atagata

SEQ ID NO: 137310 - DNA, 7 bp, Unknown
  misc_feature (1)..( 7): Result.003 file - promoters60/4768147
atatata

SEQ ID NO: 137311 - DNA, 7 bp, Unknown
  misc_feature (1)..( 7): Result.003 file - promoters60/4768147
atgtaat

SEQ ID NO: 137312 - DNA, 7 bp, Unknown
  misc_feature (1)..( 7): Result.003 file - promoters60/4768147
atggaat

SEQ ID NO: 137313 - DNA, 7 bp, Unknown
  misc_feature (1)..( 7): Result.003 file - promoters60/4768147
acctaat

SEQ ID NO: 137314 - DNA, 7 bp, Unknown
  misc_feature (1)..( 7): Result.003 file - promoters60/4768147
accaaat

SEQ ID NO: 137315 - DNA, 6 bp, Unknown
  misc_feature (1)..( 6): Result.003 file - promoters60/4768147
aaaaaa

SEQ ID NO: 137316 - DNA, 6 bp, Unknown
  misc_feature (1)..( 6): Result.003 file - promoters60/4768147
aaaaaa

SEQ ID NO: 137317 - DNA, 6 bp, Unknown
  misc_feature (1)..( 6): Result.003 file - promoters60/4768147
gtcaaa

SEQ ID NO: 137318 - DNA, 6 bp, Unknown
  misc_feature (1)..( 6): Result.003 file - promoters60/4768147
gtcaaa

SEQ ID NO: 137319 - DNA, 6 bp, Unknown
  misc_feature (1)..( 6): Result.003 file - promoters60/4768147
ggcgag

SEQ ID NO: 137320 - DNA, 6 bp, Unknown
  misc_feature (1)..( 6): Result.003 file - promoters60/4768147
ggcgag

SEQ ID NO: 137321 - DNA, 8 bp, Unknown
  misc_feature (1)..( 8): Result.003 file - promoters60/4768169
gttagaac

SEQ ID NO: 137322 - DNA, 8 bp, Unknown
  misc_feature (1)..( 8): Result.003 file - promoters60/4768169
gtttgaaa

SEQ ID NO: 137323 - DNA, 8 bp, Unknown
  misc_feature (1)..( 8): Result.003 file - promoters60/4768169
ttttcaaa

SEQ ID NO: 137324 - DNA, 6 bp, Unknown
  misc_feature (1)..( 6): Result.003 file - promoters60/4768169
aattca

SEQ ID NO: 137325 - DNA, 6 bp, Unknown
  misc_feature (1)..( 6): Result.003 file - promoters60/4768169
aattca

SEQ ID NO: 137326 - DNA, 7 bp, Unknown
  misc_feature (1)..( 7): Result.003 file - promoters60/4768169
tttctaa

SEQ ID NO: 137327 - DNA, 7 bp, Unknown
  misc_feature (1)..( 7): Result.003 file - promoters60/4768169
tttttaa

SEQ ID NO: 137328 - DNA, 9 bp, Unknown
  misc_feature (1)..( 9): Result.003 file - promoters60/4768169
ttaattttg

SEQ ID NO: 137329 - DNA, 9 bp, Unknown
  misc_feature (1)..( 9): Result.003 file - promoters60/4768169
ttaactttg

SEQ ID NO: 137330 - DNA, 8 bp, Unknown
  misc_feature (1)..( 8): Result.003 file - promoters60/4768169
tcatataa

SEQ ID NO: 137331 - DNA, 8 bp, Unknown
  misc_feature (1)..( 8): Result.003 file - promoters60/4768169
tcaaataa

SEQ ID NO: 137332 - DNA, 6 bp, Unknown
  misc_feature (1)..( 6): Result.003 file - promoters60/4768169
ttcttt

SEQ ID NO: 137333 - DNA, 6 bp, Unknown
  misc_feature (1)..( 6): Result.003 file - promoters60/4768169
ttcttt

SEQ ID NO: 137334 - DNA, 7 bp, Unknown
  misc_feature (1)..( 7): Result.003 file - promoters60/4768169
aacaaag

SEQ ID NO: 137335 - DNA, 7 bp, Unknown
  misc_feature (1)..( 7): Result.003 file - promoters60/4768169
aacaaag

SEQ ID NO: 137336 - DNA, 7 bp, Unknown
  misc_feature (1)..( 7): Result.003 file - promoters60/4768169
tatgtat

SEQ ID NO: 137337 - DNA, 7 bp, Unknown
  misc_feature (1)..( 7): Result.003 file - promoters60/4768169
tatatat

SEQ ID NO: 137338 - DNA, 7 bp, Unknown
  misc_feature (1)..( 7): Result.003 file - promoters60/4768169
aaatcag

SEQ ID NO: 137339 - DNA, 7 bp, Unknown
  misc_feature (1)..( 7): Result.003 file - promoters60/4768169
aaaccag

SEQ ID NO: 137340 - DNA, 7 bp, Unknown
  misc_feature (1)..( 7): Result.003 file - promoters60/4768169
gaataaa

SEQ ID NO: 137341 - DNA, 7 bp, Unknown
  misc_feature (1)..( 7): Result.003 file - promoters60/4768169
gaaaaaa

SEQ ID NO: 137342 - DNA, 7 bp, Unknown
  misc_feature (1)..( 7): Result.003 file - promoters60/4768169
acctcat

SEQ ID NO: 137343 - DNA, 7 bp, Unknown
  misc_feature (1)..( 7): Result.003 file - promoters60/4768169
accacat

SEQ ID NO: 137344 - DNA, 7 bp, Unknown
  misc_feature (1)..( 7): Result.003 file - promoters60/4768169
aaaagat

SEQ ID NO: 137345 - DNA, 7 bp, Unknown
  misc_feature (1)..( 7): Result.003 file - promoters60/4768169
aaatgat

SEQ ID NO: 137346 - DNA, 6 bp, Unknown
  misc_feature (1)..( 6): Result.003 file - promoters60/4768169
tgtgga

SEQ ID NO: 137347 - DNA, 6 bp, Unknown
  misc_feature (1)..( 6): Result.003 file - promoters60/4768169
tgtgga

SEQ ID NO: 137348 - DNA, 7 bp, Unknown
  misc_feature (1)..( 7): Result.003 file - promoters60/4768169
gaatttg

SEQ ID NO: 137349 - DNA, 7 bp, Unknown
  misc_feature (1)..( 7): Result.003 file - promoters60/4768169
gaaattg

SEQ ID NO: 137350 - DNA, 9 bp, Unknown
  misc_feature (1)..( 9): Result.003 file - promoters60/4768169
aaactgtat

SEQ ID NO: 137351 - DNA, 9 bp, Unknown
  misc_feature (1)..( 9): Result.003 file - promoters60/4768169
aaactatat

SEQ ID NO: 137352 - DNA, 8 bp, Unknown
  misc_feature (1)..( 8): Result.003 file - promoters60/4768169
ttgacaaa

SEQ ID NO: 137353 - DNA, 8 bp, Unknown
  misc_feature (1)..( 8): Result.003 file - promoters60/4768169
ttggcaaa

SEQ ID NO: 137354 - DNA, 6 bp, Unknown
  misc_feature (1)..( 6): Result.003 file - promoters60/4768169
aaagtt

SEQ ID NO: 137355 - DNA, 6 bp, Unknown
  misc_feature (1)..( 6): Result.003 file - promoters60/4768169
aaagtt

SEQ ID NO: 137356 - DNA, 7 bp, Unknown
  misc_feature (1)..( 7): Result.003 file - promoters60/4768169
tatggac

SEQ ID NO: 137357 - DNA, 7 bp, Unknown
  misc_feature (1)..( 7): Result.003 file - promoters60/4768169
tatggac

SEQ ID NO: 137358 - DNA, 8 bp, Unknown
  misc_feature (1)..( 8): Result.003 file - promoters60/4768169
aaatttct

SEQ ID NO: 137359 - DNA, 8 bp, Unknown
  misc_feature (1)..( 8): Result.003 file - promoters60/4768169
aaatatct

SEQ ID NO: 137360 - DNA, 6 bp, Unknown
  misc_feature (1)..( 6): Result.003 file - promoters60/4768169
tttaaa

SEQ ID NO: 137361 - DNA, 6 bp, Unknown
  misc_feature (1)..( 6): Result.003 file - promoters60/4768169
tttaaa

SEQ ID NO: 137362 - DNA, 9 bp, Unknown
  misc_feature (1)..( 9): Result.003 file - promoters60/4768169
attttctga

SEQ ID NO: 137363 - DNA, 9 bp, Unknown
  misc_feature (1)..( 9): Result.003 file - promoters60/4768169
attttctga

SEQ ID NO: 137364 - DNA, 7 bp, Unknown
  misc_feature (1)..( 7): Result.003 file - promoters60/4768169
gttttca

SEQ ID NO: 137365 - DNA, 7 bp, Unknown
  misc_feature (1)..( 7): Result.003 file - promoters60/4768169
gttttca

SEQ ID NO: 137366 - DNA, 8 bp, Unknown
  misc_feature (1)..( 8): Result.003 file - promoters60/4768198
ttttagct

SEQ ID NO: 137367 - DNA, 8 bp, Unknown
  misc_feature (1)..( 8): Result.003 file - promoters60/4768198
atttcgct

SEQ ID NO: 137368 - DNA, 8 bp, Unknown
  misc_feature (1)..( 8): Result.003 file - promoters60/4768198
ttttagtt

SEQ ID NO: 137369 - DNA, 10 bp, Unknown
  misc_feature (1)..( 10): Result.003 file - promoters60/4768198
ttaaaattta

SEQ ID NO: 137370 - DNA, 10 bp, Unknown
  misc_feature (1)..( 10): Result.003 file - promoters60/4768198
ctaacattta

SEQ ID NO: 137371 - DNA, 10 bp, Unknown
  misc_feature (1)..( 10): Result.003 file - promoters60/4768198
ttaaaatagt

SEQ ID NO: 137372 - DNA, 7 bp, Unknown
  misc_feature (1)..( 7): Result.003 file - promoters60/4768198
tagtgat

SEQ ID NO: 137373 - DNA, 7 bp, Unknown
  misc_feature (1)..( 7): Result.003 file - promoters60/4768198
tagtgat

SEQ ID NO: 137374 - DNA, 6 bp, Unknown
  misc_feature (1)..( 6): Result.003 file - promoters60/4768198
caaaaa

SEQ ID NO: 137375 - DNA, 6 bp, Unknown
  misc_feature (1)..( 6): Result.003 file - promoters60/4768198
caaaaa

SEQ ID NO: 137376 - DNA, 7 bp, Unknown
  misc_feature (1)..( 7): Result.003 file - promoters60/4768198
gaagact

SEQ ID NO: 137377 - DNA, 7 bp, Unknown
  misc_feature (1)..( 7): Result.003 file - promoters60/4768198
gaaaact

SEQ ID NO: 137378 - DNA, 6 bp, Unknown
  misc_feature (1)..( 6): Result.003 file - promoters60/4768198
atgaaa

SEQ ID NO: 137379 - DNA, 6 bp, Unknown
  misc_feature (1)..( 6): Result.003 file - promoters60/4768198
atgaaa

SEQ ID NO: 137380 - DNA, 11 bp, Unknown
  misc_feature (1)..( 11): Result.003 file - promoters60/4768198
aatcaatggtt

SEQ ID NO: 137381 - DNA, 11 bp, Unknown
  misc_feature (1)..( 11): Result.003 file - promoters60/4768198
acacaatggaa

SEQ ID NO: 137382 - DNA, 11 bp, Unknown
  misc_feature (1)..( 11): Result.003 file - promoters60/4768198
aatcaattgtt

SEQ ID NO: 137383 - DNA, 9 bp, Unknown
  misc_feature (1)..( 9): Result.003 file - promoters60/4768198
cttcaaatc

SEQ ID NO: 137384 - DNA, 9 bp, Unknown
  misc_feature (1)..( 9): Result.003 file - promoters60/4768198
tgtcaaatt

SEQ ID NO: 137385 - DNA, 9 bp, Unknown
  misc_feature (1)..( 9): Result.003 file - promoters60/4768198
tgtcatatt

SEQ ID NO: 137386 - DNA, 9 bp, Unknown
  misc_feature (1)..( 9): Result.003 file - promoters60/4768198
tttatagtt

SEQ ID NO: 137387 - DNA, 9 bp, Unknown
  misc_feature (1)..( 9): Result.003 file - promoters60/4768198
tttttagtt

SEQ ID NO: 137388 - DNA, 9 bp, Unknown
  misc_feature (1)..( 9): Result.003 file - promoters60/4768198
tttctagtc

SEQ ID NO: 137389 - DNA, 8 bp, Unknown
  misc_feature (1)..( 8): Result.003 file - promoters60/4768198
actcaaat

SEQ ID NO: 137390 - DNA, 8 bp, Unknown
  misc_feature (1)..( 8): Result.003 file - promoters60/4768198
actcaaat

SEQ ID NO: 137391 - DNA, 6 bp, Unknown
  misc_feature (1)..( 6): Result.003 file - promoters60/4768198
attaaa

SEQ ID NO: 137392 - DNA, 6 bp, Unknown
  misc_feature (1)..( 6): Result.003 file - promoters60/4768198
attaaa

SEQ ID NO: 137393 - DNA, 6 bp, Unknown
  misc_feature (1)..( 6): Result.003 file - promoters60/4768198
aaatta

SEQ ID NO: 137394 - DNA, 6 bp, Unknown
  misc_feature (1)..( 6): Result.003 file - promoters60/4768198
aaatta

SEQ ID NO: 137395 - DNA, 7 bp, Unknown
  misc_feature (1)..( 7): Result.003 file - promoters60/4768198
aaagaag

SEQ ID NO: 137396 - DNA, 7 bp, Unknown
  misc_feature (1)..( 7): Result.003 file - promoters60/4768198
aaagaag

SEQ ID NO: 137397 - DNA, 9 bp, Unknown
  misc_feature (1)..( 9): Result.003 file - promoters60/4768198
tcttttatt

SEQ ID NO: 137398 - DNA, 9 bp, Unknown
  misc_feature (1)..( 9): Result.003 file - promoters60/4768198
tcttctatt

SEQ ID NO: 137399 - DNA, 7 bp, Unknown
  misc_feature (1)..( 7): Result.003 file - promoters60/4768198
cttgaga

SEQ ID NO: 137400 - DNA, 7 bp, Unknown
  misc_feature (1)..( 7): Result.003 file - promoters60/4768198
ctttaga

SEQ ID NO: 137401 - DNA, 6 bp, Unknown
  misc_feature (1)..( 6): Result.003 file - promoters60/4768198
ggtttt

SEQ ID NO: 137402 - DNA, 6 bp, Unknown
  misc_feature (1)..( 6): Result.003 file - promoters60/4768198
ggtttt

SEQ ID NO: 137403 - DNA, 7 bp, Unknown
  misc_feature (1)..( 7): Result.003 file - promoters60/4768198
attgttt

SEQ ID NO: 137404 - DNA, 7 bp, Unknown
  misc_feature (1)..( 7): Result.003 file - promoters60/4768198
attgttt

SEQ ID NO: 137405 - DNA, 7 bp, Unknown
  misc_feature (1)..( 7): Result.003 file - promoters60/4768198
aatatta

SEQ ID NO: 137406 - DNA, 7 bp, Unknown
  misc_feature (1)..( 7): Result.003 file - promoters60/4768198
aatgtta

SEQ ID NO: 137407 - DNA, 7 bp, Unknown
  misc_feature (1)..( 7): Result.003 file - promoters60/4768198
gcaatgt

SEQ ID NO: 137408 - DNA, 7 bp, Unknown
  misc_feature (1)..( 7): Result.003 file - promoters60/4768198
gcaatgt

SEQ ID NO: 137409 - DNA, 12 bp, Unknown
  misc_feature (1)..( 12): Result.003 file - promoters60/4768209
gattttgtctat

SEQ ID NO: 137410 - DNA, 12 bp, Unknown
  misc_feature (1)..( 12): Result.003 file - promoters60/4768209
gatgttgtttat

SEQ ID NO: 137411 - DNA, 12 bp, Unknown
  misc_feature (1)..( 12): Result.003 file - promoters60/4768209
tgagttattttc

SEQ ID NO: 137412 - DNA, 12 bp, Unknown
  misc_feature (1)..( 12): Result.003 file - promoters60/4768209
gatttaatttat

SEQ ID NO: 137413 - DNA, 12 bp, Unknown
  misc_feature (1)..( 12): Result.003 file - promoters60/4768217
ttaccattgaaa

SEQ ID NO: 137414 - DNA, 12 bp, Unknown
  misc_feature (1)..( 12): Result.003 file - promoters60/4768217
acccaattgaac

SEQ ID NO: 137415 - DNA, 12 bp, Unknown
  misc_feature (1)..( 12): Result.003 file - promoters60/4768217
gattttttgaaa

SEQ ID NO: 137416 - DNA, 12 bp, Unknown
  misc_feature (1)..( 12): Result.003 file - promoters60/4768217
taaccgttgagc

SEQ ID NO: 137417 - DNA, 12 bp, Unknown
  misc_feature (1)..( 12): Result.003 file - promoters60/4768217
gagcccttgaaa

SEQ ID NO: 137418 - DNA, 12 bp, Unknown
  misc_feature (1)..( 12): Result.003 file - promoters60/4768217
taatcgttaatt

SEQ ID NO: 137419 - DNA, 12 bp, Unknown
  misc_feature (1)..( 12): Result.003 file - promoters60/4768236
tccaaaaaagaa

SEQ ID NO: 137420 - DNA, 12 bp, Unknown
  misc_feature (1)..( 12): Result.003 file - promoters60/4768236
agcaaaaatgaa

SEQ ID NO: 137421 - DNA, 12 bp, Unknown
  misc_feature (1)..( 12): Result.003 file - promoters60/4768236
tcctaaaaacat

SEQ ID NO: 137422 - DNA, 12 bp, Unknown
  misc_feature (1)..( 12): Result.003 file - promoters60/4768236
tataaaaaaata

SEQ ID NO: 137423 - DNA, 12 bp, Unknown
  misc_feature (1)..( 12): Result.003 file - promoters60/4768236
atctagaaattc

SEQ ID NO: 137424 - DNA, 11 bp, Unknown
  misc_feature (1)..( 11): Result.003 file - promoters60/4768236
ttataaacccc

SEQ ID NO: 137425 - DNA, 11 bp, Unknown
  misc_feature (1)..( 11): Result.003 file - promoters60/4768236
aaatacaccca

SEQ ID NO: 137426 - DNA, 11 bp, Unknown
  misc_feature (1)..( 11): Result.003 file - promoters60/4768236
ctaaaaacatt

SEQ ID NO: 137427 - DNA, 11 bp, Unknown
  misc_feature (1)..( 11): Result.003 file - promoters60/4768236
ctagaaattct

SEQ ID NO: 137428 - DNA, 11 bp, Unknown
  misc_feature (1)..( 11): Result.003 file - promoters60/4768236
aaaaaaatatt

SEQ ID NO: 137429 - DNA, 7 bp, Unknown
  misc_feature (1)..( 7): Result.003 file - promoters60/4768236
aaaattc

SEQ ID NO: 137430 - DNA, 7 bp, Unknown
  misc_feature (1)..( 7): Result.003 file - promoters60/4768236
taaattc

SEQ ID NO: 137431 - DNA, 7 bp, Unknown
  misc_feature (1)..( 7): Result.003 file - promoters60/4768236
taatttc

SEQ ID NO: 137432 - DNA, 7 bp, Unknown
  misc_feature (1)..( 7): Result.003 file - promoters60/4768236
caatttc

SEQ ID NO: 137433 - DNA, 12 bp, Unknown
  misc_feature (1)..( 12): Result.003 file - promoters60/4768236
gatacatattag

SEQ ID NO: 137434 - DNA, 12 bp, Unknown
  misc_feature (1)..( 12): Result.003 file - promoters60/4768236
aataaatatcaa

SEQ ID NO: 137435 - DNA, 12 bp, Unknown
  misc_feature (1)..( 12): Result.003 file - promoters60/4768236
aattaatagcaa

SEQ ID NO: 137436 - DNA, 12 bp, Unknown
  misc_feature (1)..( 12): Result.003 file - promoters60/4768236
aattaacttcat

SEQ ID NO: 137437 - DNA, 11 bp, Unknown
  misc_feature (1)..( 11): Result.003 file - promoters60/4768236
aaagaaattat

SEQ ID NO: 137438 - DNA, 11 bp, Unknown
  misc_feature (1)..( 11): Result.003 file - promoters60/4768236
ctagaaattct

SEQ ID NO: 137439 - DNA, 11 bp, Unknown
  misc_feature (1)..( 11): Result.003 file - promoters60/4768236
taaaaaaatat

SEQ ID NO: 137440 - DNA, 11 bp, Unknown
  misc_feature (1)..( 11): Result.003 file - promoters60/4768236
agcaaaaatga

SEQ ID NO: 137441 - DNA, 11 bp, Unknown
  misc_feature (1)..( 11): Result.003 file - promoters60/4768236
ctaaaaacatt

SEQ ID NO: 137442 - DNA, 9 bp, Unknown
  misc_feature (1)..( 9): Result.003 file - promoters60/4768236
aagtcaaaa

SEQ ID NO: 137443 - DNA, 9 bp, Unknown
  misc_feature (1)..( 9): Result.003 file - promoters60/4768236
atttcaaaa

SEQ ID NO: 137444 - DNA, 9 bp, Unknown
  misc_feature (1)..( 9): Result.003 file - promoters60/4768236
aagacaaaa

SEQ ID NO: 137445 - DNA, 9 bp, Unknown
  misc_feature (1)..( 9): Result.003 file - promoters60/4768236
tagaaaaaa

SEQ ID NO: 137446 - DNA, 11 bp, Unknown
  misc_feature (1)..( 11): Result.003 file - promoters60/4768236
catttaaatca

SEQ ID NO: 137447 - DNA, 11 bp, Unknown
  misc_feature (1)..( 11): Result.003 file - promoters60/4768236
cattaaaatat

SEQ ID NO: 137448 - DNA, 11 bp, Unknown
  misc_feature (1)..( 11): Result.003 file - promoters60/4768236
atgaaaaataa

SEQ ID NO: 137449 - DNA, 12 bp, Unknown
  misc_feature (1)..( 12): Result.003 file - promoters60/4768236
agccaaaactaa

SEQ ID NO: 137450 - DNA, 10 bp, Unknown
  misc_feature (1)..( 10): Result.003 file - promoters60/4768236
aaattttaca

SEQ ID NO: 137451 - DNA, 10 bp, Unknown
  misc_feature (1)..( 10): Result.003 file - promoters60/4768236
ctattttatt

SEQ ID NO: 137452 - DNA, 10 bp, Unknown
  misc_feature (1)..( 10): Result.003 file - promoters60/4768236
ctatcttata

SEQ ID NO: 137453 - DNA, 10 bp, Unknown
  misc_feature (1)..( 10): Result.003 file - promoters60/4768236
taattatatt

SEQ ID NO: 137454 - DNA, 6 bp, Unknown
  misc_feature (1)..( 6): Result.003 file - promoters60/4768239
ctttta

SEQ ID NO: 137455 - DNA, 6 bp, Unknown
  misc_feature (1)..( 6): Result.003 file - promoters60/4768239
ctttta

SEQ ID NO: 137456 - DNA, 10 bp, Unknown
  misc_feature (1)..( 10): Result.003 file - promoters60/4768239
aaatattata

SEQ ID NO: 137457 - DNA, 10 bp, Unknown
  misc_feature (1)..( 10): Result.003 file - promoters60/4768239
aaaaattcag

SEQ ID NO: 137458 - DNA, 10 bp, Unknown
  misc_feature (1)..( 10): Result.003 file - promoters60/4768239
gaatatgata

SEQ ID NO: 137459 - DNA, 7 bp, Unknown
  misc_feature (1)..( 7): Result.003 file - promoters60/4768239
acaaata

SEQ ID NO: 137460 - DNA, 7 bp, Unknown
  misc_feature (1)..( 7): Result.003 file - promoters60/4768239
acaaatg

SEQ ID NO: 137461 - DNA, 7 bp, Unknown
  misc_feature (1)..( 7): Result.003 file - promoters60/4768239
gcaaata

SEQ ID NO: 137462 - DNA, 8 bp, Unknown
  misc_feature (1)..( 8): Result.003 file - promoters60/4768239
atcgtttg

SEQ ID NO: 137463 - DNA, 8 bp, Unknown
  misc_feature (1)..( 8): Result.003 file - promoters60/4768239
atcctttg

SEQ ID NO: 137464 - DNA, 6 bp, Unknown
  misc_feature (1)..( 6): Result.003 file - promoters60/4768239
atttga

SEQ ID NO: 137465 - DNA, 6 bp, Unknown
  misc_feature (1)..( 6): Result.003 file - promoters60/4768239
atttga

SEQ ID NO: 137466 - DNA, 9 bp, Unknown
  misc_feature (1)..( 9): Result.003 file - promoters60/4768239
gatgctttg

SEQ ID NO: 137467 - DNA, 9 bp, Unknown
  misc_feature (1)..( 9): Result.003 file - promoters60/4768239
gattctttg

SEQ ID NO: 137468 - DNA, 9 bp, Unknown
  misc_feature (1)..( 9): Result.003 file - promoters60/4768239
cattttttc

SEQ ID NO: 137469 - DNA, 7 bp, Unknown
  misc_feature (1)..( 7): Result.003 file - promoters60/4768239
tattata

SEQ ID NO: 137470 - DNA, 7 bp, Unknown
  misc_feature (1)..( 7): Result.003 file - promoters60/4768239
tatgata

SEQ ID NO: 137471 - DNA, 10 bp, Unknown
  misc_feature (1)..( 10): Result.003 file - promoters60/4768239
agattagcta

SEQ ID NO: 137472 - DNA, 10 bp, Unknown
  misc_feature (1)..( 10): Result.003 file - promoters60/4768239
agattagcta

SEQ ID NO: 137473 - DNA, 6 bp, Unknown
  misc_feature (1)..( 6): Result.003 file - promoters60/4768239
tgtttt

SEQ ID NO: 137474 - DNA, 6 bp, Unknown
  misc_feature (1)..( 6): Result.003 file - promoters60/4768239
tgtttt

SEQ ID NO: 137475 - DNA, 6 bp, Unknown
  misc_feature (1)..( 6): Result.003 file - promoters60/4768239
ttttat

SEQ ID NO: 137476 - DNA, 6 bp, Unknown
  misc_feature (1)..( 6): Result.003 file - promoters60/4768239
ttttat

SEQ ID NO: 137477 - DNA, 7 bp, Unknown
  misc_feature (1)..( 7): Result.003 file - promoters60/4768239
taataat

SEQ ID NO: 137478 - DNA, 7 bp, Unknown
  misc_feature (1)..( 7): Result.003 file - promoters60/4768239
taacaat

SEQ ID NO: 137479 - DNA, 8 bp, Unknown
  misc_feature (1)..( 8): Result.003 file - promoters60/4768239
gtcctatt

SEQ ID NO: 137480 - DNA, 8 bp, Unknown
  misc_feature (1)..( 8): Result.003 file - promoters60/4768239
gtccgatt

SEQ ID NO: 137481 - DNA, 7 bp, Unknown
  misc_feature (1)..( 7): Result.003 file - promoters60/4768239
tatatat

SEQ ID NO: 137482 - DNA, 7 bp, Unknown
  misc_feature (1)..( 7): Result.003 file - promoters60/4768239
tatttat

SEQ ID NO: 137483 - DNA, 8 bp, Unknown
  misc_feature (1)..( 8): Result.003 file - promoters60/4768250
ttttaata

SEQ ID NO: 137484 - DNA, 8 bp, Unknown
  misc_feature (1)..( 8): Result.003 file - promoters60/4768250
atttaatt

SEQ ID NO: 137485 - DNA, 9 bp, Unknown
  misc_feature (1)..( 9): Result.003 file - promoters60/4768250
tttgtaatt

SEQ ID NO: 137486 - DNA, 9 bp, Unknown
  misc_feature (1)..( 9): Result.003 file - promoters60/4768250
gatttaaag

SEQ ID NO: 137487 - DNA, 9 bp, Unknown
  misc_feature (1)..( 9): Result.003 file - promoters60/4768250
actttaaaa

SEQ ID NO: 137488 - DNA, 9 bp, Unknown
  misc_feature (1)..( 9): Result.003 file - promoters60/4768250
tgtttgatt

SEQ ID NO: 137489 - DNA, 11 bp, Unknown
  misc_feature (1)..( 11): Result.003 file - promoters60/4768250
atttaaagcta

SEQ ID NO: 137490 - DNA, 11 bp, Unknown
  misc_feature (1)..( 11): Result.003 file - promoters60/4768250
attaaaagaaa

SEQ ID NO: 137491 - DNA, 11 bp, Unknown
  misc_feature (1)..( 11): Result.003 file - promoters60/4768250
cttaaataata

SEQ ID NO: 137492 - DNA, 11 bp, Unknown
  misc_feature (1)..( 11): Result.003 file - promoters60/4768250
ctaaaataata

SEQ ID NO: 137493 - DNA, 11 bp, Unknown
  misc_feature (1)..( 11): Result.003 file - promoters60/4768250
cctaacagaat

SEQ ID NO: 137494 - DNA, 11 bp, Unknown
  misc_feature (1)..( 11): Result.003 file - promoters60/4768250
aagaaaaaaat

SEQ ID NO: 137495 - DNA, 12 bp, Unknown
  misc_feature (1)..( 12): Result.003 file - promoters60/4768250
agtaataatatt

SEQ ID NO: 137496 - DNA, 12 bp, Unknown
  misc_feature (1)..( 12): Result.003 file - promoters60/4768250
caaaattatatc

SEQ ID NO: 137497 - DNA, 12 bp, Unknown
  misc_feature (1)..( 12): Result.003 file - promoters60/4768250
ttatacaatatt

SEQ ID NO: 137498 - DNA, 12 bp, Unknown
  misc_feature (1)..( 12): Result.003 file - promoters60/4768250
caaacttatcca

SEQ ID NO: 137499 - DNA, 12 bp, Unknown
  misc_feature (1)..( 12): Result.003 file - promoters60/4768250
aaaactttaaaa

SEQ ID NO: 137500 - DNA, 12 bp, Unknown
  misc_feature (1)..( 12): Result.003 file - promoters60/4768250
cgaatcaatatg

SEQ ID NO: 137501 - DNA, 9 bp, Unknown
  misc_feature (1)..( 9): Result.003 file - promoters60/4768250
caagattta

SEQ ID NO: 137502 - DNA, 9 bp, Unknown
  misc_feature (1)..( 9): Result.003 file - promoters60/4768250
caaaattat

SEQ ID NO: 137503 - DNA, 9 bp, Unknown
  misc_feature (1)..( 9): Result.003 file - promoters60/4768250
caaacttat

SEQ ID NO: 137504 - DNA, 9 bp, Unknown
  misc_feature (1)..( 9): Result.003 file - promoters60/4768250
aaaacttta

SEQ ID NO: 137505 - DNA, 9 bp, Unknown
  misc_feature (1)..( 9): Result.003 file - promoters60/4768250
caatatttg

SEQ ID NO: 137506 - DNA, 9 bp, Unknown
  misc_feature (1)..( 9): Result.003 file - promoters60/4768250
caatatgtg

SEQ ID NO: 137507 - DNA, 13 bp, Unknown
  misc_feature (1)..( 13): Result.003 file - promoters60/4768250
ggtagaaaaacct

SEQ ID NO: 137508 - DNA, 13 bp, Unknown
  misc_feature (1)..( 13): Result.003 file - promoters60/4768250
gatacaaaaccct

SEQ ID NO: 137509 - DNA, 13 bp, Unknown
  misc_feature (1)..( 13): Result.003 file - promoters60/4768250
agaagaaaaaaat

SEQ ID NO: 137510 - DNA, 13 bp, Unknown
  misc_feature (1)..( 13): Result.003 file - promoters60/4768250
tttctaaaataat

SEQ ID NO: 137511 - DNA, 13 bp, Unknown
  misc_feature (1)..( 13): Result.003 file - promoters60/4768250
tttataatatata

SEQ ID NO: 137512 - DNA, 11 bp, Unknown
  misc_feature (1)..( 11): Result.003 file - promoters60/4768250
ttaaataatac

SEQ ID NO: 137513 - DNA, 11 bp, Unknown
  misc_feature (1)..( 11): Result.003 file - promoters60/4768250
gaaaaaaattc

SEQ ID NO: 137514 - DNA, 11 bp, Unknown
  misc_feature (1)..( 11): Result.003 file - promoters60/4768250
ttaattaaaag

SEQ ID NO: 137515 - DNA, 11 bp, Unknown
  misc_feature (1)..( 11): Result.003 file - promoters60/4768250
taaaataatat

SEQ ID NO: 137516 - DNA, 11 bp, Unknown
  misc_feature (1)..( 11): Result.003 file - promoters60/4768250
cagaataaaaa

SEQ ID NO: 137517 - DNA, 6 bp, Unknown
  misc_feature (1)..( 6): Result.003 file - promoters60/4768253
agattc

SEQ ID NO: 137518 - DNA, 6 bp, Unknown
  misc_feature (1)..( 6): Result.003 file - promoters60/4768253
agattc

SEQ ID NO: 137519 - DNA, 8 bp, Unknown
  misc_feature (1)..( 8): Result.003 file - promoters60/4768253
tcccatga

SEQ ID NO: 137520 - DNA, 8 bp, Unknown
  misc_feature (1)..( 8): Result.003 file - promoters60/4768253
tccgatga

SEQ ID NO: 137521 - DNA, 6 bp, Unknown
  misc_feature (1)..( 6): Result.003 file - promoters60/4768253
tcttct

SEQ ID NO: 137522 - DNA, 6 bp, Unknown
  misc_feature (1)..( 6): Result.003 file - promoters60/4768253
tcttct

SEQ ID NO: 137523 - DNA, 6 bp, Unknown
  misc_feature (1)..( 6): Result.003 file - promoters60/4768253
gaaaaa

SEQ ID NO: 137524 - DNA, 6 bp, Unknown
  misc_feature (1)..( 6): Result.003 file - promoters60/4768253
gaaaaa

SEQ ID NO: 137525 - DNA, 6 bp, Unknown
  misc_feature (1)..( 6): Result.003 file - promoters60/4768253
ataaat

SEQ ID NO: 137526 - DNA, 6 bp, Unknown
  misc_feature (1)..( 6): Result.003 file - promoters60/4768253
ataaat

SEQ ID NO: 137527 - DNA, 7 bp, Unknown
  misc_feature (1)..( 7): Result.003 file - promoters60/4768253
taataat

SEQ ID NO: 137528 - DNA, 7 bp, Unknown
  misc_feature (1)..( 7): Result.003 file - promoters60/4768253
taaaaat

SEQ ID NO: 137529 - DNA, 8 bp, Unknown
  misc_feature (1)..( 8): Result.003 file - promoters60/4768253
aagacaaa

SEQ ID NO: 137530 - DNA, 8 bp, Unknown
  misc_feature (1)..( 8): Result.003 file - promoters60/4768253
aagaaaaa

SEQ ID NO: 137531 - DNA, 7 bp, Unknown
  misc_feature (1)..( 7): Result.003 file - promoters60/4768253
gaactca

SEQ ID NO: 137532 - DNA, 7 bp, Unknown
  misc_feature (1)..( 7): Result.003 file - promoters60/4768253
gaactca

SEQ ID NO: 137533 - DNA, 7 bp, Unknown
  misc_feature (1)..( 7): Result.003 file - promoters60/4768253
attttct

SEQ ID NO: 137534 - DNA, 7 bp, Unknown
  misc_feature (1)..( 7): Result.003 file - promoters60/4768253
attgtct

SEQ ID NO: 137535 - DNA, 6 bp, Unknown
  misc_feature (1)..( 6): Result.003 file - promoters60/4768253
aagaaa

SEQ ID NO: 137536 - DNA, 6 bp, Unknown
  misc_feature (1)..( 6): Result.003 file - promoters60/4768253
aagaaa

SEQ ID NO: 137537 - DNA, 8 bp, Unknown
  misc_feature (1)..( 8): Result.003 file - promoters60/4768253
ggcccatt

SEQ ID NO: 137538 - DNA, 8 bp, Unknown
  misc_feature (1)..( 8): Result.003 file - promoters60/4768253
ggccgatt

SEQ ID NO: 137539 - DNA, 7 bp, Unknown
  misc_feature (1)..( 7): Result.003 file - promoters60/4768253
agtctcc

SEQ ID NO: 137540 - DNA, 7 bp, Unknown
  misc_feature (1)..( 7): Result.003 file - promoters60/4768253
agtctcc

SEQ ID NO: 137541 - DNA, 10 bp, Unknown
  misc_feature (1)..( 10): Result.003 file - promoters60/4768265
ataaatgtgt

SEQ ID NO: 137542 - DNA, 10 bp, Unknown
  misc_feature (1)..( 10): Result.003 file - promoters60/4768265
aagaatttgt

SEQ ID NO: 137543 - DNA, 10 bp, Unknown
  misc_feature (1)..( 10): Result.003 file - promoters60/4768265
ttaaatgtat

SEQ ID NO: 137544 - DNA, 10 bp, Unknown
  misc_feature (1)..( 10): Result.003 file - promoters60/4768265
cctaatttgc

SEQ ID NO: 137545 - DNA, 10 bp, Unknown
  misc_feature (1)..( 10): Result.003 file - promoters60/4768265
agaaattgcg

SEQ ID NO: 137546 - DNA, 10 bp, Unknown
  misc_feature (1)..( 10): Result.003 file - promoters60/4768265
ctgaattgca

SEQ ID NO: 137547 - DNA, 12 bp, Unknown
  misc_feature (1)..( 12): Result.003 file - promoters60/4768265
gtcaagtttgag

SEQ ID NO: 137548 - DNA, 12 bp, Unknown
  misc_feature (1)..( 12): Result.003 file - promoters60/4768265
atcaattttgct

SEQ ID NO: 137549 - DNA, 12 bp, Unknown
  misc_feature (1)..( 12): Result.003 file - promoters60/4768265
gaagagtctgat

SEQ ID NO: 137550 - DNA, 12 bp, Unknown
  misc_feature (1)..( 12): Result.003 file - promoters60/4768265
atcatttttttc

SEQ ID NO: 137551 - DNA, 12 bp, Unknown
  misc_feature (1)..( 12): Result.003 file - promoters60/4768265
aataatttattt

SEQ ID NO: 137552 - DNA, 12 bp, Unknown
  misc_feature (1)..( 12): Result.003 file - promoters60/4768265
gacgagcctgat

SEQ ID NO: 137553 - DNA, 6 bp, Unknown
  misc_feature (1)..( 6): Result.003 file - promoters60/4768269
attcac

SEQ ID NO: 137554 - DNA, 6 bp, Unknown
  misc_feature (1)..( 6): Result.003 file - promoters60/4768269
attcac

SEQ ID NO: 137555 - DNA, 7 bp, Unknown
  misc_feature (1)..( 7): Result.003 file - promoters60/4768269
acaaata

SEQ ID NO: 137556 - DNA, 7 bp, Unknown
  misc_feature (1)..( 7): Result.003 file - promoters60/4768269
ccaaata

SEQ ID NO: 137557 - DNA, 7 bp, Unknown
  misc_feature (1)..( 7): Result.003 file - promoters60/4768269
acaaatg

SEQ ID NO: 137558 - DNA, 8 bp, Unknown
  misc_feature (1)..( 8): Result.003 file - promoters60/4768269
ataataat

SEQ ID NO: 137559 - DNA, 8 bp, Unknown
  misc_feature (1)..( 8): Result.003 file - promoters60/4768269
ataacaat

SEQ ID NO: 137560 - DNA, 6 bp, Unknown
  misc_feature (1)..( 6): Result.003 file - promoters60/4768269
ctttca

SEQ ID NO: 137561 - DNA, 6 bp, Unknown
  misc_feature (1)..( 6): Result.003 file - promoters60/4768269
ctttca

SEQ ID NO: 137562 - DNA, 6 bp, Unknown
  misc_feature (1)..( 6): Result.003 file - promoters60/4768269
aataac

SEQ ID NO: 137563 - DNA, 6 bp, Unknown
  misc_feature (1)..( 6): Result.003 file - promoters60/4768269
aataac

SEQ ID NO: 137564 - DNA, 7 bp, Unknown
  misc_feature (1)..( 7): Result.003 file - promoters60/4768269
aaagaat

SEQ ID NO: 137565 - DNA, 7 bp, Unknown
  misc_feature (1)..( 7): Result.003 file - promoters60/4768269
aaacaat

SEQ ID NO: 137566 - DNA, 11 bp, Unknown
  misc_feature (1)..( 11): Result.003 file - promoters60/4768269
agtttttttgc

SEQ ID NO: 137567 - DNA, 11 bp, Unknown
  misc_feature (1)..( 11): Result.003 file - promoters60/4768269
agttattttgc

SEQ ID NO: 137568 - DNA, 7 bp, Unknown
  misc_feature (1)..( 7): Result.003 file - promoters60/4768269
tctgtga

SEQ ID NO: 137569 - DNA, 7 bp, Unknown
  misc_feature (1)..( 7): Result.003 file - promoters60/4768269
tctgtga

SEQ ID NO: 137570 - DNA, 7 bp, Unknown
  misc_feature (1)..( 7): Result.003 file - promoters60/4768269
ttttgta

SEQ ID NO: 137571 - DNA, 7 bp, Unknown
  misc_feature (1)..( 7): Result.003 file - promoters60/4768269
tttggta

SEQ ID NO: 137572 - DNA, 7 bp, Unknown
  misc_feature (1)..( 7): Result.003 file - promoters60/4768269
tggcatt

SEQ ID NO: 137573 - DNA, 7 bp, Unknown
  misc_feature (1)..( 7): Result.003 file - promoters60/4768269
tggaatt

SEQ ID NO: 137574 - DNA, 6 bp, Unknown
  misc_feature (1)..( 6): Result.003 file - promoters60/4768269
ttcggt

SEQ ID NO: 137575 - DNA, 6 bp, Unknown
  misc_feature (1)..( 6): Result.003 file - promoters60/4768269
ttcggt

SEQ ID NO: 137576 - DNA, 8 bp, Unknown
  misc_feature (1)..( 8): Result.003 file - promoters60/4768269
catcagaa

SEQ ID NO: 137577 - DNA, 8 bp, Unknown
  misc_feature (1)..( 8): Result.003 file - promoters60/4768269
catcggaa

SEQ ID NO: 137578 - DNA, 7 bp, Unknown
  misc_feature (1)..( 7): Result.003 file - promoters60/4768269
tgcaagg

SEQ ID NO: 137579 - DNA, 7 bp, Unknown
  misc_feature (1)..( 7): Result.003 file - promoters60/4768269
tgccagg

SEQ ID NO: 137580 - DNA, 11 bp, Unknown
  misc_feature (1)..( 11): Result.003 file - promoters60/4768285
caaacttataa

SEQ ID NO: 137581 - DNA, 11 bp, Unknown
  misc_feature (1)..( 11): Result.003 file - promoters60/4768285
atcacttgtaa

SEQ ID NO: 137582 - DNA, 11 bp, Unknown
  misc_feature (1)..( 11): Result.003 file - promoters60/4768285
taaatttaaat

SEQ ID NO: 137583 - DNA, 11 bp, Unknown
  misc_feature (1)..( 11): Result.003 file - promoters60/4768285
cgatcttgtat

SEQ ID NO: 137584 - DNA, 11 bp, Unknown
  misc_feature (1)..( 11): Result.003 file - promoters60/4768285
taaattaaact

SEQ ID NO: 137585 - DNA, 11 bp, Unknown
  misc_feature (1)..( 11): Result.003 file - promoters60/4768285
gaaatgaaatc

SEQ ID NO: 137586 - DNA, 12 bp, Unknown
  misc_feature (1)..( 12): Result.003 file - promoters60/4768285
gtttttctaatt

SEQ ID NO: 137587 - DNA, 12 bp, Unknown
  misc_feature (1)..( 12): Result.003 file - promoters60/4768285
gttattctctta

SEQ ID NO: 137588 - DNA, 12 bp, Unknown
  misc_feature (1)..( 12): Result.003 file - promoters60/4768285
ttttttccaaat

SEQ ID NO: 137589 - DNA, 12 bp, Unknown
  misc_feature (1)..( 12): Result.003 file - promoters60/4768285
acttttccaatg

SEQ ID NO: 137590 - DNA, 12 bp, Unknown
  misc_feature (1)..( 12): Result.003 file - promoters60/4768285
ttgctgccaatg

SEQ ID NO: 137591 - DNA, 12 bp, Unknown
  misc_feature (1)..( 12): Result.003 file - promoters60/4768285
tcttttcacata

SEQ ID NO: 137592 - DNA, 14 bp, Unknown
  misc_feature (1)..( 14): Result.003 file - promoters60/4768285
tttaatcgatcatc

SEQ ID NO: 137593 - DNA, 14 bp, Unknown
  misc_feature (1)..( 14): Result.003 file - promoters60/4768285
ttttatcattaatt

SEQ ID NO: 137594 - DNA, 14 bp, Unknown
  misc_feature (1)..( 14): Result.003 file - promoters60/4768285
gtttgtcaaccaca

SEQ ID NO: 137595 - DNA, 14 bp, Unknown
  misc_feature (1)..( 14): Result.003 file - promoters60/4768285
tattgacaataaca

SEQ ID NO: 137596 - DNA, 14 bp, Unknown
  misc_feature (1)..( 14): Result.003 file - promoters60/4768285
atttttcactaatt

SEQ ID NO: 137597 - DNA, 14 bp, Unknown
  misc_feature (1)..( 14): Result.003 file - promoters60/4768285
tcctcacactaaac

SEQ ID NO: 137598 - DNA, 12 bp, Unknown
  misc_feature (1)..( 12): Result.003 file - promoters60/4768285
cgttttatattt

SEQ ID NO: 137599 - DNA, 12 bp, Unknown
  misc_feature (1)..( 12): Result.003 file - promoters60/4768285
caatttatatct

SEQ ID NO: 137600 - DNA, 12 bp, Unknown
  misc_feature (1)..( 12): Result.003 file - promoters60/4768285
aataatatattt

SEQ ID NO: 137601 - DNA, 12 bp, Unknown
  misc_feature (1)..( 12): Result.003 file - promoters60/4768285
caatttatctaa

SEQ ID NO: 137602 - DNA, 12 bp, Unknown
  misc_feature (1)..( 12): Result.003 file - promoters60/4768285
tcattcatatca

SEQ ID NO: 137603 - DNA, 12 bp, Unknown
  misc_feature (1)..( 12): Result.003 file - promoters60/4768285
gttttcttatta

SEQ ID NO: 137604 - DNA, 6 bp, Unknown
  misc_feature (1)..( 6): Result.003 file - promoters60/4768289
taacaa

SEQ ID NO: 137605 - DNA, 6 bp, Unknown
  misc_feature (1)..( 6): Result.003 file - promoters60/4768289
taacaa

SEQ ID NO: 137606 - DNA, 9 bp, Unknown
  misc_feature (1)..( 9): Result.003 file - promoters60/4768289
gtttattaa

SEQ ID NO: 137607 - DNA, 9 bp, Unknown
  misc_feature (1)..( 9): Result.003 file - promoters60/4768289
atttattaa

SEQ ID NO: 137608 - DNA, 9 bp, Unknown
  misc_feature (1)..( 9): Result.003 file - promoters60/4768289
gtttatgaa

SEQ ID NO: 137609 - DNA, 6 bp, Unknown
  misc_feature (1)..( 6): Result.003 file - promoters60/4768289
gaacat

SEQ ID NO: 137610 - DNA, 6 bp, Unknown
  misc_feature (1)..( 6): Result.003 file - promoters60/4768289
gaacat

SEQ ID NO: 137611 - DNA, 8 bp, Unknown
  misc_feature (1)..( 8): Result.003 file - promoters60/4768289
ttacaaga

SEQ ID NO: 137612 - DNA, 8 bp, Unknown
  misc_feature (1)..( 8): Result.003 file - promoters60/4768289
ttaaaaga

SEQ ID NO: 137613 - DNA, 8 bp, Unknown
  misc_feature (1)..( 8): Result.003 file - promoters60/4768289
tgagctta

SEQ ID NO: 137614 - DNA, 8 bp, Unknown
  misc_feature (1)..( 8): Result.003 file - promoters60/4768289
tgaactta

SEQ ID NO: 137615 - DNA, 6 bp, Unknown
  misc_feature (1)..( 6): Result.003 file - promoters60/4768289
gagatt

SEQ ID NO: 137616 - DNA, 6 bp, Unknown
  misc_feature (1)..( 6): Result.003 file - promoters60/4768289
gagatt

SEQ ID NO: 137617 - DNA, 7 bp, Unknown
  misc_feature (1)..( 7): Result.003 file - promoters60/4768289
atgctta

SEQ ID NO: 137618 - DNA, 7 bp, Unknown
  misc_feature (1)..( 7): Result.003 file - promoters60/4768289
atgctta

SEQ ID NO: 137619 - DNA, 8 bp, Unknown
  misc_feature (1)..( 8): Result.003 file - promoters60/4768289
tcaggttg

SEQ ID NO: 137620 - DNA, 8 bp, Unknown
  misc_feature (1)..( 8): Result.003 file - promoters60/4768289
tcaagttg

SEQ ID NO: 137621 - DNA, 13 bp, Unknown
  misc_feature (1)..( 13): Result.003 file - promoters60/4768289
ttgaatcaatatt

SEQ ID NO: 137622 - DNA, 13 bp, Unknown
  misc_feature (1)..( 13): Result.003 file - promoters60/4768289
ttgattcaaaatt

SEQ ID NO: 137623 - DNA, 7 bp, Unknown
  misc_feature (1)..( 7): Result.003 file - promoters60/4768289
tggattt

SEQ ID NO: 137624 - DNA, 7 bp, Unknown
  misc_feature (1)..( 7): Result.003 file - promoters60/4768289
tggattt

SEQ ID NO: 137625 - DNA, 6 bp, Unknown
  misc_feature (1)..( 6): Result.003 file - promoters60/4768289
aagatt

SEQ ID NO: 137626 - DNA, 6 bp, Unknown
  misc_feature (1)..( 6): Result.003 file - promoters60/4768289
aagatt

SEQ ID NO: 137627 - DNA, 6 bp, Unknown
  misc_feature (1)..( 6): Result.003 file - promoters60/4768289
ttggtt

SEQ ID NO: 137628 - DNA, 6 bp, Unknown
  misc_feature (1)..( 6): Result.003 file - promoters60/4768289
ttggtt

SEQ ID NO: 137629 - DNA, 6 bp, Unknown
  misc_feature (1)..( 6): Result.003 file - promoters60/4768289
ttaacc

SEQ ID NO: 137630 - DNA, 6 bp, Unknown
  misc_feature (1)..( 6): Result.003 file - promoters60/4768289
ttaacc

SEQ ID NO: 137631 - DNA, 7 bp, Unknown
  misc_feature (1)..( 7): Result.003 file - promoters60/4768289
ctcactc

SEQ ID NO: 137632 - DNA, 7 bp, Unknown
  misc_feature (1)..( 7): Result.003 file - promoters60/4768289
ctcgctc

SEQ ID NO: 137633 - DNA, 6 bp, Unknown
  misc_feature (1)..( 6): Result.003 file - promoters60/4768289
atttct

SEQ ID NO: 137634 - DNA, 6 bp, Unknown
  misc_feature (1)..( 6): Result.003 file - promoters60/4768289
atttct

SEQ ID NO: 137635 - DNA, 7 bp, Unknown
  misc_feature (1)..( 7): Result.003 file - promoters60/4768293
tcttctg

SEQ ID NO: 137636 - DNA, 7 bp, Unknown
  misc_feature (1)..( 7): Result.003 file - promoters60/4768293
tcttctg

SEQ ID NO: 137637 - DNA, 8 bp, Unknown
  misc_feature (1)..( 8): Result.003 file - promoters60/4768293
cattttgt

SEQ ID NO: 137638 - DNA, 8 bp, Unknown
  misc_feature (1)..( 8): Result.003 file - promoters60/4768293
cattttca

SEQ ID NO: 137639 - DNA, 8 bp, Unknown
  misc_feature (1)..( 8): Result.003 file - promoters60/4768293
gattctca

SEQ ID NO: 137640 - DNA, 10 bp, Unknown
  misc_feature (1)..( 10): Result.003 file - promoters60/4768293
ttttacagat

SEQ ID NO: 137641 - DNA, 10 bp, Unknown
  misc_feature (1)..( 10): Result.003 file - promoters60/4768293
attttcagat

SEQ ID NO: 137642 - DNA, 10 bp, Unknown
  misc_feature (1)..( 10): Result.003 file - promoters60/4768293
attctcaccc

SEQ ID NO: 137643 - DNA, 7 bp, Unknown
  misc_feature (1)..( 7): Result.003 file - promoters60/4768293
cagtgaa

SEQ ID NO: 137644 - DNA, 7 bp, Unknown
  misc_feature (1)..( 7): Result.003 file - promoters60/4768293
cagggaa

SEQ ID NO: 137645 - DNA, 10 bp, Unknown
  misc_feature (1)..( 10): Result.003 file - promoters60/4768293
tgatattctt

SEQ ID NO: 137646 - DNA, 10 bp, Unknown
  misc_feature (1)..( 10): Result.003 file - promoters60/4768293
tgatatgctt

SEQ ID NO: 137647 - DNA, 7 bp, Unknown
  misc_feature (1)..( 7): Result.003 file - promoters60/4768293
gatgata

SEQ ID NO: 137648 - DNA, 7 bp, Unknown
  misc_feature (1)..( 7): Result.003 file - promoters60/4768293
gatcata

SEQ ID NO: 137649 - DNA, 7 bp, Unknown
  misc_feature (1)..( 7): Result.003 file - promoters60/4768293
aaactac

SEQ ID NO: 137650 - DNA, 7 bp, Unknown
  misc_feature (1)..( 7): Result.003 file - promoters60/4768293
aaactac

SEQ ID NO: 137651 - DNA, 6 bp, Unknown
  misc_feature (1)..( 6): Result.003 file - promoters60/4768293
aaactt

SEQ ID NO: 137652 - DNA, 6 bp, Unknown
  misc_feature (1)..( 6): Result.003 file - promoters60/4768293
aaactt

SEQ ID NO: 137653 - DNA, 8 bp, Unknown
  misc_feature (1)..( 8): Result.003 file - promoters60/4768293
tgcaggta

SEQ ID NO: 137654 - DNA, 8 bp, Unknown
  misc_feature (1)..( 8): Result.003 file - promoters60/4768293
tgcaggta

SEQ ID NO: 137655 - DNA, 8 bp, Unknown
  misc_feature (1)..( 8): Result.003 file - promoters60/4768293
tggaatcc

SEQ ID NO: 137656 - DNA, 8 bp, Unknown
  misc_feature (1)..( 8): Result.003 file - promoters60/4768293
tggtatcc

SEQ ID NO: 137657 - DNA, 7 bp, Unknown
  misc_feature (1)..( 7): Result.003 file - promoters60/4768293
atcatgc

SEQ ID NO: 137658 - DNA, 7 bp, Unknown
  misc_feature (1)..( 7): Result.003 file - promoters60/4768293
atcctgc

SEQ ID NO: 137659 - DNA, 13 bp, Unknown
  misc_feature (1)..( 13): Result.003 file - promoters60/4768319
catcttcctttgt

SEQ ID NO: 137660 - DNA, 13 bp, Unknown
  misc_feature (1)..( 13): Result.003 file - promoters60/4768319
attcttcgtttgt

SEQ ID NO: 137661 - DNA, 13 bp, Unknown
  misc_feature (1)..( 13): Result.003 file - promoters60/4768319
actcttcgtcaat

SEQ ID NO: 137662 - DNA, 13 bp, Unknown
  misc_feature (1)..( 13): Result.003 file - promoters60/4768319
cattttctttttg

SEQ ID NO: 137663 - DNA, 11 bp, Unknown
  misc_feature (1)..( 11): Result.003 file - promoters60/4768319
tagataattgt

SEQ ID NO: 137664 - DNA, 11 bp, Unknown
  misc_feature (1)..( 11): Result.003 file - promoters60/4768319
cagataagtct

SEQ ID NO: 137665 - DNA, 11 bp, Unknown
  misc_feature (1)..( 11): Result.003 file - promoters60/4768319
tagacaattgt

SEQ ID NO: 137666 - DNA, 7 bp, Unknown
  misc_feature (1)..( 7): Result.003 file - promoters60/4768319
actcttt

SEQ ID NO: 137667 - DNA, 7 bp, Unknown
  misc_feature (1)..( 7): Result.003 file - promoters60/4768319
actcttc

SEQ ID NO: 137668 - DNA, 7 bp, Unknown
  misc_feature (1)..( 7): Result.003 file - promoters60/4768319
actattc

SEQ ID NO: 137669 - DNA, 6 bp, Unknown
  misc_feature (1)..( 6): Result.003 file - promoters60/4768319
aaaaaa

SEQ ID NO: 137670 - DNA, 6 bp, Unknown
  misc_feature (1)..( 6): Result.003 file - promoters60/4768319
aaaaaa

SEQ ID NO: 137671 - DNA, 6 bp, Unknown
  misc_feature (1)..( 6): Result.003 file - promoters60/4768319
aaaaaa

SEQ ID NO: 137672 - DNA, 8 bp, Unknown
  misc_feature (1)..( 8): Result.003 file - promoters60/4768319
taaacatt

SEQ ID NO: 137673 - DNA, 8 bp, Unknown
  misc_feature (1)..( 8): Result.003 file - promoters60/4768319
taaacaaa

SEQ ID NO: 137674 - DNA, 8 bp, Unknown
  misc_feature (1)..( 8): Result.003 file - promoters60/4768319
taaaaaaa

SEQ ID NO: 137675 - DNA, 9 bp, Unknown
  misc_feature (1)..( 9): Result.003 file - promoters60/4768319
ttcactttt

SEQ ID NO: 137676 - DNA, 9 bp, Unknown
  misc_feature (1)..( 9): Result.003 file - promoters60/4768319
ctcattttt

SEQ ID NO: 137677 - DNA, 9 bp, Unknown
  misc_feature (1)..( 9): Result.003 file - promoters60/4768319
attattatt

SEQ ID NO: 137678 - DNA, 7 bp, Unknown
  misc_feature (1)..( 7): Result.003 file - promoters60/4768323
ttggtca

SEQ ID NO: 137679 - DNA, 7 bp, Unknown
  misc_feature (1)..( 7): Result.003 file - promoters60/4768323
ttggtct

SEQ ID NO: 137680 - DNA, 7 bp, Unknown
  misc_feature (1)..( 7): Result.003 file - promoters60/4768323
ttgatca

SEQ ID NO: 137681 - DNA, 7 bp, Unknown
  misc_feature (1)..( 7): Result.003 file - promoters60/4768323
tttactg

SEQ ID NO: 137682 - DNA, 7 bp, Unknown
  misc_feature (1)..( 7): Result.003 file - promoters60/4768323
ttttctg

SEQ ID NO: 137683 - DNA, 7 bp, Unknown
  misc_feature (1)..( 7): Result.003 file - promoters60/4768323
atgaaat

SEQ ID NO: 137684 - DNA, 7 bp, Unknown
  misc_feature (1)..( 7): Result.003 file - promoters60/4768323
atgcaat

SEQ ID NO: 137685 - DNA, 9 bp, Unknown
  misc_feature (1)..( 9): Result.003 file - promoters60/4768323
gaaaagtat

SEQ ID NO: 137686 - DNA, 9 bp, Unknown
  misc_feature (1)..( 9): Result.003 file - promoters60/4768323
gaaaagtat

SEQ ID NO: 137687 - DNA, 7 bp, Unknown
  misc_feature (1)..( 7): Result.003 file - promoters60/4768323
tcacatc

SEQ ID NO: 137688 - DNA, 7 bp, Unknown
  misc_feature (1)..( 7): Result.003 file - promoters60/4768323
tcaaatc

SEQ ID NO: 137689 - DNA, 7 bp, Unknown
  misc_feature (1)..( 7): Result.003 file - promoters60/4768323
gtttttc

SEQ ID NO: 137690 - DNA, 7 bp, Unknown
  misc_feature (1)..( 7): Result.003 file - promoters60/4768323
ctttttc

SEQ ID NO: 137691 - DNA, 7 bp, Unknown
  misc_feature (1)..( 7): Result.003 file - promoters60/4768323
ctttttt

SEQ ID NO: 137692 - DNA, 6 bp, Unknown
  misc_feature (1)..( 6): Result.003 file - promoters60/4768323
tgattt

SEQ ID NO: 137693 - DNA, 6 bp, Unknown
  misc_feature (1)..( 6): Result.003 file - promoters60/4768323
tgattt

SEQ ID NO: 137694 - DNA, 8 bp, Unknown
  misc_feature (1)..( 8): Result.003 file - promoters60/4768323
tttcttat

SEQ ID NO: 137695 - DNA, 8 bp, Unknown
  misc_feature (1)..( 8): Result.003 file - promoters60/4768323
tttgttat

SEQ ID NO: 137696 - DNA, 7 bp, Unknown
  misc_feature (1)..( 7): Result.003 file - promoters60/4768323
ggaacca

SEQ ID NO: 137697 - DNA, 7 bp, Unknown
  misc_feature (1)..( 7): Result.003 file - promoters60/4768323
ggatcca

SEQ ID NO: 137698 - DNA, 6 bp, Unknown
  misc_feature (1)..( 6): Result.003 file - promoters60/4768323
tagggt

SEQ ID NO: 137699 - DNA, 6 bp, Unknown
  misc_feature (1)..( 6): Result.003 file - promoters60/4768323
tagggt

SEQ ID NO: 137700 - DNA, 6 bp, Unknown
  misc_feature (1)..( 6): Result.003 file - promoters60/4768323
aaaaaa

SEQ ID NO: 137701 - DNA, 6 bp, Unknown
  misc_feature (1)..( 6): Result.003 file - promoters60/4768323
aaaaaa

SEQ ID NO: 137702 - DNA, 7 bp, Unknown
  misc_feature (1)..( 7): Result.003 file - promoters60/4768323
tcttttt

SEQ ID NO: 137703 - DNA, 7 bp, Unknown
  misc_feature (1)..( 7): Result.003 file - promoters60/4768323
tcttttt

SEQ ID NO: 137704 - DNA, 6 bp, Unknown
  misc_feature (1)..( 6): Result.003 file - promoters60/4768323
atattt

SEQ ID NO: 137705 - DNA, 6 bp, Unknown
  misc_feature (1)..( 6): Result.003 file - promoters60/4768323
atattt

SEQ ID NO: 137706 - DNA, 6 bp, Unknown
  misc_feature (1)..( 6): Result.003 file - promoters60/4768323
aaaaga

SEQ ID NO: 137707 - DNA, 6 bp, Unknown
  misc_feature (1)..( 6): Result.003 file - promoters60/4768323
aaaaga

SEQ ID NO: 137708 - DNA, 7 bp, Unknown
  misc_feature (1)..( 7): Result.003 file - promoters60/4768346
atatgat

SEQ ID NO: 137709 - DNA, 7 bp, Unknown
  misc_feature (1)..( 7): Result.003 file - promoters60/4768346
atatgat

SEQ ID NO: 137710 - DNA, 7 bp, Unknown
  misc_feature (1)..( 7): Result.003 file - promoters60/4768346
taaaata

SEQ ID NO: 137711 - DNA, 7 bp, Unknown
  misc_feature (1)..( 7): Result.003 file - promoters60/4768346
taagata

SEQ ID NO: 137712 - DNA, 10 bp, Unknown
  misc_feature (1)..( 10): Result.003 file - promoters60/4768346
atatctgaaa

SEQ ID NO: 137713 - DNA, 10 bp, Unknown
  misc_feature (1)..( 10): Result.003 file - promoters60/4768346
atatatgaaa

SEQ ID NO: 137714 - DNA, 9 bp, Unknown
  misc_feature (1)..( 9): Result.003 file - promoters60/4768346
aaataaaat

SEQ ID NO: 137715 - DNA, 9 bp, Unknown
  misc_feature (1)..( 9): Result.003 file - promoters60/4768346
aaataaaat

SEQ ID NO: 137716 - DNA, 7 bp, Unknown
  misc_feature (1)..( 7): Result.003 file - promoters60/4768346
accgaaa

SEQ ID NO: 137717 - DNA, 7 bp, Unknown
  misc_feature (1)..( 7): Result.003 file - promoters60/4768346
accaaaa

SEQ ID NO: 137718 - DNA, 8 bp, Unknown
  misc_feature (1)..( 8): Result.003 file - promoters60/4768346
aaagaatc

SEQ ID NO: 137719 - DNA, 8 bp, Unknown
  misc_feature (1)..( 8): Result.003 file - promoters60/4768346
aaaaaatc

SEQ ID NO: 137720 - DNA, 9 bp, Unknown
  misc_feature (1)..( 9): Result.003 file - promoters60/4768346
aatcatatt

SEQ ID NO: 137721 - DNA, 9 bp, Unknown
  misc_feature (1)..( 9): Result.003 file - promoters60/4768346
aatcttatt

SEQ ID NO: 137722 - DNA, 7 bp, Unknown
  misc_feature (1)..( 7): Result.003 file - promoters60/4768346
tcaaaat

SEQ ID NO: 137723 - DNA, 7 bp, Unknown
  misc_feature (1)..( 7): Result.003 file - promoters60/4768346
tcaaaat

SEQ ID NO: 137724 - DNA, 7 bp, Unknown
  misc_feature (1)..( 7): Result.003 file - promoters60/4768346
aatacaa

SEQ ID NO: 137725 - DNA, 7 bp, Unknown
  misc_feature (1)..( 7): Result.003 file - promoters60/4768346
aatacaa

SEQ ID NO: 137726 - DNA, 7 bp, Unknown
  misc_feature (1)..( 7): Result.003 file - promoters60/4768346
accaaaa

SEQ ID NO: 137727 - DNA, 7 bp, Unknown
  misc_feature (1)..( 7): Result.003 file - promoters60/4768346
accaaaa

SEQ ID NO: 137728 - DNA, 9 bp, Unknown
  misc_feature (1)..( 9): Result.003 file - promoters60/4768346
actcgaaaa

SEQ ID NO: 137729 - DNA, 9 bp, Unknown
  misc_feature (1)..( 9): Result.003 file - promoters60/4768346
actggaaaa

SEQ ID NO: 137730 - DNA, 9 bp, Unknown
  misc_feature (1)..( 9): Result.003 file - promoters60/4768346
accaaaatc

SEQ ID NO: 137731 - DNA, 9 bp, Unknown
  misc_feature (1)..( 9): Result.003 file - promoters60/4768346
accaaaatc

SEQ ID NO: 137732 - DNA, 7 bp, Unknown
  misc_feature (1)..( 7): Result.003 file - promoters60/4768346
tcaaaac

SEQ ID NO: 137733 - DNA, 7 bp, Unknown
  misc_feature (1)..( 7): Result.003 file - promoters60/4768346
tcacaac

SEQ ID NO: 137734 - DNA, 7 bp, Unknown
  misc_feature (1)..( 7): Result.003 file - promoters60/4768346
aattgaa

SEQ ID NO: 137735 - DNA, 7 bp, Unknown
  misc_feature (1)..( 7): Result.003 file - promoters60/4768346
aattgaa

SEQ ID NO: 137736 - DNA, 8 bp, Unknown
  misc_feature (1)..( 8): Result.003 file - promoters60/4768346
catatatg

SEQ ID NO: 137737 - DNA, 8 bp, Unknown
  misc_feature (1)..( 8): Result.003 file - promoters60/4768346
catttatg

SEQ ID NO: 137738 - DNA, 6 bp, Unknown
  misc_feature (1)..( 6): Result.003 file - promoters60/4768346
tttacg

SEQ ID NO: 137739 - DNA, 6 bp, Unknown
  misc_feature (1)..( 6): Result.003 file - promoters60/4768346
tttacg

SEQ ID NO: 137740 - DNA, 7 bp, Unknown
  misc_feature (1)..( 7): Result.003 file - promoters60/4768346
aatcatt

SEQ ID NO: 137741 - DNA, 7 bp, Unknown
  misc_feature (1)..( 7): Result.003 file - promoters60/4768346
aatgatt

SEQ ID NO: 137742 - DNA, 7 bp, Unknown
  misc_feature (1)..( 7): Result.003 file - promoters60/4768346
ttacaat

SEQ ID NO: 137743 - DNA, 7 bp, Unknown
  misc_feature (1)..( 7): Result.003 file - promoters60/4768346
ttataat

SEQ ID NO: 137744 - DNA, 7 bp, Unknown
  misc_feature (1)..( 7): Result.003 file - promoters60/4768346
aatctgt

SEQ ID NO: 137745 - DNA, 7 bp, Unknown
  misc_feature (1)..( 7): Result.003 file - promoters60/4768346
aatctgt

SEQ ID NO: 137746 - DNA, 11 bp, Unknown
  misc_feature (1)..( 11): Result.003 file - promoters60/4768354
taacatttttt

SEQ ID NO: 137747 - DNA, 11 bp, Unknown
  misc_feature (1)..( 11): Result.003 file - promoters60/4768354
taagatttttg

SEQ ID NO: 137748 - DNA, 11 bp, Unknown
  misc_feature (1)..( 11): Result.003 file - promoters60/4768354
tagaatttttt

SEQ ID NO: 137749 - DNA, 9 bp, Unknown
  misc_feature (1)..( 9): Result.003 file - promoters60/4768354
tttaatcag

SEQ ID NO: 137750 - DNA, 9 bp, Unknown
  misc_feature (1)..( 9): Result.003 file - promoters60/4768354
tttattcag

SEQ ID NO: 137751 - DNA, 9 bp, Unknown
  misc_feature (1)..( 9): Result.003 file - promoters60/4768354
gttattcga

SEQ ID NO: 137752 - DNA, 6 bp, Unknown
  misc_feature (1)..( 6): Result.003 file - promoters60/4768354
tgcaat

SEQ ID NO: 137753 - DNA, 6 bp, Unknown
  misc_feature (1)..( 6): Result.003 file - promoters60/4768354
tgcaat

SEQ ID NO: 137754 - DNA, 8 bp, Unknown
  misc_feature (1)..( 8): Result.003 file - promoters60/4768354
ttcattta

SEQ ID NO: 137755 - DNA, 8 bp, Unknown
  misc_feature (1)..( 8): Result.003 file - promoters60/4768354
ttcattta

SEQ ID NO: 137756 - DNA, 6 bp, Unknown
  misc_feature (1)..( 6): Result.003 file - promoters60/4768354
tatttt

SEQ ID NO: 137757 - DNA, 6 bp, Unknown
  misc_feature (1)..( 6): Result.003 file - promoters60/4768354
tatttt

SEQ ID NO: 137758 - DNA, 6 bp, Unknown
  misc_feature (1)..( 6): Result.003 file - promoters60/4768354
taattt

SEQ ID NO: 137759 - DNA, 6 bp, Unknown
  misc_feature (1)..( 6): Result.003 file - promoters60/4768354
taattt

SEQ ID NO: 137760 - DNA, 6 bp, Unknown
  misc_feature (1)..( 6): Result.003 file - promoters60/4768354
tttcac

SEQ ID NO: 137761 - DNA, 6 bp, Unknown
  misc_feature (1)..( 6): Result.003 file - promoters60/4768354
tttcac

SEQ ID NO: 137762 - DNA, 7 bp, Unknown
  misc_feature (1)..( 7): Result.003 file - promoters60/4768354
attttca

SEQ ID NO: 137763 - DNA, 7 bp, Unknown
  misc_feature (1)..( 7): Result.003 file - promoters60/4768354
attctca

SEQ ID NO: 137764 - DNA, 7 bp, Unknown
  misc_feature (1)..( 7): Result.003 file - promoters60/4768354
atgttat

SEQ ID NO: 137765 - DNA, 7 bp, Unknown
  misc_feature (1)..( 7): Result.003 file - promoters60/4768354
atggtat

SEQ ID NO: 137766 - DNA, 6 bp, Unknown
  misc_feature (1)..( 6): Result.003 file - promoters60/4768354
aatatt

SEQ ID NO: 137767 - DNA, 6 bp, Unknown
  misc_feature (1)..( 6): Result.003 file - promoters60/4768354
aatatt

SEQ ID NO: 137768 - DNA, 6 bp, Unknown
  misc_feature (1)..( 6): Result.003 file - promoters60/4768354
gaaaat

SEQ ID NO: 137769 - DNA, 6 bp, Unknown
  misc_feature (1)..( 6): Result.003 file - promoters60/4768354
gaaaat

SEQ ID NO: 137770 - DNA, 7 bp, Unknown
  misc_feature (1)..( 7): Result.003 file - promoters60/4768354
taaatct

SEQ ID NO: 137771 - DNA, 7 bp, Unknown
  misc_feature (1)..( 7): Result.003 file - promoters60/4768354
taactct

SEQ ID NO: 137772 - DNA, 12 bp, Unknown
  misc_feature (1)..( 12): Result.003 file - promoters60/4768354
aaaaaatctctg

SEQ ID NO: 137773 - DNA, 12 bp, Unknown
  misc_feature (1)..( 12): Result.003 file - promoters60/4768354
aaataatctctg

SEQ ID NO: 137774 - DNA, 7 bp, Unknown
  misc_feature (1)..( 7): Result.003 file - promoters60/4768354
aattttt

SEQ ID NO: 137775 - DNA, 7 bp, Unknown
  misc_feature (1)..( 7): Result.003 file - promoters60/4768354
aattttt

SEQ ID NO: 137776 - DNA, 7 bp, Unknown
  misc_feature (1)..( 7): Result.003 file - promoters60/4768354
ttaatgt

SEQ ID NO: 137777 - DNA, 7 bp, Unknown
  misc_feature (1)..( 7): Result.003 file - promoters60/4768354
ttattgt

SEQ ID NO: 137778 - DNA, 6 bp, Unknown
  misc_feature (1)..( 6): Result.003 file - promoters60/4768354
aatttt

SEQ ID NO: 137779 - DNA, 6 bp, Unknown
  misc_feature (1)..( 6): Result.003 file - promoters60/4768354
aatttt

SEQ ID NO: 137780 - DNA, 6 bp, Unknown
  misc_feature (1)..( 6): Result.003 file - promoters60/4768354
tattcg

SEQ ID NO: 137781 - DNA, 6 bp, Unknown
  misc_feature (1)..( 6): Result.003 file - promoters60/4768354
tattcg

SEQ ID NO: 137782 - DNA, 6 bp, Unknown
  misc_feature (1)..( 6): Result.003 file - promoters60/4768354
acctat

SEQ ID NO: 137783 - DNA, 6 bp, Unknown
  misc_feature (1)..( 6): Result.003 file - promoters60/4768354
acctat

SEQ ID NO: 137784 - DNA, 8 bp, Unknown
  misc_feature (1)..( 8): Result.003 file - promoters60/4768354
caaaactt

SEQ ID NO: 137785 - DNA, 8 bp, Unknown
  misc_feature (1)..( 8): Result.003 file - promoters60/4768354
caaatctt

SEQ ID NO: 137786 - DNA, 7 bp, Unknown
  misc_feature (1)..( 7): Result.003 file - promoters60/4768354
gaataaa

SEQ ID NO: 137787 - DNA, 7 bp, Unknown
  misc_feature (1)..( 7): Result.003 file - promoters60/4768354
gaaaaaa

SEQ ID NO: 137788 - DNA, 6 bp, Unknown
  misc_feature (1)..( 6): Result.003 file - promoters60/4768354
atttaa

SEQ ID NO: 137789 - DNA, 6 bp, Unknown
  misc_feature (1)..( 6): Result.003 file - promoters60/4768354
atttaa

SEQ ID NO: 137790 - DNA, 6 bp, Unknown
  misc_feature (1)..( 6): Result.003 file - promoters60/4768354
taaaat

SEQ ID NO: 137791 - DNA, 6 bp, Unknown
  misc_feature (1)..( 6): Result.003 file - promoters60/4768354
taaaat

SEQ ID NO: 137792 - DNA, 7 bp, Unknown
  misc_feature (1)..( 7): Result.003 file - promoters60/4768354
aaagtca

SEQ ID NO: 137793 - DNA, 7 bp, Unknown
  misc_feature (1)..( 7): Result.003 file - promoters60/4768354
aaaatca

SEQ ID NO: 137794 - DNA, 6 bp, Unknown
  misc_feature (1)..( 6): Result.003 file - promoters60/4768354
tcacat

SEQ ID NO: 137795 - DNA, 6 bp, Unknown
  misc_feature (1)..( 6): Result.003 file - promoters60/4768354
tcacat

SEQ ID NO: 137796 - DNA, 6 bp, Unknown
  misc_feature (1)..( 6): Result.003 file - promoters60/4768354
aatcat

SEQ ID NO: 137797 - DNA, 6 bp, Unknown
  misc_feature (1)..( 6): Result.003 file - promoters60/4768354
aatcat

SEQ ID NO: 137798 - DNA, 6 bp, Unknown
  misc_feature (1)..( 6): Result.003 file - promoters60/4768354
tttgta

SEQ ID NO: 137799 - DNA, 6 bp, Unknown
  misc_feature (1)..( 6): Result.003 file - promoters60/4768354
tttgta

SEQ ID NO: 137800 - DNA, 6 bp, Unknown
  misc_feature (1)..( 6): Result.003 file - promoters60/4768358
gttttt

SEQ ID NO: 137801 - DNA, 6 bp, Unknown
  misc_feature (1)..( 6): Result.003 file - promoters60/4768358
gttttt

SEQ ID NO: 137802 - DNA, 7 bp, Unknown
  misc_feature (1)..( 7): Result.003 file - promoters60/4768358
aatttta

SEQ ID NO: 137803 - DNA, 7 bp, Unknown
  misc_feature (1)..( 7): Result.003 file - promoters60/4768358
aatttta

SEQ ID NO: 137804 - DNA, 7 bp, Unknown
  misc_feature (1)..( 7): Result.003 file - promoters60/4768358
ataacaa

SEQ ID NO: 137805 - DNA, 7 bp, Unknown
  misc_feature (1)..( 7): Result.003 file - promoters60/4768358
ataacaa

SEQ ID NO: 137806 - DNA, 8 bp, Unknown
  misc_feature (1)..( 8): Result.003 file - promoters60/4768358
atattttt

SEQ ID NO: 137807 - DNA, 8 bp, Unknown
  misc_feature (1)..( 8): Result.003 file - promoters60/4768358
atactttt

SEQ ID NO: 137808 - DNA, 6 bp, Unknown
  misc_feature (1)..( 6): Result.003 file - promoters60/4768358
ttttag

SEQ ID NO: 137809 - DNA, 6 bp, Unknown
  misc_feature (1)..( 6): Result.003 file - promoters60/4768358
ttttag

SEQ ID NO: 137810 - DNA, 6 bp, Unknown
  misc_feature (1)..( 6): Result.003 file - promoters60/4768358
aacgaa

SEQ ID NO: 137811 - DNA, 6 bp, Unknown
  misc_feature (1)..( 6): Result.003 file - promoters60/4768358
aacgaa

SEQ ID NO: 137812 - DNA, 6 bp, Unknown
  misc_feature (1)..( 6): Result.003 file - promoters60/4768358
aactaa

SEQ ID NO: 137813 - DNA, 6 bp, Unknown
  misc_feature (1)..( 6): Result.003 file - promoters60/4768358
aactaa

SEQ ID NO: 137814 - DNA, 9 bp, Unknown
  misc_feature (1)..( 9): Result.003 file - promoters60/4768358
caatttgtt

SEQ ID NO: 137815 - DNA, 9 bp, Unknown
  misc_feature (1)..( 9): Result.003 file - promoters60/4768358
caatatgtt

SEQ ID NO: 137816 - DNA, 8 bp, Unknown
  misc_feature (1)..( 8): Result.003 file - promoters60/4768358
atatgttt

SEQ ID NO: 137817 - DNA, 8 bp, Unknown
  misc_feature (1)..( 8): Result.003 file - promoters60/4768358
atatgttt

SEQ ID NO: 137818 - DNA, 7 bp, Unknown
  misc_feature (1)..( 7): Result.003 file - promoters60/4768358
tttgatt

SEQ ID NO: 137819 - DNA, 7 bp, Unknown
  misc_feature (1)..( 7): Result.003 file - promoters60/4768358
tttcatt

SEQ ID NO: 137820 - DNA, 8 bp, Unknown
  misc_feature (1)..( 8): Result.003 file - promoters60/4768358
tgtgttta

SEQ ID NO: 137821 - DNA, 8 bp, Unknown
  misc_feature (1)..( 8): Result.003 file - promoters60/4768358
tgttttta

SEQ ID NO: 137822 - DNA, 7 bp, Unknown
  misc_feature (1)..( 7): Result.003 file - promoters60/4768358
aaaaatc

SEQ ID NO: 137823 - DNA, 7 bp, Unknown
  misc_feature (1)..( 7): Result.003 file - promoters60/4768358
aaacatc

SEQ ID NO: 137824 - DNA, 6 bp, Unknown
  misc_feature (1)..( 6): Result.003 file - promoters60/4768358
gttata

SEQ ID NO: 137825 - DNA, 6 bp, Unknown
  misc_feature (1)..( 6): Result.003 file - promoters60/4768358
gttata

SEQ ID NO: 137826 - DNA, 6 bp, Unknown
  misc_feature (1)..( 6): Result.003 file - promoters60/4768358
ttttaa

SEQ ID NO: 137827 - DNA, 6 bp, Unknown
  misc_feature (1)..( 6): Result.003 file - promoters60/4768358
ttttaa

SEQ ID NO: 137828 - DNA, 7 bp, Unknown
  misc_feature (1)..( 7): Result.003 file - promoters60/4768358
ttaaatt

SEQ ID NO: 137829 - DNA, 7 bp, Unknown
  misc_feature (1)..( 7): Result.003 file - promoters60/4768358
ttaaatt

SEQ ID NO: 137830 - DNA, 6 bp, Unknown
  misc_feature (1)..( 6): Result.003 file - promoters60/4768358
acttaa

SEQ ID NO: 137831 - DNA, 6 bp, Unknown
  misc_feature (1)..( 6): Result.003 file - promoters60/4768358
acttaa

SEQ ID NO: 137832 - DNA, 6 bp, Unknown
  misc_feature (1)..( 6): Result.003 file - promoters60/4768358
tattta

SEQ ID NO: 137833 - DNA, 6 bp, Unknown
  misc_feature (1)..( 6): Result.003 file - promoters60/4768358
tattta

SEQ ID NO: 137834 - DNA, 6 bp, Unknown
  misc_feature (1)..( 6): Result.003 file - promoters60/4768358
aaataa

SEQ ID NO: 137835 - DNA, 6 bp, Unknown
  misc_feature (1)..( 6): Result.003 file - promoters60/4768358
aaataa

SEQ ID NO: 137836 - DNA, 6 bp, Unknown
  misc_feature (1)..( 6): Result.003 file - promoters60/4768444
ctattg

SEQ ID NO: 137837 - DNA, 6 bp, Unknown
  misc_feature (1)..( 6): Result.003 file - promoters60/4768444
ctattg

SEQ ID NO: 137838 - DNA, 6 bp, Unknown
  misc_feature (1)..( 6): Result.003 file - promoters60/4768444
cttcaa

SEQ ID NO: 137839 - DNA, 6 bp, Unknown
  misc_feature (1)..( 6): Result.003 file - promoters60/4768444
cttcaa

SEQ ID NO: 137840 - DNA, 7 bp, Unknown
  misc_feature (1)..( 7): Result.003 file - promoters60/4768444
gagagta

SEQ ID NO: 137841 - DNA, 7 bp, Unknown
  misc_feature (1)..( 7): Result.003 file - promoters60/4768444
gagtgta

SEQ ID NO: 137842 - DNA, 6 bp, Unknown
  misc_feature (1)..( 6): Result.003 file - promoters60/4768444
atttaa

SEQ ID NO: 137843 - DNA, 6 bp, Unknown
  misc_feature (1)..( 6): Result.003 file - promoters60/4768444
atttaa

SEQ ID NO: 137844 - DNA, 6 bp, Unknown
  misc_feature (1)..( 6): Result.003 file - promoters60/4768444
caaaaa

SEQ ID NO: 137845 - DNA, 6 bp, Unknown
  misc_feature (1)..( 6): Result.003 file - promoters60/4768444
caaaaa

SEQ ID NO: 137846 - DNA, 7 bp, Unknown
  misc_feature (1)..( 7): Result.003 file - promoters60/4768444
tatttta

SEQ ID NO: 137847 - DNA, 7 bp, Unknown
  misc_feature (1)..( 7): Result.003 file - promoters60/4768444
tatctta

SEQ ID NO: 137848 - DNA, 8 bp, Unknown
  misc_feature (1)..( 8): Result.003 file - promoters60/4768444
aagactct

SEQ ID NO: 137849 - DNA, 8 bp, Unknown
  misc_feature (1)..( 8): Result.003 file - promoters60/4768444
aagagtct

SEQ ID NO: 137850 - DNA, 7 bp, Unknown
  misc_feature (1)..( 7): Result.003 file - promoters60/4768444
caatagt

SEQ ID NO: 137851 - DNA, 7 bp, Unknown
  misc_feature (1)..( 7): Result.003 file - promoters60/4768444
caagagt

SEQ ID NO: 137852 - DNA, 9 bp, Unknown
  misc_feature (1)..( 9): Result.003 file - promoters60/4768528
aaactttaa

SEQ ID NO: 137853 - DNA, 9 bp, Unknown
  misc_feature (1)..( 9): Result.003 file - promoters60/4768528
aaaatttct

SEQ ID NO: 137854 - DNA, 9 bp, Unknown
  misc_feature (1)..( 9): Result.003 file - promoters60/4768528
aaaatctct

SEQ ID NO: 137855 - DNA, 8 bp, Unknown
  misc_feature (1)..( 8): Result.003 file - promoters60/4768528
tttgaaac

SEQ ID NO: 137856 - DNA, 8 bp, Unknown
  misc_feature (1)..( 8): Result.003 file - promoters60/4768528
tgtgaaac

SEQ ID NO: 137857 - DNA, 8 bp, Unknown
  misc_feature (1)..( 8): Result.003 file - promoters60/4768528
tgtgaaaa

SEQ ID NO: 137858 - DNA, 9 bp, Unknown
  misc_feature (1)..( 9): Result.003 file - promoters60/4768528
gatatttct

SEQ ID NO: 137859 - DNA, 9 bp, Unknown
  misc_feature (1)..( 9): Result.003 file - promoters60/4768528
aaaatttct

SEQ ID NO: 137860 - DNA, 9 bp, Unknown
  misc_feature (1)..( 9): Result.003 file - promoters60/4768528
aaaatctct

SEQ ID NO: 137861 - DNA, 9 bp, Unknown
  misc_feature (1)..( 9): Result.003 file - promoters60/4768528
tttcaaaat

SEQ ID NO: 137862 - DNA, 9 bp, Unknown
  misc_feature (1)..( 9): Result.003 file - promoters60/4768528
tatcaaaat

SEQ ID NO: 137863 - DNA, 9 bp, Unknown
  misc_feature (1)..( 9): Result.003 file - promoters60/4768528
ttttaaaat

SEQ ID NO: 137864 - DNA, 6 bp, Unknown
  misc_feature (1)..( 6): Result.003 file - promoters60/4768528
taacat

SEQ ID NO: 137865 - DNA, 6 bp, Unknown
  misc_feature (1)..( 6): Result.003 file - promoters60/4768528
taacat

SEQ ID NO: 137866 - DNA, 7 bp, Unknown
  misc_feature (1)..( 7): Result.003 file - promoters60/4768528
aaaatat

SEQ ID NO: 137867 - DNA, 7 bp, Unknown
  misc_feature (1)..( 7): Result.003 file - promoters60/4768528
aaattat

SEQ ID NO: 137868 - DNA, 8 bp, Unknown
  misc_feature (1)..( 8): Result.003 file - promoters60/4768528
taattaaa

SEQ ID NO: 137869 - DNA, 8 bp, Unknown
  misc_feature (1)..( 8): Result.003 file - promoters60/4768528
taactaaa

SEQ ID NO: 137870 - DNA, 6 bp, Unknown
  misc_feature (1)..( 6): Result.003 file - promoters60/4768528
aatcaa

SEQ ID NO: 137871 - DNA, 6 bp, Unknown
  misc_feature (1)..( 6): Result.003 file - promoters60/4768528
aatcaa

SEQ ID NO: 137872 - DNA, 14 bp, Unknown
  misc_feature (1)..( 14): Result.003 file - promoters60/4768528
tcaataaatacaca

SEQ ID NO: 137873 - DNA, 14 bp, Unknown
  misc_feature (1)..( 14): Result.003 file - promoters60/4768528
tcaataaatagaca

SEQ ID NO: 137874 - DNA, 7 bp, Unknown
  misc_feature (1)..( 7): Result.003 file - promoters60/4768528
aaataaa

SEQ ID NO: 137875 - DNA, 7 bp, Unknown
  misc_feature (1)..( 7): Result.003 file - promoters60/4768528
aaaaaaa

SEQ ID NO: 137876 - DNA, 9 bp, Unknown
  misc_feature (1)..( 9): Result.003 file - promoters60/4768528
ctgttttca

SEQ ID NO: 137877 - DNA, 9 bp, Unknown
  misc_feature (1)..( 9): Result.003 file - promoters60/4768528
ctgctttca

SEQ ID NO: 137878 - DNA, 7 bp, Unknown
  misc_feature (1)..( 7): Result.003 file - promoters60/4768528
attttgg

SEQ ID NO: 137879 - DNA, 7 bp, Unknown
  misc_feature (1)..( 7): Result.003 file - promoters60/4768528
attttgg

SEQ ID NO: 137880 - DNA, 8 bp, Unknown
  misc_feature (1)..( 8): Result.003 file - promoters60/4768528
tcaaattt

SEQ ID NO: 137881 - DNA, 8 bp, Unknown
  misc_feature (1)..( 8): Result.003 file - promoters60/4768528
tcaatttt

SEQ ID NO: 137882 - DNA, 7 bp, Unknown
  misc_feature (1)..( 7): Result.003 file - promoters60/4768528
gtaatgg

SEQ ID NO: 137883 - DNA, 7 bp, Unknown
  misc_feature (1)..( 7): Result.003 file - promoters60/4768528
gtattgg

SEQ ID NO: 137884 - DNA, 6 bp, Unknown
  misc_feature (1)..( 6): Result.003 file - promoters60/4768528
aaaatg

SEQ ID NO: 137885 - DNA, 6 bp, Unknown
  misc_feature (1)..( 6): Result.003 file - promoters60/4768528
aaaatg

SEQ ID NO: 137886 - DNA, 6 bp, Unknown
  misc_feature (1)..( 6): Result.003 file - promoters60/4768528
aagatt

SEQ ID NO: 137887 - DNA, 6 bp, Unknown
  misc_feature (1)..( 6): Result.003 file - promoters60/4768528
aagatt

SEQ ID NO: 137888 - DNA, 8 bp, Unknown
  misc_feature (1)..( 8): Result.003 file - promoters60/4768528
atgtaaac

SEQ ID NO: 137889 - DNA, 8 bp, Unknown
  misc_feature (1)..( 8): Result.003 file - promoters60/4768528
atgtcaac

SEQ ID NO: 137890 - DNA, 7 bp, Unknown
  misc_feature (1)..( 7): Result.003 file - promoters60/4768528
gaaaaat

SEQ ID NO: 137891 - DNA, 7 bp, Unknown
  misc_feature (1)..( 7): Result.003 file - promoters60/4768528
gaagaat

SEQ ID NO: 137892 - DNA, 7 bp, Unknown
  misc_feature (1)..( 7): Result.003 file - promoters60/4768528
caaaatt

SEQ ID NO: 137893 - DNA, 7 bp, Unknown
  misc_feature (1)..( 7): Result.003 file - promoters60/4768528
caatatt

SEQ ID NO: 137894 - DNA, 7 bp, Unknown
  misc_feature (1)..( 7): Result.003 file - promoters60/4768528
acaactt

SEQ ID NO: 137895 - DNA, 7 bp, Unknown
  misc_feature (1)..( 7): Result.003 file - promoters60/4768528
acatctt

SEQ ID NO: 137896 - DNA, 7 bp, Unknown
  misc_feature (1)..( 7): Result.003 file - promoters60/4768528
tttattt

SEQ ID NO: 137897 - DNA, 7 bp, Unknown
  misc_feature (1)..( 7): Result.003 file - promoters60/4768528
ttttttt

SEQ ID NO: 137898 - DNA, 6 bp, Unknown
  misc_feature (1)..( 6): Result.003 file - promoters60/4768528
ttggtt

SEQ ID NO: 137899 - DNA, 6 bp, Unknown
  misc_feature (1)..( 6): Result.003 file - promoters60/4768528
ttggtt

SEQ ID NO: 137900 - DNA, 6 bp, Unknown
  misc_feature (1)..( 6): Result.003 file - promoters60/4768528
aaaagt

SEQ ID NO: 137901 - DNA, 6 bp, Unknown
  misc_feature (1)..( 6): Result.003 file - promoters60/4768528
aaaagt

SEQ ID NO: 137902 - DNA, 8 bp, Unknown
  misc_feature (1)..( 8): Result.003 file - promoters60/4768547
tcaaaata

SEQ ID NO: 137903 - DNA, 8 bp, Unknown
  misc_feature (1)..( 8): Result.003 file - promoters60/4768547
ccaaaatg

SEQ ID NO: 137904 - DNA, 8 bp, Unknown
  misc_feature (1)..( 8): Result.003 file - promoters60/4768547
tcataatt

SEQ ID NO: 137905 - DNA, 8 bp, Unknown
  misc_feature (1)..( 8): Result.003 file - promoters60/4768547
acattatt

SEQ ID NO: 137906 - DNA, 14 bp, Unknown
  misc_feature (1)..( 14): Result.003 file - promoters60/4768547
ccaaacttaaacca

SEQ ID NO: 137907 - DNA, 14 bp, Unknown
  misc_feature (1)..( 14): Result.003 file - promoters60/4768547
ccaaatttaagata

SEQ ID NO: 137908 - DNA, 14 bp, Unknown
  misc_feature (1)..( 14): Result.003 file - promoters60/4768547
tttgacttaaatat

SEQ ID NO: 137909 - DNA, 14 bp, Unknown
  misc_feature (1)..( 14): Result.003 file - promoters60/4768547
cttactttatatat

SEQ ID NO: 137910 - DNA, 9 bp, Unknown
  misc_feature (1)..( 9): Result.003 file - promoters60/4768547
tgatcttgg

SEQ ID NO: 137911 - DNA, 7 bp, Unknown
  misc_feature (1)..( 7): Result.003 file - promoters60/4768547
atcttga

SEQ ID NO: 137912 - DNA, 9 bp, Unknown
  misc_feature (1)..( 9): Result.003 file - promoters60/4768547
tgaacttat

SEQ ID NO: 137913 - DNA, 8 bp, Unknown
  misc_feature (1)..( 8): Result.003 file - promoters60/4768547
aatcatga

SEQ ID NO: 137914 - DNA, 9 bp, Unknown
  misc_feature (1)..( 9): Result.003 file - promoters60/4768547
ttacacgat

SEQ ID NO: 137915 - DNA, 9 bp, Unknown
  misc_feature (1)..( 9): Result.003 file - promoters60/4768547
caacaggat

SEQ ID NO: 137916 - DNA, 9 bp, Unknown
  misc_feature (1)..( 9): Result.003 file - promoters60/4768547
ttagacgga

SEQ ID NO: 137917 - DNA, 10 bp, Unknown
  misc_feature (1)..( 10): Result.003 file - promoters60/4768547
aaagatggaa

SEQ ID NO: 137918 - DNA, 13 bp, Unknown
  misc_feature (1)..( 13): Result.003 file - promoters60/4768568
tgattgaatattc

SEQ ID NO: 137919 - DNA, 13 bp, Unknown
  misc_feature (1)..( 13): Result.003 file - promoters60/4768568
attttgcatagat

SEQ ID NO: 137920 - DNA, 13 bp, Unknown
  misc_feature (1)..( 13): Result.003 file - promoters60/4768568
cttttacataatt

SEQ ID NO: 137921 - DNA, 13 bp, Unknown
  misc_feature (1)..( 13): Result.003 file - promoters60/4768568
tggacacataatt

SEQ ID NO: 137922 - DNA, 13 bp, Unknown
  misc_feature (1)..( 13): Result.003 file - promoters60/4768568
tttttacaaaaat

SEQ ID NO: 137923 - DNA, 13 bp, Unknown
  misc_feature (1)..( 13): Result.003 file - promoters60/4768568
taggcacatagtc

SEQ ID NO: 137924 - DNA, 13 bp, Unknown
  misc_feature (1)..( 13): Result.003 file - promoters60/4768568
tttttattctatt

SEQ ID NO: 137925 - DNA, 13 bp, Unknown
  misc_feature (1)..( 13): Result.003 file - promoters60/4768568
aattttggcaaat

SEQ ID NO: 137926 - DNA, 13 bp, Unknown
  misc_feature (1)..( 13): Result.003 file - promoters60/4768568
aattttgtaaatt

SEQ ID NO: 137927 - DNA, 13 bp, Unknown
  misc_feature (1)..( 13): Result.003 file - promoters60/4768568
aattttaagtcga

SEQ ID NO: 137928 - DNA, 13 bp, Unknown
  misc_feature (1)..( 13): Result.003 file - promoters60/4768568
ctttttataatca

SEQ ID NO: 137929 - DNA, 13 bp, Unknown
  misc_feature (1)..( 13): Result.003 file - promoters60/4768568
tattttttaaatt

SEQ ID NO: 137930 - DNA, 13 bp, Unknown
  misc_feature (1)..( 13): Result.003 file - promoters60/4768568
aatttttttatac

SEQ ID NO: 137931 - DNA, 16 bp, Unknown
  misc_feature (1)..( 16): Result.003 file - promoters60/4768568
ggcataactactacaa

SEQ ID NO: 137932 - DNA, 16 bp, Unknown
  misc_feature (1)..( 16): Result.003 file - promoters60/4768568
aatacaactaatacat

SEQ ID NO: 137933 - DNA, 16 bp, Unknown
  misc_feature (1)..( 16): Result.003 file - promoters60/4768568
aatataactaaacttt

SEQ ID NO: 137934 - DNA, 16 bp, Unknown
  misc_feature (1)..( 16): Result.003 file - promoters60/4768568
ataagaaaatatacat

SEQ ID NO: 137935 - DNA, 16 bp, Unknown
  misc_feature (1)..( 16): Result.003 file - promoters60/4768568
aaattaattaaattca

SEQ ID NO: 137936 - DNA, 16 bp, Unknown
  misc_feature (1)..( 16): Result.003 file - promoters60/4768568
ccagaaatgaatttag

SEQ ID NO: 137937 - DNA, 14 bp, Unknown
  misc_feature (1)..( 14): Result.003 file - promoters60/4768568
ctactacaacaaag

SEQ ID NO: 137938 - DNA, 14 bp, Unknown
  misc_feature (1)..( 14): Result.003 file - promoters60/4768568
ttaatacaactaat

SEQ ID NO: 137939 - DNA, 14 bp, Unknown
  misc_feature (1)..( 14): Result.003 file - promoters60/4768568
aaaatataactaaa

SEQ ID NO: 137940 - DNA, 15 bp, Unknown
  misc_feature (1)..( 15): Result.003 file - promoters60/4768568
tttaaattaattaaa

SEQ ID NO: 137941 - DNA, 14 bp, Unknown
  misc_feature (1)..( 14): Result.003 file - promoters60/4768568
aaaatatacattcg

SEQ ID NO: 137942 - DNA, 15 bp, Unknown
  misc_feature (1)..( 15): Result.003 file - promoters60/4768568
cagaaatgaatttag

SEQ ID NO: 137943 - DNA, 19 bp, Unknown
  misc_feature (1)..( 19): Result.003 file - promoters60/4768568
ttaaatgatagatgtccac

SEQ ID NO: 137944 - DNA, 19 bp, Unknown
  misc_feature (1)..( 19): Result.003 file - promoters60/4768568
ttacatgaaagacacagtg

SEQ ID NO: 137945 - DNA, 19 bp, Unknown
  misc_feature (1)..( 19): Result.003 file - promoters60/4768568
gcaagaaaaagacatagcc

SEQ ID NO: 137946 - DNA, 19 bp, Unknown
  misc_feature (1)..( 19): Result.003 file - promoters60/4768568
tactaaaatagaaaaaacg

SEQ ID NO: 137947 - DNA, 19 bp, Unknown
  misc_feature (1)..( 19): Result.003 file - promoters60/4768568
tttattaatagagaaaacg

SEQ ID NO: 137948 - DNA, 19 bp, Unknown
  misc_feature (1)..( 19): Result.003 file - promoters60/4768568
tcaataaatataaatatgg

SEQ ID NO: 137949 - DNA, 10 bp, Unknown
  misc_feature (1)..( 10): Result.003 file - promoters60/4768568
actatataag

SEQ ID NO: 137950 - DNA, 10 bp, Unknown
  misc_feature (1)..( 10): Result.003 file - promoters60/4768568
tttatatata

SEQ ID NO: 137951 - DNA, 10 bp, Unknown
  misc_feature (1)..( 10): Result.003 file - promoters60/4768568
gagatataat

SEQ ID NO: 137952 - DNA, 10 bp, Unknown
  misc_feature (1)..( 10): Result.003 file - promoters60/4768568
catatatata

SEQ ID NO: 137953 - DNA, 10 bp, Unknown
  misc_feature (1)..( 10): Result.003 file - promoters60/4768568
cgtataaata

SEQ ID NO: 137954 - DNA, 10 bp, Unknown
  misc_feature (1)..( 10): Result.003 file - promoters60/4768568
tttatattct

SEQ ID NO: 137955 - DNA, 9 bp, Unknown
  misc_feature (1)..( 9): Result.003 file - promoters60/4768568
tgtttgatt

SEQ ID NO: 137956 - DNA, 9 bp, Unknown
  misc_feature (1)..( 9): Result.003 file - promoters60/4768568
atttttatt

SEQ ID NO: 137957 - DNA, 9 bp, Unknown
  misc_feature (1)..( 9): Result.003 file - promoters60/4768568
agatttatt

SEQ ID NO: 137958 - DNA, 9 bp, Unknown
  misc_feature (1)..( 9): Result.003 file - promoters60/4768568
tattttttt

SEQ ID NO: 137959 - DNA, 9 bp, Unknown
  misc_feature (1)..( 9): Result.003 file - promoters60/4768568
aatttttac

SEQ ID NO: 137960 - DNA, 9 bp, Unknown
  misc_feature (1)..( 9): Result.003 file - promoters60/4768568
tattttcga

SEQ ID NO: 137961 - DNA, 13 bp, Unknown
  misc_feature (1)..( 13): Result.003 file - promoters60/4768568
aagctaattttgc

SEQ ID NO: 137962 - DNA, 13 bp, Unknown
  misc_feature (1)..( 13): Result.003 file - promoters60/4768568
tacataattttta

SEQ ID NO: 137963 - DNA, 13 bp, Unknown
  misc_feature (1)..( 13): Result.003 file - promoters60/4768568
cacataattatga

SEQ ID NO: 137964 - DNA, 13 bp, Unknown
  misc_feature (1)..( 13): Result.003 file - promoters60/4768568
tccttcattttta

SEQ ID NO: 137965 - DNA, 13 bp, Unknown
  misc_feature (1)..( 13): Result.003 file - promoters60/4768568
cacatagtcaagt

SEQ ID NO: 137966 - DNA, 13 bp, Unknown
  misc_feature (1)..( 13): Result.003 file - promoters60/4768568
aatgttatttttt

SEQ ID NO: 137967 - DNA, 13 bp, Unknown
  misc_feature (1)..( 13): Result.003 file - promoters60/4768568
aaacatattttcg

SEQ ID NO: 137968 - DNA, 15 bp, Unknown
  misc_feature (1)..( 15): Result.003 file - promoters60/4768568
ttcgtagattgcgtg

SEQ ID NO: 137969 - DNA, 15 bp, Unknown
  misc_feature (1)..( 15): Result.003 file - promoters60/4768568
tttttagtttgtgtg

SEQ ID NO: 137970 - DNA, 15 bp, Unknown
  misc_feature (1)..( 15): Result.003 file - promoters60/4768568
tttttaatttgtgtc

SEQ ID NO: 137971 - DNA, 15 bp, Unknown
  misc_feature (1)..( 15): Result.003 file - promoters60/4768568
atttgaattttccta

SEQ ID NO: 137972 - DNA, 15 bp, Unknown
  misc_feature (1)..( 15): Result.003 file - promoters60/4768568
tttttattttttatt

SEQ ID NO: 137973 - DNA, 15 bp, Unknown
  misc_feature (1)..( 15): Result.003 file - promoters60/4768568
ccattactttactct

SEQ ID NO: 137974 - DNA, 14 bp, Unknown
  misc_feature (1)..( 14): Result.003 file - promoters60/4768568
catttagtcattta

SEQ ID NO: 137975 - DNA, 14 bp, Unknown
  misc_feature (1)..( 14): Result.003 file - promoters60/4768568
tttttagtttgtgt

SEQ ID NO: 137976 - DNA, 14 bp, Unknown
  misc_feature (1)..( 14): Result.003 file - promoters60/4768568
tttttaatttgtgt

SEQ ID NO: 137977 - DNA, 14 bp, Unknown
  misc_feature (1)..( 14): Result.003 file - promoters60/4768568
atttgaattttcct

SEQ ID NO: 137978 - DNA, 14 bp, Unknown
  misc_feature (1)..( 14): Result.003 file - promoters60/4768568
tttttattttttat

SEQ ID NO: 137979 - DNA, 14 bp, Unknown
  misc_feature (1)..( 14): Result.003 file - promoters60/4768568
ccattactttactc

SEQ ID NO: 137980 - DNA, 12 bp, Unknown
  misc_feature (1)..( 12): Result.003 file - promoters60/4768599
gttttatatatt

SEQ ID NO: 137981 - DNA, 12 bp, Unknown
  misc_feature (1)..( 12): Result.003 file - promoters60/4768599
gttatatgtatt

SEQ ID NO: 137982 - DNA, 6 bp, Unknown
  misc_feature (1)..( 6): Result.003 file - promoters60/4768599
ttaata

SEQ ID NO: 137983 - DNA, 6 bp, Unknown
  misc_feature (1)..( 6): Result.003 file - promoters60/4768599
ttaata

SEQ ID NO: 137984 - DNA, 10 bp, Unknown
  misc_feature (1)..( 10): Result.003 file - promoters60/4768599
atttggtttt

SEQ ID NO: 137985 - DNA, 10 bp, Unknown
  misc_feature (1)..( 10): Result.003 file - promoters60/4768599
ttttagttat

SEQ ID NO: 137986 - DNA, 10 bp, Unknown
  misc_feature (1)..( 10): Result.003 file - promoters60/4768599
atttgatttt

SEQ ID NO: 137987 - DNA, 8 bp, Unknown
  misc_feature (1)..( 8): Result.003 file - promoters60/4768599
tttgccgt

SEQ ID NO: 137988 - DNA, 8 bp, Unknown
  misc_feature (1)..( 8): Result.003 file - promoters60/4768599
tttgtcgt

SEQ ID NO: 137989 - DNA, 9 bp, Unknown
  misc_feature (1)..( 9): Result.003 file - promoters60/4768599
tatttagga

SEQ ID NO: 137990 - DNA, 9 bp, Unknown
  misc_feature (1)..( 9): Result.003 file - promoters60/4768599
tatttggga

SEQ ID NO: 137991 - DNA, 9 bp, Unknown
  misc_feature (1)..( 9): Result.003 file - promoters60/4768599
tgattttct

SEQ ID NO: 137992 - DNA, 9 bp, Unknown
  misc_feature (1)..( 9): Result.003 file - promoters60/4768599
tgagtttct

SEQ ID NO: 137993 - DNA, 6 bp, Unknown
  misc_feature (1)..( 6): Result.003 file - promoters60/4768599
tttttc

SEQ ID NO: 137994 - DNA, 6 bp, Unknown
  misc_feature (1)..( 6): Result.003 file - promoters60/4768599
tttttc

SEQ ID NO: 137995 - DNA, 6 bp, Unknown
  misc_feature (1)..( 6): Result.003 file - promoters60/4768599
gggaaa

SEQ ID NO: 137996 - DNA, 6 bp, Unknown
  misc_feature (1)..( 6): Result.003 file - promoters60/4768599
gggaaa

SEQ ID NO: 137997 - DNA, 6 bp, Unknown
  misc_feature (1)..( 6): Result.003 file - promoters60/4768599
tccatg

SEQ ID NO: 137998 - DNA, 6 bp, Unknown
  misc_feature (1)..( 6): Result.003 file - promoters60/4768599
tccatg

SEQ ID NO: 137999 - DNA, 8 bp, Unknown
  misc_feature (1)..( 8): Result.003 file - promoters60/4768599
ttttttct

SEQ ID NO: 138000 - DNA, 8 bp, Unknown
  misc_feature (1)..( 8): Result.003 file - promoters60/4768599
tttcttct

SEQ ID NO: 138001 - DNA, 12 bp, Unknown
  misc_feature (1)..( 12): Result.003 file - promoters60/4768599
atgctattaaat

SEQ ID NO: 138002 - DNA, 12 bp, Unknown
  misc_feature (1)..( 12): Result.003 file - promoters60/4768599
atgctcttaaat

SEQ ID NO: 138003 - DNA, 6 bp, Unknown
  misc_feature (1)..( 6): Result.003 file - promoters60/4768599
aatatt

SEQ ID NO: 138004 - DNA, 6 bp, Unknown
  misc_feature (1)..( 6): Result.003 file - promoters60/4768599
aatatt

SEQ ID NO: 138005 - DNA, 6 bp, Unknown
  misc_feature (1)..( 6): Result.003 file - promoters60/4768599
atagta

SEQ ID NO: 138006 - DNA, 6 bp, Unknown
  misc_feature (1)..( 6): Result.003 file - promoters60/4768599
atagta

SEQ ID NO: 138007 - DNA, 6 bp, Unknown
  misc_feature (1)..( 6): Result.003 file - promoters60/4768599
atacca

SEQ ID NO: 138008 - DNA, 6 bp, Unknown
  misc_feature (1)..( 6): Result.003 file - promoters60/4768599
atacca

SEQ ID NO: 138009 - DNA, 7 bp, Unknown
  misc_feature (1)..( 7): Result.003 file - promoters60/4768599
tcttata

SEQ ID NO: 138010 - DNA, 7 bp, Unknown
  misc_feature (1)..( 7): Result.003 file - promoters60/4768599
tcttata

SEQ ID NO: 138011 - DNA, 6 bp, Unknown
  misc_feature (1)..( 6): Result.003 file - promoters60/4768599
tgttca

SEQ ID NO: 138012 - DNA, 6 bp, Unknown
  misc_feature (1)..( 6): Result.003 file - promoters60/4768599
tgttca

SEQ ID NO: 138013 - DNA, 7 bp, Unknown
  misc_feature (1)..( 7): Result.003 file - promoters60/4768599
attaaat

SEQ ID NO: 138014 - DNA, 7 bp, Unknown
  misc_feature (1)..( 7): Result.003 file - promoters60/4768599
atttaat

SEQ ID NO: 138015 - DNA, 6 bp, Unknown
  misc_feature (1)..( 6): Result.003 file - promoters60/4768599
aaattt

SEQ ID NO: 138016 - DNA, 6 bp, Unknown
  misc_feature (1)..( 6): Result.003 file - promoters60/4768599
aaattt

SEQ ID NO: 138017 - DNA, 7 bp, Unknown
  misc_feature (1)..( 7): Result.003 file - promoters60/4768599
aacatga

SEQ ID NO: 138018 - DNA, 7 bp, Unknown
  misc_feature (1)..( 7): Result.003 file - promoters60/4768599
aacatga

SEQ ID NO: 138019 - DNA, 7 bp, Unknown
  misc_feature (1)..( 7): Result.003 file - promoters60/4768599
tatcttt

SEQ ID NO: 138020 - DNA, 7 bp, Unknown
  misc_feature (1)..( 7): Result.003 file - promoters60/4768599
tatgttt

SEQ ID NO: 138021 - DNA, 7 bp, Unknown
  misc_feature (1)..( 7): Result.003 file - promoters60/4768599
gagagtt

SEQ ID NO: 138022 - DNA, 7 bp, Unknown
  misc_feature (1)..( 7): Result.003 file - promoters60/4768599
gagagtt

SEQ ID NO: 138023 - DNA, 7 bp, Unknown
  misc_feature (1)..( 7): Result.003 file - promoters60/4768599
tgttttc

SEQ ID NO: 138024 - DNA, 7 bp, Unknown
  misc_feature (1)..( 7): Result.003 file - promoters60/4768599
tgtcttc

SEQ ID NO: 138025 - DNA, 9 bp, Unknown
  misc_feature (1)..( 9): Result.003 file - promoters60/4768615
gaaaatatt

SEQ ID NO: 138026 - DNA, 9 bp, Unknown
  misc_feature (1)..( 9): Result.003 file - promoters60/4768615
aaaaataag

SEQ ID NO: 138027 - DNA, 9 bp, Unknown
  misc_feature (1)..( 9): Result.003 file - promoters60/4768615
aaaaattaa

SEQ ID NO: 138028 - DNA, 9 bp, Unknown
  misc_feature (1)..( 9): Result.003 file - promoters60/4768615
taaagtata

SEQ ID NO: 138029 - DNA, 9 bp, Unknown
  misc_feature (1)..( 9): Result.003 file - promoters60/4768615
aaacatatt

SEQ ID NO: 138030 - DNA, 9 bp, Unknown
  misc_feature (1)..( 9): Result.003 file - promoters60/4768615
taaaatttc

SEQ ID NO: 138031 - DNA, 9 bp, Unknown
  misc_feature (1)..( 9): Result.003 file - promoters60/4768615
ctaaattag

SEQ ID NO: 138032 - DNA, 9 bp, Unknown
  misc_feature (1)..( 9): Result.003 file - promoters60/4768615
aaaataaat

SEQ ID NO: 138033 - DNA, 9 bp, Unknown
  misc_feature (1)..( 9): Result.003 file - promoters60/4768615
ttaataaag

SEQ ID NO: 138034 - DNA, 9 bp, Unknown
  misc_feature (1)..( 9): Result.003 file - promoters60/4768615
aaaattaat

SEQ ID NO: 138035 - DNA, 10 bp, Unknown
  misc_feature (1)..( 10): Result.003 file - promoters60/4768615
gaaatataag

SEQ ID NO: 138036 - DNA, 10 bp, Unknown
  misc_feature (1)..( 10): Result.003 file - promoters60/4768615
ttaattaaac

SEQ ID NO: 138037 - DNA, 10 bp, Unknown
  misc_feature (1)..( 10): Result.003 file - promoters60/4768615
ataatatttc

SEQ ID NO: 138038 - DNA, 10 bp, Unknown
  misc_feature (1)..( 10): Result.003 file - promoters60/4768615
attataaaat

SEQ ID NO: 138039 - DNA, 10 bp, Unknown
  misc_feature (1)..( 10): Result.003 file - promoters60/4768615
aaaacaaacg

SEQ ID NO: 138040 - DNA, 10 bp, Unknown
  misc_feature (1)..( 10): Result.003 file - promoters60/4768615
aaaaaaaaga

SEQ ID NO: 138041 - DNA, 10 bp, Unknown
  misc_feature (1)..( 10): Result.003 file - promoters60/4768615
taaataaatt

SEQ ID NO: 138042 - DNA, 10 bp, Unknown
  misc_feature (1)..( 10): Result.003 file - promoters60/4768615
caaacaaatg

SEQ ID NO: 138043 - DNA, 10 bp, Unknown
  misc_feature (1)..( 10): Result.003 file - promoters60/4768615
taaaaaaaga

SEQ ID NO: 138044 - DNA, 10 bp, Unknown
  misc_feature (1)..( 10): Result.003 file - promoters60/4768615
tatatattaa

SEQ ID NO: 138045 - DNA, 10 bp, Unknown
  misc_feature (1)..( 10): Result.003 file - promoters60/4768615
ataatgaatt

SEQ ID NO: 138046 - DNA, 11 bp, Unknown
  misc_feature (1)..( 11): Result.003 file - promoters60/4768615
ttgagtttagg

SEQ ID NO: 138047 - DNA, 11 bp, Unknown
  misc_feature (1)..( 11): Result.003 file - promoters60/4768615
ttaagtctagt

SEQ ID NO: 138048 - DNA, 11 bp, Unknown
  misc_feature (1)..( 11): Result.003 file - promoters60/4768615
gatagtttaaa

SEQ ID NO: 138049 - DNA, 11 bp, Unknown
  misc_feature (1)..( 11): Result.003 file - promoters60/4768615
ataagtttaac

SEQ ID NO: 138050 - DNA, 11 bp, Unknown
  misc_feature (1)..( 11): Result.003 file - promoters60/4768615
ataagattagt

SEQ ID NO: 138051 - DNA, 11 bp, Unknown
  misc_feature (1)..( 11): Result.003 file - promoters60/4768615
attactctagt

SEQ ID NO: 138052 - DNA, 11 bp, Unknown
  misc_feature (1)..( 11): Result.003 file - promoters60/4768615
ctaattttcta

SEQ ID NO: 138053 - DNA, 10 bp, Unknown
  misc_feature (1)..( 10): Result.003 file - promoters60/4768615
gaaaaataaa

SEQ ID NO: 138054 - DNA, 10 bp, Unknown
  misc_feature (1)..( 10): Result.003 file - promoters60/4768615
taaacatata

SEQ ID NO: 138055 - DNA, 10 bp, Unknown
  misc_feature (1)..( 10): Result.003 file - promoters60/4768615
taaaattaat

SEQ ID NO: 138056 - DNA, 10 bp, Unknown
  misc_feature (1)..( 10): Result.003 file - promoters60/4768615
gaaatataag

SEQ ID NO: 138057 - DNA, 10 bp, Unknown
  misc_feature (1)..( 10): Result.003 file - promoters60/4768615
ataaaataca

SEQ ID NO: 138058 - DNA, 10 bp, Unknown
  misc_feature (1)..( 10): Result.003 file - promoters60/4768615
tattaataaa

SEQ ID NO: 138059 - DNA, 10 bp, Unknown
  misc_feature (1)..( 10): Result.003 file - promoters60/4768615
agataatatt

SEQ ID NO: 138060 - DNA, 12 bp, Unknown
  misc_feature (1)..( 12): Result.003 file - promoters60/4768615
aataaataaaag

SEQ ID NO: 138061 - DNA, 12 bp, Unknown
  misc_feature (1)..( 12): Result.003 file - promoters60/4768615
tttaattaaaca

SEQ ID NO: 138062 - DNA, 12 bp, Unknown
  misc_feature (1)..( 12): Result.003 file - promoters60/4768615
aaacaataaaat

SEQ ID NO: 138063 - DNA, 12 bp, Unknown
  misc_feature (1)..( 12): Result.003 file - promoters60/4768615
atgaaatataag

SEQ ID NO: 138064 - DNA, 12 bp, Unknown
  misc_feature (1)..( 12): Result.003 file - promoters60/4768615
acattataaaat

SEQ ID NO: 138065 - DNA, 12 bp, Unknown
  misc_feature (1)..( 12): Result.003 file - promoters60/4768615
aaacagtaaaac

SEQ ID NO: 138066 - DNA, 12 bp, Unknown
  misc_feature (1)..( 12): Result.003 file - promoters60/4768615
tttcatttccaa

SEQ ID NO: 138067 - DNA, 10 bp, Unknown
  misc_feature (1)..( 10): Result.003 file - promoters60/4768615
atattattag

SEQ ID NO: 138068 - DNA, 10 bp, Unknown
  misc_feature (1)..( 10): Result.003 file - promoters60/4768615
atattaataa

SEQ ID NO: 138069 - DNA, 10 bp, Unknown
  misc_feature (1)..( 10): Result.003 file - promoters60/4768615
atattattag

SEQ ID NO: 138070 - DNA, 10 bp, Unknown
  misc_feature (1)..( 10): Result.003 file - promoters60/4768615
ttattatatt

SEQ ID NO: 138071 - DNA, 10 bp, Unknown
  misc_feature (1)..( 10): Result.003 file - promoters60/4768615
atataattat

SEQ ID NO: 138072 - DNA, 10 bp, Unknown
  misc_feature (1)..( 10): Result.003 file - promoters60/4768615
aactaattaa

SEQ ID NO: 138073 - DNA, 14 bp, Unknown
  misc_feature (1)..( 14): Result.003 file - promoters60/4768615
aattacaaaactac

SEQ ID NO: 138074 - DNA, 14 bp, Unknown
  misc_feature (1)..( 14): Result.003 file - promoters60/4768615
gtatacaaaaaaag

SEQ ID NO: 138075 - DNA, 14 bp, Unknown
  misc_feature (1)..( 14): Result.003 file - promoters60/4768615
caatactatctaat

SEQ ID NO: 138076 - DNA, 14 bp, Unknown
  misc_feature (1)..( 14): Result.003 file - promoters60/4768615
actcccaaaaataa

SEQ ID NO: 138077 - DNA, 14 bp, Unknown
  misc_feature (1)..( 14): Result.003 file - promoters60/4768615
aattcctaaaatca

SEQ ID NO: 138078 - DNA, 14 bp, Unknown
  misc_feature (1)..( 14): Result.003 file - promoters60/4768615
gacaaataaacata

SEQ ID NO: 138079 - DNA, 14 bp, Unknown
  misc_feature (1)..( 14): Result.003 file - promoters60/4768615
ggaaccaatatcta

SEQ ID NO: 138080 - DNA, 9 bp, Unknown
  misc_feature (1)..( 9): Result.003 file - promoters60/4768615
aatgaaaaa

SEQ ID NO: 138081 - DNA, 9 bp, Unknown
  misc_feature (1)..( 9): Result.003 file - promoters60/4768615
aatgaatta

SEQ ID NO: 138082 - DNA, 9 bp, Unknown
  misc_feature (1)..( 9): Result.003 file - promoters60/4768615
aatgaaatt

SEQ ID NO: 138083 - DNA, 9 bp, Unknown
  misc_feature (1)..( 9): Result.003 file - promoters60/4768615
aataaattt

SEQ ID NO: 138084 - DNA, 9 bp, Unknown
  misc_feature (1)..( 9): Result.003 file - promoters60/4768615
agtaaatta

SEQ ID NO: 138085 - DNA, 10 bp, Unknown
  misc_feature (1)..( 10): Result.003 file - promoters60/4768615
aatgatattc

SEQ ID NO: 138086 - DNA, 8 bp, Unknown
  misc_feature (1)..( 8): Result.003 file - promoters60/4768615
tatatata

SEQ ID NO: 138087 - DNA, 8 bp, Unknown
  misc_feature (1)..( 8): Result.003 file - promoters60/4768615
tatataaa

SEQ ID NO: 138088 - DNA, 8 bp, Unknown
  misc_feature (1)..( 8): Result.003 file - promoters60/4768615
tatatata

SEQ ID NO: 138089 - DNA, 8 bp, Unknown
  misc_feature (1)..( 8): Result.003 file - promoters60/4768615
tataaata

SEQ ID NO: 138090 - DNA, 8 bp, Unknown
  misc_feature (1)..( 8): Result.003 file - promoters60/4768615
tataaatt

SEQ ID NO: 138091 - DNA, 8 bp, Unknown
  misc_feature (1)..( 8): Result.003 file - promoters60/4768615
tatacaaa

SEQ ID NO: 138092 - DNA, 11 bp, Unknown
  misc_feature (1)..( 11): Result.003 file - promoters60/4768615
ataagattagt

SEQ ID NO: 138093 - DNA, 11 bp, Unknown
  misc_feature (1)..( 11): Result.003 file - promoters60/4768615
gtaaaatttca

SEQ ID NO: 138094 - DNA, 11 bp, Unknown
  misc_feature (1)..( 11): Result.003 file - promoters60/4768615
ataagtttaac

SEQ ID NO: 138095 - DNA, 11 bp, Unknown
  misc_feature (1)..( 11): Result.003 file - promoters60/4768615
taaaaattaaa

SEQ ID NO: 138096 - DNA, 12 bp, Unknown
  misc_feature (1)..( 12): Result.003 file - promoters60/4768615
gtaacaattcta

SEQ ID NO: 138097 - DNA, 12 bp, Unknown
  misc_feature (1)..( 12): Result.003 file - promoters60/4768615
ttgccaatacta

SEQ ID NO: 138098 - DNA, 9 bp, Unknown
  misc_feature (1)..( 9): Result.003 file - promoters60/4768631
taaatctca

SEQ ID NO: 138099 - DNA, 9 bp, Unknown
  misc_feature (1)..( 9): Result.003 file - promoters60/4768631
caaatctcg

SEQ ID NO: 138100 - DNA, 9 bp, Unknown
  misc_feature (1)..( 9): Result.003 file - promoters60/4768631
ataatttcg

SEQ ID NO: 138101 - DNA, 9 bp, Unknown
  misc_feature (1)..( 9): Result.003 file - promoters60/4768631
ataatttga

SEQ ID NO: 138102 - DNA, 8 bp, Unknown
  misc_feature (1)..( 8): Result.003 file - promoters60/4768631
ggcccatc

SEQ ID NO: 138103 - DNA, 8 bp, Unknown
  misc_feature (1)..( 8): Result.003 file - promoters60/4768631
ggcccaaa

SEQ ID NO: 138104 - DNA, 8 bp, Unknown
  misc_feature (1)..( 8): Result.003 file - promoters60/4768631
tgcccaaa

SEQ ID NO: 138105 - DNA, 8 bp, Unknown
  misc_feature (1)..( 8): Result.003 file - promoters60/4768631
ggcccaac

SEQ ID NO: 138106 - DNA, 7 bp, Unknown
  misc_feature (1)..( 7): Result.003 file - promoters60/4768690
tgtccaa

SEQ ID NO: 138107 - DNA, 7 bp, Unknown
  misc_feature (1)..( 7): Result.003 file - promoters60/4768690
tgttcaa

SEQ ID NO: 138108 - DNA, 9 bp, Unknown
  misc_feature (1)..( 9): Result.003 file - promoters60/4768690
taagaatct

SEQ ID NO: 138109 - DNA, 9 bp, Unknown
  misc_feature (1)..( 9): Result.003 file - promoters60/4768690
taagagtct

SEQ ID NO: 138110 - DNA, 7 bp, Unknown
  misc_feature (1)..( 7): Result.003 file - promoters60/4768690
ttgattt

SEQ ID NO: 138111 - DNA, 7 bp, Unknown
  misc_feature (1)..( 7): Result.003 file - promoters60/4768690
ttgtttt

SEQ ID NO: 138112 - DNA, 8 bp, Unknown
  misc_feature (1)..( 8): Result.003 file - promoters60/4768690
gatagtag

SEQ ID NO: 138113 - DNA, 8 bp, Unknown
  misc_feature (1)..( 8): Result.003 file - promoters60/4768690
gatagtac

SEQ ID NO: 138114 - DNA, 8 bp, Unknown
  misc_feature (1)..( 8): Result.003 file - promoters60/4768690
aatattag

SEQ ID NO: 138115 - DNA, 9 bp, Unknown
  misc_feature (1)..( 9): Result.003 file - promoters60/4768690
aactgttct

SEQ ID NO: 138116 - DNA, 9 bp, Unknown
  misc_feature (1)..( 9): Result.003 file - promoters60/4768690
aacggttct

SEQ ID NO: 138117 - DNA, 6 bp, Unknown
  misc_feature (1)..( 6): Result.003 file - promoters60/4768690
ataaac

SEQ ID NO: 138118 - DNA, 6 bp, Unknown
  misc_feature (1)..( 6): Result.003 file - promoters60/4768690
ataaac

SEQ ID NO: 138119 - DNA, 8 bp, Unknown
  misc_feature (1)..( 8): Result.003 file - promoters60/4768690
ctatatat

SEQ ID NO: 138120 - DNA, 8 bp, Unknown
  misc_feature (1)..( 8): Result.003 file - promoters60/4768690
ctaaatat

SEQ ID NO: 138121 - DNA, 8 bp, Unknown
  misc_feature (1)..( 8): Result.003 file - promoters60/4768690
tatataaa

SEQ ID NO: 138122 - DNA, 8 bp, Unknown
  misc_feature (1)..( 8): Result.003 file - promoters60/4768690
tatataaa

SEQ ID NO: 138123 - DNA, 8 bp, Unknown
  misc_feature (1)..( 8): Result.003 file - promoters60/4768690
gtttcaaa

SEQ ID NO: 138124 - DNA, 8 bp, Unknown
  misc_feature (1)..( 8): Result.003 file - promoters60/4768690
gtttgaaa

SEQ ID NO: 138125 - DNA, 6 bp, Unknown
  misc_feature (1)..( 6): Result.003 file - promoters60/4768690
caaaat

SEQ ID NO: 138126 - DNA, 6 bp, Unknown
  misc_feature (1)..( 6): Result.003 file - promoters60/4768690
caaaat

SEQ ID NO: 138127 - DNA, 6 bp, Unknown
  misc_feature (1)..( 6): Result.003 file - promoters60/4768690
agaatc

SEQ ID NO: 138128 - DNA, 6 bp, Unknown
  misc_feature (1)..( 6): Result.003 file - promoters60/4768690
agaatc

SEQ ID NO: 138129 - DNA, 8 bp, Unknown
  misc_feature (1)..( 8): Result.003 file - promoters60/4768690
aatccaat

SEQ ID NO: 138130 - DNA, 8 bp, Unknown
  misc_feature (1)..( 8): Result.003 file - promoters60/4768690
aatctaat

SEQ ID NO: 138131 - DNA, 7 bp, Unknown
  misc_feature (1)..( 7): Result.003 file - promoters60/4768690
ataacca

SEQ ID NO: 138132 - DNA, 7 bp, Unknown
  misc_feature (1)..( 7): Result.003 file - promoters60/4768690
ataccca

SEQ ID NO: 138133 - DNA, 6 bp, Unknown
  misc_feature (1)..( 6): Result.003 file - promoters60/4768690
aaagaa

SEQ ID NO: 138134 - DNA, 6 bp, Unknown
  misc_feature (1)..( 6): Result.003 file - promoters60/4768690
aaagaa

SEQ ID NO: 138135 - DNA, 6 bp, Unknown
  misc_feature (1)..( 6): Result.003 file - promoters60/4768690
agaaaa

SEQ ID NO: 138136 - DNA, 6 bp, Unknown
  misc_feature (1)..( 6): Result.003 file - promoters60/4768690
agaaaa

SEQ ID NO: 138137 - DNA, 8 bp, Unknown
  misc_feature (1)..( 8): Result.003 file - promoters60/4768690
ctcaatac

SEQ ID NO: 138138 - DNA, 8 bp, Unknown
  misc_feature (1)..( 8): Result.003 file - promoters60/4768690
ctcattac

SEQ ID NO: 138139 - DNA, 8 bp, Unknown
  misc_feature (1)..( 8): Result.003 file - promoters60/4768698
attagttc

SEQ ID NO: 138140 - DNA, 8 bp, Unknown
  misc_feature (1)..( 8): Result.003 file - promoters60/4768698
atttgtta

SEQ ID NO: 138141 - DNA, 8 bp, Unknown
  misc_feature (1)..( 8): Result.003 file - promoters60/4768698
attagtta

SEQ ID NO: 138142 - DNA, 8 bp, Unknown
  misc_feature (1)..( 8): Result.003 file - promoters60/4768698
attagtta

SEQ ID NO: 138143 - DNA, 8 bp, Unknown
  misc_feature (1)..( 8): Result.003 file - promoters60/4768698
aattgtta

SEQ ID NO: 138144 - DNA, 14 bp, Unknown
  misc_feature (1)..( 14): Result.003 file - promoters60/4768698
aattcgaatttttc

SEQ ID NO: 138145 - DNA, 14 bp, Unknown
  misc_feature (1)..( 14): Result.003 file - promoters60/4768698
ggccggaattttag

SEQ ID NO: 138146 - DNA, 14 bp, Unknown
  misc_feature (1)..( 14): Result.003 file - promoters60/4768698
atttgaaattttca

SEQ ID NO: 138147 - DNA, 14 bp, Unknown
  misc_feature (1)..( 14): Result.003 file - promoters60/4768698
gaatgaaatctgtc

SEQ ID NO: 138148 - DNA, 14 bp, Unknown
  misc_feature (1)..( 14): Result.003 file - promoters60/4768698
tttgaaaatttcat

SEQ ID NO: 138149 - DNA, 14 bp, Unknown
  misc_feature (1)..( 14): Result.003 file - promoters60/4768698
gcgctaaactttta

SEQ ID NO: 138150 - DNA, 16 bp, Unknown
  misc_feature (1)..( 16): Result.003 file - promoters60/4768698
attcgaatttttcaat

SEQ ID NO: 138151 - DNA, 16 bp, Unknown
  misc_feature (1)..( 16): Result.003 file - promoters60/4768698
tttagtctattttaat

SEQ ID NO: 138152 - DNA, 16 bp, Unknown
  misc_feature (1)..( 16): Result.003 file - promoters60/4768698
atttgaaattttcata

SEQ ID NO: 138153 - DNA, 16 bp, Unknown
  misc_feature (1)..( 16): Result.003 file - promoters60/4768698
caatcccaattctaac

SEQ ID NO: 138154 - DNA, 16 bp, Unknown
  misc_feature (1)..( 16): Result.003 file - promoters60/4768698
gcgctaaacttttaaa

SEQ ID NO: 138155 - DNA, 16 bp, Unknown
  misc_feature (1)..( 16): Result.003 file - promoters60/4768698
tagaaaagaatgaaat

SEQ ID NO: 138156 - DNA, 16 bp, Unknown
  misc_feature (1)..( 16): Result.003 file - promoters60/4768698
atttgaaaatttcata

SEQ ID NO: 138157 - DNA, 13 bp, Unknown
  misc_feature (1)..( 13): Result.003 file - promoters60/4768698
ttttgaagaattt

SEQ ID NO: 138158 - DNA, 13 bp, Unknown
  misc_feature (1)..( 13): Result.003 file - promoters60/4768698
ttttgatgaatgt

SEQ ID NO: 138159 - DNA, 13 bp, Unknown
  misc_feature (1)..( 13): Result.003 file - promoters60/4768698
atttgctgaataa

SEQ ID NO: 138160 - DNA, 13 bp, Unknown
  misc_feature (1)..( 13): Result.003 file - promoters60/4768698
aaaagatgaagtc

SEQ ID NO: 138161 - DNA, 13 bp, Unknown
  misc_feature (1)..( 13): Result.003 file - promoters60/4768698
tttcgatgtataa

SEQ ID NO: 138162 - DNA, 13 bp, Unknown
  misc_feature (1)..( 13): Result.003 file - promoters60/4768698
cccttgtgaatgt

SEQ ID NO: 138163 - DNA, 20 bp, Unknown
  misc_feature (1)..( 20): Result.003 file - promoters60/4768698
ataaaaatgttagataggaa

SEQ ID NO: 138164 - DNA, 20 bp, Unknown
  misc_feature (1)..( 20): Result.003 file - promoters60/4768698
tcataaattttaaaattatt

SEQ ID NO: 138165 - DNA, 20 bp, Unknown
  misc_feature (1)..( 20): Result.003 file - promoters60/4768698
tgttaaatatgaatattacc

SEQ ID NO: 138166 - DNA, 21 bp, Unknown
  misc_feature (1)..( 21): Result.003 file - promoters60/4768698
atgtaaattttgaaataattt

SEQ ID NO: 138167 - DNA, 21 bp, Unknown
  misc_feature (1)..( 21): Result.003 file - promoters60/4768698
ttaaccattgtgaaataattt

SEQ ID NO: 138168 - DNA, 21 bp, Unknown
  misc_feature (1)..( 21): Result.003 file - promoters60/4768698
agtataattgttaatcttttg

SEQ ID NO: 138169 - DNA, 10 bp, Unknown
  misc_feature (1)..( 10): Result.003 file - promoters60/4768698
tatataaaca

SEQ ID NO: 138170 - DNA, 10 bp, Unknown
  misc_feature (1)..( 10): Result.003 file - promoters60/4768698
tatataataa

SEQ ID NO: 138171 - DNA, 10 bp, Unknown
  misc_feature (1)..( 10): Result.003 file - promoters60/4768698
tatataaatg

SEQ ID NO: 138172 - DNA, 10 bp, Unknown
  misc_feature (1)..( 10): Result.003 file - promoters60/4768698
tatataaatg

SEQ ID NO: 138173 - DNA, 10 bp, Unknown
  misc_feature (1)..( 10): Result.003 file - promoters60/4768698
cctataaata

SEQ ID NO: 138174 - DNA, 10 bp, Unknown
  misc_feature (1)..( 10): Result.003 file - promoters60/4768698
acgataaata

SEQ ID NO: 138175 - DNA, 12 bp, Unknown
  misc_feature (1)..( 12): Result.003 file - promoters60/4768698
tatataaacaaa

SEQ ID NO: 138176 - DNA, 12 bp, Unknown
  misc_feature (1)..( 12): Result.003 file - promoters60/4768698
ataataaccaaa

SEQ ID NO: 138177 - DNA, 12 bp, Unknown
  misc_feature (1)..( 12): Result.003 file - promoters60/4768698
tatataaatgac

SEQ ID NO: 138178 - DNA, 12 bp, Unknown
  misc_feature (1)..( 12): Result.003 file - promoters60/4768698
tatataaatgac

SEQ ID NO: 138179 - DNA, 12 bp, Unknown
  misc_feature (1)..( 12): Result.003 file - promoters60/4768698
cctataaatatc

SEQ ID NO: 138180 - DNA, 11 bp, Unknown
  misc_feature (1)..( 11): Result.003 file - promoters60/4768698
cagaaaattcg

SEQ ID NO: 138181 - DNA, 11 bp, Unknown
  misc_feature (1)..( 11): Result.003 file - promoters60/4768698
tagaaaagaat

SEQ ID NO: 138182 - DNA, 11 bp, Unknown
  misc_feature (1)..( 11): Result.003 file - promoters60/4768698
ttgaaaatttc

SEQ ID NO: 138183 - DNA, 11 bp, Unknown
  misc_feature (1)..( 11): Result.003 file - promoters60/4768698
tagtaaatgac

SEQ ID NO: 138184 - DNA, 11 bp, Unknown
  misc_feature (1)..( 11): Result.003 file - promoters60/4768698
tttgaaatttt

SEQ ID NO: 138185 - DNA, 11 bp, Unknown
  misc_feature (1)..( 11): Result.003 file - promoters60/4768698
cgctaaacttt

SEQ ID NO: 138186 - DNA, 14 bp, Unknown
  misc_feature (1)..( 14): Result.003 file - promoters60/4768698
aaacttataattat

SEQ ID NO: 138187 - DNA, 14 bp, Unknown
  misc_feature (1)..( 14): Result.003 file - promoters60/4768698
atctttataagtat

SEQ ID NO: 138188 - DNA, 14 bp, Unknown
  misc_feature (1)..( 14): Result.003 file - promoters60/4768698
aaatttgtaacttc

SEQ ID NO: 138189 - DNA, 14 bp, Unknown
  misc_feature (1)..( 14): Result.003 file - promoters60/4768698
cgttttaaaagtaa

SEQ ID NO: 138190 - DNA, 14 bp, Unknown
  misc_feature (1)..( 14): Result.003 file - promoters60/4768698
atctttatacaaaa

SEQ ID NO: 138191 - DNA, 14 bp, Unknown
  misc_feature (1)..( 14): Result.003 file - promoters60/4768698
tatgttattagtta

SEQ ID NO: 138192 - DNA, 14 bp, Unknown
  misc_feature (1)..( 14): Result.003 file - promoters60/4768698
tatgttattagtta

SEQ ID NO: 138193 - DNA, 10 bp, Unknown
  misc_feature (1)..( 10): Result.003 file - promoters60/4768698
gtaatgtaat

SEQ ID NO: 138194 - DNA, 10 bp, Unknown
  misc_feature (1)..( 10): Result.003 file - promoters60/4768698
tgaatgtata

SEQ ID NO: 138195 - DNA, 10 bp, Unknown
  misc_feature (1)..( 10): Result.003 file - promoters60/4768698
ctaatgtgac

SEQ ID NO: 138196 - DNA, 10 bp, Unknown
  misc_feature (1)..( 10): Result.003 file - promoters60/4768698
tcgatgtata

SEQ ID NO: 138197 - DNA, 10 bp, Unknown
  misc_feature (1)..( 10): Result.003 file - promoters60/4768698
tgaatgtcaa

SEQ ID NO: 138198 - DNA, 10 bp, Unknown
  misc_feature (1)..( 10): Result.003 file - promoters60/4768698
ttatgtaaat

SEQ ID NO: 138199 - DNA, 10 bp, Unknown
  misc_feature (1)..( 10): Result.003 file - promoters60/4768698
gtatttaagc

SEQ ID NO: 138200 - DNA, 10 bp, Unknown
  misc_feature (1)..( 10): Result.003 file - promoters60/4768698
ttatgttatt

SEQ ID NO: 138201 - DNA, 10 bp, Unknown
  misc_feature (1)..( 10): Result.003 file - promoters60/4768698
aattgttaat

SEQ ID NO: 138202 - DNA, 10 bp, Unknown
  misc_feature (1)..( 10): Result.003 file - promoters60/4768698
ttatttactt

SEQ ID NO: 138203 - DNA, 14 bp, Unknown
  misc_feature (1)..( 14): Result.003 file - promoters60/4768698
tccatattatacgt

SEQ ID NO: 138204 - DNA, 14 bp, Unknown
  misc_feature (1)..( 14): Result.003 file - promoters60/4768698
caatctttatacaa

SEQ ID NO: 138205 - DNA, 14 bp, Unknown
  misc_feature (1)..( 14): Result.003 file - promoters60/4768698
atatctttataagt

SEQ ID NO: 138206 - DNA, 14 bp, Unknown
  misc_feature (1)..( 14): Result.003 file - promoters60/4768698
ataactttatgtta

SEQ ID NO: 138207 - DNA, 14 bp, Unknown
  misc_feature (1)..( 14): Result.003 file - promoters60/4768698
tttatgttattagt

SEQ ID NO: 138208 - DNA, 7 bp, Unknown
  misc_feature (1)..( 7): Result.003 file - promoters60/4768748
gtaaagt

SEQ ID NO: 138209 - DNA, 7 bp, Unknown
  misc_feature (1)..( 7): Result.003 file - promoters60/4768748
gtaaagt

SEQ ID NO: 138210 - DNA, 6 bp, Unknown
  misc_feature (1)..( 6): Result.003 file - promoters60/4768748
ttttga

SEQ ID NO: 138211 - DNA, 6 bp, Unknown
  misc_feature (1)..( 6): Result.003 file - promoters60/4768748
ttttga

SEQ ID NO: 138212 - DNA, 8 bp, Unknown
  misc_feature (1)..( 8): Result.003 file - promoters60/4768748
atttttag

SEQ ID NO: 138213 - DNA, 8 bp, Unknown
  misc_feature (1)..( 8): Result.003 file - promoters60/4768748
atttgtag

SEQ ID NO: 138214 - DNA, 7 bp, Unknown
  misc_feature (1)..( 7): Result.003 file - promoters60/4768748
ttatttt

SEQ ID NO: 138215 - DNA, 7 bp, Unknown
  misc_feature (1)..( 7): Result.003 file - promoters60/4768748
ttaattt

SEQ ID NO: 138216 - DNA, 7 bp, Unknown
  misc_feature (1)..( 7): Result.003 file - promoters60/4768748
gacctct

SEQ ID NO: 138217 - DNA, 7 bp, Unknown
  misc_feature (1)..( 7): Result.003 file - promoters60/4768748
gacttct

SEQ ID NO: 138218 - DNA, 6 bp, Unknown
  misc_feature (1)..( 6): Result.003 file - promoters60/4768748
tgagct

SEQ ID NO: 138219 - DNA, 6 bp, Unknown
  misc_feature (1)..( 6): Result.003 file - promoters60/4768748
tgagct

SEQ ID NO: 138220 - DNA, 8 bp, Unknown
  misc_feature (1)..( 8): Result.003 file - promoters60/4768748
gctttctc

SEQ ID NO: 138221 - DNA, 8 bp, Unknown
  misc_feature (1)..( 8): Result.003 file - promoters60/4768748
gcttactc

SEQ ID NO: 138222 - DNA, 8 bp, Unknown
  misc_feature (1)..( 8): Result.003 file - promoters60/4768748
ttagctca

SEQ ID NO: 138223 - DNA, 8 bp, Unknown
  misc_feature (1)..( 8): Result.003 file - promoters60/4768748
ttagttca

SEQ ID NO: 138224 - DNA, 7 bp, Unknown
  misc_feature (1)..( 7): Result.003 file - promoters60/4768748
actcgta

SEQ ID NO: 138225 - DNA, 7 bp, Unknown
  misc_feature (1)..( 7): Result.003 file - promoters60/4768748
actggta

SEQ ID NO: 138226 - DNA, 9 bp, Unknown
  misc_feature (1)..( 9): Result.003 file - promoters60/4768748
tgaaaaact

SEQ ID NO: 138227 - DNA, 9 bp, Unknown
  misc_feature (1)..( 9): Result.003 file - promoters60/4768748
tgaaaaact

SEQ ID NO: 138228 - DNA, 8 bp, Unknown
  misc_feature (1)..( 8): Result.003 file - promoters60/4768748
aatcaagt

SEQ ID NO: 138229 - DNA, 8 bp, Unknown
  misc_feature (1)..( 8): Result.003 file - promoters60/4768748
aatcaagt

SEQ ID NO: 138230 - DNA, 7 bp, Unknown
  misc_feature (1)..( 7): Result.003 file - promoters60/4768748
caaaaaa

SEQ ID NO: 138231 - DNA, 7 bp, Unknown
  misc_feature (1)..( 7): Result.003 file - promoters60/4768748
caacaaa

SEQ ID NO: 138232 - DNA, 8 bp, Unknown
  misc_feature (1)..( 8): Result.003 file - promoters60/4768778
gtttttgt

SEQ ID NO: 138233 - DNA, 8 bp, Unknown
  misc_feature (1)..( 8): Result.003 file - promoters60/4768778
gtttttgg

SEQ ID NO: 138234 - DNA, 8 bp, Unknown
  misc_feature (1)..( 8): Result.003 file - promoters60/4768778
acttttgt

SEQ ID NO: 138235 - DNA, 10 bp, Unknown
  misc_feature (1)..( 10): Result.003 file - promoters60/4768778
ttgtcttttc

SEQ ID NO: 138236 - DNA, 10 bp, Unknown
  misc_feature (1)..( 10): Result.003 file - promoters60/4768778
ttgtattttt

SEQ ID NO: 138237 - DNA, 10 bp, Unknown
  misc_feature (1)..( 10): Result.003 file - promoters60/4768778
tcaaattttt

SEQ ID NO: 138238 - DNA, 7 bp, Unknown
  misc_feature (1)..( 7): Result.003 file - promoters60/4768782
attgtgt

SEQ ID NO: 138239 - DNA, 7 bp, Unknown
  misc_feature (1)..( 7): Result.003 file - promoters60/4768782
attctgt

SEQ ID NO: 138240 - DNA, 7 bp, Unknown
  misc_feature (1)..( 7): Result.003 file - promoters60/4768782
tttgtgt

SEQ ID NO: 138241 - DNA, 11 bp, Unknown
  misc_feature (1)..( 11): Result.003 file - promoters60/4768782
ttgggaaatgt

SEQ ID NO: 138242 - DNA, 11 bp, Unknown
  misc_feature (1)..( 11): Result.003 file - promoters60/4768782
atggaaaatgt

SEQ ID NO: 138243 - DNA, 11 bp, Unknown
  misc_feature (1)..( 11): Result.003 file - promoters60/4768782
ttggaaaatat

SEQ ID NO: 138244 - DNA, 8 bp, Unknown
  misc_feature (1)..( 8): Result.003 file - promoters60/4768782
atttttca

SEQ ID NO: 138245 - DNA, 8 bp, Unknown
  misc_feature (1)..( 8): Result.003 file - promoters60/4768782
attattct

SEQ ID NO: 138246 - DNA, 8 bp, Unknown
  misc_feature (1)..( 8): Result.003 file - promoters60/4768782
cttattct

SEQ ID NO: 138247 - DNA, 10 bp, Unknown
  misc_feature (1)..( 10): Result.003 file - promoters60/4768782
aagaaaatct

SEQ ID NO: 138248 - DNA, 10 bp, Unknown
  misc_feature (1)..( 10): Result.003 file - promoters60/4768782
aagtaaatga

SEQ ID NO: 138249 - DNA, 10 bp, Unknown
  misc_feature (1)..( 10): Result.003 file - promoters60/4768782
tcttaaatga

SEQ ID NO: 138250 - DNA, 11 bp, Unknown
  misc_feature (1)..( 11): Result.003 file - promoters60/4768782
ttcttattgtt

SEQ ID NO: 138251 - DNA, 11 bp, Unknown
  misc_feature (1)..( 11): Result.003 file - promoters60/4768782
ttctcattagc

SEQ ID NO: 138252 - DNA, 11 bp, Unknown
  misc_feature (1)..( 11): Result.003 file - promoters60/4768782
ggtttaatgtt

SEQ ID NO: 138253 - DNA, 7 bp, Unknown
  misc_feature (1)..( 7): Result.003 file - promoters60/4768804
aattttg

SEQ ID NO: 138254 - DNA, 7 bp, Unknown
  misc_feature (1)..( 7): Result.003 file - promoters60/4768804
aattttg

SEQ ID NO: 138255 - DNA, 6 bp, Unknown
  misc_feature (1)..( 6): Result.003 file - promoters60/4768804
ctaaca

SEQ ID NO: 138256 - DNA, 6 bp, Unknown
  misc_feature (1)..( 6): Result.003 file - promoters60/4768804
ctaaca

SEQ ID NO: 138257 - DNA, 8 bp, Unknown
  misc_feature (1)..( 8): Result.003 file - promoters60/4768804
ataagata

SEQ ID NO: 138258 - DNA, 8 bp, Unknown
  misc_feature (1)..( 8): Result.003 file - promoters60/4768804
atatgata

SEQ ID NO: 138259 - DNA, 7 bp, Unknown
  misc_feature (1)..( 7): Result.003 file - promoters60/4768804
aataaaa

SEQ ID NO: 138260 - DNA, 7 bp, Unknown
  misc_feature (1)..( 7): Result.003 file - promoters60/4768804
aataaaa

SEQ ID NO: 138261 - DNA, 10 bp, Unknown
  misc_feature (1)..( 10): Result.003 file - promoters60/4768804
aatagataaa

SEQ ID NO: 138262 - DNA, 10 bp, Unknown
  misc_feature (1)..( 10): Result.003 file - promoters60/4768804
aatagttaaa

SEQ ID NO: 138263 - DNA, 8 bp, Unknown
  misc_feature (1)..( 8): Result.003 file - promoters60/4768804
ttgataaa

SEQ ID NO: 138264 - DNA, 8 bp, Unknown
  misc_feature (1)..( 8): Result.003 file - promoters60/4768804
ttgagaaa

SEQ ID NO: 138265 - DNA, 6 bp, Unknown
  misc_feature (1)..( 6): Result.003 file - promoters60/4768804
gttaag

SEQ ID NO: 138266 - DNA, 6 bp, Unknown
  misc_feature (1)..( 6): Result.003 file - promoters60/4768804
gttaag

SEQ ID NO: 138267 - DNA, 7 bp, Unknown
  misc_feature (1)..( 7): Result.003 file - promoters60/4768804
agagaca

SEQ ID NO: 138268 - DNA, 7 bp, Unknown
  misc_feature (1)..( 7): Result.003 file - promoters60/4768804
agataca

SEQ ID NO: 138269 - DNA, 6 bp, Unknown
  misc_feature (1)..( 6): Result.003 file - promoters60/4768804
tgctaa

SEQ ID NO: 138270 - DNA, 6 bp, Unknown
  misc_feature (1)..( 6): Result.003 file - promoters60/4768804
tgctaa

SEQ ID NO: 138271 - DNA, 6 bp, Unknown
  misc_feature (1)..( 6): Result.003 file - promoters60/4768804
attata

SEQ ID NO: 138272 - DNA, 6 bp, Unknown
  misc_feature (1)..( 6): Result.003 file - promoters60/4768804
attata

SEQ ID NO: 138273 - DNA, 7 bp, Unknown
  misc_feature (1)..( 7): Result.003 file - promoters60/4768804
tttaaag

SEQ ID NO: 138274 - DNA, 7 bp, Unknown
  misc_feature (1)..( 7): Result.003 file - promoters60/4768804
tttcaag

SEQ ID NO: 138275 - DNA, 6 bp, Unknown
  misc_feature (1)..( 6): Result.003 file - promoters60/4768811
aaagta

SEQ ID NO: 138276 - DNA, 6 bp, Unknown
  misc_feature (1)..( 6): Result.003 file - promoters60/4768811
aaagta

SEQ ID NO: 138277 - DNA, 7 bp, Unknown
  misc_feature (1)..( 7): Result.003 file - promoters60/4768811
tcccact

SEQ ID NO: 138278 - DNA, 7 bp, Unknown
  misc_feature (1)..( 7): Result.003 file - promoters60/4768811
tccgact

SEQ ID NO: 138279 - DNA, 6 bp, Unknown
  misc_feature (1)..( 6): Result.003 file - promoters60/4768811
tacgcg

SEQ ID NO: 138280 - DNA, 6 bp, Unknown
  misc_feature (1)..( 6): Result.003 file - promoters60/4768811
tacgcg

SEQ ID NO: 138281 - DNA, 7 bp, Unknown
  misc_feature (1)..( 7): Result.003 file - promoters60/4768811
ctaattt

SEQ ID NO: 138282 - DNA, 7 bp, Unknown
  misc_feature (1)..( 7): Result.003 file - promoters60/4768811
ctagttt

SEQ ID NO: 138283 - DNA, 6 bp, Unknown
  misc_feature (1)..( 6): Result.003 file - promoters60/4768811
tttgga

SEQ ID NO: 138284 - DNA, 6 bp, Unknown
  misc_feature (1)..( 6): Result.003 file - promoters60/4768811
tttgga

SEQ ID NO: 138285 - DNA, 6 bp, Unknown
  misc_feature (1)..( 6): Result.003 file - promoters60/4768811
gatttg

SEQ ID NO: 138286 - DNA, 6 bp, Unknown
  misc_feature (1)..( 6): Result.003 file - promoters60/4768811
gatttg

SEQ ID NO: 138287 - DNA, 8 bp, Unknown
  misc_feature (1)..( 8): Result.003 file - promoters60/4768811
aaaacttt

SEQ ID NO: 138288 - DNA, 8 bp, Unknown
  misc_feature (1)..( 8): Result.003 file - promoters60/4768811
aaatcttt

SEQ ID NO: 138289 - DNA, 8 bp, Unknown
  misc_feature (1)..( 8): Result.003 file - promoters60/4768811
gagttgct

SEQ ID NO: 138290 - DNA, 8 bp, Unknown
  misc_feature (1)..( 8): Result.003 file - promoters60/4768811
gaggtgct

SEQ ID NO: 138291 - DNA, 7 bp, Unknown
  misc_feature (1)..( 7): Result.003 file - promoters60/4768811
gagcttc

SEQ ID NO: 138292 - DNA, 7 bp, Unknown
  misc_feature (1)..( 7): Result.003 file - promoters60/4768811
gagtttc

SEQ ID NO: 138293 - DNA, 6 bp, Unknown
  misc_feature (1)..( 6): Result.003 file - promoters60/4768811
ttagat

SEQ ID NO: 138294 - DNA, 6 bp, Unknown
  misc_feature (1)..( 6): Result.003 file - promoters60/4768811
ttagat

SEQ ID NO: 138295 - DNA, 7 bp, Unknown
  misc_feature (1)..( 7): Result.003 file - promoters60/4768811
tgtaaaa

SEQ ID NO: 138296 - DNA, 7 bp, Unknown
  misc_feature (1)..( 7): Result.003 file - promoters60/4768811
tgtgaaa

SEQ ID NO: 138297 - DNA, 7 bp, Unknown
  misc_feature (1)..( 7): Result.003 file - promoters60/4768811
aagtttg

SEQ ID NO: 138298 - DNA, 7 bp, Unknown
  misc_feature (1)..( 7): Result.003 file - promoters60/4768811
aagtttg

SEQ ID NO: 138299 - DNA, 7 bp, Unknown
  misc_feature (1)..( 7): Result.003 file - promoters60/4768811
taaataa

SEQ ID NO: 138300 - DNA, 7 bp, Unknown
  misc_feature (1)..( 7): Result.003 file - promoters60/4768811
taattaa

SEQ ID NO: 138301 - DNA, 10 bp, Unknown
  misc_feature (1)..( 10): Result.003 file - promoters60/4768829
taaaaattaa

SEQ ID NO: 138302 - DNA, 10 bp, Unknown
  misc_feature (1)..( 10): Result.003 file - promoters60/4768829
gtaaaatttc

SEQ ID NO: 138303 - DNA, 11 bp, Unknown
  misc_feature (1)..( 11): Result.003 file - promoters60/4768829
ctaaatattag

SEQ ID NO: 138304 - DNA, 11 bp, Unknown
  misc_feature (1)..( 11): Result.003 file - promoters60/4768829
gtaacaattct

SEQ ID NO: 138305 - DNA, 11 bp, Unknown
  misc_feature (1)..( 11): Result.003 file - promoters60/4768829
cccaaaattga

SEQ ID NO: 138306 - DNA, 11 bp, Unknown
  misc_feature (1)..( 11): Result.003 file - promoters60/4768829
ttcgaaatgga

SEQ ID NO: 138307 - DNA, 11 bp, Unknown
  misc_feature (1)..( 11): Result.003 file - promoters60/4768829
ggaacaagtct

SEQ ID NO: 138308 - DNA, 11 bp, Unknown
  misc_feature (1)..( 11): Result.003 file - promoters60/4768829
atcgaaaagaa

SEQ ID NO: 138309 - DNA, 14 bp, Unknown
  misc_feature (1)..( 14): Result.003 file - promoters60/4768829
taaataaatttttg

SEQ ID NO: 138310 - DNA, 14 bp, Unknown
  misc_feature (1)..( 14): Result.003 file - promoters60/4768829
caaacaaatgtttg

SEQ ID NO: 138311 - DNA, 14 bp, Unknown
  misc_feature (1)..( 14): Result.003 file - promoters60/4768829
taaaaaaagaagaa

SEQ ID NO: 138312 - DNA, 14 bp, Unknown
  misc_feature (1)..( 14): Result.003 file - promoters60/4768829
taaaccaatgttta

SEQ ID NO: 138313 - DNA, 14 bp, Unknown
  misc_feature (1)..( 14): Result.003 file - promoters60/4768829
ctaactgatttttc

SEQ ID NO: 138314 - DNA, 14 bp, Unknown
  misc_feature (1)..( 14): Result.003 file - promoters60/4768829
agccaaaatgaacc

SEQ ID NO: 138315 - DNA, 9 bp, Unknown
  misc_feature (1)..( 9): Result.003 file - promoters60/4768829
atattatta

SEQ ID NO: 138316 - DNA, 9 bp, Unknown
  misc_feature (1)..( 9): Result.003 file - promoters60/4768829
ttattatat

SEQ ID NO: 138317 - DNA, 9 bp, Unknown
  misc_feature (1)..( 9): Result.003 file - promoters60/4768829
gtattttta

SEQ ID NO: 138318 - DNA, 9 bp, Unknown
  misc_feature (1)..( 9): Result.003 file - promoters60/4768829
atataatta

SEQ ID NO: 138319 - DNA, 9 bp, Unknown
  misc_feature (1)..( 9): Result.003 file - promoters60/4768829
ttattatgt

SEQ ID NO: 138320 - DNA, 10 bp, Unknown
  misc_feature (1)..( 10): Result.003 file - promoters60/4768829
aaatgaattt

SEQ ID NO: 138321 - DNA, 13 bp, Unknown
  misc_feature (1)..( 13): Result.003 file - promoters60/4768829
ttaaatgctagaa

SEQ ID NO: 138322 - DNA, 13 bp, Unknown
  misc_feature (1)..( 13): Result.003 file - promoters60/4768829
aacaattctaatt

SEQ ID NO: 138323 - DNA, 13 bp, Unknown
  misc_feature (1)..( 13): Result.003 file - promoters60/4768829
gttgcttctaaat

SEQ ID NO: 138324 - DNA, 13 bp, Unknown
  misc_feature (1)..( 13): Result.003 file - promoters60/4768829
aaatattcgaaat

SEQ ID NO: 138325 - DNA, 13 bp, Unknown
  misc_feature (1)..( 13): Result.003 file - promoters60/4768829
aacaagtctctat

SEQ ID NO: 138326 - DNA, 13 bp, Unknown
  misc_feature (1)..( 13): Result.003 file - promoters60/4768829
gttatatcgaaaa

SEQ ID NO: 138327 - DNA, 8 bp, Unknown
  misc_feature (1)..( 8): Result.003 file - promoters60/4768848
tggaaaat

SEQ ID NO: 138328 - DNA, 8 bp, Unknown
  misc_feature (1)..( 8): Result.003 file - promoters60/4768848
tggaaaat

SEQ ID NO: 138329 - DNA, 8 bp, Unknown
  misc_feature (1)..( 8): Result.003 file - promoters60/4768848
ttctgact

SEQ ID NO: 138330 - DNA, 8 bp, Unknown
  misc_feature (1)..( 8): Result.003 file - promoters60/4768848
ttcttact

SEQ ID NO: 138331 - DNA, 6 bp, Unknown
  misc_feature (1)..( 6): Result.003 file - promoters60/4768848
aatgat

SEQ ID NO: 138332 - DNA, 6 bp, Unknown
  misc_feature (1)..( 6): Result.003 file - promoters60/4768848
aatgat

SEQ ID NO: 138333 - DNA, 9 bp, Unknown
  misc_feature (1)..( 9): Result.003 file - promoters60/4768848
atctccatc

SEQ ID NO: 138334 - DNA, 9 bp, Unknown
  misc_feature (1)..( 9): Result.003 file - promoters60/4768848
tactccatt

SEQ ID NO: 138335 - DNA, 9 bp, Unknown
  misc_feature (1)..( 9): Result.003 file - promoters60/4768848
tactcaatt

SEQ ID NO: 138336 - DNA, 10 bp, Unknown
  misc_feature (1)..( 10): Result.003 file - promoters60/4768848
ttttacggtt

SEQ ID NO: 138337 - DNA, 10 bp, Unknown
  misc_feature (1)..( 10): Result.003 file - promoters60/4768848
ttttaaggtt

SEQ ID NO: 138338 - DNA, 7 bp, Unknown
  misc_feature (1)..( 7): Result.003 file - promoters60/4768848
gttttat

SEQ ID NO: 138339 - DNA, 7 bp, Unknown
  misc_feature (1)..( 7): Result.003 file - promoters60/4768848
gttatat

SEQ ID NO: 138340 - DNA, 6 bp, Unknown
  misc_feature (1)..( 6): Result.003 file - promoters60/4768848
attttt

SEQ ID NO: 138341 - DNA, 6 bp, Unknown
  misc_feature (1)..( 6): Result.003 file - promoters60/4768848
attttt

SEQ ID NO: 138342 - DNA, 6 bp, Unknown
  misc_feature (1)..( 6): Result.003 file - promoters60/4768848
tccaaa

SEQ ID NO: 138343 - DNA, 6 bp, Unknown
  misc_feature (1)..( 6): Result.003 file - promoters60/4768848
tccaaa

SEQ ID NO: 138344 - DNA, 7 bp, Unknown
  misc_feature (1)..( 7): Result.003 file - promoters60/4768848
attaaat

SEQ ID NO: 138345 - DNA, 7 bp, Unknown
  misc_feature (1)..( 7): Result.003 file - promoters60/4768848
attaaaa

SEQ ID NO: 138346 - DNA, 8 bp, Unknown
  misc_feature (1)..( 8): Result.003 file - promoters60/4768848
tttataat

SEQ ID NO: 138347 - DNA, 7 bp, Unknown
  misc_feature (1)..( 7): Result.003 file - promoters60/4768848
tttctca

SEQ ID NO: 138348 - DNA, 7 bp, Unknown
  misc_feature (1)..( 7): Result.003 file - promoters60/4768848
tttctca

SEQ ID NO: 138349 - DNA, 8 bp, Unknown
  misc_feature (1)..( 8): Result.003 file - promoters60/4768848
cattttct

SEQ ID NO: 138350 - DNA, 8 bp, Unknown
  misc_feature (1)..( 8): Result.003 file - promoters60/4768848
cattctct

SEQ ID NO: 138351 - DNA, 6 bp, Unknown
  misc_feature (1)..( 6): Result.003 file - promoters60/4768848
aagaaa

SEQ ID NO: 138352 - DNA, 6 bp, Unknown
  misc_feature (1)..( 6): Result.003 file - promoters60/4768848
aagaaa

SEQ ID NO: 138353 - DNA, 7 bp, Unknown
  misc_feature (1)..( 7): Result.003 file - promoters60/4768848
agaaagt

SEQ ID NO: 138354 - DNA, 7 bp, Unknown
  misc_feature (1)..( 7): Result.003 file - promoters60/4768848
agatagt

SEQ ID NO: 138355 - DNA, 6 bp, Unknown
  misc_feature (1)..( 6): Result.003 file - promoters60/4768848
aaatgc

SEQ ID NO: 138356 - DNA, 6 bp, Unknown
  misc_feature (1)..( 6): Result.003 file - promoters60/4768848
aaatgc

SEQ ID NO: 138357 - DNA, 21 bp, Unknown
  misc_feature (1)..( 21): Result.003 file - promoters60/4768856
aaagtgattctatttttatat

SEQ ID NO: 138358 - DNA, 21 bp, Unknown
  misc_feature (1)..( 21): Result.003 file - promoters60/4768856
gtaacaattctaattttctaa

SEQ ID NO: 138359 - DNA, 21 bp, Unknown
  misc_feature (1)..( 21): Result.003 file - promoters60/4768856
tgtgtgaatttgtttttgata

SEQ ID NO: 138360 - DNA, 21 bp, Unknown
  misc_feature (1)..( 21): Result.003 file - promoters60/4768856
accttcgtgttaattgtctcc

SEQ ID NO: 138361 - DNA, 21 bp, Unknown
  misc_feature (1)..( 21): Result.003 file - promoters60/4768856
ggaacaagtctctatgacacg

SEQ ID NO: 138362 - DNA, 21 bp, Unknown
  misc_feature (1)..( 21): Result.003 file - promoters60/4768856
ggagcaatagagaagcaagct

SEQ ID NO: 138363 - DNA, 12 bp, Unknown
  misc_feature (1)..( 12): Result.003 file - promoters60/4768856
atttgatataca

SEQ ID NO: 138364 - DNA, 12 bp, Unknown
  misc_feature (1)..( 12): Result.003 file - promoters60/4768856
gtttgttataca

SEQ ID NO: 138365 - DNA, 12 bp, Unknown
  misc_feature (1)..( 12): Result.003 file - promoters60/4768856
ttttgattaaat

SEQ ID NO: 138366 - DNA, 12 bp, Unknown
  misc_feature (1)..( 12): Result.003 file - promoters60/4768856
ctgcattaaaca

SEQ ID NO: 138367 - DNA, 12 bp, Unknown
  misc_feature (1)..( 12): Result.003 file - promoters60/4768856
acttggtatatt

SEQ ID NO: 138368 - DNA, 12 bp, Unknown
  misc_feature (1)..( 12): Result.003 file - promoters60/4768856
ttttgaccgagt

SEQ ID NO: 138369 - DNA, 11 bp, Unknown
  misc_feature (1)..( 11): Result.003 file - promoters60/4768856
tatgtaaatta

SEQ ID NO: 138370 - DNA, 11 bp, Unknown
  misc_feature (1)..( 11): Result.003 file - promoters60/4768856
ttggtatatta

SEQ ID NO: 138371 - DNA, 11 bp, Unknown
  misc_feature (1)..( 11): Result.003 file - promoters60/4768856
tgattaaattg

SEQ ID NO: 138372 - DNA, 11 bp, Unknown
  misc_feature (1)..( 11): Result.003 file - promoters60/4768856
agatcaaatag

SEQ ID NO: 138373 - DNA, 11 bp, Unknown
  misc_feature (1)..( 11): Result.003 file - promoters60/4768856
cgataaaacaa

SEQ ID NO: 138374 - DNA, 11 bp, Unknown
  misc_feature (1)..( 11): Result.003 file - promoters60/4768856
ttgttatacat

SEQ ID NO: 138375 - DNA, 10 bp, Unknown
  misc_feature (1)..( 10): Result.003 file - promoters60/4768856
aattaatttg

SEQ ID NO: 138376 - DNA, 10 bp, Unknown
  misc_feature (1)..( 10): Result.003 file - promoters60/4768856
tattaattta

SEQ ID NO: 138377 - DNA, 10 bp, Unknown
  misc_feature (1)..( 10): Result.003 file - promoters60/4768856
gattaaattg

SEQ ID NO: 138378 - DNA, 10 bp, Unknown
  misc_feature (1)..( 10): Result.003 file - promoters60/4768856
gatcaaatag

SEQ ID NO: 138379 - DNA, 10 bp, Unknown
  misc_feature (1)..( 10): Result.003 file - promoters60/4768856
gataaaacaa

SEQ ID NO: 138380 - DNA, 10 bp, Unknown
  misc_feature (1)..( 10): Result.003 file - promoters60/4768856
cattaaacaa

SEQ ID NO: 138381 - DNA, 10 bp, Unknown
  misc_feature (1)..( 10): Result.003 file - promoters60/4768856
tttagtgtct

SEQ ID NO: 138382 - DNA, 10 bp, Unknown
  misc_feature (1)..( 10): Result.003 file - promoters60/4768856
tgcagtgtct

SEQ ID NO: 138383 - DNA, 10 bp, Unknown
  misc_feature (1)..( 10): Result.003 file - promoters60/4768856
tttattgtta

SEQ ID NO: 138384 - DNA, 10 bp, Unknown
  misc_feature (1)..( 10): Result.003 file - promoters60/4768856
tttatttctt

SEQ ID NO: 138385 - DNA, 10 bp, Unknown
  misc_feature (1)..( 10): Result.003 file - promoters60/4768856
tttattttat

SEQ ID NO: 138386 - DNA, 10 bp, Unknown
  misc_feature (1)..( 10): Result.003 file - promoters60/4768856
tttttttttt

SEQ ID NO: 138387 - DNA, 11 bp, Unknown
  misc_feature (1)..( 11): Result.003 file - promoters60/4768856
acacttttttt

SEQ ID NO: 138388 - DNA, 11 bp, Unknown
  misc_feature (1)..( 11): Result.003 file - promoters60/4768856
ttcctttattt

SEQ ID NO: 138389 - DNA, 11 bp, Unknown
  misc_feature (1)..( 11): Result.003 file - promoters60/4768856
ctattttattg

SEQ ID NO: 138390 - DNA, 11 bp, Unknown
  misc_feature (1)..( 11): Result.003 file - promoters60/4768856
ttattttattt

SEQ ID NO: 138391 - DNA, 11 bp, Unknown
  misc_feature (1)..( 11): Result.003 file - promoters60/4768856
cacatttctgc

SEQ ID NO: 138392 - DNA, 11 bp, Unknown
  misc_feature (1)..( 11): Result.003 file - promoters60/4768856
aaggttttttt

SEQ ID NO: 138393 - DNA, 10 bp, Unknown
  misc_feature (1)..( 10): Result.003 file - promoters60/4768856
taataaaaaa

SEQ ID NO: 138394 - DNA, 10 bp, Unknown
  misc_feature (1)..( 10): Result.003 file - promoters60/4768856
taattaaaaa

SEQ ID NO: 138395 - DNA, 10 bp, Unknown
  misc_feature (1)..( 10): Result.003 file - promoters60/4768856
acataaaatc

SEQ ID NO: 138396 - DNA, 10 bp, Unknown
  misc_feature (1)..( 10): Result.003 file - promoters60/4768856
agccaaaaaa

SEQ ID NO: 138397 - DNA, 10 bp, Unknown
  misc_feature (1)..( 10): Result.003 file - promoters60/4768856
gagtaacaac

SEQ ID NO: 138398 - DNA, 10 bp, Unknown
  misc_feature (1)..( 10): Result.003 file - promoters60/4768856
cagtaaataa

SEQ ID NO: 138399 - DNA, 6 bp, Unknown
  misc_feature (1)..( 6): Result.003 file - promoters60/4768928
gtttca

SEQ ID NO: 138400 - DNA, 6 bp, Unknown
  misc_feature (1)..( 6): Result.003 file - promoters60/4768928
gtttca

SEQ ID NO: 138401 - DNA, 8 bp, Unknown
  misc_feature (1)..( 8): Result.003 file - promoters60/4768928
ttcagatc

SEQ ID NO: 138402 - DNA, 8 bp, Unknown
  misc_feature (1)..( 8): Result.003 file - promoters60/4768928
ttcatatc

SEQ ID NO: 138403 - DNA, 10 bp, Unknown
  misc_feature (1)..( 10): Result.003 file - promoters60/4768928
tagttgtgtt

SEQ ID NO: 138404 - DNA, 10 bp, Unknown
  misc_feature (1)..( 10): Result.003 file - promoters60/4768928
tagatgtgtt

SEQ ID NO: 138405 - DNA, 6 bp, Unknown
  misc_feature (1)..( 6): Result.003 file - promoters60/4768928
gcaata

SEQ ID NO: 138406 - DNA, 6 bp, Unknown
  misc_feature (1)..( 6): Result.003 file - promoters60/4768928
gcaata

SEQ ID NO: 138407 - DNA, 8 bp, Unknown
  misc_feature (1)..( 8): Result.003 file - promoters60/4768928
aaagaaaa

SEQ ID NO: 138408 - DNA, 8 bp, Unknown
  misc_feature (1)..( 8): Result.003 file - promoters60/4768928
aaagaaag

SEQ ID NO: 138409 - DNA, 8 bp, Unknown
  misc_feature (1)..( 8): Result.003 file - promoters60/4768928
aaacaaaa

SEQ ID NO: 138410 - DNA, 10 bp, Unknown
  misc_feature (1)..( 10): Result.003 file - promoters60/4768928
aaagaaaaga

SEQ ID NO: 138411 - DNA, 10 bp, Unknown
  misc_feature (1)..( 10): Result.003 file - promoters60/4768928
ttggaaaaga

SEQ ID NO: 138412 - DNA, 10 bp, Unknown
  misc_feature (1)..( 10): Result.003 file - promoters60/4768928
aaacaaaaac

SEQ ID NO: 138413 - DNA, 8 bp, Unknown
  misc_feature (1)..( 8): Result.003 file - promoters60/4768928
agatttta

SEQ ID NO: 138414 - DNA, 8 bp, Unknown
  misc_feature (1)..( 8): Result.003 file - promoters60/4768928
agaattta

SEQ ID NO: 138415 - DNA, 9 bp, Unknown
  misc_feature (1)..( 9): Result.003 file - promoters60/4768928
agaaatttg

SEQ ID NO: 138416 - DNA, 9 bp, Unknown
  misc_feature (1)..( 9): Result.003 file - promoters60/4768928
agatatttg

SEQ ID NO: 138417 - DNA, 8 bp, Unknown
  misc_feature (1)..( 8): Result.003 file - promoters60/4768928
tgtttgaa

SEQ ID NO: 138418 - DNA, 8 bp, Unknown
  misc_feature (1)..( 8): Result.003 file - promoters60/4768928
tgttggaa

SEQ ID NO: 138419 - DNA, 11 bp, Unknown
  misc_feature (1)..( 11): Result.003 file - promoters60/4768928
agtgcaagata

SEQ ID NO: 138420 - DNA, 11 bp, Unknown
  misc_feature (1)..( 11): Result.003 file - promoters60/4768928
agtgaaagata

SEQ ID NO: 138421 - DNA, 7 bp, Unknown
  misc_feature (1)..( 7): Result.003 file - promoters60/4768928
aaattta

SEQ ID NO: 138422 - DNA, 7 bp, Unknown
  misc_feature (1)..( 7): Result.003 file - promoters60/4768928
aaactta

SEQ ID NO: 138423 - DNA, 6 bp, Unknown
  misc_feature (1)..( 6): Result.003 file - promoters60/4768928
taataa

SEQ ID NO: 138424 - DNA, 6 bp, Unknown
  misc_feature (1)..( 6): Result.003 file - promoters60/4768928
taataa

SEQ ID NO: 138425 - DNA, 6 bp, Unknown
  misc_feature (1)..( 6): Result.003 file - promoters60/4768928
agtaaa

SEQ ID NO: 138426 - DNA, 6 bp, Unknown
  misc_feature (1)..( 6): Result.003 file - promoters60/4768928
agtaaa

SEQ ID NO: 138427 - DNA, 7 bp, Unknown
  misc_feature (1)..( 7): Result.003 file - promoters60/4768928
aatcggg

SEQ ID NO: 138428 - DNA, 7 bp, Unknown
  misc_feature (1)..( 7): Result.003 file - promoters60/4768928
aattggg

SEQ ID NO: 138429 - DNA, 10 bp, Unknown
  misc_feature (1)..( 10): Result.003 file - promoters60/4768928
aaataaaata

SEQ ID NO: 138430 - DNA, 10 bp, Unknown
  misc_feature (1)..( 10): Result.003 file - promoters60/4768928
aaatgaaata

SEQ ID NO: 138431 - DNA, 7 bp, Unknown
  misc_feature (1)..( 7): Result.003 file - promoters60/4768928
cccacta

SEQ ID NO: 138432 - DNA, 7 bp, Unknown
  misc_feature (1)..( 7): Result.003 file - promoters60/4768928
cccacta

SEQ ID NO: 138433 - DNA, 9 bp, Unknown
  misc_feature (1)..( 9): Result.003 file - promoters60/4768928
aaagaaaag

SEQ ID NO: 138434 - DNA, 9 bp, Unknown
  misc_feature (1)..( 9): Result.003 file - promoters60/4768928
aaagtaaag

SEQ ID NO: 138435 - DNA, 7 bp, Unknown
  misc_feature (1)..( 7): Result.003 file - promoters60/4768928
gtatata

SEQ ID NO: 138436 - DNA, 7 bp, Unknown
  misc_feature (1)..( 7): Result.003 file - promoters60/4768928
gtatata

SEQ ID NO: 138437 - DNA, 8 bp, Unknown
  misc_feature (1)..( 8): Result.003 file - promoters60/4769048
aaatttgg

SEQ ID NO: 138438 - DNA, 8 bp, Unknown
  misc_feature (1)..( 8): Result.003 file - promoters60/4769048
gaatttgg

SEQ ID NO: 138439 - DNA, 8 bp, Unknown
  misc_feature (1)..( 8): Result.003 file - promoters60/4769048
aaatttca

SEQ ID NO: 138440 - DNA, 8 bp, Unknown
  misc_feature (1)..( 8): Result.003 file - promoters60/4769048
aaatttgg

SEQ ID NO: 138441 - DNA, 6 bp, Unknown
  misc_feature (1)..( 6): Result.003 file - promoters60/4769052
ttgtaa

SEQ ID NO: 138442 - DNA, 6 bp, Unknown
  misc_feature (1)..( 6): Result.003 file - promoters60/4769052
ttgtaa

SEQ ID NO: 138443 - DNA, 6 bp, Unknown
  misc_feature (1)..( 6): Result.003 file - promoters60/4769052
cctttt

SEQ ID NO: 138444 - DNA, 6 bp, Unknown
  misc_feature (1)..( 6): Result.003 file - promoters60/4769052
cctttt

SEQ ID NO: 138445 - DNA, 8 bp, Unknown
  misc_feature (1)..( 8): Result.003 file - promoters60/4769052
aatagatc

SEQ ID NO: 138446 - DNA, 8 bp, Unknown
  misc_feature (1)..( 8): Result.003 file - promoters60/4769052
aatcgatc

SEQ ID NO: 138447 - DNA, 8 bp, Unknown
  misc_feature (1)..( 8): Result.003 file - promoters60/4769052
aaaaatta

SEQ ID NO: 138448 - DNA, 8 bp, Unknown
  misc_feature (1)..( 8): Result.003 file - promoters60/4769052
aaacatta

SEQ ID NO: 138449 - DNA, 9 bp, Unknown
  misc_feature (1)..( 9): Result.003 file - promoters60/4769052
ggatcaaat

SEQ ID NO: 138450 - DNA, 9 bp, Unknown
  misc_feature (1)..( 9): Result.003 file - promoters60/4769052
ggataaaat

SEQ ID NO: 138451 - DNA, 6 bp, Unknown
  misc_feature (1)..( 6): Result.003 file - promoters60/4769052
taggtt

SEQ ID NO: 138452 - DNA, 6 bp, Unknown
  misc_feature (1)..( 6): Result.003 file - promoters60/4769052
taggtt

SEQ ID NO: 138453 - DNA, 6 bp, Unknown
  misc_feature (1)..( 6): Result.003 file - promoters60/4769052
aaaaaa

SEQ ID NO: 138454 - DNA, 6 bp, Unknown
  misc_feature (1)..( 6): Result.003 file - promoters60/4769052
aaaaaa

SEQ ID NO: 138455 - DNA, 7 bp, Unknown
  misc_feature (1)..( 7): Result.003 file - promoters60/4769052
attaaca

SEQ ID NO: 138456 - DNA, 7 bp, Unknown
  misc_feature (1)..( 7): Result.003 file - promoters60/4769052
atttaca

SEQ ID NO: 138457 - DNA, 6 bp, Unknown
  misc_feature (1)..( 6): Result.003 file - promoters60/4769052
gaaatt

SEQ ID NO: 138458 - DNA, 6 bp, Unknown
  misc_feature (1)..( 6): Result.003 file - promoters60/4769052
gaaatt

SEQ ID NO: 138459 - DNA, 7 bp, Unknown
  misc_feature (1)..( 7): Result.003 file - promoters60/4769052
atctcag

SEQ ID NO: 138460 - DNA, 7 bp, Unknown
  misc_feature (1)..( 7): Result.003 file - promoters60/4769052
atctcag

SEQ ID NO: 138461 - DNA, 7 bp, Unknown
  misc_feature (1)..( 7): Result.003 file - promoters60/4769052
caaaaca

SEQ ID NO: 138462 - DNA, 7 bp, Unknown
  misc_feature (1)..( 7): Result.003 file - promoters60/4769052
caaaaca

SEQ ID NO: 138463 - DNA, 7 bp, Unknown
  misc_feature (1)..( 7): Result.003 file - promoters60/4769052
aacactc

SEQ ID NO: 138464 - DNA, 7 bp, Unknown
  misc_feature (1)..( 7): Result.003 file - promoters60/4769052
aaccctc

SEQ ID NO: 138465 - DNA, 7 bp, Unknown
  misc_feature (1)..( 7): Result.003 file - promoters60/4769052
tatctcg

SEQ ID NO: 138466 - DNA, 7 bp, Unknown
  misc_feature (1)..( 7): Result.003 file - promoters60/4769052
tatttcg

SEQ ID NO: 138467 - DNA, 6 bp, Unknown
  misc_feature (1)..( 6): Result.003 file - promoters60/4769052
catcca

SEQ ID NO: 138468 - DNA, 6 bp, Unknown
  misc_feature (1)..( 6): Result.003 file - promoters60/4769052
catcca

SEQ ID NO: 138469 - DNA, 6 bp, Unknown
  misc_feature (1)..( 6): Result.003 file - promoters60/4769052
aatcca

SEQ ID NO: 138470 - DNA, 6 bp, Unknown
  misc_feature (1)..( 6): Result.003 file - promoters60/4769052
aatcca

SEQ ID NO: 138471 - DNA, 7 bp, Unknown
  misc_feature (1)..( 7): Result.003 file - promoters60/4769052
tattatc

SEQ ID NO: 138472 - DNA, 7 bp, Unknown
  misc_feature (1)..( 7): Result.003 file - promoters60/4769052
tattatc

SEQ ID NO: 138473 - DNA, 7 bp, Unknown
  misc_feature (1)..( 7): Result.003 file - promoters60/4769055
aatagga

SEQ ID NO: 138474 - DNA, 7 bp, Unknown
  misc_feature (1)..( 7): Result.003 file - promoters60/4769055
aatagga

SEQ ID NO: 138475 - DNA, 9 bp, Unknown
  misc_feature (1)..( 9): Result.003 file - promoters60/4769055
tagaaatac

SEQ ID NO: 138476 - DNA, 9 bp, Unknown
  misc_feature (1)..( 9): Result.003 file - promoters60/4769055
tagcaatac

SEQ ID NO: 138477 - DNA, 9 bp, Unknown
  misc_feature (1)..( 9): Result.003 file - promoters60/4769055
gaaagttaa

SEQ ID NO: 138478 - DNA, 9 bp, Unknown
  misc_feature (1)..( 9): Result.003 file - promoters60/4769055
gaaggtttt

SEQ ID NO: 138479 - DNA, 9 bp, Unknown
  misc_feature (1)..( 9): Result.003 file - promoters60/4769055
caaaattaa

SEQ ID NO: 138480 - DNA, 6 bp, Unknown
  misc_feature (1)..( 6): Result.003 file - promoters60/4769055
aatttt

SEQ ID NO: 138481 - DNA, 6 bp, Unknown
  misc_feature (1)..( 6): Result.003 file - promoters60/4769055
aatttt

SEQ ID NO: 138482 - DNA, 8 bp, Unknown
  misc_feature (1)..( 8): Result.003 file - promoters60/4769055
tttaaatt

SEQ ID NO: 138483 - DNA, 8 bp, Unknown
  misc_feature (1)..( 8): Result.003 file - promoters60/4769055
tttcaatt

SEQ ID NO: 138484 - DNA, 6 bp, Unknown
  misc_feature (1)..( 6): Result.003 file - promoters60/4769055
cctaaa

SEQ ID NO: 138485 - DNA, 6 bp, Unknown
  misc_feature (1)..( 6): Result.003 file - promoters60/4769055
cctaaa

SEQ ID NO: 138486 - DNA, 11 bp, Unknown
  misc_feature (1)..( 11): Result.003 file - promoters60/4769055
taaaatattga

SEQ ID NO: 138487 - DNA, 11 bp, Unknown
  misc_feature (1)..( 11): Result.003 file - promoters60/4769055
taaattattga

SEQ ID NO: 138488 - DNA, 12 bp, Unknown
  misc_feature (1)..( 12): Result.003 file - promoters60/4769055
gaaaagcaaaac

SEQ ID NO: 138489 - DNA, 12 bp, Unknown
  misc_feature (1)..( 12): Result.003 file - promoters60/4769055
gaagagcaaaac

SEQ ID NO: 138490 - DNA, 9 bp, Unknown
  misc_feature (1)..( 9): Result.003 file - promoters60/4769055
ttaaatttt

SEQ ID NO: 138491 - DNA, 9 bp, Unknown
  misc_feature (1)..( 9): Result.003 file - promoters60/4769055
ttaattttt

SEQ ID NO: 138492 - DNA, 7 bp, Unknown
  misc_feature (1)..( 7): Result.003 file - promoters60/4769055
caattgt

SEQ ID NO: 138493 - DNA, 7 bp, Unknown
  misc_feature (1)..( 7): Result.003 file - promoters60/4769055
caagtgt

SEQ ID NO: 138494 - DNA, 7 bp, Unknown
  misc_feature (1)..( 7): Result.003 file - promoters60/4769055
ctgattt

SEQ ID NO: 138495 - DNA, 7 bp, Unknown
  misc_feature (1)..( 7): Result.003 file - promoters60/4769055
ctgtttt

SEQ ID NO: 138496 - DNA, 6 bp, Unknown
  misc_feature (1)..( 6): Result.003 file - promoters60/4769055
tcttcc

SEQ ID NO: 138497 - DNA, 6 bp, Unknown
  misc_feature (1)..( 6): Result.003 file - promoters60/4769055
tcttcc

SEQ ID NO: 138498 - DNA, 8 bp, Unknown
  misc_feature (1)..( 8): Result.003 file - promoters60/4769055
ctctctcg

SEQ ID NO: 138499 - DNA, 8 bp, Unknown
  misc_feature (1)..( 8): Result.003 file - promoters60/4769055
ctctctcg

SEQ ID NO: 138500 - DNA, 6 bp, Unknown
  misc_feature (1)..( 6): Result.003 file - promoters60/4769059
aaagaa

SEQ ID NO: 138501 - DNA, 6 bp, Unknown
  misc_feature (1)..( 6): Result.003 file - promoters60/4769059
aaagaa

SEQ ID NO: 138502 - DNA, 7 bp, Unknown
  misc_feature (1)..( 7): Result.003 file - promoters60/4769059
tccacca

SEQ ID NO: 138503 - DNA, 7 bp, Unknown
  misc_feature (1)..( 7): Result.003 file - promoters60/4769059
tcctcca

SEQ ID NO: 138504 - DNA, 7 bp, Unknown
  misc_feature (1)..( 7): Result.003 file - promoters60/4769059
tactgca

SEQ ID NO: 138505 - DNA, 7 bp, Unknown
  misc_feature (1)..( 7): Result.003 file - promoters60/4769059
taccgca

SEQ ID NO: 138506 - DNA, 6 bp, Unknown
  misc_feature (1)..( 6): Result.003 file - promoters60/4769059
tgacgg

SEQ ID NO: 138507 - DNA, 6 bp, Unknown
  misc_feature (1)..( 6): Result.003 file - promoters60/4769059
tgacgg

SEQ ID NO: 138508 - DNA, 8 bp, Unknown
  misc_feature (1)..( 8): Result.003 file - promoters60/4769059
aagggaat

SEQ ID NO: 138509 - DNA, 8 bp, Unknown
  misc_feature (1)..( 8): Result.003 file - promoters60/4769059
aagcgaat

SEQ ID NO: 138510 - DNA, 12 bp, Unknown
  misc_feature (1)..( 12): Result.003 file - promoters60/4769059
ctatctctttat

SEQ ID NO: 138511 - DNA, 12 bp, Unknown
  misc_feature (1)..( 12): Result.003 file - promoters60/4769059
ttatatctgtat

SEQ ID NO: 138512 - DNA, 12 bp, Unknown
  misc_feature (1)..( 12): Result.003 file - promoters60/4769059
ttagatcgtacc

SEQ ID NO: 138513 - DNA, 9 bp, Unknown
  misc_feature (1)..( 9): Result.003 file - promoters60/4769059
gtgttcatt

SEQ ID NO: 138514 - DNA, 9 bp, Unknown
  misc_feature (1)..( 9): Result.003 file - promoters60/4769059
gtgttgatt

SEQ ID NO: 138515 - DNA, 8 bp, Unknown
  misc_feature (1)..( 8): Result.003 file - promoters60/4769059
tggtcagt

SEQ ID NO: 138516 - DNA, 8 bp, Unknown
  misc_feature (1)..( 8): Result.003 file - promoters60/4769059
tggtgagt

SEQ ID NO: 138517 - DNA, 6 bp, Unknown
  misc_feature (1)..( 6): Result.003 file - promoters60/4769059
gttctc

SEQ ID NO: 138518 - DNA, 6 bp, Unknown
  misc_feature (1)..( 6): Result.003 file - promoters60/4769059
gttctc

SEQ ID NO: 138519 - DNA, 6 bp, Unknown
  misc_feature (1)..( 6): Result.003 file - promoters60/4769059
cctttt

SEQ ID NO: 138520 - DNA, 6 bp, Unknown
  misc_feature (1)..( 6): Result.003 file - promoters60/4769059
cctttt

SEQ ID NO: 138521 - DNA, 6 bp, Unknown
  misc_feature (1)..( 6): Result.003 file - promoters60/4769059
tcttta

SEQ ID NO: 138522 - DNA, 6 bp, Unknown
  misc_feature (1)..( 6): Result.003 file - promoters60/4769059
tcttta

SEQ ID NO: 138523 - DNA, 7 bp, Unknown
  misc_feature (1)..( 7): Result.003 file - promoters60/4769059
tggagtc

SEQ ID NO: 138524 - DNA, 7 bp, Unknown
  misc_feature (1)..( 7): Result.003 file - promoters60/4769059
tggagtc

SEQ ID NO: 138525 - DNA, 7 bp, Unknown
  misc_feature (1)..( 7): Result.003 file - promoters60/4769059
tatcatt

SEQ ID NO: 138526 - DNA, 7 bp, Unknown
  misc_feature (1)..( 7): Result.003 file - promoters60/4769059
tatgatt

SEQ ID NO: 138527 - DNA, 7 bp, Unknown
  misc_feature (1)..( 7): Result.003 file - promoters60/4769059
gaatttg

SEQ ID NO: 138528 - DNA, 7 bp, Unknown
  misc_feature (1)..( 7): Result.003 file - promoters60/4769059
gaatttg

SEQ ID NO: 138529 - DNA, 7 bp, Unknown
  misc_feature (1)..( 7): Result.003 file - promoters60/4769059
tttgatt

SEQ ID NO: 138530 - DNA, 7 bp, Unknown
  misc_feature (1)..( 7): Result.003 file - promoters60/4769059
tttgatt

SEQ ID NO: 138531 - DNA, 6 bp, Unknown
  misc_feature (1)..( 6): Result.003 file - promoters60/4769059
catttg

SEQ ID NO: 138532 - DNA, 6 bp, Unknown
  misc_feature (1)..( 6): Result.003 file - promoters60/4769059
catttg

SEQ ID NO: 138533 - DNA, 6 bp, Unknown
  misc_feature (1)..( 6): Result.003 file - promoters60/4769075
ataaat

SEQ ID NO: 138534 - DNA, 6 bp, Unknown
  misc_feature (1)..( 6): Result.003 file - promoters60/4769075
ataaat

SEQ ID NO: 138535 - DNA, 6 bp, Unknown
  misc_feature (1)..( 6): Result.003 file - promoters60/4769075
aaacca

SEQ ID NO: 138536 - DNA, 6 bp, Unknown
  misc_feature (1)..( 6): Result.003 file - promoters60/4769075
aaacca

SEQ ID NO: 138537 - DNA, 13 bp, Unknown
  misc_feature (1)..( 13): Result.003 file - promoters60/4769075
acactatactgta

SEQ ID NO: 138538 - DNA, 13 bp, Unknown
  misc_feature (1)..( 13): Result.003 file - promoters60/4769075
aaactttacattc

SEQ ID NO: 138539 - DNA, 13 bp, Unknown
  misc_feature (1)..( 13): Result.003 file - promoters60/4769075
caactctattctg

SEQ ID NO: 138540 - DNA, 6 bp, Unknown
  misc_feature (1)..( 6): Result.003 file - promoters60/4769075
tttgat

SEQ ID NO: 138541 - DNA, 6 bp, Unknown
  misc_feature (1)..( 6): Result.003 file - promoters60/4769075
tttgat

SEQ ID NO: 138542 - DNA, 7 bp, Unknown
  misc_feature (1)..( 7): Result.003 file - promoters60/4769075
atgtgct

SEQ ID NO: 138543 - DNA, 7 bp, Unknown
  misc_feature (1)..( 7): Result.003 file - promoters60/4769075
atgcgct

SEQ ID NO: 138544 - DNA, 6 bp, Unknown
  misc_feature (1)..( 6): Result.003 file - promoters60/4769075
caatta

SEQ ID NO: 138545 - DNA, 6 bp, Unknown
  misc_feature (1)..( 6): Result.003 file - promoters60/4769075
caatta

SEQ ID NO: 138546 - DNA, 6 bp, Unknown
  misc_feature (1)..( 6): Result.003 file - promoters60/4769075
caattt

SEQ ID NO: 138547 - DNA, 6 bp, Unknown
  misc_feature (1)..( 6): Result.003 file - promoters60/4769075
caattt

SEQ ID NO: 138548 - DNA, 7 bp, Unknown
  misc_feature (1)..( 7): Result.003 file - promoters60/4769075
tttcact

SEQ ID NO: 138549 - DNA, 7 bp, Unknown
  misc_feature (1)..( 7): Result.003 file - promoters60/4769075
tttcact

SEQ ID NO: 138550 - DNA, 6 bp, Unknown
  misc_feature (1)..( 6): Result.003 file - promoters60/4769075
tctaaa

SEQ ID NO: 138551 - DNA, 6 bp, Unknown
  misc_feature (1)..( 6): Result.003 file - promoters60/4769075
tctaaa

SEQ ID NO: 138552 - DNA, 8 bp, Unknown
  misc_feature (1)..( 8): Result.003 file - promoters60/4769075
attttcta

SEQ ID NO: 138553 - DNA, 8 bp, Unknown
  misc_feature (1)..( 8): Result.003 file - promoters60/4769075
attttcta

SEQ ID NO: 138554 - DNA, 9 bp, Unknown
  misc_feature (1)..( 9): Result.003 file - promoters60/4769075
taaaatccg

SEQ ID NO: 138555 - DNA, 9 bp, Unknown
  misc_feature (1)..( 9): Result.003 file - promoters60/4769075
taaaagccg

SEQ ID NO: 138556 - DNA, 9 bp, Unknown
  misc_feature (1)..( 9): Result.003 file - promoters60/4769075
gaagtattt

SEQ ID NO: 138557 - DNA, 9 bp, Unknown
  misc_feature (1)..( 9): Result.003 file - promoters60/4769075
gaaggattt

SEQ ID NO: 138558 - DNA, 6 bp, Unknown
  misc_feature (1)..( 6): Result.003 file - promoters60/4769075
aaacca

SEQ ID NO: 138559 - DNA, 6 bp, Unknown
  misc_feature (1)..( 6): Result.003 file - promoters60/4769075
aaacca

SEQ ID NO: 138560 - DNA, 7 bp, Unknown
  misc_feature (1)..( 7): Result.003 file - promoters60/4769075
aaataaa

SEQ ID NO: 138561 - DNA, 7 bp, Unknown
  misc_feature (1)..( 7): Result.003 file - promoters60/4769075
aaagaaa

SEQ ID NO: 138562 - DNA, 6 bp, Unknown
  misc_feature (1)..( 6): Result.003 file - promoters60/4769075
tgattt

SEQ ID NO: 138563 - DNA, 6 bp, Unknown
  misc_feature (1)..( 6): Result.003 file - promoters60/4769075
tgattt

SEQ ID NO: 138564 - DNA, 7 bp, Unknown
  misc_feature (1)..( 7): Result.003 file - promoters60/4769075
tgaccaa

SEQ ID NO: 138565 - DNA, 7 bp, Unknown
  misc_feature (1)..( 7): Result.003 file - promoters60/4769075
tgatcaa

SEQ ID NO: 138566 - DNA, 7 bp, Unknown
  misc_feature (1)..( 7): Result.003 file - promoters60/4769083
gagccac

SEQ ID NO: 138567 - DNA, 7 bp, Unknown
  misc_feature (1)..( 7): Result.003 file - promoters60/4769083
gagtcac

SEQ ID NO: 138568 - DNA, 9 bp, Unknown
  misc_feature (1)..( 9): Result.003 file - promoters60/4769083
ttaatttat

SEQ ID NO: 138569 - DNA, 9 bp, Unknown
  misc_feature (1)..( 9): Result.003 file - promoters60/4769083
ttatttttg

SEQ ID NO: 138570 - DNA, 9 bp, Unknown
  misc_feature (1)..( 9): Result.003 file - promoters60/4769083
taaatttat

SEQ ID NO: 138571 - DNA, 7 bp, Unknown
  misc_feature (1)..( 7): Result.003 file - promoters60/4769083
aatttat

SEQ ID NO: 138572 - DNA, 7 bp, Unknown
  misc_feature (1)..( 7): Result.003 file - promoters60/4769083
catttat

SEQ ID NO: 138573 - DNA, 7 bp, Unknown
  misc_feature (1)..( 7): Result.003 file - promoters60/4769083
aatttat

SEQ ID NO: 138574 - DNA, 6 bp, Unknown
  misc_feature (1)..( 6): Result.003 file - promoters60/4769083
aagctc

SEQ ID NO: 138575 - DNA, 6 bp, Unknown
  misc_feature (1)..( 6): Result.003 file - promoters60/4769083
aagctc

SEQ ID NO: 138576 - DNA, 7 bp, Unknown
  misc_feature (1)..( 7): Result.003 file - promoters60/4769083
ctctcat

SEQ ID NO: 138577 - DNA, 7 bp, Unknown
  misc_feature (1)..( 7): Result.003 file - promoters60/4769083
ctcacat

SEQ ID NO: 138578 - DNA, 7 bp, Unknown
  misc_feature (1)..( 7): Result.003 file - promoters60/4769083
taaaata

SEQ ID NO: 138579 - DNA, 7 bp, Unknown
  misc_feature (1)..( 7): Result.003 file - promoters60/4769083
aaaaata

SEQ ID NO: 138580 - DNA, 7 bp, Unknown
  misc_feature (1)..( 7): Result.003 file - promoters60/4769083
taaaatg

SEQ ID NO: 138581 - DNA, 12 bp, Unknown
  misc_feature (1)..( 12): Result.003 file - promoters60/4769083
gtttggtttata

SEQ ID NO: 138582 - DNA, 12 bp, Unknown
  misc_feature (1)..( 12): Result.003 file - promoters60/4769083
gttaggttgata

SEQ ID NO: 138583 - DNA, 9 bp, Unknown
  misc_feature (1)..( 9): Result.003 file - promoters60/4769083
taaagaaaa

SEQ ID NO: 138584 - DNA, 9 bp, Unknown
  misc_feature (1)..( 9): Result.003 file - promoters60/4769083
taaagaaaa

SEQ ID NO: 138585 - DNA, 9 bp, Unknown
  misc_feature (1)..( 9): Result.003 file - promoters60/4769083
aaaagtaaa

SEQ ID NO: 138586 - DNA, 8 bp, Unknown
  misc_feature (1)..( 8): Result.003 file - promoters60/4769083
aaaataaa

SEQ ID NO: 138587 - DNA, 8 bp, Unknown
  misc_feature (1)..( 8): Result.003 file - promoters60/4769083
aaattaaa

SEQ ID NO: 138588 - DNA, 8 bp, Unknown
  misc_feature (1)..( 8): Result.003 file - promoters60/4769083
aaagtaaa

SEQ ID NO: 138589 - DNA, 6 bp, Unknown
  misc_feature (1)..( 6): Result.003 file - promoters60/4769083
aaaata

SEQ ID NO: 138590 - DNA, 6 bp, Unknown
  misc_feature (1)..( 6): Result.003 file - promoters60/4769083
aaaata

SEQ ID NO: 138591 - DNA, 9 bp, Unknown
  misc_feature (1)..( 9): Result.003 file - promoters60/4769083
ttcttaacc

SEQ ID NO: 138592 - DNA, 9 bp, Unknown
  misc_feature (1)..( 9): Result.003 file - promoters60/4769083
ttctcaacc

SEQ ID NO: 138593 - DNA, 8 bp, Unknown
  misc_feature (1)..( 8): Result.003 file - promoters60/4769083
tatctata

SEQ ID NO: 138594 - DNA, 8 bp, Unknown
  misc_feature (1)..( 8): Result.003 file - promoters60/4769083
tatatata

SEQ ID NO: 138595 - DNA, 7 bp, Unknown
  misc_feature (1)..( 7): Result.003 file - promoters60/4769083
ccaaaaa

SEQ ID NO: 138596 - DNA, 7 bp, Unknown
  misc_feature (1)..( 7): Result.003 file - promoters60/4769083
ccaaaaa

SEQ ID NO: 138597 - DNA, 11 bp, Unknown
  misc_feature (1)..( 11): Result.003 file - promoters60/4769083
attcaaagcaa

SEQ ID NO: 138598 - DNA, 11 bp, Unknown
  misc_feature (1)..( 11): Result.003 file - promoters60/4769083
attaaaatcaa

SEQ ID NO: 138599 - DNA, 8 bp, Unknown
  misc_feature (1)..( 8): Result.003 file - promoters60/4769083
ctacaaat

SEQ ID NO: 138600 - DNA, 8 bp, Unknown
  misc_feature (1)..( 8): Result.003 file - promoters60/4769083
ctaaaaat

SEQ ID NO: 138601 - DNA, 8 bp, Unknown
  misc_feature (1)..( 8): Result.003 file - promoters60/4769083
ataaaaaa

SEQ ID NO: 138602 - DNA, 6 bp, Unknown
  misc_feature (1)..( 6): Result.003 file - promoters60/4769083
aaatgt

SEQ ID NO: 138603 - DNA, 6 bp, Unknown
  misc_feature (1)..( 6): Result.003 file - promoters60/4769083
aaatgt

SEQ ID NO: 138604 - DNA, 9 bp, Unknown
  misc_feature (1)..( 9): Result.003 file - promoters60/4769083
aaaaacaaa

SEQ ID NO: 138605 - DNA, 9 bp, Unknown
  misc_feature (1)..( 9): Result.003 file - promoters60/4769083
aaaaagaaa

SEQ ID NO: 138606 - DNA, 7 bp, Unknown
  misc_feature (1)..( 7): Result.003 file - promoters60/4769083
atcccaa

SEQ ID NO: 138607 - DNA, 7 bp, Unknown
  misc_feature (1)..( 7): Result.003 file - promoters60/4769083
atcacaa

SEQ ID NO: 138608 - DNA, 8 bp, Unknown
  misc_feature (1)..( 8): Result.003 file - promoters60/4769083
aagtatcc

SEQ ID NO: 138609 - DNA, 8 bp, Unknown
  misc_feature (1)..( 8): Result.003 file - promoters60/4769083
aagaatcc

SEQ ID NO: 138610 - DNA, 8 bp, Unknown
  misc_feature (1)..( 8): Result.003 file - promoters60/4769083
tataaaac

SEQ ID NO: 138611 - DNA, 8 bp, Unknown
  misc_feature (1)..( 8): Result.003 file - promoters60/4769083
tataaaac

SEQ ID NO: 138612 - DNA, 6 bp, Unknown
  misc_feature (1)..( 6): Result.003 file - promoters60/4769083
atgttt

SEQ ID NO: 138613 - DNA, 6 bp, Unknown
  misc_feature (1)..( 6): Result.003 file - promoters60/4769083
atgttt

SEQ ID NO: 138614 - DNA, 7 bp, Unknown
  misc_feature (1)..( 7): Result.003 file - promoters60/4769083
taataat

SEQ ID NO: 138615 - DNA, 7 bp, Unknown
  misc_feature (1)..( 7): Result.003 file - promoters60/4769083
taaaaat

SEQ ID NO: 138616 - DNA, 7 bp, Unknown
  misc_feature (1)..( 7): Result.003 file - promoters60/4769083
atcatca

SEQ ID NO: 138617 - DNA, 7 bp, Unknown
  misc_feature (1)..( 7): Result.003 file - promoters60/4769083
atcttca

SEQ ID NO: 138618 - DNA, 6 bp, Unknown
  misc_feature (1)..( 6): Result.003 file - promoters60/4769107
ttgttt

SEQ ID NO: 138619 - DNA, 6 bp, Unknown
  misc_feature (1)..( 6): Result.003 file - promoters60/4769107
ttgttt

SEQ ID NO: 138620 - DNA, 6 bp, Unknown
  misc_feature (1)..( 6): Result.003 file - promoters60/4769107
atatat

SEQ ID NO: 138621 - DNA, 6 bp, Unknown
  misc_feature (1)..( 6): Result.003 file - promoters60/4769107
atatat

SEQ ID NO: 138622 - DNA, 6 bp, Unknown
  misc_feature (1)..( 6): Result.003 file - promoters60/4769107
attttt

SEQ ID NO: 138623 - DNA, 6 bp, Unknown
  misc_feature (1)..( 6): Result.003 file - promoters60/4769107
attttt

SEQ ID NO: 138624 - DNA, 8 bp, Unknown
  misc_feature (1)..( 8): Result.003 file - promoters60/4769107
aaacaaaa

SEQ ID NO: 138625 - DNA, 8 bp, Unknown
  misc_feature (1)..( 8): Result.003 file - promoters60/4769107
aaacaatt

SEQ ID NO: 138626 - DNA, 8 bp, Unknown
  misc_feature (1)..( 8): Result.003 file - promoters60/4769107
aaacaaaa

SEQ ID NO: 138627 - DNA, 7 bp, Unknown
  misc_feature (1)..( 7): Result.003 file - promoters60/4769107
aataaac

SEQ ID NO: 138628 - DNA, 7 bp, Unknown
  misc_feature (1)..( 7): Result.003 file - promoters60/4769107
aattaac

SEQ ID NO: 138629 - DNA, 6 bp, Unknown
  misc_feature (1)..( 6): Result.003 file - promoters60/4769107
tttatt

SEQ ID NO: 138630 - DNA, 6 bp, Unknown
  misc_feature (1)..( 6): Result.003 file - promoters60/4769107
tttatt

SEQ ID NO: 138631 - DNA, 6 bp, Unknown
  misc_feature (1)..( 6): Result.003 file - promoters60/4769107
attaaa

SEQ ID NO: 138632 - DNA, 6 bp, Unknown
  misc_feature (1)..( 6): Result.003 file - promoters60/4769107
attaaa

SEQ ID NO: 138633 - DNA, 6 bp, Unknown
  misc_feature (1)..( 6): Result.003 file - promoters60/4769107
attaca

SEQ ID NO: 138634 - DNA, 6 bp, Unknown
  misc_feature (1)..( 6): Result.003 file - promoters60/4769107
attaca

SEQ ID NO: 138635 - DNA, 6 bp, Unknown
  misc_feature (1)..( 6): Result.003 file - promoters60/4769107
tatatt

SEQ ID NO: 138636 - DNA, 6 bp, Unknown
  misc_feature (1)..( 6): Result.003 file - promoters60/4769107
tatatt

SEQ ID NO: 138637 - DNA, 12 bp, Unknown
  misc_feature (1)..( 12): Result.003 file - promoters60/4769107
tatatatattgc

SEQ ID NO: 138638 - DNA, 12 bp, Unknown
  misc_feature (1)..( 12): Result.003 file - promoters60/4769107
tatatataatgc

SEQ ID NO: 138639 - DNA, 10 bp, Unknown
  misc_feature (1)..( 10): Result.003 file - promoters60/4769107
tttctatatt

SEQ ID NO: 138640 - DNA, 10 bp, Unknown
  misc_feature (1)..( 10): Result.003 file - promoters60/4769107
tttttatatt

SEQ ID NO: 138641 - DNA, 10 bp, Unknown
  misc_feature (1)..( 10): Result.003 file - promoters60/4769107
cttttatcat

SEQ ID NO: 138642 - DNA, 7 bp, Unknown
  misc_feature (1)..( 7): Result.003 file - promoters60/4769107
aacatta

SEQ ID NO: 138643 - DNA, 7 bp, Unknown
  misc_feature (1)..( 7): Result.003 file - promoters60/4769107
aacttta

SEQ ID NO: 138644 - DNA, 10 bp, Unknown
  misc_feature (1)..( 10): Result.003 file - promoters60/4769107
caaaataaat

SEQ ID NO: 138645 - DNA, 10 bp, Unknown
  misc_feature (1)..( 10): Result.003 file - promoters60/4769107
aaaaacaaat

SEQ ID NO: 138646 - DNA, 10 bp, Unknown
  misc_feature (1)..( 10): Result.003 file - promoters60/4769107
aaaaacaatt

SEQ ID NO: 138647 - DNA, 8 bp, Unknown
  misc_feature (1)..( 8): Result.003 file - promoters60/4769107
aaaaaaac

SEQ ID NO: 138648 - DNA, 8 bp, Unknown
  misc_feature (1)..( 8): Result.003 file - promoters60/4769107
aaagaaac

SEQ ID NO: 138649 - DNA, 7 bp, Unknown
  misc_feature (1)..( 7): Result.003 file - promoters60/4769107
accgcag

SEQ ID NO: 138650 - DNA, 7 bp, Unknown
  misc_feature (1)..( 7): Result.003 file - promoters60/4769107
accacag

SEQ ID NO: 138651 - DNA, 8 bp, Unknown
  misc_feature (1)..( 8): Result.003 file - promoters60/4769107
aaacaaaa

SEQ ID NO: 138652 - DNA, 8 bp, Unknown
  misc_feature (1)..( 8): Result.003 file - promoters60/4769107
aaaaaaaa

SEQ ID NO: 138653 - DNA, 6 bp, Unknown
  misc_feature (1)..( 6): Result.003 file - promoters60/4769107
aaaaaa

SEQ ID NO: 138654 - DNA, 6 bp, Unknown
  misc_feature (1)..( 6): Result.003 file - promoters60/4769107
aaaaaa

SEQ ID NO: 138655 - DNA, 7 bp, Unknown
  misc_feature (1)..( 7): Result.003 file - promoters60/4769107
aaagaag

SEQ ID NO: 138656 - DNA, 7 bp, Unknown
  misc_feature (1)..( 7): Result.003 file - promoters60/4769107
aaaaaag

SEQ ID NO: 138657 - DNA, 7 bp, Unknown
  misc_feature (1)..( 7): Result.003 file - promoters60/4769107
ttctttt

SEQ ID NO: 138658 - DNA, 7 bp, Unknown
  misc_feature (1)..( 7): Result.003 file - promoters60/4769107
ttctttt

SEQ ID NO: 138659 - DNA, 6 bp, Unknown
  misc_feature (1)..( 6): Result.003 file - promoters60/4769107
ataaag

SEQ ID NO: 138660 - DNA, 6 bp, Unknown
  misc_feature (1)..( 6): Result.003 file - promoters60/4769107
ataaag

SEQ ID NO: 138661 - DNA, 8 bp, Unknown
  misc_feature (1)..( 8): Result.003 file - promoters60/4769107
cttcgcaa

SEQ ID NO: 138662 - DNA, 8 bp, Unknown
  misc_feature (1)..( 8): Result.003 file - promoters60/4769107
cttctcaa

SEQ ID NO: 138663 - DNA, 8 bp, Unknown
  misc_feature (1)..( 8): Result.003 file - promoters60/4769107
tttaaaaa

SEQ ID NO: 138664 - DNA, 8 bp, Unknown
  misc_feature (1)..( 8): Result.003 file - promoters60/4769107
tttacaaa

SEQ ID NO: 138665 - DNA, 6 bp, Unknown
  misc_feature (1)..( 6): Result.003 file - promoters60/4769107
tcattt

SEQ ID NO: 138666 - DNA, 6 bp, Unknown
  misc_feature (1)..( 6): Result.003 file - promoters60/4769107
tcattt

SEQ ID NO: 138667 - DNA, 8 bp, Unknown
  misc_feature (1)..( 8): Result.003 file - promoters60/4769107
ttgtttca

SEQ ID NO: 138668 - DNA, 8 bp, Unknown
  misc_feature (1)..( 8): Result.003 file - promoters60/4769107
ttgtttca

SEQ ID NO: 138669 - DNA, 8 bp, Unknown
  misc_feature (1)..( 8): Result.003 file - promoters60/4769107
tctatata

SEQ ID NO: 138670 - DNA, 8 bp, Unknown
  misc_feature (1)..( 8): Result.003 file - promoters60/4769107
tctatata

SEQ ID NO: 138671 - DNA, 6 bp, Unknown
  misc_feature (1)..( 6): Result.003 file - promoters60/4769107
aagata

SEQ ID NO: 138672 - DNA, 6 bp, Unknown
  misc_feature (1)..( 6): Result.003 file - promoters60/4769107
aagata

SEQ ID NO: 138673 - DNA, 11 bp, Unknown
  misc_feature (1)..( 11): Result.003 file - promoters60/4769107
atccaccaccg

SEQ ID NO: 138674 - DNA, 11 bp, Unknown
  misc_feature (1)..( 11): Result.003 file - promoters60/4769107
atccaccaccg

SEQ ID NO: 138675 - DNA, 13 bp, Unknown
  misc_feature (1)..( 13): Result.003 file - promoters60/4769137
accgtcgtgtcaa

SEQ ID NO: 138676 - DNA, 13 bp, Unknown
  misc_feature (1)..( 13): Result.003 file - promoters60/4769137
ttcgttgtgtaat

SEQ ID NO: 138677 - DNA, 13 bp, Unknown
  misc_feature (1)..( 13): Result.003 file - promoters60/4769137
aacgtcgtctagc

SEQ ID NO: 138678 - DNA, 13 bp, Unknown
  misc_feature (1)..( 13): Result.003 file - promoters60/4769137
aacttcgtcgaat

SEQ ID NO: 138679 - DNA, 13 bp, Unknown
  misc_feature (1)..( 13): Result.003 file - promoters60/4769137
gccaatgtctaat

SEQ ID NO: 138680 - DNA, 13 bp, Unknown
  misc_feature (1)..( 13): Result.003 file - promoters60/4769137
atgtttttctaat

SEQ ID NO: 138681 - DNA, 8 bp, Unknown
  misc_feature (1)..( 8): Result.003 file - promoters60/4769137
catatata

SEQ ID NO: 138682 - DNA, 8 bp, Unknown
  misc_feature (1)..( 8): Result.003 file - promoters60/4769137
catataaa

SEQ ID NO: 138683 - DNA, 8 bp, Unknown
  misc_feature (1)..( 8): Result.003 file - promoters60/4769137
gatatata

SEQ ID NO: 138684 - DNA, 8 bp, Unknown
  misc_feature (1)..( 8): Result.003 file - promoters60/4769137
aatataaa

SEQ ID NO: 138685 - DNA, 8 bp, Unknown
  misc_feature (1)..( 8): Result.003 file - promoters60/4769137
actataaa

SEQ ID NO: 138686 - DNA, 8 bp, Unknown
  misc_feature (1)..( 8): Result.003 file - promoters60/4769137
catatatt

SEQ ID NO: 138687 - DNA, 8 bp, Unknown
  misc_feature (1)..( 8): Result.003 file - promoters60/4769141
atttaaat

SEQ ID NO: 138688 - DNA, 8 bp, Unknown
  misc_feature (1)..( 8): Result.003 file - promoters60/4769141
atttcaat

SEQ ID NO: 138689 - DNA, 8 bp, Unknown
  misc_feature (1)..( 8): Result.003 file - promoters60/4769141
attaaaat

SEQ ID NO: 138690 - DNA, 9 bp, Unknown
  misc_feature (1)..( 9): Result.003 file - promoters60/4769141
aaaaactaa

SEQ ID NO: 138691 - DNA, 9 bp, Unknown
  misc_feature (1)..( 9): Result.003 file - promoters60/4769141
aaatactct

SEQ ID NO: 138692 - DNA, 9 bp, Unknown
  misc_feature (1)..( 9): Result.003 file - promoters60/4769141
agaaactaa

SEQ ID NO: 138693 - DNA, 10 bp, Unknown
  misc_feature (1)..( 10): Result.003 file - promoters60/4769141
aaatagttat

SEQ ID NO: 138694 - DNA, 10 bp, Unknown
  misc_feature (1)..( 10): Result.003 file - promoters60/4769141
aaataattat

SEQ ID NO: 138695 - DNA, 11 bp, Unknown
  misc_feature (1)..( 11): Result.003 file - promoters60/4769141
aaactaaagaa

SEQ ID NO: 138696 - DNA, 9 bp, Unknown
  misc_feature (1)..( 9): Result.003 file - promoters60/4769141
ttttctaaa

SEQ ID NO: 138697 - DNA, 9 bp, Unknown
  misc_feature (1)..( 9): Result.003 file - promoters60/4769141
aattcaaaa

SEQ ID NO: 138698 - DNA, 10 bp, Unknown
  misc_feature (1)..( 10): Result.003 file - promoters60/4769141
atttgctact

SEQ ID NO: 138699 - DNA, 11 bp, Unknown
  misc_feature (1)..( 11): Result.003 file - promoters60/4769141
aagaaaaaagt

SEQ ID NO: 138700 - DNA, 11 bp, Unknown
  misc_feature (1)..( 11): Result.003 file - promoters60/4769141
atgaacaaagt

SEQ ID NO: 138701 - DNA, 11 bp, Unknown
  misc_feature (1)..( 11): Result.003 file - promoters60/4769141
aagaaaattaa

SEQ ID NO: 138702 - DNA, 11 bp, Unknown
  misc_feature (1)..( 11): Result.003 file - promoters60/4769141
tatatatccgc

SEQ ID NO: 138703 - DNA, 11 bp, Unknown
  misc_feature (1)..( 11): Result.003 file - promoters60/4769141
tatataatagt

SEQ ID NO: 138704 - DNA, 11 bp, Unknown
  misc_feature (1)..( 11): Result.003 file - promoters60/4769141
tatataaatcc

SEQ ID NO: 138705 - DNA, 11 bp, Unknown
  misc_feature (1)..( 11): Result.003 file - promoters60/4769141
aatataaaatg

SEQ ID NO: 138706 - DNA, 10 bp, Unknown
  misc_feature (1)..( 10): Result.003 file - promoters60/4769141
ctaataaata

SEQ ID NO: 138707 - DNA, 10 bp, Unknown
  misc_feature (1)..( 10): Result.003 file - promoters60/4769141
ttaataaaac

SEQ ID NO: 138708 - DNA, 10 bp, Unknown
  misc_feature (1)..( 10): Result.003 file - promoters60/4769141
tcaataaaat

SEQ ID NO: 138709 - DNA, 10 bp, Unknown
  misc_feature (1)..( 10): Result.003 file - promoters60/4769141
ttagtaaaac

SEQ ID NO: 138710 - DNA, 7 bp, Unknown
  misc_feature (1)..( 7): Result.003 file - promoters60/4769153
aaaatat

SEQ ID NO: 138711 - DNA, 7 bp, Unknown
  misc_feature (1)..( 7): Result.003 file - promoters60/4769153
aaaataa

SEQ ID NO: 138712 - DNA, 7 bp, Unknown
  misc_feature (1)..( 7): Result.003 file - promoters60/4769153
caaatat

SEQ ID NO: 138713 - DNA, 8 bp, Unknown
  misc_feature (1)..( 8): Result.003 file - promoters60/4769153
aaacatat

SEQ ID NO: 138714 - DNA, 8 bp, Unknown
  misc_feature (1)..( 8): Result.003 file - promoters60/4769153
acaaataa

SEQ ID NO: 138715 - DNA, 8 bp, Unknown
  misc_feature (1)..( 8): Result.003 file - promoters60/4769153
caaattaa

SEQ ID NO: 138716 - DNA, 12 bp, Unknown
  misc_feature (1)..( 12): Result.003 file - promoters60/4769153
atgaaaaacaaa

SEQ ID NO: 138717 - DNA, 12 bp, Unknown
  misc_feature (1)..( 12): Result.003 file - promoters60/4769153
ggggaaaaaaaa

SEQ ID NO: 138718 - DNA, 12 bp, Unknown
  misc_feature (1)..( 12): Result.003 file - promoters60/4769153
ttttaaaaaaag

SEQ ID NO: 138719 - DNA, 12 bp, Unknown
  misc_feature (1)..( 12): Result.003 file - promoters60/4769153
agccaaaacatc

SEQ ID NO: 138720 - DNA, 12 bp, Unknown
  misc_feature (1)..( 12): Result.003 file - promoters60/4769153
aaccaaaacgac

SEQ ID NO: 138721 - DNA, 12 bp, Unknown
  misc_feature (1)..( 12): Result.003 file - promoters60/4769153
ttacaaatatga

SEQ ID NO: 138722 - DNA, 9 bp, Unknown
  misc_feature (1)..( 9): Result.003 file - promoters60/4769153
ctacatatt

SEQ ID NO: 138723 - DNA, 9 bp, Unknown
  misc_feature (1)..( 9): Result.003 file - promoters60/4769153
aaacatatt

SEQ ID NO: 138724 - DNA, 9 bp, Unknown
  misc_feature (1)..( 9): Result.003 file - promoters60/4769153
ctacataat

SEQ ID NO: 138725 - DNA, 9 bp, Unknown
  misc_feature (1)..( 9): Result.003 file - promoters60/4769153
aatcatatt

SEQ ID NO: 138726 - DNA, 9 bp, Unknown
  misc_feature (1)..( 9): Result.003 file - promoters60/4769153
ccaaaaata

SEQ ID NO: 138727 - DNA, 9 bp, Unknown
  misc_feature (1)..( 9): Result.003 file - promoters60/4769153
acaaataaa

SEQ ID NO: 138728 - DNA, 13 bp, Unknown
  misc_feature (1)..( 13): Result.003 file - promoters60/4769153
aacccgacagaaa

SEQ ID NO: 138729 - DNA, 13 bp, Unknown
  misc_feature (1)..( 13): Result.003 file - promoters60/4769153
atgttaacaaaaa

SEQ ID NO: 138730 - DNA, 13 bp, Unknown
  misc_feature (1)..( 13): Result.003 file - promoters60/4769153
atattaataaagc

SEQ ID NO: 138731 - DNA, 13 bp, Unknown
  misc_feature (1)..( 13): Result.003 file - promoters60/4769153
cttttaatatgaa

SEQ ID NO: 138732 - DNA, 13 bp, Unknown
  misc_feature (1)..( 13): Result.003 file - promoters60/4769153
acattaaaaaaat

SEQ ID NO: 138733 - DNA, 13 bp, Unknown
  misc_feature (1)..( 13): Result.003 file - promoters60/4769153
acattataaaata

SEQ ID NO: 138734 - DNA, 11 bp, Unknown
  misc_feature (1)..( 11): Result.003 file - promoters60/4769153
atgtcaaccaa

SEQ ID NO: 138735 - DNA, 11 bp, Unknown
  misc_feature (1)..( 11): Result.003 file - promoters60/4769153
atgttaacaaa

SEQ ID NO: 138736 - DNA, 11 bp, Unknown
  misc_feature (1)..( 11): Result.003 file - promoters60/4769153
atattaataaa

SEQ ID NO: 138737 - DNA, 11 bp, Unknown
  misc_feature (1)..( 11): Result.003 file - promoters60/4769153
cttttaatatg

SEQ ID NO: 138738 - DNA, 11 bp, Unknown
  misc_feature (1)..( 11): Result.003 file - promoters60/4769153
acattaaaaaa

SEQ ID NO: 138739 - DNA, 11 bp, Unknown
  misc_feature (1)..( 11): Result.003 file - promoters60/4769153
acattataaaa

SEQ ID NO: 138740 - DNA, 7 bp, Unknown
  misc_feature (1)..( 7): Result.003 file - promoters60/4769169
tccaaaa

SEQ ID NO: 138741 - DNA, 7 bp, Unknown
  misc_feature (1)..( 7): Result.003 file - promoters60/4769169
tcctaaa

SEQ ID NO: 138742 - DNA, 7 bp, Unknown
  misc_feature (1)..( 7): Result.003 file - promoters60/4769169
tccaaac

SEQ ID NO: 138743 - DNA, 9 bp, Unknown
  misc_feature (1)..( 9): Result.003 file - promoters60/4769169
aaaagcaaa

SEQ ID NO: 138744 - DNA, 9 bp, Unknown
  misc_feature (1)..( 9): Result.003 file - promoters60/4769169
aaaaacaac

SEQ ID NO: 138745 - DNA, 9 bp, Unknown
  misc_feature (1)..( 9): Result.003 file - promoters60/4769169
caaaacaaa

SEQ ID NO: 138746 - DNA, 9 bp, Unknown
  misc_feature (1)..( 9): Result.003 file - promoters60/4769169
gaaaacact

SEQ ID NO: 138747 - DNA, 7 bp, Unknown
  misc_feature (1)..( 7): Result.003 file - promoters60/4769169
cccacga

SEQ ID NO: 138748 - DNA, 7 bp, Unknown
  misc_feature (1)..( 7): Result.003 file - promoters60/4769169
tccacga

SEQ ID NO: 138749 - DNA, 7 bp, Unknown
  misc_feature (1)..( 7): Result.003 file - promoters60/4769169
cccacgt

SEQ ID NO: 138750 - DNA, 8 bp, Unknown
  misc_feature (1)..( 8): Result.003 file - promoters60/4769169
aaattata

SEQ ID NO: 138751 - DNA, 8 bp, Unknown
  misc_feature (1)..( 8): Result.003 file - promoters60/4769169
aaaatatc

SEQ ID NO: 138752 - DNA, 8 bp, Unknown
  misc_feature (1)..( 8): Result.003 file - promoters60/4769169
taatcata

SEQ ID NO: 138753 - DNA, 9 bp, Unknown
  misc_feature (1)..( 9): Result.003 file - promoters60/4769169
aaaaataaa

SEQ ID NO: 138754 - DNA, 9 bp, Unknown
  misc_feature (1)..( 9): Result.003 file - promoters60/4769169
caaaacaaa

SEQ ID NO: 138755 - DNA, 9 bp, Unknown
  misc_feature (1)..( 9): Result.003 file - promoters60/4769169
aaaaattag

SEQ ID NO: 138756 - DNA, 9 bp, Unknown
  misc_feature (1)..( 9): Result.003 file - promoters60/4769169
gcaaactta

SEQ ID NO: 138757 - DNA, 10 bp, Unknown
  misc_feature (1)..( 10): Result.003 file - promoters60/4769169
aaatattgaa

SEQ ID NO: 138758 - DNA, 10 bp, Unknown
  misc_feature (1)..( 10): Result.003 file - promoters60/4769169
aaaaatttat

SEQ ID NO: 138759 - DNA, 10 bp, Unknown
  misc_feature (1)..( 10): Result.003 file - promoters60/4769169
atatataata

SEQ ID NO: 138760 - DNA, 9 bp, Unknown
  misc_feature (1)..( 9): Result.003 file - promoters60/4769169
ctaaacact

SEQ ID NO: 138761 - DNA, 9 bp, Unknown
  misc_feature (1)..( 9): Result.003 file - promoters60/4769169
ttaaacata

SEQ ID NO: 138762 - DNA, 9 bp, Unknown
  misc_feature (1)..( 9): Result.003 file - promoters60/4769169
ttaaaaata

SEQ ID NO: 138763 - DNA, 9 bp, Unknown
  misc_feature (1)..( 9): Result.003 file - promoters60/4769169
attttgtag

SEQ ID NO: 138764 - DNA, 9 bp, Unknown
  misc_feature (1)..( 9): Result.003 file - promoters60/4769169
attttgtaa

SEQ ID NO: 138765 - DNA, 9 bp, Unknown
  misc_feature (1)..( 9): Result.003 file - promoters60/4769169
cgtttataa

SEQ ID NO: 138766 - DNA, 7 bp, Unknown
  misc_feature (1)..( 7): Result.003 file - promoters60/4769169
aaaattg

SEQ ID NO: 138767 - DNA, 7 bp, Unknown
  misc_feature (1)..( 7): Result.003 file - promoters60/4769169
aaaatta

SEQ ID NO: 138768 - DNA, 7 bp, Unknown
  misc_feature (1)..( 7): Result.003 file - promoters60/4769169
aaactta

SEQ ID NO: 138769 - DNA, 7 bp, Unknown
  misc_feature (1)..( 7): Result.003 file - promoters60/4769169
ataaaat

SEQ ID NO: 138770 - DNA, 7 bp, Unknown
  misc_feature (1)..( 7): Result.003 file - promoters60/4769169
gtaaaat

SEQ ID NO: 138771 - DNA, 7 bp, Unknown
  misc_feature (1)..( 7): Result.003 file - promoters60/4769169
gtaaaaa

SEQ ID NO: 138772 - DNA, 9 bp, Unknown
  misc_feature (1)..( 9): Result.003 file - promoters60/4769169
ttaatattt

SEQ ID NO: 138773 - DNA, 9 bp, Unknown
  misc_feature (1)..( 9): Result.003 file - promoters60/4769169
ataagattt

SEQ ID NO: 138774 - DNA, 9 bp, Unknown
  misc_feature (1)..( 9): Result.003 file - promoters60/4769169
ataatattg

SEQ ID NO: 138775 - DNA, 6 bp, Unknown
  misc_feature (1)..( 6): Result.003 file - promoters60/4769169
ttcaaa

SEQ ID NO: 138776 - DNA, 6 bp, Unknown
  misc_feature (1)..( 6): Result.003 file - promoters60/4769169
ttcaaa

SEQ ID NO: 138777 - DNA, 6 bp, Unknown
  misc_feature (1)..( 6): Result.003 file - promoters60/4769169
ttcaaa

SEQ ID NO: 138778 - DNA, 9 bp, Unknown
  misc_feature (1)..( 9): Result.003 file - promoters60/4769169
ttttttttt

SEQ ID NO: 138779 - DNA, 9 bp, Unknown
  misc_feature (1)..( 9): Result.003 file - promoters60/4769169
ttttttttc

SEQ ID NO: 138780 - DNA, 9 bp, Unknown
  misc_feature (1)..( 9): Result.003 file - promoters60/4769169
tttcttaaa

SEQ ID NO: 138781 - DNA, 10 bp, Unknown
  misc_feature (1)..( 10): Result.003 file - promoters60/4769169
attgatgttc

SEQ ID NO: 138782 - DNA, 10 bp, Unknown
  misc_feature (1)..( 10): Result.003 file - promoters60/4769169
attaatgttc

SEQ ID NO: 138783 - DNA, 10 bp, Unknown
  misc_feature (1)..( 10): Result.003 file - promoters60/4769169
attaattcca

SEQ ID NO: 138784 - DNA, 9 bp, Unknown
  misc_feature (1)..( 9): Result.003 file - promoters60/4769169
ttaaaatag

SEQ ID NO: 138785 - DNA, 9 bp, Unknown
  misc_feature (1)..( 9): Result.003 file - promoters60/4769169
ttaaaaata

SEQ ID NO: 138786 - DNA, 9 bp, Unknown
  misc_feature (1)..( 9): Result.003 file - promoters60/4769169
ttaaacata

SEQ ID NO: 138787 - DNA, 8 bp, Unknown
  misc_feature (1)..( 8): Result.003 file - promoters60/4769169
ttaaaata

SEQ ID NO: 138788 - DNA, 8 bp, Unknown
  misc_feature (1)..( 8): Result.003 file - promoters60/4769169
taaaaata

SEQ ID NO: 138789 - DNA, 9 bp, Unknown
  misc_feature (1)..( 9): Result.003 file - promoters60/4769169
ttaaacata

SEQ ID NO: 138790 - DNA, 9 bp, Unknown
  misc_feature (1)..( 9): Result.003 file - promoters60/4769180
agattcata

SEQ ID NO: 138791 - DNA, 9 bp, Unknown
  misc_feature (1)..( 9): Result.003 file - promoters60/4769180
acattaata

SEQ ID NO: 138792 - DNA, 9 bp, Unknown
  misc_feature (1)..( 9): Result.003 file - promoters60/4769180
ttattaatt

SEQ ID NO: 138793 - DNA, 9 bp, Unknown
  misc_feature (1)..( 9): Result.003 file - promoters60/4769180
acaataatc

SEQ ID NO: 138794 - DNA, 8 bp, Unknown
  misc_feature (1)..( 8): Result.003 file - promoters60/4769180
aaatcata

SEQ ID NO: 138795 - DNA, 8 bp, Unknown
  misc_feature (1)..( 8): Result.003 file - promoters60/4769180
aaaacatt

SEQ ID NO: 138796 - DNA, 8 bp, Unknown
  misc_feature (1)..( 8): Result.003 file - promoters60/4769180
aaaatatt

SEQ ID NO: 138797 - DNA, 8 bp, Unknown
  misc_feature (1)..( 8): Result.003 file - promoters60/4769180
ttaatatt

SEQ ID NO: 138798 - DNA, 9 bp, Unknown
  misc_feature (1)..( 9): Result.003 file - promoters60/4769180
agatttacc

SEQ ID NO: 138799 - DNA, 9 bp, Unknown
  misc_feature (1)..( 9): Result.003 file - promoters60/4769180
tgatttatc

SEQ ID NO: 138800 - DNA, 9 bp, Unknown
  misc_feature (1)..( 9): Result.003 file - promoters60/4769180
agatttatt

SEQ ID NO: 138801 - DNA, 9 bp, Unknown
  misc_feature (1)..( 9): Result.003 file - promoters60/4769180
aaattaatc

SEQ ID NO: 138802 - DNA, 9 bp, Unknown
  misc_feature (1)..( 9): Result.003 file - promoters60/4769180
ccctatctt

SEQ ID NO: 138803 - DNA, 9 bp, Unknown
  misc_feature (1)..( 9): Result.003 file - promoters60/4769180
atttatctt

SEQ ID NO: 138804 - DNA, 9 bp, Unknown
  misc_feature (1)..( 9): Result.003 file - promoters60/4769180
attcatctt

SEQ ID NO: 138805 - DNA, 9 bp, Unknown
  misc_feature (1)..( 9): Result.003 file - promoters60/4769180
attaatcgg

SEQ ID NO: 138806 - DNA, 11 bp, Unknown
  misc_feature (1)..( 11): Result.003 file - promoters60/4769180
aaataaacaat

SEQ ID NO: 138807 - DNA, 11 bp, Unknown
  misc_feature (1)..( 11): Result.003 file - promoters60/4769180
aaaaaaaaata

SEQ ID NO: 138808 - DNA, 11 bp, Unknown
  misc_feature (1)..( 11): Result.003 file - promoters60/4769180
gaataaccaaa

SEQ ID NO: 138809 - DNA, 11 bp, Unknown
  misc_feature (1)..( 11): Result.003 file - promoters60/4769180
taattaccaaa

SEQ ID NO: 138810 - DNA, 11 bp, Unknown
  misc_feature (1)..( 11): Result.003 file - promoters60/4769180
gaataatattt

SEQ ID NO: 138811 - DNA, 11 bp, Unknown
  misc_feature (1)..( 11): Result.003 file - promoters60/4769180
aaataaacaat

SEQ ID NO: 138812 - DNA, 11 bp, Unknown
  misc_feature (1)..( 11): Result.003 file - promoters60/4769180
taaaaaaaaat

SEQ ID NO: 138813 - DNA, 11 bp, Unknown
  misc_feature (1)..( 11): Result.003 file - promoters60/4769180
gaataaccaaa

SEQ ID NO: 138814 - DNA, 11 bp, Unknown
  misc_feature (1)..( 11): Result.003 file - promoters60/4769180
taattaccaaa

SEQ ID NO: 138815 - DNA, 11 bp, Unknown
  misc_feature (1)..( 11): Result.003 file - promoters60/4769180
gaataatattt

SEQ ID NO: 138816 - DNA, 8 bp, Unknown
  misc_feature (1)..( 8): Result.003 file - promoters60/4769180
tcataaaa

SEQ ID NO: 138817 - DNA, 8 bp, Unknown
  misc_feature (1)..( 8): Result.003 file - promoters60/4769180
tcataaaa

SEQ ID NO: 138818 - DNA, 8 bp, Unknown
  misc_feature (1)..( 8): Result.003 file - promoters60/4769180
agataaaa

SEQ ID NO: 138819 - DNA, 8 bp, Unknown
  misc_feature (1)..( 8): Result.003 file - promoters60/4769180
gcatgaaa

SEQ ID NO: 138820 - DNA, 9 bp, Unknown
  misc_feature (1)..( 9): Result.003 file - promoters60/4769180
gtaacaaat

SEQ ID NO: 138821 - DNA, 9 bp, Unknown
  misc_feature (1)..( 9): Result.003 file - promoters60/4769180
aaaacgaat

SEQ ID NO: 138822 - DNA, 9 bp, Unknown
  misc_feature (1)..( 9): Result.003 file - promoters60/4769180
ataataaat

SEQ ID NO: 138823 - DNA, 9 bp, Unknown
  misc_feature (1)..( 9): Result.003 file - promoters60/4769180
ataatagta

SEQ ID NO: 138824 - DNA, 8 bp, Unknown
  misc_feature (1)..( 8): Result.003 file - promoters60/4769180
aaaaaaaa

SEQ ID NO: 138825 - DNA, 8 bp, Unknown
  misc_feature (1)..( 8): Result.003 file - promoters60/4769180
aaacaaaa

SEQ ID NO: 138826 - DNA, 8 bp, Unknown
  misc_feature (1)..( 8): Result.003 file - promoters60/4769180
aagaaaaa

SEQ ID NO: 138827 - DNA, 8 bp, Unknown
  misc_feature (1)..( 8): Result.003 file - promoters60/4769180
gagagaaa

SEQ ID NO: 138828 - DNA, 11 bp, Unknown
  misc_feature (1)..( 11): Result.003 file - promoters60/4769180
taattaccaaa

SEQ ID NO: 138829 - DNA, 11 bp, Unknown
  misc_feature (1)..( 11): Result.003 file - promoters60/4769180
aaattacatac

SEQ ID NO: 138830 - DNA, 11 bp, Unknown
  misc_feature (1)..( 11): Result.003 file - promoters60/4769180
gaataaccaaa

SEQ ID NO: 138831 - DNA, 11 bp, Unknown
  misc_feature (1)..( 11): Result.003 file - promoters60/4769180
gaataatattt

SEQ ID NO: 138832 - DNA, 12 bp, Unknown
  misc_feature (1)..( 12): Result.003 file - promoters60/4769180
taattaccaaaa

SEQ ID NO: 138833 - DNA, 12 bp, Unknown
  misc_feature (1)..( 12): Result.003 file - promoters60/4769180
tacatactaaaa

SEQ ID NO: 138834 - DNA, 12 bp, Unknown
  misc_feature (1)..( 12): Result.003 file - promoters60/4769180
gaataaccaaag

SEQ ID NO: 138835 - DNA, 12 bp, Unknown
  misc_feature (1)..( 12): Result.003 file - promoters60/4769180
gaataatattta

SEQ ID NO: 138836 - DNA, 9 bp, Unknown
  misc_feature (1)..( 9): Result.003 file - promoters60/4769180
aaatcaatc

SEQ ID NO: 138837 - DNA, 9 bp, Unknown
  misc_feature (1)..( 9): Result.003 file - promoters60/4769180
aaattaatc

SEQ ID NO: 138838 - DNA, 9 bp, Unknown
  misc_feature (1)..( 9): Result.003 file - promoters60/4769180
tgatttatc

SEQ ID NO: 138839 - DNA, 9 bp, Unknown
  misc_feature (1)..( 9): Result.003 file - promoters60/4769180
ttattcatc

SEQ ID NO: 138840 - DNA, 18 bp, Unknown
  misc_feature (1)..( 18): Result.003 file - promoters60/4769184
agctaaaagtacaattta

SEQ ID NO: 138841 - DNA, 18 bp, Unknown
  misc_feature (1)..( 18): Result.003 file - promoters60/4769184
tgctaaaaatccttgaga

SEQ ID NO: 138842 - DNA, 18 bp, Unknown
  misc_feature (1)..( 18): Result.003 file - promoters60/4769184
gattaaatgtataattta

SEQ ID NO: 138843 - DNA, 18 bp, Unknown
  misc_feature (1)..( 18): Result.003 file - promoters60/4769184
tgctaatgtgaacttagt

SEQ ID NO: 138844 - DNA, 11 bp, Unknown
  misc_feature (1)..( 11): Result.003 file - promoters60/4769184
ttaaaattcaa

SEQ ID NO: 138845 - DNA, 11 bp, Unknown
  misc_feature (1)..( 11): Result.003 file - promoters60/4769184
ccaaaatccaa

SEQ ID NO: 138846 - DNA, 11 bp, Unknown
  misc_feature (1)..( 11): Result.003 file - promoters60/4769184
cacaaagtcaa

SEQ ID NO: 138847 - DNA, 11 bp, Unknown
  misc_feature (1)..( 11): Result.003 file - promoters60/4769184
ttaaaatctct

SEQ ID NO: 138848 - DNA, 11 bp, Unknown
  misc_feature (1)..( 11): Result.003 file - promoters60/4769184
ttataatattt

SEQ ID NO: 138849 - DNA, 15 bp, Unknown
  misc_feature (1)..( 15): Result.003 file - promoters60/4769184
taaaagtacaattta

SEQ ID NO: 138850 - DNA, 15 bp, Unknown
  misc_feature (1)..( 15): Result.003 file - promoters60/4769184
ttgtagtacagtaag

SEQ ID NO: 138851 - DNA, 15 bp, Unknown
  misc_feature (1)..( 15): Result.003 file - promoters60/4769184
taaatgtataattta

SEQ ID NO: 138852 - DNA, 15 bp, Unknown
  misc_feature (1)..( 15): Result.003 file - promoters60/4769184
gtgttcgataattga

SEQ ID NO: 138853 - DNA, 9 bp, Unknown
  misc_feature (1)..( 9): Result.003 file - promoters60/4769184
aaaaattgg

SEQ ID NO: 138854 - DNA, 9 bp, Unknown
  misc_feature (1)..( 9): Result.003 file - promoters60/4769184
aaaaattcc

SEQ ID NO: 138855 - DNA, 9 bp, Unknown
  misc_feature (1)..( 9): Result.003 file - promoters60/4769184
caaagttct

SEQ ID NO: 138856 - DNA, 9 bp, Unknown
  misc_feature (1)..( 9): Result.003 file - promoters60/4769184
taaaataat

SEQ ID NO: 138857 - DNA, 9 bp, Unknown
  misc_feature (1)..( 9): Result.003 file - promoters60/4769184
gtttaatta

SEQ ID NO: 138858 - DNA, 9 bp, Unknown
  misc_feature (1)..( 9): Result.003 file - promoters60/4769184
atttgattt

SEQ ID NO: 138859 - DNA, 9 bp, Unknown
  misc_feature (1)..( 9): Result.003 file - promoters60/4769184
atttaattt

SEQ ID NO: 138860 - DNA, 9 bp, Unknown
  misc_feature (1)..( 9): Result.003 file - promoters60/4769184
atttaacaa

SEQ ID NO: 138861 - DNA, 8 bp, Unknown
  misc_feature (1)..( 8): Result.003 file - promoters60/4769184
aattatat

SEQ ID NO: 138862 - DNA, 8 bp, Unknown
  misc_feature (1)..( 8): Result.003 file - promoters60/4769184
tattgtat

SEQ ID NO: 138863 - DNA, 8 bp, Unknown
  misc_feature (1)..( 8): Result.003 file - promoters60/4769184
aattgtat

SEQ ID NO: 138864 - DNA, 8 bp, Unknown
  misc_feature (1)..( 8): Result.003 file - promoters60/4769184
tattatag

SEQ ID NO: 138865 - DNA, 13 bp, Unknown
  misc_feature (1)..( 13): Result.003 file - promoters60/4769184
ttaacagagacat

SEQ ID NO: 138866 - DNA, 13 bp, Unknown
  misc_feature (1)..( 13): Result.003 file - promoters60/4769184
ttcctagatacag

SEQ ID NO: 138867 - DNA, 13 bp, Unknown
  misc_feature (1)..( 13): Result.003 file - promoters60/4769184
gattccgatccag

SEQ ID NO: 138868 - DNA, 13 bp, Unknown
  misc_feature (1)..( 13): Result.003 file - promoters60/4769184
ttcttagctacgt

SEQ ID NO: 138869 - DNA, 9 bp, Unknown
  misc_feature (1)..( 9): Result.003 file - promoters60/4769186
cgaaagaat

SEQ ID NO: 138870 - DNA, 9 bp, Unknown
  misc_feature (1)..( 9): Result.003 file - promoters60/4769186
gaaaagaaa

SEQ ID NO: 138871 - DNA, 10 bp, Unknown
  misc_feature (1)..( 10): Result.003 file - promoters60/4769186
ggaaatgaaa

SEQ ID NO: 138872 - DNA, 7 bp, Unknown
  misc_feature (1)..( 7): Result.003 file - promoters60/4769186
aaaatat

SEQ ID NO: 138873 - DNA, 7 bp, Unknown
  misc_feature (1)..( 7): Result.003 file - promoters60/4769186
aaaataa

SEQ ID NO: 138874 - DNA, 7 bp, Unknown
  misc_feature (1)..( 7): Result.003 file - promoters60/4769186
gaaatat

SEQ ID NO: 138875 - DNA, 6 bp, Unknown
  misc_feature (1)..( 6): Result.003 file - promoters60/4769186
aatatt

SEQ ID NO: 138876 - DNA, 6 bp, Unknown
  misc_feature (1)..( 6): Result.003 file - promoters60/4769186
aatatt

SEQ ID NO: 138877 - DNA, 8 bp, Unknown
  misc_feature (1)..( 8): Result.003 file - promoters60/4769186
atgtagaa

SEQ ID NO: 138878 - DNA, 8 bp, Unknown
  misc_feature (1)..( 8): Result.003 file - promoters60/4769186
atgaagaa

SEQ ID NO: 138879 - DNA, 7 bp, Unknown
  misc_feature (1)..( 7): Result.003 file - promoters60/4769186
tattaac

SEQ ID NO: 138880 - DNA, 7 bp, Unknown
  misc_feature (1)..( 7): Result.003 file - promoters60/4769186
tataaac

SEQ ID NO: 138881 - DNA, 8 bp, Unknown
  misc_feature (1)..( 8): Result.003 file - promoters60/4769186
ggttgtgt

SEQ ID NO: 138882 - DNA, 8 bp, Unknown
  misc_feature (1)..( 8): Result.003 file - promoters60/4769186
ggttttgt

SEQ ID NO: 138883 - DNA, 10 bp, Unknown
  misc_feature (1)..( 10): Result.003 file - promoters60/4769186
gaactcacta

SEQ ID NO: 138884 - DNA, 10 bp, Unknown
  misc_feature (1)..( 10): Result.003 file - promoters60/4769186
gaacccacta

SEQ ID NO: 138885 - DNA, 6 bp, Unknown
  misc_feature (1)..( 6): Result.003 file - promoters60/4769186
tttatt

SEQ ID NO: 138886 - DNA, 6 bp, Unknown
  misc_feature (1)..( 6): Result.003 file - promoters60/4769186
tttatt

SEQ ID NO: 138887 - DNA, 6 bp, Unknown
  misc_feature (1)..( 6): Result.003 file - promoters60/4769186
agtaaa

SEQ ID NO: 138888 - DNA, 6 bp, Unknown
  misc_feature (1)..( 6): Result.003 file - promoters60/4769186
agtaaa

SEQ ID NO: 138889 - DNA, 7 bp, Unknown
  misc_feature (1)..( 7): Result.003 file - promoters60/4769186
aatcggg

SEQ ID NO: 138890 - DNA, 7 bp, Unknown
  misc_feature (1)..( 7): Result.003 file - promoters60/4769186
aattggg

SEQ ID NO: 138891 - DNA, 8 bp, Unknown
  misc_feature (1)..( 8): Result.003 file - promoters60/4769186
gaaagaaa

SEQ ID NO: 138892 - DNA, 8 bp, Unknown
  misc_feature (1)..( 8): Result.003 file - promoters60/4769186
gaaacaaa

SEQ ID NO: 138893 - DNA, 7 bp, Unknown
  misc_feature (1)..( 7): Result.003 file - promoters60/4769186
cccacta

SEQ ID NO: 138894 - DNA, 7 bp, Unknown
  misc_feature (1)..( 7): Result.003 file - promoters60/4769186
cccacta

SEQ ID NO: 138895 - DNA, 9 bp, Unknown
  misc_feature (1)..( 9): Result.003 file - promoters60/4769186
aaagaaaag

SEQ ID NO: 138896 - DNA, 9 bp, Unknown
  misc_feature (1)..( 9): Result.003 file - promoters60/4769186
aaagtaaag

SEQ ID NO: 138897 - DNA, 7 bp, Unknown
  misc_feature (1)..( 7): Result.003 file - promoters60/4769186
gtatata

SEQ ID NO: 138898 - DNA, 7 bp, Unknown
  misc_feature (1)..( 7): Result.003 file - promoters60/4769186
gtatata

SEQ ID NO: 138899 - DNA, 7 bp, Unknown
  misc_feature (1)..( 7): Result.003 file - promoters60/4769229
tactaaa

SEQ ID NO: 138900 - DNA, 7 bp, Unknown
  misc_feature (1)..( 7): Result.003 file - promoters60/4769229
tacgaaa

SEQ ID NO: 138901 - DNA, 9 bp, Unknown
  misc_feature (1)..( 9): Result.003 file - promoters60/4769229
gttgaaaaa

SEQ ID NO: 138902 - DNA, 9 bp, Unknown
  misc_feature (1)..( 9): Result.003 file - promoters60/4769229
gtttaaaaa

SEQ ID NO: 138903 - DNA, 6 bp, Unknown
  misc_feature (1)..( 6): Result.003 file - promoters60/4769229
ctatta

SEQ ID NO: 138904 - DNA, 6 bp, Unknown
  misc_feature (1)..( 6): Result.003 file - promoters60/4769229
ctatta

SEQ ID NO: 138905 - DNA, 7 bp, Unknown
  misc_feature (1)..( 7): Result.003 file - promoters60/4769229
tttgtga

SEQ ID NO: 138906 - DNA, 7 bp, Unknown
  misc_feature (1)..( 7): Result.003 file - promoters60/4769229
tttttga

SEQ ID NO: 138907 - DNA, 7 bp, Unknown
  misc_feature (1)..( 7): Result.003 file - promoters60/4769229
ttttttt

SEQ ID NO: 138908 - DNA, 9 bp, Unknown
  misc_feature (1)..( 9): Result.003 file - promoters60/4769229
aagaagaaa

SEQ ID NO: 138909 - DNA, 9 bp, Unknown
  misc_feature (1)..( 9): Result.003 file - promoters60/4769229
aagtagaaa

SEQ ID NO: 138910 - DNA, 6 bp, Unknown
  misc_feature (1)..( 6): Result.003 file - promoters60/4769229
aattta

SEQ ID NO: 138911 - DNA, 6 bp, Unknown
  misc_feature (1)..( 6): Result.003 file - promoters60/4769229
aattta

SEQ ID NO: 138912 - DNA, 9 bp, Unknown
  misc_feature (1)..( 9): Result.003 file - promoters60/4769229
ttataataa

SEQ ID NO: 138913 - DNA, 9 bp, Unknown
  misc_feature (1)..( 9): Result.003 file - promoters60/4769229
ttaaaattc

SEQ ID NO: 138914 - DNA, 9 bp, Unknown
  misc_feature (1)..( 9): Result.003 file - promoters60/4769229
caataataa

SEQ ID NO: 138915 - DNA, 7 bp, Unknown
  misc_feature (1)..( 7): Result.003 file - promoters60/4769229
agagttt

SEQ ID NO: 138916 - DNA, 7 bp, Unknown
  misc_feature (1)..( 7): Result.003 file - promoters60/4769229
agagttt

SEQ ID NO: 138917 - DNA, 9 bp, Unknown
  misc_feature (1)..( 9): Result.003 file - promoters60/4769229
gactctctt

SEQ ID NO: 138918 - DNA, 9 bp, Unknown
  misc_feature (1)..( 9): Result.003 file - promoters60/4769229
gactctctt

SEQ ID NO: 138919 - DNA, 7 bp, Unknown
  misc_feature (1)..( 7): Result.003 file - promoters60/4769229
aatacat

SEQ ID NO: 138920 - DNA, 7 bp, Unknown
  misc_feature (1)..( 7): Result.003 file - promoters60/4769229
aatccat

SEQ ID NO: 138921 - DNA, 7 bp, Unknown
  misc_feature (1)..( 7): Result.003 file - promoters60/4769229
aaggatt

SEQ ID NO: 138922 - DNA, 7 bp, Unknown
  misc_feature (1)..( 7): Result.003 file - promoters60/4769229
aagtatt

SEQ ID NO: 138923 - DNA, 10 bp, Unknown
  misc_feature (1)..( 10): Result.003 file - promoters60/4769229
tatcttaccg

SEQ ID NO: 138924 - DNA, 10 bp, Unknown
  misc_feature (1)..( 10): Result.003 file - promoters60/4769229
tatcttgccg

SEQ ID NO: 138925 - DNA, 8 bp, Unknown
  misc_feature (1)..( 8): Result.003 file - promoters60/4769229
aaattccc

SEQ ID NO: 138926 - DNA, 8 bp, Unknown
  misc_feature (1)..( 8): Result.003 file - promoters60/4769229
aaaatccc

SEQ ID NO: 138927 - DNA, 8 bp, Unknown
  misc_feature (1)..( 8): Result.003 file - promoters60/4769257
aatacaaa

SEQ ID NO: 138928 - DNA, 8 bp, Unknown
  misc_feature (1)..( 8): Result.003 file - promoters60/4769257
aatataaa

SEQ ID NO: 138929 - DNA, 8 bp, Unknown
  misc_feature (1)..( 8): Result.003 file - promoters60/4769257
tttacaaa

SEQ ID NO: 138930 - DNA, 8 bp, Unknown
  misc_feature (1)..( 8): Result.003 file - promoters60/4769257
aattcaat

SEQ ID NO: 138931 - DNA, 8 bp, Unknown
  misc_feature (1)..( 8): Result.003 file - promoters60/4769257
tatataaa

SEQ ID NO: 138932 - DNA, 8 bp, Unknown
  misc_feature (1)..( 8): Result.003 file - promoters60/4769257
aatataat

SEQ ID NO: 138933 - DNA, 12 bp, Unknown
  misc_feature (1)..( 12): Result.003 file - promoters60/4769257
ctccatctatgt

SEQ ID NO: 138934 - DNA, 12 bp, Unknown
  misc_feature (1)..( 12): Result.003 file - promoters60/4769257
tataatcaatgg

SEQ ID NO: 138935 - DNA, 12 bp, Unknown
  misc_feature (1)..( 12): Result.003 file - promoters60/4769257
aaaaatctttgt

SEQ ID NO: 138936 - DNA, 12 bp, Unknown
  misc_feature (1)..( 12): Result.003 file - promoters60/4769257
taaaatcttcca

SEQ ID NO: 138937 - DNA, 12 bp, Unknown
  misc_feature (1)..( 12): Result.003 file - promoters60/4769257
taaaatcagatc

SEQ ID NO: 138938 - DNA, 12 bp, Unknown
  misc_feature (1)..( 12): Result.003 file - promoters60/4769257
atatatcattgc

SEQ ID NO: 138939 - DNA, 9 bp, Unknown
  misc_feature (1)..( 9): Result.003 file - promoters60/4769257
ataagaata

SEQ ID NO: 138940 - DNA, 9 bp, Unknown
  misc_feature (1)..( 9): Result.003 file - promoters60/4769257
gtaagaaaa

SEQ ID NO: 138941 - DNA, 9 bp, Unknown
  misc_feature (1)..( 9): Result.003 file - promoters60/4769257
gtaagagag

SEQ ID NO: 138942 - DNA, 9 bp, Unknown
  misc_feature (1)..( 9): Result.003 file - promoters60/4769257
ctaaaaaaa

SEQ ID NO: 138943 - DNA, 9 bp, Unknown
  misc_feature (1)..( 9): Result.003 file - promoters60/4769257
ctaaaatct

SEQ ID NO: 138944 - DNA, 9 bp, Unknown
  misc_feature (1)..( 9): Result.003 file - promoters60/4769257
ataaaatca

SEQ ID NO: 138945 - DNA, 13 bp, Unknown
  misc_feature (1)..( 13): Result.003 file - promoters60/4769257
aaacaaaatcgat

SEQ ID NO: 138946 - DNA, 13 bp, Unknown
  misc_feature (1)..( 13): Result.003 file - promoters60/4769257
tcaaaaaaacgag

SEQ ID NO: 138947 - DNA, 13 bp, Unknown
  misc_feature (1)..( 13): Result.003 file - promoters60/4769257
tcataaatacgta

SEQ ID NO: 138948 - DNA, 13 bp, Unknown
  misc_feature (1)..( 13): Result.003 file - promoters60/4769257
aattaaatagtta

SEQ ID NO: 138949 - DNA, 13 bp, Unknown
  misc_feature (1)..( 13): Result.003 file - promoters60/4769257
aagaaaagaaaga

SEQ ID NO: 138950 - DNA, 14 bp, Unknown
  misc_feature (1)..( 14): Result.003 file - promoters60/4769257
tgacaacaaacgaa

SEQ ID NO: 138951 - DNA, 6 bp, Unknown
  misc_feature (1)..( 6): Result.003 file - promoters60/4769260
gattca

SEQ ID NO: 138952 - DNA, 6 bp, Unknown
  misc_feature (1)..( 6): Result.003 file - promoters60/4769260
gattca

SEQ ID NO: 138953 - DNA, 7 bp, Unknown
  misc_feature (1)..( 7): Result.003 file - promoters60/4769260
tatgttc

SEQ ID NO: 138954 - DNA, 7 bp, Unknown
  misc_feature (1)..( 7): Result.003 file - promoters60/4769260
tatgttc

SEQ ID NO: 138955 - DNA, 9 bp, Unknown
  misc_feature (1)..( 9): Result.003 file - promoters60/4769260
caaaatcaa

SEQ ID NO: 138956 - DNA, 9 bp, Unknown
  misc_feature (1)..( 9): Result.003 file - promoters60/4769260
caaaaacaa

SEQ ID NO: 138957 - DNA, 7 bp, Unknown
  misc_feature (1)..( 7): Result.003 file - promoters60/4769260
gaaaaag

SEQ ID NO: 138958 - DNA, 7 bp, Unknown
  misc_feature (1)..( 7): Result.003 file - promoters60/4769260
taaaaag

SEQ ID NO: 138959 - DNA, 7 bp, Unknown
  misc_feature (1)..( 7): Result.003 file - promoters60/4769260
taaaaac

SEQ ID NO: 138960 - DNA, 6 bp, Unknown
  misc_feature (1)..( 6): Result.003 file - promoters60/4769260
ttgatt

SEQ ID NO: 138961 - DNA, 6 bp, Unknown
  misc_feature (1)..( 6): Result.003 file - promoters60/4769260
ttgatt

SEQ ID NO: 138962 - DNA, 7 bp, Unknown
  misc_feature (1)..( 7): Result.003 file - promoters60/4769260
caaaatt

SEQ ID NO: 138963 - DNA, 7 bp, Unknown
  misc_feature (1)..( 7): Result.003 file - promoters60/4769260
caaaatt

SEQ ID NO: 138964 - DNA, 7 bp, Unknown
  misc_feature (1)..( 7): Result.003 file - promoters60/4769260
atataaa

SEQ ID NO: 138965 - DNA, 7 bp, Unknown
  misc_feature (1)..( 7): Result.003 file - promoters60/4769260
ataaaaa

SEQ ID NO: 138966 - DNA, 6 bp, Unknown
  misc_feature (1)..( 6): Result.003 file - promoters60/4769260
aaaaaa

SEQ ID NO: 138967 - DNA, 6 bp, Unknown
  misc_feature (1)..( 6): Result.003 file - promoters60/4769260
aaaaaa

SEQ ID NO: 138968 - DNA, 11 bp, Unknown
  misc_feature (1)..( 11): Result.003 file - promoters60/4769260
atgttttatgt

SEQ ID NO: 138969 - DNA, 11 bp, Unknown
  misc_feature (1)..( 11): Result.003 file - promoters60/4769260
atgatttatgt

SEQ ID NO: 138970 - DNA, 6 bp, Unknown
  misc_feature (1)..( 6): Result.003 file - promoters60/4769260
atatgt

SEQ ID NO: 138971 - DNA, 6 bp, Unknown
  misc_feature (1)..( 6): Result.003 file - promoters60/4769260
atatgt

SEQ ID NO: 138972 - DNA, 7 bp, Unknown
  misc_feature (1)..( 7): Result.003 file - promoters60/4769260
ctagact

SEQ ID NO: 138973 - DNA, 7 bp, Unknown
  misc_feature (1)..( 7): Result.003 file - promoters60/4769260
ctatact

SEQ ID NO: 138974 - DNA, 10 bp, Unknown
  misc_feature (1)..( 10): Result.003 file - promoters60/4769260
tgatttgttt

SEQ ID NO: 138975 - DNA, 10 bp, Unknown
  misc_feature (1)..( 10): Result.003 file - promoters60/4769260
tgattttttt

SEQ ID NO: 138976 - DNA, 7 bp, Unknown
  misc_feature (1)..( 7): Result.003 file - promoters60/4769260
ttgtatc

SEQ ID NO: 138977 - DNA, 7 bp, Unknown
  misc_feature (1)..( 7): Result.003 file - promoters60/4769260
ttggatc

SEQ ID NO: 138978 - DNA, 7 bp, Unknown
  misc_feature (1)..( 7): Result.003 file - promoters60/4769260
tacttga

SEQ ID NO: 138979 - DNA, 7 bp, Unknown
  misc_feature (1)..( 7): Result.003 file - promoters60/4769260
tacttga

SEQ ID NO: 138980 - DNA, 12 bp, Unknown
  misc_feature (1)..( 12): Result.003 file - promoters60/4769260
aatgggcctaag

SEQ ID NO: 138981 - DNA, 12 bp, Unknown
  misc_feature (1)..( 12): Result.003 file - promoters60/4769260
aatgggcttaag

SEQ ID NO: 138982 - DNA, 6 bp, Unknown
  misc_feature (1)..( 6): Result.003 file - promoters60/4769260
ctaaaa

SEQ ID NO: 138983 - DNA, 6 bp, Unknown
  misc_feature (1)..( 6): Result.003 file - promoters60/4769260
ctaaaa

SEQ ID NO: 138984 - DNA, 6 bp, Unknown
  misc_feature (1)..( 6): Result.003 file - promoters60/4769276
gaacat

SEQ ID NO: 138985 - DNA, 6 bp, Unknown
  misc_feature (1)..( 6): Result.003 file - promoters60/4769276
gaacat

SEQ ID NO: 138986 - DNA, 6 bp, Unknown
  misc_feature (1)..( 6): Result.003 file - promoters60/4769276
gaacat

SEQ ID NO: 138987 - DNA, 6 bp, Unknown
  misc_feature (1)..( 6): Result.003 file - promoters60/4769298
cactgt

SEQ ID NO: 138988 - DNA, 6 bp, Unknown
  misc_feature (1)..( 6): Result.003 file - promoters60/4769298
cactgt

SEQ ID NO: 138989 - DNA, 8 bp, Unknown
  misc_feature (1)..( 8): Result.003 file - promoters60/4769298
atacgtcg

SEQ ID NO: 138990 - DNA, 8 bp, Unknown
  misc_feature (1)..( 8): Result.003 file - promoters60/4769298
ataagtcg

SEQ ID NO: 138991 - DNA, 7 bp, Unknown
  misc_feature (1)..( 7): Result.003 file - promoters60/4769298
ctctcta

SEQ ID NO: 138992 - DNA, 7 bp, Unknown
  misc_feature (1)..( 7): Result.003 file - promoters60/4769298
ctcacta

SEQ ID NO: 138993 - DNA, 11 bp, Unknown
  misc_feature (1)..( 11): Result.003 file - promoters60/4769298
taatattaata

SEQ ID NO: 138994 - DNA, 11 bp, Unknown
  misc_feature (1)..( 11): Result.003 file - promoters60/4769298
caataataata

SEQ ID NO: 138995 - DNA, 11 bp, Unknown
  misc_feature (1)..( 11): Result.003 file - promoters60/4769298
caataagatca

SEQ ID NO: 138996 - DNA, 8 bp, Unknown
  misc_feature (1)..( 8): Result.003 file - promoters60/4769298
cgttaggg

SEQ ID NO: 138997 - DNA, 8 bp, Unknown
  misc_feature (1)..( 8): Result.003 file - promoters60/4769298
cgtcaggg

SEQ ID NO: 138998 - DNA, 8 bp, Unknown
  misc_feature (1)..( 8): Result.003 file - promoters60/4769298
cattcact

SEQ ID NO: 138999 - DNA, 8 bp, Unknown
  misc_feature (1)..( 8): Result.003 file - promoters60/4769298
cattcact

SEQ ID NO: 139000 - DNA, 7 bp, Unknown
  misc_feature (1)..( 7): Result.003 file - promoters60/4769298
ttaagct

SEQ ID NO: 139001 - DNA, 7 bp, Unknown
  misc_feature (1)..( 7): Result.003 file - promoters60/4769298
ttaagct

SEQ ID NO: 139002 - DNA, 6 bp, Unknown
  misc_feature (1)..( 6): Result.003 file - promoters60/4769298
catttc

SEQ ID NO: 139003 - DNA, 6 bp, Unknown
  misc_feature (1)..( 6): Result.003 file - promoters60/4769298
catttc

SEQ ID NO: 139004 - DNA, 6 bp, Unknown
  misc_feature (1)..( 6): Result.003 file - promoters60/4769298
taaaca

SEQ ID NO: 139005 - DNA, 6 bp, Unknown
  misc_feature (1)..( 6): Result.003 file - promoters60/4769298
taaaca

SEQ ID NO: 139006 - DNA, 7 bp, Unknown
  misc_feature (1)..( 7): Result.003 file - promoters60/4769298
cattttt

SEQ ID NO: 139007 - DNA, 7 bp, Unknown
  misc_feature (1)..( 7): Result.003 file - promoters60/4769298
cattttt

SEQ ID NO: 139008 - DNA, 6 bp, Unknown
  misc_feature (1)..( 6): Result.003 file - promoters60/4769298
tcttat

SEQ ID NO: 139009 - DNA, 6 bp, Unknown
  misc_feature (1)..( 6): Result.003 file - promoters60/4769298
tcttat

SEQ ID NO: 139010 - DNA, 7 bp, Unknown
  misc_feature (1)..( 7): Result.003 file - promoters60/4769298
gatatta

SEQ ID NO: 139011 - DNA, 7 bp, Unknown
  misc_feature (1)..( 7): Result.003 file - promoters60/4769298
gatctta

SEQ ID NO: 139012 - DNA, 7 bp, Unknown
  misc_feature (1)..( 7): Result.003 file - promoters60/4769298
aaagaca

SEQ ID NO: 139013 - DNA, 7 bp, Unknown
  misc_feature (1)..( 7): Result.003 file - promoters60/4769298
aaacaca

SEQ ID NO: 139014 - DNA, 7 bp, Unknown
  misc_feature (1)..( 7): Result.003 file - promoters60/4769298
aataaaa

SEQ ID NO: 139015 - DNA, 7 bp, Unknown
  misc_feature (1)..( 7): Result.003 file - promoters60/4769298
aatcaaa

SEQ ID NO: 139016 - DNA, 7 bp, Unknown
  misc_feature (1)..( 7): Result.003 file - promoters60/4769301
ctttttt

SEQ ID NO: 139017 - DNA, 7 bp, Unknown
  misc_feature (1)..( 7): Result.003 file - promoters60/4769301
cttattt

SEQ ID NO: 139018 - DNA, 9 bp, Unknown
  misc_feature (1)..( 9): Result.003 file - promoters60/4769301
tttggtctt

SEQ ID NO: 139019 - DNA, 9 bp, Unknown
  misc_feature (1)..( 9): Result.003 file - promoters60/4769301
tttgttctt

SEQ ID NO: 139020 - DNA, 6 bp, Unknown
  misc_feature (1)..( 6): Result.003 file - promoters60/4769301
tttttt

SEQ ID NO: 139021 - DNA, 6 bp, Unknown
  misc_feature (1)..( 6): Result.003 file - promoters60/4769301
tttttt

SEQ ID NO: 139022 - DNA, 7 bp, Unknown
  misc_feature (1)..( 7): Result.003 file - promoters60/4769301
tgttctc

SEQ ID NO: 139023 - DNA, 7 bp, Unknown
  misc_feature (1)..( 7): Result.003 file - promoters60/4769301
tgtgctc

SEQ ID NO: 139024 - DNA, 7 bp, Unknown
  misc_feature (1)..( 7): Result.003 file - promoters60/4769301
ataatca

SEQ ID NO: 139025 - DNA, 7 bp, Unknown
  misc_feature (1)..( 7): Result.003 file - promoters60/4769301
atattca

SEQ ID NO: 139026 - DNA, 7 bp, Unknown
  misc_feature (1)..( 7): Result.003 file - promoters60/4769301
tgtacat

SEQ ID NO: 139027 - DNA, 7 bp, Unknown
  misc_feature (1)..( 7): Result.003 file - promoters60/4769301
tgtacat

SEQ ID NO: 139028 - DNA, 8 bp, Unknown
  misc_feature (1)..( 8): Result.003 file - promoters60/4769301
ttataata

SEQ ID NO: 139029 - DNA, 8 bp, Unknown
  misc_feature (1)..( 8): Result.003 file - promoters60/4769301
ttatgata

SEQ ID NO: 139030 - DNA, 6 bp, Unknown
  misc_feature (1)..( 6): Result.003 file - promoters60/4769301
attttt

SEQ ID NO: 139031 - DNA, 6 bp, Unknown
  misc_feature (1)..( 6): Result.003 file - promoters60/4769301
attttt

SEQ ID NO: 139032 - DNA, 6 bp, Unknown
  misc_feature (1)..( 6): Result.003 file - promoters60/4769301
aaaaaa

SEQ ID NO: 139033 - DNA, 6 bp, Unknown
  misc_feature (1)..( 6): Result.003 file - promoters60/4769301
aaaaaa

SEQ ID NO: 139034 - DNA, 14 bp, Unknown
  misc_feature (1)..( 14): Result.003 file - promoters60/4769301
ggtcttacaatttt

SEQ ID NO: 139035 - DNA, 14 bp, Unknown
  misc_feature (1)..( 14): Result.003 file - promoters60/4769301
agaaatacaatttt

SEQ ID NO: 139036 - DNA, 14 bp, Unknown
  misc_feature (1)..( 14): Result.003 file - promoters60/4769301
agaactactattcg

SEQ ID NO: 139037 - DNA, 6 bp, Unknown
  misc_feature (1)..( 6): Result.003 file - promoters60/4769301
caaaaa

SEQ ID NO: 139038 - DNA, 6 bp, Unknown
  misc_feature (1)..( 6): Result.003 file - promoters60/4769301
caaaaa

SEQ ID NO: 139039 - DNA, 8 bp, Unknown
  misc_feature (1)..( 8): Result.003 file - promoters60/4769301
ctaaaata

SEQ ID NO: 139040 - DNA, 8 bp, Unknown
  misc_feature (1)..( 8): Result.003 file - promoters60/4769301
ctaaaaaa

SEQ ID NO: 139041 - DNA, 8 bp, Unknown
  misc_feature (1)..( 8): Result.003 file - promoters60/4769301
ttaaaaaa

SEQ ID NO: 139042 - DNA, 7 bp, Unknown
  misc_feature (1)..( 7): Result.003 file - promoters60/4769301
cttttgg

SEQ ID NO: 139043 - DNA, 7 bp, Unknown
  misc_feature (1)..( 7): Result.003 file - promoters60/4769301
tttttgg

SEQ ID NO: 139044 - DNA, 7 bp, Unknown
  misc_feature (1)..( 7): Result.003 file - promoters60/4769301
tttttgt

SEQ ID NO: 139045 - DNA, 8 bp, Unknown
  misc_feature (1)..( 8): Result.003 file - promoters60/4769301
ttttcttt

SEQ ID NO: 139046 - DNA, 8 bp, Unknown
  misc_feature (1)..( 8): Result.003 file - promoters60/4769301
tttgcttt

SEQ ID NO: 139047 - DNA, 11 bp, Unknown
  misc_feature (1)..( 11): Result.003 file - promoters60/4769301
aaaagaagaaa

SEQ ID NO: 139048 - DNA, 11 bp, Unknown
  misc_feature (1)..( 11): Result.003 file - promoters60/4769301
aaacgaataaa

SEQ ID NO: 139049 - DNA, 10 bp, Unknown
  misc_feature (1)..( 10): Result.003 file - promoters60/4769301
ttttaaaaga

SEQ ID NO: 139050 - DNA, 10 bp, Unknown
  misc_feature (1)..( 10): Result.003 file - promoters60/4769301
tttcaaaaaa

SEQ ID NO: 139051 - DNA, 10 bp, Unknown
  misc_feature (1)..( 10): Result.003 file - promoters60/4769301
ttgcaaaaaa

SEQ ID NO: 139052 - DNA, 7 bp, Unknown
  misc_feature (1)..( 7): Result.003 file - promoters60/4769301
aaagaaa

SEQ ID NO: 139053 - DNA, 7 bp, Unknown
  misc_feature (1)..( 7): Result.003 file - promoters60/4769301
aaataaa

SEQ ID NO: 139054 - DNA, 7 bp, Unknown
  misc_feature (1)..( 7): Result.003 file - promoters60/4769301
aaacaaa

SEQ ID NO: 139055 - DNA, 7 bp, Unknown
  misc_feature (1)..( 7): Result.003 file - promoters60/4769301
aaataaa

SEQ ID NO: 139056 - DNA, 10 bp, Unknown
  misc_feature (1)..( 10): Result.003 file - promoters60/4769301
tatacatcaa

SEQ ID NO: 139057 - DNA, 10 bp, Unknown
  misc_feature (1)..( 10): Result.003 file - promoters60/4769301
tatagatcaa

SEQ ID NO: 139058 - DNA, 6 bp, Unknown
  misc_feature (1)..( 6): Result.003 file - promoters60/4769301
ataaat

SEQ ID NO: 139059 - DNA, 6 bp, Unknown
  misc_feature (1)..( 6): Result.003 file - promoters60/4769301
ataaat

SEQ ID NO: 139060 - DNA, 7 bp, Unknown
  misc_feature (1)..( 7): Result.003 file - promoters60/4769301
tttttta

SEQ ID NO: 139061 - DNA, 7 bp, Unknown
  misc_feature (1)..( 7): Result.003 file - promoters60/4769301
tttatta

SEQ ID NO: 139062 - DNA, 6 bp, Unknown
  misc_feature (1)..( 6): Result.003 file - promoters60/4769301
ttacaa

SEQ ID NO: 139063 - DNA, 6 bp, Unknown
  misc_feature (1)..( 6): Result.003 file - promoters60/4769301
ttacaa

SEQ ID NO: 139064 - DNA, 6 bp, Unknown
  misc_feature (1)..( 6): Result.003 file - promoters60/4769301
aactaa

SEQ ID NO: 139065 - DNA, 6 bp, Unknown
  misc_feature (1)..( 6): Result.003 file - promoters60/4769301
aactaa

SEQ ID NO: 139066 - DNA, 7 bp, Unknown
  misc_feature (1)..( 7): Result.003 file - promoters60/4769301
ttgtaca

SEQ ID NO: 139067 - DNA, 7 bp, Unknown
  misc_feature (1)..( 7): Result.003 file - promoters60/4769301
ttgtaca

SEQ ID NO: 139068 - DNA, 6 bp, Unknown
  misc_feature (1)..( 6): Result.003 file - promoters60/4769301
ataaat

SEQ ID NO: 139069 - DNA, 6 bp, Unknown
  misc_feature (1)..( 6): Result.003 file - promoters60/4769301
ataaat

SEQ ID NO: 139070 - DNA, 11 bp, Unknown
  misc_feature (1)..( 11): Result.003 file - promoters60/4769312
aaataaaatgt

SEQ ID NO: 139071 - DNA, 11 bp, Unknown
  misc_feature (1)..( 11): Result.003 file - promoters60/4769312
tgctaaaattg

SEQ ID NO: 139072 - DNA, 11 bp, Unknown
  misc_feature (1)..( 11): Result.003 file - promoters60/4769312
aaagaaaacat

SEQ ID NO: 139073 - DNA, 11 bp, Unknown
  misc_feature (1)..( 11): Result.003 file - promoters60/4769312
acgtaagattg

SEQ ID NO: 139074 - DNA, 11 bp, Unknown
  misc_feature (1)..( 11): Result.003 file - promoters60/4769312
caaaatagatt

SEQ ID NO: 139075 - DNA, 11 bp, Unknown
  misc_feature (1)..( 11): Result.003 file - promoters60/4769312
aaaaaaagaaa

SEQ ID NO: 139076 - DNA, 11 bp, Unknown
  misc_feature (1)..( 11): Result.003 file - promoters60/4769312
caataaagtag

SEQ ID NO: 139077 - DNA, 11 bp, Unknown
  misc_feature (1)..( 11): Result.003 file - promoters60/4769312
aaataaagctt

SEQ ID NO: 139078 - DNA, 11 bp, Unknown
  misc_feature (1)..( 11): Result.003 file - promoters60/4769312
caacaaaatag

SEQ ID NO: 139079 - DNA, 11 bp, Unknown
  misc_feature (1)..( 11): Result.003 file - promoters60/4769312
aaacaaagaaa

SEQ ID NO: 139080 - DNA, 11 bp, Unknown
  misc_feature (1)..( 11): Result.003 file - promoters60/4769312
caataaagtag

SEQ ID NO: 139081 - DNA, 11 bp, Unknown
  misc_feature (1)..( 11): Result.003 file - promoters60/4769312
aaataaagctt

SEQ ID NO: 139082 - DNA, 7 bp, Unknown
  misc_feature (1)..( 7): Result.003 file - promoters60/4769312
aaattaa

SEQ ID NO: 139083 - DNA, 7 bp, Unknown
  misc_feature (1)..( 7): Result.003 file - promoters60/4769312
aaattat

SEQ ID NO: 139084 - DNA, 7 bp, Unknown
  misc_feature (1)..( 7): Result.003 file - promoters60/4769312
aaagtaa

SEQ ID NO: 139085 - DNA, 7 bp, Unknown
  misc_feature (1)..( 7): Result.003 file - promoters60/4769312
aaatatt

SEQ ID NO: 139086 - DNA, 8 bp, Unknown
  misc_feature (1)..( 8): Result.003 file - promoters60/4769312
ggaaaaaa

SEQ ID NO: 139087 - DNA, 8 bp, Unknown
  misc_feature (1)..( 8): Result.003 file - promoters60/4769312
tgaacaaa

SEQ ID NO: 139088 - DNA, 8 bp, Unknown
  misc_feature (1)..( 8): Result.003 file - promoters60/4769312
tgaccaaa

SEQ ID NO: 139089 - DNA, 11 bp, Unknown
  misc_feature (1)..( 11): Result.003 file - promoters60/4769312
gaatctctctg

SEQ ID NO: 139090 - DNA, 11 bp, Unknown
  misc_feature (1)..( 11): Result.003 file - promoters60/4769312
caatcactctc

SEQ ID NO: 139091 - DNA, 11 bp, Unknown
  misc_feature (1)..( 11): Result.003 file - promoters60/4769312
caatccctctc

SEQ ID NO: 139092 - DNA, 10 bp, Unknown
  misc_feature (1)..( 10): Result.003 file - promoters60/4769312
tatatatacc

SEQ ID NO: 139093 - DNA, 10 bp, Unknown
  misc_feature (1)..( 10): Result.003 file - promoters60/4769312
tatataatag

SEQ ID NO: 139094 - DNA, 10 bp, Unknown
  misc_feature (1)..( 10): Result.003 file - promoters60/4769312
tatataaacc

SEQ ID NO: 139095 - DNA, 10 bp, Unknown
  misc_feature (1)..( 10): Result.003 file - promoters60/4769312
tatttaaaca

SEQ ID NO: 139096 - DNA, 9 bp, Unknown
  misc_feature (1)..( 9): Result.003 file - promoters60/4769312
ttgaccagg

SEQ ID NO: 139097 - DNA, 9 bp, Unknown
  misc_feature (1)..( 9): Result.003 file - promoters60/4769312
ttgaccaaa

SEQ ID NO: 139098 - DNA, 9 bp, Unknown
  misc_feature (1)..( 9): Result.003 file - promoters60/4769312
atgaacaaa

SEQ ID NO: 139099 - DNA, 6 bp, Unknown
  misc_feature (1)..( 6): Result.003 file - promoters60/4769320
aaatac

SEQ ID NO: 139100 - DNA, 6 bp, Unknown
  misc_feature (1)..( 6): Result.003 file - promoters60/4769320
aaatac

SEQ ID NO: 139101 - DNA, 6 bp, Unknown
  misc_feature (1)..( 6): Result.003 file - promoters60/4769320
cattaa

SEQ ID NO: 139102 - DNA, 6 bp, Unknown
  misc_feature (1)..( 6): Result.003 file - promoters60/4769320
cattaa

SEQ ID NO: 139103 - DNA, 6 bp, Unknown
  misc_feature (1)..( 6): Result.003 file - promoters60/4769320
caaaca

SEQ ID NO: 139104 - DNA, 6 bp, Unknown
  misc_feature (1)..( 6): Result.003 file - promoters60/4769320
caaaca

SEQ ID NO: 139105 - DNA, 6 bp, Unknown
  misc_feature (1)..( 6): Result.003 file - promoters60/4769320
aacaaa

SEQ ID NO: 139106 - DNA, 6 bp, Unknown
  misc_feature (1)..( 6): Result.003 file - promoters60/4769320
aacaaa

SEQ ID NO: 139107 - DNA, 6 bp, Unknown
  misc_feature (1)..( 6): Result.003 file - promoters60/4769320
aaaata

SEQ ID NO: 139108 - DNA, 6 bp, Unknown
  misc_feature (1)..( 6): Result.003 file - promoters60/4769320
aaaata

SEQ ID NO: 139109 - DNA, 8 bp, Unknown
  misc_feature (1)..( 8): Result.003 file - promoters60/4769320
attacaca

SEQ ID NO: 139110 - DNA, 8 bp, Unknown
  misc_feature (1)..( 8): Result.003 file - promoters60/4769320
attacaat

SEQ ID NO: 139111 - DNA, 8 bp, Unknown
  misc_feature (1)..( 8): Result.003 file - promoters60/4769320
cttaaaca

SEQ ID NO: 139112 - DNA, 14 bp, Unknown
  misc_feature (1)..( 14): Result.003 file - promoters60/4769320
atttgatagtgatt

SEQ ID NO: 139113 - DNA, 14 bp, Unknown
  misc_feature (1)..( 14): Result.003 file - promoters60/4769320
atttaatagtcatt

SEQ ID NO: 139114 - DNA, 14 bp, Unknown
  misc_feature (1)..( 14): Result.003 file - promoters60/4769320
tactaatactcaaa

SEQ ID NO: 139115 - DNA, 7 bp, Unknown
  misc_feature (1)..( 7): Result.003 file - promoters60/4769320
aatttca

SEQ ID NO: 139116 - DNA, 7 bp, Unknown
  misc_feature (1)..( 7): Result.003 file - promoters60/4769320
aatatca

SEQ ID NO: 139117 - DNA, 8 bp, Unknown
  misc_feature (1)..( 8): Result.003 file - promoters60/4769320
tatttttt

SEQ ID NO: 139118 - DNA, 8 bp, Unknown
  misc_feature (1)..( 8): Result.003 file - promoters60/4769320
tattgttt

SEQ ID NO: 139119 - DNA, 9 bp, Unknown
  misc_feature (1)..( 9): Result.003 file - promoters60/4769320
tatatgatt

SEQ ID NO: 139120 - DNA, 9 bp, Unknown
  misc_feature (1)..( 9): Result.003 file - promoters60/4769320
tatttgatt

SEQ ID NO: 139121 - DNA, 9 bp, Unknown
  misc_feature (1)..( 9): Result.003 file - promoters60/4769320
tatttttgt

SEQ ID NO: 139122 - DNA, 6 bp, Unknown
  misc_feature (1)..( 6): Result.003 file - promoters60/4769320
tgtaat

SEQ ID NO: 139123 - DNA, 6 bp, Unknown
  misc_feature (1)..( 6): Result.003 file - promoters60/4769320
tgtaat

SEQ ID NO: 139124 - DNA, 7 bp, Unknown
  misc_feature (1)..( 7): Result.003 file - promoters60/4769320
aaatata

SEQ ID NO: 139125 - DNA, 7 bp, Unknown
  misc_feature (1)..( 7): Result.003 file - promoters60/4769320
aaaaata

SEQ ID NO: 139126 - DNA, 6 bp, Unknown
  misc_feature (1)..( 6): Result.003 file - promoters60/4769320
aaaata

SEQ ID NO: 139127 - DNA, 6 bp, Unknown
  misc_feature (1)..( 6): Result.003 file - promoters60/4769320
aaaata

SEQ ID NO: 139128 - DNA, 7 bp, Unknown
  misc_feature (1)..( 7): Result.003 file - promoters60/4769320
aattttg

SEQ ID NO: 139129 - DNA, 7 bp, Unknown
  misc_feature (1)..( 7): Result.003 file - promoters60/4769320
aatattg

SEQ ID NO: 139130 - DNA, 6 bp, Unknown
  misc_feature (1)..( 6): Result.003 file - promoters60/4769320
acactt

SEQ ID NO: 139131 - DNA, 6 bp, Unknown
  misc_feature (1)..( 6): Result.003 file - promoters60/4769320
acactt

SEQ ID NO: 139132 - DNA, 6 bp, Unknown
  misc_feature (1)..( 6): Result.003 file - promoters60/4769320
ttgtat

SEQ ID NO: 139133 - DNA, 6 bp, Unknown
  misc_feature (1)..( 6): Result.003 file - promoters60/4769320
ttgtat

SEQ ID NO: 139134 - DNA, 6 bp, Unknown
  misc_feature (1)..( 6): Result.003 file - promoters60/4769320
taactt

SEQ ID NO: 139135 - DNA, 6 bp, Unknown
  misc_feature (1)..( 6): Result.003 file - promoters60/4769320
taactt

SEQ ID NO: 139136 - DNA, 6 bp, Unknown
  misc_feature (1)..( 6): Result.003 file - promoters60/4769320
attcat

SEQ ID NO: 139137 - DNA, 6 bp, Unknown
  misc_feature (1)..( 6): Result.003 file - promoters60/4769320
attcat

SEQ ID NO: 139138 - DNA, 6 bp, Unknown
  misc_feature (1)..( 6): Result.003 file - promoters60/4769320
gtcatt

SEQ ID NO: 139139 - DNA, 6 bp, Unknown
  misc_feature (1)..( 6): Result.003 file - promoters60/4769320
gtcatt

SEQ ID NO: 139140 - DNA, 13 bp, Unknown
  misc_feature (1)..( 13): Result.003 file - promoters60/4769328
gtagatttcttca

SEQ ID NO: 139141 - DNA, 13 bp, Unknown
  misc_feature (1)..( 13): Result.003 file - promoters60/4769328
gaagctttcttct

SEQ ID NO: 139142 - DNA, 13 bp, Unknown
  misc_feature (1)..( 13): Result.003 file - promoters60/4769328
tttaggttcctca

SEQ ID NO: 139143 - DNA, 13 bp, Unknown
  misc_feature (1)..( 13): Result.003 file - promoters60/4769328
ataattttcttct

SEQ ID NO: 139144 - DNA, 13 bp, Unknown
  misc_feature (1)..( 13): Result.003 file - promoters60/4769328
atagttttctgtt

SEQ ID NO: 139145 - DNA, 13 bp, Unknown
  misc_feature (1)..( 13): Result.003 file - promoters60/4769328
tttaatttcttaa

SEQ ID NO: 139146 - DNA, 12 bp, Unknown
  misc_feature (1)..( 12): Result.003 file - promoters60/4769328
tcacatacgtaa

SEQ ID NO: 139147 - DNA, 12 bp, Unknown
  misc_feature (1)..( 12): Result.003 file - promoters60/4769328
gaacaaacgccg

SEQ ID NO: 139148 - DNA, 12 bp, Unknown
  misc_feature (1)..( 12): Result.003 file - promoters60/4769328
attcatataaat

SEQ ID NO: 139149 - DNA, 12 bp, Unknown
  misc_feature (1)..( 12): Result.003 file - promoters60/4769328
actcatatccat

SEQ ID NO: 139150 - DNA, 12 bp, Unknown
  misc_feature (1)..( 12): Result.003 file - promoters60/4769328
attgatatggtg

SEQ ID NO: 139151 - DNA, 12 bp, Unknown
  misc_feature (1)..( 12): Result.003 file - promoters60/4769328
cattttatcgat

SEQ ID NO: 139152 - DNA, 6 bp, Unknown
  misc_feature (1)..( 6): Result.003 file - promoters60/4769344
cttcgt

SEQ ID NO: 139153 - DNA, 6 bp, Unknown
  misc_feature (1)..( 6): Result.003 file - promoters60/4769344
cttcgt

SEQ ID NO: 139154 - DNA, 7 bp, Unknown
  misc_feature (1)..( 7): Result.003 file - promoters60/4769344
tggattt

SEQ ID NO: 139155 - DNA, 7 bp, Unknown
  misc_feature (1)..( 7): Result.003 file - promoters60/4769344
tggtttt

SEQ ID NO: 139156 - DNA, 6 bp, Unknown
  misc_feature (1)..( 6): Result.003 file - promoters60/4769344
ttgctt

SEQ ID NO: 139157 - DNA, 6 bp, Unknown
  misc_feature (1)..( 6): Result.003 file - promoters60/4769344
ttgctt

SEQ ID NO: 139158 - DNA, 6 bp, Unknown
  misc_feature (1)..( 6): Result.003 file - promoters60/4769344
atgtgt

SEQ ID NO: 139159 - DNA, 6 bp, Unknown
  misc_feature (1)..( 6): Result.003 file - promoters60/4769344
atgtgt

SEQ ID NO: 139160 - DNA, 6 bp, Unknown
  misc_feature (1)..( 6): Result.003 file - promoters60/4769344
gtactg

SEQ ID NO: 139161 - DNA, 6 bp, Unknown
  misc_feature (1)..( 6): Result.003 file - promoters60/4769344
gtactg

SEQ ID NO: 139162 - DNA, 7 bp, Unknown
  misc_feature (1)..( 7): Result.003 file - promoters60/4769344
cattgtt

SEQ ID NO: 139163 - DNA, 7 bp, Unknown
  misc_feature (1)..( 7): Result.003 file - promoters60/4769344
catcgtt

SEQ ID NO: 139164 - DNA, 7 bp, Unknown
  misc_feature (1)..( 7): Result.003 file - promoters60/4769344
tctgaaa

SEQ ID NO: 139165 - DNA, 7 bp, Unknown
  misc_feature (1)..( 7): Result.003 file - promoters60/4769344
tcttaaa

SEQ ID NO: 139166 - DNA, 7 bp, Unknown
  misc_feature (1)..( 7): Result.003 file - promoters60/4769344
acttaaa

SEQ ID NO: 139167 - DNA, 7 bp, Unknown
  misc_feature (1)..( 7): Result.003 file - promoters60/4769344
attattg

SEQ ID NO: 139168 - DNA, 7 bp, Unknown
  misc_feature (1)..( 7): Result.003 file - promoters60/4769344
atttttg

SEQ ID NO: 139169 - DNA, 7 bp, Unknown
  misc_feature (1)..( 7): Result.003 file - promoters60/4769344
gcttagt

SEQ ID NO: 139170 - DNA, 7 bp, Unknown
  misc_feature (1)..( 7): Result.003 file - promoters60/4769344
gctgagt

SEQ ID NO: 139171 - DNA, 6 bp, Unknown
  misc_feature (1)..( 6): Result.003 file - promoters60/4769344
taaaac

SEQ ID NO: 139172 - DNA, 6 bp, Unknown
  misc_feature (1)..( 6): Result.003 file - promoters60/4769344
taaaac

SEQ ID NO: 139173 - DNA, 8 bp, Unknown
  misc_feature (1)..( 8): Result.003 file - promoters60/4769344
ttgaagaa

SEQ ID NO: 139174 - DNA, 8 bp, Unknown
  misc_feature (1)..( 8): Result.003 file - promoters60/4769344
ttgacgaa

SEQ ID NO: 139175 - DNA, 7 bp, Unknown
  misc_feature (1)..( 7): Result.003 file - promoters60/4769344
aaacttt

SEQ ID NO: 139176 - DNA, 7 bp, Unknown
  misc_feature (1)..( 7): Result.003 file - promoters60/4769344
aaacttt

SEQ ID NO: 139177 - DNA, 6 bp, Unknown
  misc_feature (1)..( 6): Result.003 file - promoters60/4769344
gtttga

SEQ ID NO: 139178 - DNA, 6 bp, Unknown
  misc_feature (1)..( 6): Result.003 file - promoters60/4769344
gtttga

SEQ ID NO: 139179 - DNA, 7 bp, Unknown
  misc_feature (1)..( 7): Result.003 file - promoters60/4769344
tatattt

SEQ ID NO: 139180 - DNA, 7 bp, Unknown
  misc_feature (1)..( 7): Result.003 file - promoters60/4769344
tatattt

SEQ ID NO: 139181 - DNA, 9 bp, Unknown
  misc_feature (1)..( 9): Result.003 file - promoters60/4769366
acaactact

SEQ ID NO: 139182 - DNA, 9 bp, Unknown
  misc_feature (1)..( 9): Result.003 file - promoters60/4769366
acaactaag

SEQ ID NO: 139183 - DNA, 9 bp, Unknown
  misc_feature (1)..( 9): Result.003 file - promoters60/4769366
aaaactaag

SEQ ID NO: 139184 - DNA, 6 bp, Unknown
  misc_feature (1)..( 6): Result.003 file - promoters60/4769366
ccaaac

SEQ ID NO: 139185 - DNA, 6 bp, Unknown
  misc_feature (1)..( 6): Result.003 file - promoters60/4769366
ccaaac

SEQ ID NO: 139186 - DNA, 8 bp, Unknown
  misc_feature (1)..( 8): Result.003 file - promoters60/4769366
caccaacc

SEQ ID NO: 139187 - DNA, 8 bp, Unknown
  misc_feature (1)..( 8): Result.003 file - promoters60/4769366
cactaacc

SEQ ID NO: 139188 - DNA, 6 bp, Unknown
  misc_feature (1)..( 6): Result.003 file - promoters60/4769366
ttctca

SEQ ID NO: 139189 - DNA, 6 bp, Unknown
  misc_feature (1)..( 6): Result.003 file - promoters60/4769366
ttctca

SEQ ID NO: 139190 - DNA, 16 bp, Unknown
  misc_feature (1)..( 16): Result.003 file - promoters60/4769366
cacaaatttaaccaaa

SEQ ID NO: 139191 - DNA, 16 bp, Unknown
  misc_feature (1)..( 16): Result.003 file - promoters60/4769366
gtttgatttatccaaa

SEQ ID NO: 139192 - DNA, 16 bp, Unknown
  misc_feature (1)..( 16): Result.003 file - promoters60/4769366
cacatatttagcaaaa

SEQ ID NO: 139193 - DNA, 14 bp, Unknown
  misc_feature (1)..( 14): Result.003 file - promoters60/4769366
ttcttatttaaacg

SEQ ID NO: 139194 - DNA, 14 bp, Unknown
  misc_feature (1)..( 14): Result.003 file - promoters60/4769366
ttcctattaaaacc

SEQ ID NO: 139195 - DNA, 14 bp, Unknown
  misc_feature (1)..( 14): Result.003 file - promoters60/4769366
tctgttataaaacc

SEQ ID NO: 139196 - DNA, 9 bp, Unknown
  misc_feature (1)..( 9): Result.003 file - promoters60/4769366
ataatcaat

SEQ ID NO: 139197 - DNA, 9 bp, Unknown
  misc_feature (1)..( 9): Result.003 file - promoters60/4769366
ataataaat

SEQ ID NO: 139198 - DNA, 12 bp, Unknown
  misc_feature (1)..( 12): Result.003 file - promoters60/4769366
tataaacatttt

SEQ ID NO: 139199 - DNA, 12 bp, Unknown
  misc_feature (1)..( 12): Result.003 file - promoters60/4769366
actaaaaatttt

SEQ ID NO: 139200 - DNA, 12 bp, Unknown
  misc_feature (1)..( 12): Result.003 file - promoters60/4769366
actacaaattcc

SEQ ID NO: 139201 - DNA, 7 bp, Unknown
  misc_feature (1)..( 7): Result.003 file - promoters60/4769366
aaaagtc

SEQ ID NO: 139202 - DNA, 7 bp, Unknown
  misc_feature (1)..( 7): Result.003 file - promoters60/4769366
aaatgtc

SEQ ID NO: 139203 - DNA, 6 bp, Unknown
  misc_feature (1)..( 6): Result.003 file - promoters60/4769366
atattt

SEQ ID NO: 139204 - DNA, 6 bp, Unknown
  misc_feature (1)..( 6): Result.003 file - promoters60/4769366
atattt

SEQ ID NO: 139205 - DNA, 7 bp, Unknown
  misc_feature (1)..( 7): Result.003 file - promoters60/4769366
aaattca

SEQ ID NO: 139206 - DNA, 7 bp, Unknown
  misc_feature (1)..( 7): Result.003 file - promoters60/4769366
aaaatca

SEQ ID NO: 139207 - DNA, 6 bp, Unknown
  misc_feature (1)..( 6): Result.003 file - promoters60/4769366
ccttct

SEQ ID NO: 139208 - DNA, 6 bp, Unknown
  misc_feature (1)..( 6): Result.003 file - promoters60/4769366
ccttct

SEQ ID NO: 139209 - DNA, 10 bp, Unknown
  misc_feature (1)..( 10): Result.003 file - promoters60/4769366
tttagccaaa

SEQ ID NO: 139210 - DNA, 10 bp, Unknown
  misc_feature (1)..( 10): Result.003 file - promoters60/4769366
tttagcaaaa

SEQ ID NO: 139211 - DNA, 6 bp, Unknown
  misc_feature (1)..( 6): Result.003 file - promoters60/4769366
acacaa

SEQ ID NO: 139212 - DNA, 6 bp, Unknown
  misc_feature (1)..( 6): Result.003 file - promoters60/4769366
acacaa

SEQ ID NO: 139213 - DNA, 7 bp, Unknown
  misc_feature (1)..( 7): Result.003 file - promoters60/4769366
gatcttg

SEQ ID NO: 139214 - DNA, 7 bp, Unknown
  misc_feature (1)..( 7): Result.003 file - promoters60/4769366
gatattg

SEQ ID NO: 139215 - DNA, 7 bp, Unknown
  misc_feature (1)..( 7): Result.003 file - promoters60/4769366
aatgcaa

SEQ ID NO: 139216 - DNA, 7 bp, Unknown
  misc_feature (1)..( 7): Result.003 file - promoters60/4769366
aatccaa

SEQ ID NO: 139217 - DNA, 6 bp, Unknown
  misc_feature (1)..( 6): Result.003 file - promoters60/4769366
ccacta

SEQ ID NO: 139218 - DNA, 6 bp, Unknown
  misc_feature (1)..( 6): Result.003 file - promoters60/4769366
ccacta

SEQ ID NO: 139219 - DNA, 8 bp, Unknown
  misc_feature (1)..( 8): Result.003 file - promoters60/4769384
attttatt

SEQ ID NO: 139220 - DNA, 8 bp, Unknown
  misc_feature (1)..( 8): Result.003 file - promoters60/4769384
atttgatt

SEQ ID NO: 139221 - DNA, 7 bp, Unknown
  misc_feature (1)..( 7): Result.003 file - promoters60/4769384
ttctccc

SEQ ID NO: 139222 - DNA, 7 bp, Unknown
  misc_feature (1)..( 7): Result.003 file - promoters60/4769384
ttctccc

SEQ ID NO: 139223 - DNA, 7 bp, Unknown
  misc_feature (1)..( 7): Result.003 file - promoters60/4769384
acaatct

SEQ ID NO: 139224 - DNA, 7 bp, Unknown
  misc_feature (1)..( 7): Result.003 file - promoters60/4769384
acactct

SEQ ID NO: 139225 - DNA, 7 bp, Unknown
  misc_feature (1)..( 7): Result.003 file - promoters60/4769384
tctatat

SEQ ID NO: 139226 - DNA, 7 bp, Unknown
  misc_feature (1)..( 7): Result.003 file - promoters60/4769384
tctttat

SEQ ID NO: 139227 - DNA, 8 bp, Unknown
  misc_feature (1)..( 8): Result.003 file - promoters60/4769384
tatctttg

SEQ ID NO: 139228 - DNA, 8 bp, Unknown
  misc_feature (1)..( 8): Result.003 file - promoters60/4769384
tatcgttg

SEQ ID NO: 139229 - DNA, 6 bp, Unknown
  misc_feature (1)..( 6): Result.003 file - promoters60/4769384
ctccaa

SEQ ID NO: 139230 - DNA, 6 bp, Unknown
  misc_feature (1)..( 6): Result.003 file - promoters60/4769384
ctccaa

SEQ ID NO: 139231 - DNA, 6 bp, Unknown
  misc_feature (1)..( 6): Result.003 file - promoters60/4769384
ttaaca

SEQ ID NO: 139232 - DNA, 6 bp, Unknown
  misc_feature (1)..( 6): Result.003 file - promoters60/4769384
ttaaca

SEQ ID NO: 139233 - DNA, 6 bp, Unknown
  misc_feature (1)..( 6): Result.003 file - promoters60/4769384
gtggac

SEQ ID NO: 139234 - DNA, 6 bp, Unknown
  misc_feature (1)..( 6): Result.003 file - promoters60/4769384
gtggac

SEQ ID NO: 139235 - DNA, 6 bp, Unknown
  misc_feature (1)..( 6): Result.003 file - promoters60/4769384
attata

SEQ ID NO: 139236 - DNA, 6 bp, Unknown
  misc_feature (1)..( 6): Result.003 file - promoters60/4769384
attata

SEQ ID NO: 139237 - DNA, 6 bp, Unknown
  misc_feature (1)..( 6): Result.003 file - promoters60/4769384
tatttt

SEQ ID NO: 139238 - DNA, 6 bp, Unknown
  misc_feature (1)..( 6): Result.003 file - promoters60/4769384
tatttt

SEQ ID NO: 139239 - DNA, 11 bp, Unknown
  misc_feature (1)..( 11): Result.003 file - promoters60/4769384
ccaaatattaa

SEQ ID NO: 139240 - DNA, 11 bp, Unknown
  misc_feature (1)..( 11): Result.003 file - promoters60/4769384
ccatatattaa

SEQ ID NO: 139241 - DNA, 6 bp, Unknown
  misc_feature (1)..( 6): Result.003 file - promoters60/4769384
ataaaa

SEQ ID NO: 139242 - DNA, 6 bp, Unknown
  misc_feature (1)..( 6): Result.003 file - promoters60/4769384
ataaaa

SEQ ID NO: 139243 - DNA, 8 bp, Unknown
  misc_feature (1)..( 8): Result.003 file - promoters60/4769384
aaaataag

SEQ ID NO: 139244 - DNA, 8 bp, Unknown
  misc_feature (1)..( 8): Result.003 file - promoters60/4769384
aaaagaag

SEQ ID NO: 139245 - DNA, 7 bp, Unknown
  misc_feature (1)..( 7): Result.003 file - promoters60/4769384
aaaaaga

SEQ ID NO: 139246 - DNA, 7 bp, Unknown
  misc_feature (1)..( 7): Result.003 file - promoters60/4769384
aaaaaga

SEQ ID NO: 139247 - DNA, 7 bp, Unknown
  misc_feature (1)..( 7): Result.003 file - promoters60/4769384
aaaacaa

SEQ ID NO: 139248 - DNA, 7 bp, Unknown
  misc_feature (1)..( 7): Result.003 file - promoters60/4769384
aaaacaa

SEQ ID NO: 139249 - DNA, 6 bp, Unknown
  misc_feature (1)..( 6): Result.003 file - promoters60/4769384
ggtctc

SEQ ID NO: 139250 - DNA, 6 bp, Unknown
  misc_feature (1)..( 6): Result.003 file - promoters60/4769384
ggtctc

SEQ ID NO: 139251 - DNA, 7 bp, Unknown
  misc_feature (1)..( 7): Result.003 file - promoters60/4769384
ctaattt

SEQ ID NO: 139252 - DNA, 7 bp, Unknown
  misc_feature (1)..( 7): Result.003 file - promoters60/4769384
ctagttt

SEQ ID NO: 139253 - DNA, 6 bp, Unknown
  misc_feature (1)..( 6): Result.003 file - promoters60/4769384
tttgga

SEQ ID NO: 139254 - DNA, 6 bp, Unknown
  misc_feature (1)..( 6): Result.003 file - promoters60/4769384
tttgga

SEQ ID NO: 139255 - DNA, 6 bp, Unknown
  misc_feature (1)..( 6): Result.003 file - promoters60/4769384
gatttg

SEQ ID NO: 139256 - DNA, 6 bp, Unknown
  misc_feature (1)..( 6): Result.003 file - promoters60/4769384
gatttg

SEQ ID NO: 139257 - DNA, 8 bp, Unknown
  misc_feature (1)..( 8): Result.003 file - promoters60/4769384
aaaacttt

SEQ ID NO: 139258 - DNA, 8 bp, Unknown
  misc_feature (1)..( 8): Result.003 file - promoters60/4769384
aaatcttt

SEQ ID NO: 139259 - DNA, 6 bp, Unknown
  misc_feature (1)..( 6): Result.003 file - promoters60/4769388
ccatat

SEQ ID NO: 139260 - DNA, 6 bp, Unknown
  misc_feature (1)..( 6): Result.003 file - promoters60/4769388
ccatat

SEQ ID NO: 139261 - DNA, 6 bp, Unknown
  misc_feature (1)..( 6): Result.003 file - promoters60/4769388
tataaa

SEQ ID NO: 139262 - DNA, 6 bp, Unknown
  misc_feature (1)..( 6): Result.003 file - promoters60/4769388
tataaa

SEQ ID NO: 139263 - DNA, 6 bp, Unknown
  misc_feature (1)..( 6): Result.003 file - promoters60/4769388
gttttg

SEQ ID NO: 139264 - DNA, 6 bp, Unknown
  misc_feature (1)..( 6): Result.003 file - promoters60/4769388
gttttg

SEQ ID NO: 139265 - DNA, 8 bp, Unknown
  misc_feature (1)..( 8): Result.003 file - promoters60/4769388
ttttaaat

SEQ ID NO: 139266 - DNA, 8 bp, Unknown
  misc_feature (1)..( 8): Result.003 file - promoters60/4769388
ctttaaaa

SEQ ID NO: 139267 - DNA, 6 bp, Unknown
  misc_feature (1)..( 6): Result.003 file - promoters60/4769388
agaaat

SEQ ID NO: 139268 - DNA, 6 bp, Unknown
  misc_feature (1)..( 6): Result.003 file - promoters60/4769388
agaaat

SEQ ID NO: 139269 - DNA, 7 bp, Unknown
  misc_feature (1)..( 7): Result.003 file - promoters60/4769388
tcgtaag

SEQ ID NO: 139270 - DNA, 7 bp, Unknown
  misc_feature (1)..( 7): Result.003 file - promoters60/4769388
tcgtaag

SEQ ID NO: 139271 - DNA, 6 bp, Unknown
  misc_feature (1)..( 6): Result.003 file - promoters60/4769388
aagaaa

SEQ ID NO: 139272 - DNA, 6 bp, Unknown
  misc_feature (1)..( 6): Result.003 file - promoters60/4769388
aagaaa

SEQ ID NO: 139273 - DNA, 6 bp, Unknown
  misc_feature (1)..( 6): Result.003 file - promoters60/4769388
gtcatc

SEQ ID NO: 139274 - DNA, 6 bp, Unknown
  misc_feature (1)..( 6): Result.003 file - promoters60/4769388
gtcatc

SEQ ID NO: 139275 - DNA, 7 bp, Unknown
  misc_feature (1)..( 7): Result.003 file - promoters60/4769388
aaataca

SEQ ID NO: 139276 - DNA, 7 bp, Unknown
  misc_feature (1)..( 7): Result.003 file - promoters60/4769388
aaacaca

SEQ ID NO: 139277 - DNA, 7 bp, Unknown
  misc_feature (1)..( 7): Result.003 file - promoters60/4769388
ccattgt

SEQ ID NO: 139278 - DNA, 7 bp, Unknown
  misc_feature (1)..( 7): Result.003 file - promoters60/4769388
ccattgt

SEQ ID NO: 139279 - DNA, 10 bp, Unknown
  misc_feature (1)..( 10): Result.003 file - promoters60/4769392
cccaaaattg

SEQ ID NO: 139280 - DNA, 10 bp, Unknown
  misc_feature (1)..( 10): Result.003 file - promoters60/4769392
cgtaaaattt

SEQ ID NO: 139281 - DNA, 10 bp, Unknown
  misc_feature (1)..( 10): Result.003 file - promoters60/4769392
tgtataatgg

SEQ ID NO: 139282 - DNA, 10 bp, Unknown
  misc_feature (1)..( 10): Result.003 file - promoters60/4769392
tggaaacttt

SEQ ID NO: 139283 - DNA, 10 bp, Unknown
  misc_feature (1)..( 10): Result.003 file - promoters60/4769392
tgtttaagta

SEQ ID NO: 139284 - DNA, 12 bp, Unknown
  misc_feature (1)..( 12): Result.003 file - promoters60/4769392
ttcatttttatt

SEQ ID NO: 139285 - DNA, 12 bp, Unknown
  misc_feature (1)..( 12): Result.003 file - promoters60/4769392
aaactttttacg

SEQ ID NO: 139286 - DNA, 12 bp, Unknown
  misc_feature (1)..( 12): Result.003 file - promoters60/4769392
gttggttttatt

SEQ ID NO: 139287 - DNA, 12 bp, Unknown
  misc_feature (1)..( 12): Result.003 file - promoters60/4769392
tcacttttcctt

SEQ ID NO: 139288 - DNA, 12 bp, Unknown
  misc_feature (1)..( 12): Result.003 file - promoters60/4769392
tagtgttttatt

SEQ ID NO: 139289 - DNA, 10 bp, Unknown
  misc_feature (1)..( 10): Result.003 file - promoters60/4769392
ggattaattc

SEQ ID NO: 139290 - DNA, 10 bp, Unknown
  misc_feature (1)..( 10): Result.003 file - promoters60/4769392
cgtttacttc

SEQ ID NO: 139291 - DNA, 10 bp, Unknown
  misc_feature (1)..( 10): Result.003 file - promoters60/4769392
cctttaatta

SEQ ID NO: 139292 - DNA, 10 bp, Unknown
  misc_feature (1)..( 10): Result.003 file - promoters60/4769392
cctataataa

SEQ ID NO: 139293 - DNA, 11 bp, Unknown
  misc_feature (1)..( 11): Result.003 file - promoters60/4769392
taaatctttat

SEQ ID NO: 139294 - DNA, 11 bp, Unknown
  misc_feature (1)..( 11): Result.003 file - promoters60/4769392
aaaaactttat

SEQ ID NO: 139295 - DNA, 11 bp, Unknown
  misc_feature (1)..( 11): Result.003 file - promoters60/4769392
taaatattttt

SEQ ID NO: 139296 - DNA, 11 bp, Unknown
  misc_feature (1)..( 11): Result.003 file - promoters60/4769392
ctaaactttga

SEQ ID NO: 139297 - DNA, 12 bp, Unknown
  misc_feature (1)..( 12): Result.003 file - promoters60/4769392
aaagaaataaat

SEQ ID NO: 139298 - DNA, 12 bp, Unknown
  misc_feature (1)..( 12): Result.003 file - promoters60/4769392
tattaaataaat

SEQ ID NO: 139299 - DNA, 12 bp, Unknown
  misc_feature (1)..( 12): Result.003 file - promoters60/4769392
gtccaaaaaaaa

SEQ ID NO: 139300 - DNA, 12 bp, Unknown
  misc_feature (1)..( 12): Result.003 file - promoters60/4769392
cttgaaaaaaga

SEQ ID NO: 139301 - DNA, 12 bp, Unknown
  misc_feature (1)..( 12): Result.003 file - promoters60/4769392
ccacaaatatcg

SEQ ID NO: 139302 - DNA, 9 bp, Unknown
  misc_feature (1)..( 9): Result.003 file - promoters60/4769392
atttatttc

SEQ ID NO: 139303 - DNA, 9 bp, Unknown
  misc_feature (1)..( 9): Result.003 file - promoters60/4769392
ttttgtttc

SEQ ID NO: 139304 - DNA, 9 bp, Unknown
  misc_feature (1)..( 9): Result.003 file - promoters60/4769392
ttatgtata

SEQ ID NO: 139305 - DNA, 9 bp, Unknown
  misc_feature (1)..( 9): Result.003 file - promoters60/4769392
ttatgtgat

SEQ ID NO: 139306 - DNA, 12 bp, Unknown
  misc_feature (1)..( 12): Result.003 file - promoters60/4769392
ttttaaaaaaga

SEQ ID NO: 139307 - DNA, 12 bp, Unknown
  misc_feature (1)..( 12): Result.003 file - promoters60/4769392
cttgaaaaaaga

SEQ ID NO: 139308 - DNA, 12 bp, Unknown
  misc_feature (1)..( 12): Result.003 file - promoters60/4769392
gtccaaaaaaaa

SEQ ID NO: 139309 - DNA, 12 bp, Unknown
  misc_feature (1)..( 12): Result.003 file - promoters60/4769392
aaataaaaaaaa

SEQ ID NO: 139310 - DNA, 12 bp, Unknown
  misc_feature (1)..( 12): Result.003 file - promoters60/4769392
aatcaaaacaaa

SEQ ID NO: 139311 - DNA, 12 bp, Unknown
  misc_feature (1)..( 12): Result.003 file - promoters60/4769392
gaccacaaatat

SEQ ID NO: 139312 - DNA, 9 bp, Unknown
  misc_feature (1)..( 9): Result.003 file - promoters60/4769392
ttatttgag

SEQ ID NO: 139313 - DNA, 9 bp, Unknown
  misc_feature (1)..( 9): Result.003 file - promoters60/4769392
ttaattgta

SEQ ID NO: 139314 - DNA, 9 bp, Unknown
  misc_feature (1)..( 9): Result.003 file - promoters60/4769392
ttatttggc

SEQ ID NO: 139315 - DNA, 9 bp, Unknown
  misc_feature (1)..( 9): Result.003 file - promoters60/4769392
ttatttttt

SEQ ID NO: 139316 - DNA, 8 bp, Unknown
  misc_feature (1)..( 8): Result.003 file - promoters60/4769392
tgattttt

SEQ ID NO: 139317 - DNA, 8 bp, Unknown
  misc_feature (1)..( 8): Result.003 file - promoters60/4769392
tgatcttt

SEQ ID NO: 139318 - DNA, 9 bp, Unknown
  misc_feature (1)..( 9): Result.003 file - promoters60/4769392
taattattt

SEQ ID NO: 139319 - DNA, 9 bp, Unknown
  misc_feature (1)..( 9): Result.003 file - promoters60/4769392
taataatta

SEQ ID NO: 139320 - DNA, 11 bp, Unknown
  misc_feature (1)..( 11): Result.003 file - promoters60/4769392
aataaatcgta

SEQ ID NO: 139321 - DNA, 11 bp, Unknown
  misc_feature (1)..( 11): Result.003 file - promoters60/4769392
agaaaatcgaa

SEQ ID NO: 139322 - DNA, 11 bp, Unknown
  misc_feature (1)..( 11): Result.003 file - promoters60/4769392
gtataatggaa

SEQ ID NO: 139323 - DNA, 11 bp, Unknown
  misc_feature (1)..( 11): Result.003 file - promoters60/4769392
atgaaaaataa

SEQ ID NO: 139324 - DNA, 19 bp, Unknown
  misc_feature (1)..( 19): Result.003 file - promoters60/4769411
aattgcaaaatatataaaa

SEQ ID NO: 139325 - DNA, 19 bp, Unknown
  misc_feature (1)..( 19): Result.003 file - promoters60/4769411
ttattcttaatttataaaa

SEQ ID NO: 139326 - DNA, 19 bp, Unknown
  misc_feature (1)..( 19): Result.003 file - promoters60/4769411
ttcggtttaatttgacaaa

SEQ ID NO: 139327 - DNA, 19 bp, Unknown
  misc_feature (1)..( 19): Result.003 file - promoters60/4769411
ttcggttgaattcatcatc

SEQ ID NO: 139328 - DNA, 19 bp, Unknown
  misc_feature (1)..( 19): Result.003 file - promoters60/4769411
tagggtttgattttgtgat

SEQ ID NO: 139329 - DNA, 19 bp, Unknown
  misc_feature (1)..( 19): Result.003 file - promoters60/4769411
aagctcttaattgtttatg

SEQ ID NO: 139330 - DNA, 10 bp, Unknown
  misc_feature (1)..( 10): Result.003 file - promoters60/4769411
aataattttc

SEQ ID NO: 139331 - DNA, 10 bp, Unknown
  misc_feature (1)..( 10): Result.003 file - promoters60/4769411
aatcattccc

SEQ ID NO: 139332 - DNA, 11 bp, Unknown
  misc_feature (1)..( 11): Result.003 file - promoters60/4769411
gataaatttat

SEQ ID NO: 139333 - DNA, 11 bp, Unknown
  misc_feature (1)..( 11): Result.003 file - promoters60/4769411
aggcgatcatt

SEQ ID NO: 139334 - DNA, 11 bp, Unknown
  misc_feature (1)..( 11): Result.003 file - promoters60/4769411
gcccaattatt

SEQ ID NO: 139335 - DNA, 11 bp, Unknown
  misc_feature (1)..( 11): Result.003 file - promoters60/4769411
tgacaaacatg

SEQ ID NO: 139336 - DNA, 11 bp, Unknown
  misc_feature (1)..( 11): Result.003 file - promoters60/4769411
tttgtataact

SEQ ID NO: 139337 - DNA, 11 bp, Unknown
  misc_feature (1)..( 11): Result.003 file - promoters60/4769411
attgtatgcaa

SEQ ID NO: 139338 - DNA, 11 bp, Unknown
  misc_feature (1)..( 11): Result.003 file - promoters60/4769411
tttgtattatt

SEQ ID NO: 139339 - DNA, 11 bp, Unknown
  misc_feature (1)..( 11): Result.003 file - promoters60/4769411
attgtaaaaag

SEQ ID NO: 139340 - DNA, 11 bp, Unknown
  misc_feature (1)..( 11): Result.003 file - promoters60/4769411
attttaaagaa

SEQ ID NO: 139341 - DNA, 11 bp, Unknown
  misc_feature (1)..( 11): Result.003 file - promoters60/4769411
agtttagagaa

SEQ ID NO: 139342 - DNA, 11 bp, Unknown
  misc_feature (1)..( 11): Result.003 file - promoters60/4769411
gttttaaaata

SEQ ID NO: 139343 - DNA, 8 bp, Unknown
  misc_feature (1)..( 8): Result.003 file - promoters60/4769411
ggataagg

SEQ ID NO: 139344 - DNA, 8 bp, Unknown
  misc_feature (1)..( 8): Result.003 file - promoters60/4769411
ggaaaagc

SEQ ID NO: 139345 - DNA, 8 bp, Unknown
  misc_feature (1)..( 8): Result.003 file - promoters60/4769411
agataaga

SEQ ID NO: 139346 - DNA, 8 bp, Unknown
  misc_feature (1)..( 8): Result.003 file - promoters60/4769411
gaaaaagc

SEQ ID NO: 139347 - DNA, 8 bp, Unknown
  misc_feature (1)..( 8): Result.003 file - promoters60/4769411
ggataagt

SEQ ID NO: 139348 - DNA, 12 bp, Unknown
  misc_feature (1)..( 12): Result.003 file - promoters60/4769411
caaataattttc

SEQ ID NO: 139349 - DNA, 12 bp, Unknown
  misc_feature (1)..( 12): Result.003 file - promoters60/4769411
tataaaattttg

SEQ ID NO: 139350 - DNA, 12 bp, Unknown
  misc_feature (1)..( 12): Result.003 file - promoters60/4769411
ggataaatttat

SEQ ID NO: 139351 - DNA, 12 bp, Unknown
  misc_feature (1)..( 12): Result.003 file - promoters60/4769411
gcgatcattttg

SEQ ID NO: 139352 - DNA, 12 bp, Unknown
  misc_feature (1)..( 12): Result.003 file - promoters60/4769411
ggatcaatcaat

SEQ ID NO: 139353 - DNA, 10 bp, Unknown
  misc_feature (1)..( 10): Result.003 file - promoters60/4769411
ccattaaatt

SEQ ID NO: 139354 - DNA, 10 bp, Unknown
  misc_feature (1)..( 10): Result.003 file - promoters60/4769411
cgattaaacc

SEQ ID NO: 139355 - DNA, 10 bp, Unknown
  misc_feature (1)..( 10): Result.003 file - promoters60/4769411
gaattaaatt

SEQ ID NO: 139356 - DNA, 10 bp, Unknown
  misc_feature (1)..( 10): Result.003 file - promoters60/4769411
aaattaacat

SEQ ID NO: 139357 - DNA, 10 bp, Unknown
  misc_feature (1)..( 10): Result.003 file - promoters60/4769411
aaattgagga

SEQ ID NO: 139358 - DNA, 10 bp, Unknown
  misc_feature (1)..( 10): Result.003 file - promoters60/4769411
aaagtgtttt

SEQ ID NO: 139359 - DNA, 10 bp, Unknown
  misc_feature (1)..( 10): Result.003 file - promoters60/4769411
gaagataagg

SEQ ID NO: 139360 - DNA, 10 bp, Unknown
  misc_feature (1)..( 10): Result.003 file - promoters60/4769411
agagataaag

SEQ ID NO: 139361 - DNA, 10 bp, Unknown
  misc_feature (1)..( 10): Result.003 file - promoters60/4769411
tgagagaagt

SEQ ID NO: 139362 - DNA, 10 bp, Unknown
  misc_feature (1)..( 10): Result.003 file - promoters60/4769411
gaagacaagg

SEQ ID NO: 139363 - DNA, 10 bp, Unknown
  misc_feature (1)..( 10): Result.003 file - promoters60/4769411
gaaaatatat

SEQ ID NO: 139364 - DNA, 7 bp, Unknown
  misc_feature (1)..( 7): Result.003 file - promoters60/4769420
taatttc

SEQ ID NO: 139365 - DNA, 7 bp, Unknown
  misc_feature (1)..( 7): Result.003 file - promoters60/4769420
taatttc

SEQ ID NO: 139366 - DNA, 12 bp, Unknown
  misc_feature (1)..( 12): Result.003 file - promoters60/4769420
ccaaattatttt

SEQ ID NO: 139367 - DNA, 12 bp, Unknown
  misc_feature (1)..( 12): Result.003 file - promoters60/4769420
aaaaagtatttt

SEQ ID NO: 139368 - DNA, 12 bp, Unknown
  misc_feature (1)..( 12): Result.003 file - promoters60/4769420
aaaaagtaaaca

SEQ ID NO: 139369 - DNA, 6 bp, Unknown
  misc_feature (1)..( 6): Result.003 file - promoters60/4769420
agctaa

SEQ ID NO: 139370 - DNA, 6 bp, Unknown
  misc_feature (1)..( 6): Result.003 file - promoters60/4769420
agctaa

SEQ ID NO: 139371 - DNA, 7 bp, Unknown
  misc_feature (1)..( 7): Result.003 file - promoters60/4769420
aaattat

SEQ ID NO: 139372 - DNA, 7 bp, Unknown
  misc_feature (1)..( 7): Result.003 file - promoters60/4769420
aaattat

SEQ ID NO: 139373 - DNA, 7 bp, Unknown
  misc_feature (1)..( 7): Result.003 file - promoters60/4769420
aactaag

SEQ ID NO: 139374 - DNA, 7 bp, Unknown
  misc_feature (1)..( 7): Result.003 file - promoters60/4769420
aactaag

SEQ ID NO: 139375 - DNA, 10 bp, Unknown
  misc_feature (1)..( 10): Result.003 file - promoters60/4769420
actacaaatt

SEQ ID NO: 139376 - DNA, 10 bp, Unknown
  misc_feature (1)..( 10): Result.003 file - promoters60/4769420
actaaaaatt

SEQ ID NO: 139377 - DNA, 10 bp, Unknown
  misc_feature (1)..( 10): Result.003 file - promoters60/4769420
tttagccaaa

SEQ ID NO: 139378 - DNA, 10 bp, Unknown
  misc_feature (1)..( 10): Result.003 file - promoters60/4769420
tttagcaaaa

SEQ ID NO: 139379 - DNA, 6 bp, Unknown
  misc_feature (1)..( 6): Result.003 file - promoters60/4769420
acacaa

SEQ ID NO: 139380 - DNA, 6 bp, Unknown
  misc_feature (1)..( 6): Result.003 file - promoters60/4769420
acacaa

SEQ ID NO: 139381 - DNA, 7 bp, Unknown
  misc_feature (1)..( 7): Result.003 file - promoters60/4769420
gatcttg

SEQ ID NO: 139382 - DNA, 7 bp, Unknown
  misc_feature (1)..( 7): Result.003 file - promoters60/4769420
gatattg

SEQ ID NO: 139383 - DNA, 7 bp, Unknown
  misc_feature (1)..( 7): Result.003 file - promoters60/4769420
aatgcaa

SEQ ID NO: 139384 - DNA, 7 bp, Unknown
  misc_feature (1)..( 7): Result.003 file - promoters60/4769420
aatccaa

SEQ ID NO: 139385 - DNA, 6 bp, Unknown
  misc_feature (1)..( 6): Result.003 file - promoters60/4769420
ccacta

SEQ ID NO: 139386 - DNA, 6 bp, Unknown
  misc_feature (1)..( 6): Result.003 file - promoters60/4769420
ccacta

SEQ ID NO: 139387 - DNA, 7 bp, Unknown
  misc_feature (1)..( 7): Result.003 file - promoters60/4769420
taaaacc

SEQ ID NO: 139388 - DNA, 7 bp, Unknown
  misc_feature (1)..( 7): Result.003 file - promoters60/4769420
taaaacc

SEQ ID NO: 139389 - DNA, 6 bp, Unknown
  misc_feature (1)..( 6): Result.003 file - promoters60/4769420
gttttg

SEQ ID NO: 139390 - DNA, 6 bp, Unknown
  misc_feature (1)..( 6): Result.003 file - promoters60/4769420
gttttg

SEQ ID NO: 139391 - DNA, 6 bp, Unknown
  misc_feature (1)..( 6): Result.003 file - promoters60/4769420
aattgt

SEQ ID NO: 139392 - DNA, 6 bp, Unknown
  misc_feature (1)..( 6): Result.003 file - promoters60/4769420
aattgt

SEQ ID NO: 139393 - DNA, 8 bp, Unknown
  misc_feature (1)..( 8): Result.003 file - promoters60/4769420
ccaagtaa

SEQ ID NO: 139394 - DNA, 8 bp, Unknown
  misc_feature (1)..( 8): Result.003 file - promoters60/4769420
ccaagtaa

SEQ ID NO: 139395 - DNA, 9 bp, Unknown
  misc_feature (1)..( 9): Result.003 file - promoters60/4769420
tcagtgata

SEQ ID NO: 139396 - DNA, 9 bp, Unknown
  misc_feature (1)..( 9): Result.003 file - promoters60/4769420
tcagagata

SEQ ID NO: 139397 - DNA, 6 bp, Unknown
  misc_feature (1)..( 6): Result.003 file - promoters60/4769420
ttatat

SEQ ID NO: 139398 - DNA, 6 bp, Unknown
  misc_feature (1)..( 6): Result.003 file - promoters60/4769420
ttatat

SEQ ID NO: 139399 - DNA, 7 bp, Unknown
  misc_feature (1)..( 7): Result.003 file - promoters60/4769420
atcttca

SEQ ID NO: 139400 - DNA, 7 bp, Unknown
  misc_feature (1)..( 7): Result.003 file - promoters60/4769420
atcatca

SEQ ID NO: 139401 - DNA, 7 bp, Unknown
  misc_feature (1)..( 7): Result.003 file - promoters60/4769420
caatgaa

SEQ ID NO: 139402 - DNA, 7 bp, Unknown
  misc_feature (1)..( 7): Result.003 file - promoters60/4769420
caaagaa

SEQ ID NO: 139403 - DNA, 11 bp, Unknown
  misc_feature (1)..( 11): Result.003 file - promoters60/4770260
ccatttaaatc

SEQ ID NO: 139404 - DNA, 11 bp, Unknown
  misc_feature (1)..( 11): Result.003 file - promoters60/4770260
gcattaaaata

SEQ ID NO: 139405 - DNA, 11 bp, Unknown
  misc_feature (1)..( 11): Result.003 file - promoters60/4770260
ccatttctaca

SEQ ID NO: 139406 - DNA, 11 bp, Unknown
  misc_feature (1)..( 11): Result.003 file - promoters60/4770260
aacttaatata

SEQ ID NO: 139407 - DNA, 11 bp, Unknown
  misc_feature (1)..( 11): Result.003 file - promoters60/4770260
tttgtaaaatt

SEQ ID NO: 139408 - DNA, 11 bp, Unknown
  misc_feature (1)..( 11): Result.003 file - promoters60/4770260
atatttgaaat

SEQ ID NO: 139409 - DNA, 11 bp, Unknown
  misc_feature (1)..( 11): Result.003 file - promoters60/4770260
atattcgaaat

SEQ ID NO: 139410 - DNA, 11 bp, Unknown
  misc_feature (1)..( 11): Result.003 file - promoters60/4770260
tagtttcaaat

SEQ ID NO: 139411 - DNA, 11 bp, Unknown
  misc_feature (1)..( 11): Result.003 file - promoters60/4770260
ggatttgaatt

SEQ ID NO: 139412 - DNA, 11 bp, Unknown
  misc_feature (1)..( 11): Result.003 file - promoters60/4770260
ttacttcaaag

SEQ ID NO: 139413 - DNA, 13 bp, Unknown
  misc_feature (1)..( 13): Result.003 file - promoters60/4770264
tttcttaaaaaaa

SEQ ID NO: 139414 - DNA, 13 bp, Unknown
  misc_feature (1)..( 13): Result.003 file - promoters60/4770264
tttattaaaaaaa

SEQ ID NO: 139415 - DNA, 8 bp, Unknown
  misc_feature (1)..( 8): Result.003 file - promoters60/4770264
taaaagaa

SEQ ID NO: 139416 - DNA, 8 bp, Unknown
  misc_feature (1)..( 8): Result.003 file - promoters60/4770264
taaatgaa

SEQ ID NO: 139417 - DNA, 8 bp, Unknown
  misc_feature (1)..( 8): Result.003 file - promoters60/4770264
aaaattga

SEQ ID NO: 139418 - DNA, 8 bp, Unknown
  misc_feature (1)..( 8): Result.003 file - promoters60/4770264
aaagttga

SEQ ID NO: 139419 - DNA, 6 bp, Unknown
  misc_feature (1)..( 6): Result.003 file - promoters60/4770264
aaaata

SEQ ID NO: 139420 - DNA, 6 bp, Unknown
  misc_feature (1)..( 6): Result.003 file - promoters60/4770264
aaaata

SEQ ID NO: 139421 - DNA, 8 bp, Unknown
  misc_feature (1)..( 8): Result.003 file - promoters60/4770264
caaaagat

SEQ ID NO: 139422 - DNA, 8 bp, Unknown
  misc_feature (1)..( 8): Result.003 file - promoters60/4770264
caaaggat

SEQ ID NO: 139423 - DNA, 6 bp, Unknown
  misc_feature (1)..( 6): Result.003 file - promoters60/4770264
gtgaga

SEQ ID NO: 139424 - DNA, 6 bp, Unknown
  misc_feature (1)..( 6): Result.003 file - promoters60/4770264
gtgaga

SEQ ID NO: 139425 - DNA, 10 bp, Unknown
  misc_feature (1)..( 10): Result.003 file - promoters60/4770264
cattaattct

SEQ ID NO: 139426 - DNA, 10 bp, Unknown
  misc_feature (1)..( 10): Result.003 file - promoters60/4770264
cattcattct

SEQ ID NO: 139427 - DNA, 10 bp, Unknown
  misc_feature (1)..( 10): Result.003 file - promoters60/4770264
ttaaatattt

SEQ ID NO: 139428 - DNA, 10 bp, Unknown
  misc_feature (1)..( 10): Result.003 file - promoters60/4770264
ttaattattt

SEQ ID NO: 139429 - DNA, 9 bp, Unknown
  misc_feature (1)..( 9): Result.003 file - promoters60/4770264
gaatattat

SEQ ID NO: 139430 - DNA, 9 bp, Unknown
  misc_feature (1)..( 9): Result.003 file - promoters60/4770264
gaatatctt

SEQ ID NO: 139431 - DNA, 9 bp, Unknown
  misc_feature (1)..( 9): Result.003 file - promoters60/4770264
gaaaaaata

SEQ ID NO: 139432 - DNA, 7 bp, Unknown
  misc_feature (1)..( 7): Result.003 file - promoters60/4770264
aaattta

SEQ ID NO: 139433 - DNA, 7 bp, Unknown
  misc_feature (1)..( 7): Result.003 file - promoters60/4770264
aaagtta

SEQ ID NO: 139434 - DNA, 6 bp, Unknown
  misc_feature (1)..( 6): Result.003 file - promoters60/4770264
tttgaa

SEQ ID NO: 139435 - DNA, 6 bp, Unknown
  misc_feature (1)..( 6): Result.003 file - promoters60/4770264
tttgaa

SEQ ID NO: 139436 - DNA, 7 bp, Unknown
  misc_feature (1)..( 7): Result.003 file - promoters60/4770264
gaataaa

SEQ ID NO: 139437 - DNA, 7 bp, Unknown
  misc_feature (1)..( 7): Result.003 file - promoters60/4770264
gaagaaa

SEQ ID NO: 139438 - DNA, 7 bp, Unknown
  misc_feature (1)..( 7): Result.003 file - promoters60/4770264
gatcttc

SEQ ID NO: 139439 - DNA, 7 bp, Unknown
  misc_feature (1)..( 7): Result.003 file - promoters60/4770264
gatcttc

SEQ ID NO: 139440 - DNA, 8 bp, Unknown
  misc_feature (1)..( 8): Result.003 file - promoters60/4770264
tttagctt

SEQ ID NO: 139441 - DNA, 8 bp, Unknown
  misc_feature (1)..( 8): Result.003 file - promoters60/4770264
tttatctt

SEQ ID NO: 139442 - DNA, 6 bp, Unknown
  misc_feature (1)..( 6): Result.003 file - promoters60/4770264
gaatta

SEQ ID NO: 139443 - DNA, 6 bp, Unknown
  misc_feature (1)..( 6): Result.003 file - promoters60/4770264
gaatta

SEQ ID NO: 139444 - DNA, 6 bp, Unknown
  misc_feature (1)..( 6): Result.003 file - promoters60/4770264
gcggaa

SEQ ID NO: 139445 - DNA, 6 bp, Unknown
  misc_feature (1)..( 6): Result.003 file - promoters60/4770264
gcggaa

SEQ ID NO: 139446 - DNA, 6 bp, Unknown
  misc_feature (1)..( 6): Result.003 file - promoters60/4770264
aaagaa

SEQ ID NO: 139447 - DNA, 6 bp, Unknown
  misc_feature (1)..( 6): Result.003 file - promoters60/4770264
aaagaa

SEQ ID NO: 139448 - DNA, 7 bp, Unknown
  misc_feature (1)..( 7): Result.003 file - promoters60/4770264
tattttc

SEQ ID NO: 139449 - DNA, 7 bp, Unknown
  misc_feature (1)..( 7): Result.003 file - promoters60/4770264
tatcttc

SEQ ID NO: 139450 - DNA, 6 bp, Unknown
  misc_feature (1)..( 6): Result.003 file - promoters60/4770264
tccttg

SEQ ID NO: 139451 - DNA, 6 bp, Unknown
  misc_feature (1)..( 6): Result.003 file - promoters60/4770264
tccttg

SEQ ID NO: 139452 - DNA, 7 bp, Unknown
  misc_feature (1)..( 7): Result.003 file - promoters60/4770264
gatatat

SEQ ID NO: 139453 - DNA, 7 bp, Unknown
  misc_feature (1)..( 7): Result.003 file - promoters60/4770264
gatgtat

SEQ ID NO: 139454 - DNA, 10 bp, Unknown
  misc_feature (1)..( 10): Result.003 file - promoters60/4770268
gattttgaaa

SEQ ID NO: 139455 - DNA, 10 bp, Unknown
  misc_feature (1)..( 10): Result.003 file - promoters60/4770268
attttttaaa

SEQ ID NO: 139456 - DNA, 10 bp, Unknown
  misc_feature (1)..( 10): Result.003 file - promoters60/4770268
gatattgtat

SEQ ID NO: 139457 - DNA, 10 bp, Unknown
  misc_feature (1)..( 10): Result.003 file - promoters60/4770268
tctatgaatc

SEQ ID NO: 139458 - DNA, 10 bp, Unknown
  misc_feature (1)..( 10): Result.003 file - promoters60/4770268
tctttgaata

SEQ ID NO: 139459 - DNA, 10 bp, Unknown
  misc_feature (1)..( 10): Result.003 file - promoters60/4770268
aaactgaata

SEQ ID NO: 139460 - DNA, 8 bp, Unknown
  misc_feature (1)..( 8): Result.003 file - promoters60/4770268
ttttgtat

SEQ ID NO: 139461 - DNA, 8 bp, Unknown
  misc_feature (1)..( 8): Result.003 file - promoters60/4770268
ctttgtat

SEQ ID NO: 139462 - DNA, 8 bp, Unknown
  misc_feature (1)..( 8): Result.003 file - promoters60/4770268
ttttgttg

SEQ ID NO: 139463 - DNA, 8 bp, Unknown
  misc_feature (1)..( 8): Result.003 file - promoters60/4770268
atgtagac

SEQ ID NO: 139464 - DNA, 8 bp, Unknown
  misc_feature (1)..( 8): Result.003 file - promoters60/4770268
ttgttgac

SEQ ID NO: 139465 - DNA, 8 bp, Unknown
  misc_feature (1)..( 8): Result.003 file - promoters60/4770268
ttgttgtt

SEQ ID NO: 139466 - DNA, 7 bp, Unknown
  misc_feature (1)..( 7): Result.003 file - promoters60/4770268
gaacttg

SEQ ID NO: 139467 - DNA, 7 bp, Unknown
  misc_feature (1)..( 7): Result.003 file - promoters60/4770268
gaaattg

SEQ ID NO: 139468 - DNA, 7 bp, Unknown
  misc_feature (1)..( 7): Result.003 file - promoters60/4770268
gaaattt

SEQ ID NO: 139469 - DNA, 8 bp, Unknown
  misc_feature (1)..( 8): Result.003 file - promoters60/4770274
gaataaat

SEQ ID NO: 139470 - DNA, 8 bp, Unknown
  misc_feature (1)..( 8): Result.003 file - promoters60/4770274
gaaaaaac

SEQ ID NO: 139471 - DNA, 8 bp, Unknown
  misc_feature (1)..( 8): Result.003 file - promoters60/4770274
aaataacg

SEQ ID NO: 139472 - DNA, 8 bp, Unknown
  misc_feature (1)..( 8): Result.003 file - promoters60/4770274
atagatat

SEQ ID NO: 139473 - DNA, 8 bp, Unknown
  misc_feature (1)..( 8): Result.003 file - promoters60/4770274
ctagatat

SEQ ID NO: 139474 - DNA, 8 bp, Unknown
  misc_feature (1)..( 8): Result.003 file - promoters60/4770274
ctaaataa

SEQ ID NO: 139475 - DNA, 7 bp, Unknown
  misc_feature (1)..( 7): Result.003 file - promoters60/4770274
aataaaa

SEQ ID NO: 139476 - DNA, 7 bp, Unknown
  misc_feature (1)..( 7): Result.003 file - promoters60/4770274
aataaaa

SEQ ID NO: 139477 - DNA, 7 bp, Unknown
  misc_feature (1)..( 7): Result.003 file - promoters60/4770274
aataaac

SEQ ID NO: 139478 - DNA, 8 bp, Unknown
  misc_feature (1)..( 8): Result.003 file - promoters60/4770274
ttttcttt

SEQ ID NO: 139479 - DNA, 8 bp, Unknown
  misc_feature (1)..( 8): Result.003 file - promoters60/4770274
tttccttt

SEQ ID NO: 139480 - DNA, 8 bp, Unknown
  misc_feature (1)..( 8): Result.003 file - promoters60/4770274
gcttcttt

SEQ ID NO: 139481 - DNA, 10 bp, Unknown
  misc_feature (1)..( 10): Result.003 file - promoters60/4770274
tttaatataa

SEQ ID NO: 139482 - DNA, 10 bp, Unknown
  misc_feature (1)..( 10): Result.003 file - promoters60/4770274
ttttatataa

SEQ ID NO: 139483 - DNA, 10 bp, Unknown
  misc_feature (1)..( 10): Result.003 file - promoters60/4770274
gataatatac

SEQ ID NO: 139484 - DNA, 8 bp, Unknown
  misc_feature (1)..( 8): Result.003 file - promoters60/4770274
aatattat

SEQ ID NO: 139485 - DNA, 8 bp, Unknown
  misc_feature (1)..( 8): Result.003 file - promoters60/4770274
aatactat

SEQ ID NO: 139486 - DNA, 8 bp, Unknown
  misc_feature (1)..( 8): Result.003 file - promoters60/4770274
gataatat

SEQ ID NO: 139487 - DNA, 7 bp, Unknown
  misc_feature (1)..( 7): Result.003 file - promoters60/4770274
tacttgt

SEQ ID NO: 139488 - DNA, 7 bp, Unknown
  misc_feature (1)..( 7): Result.003 file - promoters60/4770274
aacttgt

SEQ ID NO: 139489 - DNA, 7 bp, Unknown
  misc_feature (1)..( 7): Result.003 file - promoters60/4770274
tacttgg

SEQ ID NO: 139490 - DNA, 10 bp, Unknown
  misc_feature (1)..( 10): Result.003 file - promoters60/4770274
aataaatctt

SEQ ID NO: 139491 - DNA, 10 bp, Unknown
  misc_feature (1)..( 10): Result.003 file - promoters60/4770274
cctaaacctt

SEQ ID NO: 139492 - DNA, 10 bp, Unknown
  misc_feature (1)..( 10): Result.003 file - promoters60/4770274
cctaaactaa

SEQ ID NO: 139493 - DNA, 8 bp, Unknown
  misc_feature (1)..( 8): Result.003 file - promoters60/4770274
ttaactac

SEQ ID NO: 139494 - DNA, 8 bp, Unknown
  misc_feature (1)..( 8): Result.003 file - promoters60/4770274
ataattac

SEQ ID NO: 139495 - DNA, 8 bp, Unknown
  misc_feature (1)..( 8): Result.003 file - promoters60/4770274
ataattac

SEQ ID NO: 139496 - DNA, 11 bp, Unknown
  misc_feature (1)..( 11): Result.003 file - promoters60/4770274
attaactacat

SEQ ID NO: 139497 - DNA, 11 bp, Unknown
  misc_feature (1)..( 11): Result.003 file - promoters60/4770274
aatcactacat

SEQ ID NO: 139498 - DNA, 11 bp, Unknown
  misc_feature (1)..( 11): Result.003 file - promoters60/4770274
attcactacca

SEQ ID NO: 139499 - DNA, 9 bp, Unknown
  misc_feature (1)..( 9): Result.003 file - promoters60/4770274
gtcataaat

SEQ ID NO: 139500 - DNA, 9 bp, Unknown
  misc_feature (1)..( 9): Result.003 file - promoters60/4770274
tccattaat

SEQ ID NO: 139501 - DNA, 9 bp, Unknown
  misc_feature (1)..( 9): Result.003 file - promoters60/4770274
tcctttact

SEQ ID NO: 139502 - DNA, 8 bp, Unknown
  misc_feature (1)..( 8): Result.003 file - promoters60/4770274
atctttac

SEQ ID NO: 139503 - DNA, 8 bp, Unknown
  misc_feature (1)..( 8): Result.003 file - promoters60/4770274
tcctttac

SEQ ID NO: 139504 - DNA, 8 bp, Unknown
  misc_feature (1)..( 8): Result.003 file - promoters60/4770274
tccattaa

SEQ ID NO: 139505 - DNA, 9 bp, Unknown
  misc_feature (1)..( 9): Result.003 file - promoters60/4770278
tcaaataat

SEQ ID NO: 139506 - DNA, 9 bp, Unknown
  misc_feature (1)..( 9): Result.003 file - promoters60/4770278
taaaaaaat

SEQ ID NO: 139507 - DNA, 9 bp, Unknown
  misc_feature (1)..( 9): Result.003 file - promoters60/4770278
ccaaataat

SEQ ID NO: 139508 - DNA, 9 bp, Unknown
  misc_feature (1)..( 9): Result.003 file - promoters60/4770278
gaaaacaat

SEQ ID NO: 139509 - DNA, 9 bp, Unknown
  misc_feature (1)..( 9): Result.003 file - promoters60/4770278
acaaattta

SEQ ID NO: 139510 - DNA, 10 bp, Unknown
  misc_feature (1)..( 10): Result.003 file - promoters60/4770278
ctcaaagaaa

SEQ ID NO: 139511 - DNA, 10 bp, Unknown
  misc_feature (1)..( 10): Result.003 file - promoters60/4770278
cacaaacaaa

SEQ ID NO: 139512 - DNA, 10 bp, Unknown
  misc_feature (1)..( 10): Result.003 file - promoters60/4770278
ttcaaccaat

SEQ ID NO: 139513 - DNA, 10 bp, Unknown
  misc_feature (1)..( 10): Result.003 file - promoters60/4770278
caccaacaaa

SEQ ID NO: 139514 - DNA, 10 bp, Unknown
  misc_feature (1)..( 10): Result.003 file - promoters60/4770278
ttcaaaaaaa

SEQ ID NO: 139515 - DNA, 16 bp, Unknown
  misc_feature (1)..( 16): Result.003 file - promoters60/4770278
agatttcaaataattt

SEQ ID NO: 139516 - DNA, 16 bp, Unknown
  misc_feature (1)..( 16): Result.003 file - promoters60/4770278
tctatgattatatttt

SEQ ID NO: 139517 - DNA, 16 bp, Unknown
  misc_feature (1)..( 16): Result.003 file - promoters60/4770278
aaaaaaaaaaaaattt

SEQ ID NO: 139518 - DNA, 16 bp, Unknown
  misc_feature (1)..( 16): Result.003 file - promoters60/4770278
tatatgattgtaattt

SEQ ID NO: 139519 - DNA, 16 bp, Unknown
  misc_feature (1)..( 16): Result.003 file - promoters60/4770278
aaaaataaaataatac

SEQ ID NO: 139520 - DNA, 7 bp, Unknown
  misc_feature (1)..( 7): Result.003 file - promoters60/4770280
taaaatt

SEQ ID NO: 139521 - DNA, 7 bp, Unknown
  misc_feature (1)..( 7): Result.003 file - promoters60/4770280
taatatt

SEQ ID NO: 139522 - DNA, 7 bp, Unknown
  misc_feature (1)..( 7): Result.003 file - promoters60/4770280
catatac

SEQ ID NO: 139523 - DNA, 7 bp, Unknown
  misc_feature (1)..( 7): Result.003 file - promoters60/4770280
catgtac

SEQ ID NO: 139524 - DNA, 7 bp, Unknown
  misc_feature (1)..( 7): Result.003 file - promoters60/4770280
ctgaatc

SEQ ID NO: 139525 - DNA, 7 bp, Unknown
  misc_feature (1)..( 7): Result.003 file - promoters60/4770280
ctgaatc

SEQ ID NO: 139526 - DNA, 6 bp, Unknown
  misc_feature (1)..( 6): Result.003 file - promoters60/4770280
ttgatt

SEQ ID NO: 139527 - DNA, 6 bp, Unknown
  misc_feature (1)..( 6): Result.003 file - promoters60/4770280
ttgatt

SEQ ID NO: 139528 - DNA, 6 bp, Unknown
  misc_feature (1)..( 6): Result.003 file - promoters60/4770280
caaagg

SEQ ID NO: 139529 - DNA, 6 bp, Unknown
  misc_feature (1)..( 6): Result.003 file - promoters60/4770280
caaagg

SEQ ID NO: 139530 - DNA, 7 bp, Unknown
  misc_feature (1)..( 7): Result.003 file - promoters60/4770280
tatcatt

SEQ ID NO: 139531 - DNA, 7 bp, Unknown
  misc_feature (1)..( 7): Result.003 file - promoters60/4770280
tatgatt

SEQ ID NO: 139532 - DNA, 7 bp, Unknown
  misc_feature (1)..( 7): Result.003 file - promoters60/4770280
gaatttg

SEQ ID NO: 139533 - DNA, 7 bp, Unknown
  misc_feature (1)..( 7): Result.003 file - promoters60/4770280
gaatttg

SEQ ID NO: 139534 - DNA, 7 bp, Unknown
  misc_feature (1)..( 7): Result.003 file - promoters60/4770280
tttgatt

SEQ ID NO: 139535 - DNA, 7 bp, Unknown
  misc_feature (1)..( 7): Result.003 file - promoters60/4770280
tttgatt

SEQ ID NO: 139536 - DNA, 7 bp, Unknown
  misc_feature (1)..( 7): Result.003 file - promoters60/4770280
ttagatc

SEQ ID NO: 139537 - DNA, 7 bp, Unknown
  misc_feature (1)..( 7): Result.003 file - promoters60/4770280
ttatatc

SEQ ID NO: 139538 - DNA, 6 bp, Unknown
  misc_feature (1)..( 6): Result.003 file - promoters60/4770280
catttg

SEQ ID NO: 139539 - DNA, 6 bp, Unknown
  misc_feature (1)..( 6): Result.003 file - promoters60/4770280
catttg

SEQ ID NO: 139540 - DNA, 6 bp, Unknown
  misc_feature (1)..( 6): Result.003 file - promoters60/4770288
aaaaaa

SEQ ID NO: 139541 - DNA, 6 bp, Unknown
  misc_feature (1)..( 6): Result.003 file - promoters60/4770288
aaaaaa

SEQ ID NO: 139542 - DNA, 6 bp, Unknown
  misc_feature (1)..( 6): Result.003 file - promoters60/4770288
aaaaac

SEQ ID NO: 139543 - DNA, 16 bp, Unknown
  misc_feature (1)..( 16): Result.003 file - promoters60/4770288
taaaatcaaataaatg

SEQ ID NO: 139544 - DNA, 16 bp, Unknown
  misc_feature (1)..( 16): Result.003 file - promoters60/4770288
taaaagcaaataaata

SEQ ID NO: 139545 - DNA, 16 bp, Unknown
  misc_feature (1)..( 16): Result.003 file - promoters60/4770288
tgcggatgaatatatg

SEQ ID NO: 139546 - DNA, 8 bp, Unknown
  misc_feature (1)..( 8): Result.003 file - promoters60/4770288
ttttcatt

SEQ ID NO: 139547 - DNA, 8 bp, Unknown
  misc_feature (1)..( 8): Result.003 file - promoters60/4770288
aattcatt

SEQ ID NO: 139548 - DNA, 8 bp, Unknown
  misc_feature (1)..( 8): Result.003 file - promoters60/4770288
tttttatt

SEQ ID NO: 139549 - DNA, 9 bp, Unknown
  misc_feature (1)..( 9): Result.003 file - promoters60/4770288
cgttatcaa

SEQ ID NO: 139550 - DNA, 9 bp, Unknown
  misc_feature (1)..( 9): Result.003 file - promoters60/4770288
tgttatctc

SEQ ID NO: 139551 - DNA, 9 bp, Unknown
  misc_feature (1)..( 9): Result.003 file - promoters60/4770288
tgttctctc

SEQ ID NO: 139552 - DNA, 9 bp, Unknown
  misc_feature (1)..( 9): Result.003 file - promoters60/4770288
taatctcac

SEQ ID NO: 139553 - DNA, 9 bp, Unknown
  misc_feature (1)..( 9): Result.003 file - promoters60/4770288
ttatctcat

SEQ ID NO: 139554 - DNA, 9 bp, Unknown
  misc_feature (1)..( 9): Result.003 file - promoters60/4770288
tgttctctc

SEQ ID NO: 139555 - DNA, 13 bp, Unknown
  misc_feature (1)..( 13): Result.003 file - promoters60/4770288
agtgcttaaaaaa

SEQ ID NO: 139556 - DNA, 13 bp, Unknown
  misc_feature (1)..( 13): Result.003 file - promoters60/4770288
agttcttggattc

SEQ ID NO: 139557 - DNA, 13 bp, Unknown
  misc_feature (1)..( 13): Result.003 file - promoters60/4770288
tcttcttcgattc

SEQ ID NO: 139558 - DNA, 10 bp, Unknown
  misc_feature (1)..( 10): Result.003 file - promoters60/4770305
ttttgaattc

SEQ ID NO: 139559 - DNA, 10 bp, Unknown
  misc_feature (1)..( 10): Result.003 file - promoters60/4770305
atttgaatag

SEQ ID NO: 139560 - DNA, 10 bp, Unknown
  misc_feature (1)..( 10): Result.003 file - promoters60/4770305
ttttgacaat

SEQ ID NO: 139561 - DNA, 10 bp, Unknown
  misc_feature (1)..( 10): Result.003 file - promoters60/4770305
ttttgtattc

SEQ ID NO: 139562 - DNA, 14 bp, Unknown
  misc_feature (1)..( 14): Result.003 file - promoters60/4770305
aaccaaatctaaat

SEQ ID NO: 139563 - DNA, 14 bp, Unknown
  misc_feature (1)..( 14): Result.003 file - promoters60/4770305
tcttcaatttaact

SEQ ID NO: 139564 - DNA, 14 bp, Unknown
  misc_feature (1)..( 14): Result.003 file - promoters60/4770305
tcttaaattttcca

SEQ ID NO: 139565 - DNA, 14 bp, Unknown
  misc_feature (1)..( 14): Result.003 file - promoters60/4770305
aagtaactttttta

SEQ ID NO: 139566 - DNA, 9 bp, Unknown
  misc_feature (1)..( 9): Result.003 file - promoters60/4770305
aacccaaaa

SEQ ID NO: 139567 - DNA, 9 bp, Unknown
  misc_feature (1)..( 9): Result.003 file - promoters60/4770305
agcccaaat

SEQ ID NO: 139568 - DNA, 9 bp, Unknown
  misc_feature (1)..( 9): Result.003 file - promoters60/4770305
agcccaatg

SEQ ID NO: 139569 - DNA, 9 bp, Unknown
  misc_feature (1)..( 9): Result.003 file - promoters60/4770305
ggcctaatg

SEQ ID NO: 139570 - DNA, 12 bp, Unknown
  misc_feature (1)..( 12): Result.003 file - promoters60/4770305
attcttataaca

SEQ ID NO: 139571 - DNA, 12 bp, Unknown
  misc_feature (1)..( 12): Result.003 file - promoters60/4770305
attcttcaggtg

SEQ ID NO: 139572 - DNA, 12 bp, Unknown
  misc_feature (1)..( 12): Result.003 file - promoters60/4770305
tttcttaaattt

SEQ ID NO: 139573 - DNA, 12 bp, Unknown
  misc_feature (1)..( 12): Result.003 file - promoters60/4770305
tatcttcaattt

SEQ ID NO: 139574 - DNA, 12 bp, Unknown
  misc_feature (1)..( 12): Result.003 file - promoters60/4770305
cttttttacata

SEQ ID NO: 139575 - DNA, 9 bp, Unknown
  misc_feature (1)..( 9): Result.003 file - promoters60/4770305
gtaattttc

SEQ ID NO: 139576 - DNA, 9 bp, Unknown
  misc_feature (1)..( 9): Result.003 file - promoters60/4770305
ccaatcttc

SEQ ID NO: 139577 - DNA, 9 bp, Unknown
  misc_feature (1)..( 9): Result.003 file - promoters60/4770305
catattttc

SEQ ID NO: 139578 - DNA, 9 bp, Unknown
  misc_feature (1)..( 9): Result.003 file - promoters60/4770305
atagtttag

SEQ ID NO: 139579 - DNA, 11 bp, Unknown
  misc_feature (1)..( 11): Result.003 file - promoters60/4770305
atctaaattct

SEQ ID NO: 139580 - DNA, 11 bp, Unknown
  misc_feature (1)..( 11): Result.003 file - promoters60/4770305
tcttaaatttt

SEQ ID NO: 139581 - DNA, 11 bp, Unknown
  misc_feature (1)..( 11): Result.003 file - promoters60/4770305
tcttcaattta

SEQ ID NO: 139582 - DNA, 11 bp, Unknown
  misc_feature (1)..( 11): Result.003 file - promoters60/4770305
aagtaactttt

SEQ ID NO: 139583 - DNA, 8 bp, Unknown
  misc_feature (1)..( 8): Result.003 file - promoters60/4770305
aaacaata

SEQ ID NO: 139584 - DNA, 8 bp, Unknown
  misc_feature (1)..( 8): Result.003 file - promoters60/4770305
gaactata

SEQ ID NO: 139585 - DNA, 8 bp, Unknown
  misc_feature (1)..( 8): Result.003 file - promoters60/4770305
caactatc

SEQ ID NO: 139586 - DNA, 9 bp, Unknown
  misc_feature (1)..( 9): Result.003 file - promoters60/4770305
aaagcacta

SEQ ID NO: 139587 - DNA, 7 bp, Unknown
  misc_feature (1)..( 7): Result.003 file - promoters60/4770317
gaagaaa

SEQ ID NO: 139588 - DNA, 7 bp, Unknown
  misc_feature (1)..( 7): Result.003 file - promoters60/4770317
gaacaaa

SEQ ID NO: 139589 - DNA, 6 bp, Unknown
  misc_feature (1)..( 6): Result.003 file - promoters60/4770317
aagaag

SEQ ID NO: 139590 - DNA, 6 bp, Unknown
  misc_feature (1)..( 6): Result.003 file - promoters60/4770317
aagaag

SEQ ID NO: 139591 - DNA, 6 bp, Unknown
  misc_feature (1)..( 6): Result.003 file - promoters60/4770317
gggaat

SEQ ID NO: 139592 - DNA, 6 bp, Unknown
  misc_feature (1)..( 6): Result.003 file - promoters60/4770317
gggaat

SEQ ID NO: 139593 - DNA, 8 bp, Unknown
  misc_feature (1)..( 8): Result.003 file - promoters60/4770317
agctccga

SEQ ID NO: 139594 - DNA, 8 bp, Unknown
  misc_feature (1)..( 8): Result.003 file - promoters60/4770317
agctccga

SEQ ID NO: 139595 - DNA, 6 bp, Unknown
  misc_feature (1)..( 6): Result.003 file - promoters60/4770317
tttcca

SEQ ID NO: 139596 - DNA, 6 bp, Unknown
  misc_feature (1)..( 6): Result.003 file - promoters60/4770317
tttcca

SEQ ID NO: 139597 - DNA, 6 bp, Unknown
  misc_feature (1)..( 6): Result.003 file - promoters60/4770317
cgaatg

SEQ ID NO: 139598 - DNA, 6 bp, Unknown
  misc_feature (1)..( 6): Result.003 file - promoters60/4770317
cgaatg

SEQ ID NO: 139599 - DNA, 6 bp, Unknown
  misc_feature (1)..( 6): Result.003 file - promoters60/4770317
gaagaa

SEQ ID NO: 139600 - DNA, 6 bp, Unknown
  misc_feature (1)..( 6): Result.003 file - promoters60/4770317
gaagaa

SEQ ID NO: 139601 - DNA, 6 bp, Unknown
  misc_feature (1)..( 6): Result.003 file - promoters60/4770317
ttccga

SEQ ID NO: 139602 - DNA, 6 bp, Unknown
  misc_feature (1)..( 6): Result.003 file - promoters60/4770317
ttccga

SEQ ID NO: 139603 - DNA, 6 bp, Unknown
  misc_feature (1)..( 6): Result.003 file - promoters60/4770317
accttt

SEQ ID NO: 139604 - DNA, 6 bp, Unknown
  misc_feature (1)..( 6): Result.003 file - promoters60/4770317
accttt

SEQ ID NO: 139605 - DNA, 8 bp, Unknown
  misc_feature (1)..( 8): Result.003 file - promoters60/4770317
tttctctc

SEQ ID NO: 139606 - DNA, 8 bp, Unknown
  misc_feature (1)..( 8): Result.003 file - promoters60/4770317
tttctctc

SEQ ID NO: 139607 - DNA, 6 bp, Unknown
  misc_feature (1)..( 6): Result.003 file - promoters60/4770317
tcaaaa

SEQ ID NO: 139608 - DNA, 6 bp, Unknown
  misc_feature (1)..( 6): Result.003 file - promoters60/4770317
tcaaaa

SEQ ID NO: 139609 - DNA, 7 bp, Unknown
  misc_feature (1)..( 7): Result.003 file - promoters60/4770317
aaaagaa

SEQ ID NO: 139610 - DNA, 7 bp, Unknown
  misc_feature (1)..( 7): Result.003 file - promoters60/4770317
aaacgaa

SEQ ID NO: 139611 - DNA, 8 bp, Unknown
  misc_feature (1)..( 8): Result.003 file - promoters60/4770317
caaaaaaa

SEQ ID NO: 139612 - DNA, 8 bp, Unknown
  misc_feature (1)..( 8): Result.003 file - promoters60/4770317
caataaaa

SEQ ID NO: 139613 - DNA, 7 bp, Unknown
  misc_feature (1)..( 7): Result.003 file - promoters60/4770330
gatacac

SEQ ID NO: 139614 - DNA, 7 bp, Unknown
  misc_feature (1)..( 7): Result.003 file - promoters60/4770330
gatgcac

SEQ ID NO: 139615 - DNA, 6 bp, Unknown
  misc_feature (1)..( 6): Result.003 file - promoters60/4770330
aagaag

SEQ ID NO: 139616 - DNA, 6 bp, Unknown
  misc_feature (1)..( 6): Result.003 file - promoters60/4770330
aagaag

SEQ ID NO: 139617 - DNA, 6 bp, Unknown
  misc_feature (1)..( 6): Result.003 file - promoters60/4770330
tagtgt

SEQ ID NO: 139618 - DNA, 6 bp, Unknown
  misc_feature (1)..( 6): Result.003 file - promoters60/4770330
tagtgt

SEQ ID NO: 139619 - DNA, 8 bp, Unknown
  misc_feature (1)..( 8): Result.003 file - promoters60/4770330
aacaactt

SEQ ID NO: 139620 - DNA, 8 bp, Unknown
  misc_feature (1)..( 8): Result.003 file - promoters60/4770330
aacatctt

SEQ ID NO: 139621 - DNA, 7 bp, Unknown
  misc_feature (1)..( 7): Result.003 file - promoters60/4770330
tttaact

SEQ ID NO: 139622 - DNA, 7 bp, Unknown
  misc_feature (1)..( 7): Result.003 file - promoters60/4770330
tttcact

SEQ ID NO: 139623 - DNA, 6 bp, Unknown
  misc_feature (1)..( 6): Result.003 file - promoters60/4770330
gattaa

SEQ ID NO: 139624 - DNA, 6 bp, Unknown
  misc_feature (1)..( 6): Result.003 file - promoters60/4770330
gattaa

SEQ ID NO: 139625 - DNA, 6 bp, Unknown
  misc_feature (1)..( 6): Result.003 file - promoters60/4770330
tttgat

SEQ ID NO: 139626 - DNA, 6 bp, Unknown
  misc_feature (1)..( 6): Result.003 file - promoters60/4770330
tttgat

SEQ ID NO: 139627 - DNA, 8 bp, Unknown
  misc_feature (1)..( 8): Result.003 file - promoters60/4770330
cttcatat

SEQ ID NO: 139628 - DNA, 8 bp, Unknown
  misc_feature (1)..( 8): Result.003 file - promoters60/4770330
cttcttat

SEQ ID NO: 139629 - DNA, 8 bp, Unknown
  misc_feature (1)..( 8): Result.003 file - promoters60/4770330
atttttca

SEQ ID NO: 139630 - DNA, 8 bp, Unknown
  misc_feature (1)..( 8): Result.003 file - promoters60/4770330
attgttca

SEQ ID NO: 139631 - DNA, 8 bp, Unknown
  misc_feature (1)..( 8): Result.003 file - promoters60/4770330
tttgacaa

SEQ ID NO: 139632 - DNA, 8 bp, Unknown
  misc_feature (1)..( 8): Result.003 file - promoters60/4770330
tttaacaa

SEQ ID NO: 139633 - DNA, 8 bp, Unknown
  misc_feature (1)..( 8): Result.003 file - promoters60/4770330
tgttatta

SEQ ID NO: 139634 - DNA, 8 bp, Unknown
  misc_feature (1)..( 8): Result.003 file - promoters60/4770330
tgttatta

SEQ ID NO: 139635 - DNA, 6 bp, Unknown
  misc_feature (1)..( 6): Result.003 file - promoters60/4770330
attttt

SEQ ID NO: 139636 - DNA, 6 bp, Unknown
  misc_feature (1)..( 6): Result.003 file - promoters60/4770330
attttt

SEQ ID NO: 139637 - DNA, 7 bp, Unknown
  misc_feature (1)..( 7): Result.003 file - promoters60/4770365
tatatat

SEQ ID NO: 139638 - DNA, 7 bp, Unknown
  misc_feature (1)..( 7): Result.003 file - promoters60/4770365
tatatag

SEQ ID NO: 139639 - DNA, 7 bp, Unknown
  misc_feature (1)..( 7): Result.003 file - promoters60/4770365
gatatag

SEQ ID NO: 139640 - DNA, 7 bp, Unknown
  misc_feature (1)..( 7): Result.003 file - promoters60/4770365
tagttaa

SEQ ID NO: 139641 - DNA, 7 bp, Unknown
  misc_feature (1)..( 7): Result.003 file - promoters60/4770365
aagttaa

SEQ ID NO: 139642 - DNA, 7 bp, Unknown
  misc_feature (1)..( 7): Result.003 file - promoters60/4770365
aagttat

SEQ ID NO: 139643 - DNA, 8 bp, Unknown
  misc_feature (1)..( 8): Result.003 file - promoters60/4770365
ttaaaaaa

SEQ ID NO: 139644 - DNA, 8 bp, Unknown
  misc_feature (1)..( 8): Result.003 file - promoters60/4770365
ataaaaaa

SEQ ID NO: 139645 - DNA, 8 bp, Unknown
  misc_feature (1)..( 8): Result.003 file - promoters60/4770365
ttaaaatg

SEQ ID NO: 139646 - DNA, 8 bp, Unknown
  misc_feature (1)..( 8): Result.003 file - promoters60/4770365
aaacaatc

SEQ ID NO: 139647 - DNA, 8 bp, Unknown
  misc_feature (1)..( 8): Result.003 file - promoters60/4770365
aaaaaatg

SEQ ID NO: 139648 - DNA, 8 bp, Unknown
  misc_feature (1)..( 8): Result.003 file - promoters60/4770365
cgaaaatg

SEQ ID NO: 139649 - DNA, 9 bp, Unknown
  misc_feature (1)..( 9): Result.003 file - promoters60/4770365
gattattat

SEQ ID NO: 139650 - DNA, 9 bp, Unknown
  misc_feature (1)..( 9): Result.003 file - promoters60/4770365
cggtattat

SEQ ID NO: 139651 - DNA, 9 bp, Unknown
  misc_feature (1)..( 9): Result.003 file - promoters60/4770365
gattactat

SEQ ID NO: 139652 - DNA, 7 bp, Unknown
  misc_feature (1)..( 7): Result.003 file - promoters60/4770365
aattatt

SEQ ID NO: 139653 - DNA, 7 bp, Unknown
  misc_feature (1)..( 7): Result.003 file - promoters60/4770365
tattatt

SEQ ID NO: 139654 - DNA, 7 bp, Unknown
  misc_feature (1)..( 7): Result.003 file - promoters60/4770365
tataatt

SEQ ID NO: 139655 - DNA, 8 bp, Unknown
  misc_feature (1)..( 8): Result.003 file - promoters60/4770365
taagatta

SEQ ID NO: 139656 - DNA, 8 bp, Unknown
  misc_feature (1)..( 8): Result.003 file - promoters60/4770365
caagatta

SEQ ID NO: 139657 - DNA, 8 bp, Unknown
  misc_feature (1)..( 8): Result.003 file - promoters60/4770365
caatattt

SEQ ID NO: 139658 - DNA, 8 bp, Unknown
  misc_feature (1)..( 8): Result.003 file - promoters60/4770365
ttttattt

SEQ ID NO: 139659 - DNA, 8 bp, Unknown
  misc_feature (1)..( 8): Result.003 file - promoters60/4770365
ttttgttt

SEQ ID NO: 139660 - DNA, 8 bp, Unknown
  misc_feature (1)..( 8): Result.003 file - promoters60/4770365
ttttattt

SEQ ID NO: 139661 - DNA, 7 bp, Unknown
  misc_feature (1)..( 7): Result.003 file - promoters60/4770365
aaaaaat

SEQ ID NO: 139662 - DNA, 7 bp, Unknown
  misc_feature (1)..( 7): Result.003 file - promoters60/4770365
aaacaat

SEQ ID NO: 139663 - DNA, 7 bp, Unknown
  misc_feature (1)..( 7): Result.003 file - promoters60/4770365
aaaaaag

SEQ ID NO: 139664 - DNA, 11 bp, Unknown
  misc_feature (1)..( 11): Result.003 file - promoters60/4770379
ttttcttataa

SEQ ID NO: 139665 - DNA, 11 bp, Unknown
  misc_feature (1)..( 11): Result.003 file - promoters60/4770379
cattcttattt

SEQ ID NO: 139666 - DNA, 11 bp, Unknown
  misc_feature (1)..( 11): Result.003 file - promoters60/4770379
catgctttcaa

SEQ ID NO: 139667 - DNA, 11 bp, Unknown
  misc_feature (1)..( 11): Result.003 file - promoters60/4770379
acaacttattt

SEQ ID NO: 139668 - DNA, 11 bp, Unknown
  misc_feature (1)..( 11): Result.003 file - promoters60/4770379
cgtttttattt

SEQ ID NO: 139669 - DNA, 11 bp, Unknown
  misc_feature (1)..( 11): Result.003 file - promoters60/4770379
taacttacaaa

SEQ ID NO: 139670 - DNA, 11 bp, Unknown
  misc_feature (1)..( 11): Result.003 file - promoters60/4770379
atacttactta

SEQ ID NO: 139671 - DNA, 11 bp, Unknown
  misc_feature (1)..( 11): Result.003 file - promoters60/4770379
ggccttccaaa

SEQ ID NO: 139672 - DNA, 11 bp, Unknown
  misc_feature (1)..( 11): Result.003 file - promoters60/4770379
atacgtacgta

SEQ ID NO: 139673 - DNA, 13 bp, Unknown
  misc_feature (1)..( 13): Result.003 file - promoters60/4770379
tacaatataaaca

SEQ ID NO: 139674 - DNA, 13 bp, Unknown
  misc_feature (1)..( 13): Result.003 file - promoters60/4770379
tcacatattaaca

SEQ ID NO: 139675 - DNA, 13 bp, Unknown
  misc_feature (1)..( 13): Result.003 file - promoters60/4770379
tcatatatataca

SEQ ID NO: 139676 - DNA, 13 bp, Unknown
  misc_feature (1)..( 13): Result.003 file - promoters60/4770379
gtatatataaaga

SEQ ID NO: 139677 - DNA, 13 bp, Unknown
  misc_feature (1)..( 13): Result.003 file - promoters60/4770379
actcatatatatc

SEQ ID NO: 139678 - DNA, 12 bp, Unknown
  misc_feature (1)..( 12): Result.003 file - promoters60/4770379
acttttctttct

SEQ ID NO: 139679 - DNA, 12 bp, Unknown
  misc_feature (1)..( 12): Result.003 file - promoters60/4770379
aattttttttct

SEQ ID NO: 139680 - DNA, 12 bp, Unknown
  misc_feature (1)..( 12): Result.003 file - promoters60/4770379
actttttttaca

SEQ ID NO: 139681 - DNA, 12 bp, Unknown
  misc_feature (1)..( 12): Result.003 file - promoters60/4770379
aatttttagtca

SEQ ID NO: 139682 - DNA, 14 bp, Unknown
  misc_feature (1)..( 14): Result.003 file - promoters60/4770379
tcagatatacattg

SEQ ID NO: 139683 - DNA, 14 bp, Unknown
  misc_feature (1)..( 14): Result.003 file - promoters60/4770379
ttttctataaatta

SEQ ID NO: 139684 - DNA, 14 bp, Unknown
  misc_feature (1)..( 14): Result.003 file - promoters60/4770379
ttttttatagatta

SEQ ID NO: 139685 - DNA, 14 bp, Unknown
  misc_feature (1)..( 14): Result.003 file - promoters60/4770379
agagctaaaaacgg

SEQ ID NO: 139686 - DNA, 7 bp, Unknown
  misc_feature (1)..( 7): Result.003 file - promoters60/4770379
tacgaaa

SEQ ID NO: 139687 - DNA, 7 bp, Unknown
  misc_feature (1)..( 7): Result.003 file - promoters60/4770379
tactaaa

SEQ ID NO: 139688 - DNA, 7 bp, Unknown
  misc_feature (1)..( 7): Result.003 file - promoters60/4770379
aactaaa

SEQ ID NO: 139689 - DNA, 7 bp, Unknown
  misc_feature (1)..( 7): Result.003 file - promoters60/4770379
aactaaa

SEQ ID NO: 139690 - DNA, 14 bp, Unknown
  misc_feature (1)..( 14): Result.003 file - promoters60/4770379
ttttttatagatta

SEQ ID NO: 139691 - DNA, 14 bp, Unknown
  misc_feature (1)..( 14): Result.003 file - promoters60/4770379
ctttatatagagac

SEQ ID NO: 139692 - DNA, 14 bp, Unknown
  misc_feature (1)..( 14): Result.003 file - promoters60/4770379
ttttctataaatta

SEQ ID NO: 139693 - DNA, 14 bp, Unknown
  misc_feature (1)..( 14): Result.003 file - promoters60/4770379
agagctaaaaacgg

SEQ ID NO: 139694 - DNA, 9 bp, Unknown
  misc_feature (1)..( 9): Result.003 file - promoters60/4770379
aactaaacc

SEQ ID NO: 139695 - DNA, 9 bp, Unknown
  misc_feature (1)..( 9): Result.003 file - promoters60/4770379
aactaaacc

SEQ ID NO: 139696 - DNA, 9 bp, Unknown
  misc_feature (1)..( 9): Result.003 file - promoters60/4770379
aactaatca

SEQ ID NO: 139697 - DNA, 9 bp, Unknown
  misc_feature (1)..( 9): Result.003 file - promoters60/4770379
tactaaaga

SEQ ID NO: 139698 - DNA, 13 bp, Unknown
  misc_feature (1)..( 13): Result.003 file - promoters60/4770390
agttataaatcgt

SEQ ID NO: 139699 - DNA, 13 bp, Unknown
  misc_feature (1)..( 13): Result.003 file - promoters60/4770390
agttatgaatccg

SEQ ID NO: 139700 - DNA, 13 bp, Unknown
  misc_feature (1)..( 13): Result.003 file - promoters60/4770390
aacccgaaaccgt

SEQ ID NO: 139701 - DNA, 13 bp, Unknown
  misc_feature (1)..( 13): Result.003 file - promoters60/4770390
ccttataattttt

SEQ ID NO: 139702 - DNA, 13 bp, Unknown
  misc_feature (1)..( 13): Result.003 file - promoters60/4770390
gtaactaaaatta

SEQ ID NO: 139703 - DNA, 13 bp, Unknown
  misc_feature (1)..( 13): Result.003 file - promoters60/4770390
ctttatgattctt

SEQ ID NO: 139704 - DNA, 13 bp, Unknown
  misc_feature (1)..( 13): Result.003 file - promoters60/4770390
ccttatacttcag

SEQ ID NO: 139705 - DNA, 16 bp, Unknown
  misc_feature (1)..( 16): Result.003 file - promoters60/4770390
ttttgagaaaagtaag

SEQ ID NO: 139706 - DNA, 16 bp, Unknown
  misc_feature (1)..( 16): Result.003 file - promoters60/4770390
gtttgagaataaaaat

SEQ ID NO: 139707 - DNA, 16 bp, Unknown
  misc_feature (1)..( 16): Result.003 file - promoters60/4770390
ttttgatatgattctt

SEQ ID NO: 139708 - DNA, 16 bp, Unknown
  misc_feature (1)..( 16): Result.003 file - promoters60/4770390
atatgaaaaaatagtt

SEQ ID NO: 139709 - DNA, 16 bp, Unknown
  misc_feature (1)..( 16): Result.003 file - promoters60/4770390
attttatatatgtctt

SEQ ID NO: 139710 - DNA, 16 bp, Unknown
  misc_feature (1)..( 16): Result.003 file - promoters60/4770390
ggattaaatataactt

SEQ ID NO: 139711 - DNA, 16 bp, Unknown
  misc_feature (1)..( 16): Result.003 file - promoters60/4770390
tcataaaatacaactt

SEQ ID NO: 139712 - DNA, 10 bp, Unknown
  misc_feature (1)..( 10): Result.003 file - promoters60/4770390
tatataaaag

SEQ ID NO: 139713 - DNA, 10 bp, Unknown
  misc_feature (1)..( 10): Result.003 file - promoters60/4770390
aataaaaagc

SEQ ID NO: 139714 - DNA, 10 bp, Unknown
  misc_feature (1)..( 10): Result.003 file - promoters60/4770390
aatataaagg

SEQ ID NO: 139715 - DNA, 10 bp, Unknown
  misc_feature (1)..( 10): Result.003 file - promoters60/4770390
tataaaagct

SEQ ID NO: 139716 - DNA, 10 bp, Unknown
  misc_feature (1)..( 10): Result.003 file - promoters60/4770390
attaaagggt

SEQ ID NO: 139717 - DNA, 11 bp, Unknown
  misc_feature (1)..( 11): Result.003 file - promoters60/4770390
actattaaagc

SEQ ID NO: 139718 - DNA, 9 bp, Unknown
  misc_feature (1)..( 9): Result.003 file - promoters60/4770406
taataaaca

SEQ ID NO: 139719 - DNA, 9 bp, Unknown
  misc_feature (1)..( 9): Result.003 file - promoters60/4770406
taacaaaca

SEQ ID NO: 139720 - DNA, 9 bp, Unknown
  misc_feature (1)..( 9): Result.003 file - promoters60/4770406
taataagta

SEQ ID NO: 139721 - DNA, 8 bp, Unknown
  misc_feature (1)..( 8): Result.003 file - promoters60/4770406
aacacaaa

SEQ ID NO: 139722 - DNA, 8 bp, Unknown
  misc_feature (1)..( 8): Result.003 file - promoters60/4770406
aacataaa

SEQ ID NO: 139723 - DNA, 8 bp, Unknown
  misc_feature (1)..( 8): Result.003 file - promoters60/4770406
aacataga

SEQ ID NO: 139724 - DNA, 6 bp, Unknown
  misc_feature (1)..( 6): Result.003 file - promoters60/4770406
tgtttt

SEQ ID NO: 139725 - DNA, 6 bp, Unknown
  misc_feature (1)..( 6): Result.003 file - promoters60/4770406
tgtttt

SEQ ID NO: 139726 - DNA, 6 bp, Unknown
  misc_feature (1)..( 6): Result.003 file - promoters60/4770406
tgtttt

SEQ ID NO: 139727 - DNA, 6 bp, Unknown
  misc_feature (1)..( 6): Result.003 file - promoters60/4770414
gtttaa

SEQ ID NO: 139728 - DNA, 6 bp, Unknown
  misc_feature (1)..( 6): Result.003 file - promoters60/4770414
gtttaa

SEQ ID NO: 139729 - DNA, 8 bp, Unknown
  misc_feature (1)..( 8): Result.003 file - promoters60/4770414
atagttga

SEQ ID NO: 139730 - DNA, 8 bp, Unknown
  misc_feature (1)..( 8): Result.003 file - promoters60/4770414
atatttga

SEQ ID NO: 139731 - DNA, 7 bp, Unknown
  misc_feature (1)..( 7): Result.003 file - promoters60/4770414
attgttg

SEQ ID NO: 139732 - DNA, 7 bp, Unknown
  misc_feature (1)..( 7): Result.003 file - promoters60/4770414
attcttg

SEQ ID NO: 139733 - DNA, 8 bp, Unknown
  misc_feature (1)..( 8): Result.003 file - promoters60/4770414
aaaattta

SEQ ID NO: 139734 - DNA, 8 bp, Unknown
  misc_feature (1)..( 8): Result.003 file - promoters60/4770414
aaatttta

SEQ ID NO: 139735 - DNA, 12 bp, Unknown
  misc_feature (1)..( 12): Result.003 file - promoters60/4770414
aatttataacca

SEQ ID NO: 139736 - DNA, 12 bp, Unknown
  misc_feature (1)..( 12): Result.003 file - promoters60/4770414
aatttatgacca

SEQ ID NO: 139737 - DNA, 7 bp, Unknown
  misc_feature (1)..( 7): Result.003 file - promoters60/4770414
ttattaa

SEQ ID NO: 139738 - DNA, 7 bp, Unknown
  misc_feature (1)..( 7): Result.003 file - promoters60/4770414
ttagtaa

SEQ ID NO: 139739 - DNA, 6 bp, Unknown
  misc_feature (1)..( 6): Result.003 file - promoters60/4770414
attttt

SEQ ID NO: 139740 - DNA, 6 bp, Unknown
  misc_feature (1)..( 6): Result.003 file - promoters60/4770414
attttt

SEQ ID NO: 139741 - DNA, 8 bp, Unknown
  misc_feature (1)..( 8): Result.003 file - promoters60/4770414
caataaaa

SEQ ID NO: 139742 - DNA, 8 bp, Unknown
  misc_feature (1)..( 8): Result.003 file - promoters60/4770414
ctataaaa

SEQ ID NO: 139743 - DNA, 8 bp, Unknown
  misc_feature (1)..( 8): Result.003 file - promoters60/4770414
atataaac

SEQ ID NO: 139744 - DNA, 11 bp, Unknown
  misc_feature (1)..( 11): Result.003 file - promoters60/4770414
tcaacacaaaa

SEQ ID NO: 139745 - DNA, 11 bp, Unknown
  misc_feature (1)..( 11): Result.003 file - promoters60/4770414
tcaaaacaaaa

SEQ ID NO: 139746 - DNA, 11 bp, Unknown
  misc_feature (1)..( 11): Result.003 file - promoters60/4770414
gcaacaaattt

SEQ ID NO: 139747 - DNA, 6 bp, Unknown
  misc_feature (1)..( 6): Result.003 file - promoters60/4770414
tagttt

SEQ ID NO: 139748 - DNA, 6 bp, Unknown
  misc_feature (1)..( 6): Result.003 file - promoters60/4770414
tagttt

SEQ ID NO: 139749 - DNA, 6 bp, Unknown
  misc_feature (1)..( 6): Result.003 file - promoters60/4770414
tgacta

SEQ ID NO: 139750 - DNA, 6 bp, Unknown
  misc_feature (1)..( 6): Result.003 file - promoters60/4770414
tgacta

SEQ ID NO: 139751 - DNA, 8 bp, Unknown
  misc_feature (1)..( 8): Result.003 file - promoters60/4770414
ctttttac

SEQ ID NO: 139752 - DNA, 8 bp, Unknown
  misc_feature (1)..( 8): Result.003 file - promoters60/4770414
cttgttac

SEQ ID NO: 139753 - DNA, 7 bp, Unknown
  misc_feature (1)..( 7): Result.003 file - promoters60/4770414
aaagtaa

SEQ ID NO: 139754 - DNA, 7 bp, Unknown
  misc_feature (1)..( 7): Result.003 file - promoters60/4770414
aaattaa

SEQ ID NO: 139755 - DNA, 9 bp, Unknown
  misc_feature (1)..( 9): Result.003 file - promoters60/4770414
gtaacttaa

SEQ ID NO: 139756 - DNA, 9 bp, Unknown
  misc_feature (1)..( 9): Result.003 file - promoters60/4770414
gtaacataa

SEQ ID NO: 139757 - DNA, 8 bp, Unknown
  misc_feature (1)..( 8): Result.003 file - promoters60/4770428
ttttgtgc

SEQ ID NO: 139758 - DNA, 8 bp, Unknown
  misc_feature (1)..( 8): Result.003 file - promoters60/4770428
ttttgtaa

SEQ ID NO: 139759 - DNA, 8 bp, Unknown
  misc_feature (1)..( 8): Result.003 file - promoters60/4770428
ttttgtgt

SEQ ID NO: 139760 - DNA, 8 bp, Unknown
  misc_feature (1)..( 8): Result.003 file - promoters60/4770428
ttttgttt

SEQ ID NO: 139761 - DNA, 8 bp, Unknown
  misc_feature (1)..( 8): Result.003 file - promoters60/4770428
ttttgtaa

SEQ ID NO: 139762 - DNA, 8 bp, Unknown
  misc_feature (1)..( 8): Result.003 file - promoters60/4770428
tcttgtgt

SEQ ID NO: 139763 - DNA, 9 bp, Unknown
  misc_feature (1)..( 9): Result.003 file - promoters60/4770428
aatgggccg

SEQ ID NO: 139764 - DNA, 9 bp, Unknown
  misc_feature (1)..( 9): Result.003 file - promoters60/4770428
tatgggcct

SEQ ID NO: 139765 - DNA, 9 bp, Unknown
  misc_feature (1)..( 9): Result.003 file - promoters60/4770428
aatgggtct

SEQ ID NO: 139766 - DNA, 9 bp, Unknown
  misc_feature (1)..( 9): Result.003 file - promoters60/4770428
tgtgggcca

SEQ ID NO: 139767 - DNA, 9 bp, Unknown
  misc_feature (1)..( 9): Result.003 file - promoters60/4770428
aatgggctg

SEQ ID NO: 139768 - DNA, 9 bp, Unknown
  misc_feature (1)..( 9): Result.003 file - promoters60/4770428
tatggccca

SEQ ID NO: 139769 - DNA, 12 bp, Unknown
  misc_feature (1)..( 12): Result.003 file - promoters60/4770463
ttttttatatcg

SEQ ID NO: 139770 - DNA, 12 bp, Unknown
  misc_feature (1)..( 12): Result.003 file - promoters60/4770463
aattttgtattt

SEQ ID NO: 139771 - DNA, 12 bp, Unknown
  misc_feature (1)..( 12): Result.003 file - promoters60/4770463
tattttgcattt

SEQ ID NO: 139772 - DNA, 12 bp, Unknown
  misc_feature (1)..( 12): Result.003 file - promoters60/4770463
tcttttgtagtc

SEQ ID NO: 139773 - DNA, 12 bp, Unknown
  misc_feature (1)..( 12): Result.003 file - promoters60/4770463
tatgttgcatat

SEQ ID NO: 139774 - DNA, 17 bp, Unknown
  misc_feature (1)..( 17): Result.003 file - promoters60/4770463
ttcatttttaaaaacaa

SEQ ID NO: 139775 - DNA, 17 bp, Unknown
  misc_feature (1)..( 17): Result.003 file - promoters60/4770463
tttattaatcaaaccaa

SEQ ID NO: 139776 - DNA, 17 bp, Unknown
  misc_feature (1)..( 17): Result.003 file - promoters60/4770463
aaagtttataaaatcaa

SEQ ID NO: 139777 - DNA, 17 bp, Unknown
  misc_feature (1)..( 17): Result.003 file - promoters60/4770463
tctagatctaaaaacca

SEQ ID NO: 139778 - DNA, 17 bp, Unknown
  misc_feature (1)..( 17): Result.003 file - promoters60/4770463
ttcacttttaaaaacga

SEQ ID NO: 139779 - DNA, 7 bp, Unknown
  misc_feature (1)..( 7): Result.003 file - promoters60/4770463
caacaaa

SEQ ID NO: 139780 - DNA, 7 bp, Unknown
  misc_feature (1)..( 7): Result.003 file - promoters60/4770463
caacaag

SEQ ID NO: 139781 - DNA, 7 bp, Unknown
  misc_feature (1)..( 7): Result.003 file - promoters60/4770463
gaacaaa

SEQ ID NO: 139782 - DNA, 7 bp, Unknown
  misc_feature (1)..( 7): Result.003 file - promoters60/4770463
aaacaaa

SEQ ID NO: 139783 - DNA, 7 bp, Unknown
  misc_feature (1)..( 7): Result.003 file - promoters60/4770463
aaacaaa

SEQ ID NO: 139784 - DNA, 9 bp, Unknown
  misc_feature (1)..( 9): Result.003 file - promoters60/4770463
aaagttaac

SEQ ID NO: 139785 - DNA, 9 bp, Unknown
  misc_feature (1)..( 9): Result.003 file - promoters60/4770463
aaaattatt

SEQ ID NO: 139786 - DNA, 9 bp, Unknown
  misc_feature (1)..( 9): Result.003 file - promoters60/4770463
gaagttagt

SEQ ID NO: 139787 - DNA, 9 bp, Unknown
  misc_feature (1)..( 9): Result.003 file - promoters60/4770463
taaataatt

SEQ ID NO: 139788 - DNA, 9 bp, Unknown
  misc_feature (1)..( 9): Result.003 file - promoters60/4770463
aaaattgcg

SEQ ID NO: 139789 - DNA, 12 bp, Unknown
  misc_feature (1)..( 12): Result.003 file - promoters60/4770463
tcgaaatcatat

SEQ ID NO: 139790 - DNA, 12 bp, Unknown
  misc_feature (1)..( 12): Result.003 file - promoters60/4770463
ttgaaatcatac

SEQ ID NO: 139791 - DNA, 12 bp, Unknown
  misc_feature (1)..( 12): Result.003 file - promoters60/4770463
cagaaatcgcct

SEQ ID NO: 139792 - DNA, 12 bp, Unknown
  misc_feature (1)..( 12): Result.003 file - promoters60/4770463
ttgcaatttaga

SEQ ID NO: 139793 - DNA, 12 bp, Unknown
  misc_feature (1)..( 12): Result.003 file - promoters60/4770463
ttgaaacttgca

SEQ ID NO: 139794 - DNA, 8 bp, Unknown
  misc_feature (1)..( 8): Result.003 file - promoters60/4770463
taaaaaaa

SEQ ID NO: 139795 - DNA, 8 bp, Unknown
  misc_feature (1)..( 8): Result.003 file - promoters60/4770463
taaacaaa

SEQ ID NO: 139796 - DNA, 8 bp, Unknown
  misc_feature (1)..( 8): Result.003 file - promoters60/4770463
caaacaac

SEQ ID NO: 139797 - DNA, 8 bp, Unknown
  misc_feature (1)..( 8): Result.003 file - promoters60/4770463
taaacaaa

SEQ ID NO: 139798 - DNA, 8 bp, Unknown
  misc_feature (1)..( 8): Result.003 file - promoters60/4770463
ggaacaaa

SEQ ID NO: 139799 - DNA, 6 bp, Unknown
  misc_feature (1)..( 6): Result.003 file - promoters60/4770466
tttttc

SEQ ID NO: 139800 - DNA, 6 bp, Unknown
  misc_feature (1)..( 6): Result.003 file - promoters60/4770466
tttttc

SEQ ID NO: 139801 - DNA, 6 bp, Unknown
  misc_feature (1)..( 6): Result.003 file - promoters60/4770466
ataaac

SEQ ID NO: 139802 - DNA, 6 bp, Unknown
  misc_feature (1)..( 6): Result.003 file - promoters60/4770466
ataaac

SEQ ID NO: 139803 - DNA, 6 bp, Unknown
  misc_feature (1)..( 6): Result.003 file - promoters60/4770466
ataaac

SEQ ID NO: 139804 - DNA, 6 bp, Unknown
  misc_feature (1)..( 6): Result.003 file - promoters60/4770466
atatat

SEQ ID NO: 139805 - DNA, 6 bp, Unknown
  misc_feature (1)..( 6): Result.003 file - promoters60/4770466
atatat

SEQ ID NO: 139806 - DNA, 14 bp, Unknown
  misc_feature (1)..( 14): Result.003 file - promoters60/4770466
attttatgtgctgc

SEQ ID NO: 139807 - DNA, 14 bp, Unknown
  misc_feature (1)..( 14): Result.003 file - promoters60/4770466
cttttctgttctgc

SEQ ID NO: 139808 - DNA, 14 bp, Unknown
  misc_feature (1)..( 14): Result.003 file - promoters60/4770466
attttatttttgaa

SEQ ID NO: 139809 - DNA, 9 bp, Unknown
  misc_feature (1)..( 9): Result.003 file - promoters60/4770466
aaatcaaaa

SEQ ID NO: 139810 - DNA, 9 bp, Unknown
  misc_feature (1)..( 9): Result.003 file - promoters60/4770466
aaattaaaa

SEQ ID NO: 139811 - DNA, 6 bp, Unknown
  misc_feature (1)..( 6): Result.003 file - promoters60/4770466
tttctt

SEQ ID NO: 139812 - DNA, 6 bp, Unknown
  misc_feature (1)..( 6): Result.003 file - promoters60/4770466
tttctt

SEQ ID NO: 139813 - DNA, 8 bp, Unknown
  misc_feature (1)..( 8): Result.003 file - promoters60/4770466
tatttcga

SEQ ID NO: 139814 - DNA, 8 bp, Unknown
  misc_feature (1)..( 8): Result.003 file - promoters60/4770466
tatctcga

SEQ ID NO: 139815 - DNA, 11 bp, Unknown
  misc_feature (1)..( 11): Result.003 file - promoters60/4770477
tatagttcagc

SEQ ID NO: 139816 - DNA, 11 bp, Unknown
  misc_feature (1)..( 11): Result.003 file - promoters60/4770477
tatacttcagt

SEQ ID NO: 139817 - DNA, 11 bp, Unknown
  misc_feature (1)..( 11): Result.003 file - promoters60/4770477
gatagttgtgt

SEQ ID NO: 139818 - DNA, 11 bp, Unknown
  misc_feature (1)..( 11): Result.003 file - promoters60/4770477
ttgatttcagt

SEQ ID NO: 139819 - DNA, 7 bp, Unknown
  misc_feature (1)..( 7): Result.003 file - promoters60/4770499
ttctgat

SEQ ID NO: 139820 - DNA, 7 bp, Unknown
  misc_feature (1)..( 7): Result.003 file - promoters60/4770499
ttcagat

SEQ ID NO: 139821 - DNA, 9 bp, Unknown
  misc_feature (1)..( 9): Result.003 file - promoters60/4770499
ctttttaat

SEQ ID NO: 139822 - DNA, 9 bp, Unknown
  misc_feature (1)..( 9): Result.003 file - promoters60/4770499
ctttgtaac

SEQ ID NO: 139823 - DNA, 9 bp, Unknown
  misc_feature (1)..( 9): Result.003 file - promoters60/4770499
tgttttaat

SEQ ID NO: 139824 - DNA, 6 bp, Unknown
  misc_feature (1)..( 6): Result.003 file - promoters60/4770499
gagaaa

SEQ ID NO: 139825 - DNA, 6 bp, Unknown
  misc_feature (1)..( 6): Result.003 file - promoters60/4770499
gagaaa

SEQ ID NO: 139826 - DNA, 7 bp, Unknown
  misc_feature (1)..( 7): Result.003 file - promoters60/4770499
tttcgaa

SEQ ID NO: 139827 - DNA, 7 bp, Unknown
  misc_feature (1)..( 7): Result.003 file - promoters60/4770499
tttggaa

SEQ ID NO: 139828 - DNA, 10 bp, Unknown
  misc_feature (1)..( 10): Result.003 file - promoters60/4770499
gattaaaatt

SEQ ID NO: 139829 - DNA, 10 bp, Unknown
  misc_feature (1)..( 10): Result.003 file - promoters60/4770499
aaataaaata

SEQ ID NO: 139830 - DNA, 10 bp, Unknown
  misc_feature (1)..( 10): Result.003 file - promoters60/4770499
aaatgaaata

SEQ ID NO: 139831 - DNA, 7 bp, Unknown
  misc_feature (1)..( 7): Result.003 file - promoters60/4770499
aacttga

SEQ ID NO: 139832 - DNA, 7 bp, Unknown
  misc_feature (1)..( 7): Result.003 file - promoters60/4770499
aacttga

SEQ ID NO: 139833 - DNA, 6 bp, Unknown
  misc_feature (1)..( 6): Result.003 file - promoters60/4770499
agaact

SEQ ID NO: 139834 - DNA, 6 bp, Unknown
  misc_feature (1)..( 6): Result.003 file - promoters60/4770499
agaact

SEQ ID NO: 139835 - DNA, 6 bp, Unknown
  misc_feature (1)..( 6): Result.003 file - promoters60/4770499
aacgat

SEQ ID NO: 139836 - DNA, 6 bp, Unknown
  misc_feature (1)..( 6): Result.003 file - promoters60/4770499
aacgat

SEQ ID NO: 139837 - DNA, 8 bp, Unknown
  misc_feature (1)..( 8): Result.003 file - promoters60/4770499
gttcggtt

SEQ ID NO: 139838 - DNA, 8 bp, Unknown
  misc_feature (1)..( 8): Result.003 file - promoters60/4770499
gttctgtt

SEQ ID NO: 139839 - DNA, 7 bp, Unknown
  misc_feature (1)..( 7): Result.003 file - promoters60/4770499
tcagtgt

SEQ ID NO: 139840 - DNA, 7 bp, Unknown
  misc_feature (1)..( 7): Result.003 file - promoters60/4770499
tcattgt

SEQ ID NO: 139841 - DNA, 6 bp, Unknown
  misc_feature (1)..( 6): Result.003 file - promoters60/4770499
agtaaa

SEQ ID NO: 139842 - DNA, 6 bp, Unknown
  misc_feature (1)..( 6): Result.003 file - promoters60/4770499
agtaaa

SEQ ID NO: 139843 - DNA, 7 bp, Unknown
  misc_feature (1)..( 7): Result.003 file - promoters60/4770499
aatcggg

SEQ ID NO: 139844 - DNA, 7 bp, Unknown
  misc_feature (1)..( 7): Result.003 file - promoters60/4770499
aattggg

SEQ ID NO: 139845 - DNA, 8 bp, Unknown
  misc_feature (1)..( 8): Result.003 file - promoters60/4770499
gaaagaaa

SEQ ID NO: 139846 - DNA, 8 bp, Unknown
  misc_feature (1)..( 8): Result.003 file - promoters60/4770499
gaaacaaa

SEQ ID NO: 139847 - DNA, 10 bp, Unknown
  misc_feature (1)..( 10): Result.003 file - promoters60/4770499
ggaaaagaaa

SEQ ID NO: 139848 - DNA, 10 bp, Unknown
  misc_feature (1)..( 10): Result.003 file - promoters60/4770499
ggaaatgaaa

SEQ ID NO: 139849 - DNA, 7 bp, Unknown
  misc_feature (1)..( 7): Result.003 file - promoters60/4770499
cccacta

SEQ ID NO: 139850 - DNA, 7 bp, Unknown
  misc_feature (1)..( 7): Result.003 file - promoters60/4770499
cccacta

SEQ ID NO: 139851 - DNA, 9 bp, Unknown
  misc_feature (1)..( 9): Result.003 file - promoters60/4770499
aaagaaaag

SEQ ID NO: 139852 - DNA, 9 bp, Unknown
  misc_feature (1)..( 9): Result.003 file - promoters60/4770499
aaagtaaag

SEQ ID NO: 139853 - DNA, 7 bp, Unknown
  misc_feature (1)..( 7): Result.003 file - promoters60/4770499
gtatata

SEQ ID NO: 139854 - DNA, 7 bp, Unknown
  misc_feature (1)..( 7): Result.003 file - promoters60/4770499
gtatata

SEQ ID NO: 139855 - DNA, 14 bp, Unknown
  misc_feature (1)..( 14): Result.003 file - promoters60/4770594
aaacgaataccata

SEQ ID NO: 139856 - DNA, 14 bp, Unknown
  misc_feature (1)..( 14): Result.003 file - promoters60/4770594
aaatcattacaata

SEQ ID NO: 139857 - DNA, 14 bp, Unknown
  misc_feature (1)..( 14): Result.003 file - promoters60/4770594
cttactttataatg

SEQ ID NO: 139858 - DNA, 14 bp, Unknown
  misc_feature (1)..( 14): Result.003 file - promoters60/4770594
aaaacattaaaatc

SEQ ID NO: 139859 - DNA, 9 bp, Unknown
  misc_feature (1)..( 9): Result.003 file - promoters60/4770604
tatattcta

SEQ ID NO: 139860 - DNA, 9 bp, Unknown
  misc_feature (1)..( 9): Result.003 file - promoters60/4770604
catatacta

SEQ ID NO: 139861 - DNA, 9 bp, Unknown
  misc_feature (1)..( 9): Result.003 file - promoters60/4770604
tatattaaa

SEQ ID NO: 139862 - DNA, 10 bp, Unknown
  misc_feature (1)..( 10): Result.003 file - promoters60/4770604
caaaaaagaa

SEQ ID NO: 139863 - DNA, 10 bp, Unknown
  misc_feature (1)..( 10): Result.003 file - promoters60/4770604
caaaaatgaa

SEQ ID NO: 139864 - DNA, 10 bp, Unknown
  misc_feature (1)..( 10): Result.003 file - promoters60/4770604
ggcaaaggaa

SEQ ID NO: 139865 - DNA, 9 bp, Unknown
  misc_feature (1)..( 9): Result.003 file - promoters60/4770604
cctcaataa

SEQ ID NO: 139866 - DNA, 9 bp, Unknown
  misc_feature (1)..( 9): Result.003 file - promoters60/4770604
aatcattaa

SEQ ID NO: 139867 - DNA, 9 bp, Unknown
  misc_feature (1)..( 9): Result.003 file - promoters60/4770604
attcacatt

SEQ ID NO: 139868 - DNA, 9 bp, Unknown
  misc_feature (1)..( 9): Result.003 file - promoters60/4770604
aaatattct

SEQ ID NO: 139869 - DNA, 9 bp, Unknown
  misc_feature (1)..( 9): Result.003 file - promoters60/4770604
acataatct

SEQ ID NO: 139870 - DNA, 9 bp, Unknown
  misc_feature (1)..( 9): Result.003 file - promoters60/4770604
aaatattag

SEQ ID NO: 139871 - DNA, 7 bp, Unknown
  misc_feature (1)..( 7): Result.003 file - promoters60/4770604
tatataa

SEQ ID NO: 139872 - DNA, 7 bp, Unknown
  misc_feature (1)..( 7): Result.003 file - promoters60/4770604
tatatat

SEQ ID NO: 139873 - DNA, 7 bp, Unknown
  misc_feature (1)..( 7): Result.003 file - promoters60/4770604
tatttat

SEQ ID NO: 139874 - DNA, 8 bp, Unknown
  misc_feature (1)..( 8): Result.003 file - promoters60/4770620
gaaagatc

SEQ ID NO: 139875 - DNA, 8 bp, Unknown
  misc_feature (1)..( 8): Result.003 file - promoters60/4770620
aaaatatc

SEQ ID NO: 139876 - DNA, 8 bp, Unknown
  misc_feature (1)..( 8): Result.003 file - promoters60/4770620
ataagatc

SEQ ID NO: 139877 - DNA, 8 bp, Unknown
  misc_feature (1)..( 8): Result.003 file - promoters60/4770620
aaaataat

SEQ ID NO: 139878 - DNA, 12 bp, Unknown
  misc_feature (1)..( 12): Result.003 file - promoters60/4770620
tctgaaaattag

SEQ ID NO: 139879 - DNA, 12 bp, Unknown
  misc_feature (1)..( 12): Result.003 file - promoters60/4770620
caacaaaattaa

SEQ ID NO: 139880 - DNA, 12 bp, Unknown
  misc_feature (1)..( 12): Result.003 file - promoters60/4770620
tcttaaatttaa

SEQ ID NO: 139881 - DNA, 12 bp, Unknown
  misc_feature (1)..( 12): Result.003 file - promoters60/4770620
gatcaacattaa

SEQ ID NO: 139882 - DNA, 7 bp, Unknown
  misc_feature (1)..( 7): Result.003 file - promoters60/4770624
aaattaa

SEQ ID NO: 139883 - DNA, 7 bp, Unknown
  misc_feature (1)..( 7): Result.003 file - promoters60/4770624
aaactaa

SEQ ID NO: 139884 - DNA, 6 bp, Unknown
  misc_feature (1)..( 6): Result.003 file - promoters60/4770624
ttatta

SEQ ID NO: 139885 - DNA, 6 bp, Unknown
  misc_feature (1)..( 6): Result.003 file - promoters60/4770624
ttatta

SEQ ID NO: 139886 - DNA, 8 bp, Unknown
  misc_feature (1)..( 8): Result.003 file - promoters60/4770624
aatgtata

SEQ ID NO: 139887 - DNA, 8 bp, Unknown
  misc_feature (1)..( 8): Result.003 file - promoters60/4770624
aatttata

SEQ ID NO: 139888 - DNA, 6 bp, Unknown
  misc_feature (1)..( 6): Result.003 file - promoters60/4770624
ctaaac

SEQ ID NO: 139889 - DNA, 6 bp, Unknown
  misc_feature (1)..( 6): Result.003 file - promoters60/4770624
ctaaac

SEQ ID NO: 139890 - DNA, 6 bp, Unknown
  misc_feature (1)..( 6): Result.003 file - promoters60/4770624
ttaaac

SEQ ID NO: 139891 - DNA, 6 bp, Unknown
  misc_feature (1)..( 6): Result.003 file - promoters60/4770624
ttaaac

SEQ ID NO: 139892 - DNA, 8 bp, Unknown
  misc_feature (1)..( 8): Result.003 file - promoters60/4770624
aaaaatag

SEQ ID NO: 139893 - DNA, 8 bp, Unknown
  misc_feature (1)..( 8): Result.003 file - promoters60/4770624
aaaagtag

SEQ ID NO: 139894 - DNA, 8 bp, Unknown
  misc_feature (1)..( 8): Result.003 file - promoters60/4770624
aaacataa

SEQ ID NO: 139895 - DNA, 6 bp, Unknown
  misc_feature (1)..( 6): Result.003 file - promoters60/4770624
agaaaa

SEQ ID NO: 139896 - DNA, 6 bp, Unknown
  misc_feature (1)..( 6): Result.003 file - promoters60/4770624
agaaaa

SEQ ID NO: 139897 - DNA, 6 bp, Unknown
  misc_feature (1)..( 6): Result.003 file - promoters60/4770624
aaacac

SEQ ID NO: 139898 - DNA, 6 bp, Unknown
  misc_feature (1)..( 6): Result.003 file - promoters60/4770624
aaacac

SEQ ID NO: 139899 - DNA, 10 bp, Unknown
  misc_feature (1)..( 10): Result.003 file - promoters60/4770624
gtatacataa

SEQ ID NO: 139900 - DNA, 10 bp, Unknown
  misc_feature (1)..( 10): Result.003 file - promoters60/4770624
ttgtacataa

SEQ ID NO: 139901 - DNA, 10 bp, Unknown
  misc_feature (1)..( 10): Result.003 file - promoters60/4770624
ttgtaaatac

SEQ ID NO: 139902 - DNA, 6 bp, Unknown
  misc_feature (1)..( 6): Result.003 file - promoters60/4770624
aattaa

SEQ ID NO: 139903 - DNA, 6 bp, Unknown
  misc_feature (1)..( 6): Result.003 file - promoters60/4770624
aattaa

SEQ ID NO: 139904 - DNA, 6 bp, Unknown
  misc_feature (1)..( 6): Result.003 file - promoters60/4770624
ttgaca

SEQ ID NO: 139905 - DNA, 6 bp, Unknown
  misc_feature (1)..( 6): Result.003 file - promoters60/4770624
ttgaca

SEQ ID NO: 139906 - DNA, 6 bp, Unknown
  misc_feature (1)..( 6): Result.003 file - promoters60/4770624
atcatg

SEQ ID NO: 139907 - DNA, 6 bp, Unknown
  misc_feature (1)..( 6): Result.003 file - promoters60/4770624
atcatg

SEQ ID NO: 139908 - DNA, 6 bp, Unknown
  misc_feature (1)..( 6): Result.003 file - promoters60/4770624
aaacct

SEQ ID NO: 139909 - DNA, 6 bp, Unknown
  misc_feature (1)..( 6): Result.003 file - promoters60/4770624
aaacct

SEQ ID NO: 139910 - DNA, 7 bp, Unknown
  misc_feature (1)..( 7): Result.003 file - promoters60/4770624
aattcaa

SEQ ID NO: 139911 - DNA, 7 bp, Unknown
  misc_feature (1)..( 7): Result.003 file - promoters60/4770624
aattcaa

SEQ ID NO: 139912 - DNA, 6 bp, Unknown
  misc_feature (1)..( 6): Result.003 file - promoters60/4770624
aaaatt

SEQ ID NO: 139913 - DNA, 6 bp, Unknown
  misc_feature (1)..( 6): Result.003 file - promoters60/4770624
aaaatt

SEQ ID NO: 139914 - DNA, 6 bp, Unknown
  misc_feature (1)..( 6): Result.003 file - promoters60/4770624
caatca

SEQ ID NO: 139915 - DNA, 6 bp, Unknown
  misc_feature (1)..( 6): Result.003 file - promoters60/4770624
caatca

SEQ ID NO: 139916 - DNA, 7 bp, Unknown
  misc_feature (1)..( 7): Result.003 file - promoters60/4770624
aattttt

SEQ ID NO: 139917 - DNA, 7 bp, Unknown
  misc_feature (1)..( 7): Result.003 file - promoters60/4770624
aatcttt

SEQ ID NO: 139918 - DNA, 8 bp, Unknown
  misc_feature (1)..( 8): Result.003 file - promoters60/4770624
aaataaca

SEQ ID NO: 139919 - DNA, 8 bp, Unknown
  misc_feature (1)..( 8): Result.003 file - promoters60/4770624
aaaaaaca

SEQ ID NO: 139920 - DNA, 6 bp, Unknown
  misc_feature (1)..( 6): Result.003 file - promoters60/4770624
tcaaaa

SEQ ID NO: 139921 - DNA, 6 bp, Unknown
  misc_feature (1)..( 6): Result.003 file - promoters60/4770624
tcaaaa

SEQ ID NO: 139922 - DNA, 7 bp, Unknown
  misc_feature (1)..( 7): Result.003 file - promoters60/4770624
agtttaa

SEQ ID NO: 139923 - DNA, 7 bp, Unknown
  misc_feature (1)..( 7): Result.003 file - promoters60/4770624
agtataa

SEQ ID NO: 139924 - DNA, 7 bp, Unknown
  misc_feature (1)..( 7): Result.003 file - promoters60/4770659
aactctg

SEQ ID NO: 139925 - DNA, 7 bp, Unknown
  misc_feature (1)..( 7): Result.003 file - promoters60/4770659
aactctg

SEQ ID NO: 139926 - DNA, 7 bp, Unknown
  misc_feature (1)..( 7): Result.003 file - promoters60/4770659
agtatat

SEQ ID NO: 139927 - DNA, 7 bp, Unknown
  misc_feature (1)..( 7): Result.003 file - promoters60/4770659
tgtatat

SEQ ID NO: 139928 - DNA, 7 bp, Unknown
  misc_feature (1)..( 7): Result.003 file - promoters60/4770659
agtatat

SEQ ID NO: 139929 - DNA, 6 bp, Unknown
  misc_feature (1)..( 6): Result.003 file - promoters60/4770659
aaactt

SEQ ID NO: 139930 - DNA, 6 bp, Unknown
  misc_feature (1)..( 6): Result.003 file - promoters60/4770659
aaactt

SEQ ID NO: 139931 - DNA, 10 bp, Unknown
  misc_feature (1)..( 10): Result.003 file - promoters60/4770659
aaactaagaa

SEQ ID NO: 139932 - DNA, 10 bp, Unknown
  misc_feature (1)..( 10): Result.003 file - promoters60/4770659
aaaataaata

SEQ ID NO: 139933 - DNA, 10 bp, Unknown
  misc_feature (1)..( 10): Result.003 file - promoters60/4770659
acaatagata

SEQ ID NO: 139934 - DNA, 8 bp, Unknown
  misc_feature (1)..( 8): Result.003 file - promoters60/4770659
atattttt

SEQ ID NO: 139935 - DNA, 8 bp, Unknown
  misc_feature (1)..( 8): Result.003 file - promoters60/4770659
atattttt

SEQ ID NO: 139936 - DNA, 6 bp, Unknown
  misc_feature (1)..( 6): Result.003 file - promoters60/4770659
ataata

SEQ ID NO: 139937 - DNA, 6 bp, Unknown
  misc_feature (1)..( 6): Result.003 file - promoters60/4770659
ataata

SEQ ID NO: 139938 - DNA, 6 bp, Unknown
  misc_feature (1)..( 6): Result.003 file - promoters60/4770659
tgattt

SEQ ID NO: 139939 - DNA, 6 bp, Unknown
  misc_feature (1)..( 6): Result.003 file - promoters60/4770659
tgattt

SEQ ID NO: 139940 - DNA, 7 bp, Unknown
  misc_feature (1)..( 7): Result.003 file - promoters60/4770659
attagtt

SEQ ID NO: 139941 - DNA, 7 bp, Unknown
  misc_feature (1)..( 7): Result.003 file - promoters60/4770659
atttgtt

SEQ ID NO: 139942 - DNA, 6 bp, Unknown
  misc_feature (1)..( 6): Result.003 file - promoters60/4770659
attcaa

SEQ ID NO: 139943 - DNA, 6 bp, Unknown
  misc_feature (1)..( 6): Result.003 file - promoters60/4770659
attcaa

SEQ ID NO: 139944 - DNA, 8 bp, Unknown
  misc_feature (1)..( 8): Result.003 file - promoters60/4770659
tattgatg

SEQ ID NO: 139945 - DNA, 8 bp, Unknown
  misc_feature (1)..( 8): Result.003 file - promoters60/4770659
tattcatg

SEQ ID NO: 139946 - DNA, 6 bp, Unknown
  misc_feature (1)..( 6): Result.003 file - promoters60/4770659
aacaaa

SEQ ID NO: 139947 - DNA, 6 bp, Unknown
  misc_feature (1)..( 6): Result.003 file - promoters60/4770659
aacaaa

SEQ ID NO: 139948 - DNA, 8 bp, Unknown
  misc_feature (1)..( 8): Result.003 file - promoters60/4770659
tttagata

SEQ ID NO: 139949 - DNA, 8 bp, Unknown
  misc_feature (1)..( 8): Result.003 file - promoters60/4770659
aatagata

SEQ ID NO: 139950 - DNA, 8 bp, Unknown
  misc_feature (1)..( 8): Result.003 file - promoters60/4770659
aataaata

SEQ ID NO: 139951 - DNA, 6 bp, Unknown
  misc_feature (1)..( 6): Result.003 file - promoters60/4770659
ttttta

SEQ ID NO: 139952 - DNA, 6 bp, Unknown
  misc_feature (1)..( 6): Result.003 file - promoters60/4770659
ttttta

SEQ ID NO: 139953 - DNA, 6 bp, Unknown
  misc_feature (1)..( 6): Result.003 file - promoters60/4770659
ttaatt

SEQ ID NO: 139954 - DNA, 6 bp, Unknown
  misc_feature (1)..( 6): Result.003 file - promoters60/4770659
ttaatt

SEQ ID NO: 139955 - DNA, 6 bp, Unknown
  misc_feature (1)..( 6): Result.003 file - promoters60/4770659
ttctaa

SEQ ID NO: 139956 - DNA, 6 bp, Unknown
  misc_feature (1)..( 6): Result.003 file - promoters60/4770659
ttctaa

SEQ ID NO: 139957 - DNA, 7 bp, Unknown
  misc_feature (1)..( 7): Result.003 file - promoters60/4770666
gtggatt

SEQ ID NO: 139958 - DNA, 7 bp, Unknown
  misc_feature (1)..( 7): Result.003 file - promoters60/4770666
ttggatt

SEQ ID NO: 139959 - DNA, 7 bp, Unknown
  misc_feature (1)..( 7): Result.003 file - promoters60/4770666
ttgcatt

SEQ ID NO: 139960 - DNA, 7 bp, Unknown
  misc_feature (1)..( 7): Result.003 file - promoters60/4770666
aattata

SEQ ID NO: 139961 - DNA, 7 bp, Unknown
  misc_feature (1)..( 7): Result.003 file - promoters60/4770666
aattata

SEQ ID NO: 139962 - DNA, 7 bp, Unknown
  misc_feature (1)..( 7): Result.003 file - promoters60/4770666
aaaacct

SEQ ID NO: 139963 - DNA, 7 bp, Unknown
  misc_feature (1)..( 7): Result.003 file - promoters60/4770666
aaaacct

SEQ ID NO: 139964 - DNA, 7 bp, Unknown
  misc_feature (1)..( 7): Result.003 file - promoters60/4770666
tcttacg

SEQ ID NO: 139965 - DNA, 7 bp, Unknown
  misc_feature (1)..( 7): Result.003 file - promoters60/4770666
tctcacg

SEQ ID NO: 139966 - DNA, 6 bp, Unknown
  misc_feature (1)..( 6): Result.003 file - promoters60/4770666
tttcaa

SEQ ID NO: 139967 - DNA, 6 bp, Unknown
  misc_feature (1)..( 6): Result.003 file - promoters60/4770666
tttcaa

SEQ ID NO: 139968 - DNA, 7 bp, Unknown
  misc_feature (1)..( 7): Result.003 file - promoters60/4770666
atatttg

SEQ ID NO: 139969 - DNA, 7 bp, Unknown
  misc_feature (1)..( 7): Result.003 file - promoters60/4770666
ataattg

SEQ ID NO: 139970 - DNA, 7 bp, Unknown
  misc_feature (1)..( 7): Result.003 file - promoters60/4770666
ataattc

SEQ ID NO: 139971 - DNA, 6 bp, Unknown
  misc_feature (1)..( 6): Result.003 file - promoters60/4770666
agatat

SEQ ID NO: 139972 - DNA, 6 bp, Unknown
  misc_feature (1)..( 6): Result.003 file - promoters60/4770666
agatat

SEQ ID NO: 139973 - DNA, 7 bp, Unknown
  misc_feature (1)..( 7): Result.003 file - promoters60/4770666
gaaaaaa

SEQ ID NO: 139974 - DNA, 7 bp, Unknown
  misc_feature (1)..( 7): Result.003 file - promoters60/4770666
gaaaaaa

SEQ ID NO: 139975 - DNA, 7 bp, Unknown
  misc_feature (1)..( 7): Result.003 file - promoters60/4770666
caccata

SEQ ID NO: 139976 - DNA, 7 bp, Unknown
  misc_feature (1)..( 7): Result.003 file - promoters60/4770666
cactata

SEQ ID NO: 139977 - DNA, 8 bp, Unknown
  misc_feature (1)..( 8): Result.003 file - promoters60/4770666
ttaattca

SEQ ID NO: 139978 - DNA, 8 bp, Unknown
  misc_feature (1)..( 8): Result.003 file - promoters60/4770666
ttatttca

SEQ ID NO: 139979 - DNA, 6 bp, Unknown
  misc_feature (1)..( 6): Result.003 file - promoters60/4770666
atatgt

SEQ ID NO: 139980 - DNA, 6 bp, Unknown
  misc_feature (1)..( 6): Result.003 file - promoters60/4770666
atatgt

SEQ ID NO: 139981 - DNA, 6 bp, Unknown
  misc_feature (1)..( 6): Result.003 file - promoters60/4770666
aaccta

SEQ ID NO: 139982 - DNA, 6 bp, Unknown
  misc_feature (1)..( 6): Result.003 file - promoters60/4770666
aaccta

SEQ ID NO: 139983 - DNA, 6 bp, Unknown
  misc_feature (1)..( 6): Result.003 file - promoters60/4770666
tatcat

SEQ ID NO: 139984 - DNA, 6 bp, Unknown
  misc_feature (1)..( 6): Result.003 file - promoters60/4770666
tatcat

SEQ ID NO: 139985 - DNA, 6 bp, Unknown
  misc_feature (1)..( 6): Result.003 file - promoters60/4770666
ttaaaa

SEQ ID NO: 139986 - DNA, 6 bp, Unknown
  misc_feature (1)..( 6): Result.003 file - promoters60/4770666
ttaaaa

SEQ ID NO: 139987 - DNA, 7 bp, Unknown
  misc_feature (1)..( 7): Result.003 file - promoters60/4770666
tcaaata

SEQ ID NO: 139988 - DNA, 7 bp, Unknown
  misc_feature (1)..( 7): Result.003 file - promoters60/4770666
tcaaata

SEQ ID NO: 139989 - DNA, 8 bp, Unknown
  misc_feature (1)..( 8): Result.003 file - promoters60/4770666
tttaatct

SEQ ID NO: 139990 - DNA, 8 bp, Unknown
  misc_feature (1)..( 8): Result.003 file - promoters60/4770666
ttttatct

SEQ ID NO: 139991 - DNA, 8 bp, Unknown
  misc_feature (1)..( 8): Result.003 file - promoters60/4770666
aattgtaa

SEQ ID NO: 139992 - DNA, 8 bp, Unknown
  misc_feature (1)..( 8): Result.003 file - promoters60/4770666
aatggtaa

SEQ ID NO: 139993 - DNA, 8 bp, Unknown
  misc_feature (1)..( 8): Result.003 file - promoters60/4770666
aagctgag

SEQ ID NO: 139994 - DNA, 8 bp, Unknown
  misc_feature (1)..( 8): Result.003 file - promoters60/4770666
aagcagag

SEQ ID NO: 139995 - DNA, 6 bp, Unknown
  misc_feature (1)..( 6): Result.003 file - promoters60/4770666
aataat

SEQ ID NO: 139996 - DNA, 6 bp, Unknown
  misc_feature (1)..( 6): Result.003 file - promoters60/4770666
aataat

SEQ ID NO: 139997 - DNA, 10 bp, Unknown
  misc_feature (1)..( 10): Result.003 file - promoters60/4770666
aactattcat

SEQ ID NO: 139998 - DNA, 10 bp, Unknown
  misc_feature (1)..( 10): Result.003 file - promoters60/4770666
aactaatcat

SEQ ID NO: 139999 - DNA, 10 bp, Unknown
  misc_feature (1)..( 10): Result.003 file - promoters60/4770666
attattttaa

SEQ ID NO: 140000 - DNA, 10 bp, Unknown
  misc_feature (1)..( 10): Result.003 file - promoters60/4770666
attagtttaa

SEQ ID NO: 140001 - DNA, 14 bp, Unknown
  misc_feature (1)..( 14): Result.003 file - promoters60/4770666
ctacaaatagaggc

SEQ ID NO: 140002 - DNA, 14 bp, Unknown
  misc_feature (1)..( 14): Result.003 file - promoters60/4770666
ctacaaatagaggc

SEQ ID NO: 140003 - DNA, 8 bp, Unknown
  misc_feature (1)..( 8): Result.003 file - promoters60/4770865
acatattg

SEQ ID NO: 140004 - DNA, 8 bp, Unknown
  misc_feature (1)..( 8): Result.003 file - promoters60/4770865
acattttg

SEQ ID NO: 140005 - DNA, 8 bp, Unknown
  misc_feature (1)..( 8): Result.003 file - promoters60/4770865
ttattttg

SEQ ID NO: 140006 - DNA, 8 bp, Unknown
  misc_feature (1)..( 8): Result.003 file - promoters60/4770865
ccatatta

SEQ ID NO: 140007 - DNA, 9 bp, Unknown
  misc_feature (1)..( 9): Result.003 file - promoters60/4770865
gtatataaa

SEQ ID NO: 140008 - DNA, 9 bp, Unknown
  misc_feature (1)..( 9): Result.003 file - promoters60/4770865
ttataaaaa

SEQ ID NO: 140009 - DNA, 9 bp, Unknown
  misc_feature (1)..( 9): Result.003 file - promoters60/4770865
ttataaata

SEQ ID NO: 140010 - DNA, 9 bp, Unknown
  misc_feature (1)..( 9): Result.003 file - promoters60/4770865
tgataaatc

SEQ ID NO: 140011 - DNA, 9 bp, Unknown
  misc_feature (1)..( 9): Result.003 file - promoters60/4771271
gaaacaagt

SEQ ID NO: 140012 - DNA, 9 bp, Unknown
  misc_feature (1)..( 9): Result.003 file - promoters60/4771271
gaaagaaga

SEQ ID NO: 140013 - DNA, 9 bp, Unknown
  misc_feature (1)..( 9): Result.003 file - promoters60/4771271
taaaaaagg

SEQ ID NO: 140014 - DNA, 10 bp, Unknown
  misc_feature (1)..( 10): Result.003 file - promoters60/4771271
tgagagaaga

SEQ ID NO: 140015 - DNA, 10 bp, Unknown
  misc_feature (1)..( 10): Result.003 file - promoters60/4771271
caatataaag

SEQ ID NO: 140016 - DNA, 10 bp, Unknown
  misc_feature (1)..( 10): Result.003 file - promoters60/4771271
agatacaaat

SEQ ID NO: 140017 - DNA, 7 bp, Unknown
  misc_feature (1)..( 7): Result.003 file - promoters60/4771286
aacttat

SEQ ID NO: 140018 - DNA, 7 bp, Unknown
  misc_feature (1)..( 7): Result.003 file - promoters60/4771286
aacatat

SEQ ID NO: 140019 - DNA, 12 bp, Unknown
  misc_feature (1)..( 12): Result.003 file - promoters60/4771286
tttgtattttag

SEQ ID NO: 140020 - DNA, 12 bp, Unknown
  misc_feature (1)..( 12): Result.003 file - promoters60/4771286
tttggattcaaa

SEQ ID NO: 140021 - DNA, 12 bp, Unknown
  misc_feature (1)..( 12): Result.003 file - promoters60/4771286
tttatattttag

SEQ ID NO: 140022 - DNA, 7 bp, Unknown
  misc_feature (1)..( 7): Result.003 file - promoters60/4771286
attcaaa

SEQ ID NO: 140023 - DNA, 7 bp, Unknown
  misc_feature (1)..( 7): Result.003 file - promoters60/4771286
attcaaa

SEQ ID NO: 140024 - DNA, 7 bp, Unknown
  misc_feature (1)..( 7): Result.003 file - promoters60/4771286
aatttgt

SEQ ID NO: 140025 - DNA, 7 bp, Unknown
  misc_feature (1)..( 7): Result.003 file - promoters60/4771286
aatatgt

SEQ ID NO: 140026 - DNA, 9 bp, Unknown
  misc_feature (1)..( 9): Result.003 file - promoters60/4771286
gttattttt

SEQ ID NO: 140027 - DNA, 9 bp, Unknown
  misc_feature (1)..( 9): Result.003 file - promoters60/4771286
gtttttttt

SEQ ID NO: 140028 - DNA, 9 bp, Unknown
  misc_feature (1)..( 9): Result.003 file - promoters60/4771286
ataattatg

SEQ ID NO: 140029 - DNA, 9 bp, Unknown
  misc_feature (1)..( 9): Result.003 file - promoters60/4771286
ataataatg

SEQ ID NO: 140030 - DNA, 11 bp, Unknown
  misc_feature (1)..( 11): Result.003 file - promoters60/4771286
gataggaaaaa

SEQ ID NO: 140031 - DNA, 11 bp, Unknown
  misc_feature (1)..( 11): Result.003 file - promoters60/4771286
gatagtaaaaa

SEQ ID NO: 140032 - DNA, 6 bp, Unknown
  misc_feature (1)..( 6): Result.003 file - promoters60/4771286
tatcca

SEQ ID NO: 140033 - DNA, 6 bp, Unknown
  misc_feature (1)..( 6): Result.003 file - promoters60/4771286
tatcca

SEQ ID NO: 140034 - DNA, 6 bp, Unknown
  misc_feature (1)..( 6): Result.003 file - promoters60/4771286
cattaa

SEQ ID NO: 140035 - DNA, 6 bp, Unknown
  misc_feature (1)..( 6): Result.003 file - promoters60/4771286
cattaa

SEQ ID NO: 140036 - DNA, 11 bp, Unknown
  misc_feature (1)..( 11): Result.003 file - promoters60/4771286
caaaacccttc

SEQ ID NO: 140037 - DNA, 11 bp, Unknown
  misc_feature (1)..( 11): Result.003 file - promoters60/4771286
ataaacctttc

SEQ ID NO: 140038 - DNA, 11 bp, Unknown
  misc_feature (1)..( 11): Result.003 file - promoters60/4771286
ataaaccgtcg

SEQ ID NO: 140039 - DNA, 10 bp, Unknown
  misc_feature (1)..( 10): Result.003 file - promoters60/4771286
tataaacaaa

SEQ ID NO: 140040 - DNA, 10 bp, Unknown
  misc_feature (1)..( 10): Result.003 file - promoters60/4771286
tataaataaa

SEQ ID NO: 140041 - DNA, 10 bp, Unknown
  misc_feature (1)..( 10): Result.003 file - promoters60/4771286
tataaaatca

SEQ ID NO: 140042 - DNA, 6 bp, Unknown
  misc_feature (1)..( 6): Result.003 file - promoters60/4771286
aaattc

SEQ ID NO: 140043 - DNA, 6 bp, Unknown
  misc_feature (1)..( 6): Result.003 file - promoters60/4771286
aaattc

SEQ ID NO: 140044 - DNA, 7 bp, Unknown
  misc_feature (1)..( 7): Result.003 file - promoters60/4771286
tttgaaa

SEQ ID NO: 140045 - DNA, 7 bp, Unknown
  misc_feature (1)..( 7): Result.003 file - promoters60/4771286
ttttaaa

SEQ ID NO: 140046 - DNA, 10 bp, Unknown
  misc_feature (1)..( 10): Result.003 file - promoters60/4771286
aaaatgttag

SEQ ID NO: 140047 - DNA, 10 bp, Unknown
  misc_feature (1)..( 10): Result.003 file - promoters60/4771286
aaactgttag

SEQ ID NO: 140048 - DNA, 7 bp, Unknown
  misc_feature (1)..( 7): Result.003 file - promoters60/4771286
actttgt

SEQ ID NO: 140049 - DNA, 7 bp, Unknown
  misc_feature (1)..( 7): Result.003 file - promoters60/4771286
actctgt

SEQ ID NO: 140050 - DNA, 6 bp, Unknown
  misc_feature (1)..( 6): Result.003 file - promoters60/4771286
atctcc

SEQ ID NO: 140051 - DNA, 6 bp, Unknown
  misc_feature (1)..( 6): Result.003 file - promoters60/4771286
atctcc

SEQ ID NO: 140052 - DNA, 8 bp, Unknown
  misc_feature (1)..( 8): Result.003 file - promoters60/4771286
atccgcgt

SEQ ID NO: 140053 - DNA, 8 bp, Unknown
  misc_feature (1)..( 8): Result.003 file - promoters60/4771286
atcctcgt

SEQ ID NO: 140054 - DNA, 14 bp, Unknown
  misc_feature (1)..( 14): Result.003 file - promoters60/4771286
taactaatcagatc

SEQ ID NO: 140055 - DNA, 14 bp, Unknown
  misc_feature (1)..( 14): Result.003 file - promoters60/4771286
taaccaatcatatc

SEQ ID NO: 140056 - DNA, 6 bp, Unknown
  misc_feature (1)..( 6): Result.003 file - promoters60/4771286
tattct

SEQ ID NO: 140057 - DNA, 6 bp, Unknown
  misc_feature (1)..( 6): Result.003 file - promoters60/4771286
tattct

SEQ ID NO: 140058 - DNA, 8 bp, Unknown
  misc_feature (1)..( 8): Result.003 file - promoters60/4771286
ataccaca

SEQ ID NO: 140059 - DNA, 8 bp, Unknown
  misc_feature (1)..( 8): Result.003 file - promoters60/4771286
atacaaca

SEQ ID NO: 140060 - DNA, 9 bp, Unknown
  misc_feature (1)..( 9): Result.003 file - promoters60/4771286
tcaacttgt

SEQ ID NO: 140061 - DNA, 9 bp, Unknown
  misc_feature (1)..( 9): Result.003 file - promoters60/4771286
tcagcttgt

SEQ ID NO: 140062 - DNA, 7 bp, Unknown
  misc_feature (1)..( 7): Result.003 file - promoters60/4771286
tttcgat

SEQ ID NO: 140063 - DNA, 7 bp, Unknown
  misc_feature (1)..( 7): Result.003 file - promoters60/4771286
tttggat

SEQ ID NO: 140064 - DNA, 7 bp, Unknown
  misc_feature (1)..( 7): Result.003 file - promoters60/4771286
aacataa

SEQ ID NO: 140065 - DNA, 7 bp, Unknown
  misc_feature (1)..( 7): Result.003 file - promoters60/4771286
aacataa

SEQ ID NO: 140066 - DNA, 10 bp, Unknown
  misc_feature (1)..( 10): Result.003 file - promoters60/4771286
ataacccaat

SEQ ID NO: 140067 - DNA, 10 bp, Unknown
  misc_feature (1)..( 10): Result.003 file - promoters60/4771286
ataaaccaat

SEQ ID NO: 140068 - DNA, 7 bp, Unknown
  misc_feature (1)..( 7): Result.003 file - promoters60/4771286
tccgatc

SEQ ID NO: 140069 - DNA, 7 bp, Unknown
  misc_feature (1)..( 7): Result.003 file - promoters60/4771286
tcccatc

SEQ ID NO: 140070 - DNA, 8 bp, Unknown
  misc_feature (1)..( 8): Result.003 file - promoters60/4771321
attataaa

SEQ ID NO: 140071 - DNA, 8 bp, Unknown
  misc_feature (1)..( 8): Result.003 file - promoters60/4771321
tttataat

SEQ ID NO: 140072 - DNA, 9 bp, Unknown
  misc_feature (1)..( 9): Result.003 file - promoters60/4771321
ggtatcaaa

SEQ ID NO: 140073 - DNA, 9 bp, Unknown
  misc_feature (1)..( 9): Result.003 file - promoters60/4771321
tttgataag

SEQ ID NO: 140074 - DNA, 9 bp, Unknown
  misc_feature (1)..( 9): Result.003 file - promoters60/4771321
cacatcaaa

SEQ ID NO: 140075 - DNA, 9 bp, Unknown
  misc_feature (1)..( 9): Result.003 file - promoters60/4771321
gttatttga

SEQ ID NO: 140076 - DNA, 7 bp, Unknown
  misc_feature (1)..( 7): Result.003 file - promoters60/4771348
atgaaga

SEQ ID NO: 140077 - DNA, 7 bp, Unknown
  misc_feature (1)..( 7): Result.003 file - promoters60/4771348
atgaaga

SEQ ID NO: 140078 - DNA, 8 bp, Unknown
  misc_feature (1)..( 8): Result.003 file - promoters60/4771348
tgtcttta

SEQ ID NO: 140079 - DNA, 8 bp, Unknown
  misc_feature (1)..( 8): Result.003 file - promoters60/4771348
cgtcatta

SEQ ID NO: 140080 - DNA, 8 bp, Unknown
  misc_feature (1)..( 8): Result.003 file - promoters60/4771348
tgtctttc

SEQ ID NO: 140081 - DNA, 6 bp, Unknown
  misc_feature (1)..( 6): Result.003 file - promoters60/4771348
ttgttt

SEQ ID NO: 140082 - DNA, 6 bp, Unknown
  misc_feature (1)..( 6): Result.003 file - promoters60/4771348
ttgttt

SEQ ID NO: 140083 - DNA, 8 bp, Unknown
  misc_feature (1)..( 8): Result.003 file - promoters60/4771348
catttgta

SEQ ID NO: 140084 - DNA, 8 bp, Unknown
  misc_feature (1)..( 8): Result.003 file - promoters60/4771348
cattggta

SEQ ID NO: 140085 - DNA, 8 bp, Unknown
  misc_feature (1)..( 8): Result.003 file - promoters60/4771348
gattagta

SEQ ID NO: 140086 - DNA, 7 bp, Unknown
  misc_feature (1)..( 7): Result.003 file - promoters60/4771348
caacatt

SEQ ID NO: 140087 - DNA, 7 bp, Unknown
  misc_feature (1)..( 7): Result.003 file - promoters60/4771348
caacatt

SEQ ID NO: 140088 - DNA, 6 bp, Unknown
  misc_feature (1)..( 6): Result.003 file - promoters60/4771348
tgacag

SEQ ID NO: 140089 - DNA, 6 bp, Unknown
  misc_feature (1)..( 6): Result.003 file - promoters60/4771348
tgacag

SEQ ID NO: 140090 - DNA, 8 bp, Unknown
  misc_feature (1)..( 8): Result.003 file - promoters60/4771348
ctcttcac

SEQ ID NO: 140091 - DNA, 8 bp, Unknown
  misc_feature (1)..( 8): Result.003 file - promoters60/4771348
ctctccac

SEQ ID NO: 140092 - DNA, 7 bp, Unknown
  misc_feature (1)..( 7): Result.003 file - promoters60/4771348
tttggtt

SEQ ID NO: 140093 - DNA, 7 bp, Unknown
  misc_feature (1)..( 7): Result.003 file - promoters60/4771348
tttagtt

SEQ ID NO: 140094 - DNA, 7 bp, Unknown
  misc_feature (1)..( 7): Result.003 file - promoters60/4771348
atagaaa

SEQ ID NO: 140095 - DNA, 7 bp, Unknown
  misc_feature (1)..( 7): Result.003 file - promoters60/4771348
atataaa

SEQ ID NO: 140096 - DNA, 7 bp, Unknown
  misc_feature (1)..( 7): Result.003 file - promoters60/4771348
ttaattt

SEQ ID NO: 140097 - DNA, 7 bp, Unknown
  misc_feature (1)..( 7): Result.003 file - promoters60/4771348
ttacttt

SEQ ID NO: 140098 - DNA, 7 bp, Unknown
  misc_feature (1)..( 7): Result.003 file - promoters60/4771348
acactgt

SEQ ID NO: 140099 - DNA, 7 bp, Unknown
  misc_feature (1)..( 7): Result.003 file - promoters60/4771348
acattgt

SEQ ID NO: 140100 - DNA, 6 bp, Unknown
  misc_feature (1)..( 6): Result.003 file - promoters60/4771348
catttt

SEQ ID NO: 140101 - DNA, 6 bp, Unknown
  misc_feature (1)..( 6): Result.003 file - promoters60/4771348
catttt

SEQ ID NO: 140102 - DNA, 6 bp, Unknown
  misc_feature (1)..( 6): Result.003 file - promoters60/4771348
agatta

SEQ ID NO: 140103 - DNA, 6 bp, Unknown
  misc_feature (1)..( 6): Result.003 file - promoters60/4771348
agatta

SEQ ID NO: 140104 - DNA, 9 bp, Unknown
  misc_feature (1)..( 9): Result.003 file - promoters60/4771348
aagacaaag

SEQ ID NO: 140105 - DNA, 9 bp, Unknown
  misc_feature (1)..( 9): Result.003 file - promoters60/4771348
aagtcaaag

SEQ ID NO: 140106 - DNA, 7 bp, Unknown
  misc_feature (1)..( 7): Result.003 file - promoters60/4771348
tagaaaa

SEQ ID NO: 140107 - DNA, 7 bp, Unknown
  misc_feature (1)..( 7): Result.003 file - promoters60/4771348
tagcaaa

SEQ ID NO: 140108 - DNA, 7 bp, Unknown
  misc_feature (1)..( 7): Result.003 file - promoters60/4771348
gagagaa

SEQ ID NO: 140109 - DNA, 7 bp, Unknown
  misc_feature (1)..( 7): Result.003 file - promoters60/4771348
gagagaa

SEQ ID NO: 140110 - DNA, 7 bp, Unknown
  misc_feature (1)..( 7): Result.003 file - promoters60/4771348
ttatgtc

SEQ ID NO: 140111 - DNA, 7 bp, Unknown
  misc_feature (1)..( 7): Result.003 file - promoters60/4771348
ttatgtc

SEQ ID NO: 140112 - DNA, 10 bp, Unknown
  misc_feature (1)..( 10): Result.003 file - promoters60/4771348
ttttactaac

SEQ ID NO: 140113 - DNA, 10 bp, Unknown
  misc_feature (1)..( 10): Result.003 file - promoters60/4771348
ttttaataac

SEQ ID NO: 140114 - DNA, 6 bp, Unknown
  misc_feature (1)..( 6): Result.003 file - promoters60/4771348
aaaatc

SEQ ID NO: 140115 - DNA, 6 bp, Unknown
  misc_feature (1)..( 6): Result.003 file - promoters60/4771348
aaaatc

SEQ ID NO: 140116 - DNA, 7 bp, Unknown
  misc_feature (1)..( 7): Result.003 file - promoters60/4771348
gattcag

SEQ ID NO: 140117 - DNA, 7 bp, Unknown
  misc_feature (1)..( 7): Result.003 file - promoters60/4771348
gattcag

SEQ ID NO: 140118 - DNA, 7 bp, Unknown
  misc_feature (1)..( 7): Result.003 file - promoters60/4771348
gatggat

SEQ ID NO: 140119 - DNA, 7 bp, Unknown
  misc_feature (1)..( 7): Result.003 file - promoters60/4771348
gatcgat

SEQ ID NO: 140120 - DNA, 10 bp, Unknown
  misc_feature (1)..( 10): Result.003 file - promoters60/4771360
acaaacaaaa

SEQ ID NO: 140121 - DNA, 10 bp, Unknown
  misc_feature (1)..( 10): Result.003 file - promoters60/4771360
cggaacaaag

SEQ ID NO: 140122 - DNA, 10 bp, Unknown
  misc_feature (1)..( 10): Result.003 file - promoters60/4771360
ttcaacaaac

SEQ ID NO: 140123 - DNA, 10 bp, Unknown
  misc_feature (1)..( 10): Result.003 file - promoters60/4771360
aaaaacaatt

SEQ ID NO: 140124 - DNA, 10 bp, Unknown
  misc_feature (1)..( 10): Result.003 file - promoters60/4771360
ccaaaaaaaa

SEQ ID NO: 140125 - DNA, 10 bp, Unknown
  misc_feature (1)..( 10): Result.003 file - promoters60/4771360
ggaaaaaaca

SEQ ID NO: 140126 - DNA, 7 bp, Unknown
  misc_feature (1)..( 7): Result.003 file - promoters60/4771360
tttgttt

SEQ ID NO: 140127 - DNA, 7 bp, Unknown
  misc_feature (1)..( 7): Result.003 file - promoters60/4771360
tttattt

SEQ ID NO: 140128 - DNA, 7 bp, Unknown
  misc_feature (1)..( 7): Result.003 file - promoters60/4771360
tttattt

SEQ ID NO: 140129 - DNA, 7 bp, Unknown
  misc_feature (1)..( 7): Result.003 file - promoters60/4771360
tttgttc

SEQ ID NO: 140130 - DNA, 7 bp, Unknown
  misc_feature (1)..( 7): Result.003 file - promoters60/4771360
ttaattg

SEQ ID NO: 140131 - DNA, 7 bp, Unknown
  misc_feature (1)..( 7): Result.003 file - promoters60/4771360
cttattt

SEQ ID NO: 140132 - DNA, 13 bp, Unknown
  misc_feature (1)..( 13): Result.003 file - promoters60/4771360
acattattgcgtt

SEQ ID NO: 140133 - DNA, 13 bp, Unknown
  misc_feature (1)..( 13): Result.003 file - promoters60/4771360
acaatataagtta

SEQ ID NO: 140134 - DNA, 13 bp, Unknown
  misc_feature (1)..( 13): Result.003 file - promoters60/4771360
aaaataaaagtta

SEQ ID NO: 140135 - DNA, 13 bp, Unknown
  misc_feature (1)..( 13): Result.003 file - promoters60/4771360
ctaatataaataa

SEQ ID NO: 140136 - DNA, 13 bp, Unknown
  misc_feature (1)..( 13): Result.003 file - promoters60/4771360
ctaaggtaatggg

SEQ ID NO: 140137 - DNA, 13 bp, Unknown
  misc_feature (1)..( 13): Result.003 file - promoters60/4771360
acaaagttgtttt

SEQ ID NO: 140138 - DNA, 13 bp, Unknown
  misc_feature (1)..( 13): Result.003 file - promoters60/4771360
ccaaaaaaaagtc

SEQ ID NO: 140139 - DNA, 12 bp, Unknown
  misc_feature (1)..( 12): Result.003 file - promoters60/4771360
atactgtaattg

SEQ ID NO: 140140 - DNA, 12 bp, Unknown
  misc_feature (1)..( 12): Result.003 file - promoters60/4771360
tcgtgttaattg

SEQ ID NO: 140141 - DNA, 12 bp, Unknown
  misc_feature (1)..( 12): Result.003 file - promoters60/4771360
taaatttatttg

SEQ ID NO: 140142 - DNA, 12 bp, Unknown
  misc_feature (1)..( 12): Result.003 file - promoters60/4771360
tttatttattta

SEQ ID NO: 140143 - DNA, 12 bp, Unknown
  misc_feature (1)..( 12): Result.003 file - promoters60/4771360
acttcttatttt

SEQ ID NO: 140144 - DNA, 12 bp, Unknown
  misc_feature (1)..( 12): Result.003 file - promoters60/4771360
ttcatatctttg

SEQ ID NO: 140145 - DNA, 15 bp, Unknown
  misc_feature (1)..( 15): Result.003 file - promoters60/4771360
tattcaacgttgacg

SEQ ID NO: 140146 - DNA, 15 bp, Unknown
  misc_feature (1)..( 15): Result.003 file - promoters60/4771360
ccaacaaagttgttt

SEQ ID NO: 140147 - DNA, 15 bp, Unknown
  misc_feature (1)..( 15): Result.003 file - promoters60/4771360
caatataagttattt

SEQ ID NO: 140148 - DNA, 15 bp, Unknown
  misc_feature (1)..( 15): Result.003 file - promoters60/4771360
aaataaaagttaata

SEQ ID NO: 140149 - DNA, 15 bp, Unknown
  misc_feature (1)..( 15): Result.003 file - promoters60/4771360
gttcaaacgaaggag

SEQ ID NO: 140150 - DNA, 15 bp, Unknown
  misc_feature (1)..( 15): Result.003 file - promoters60/4771360
aatataaataatcaa

SEQ ID NO: 140151 - DNA, 15 bp, Unknown
  misc_feature (1)..( 15): Result.003 file - promoters60/4771360
aaaaaaaagtcttat

SEQ ID NO: 140152 - DNA, 7 bp, Unknown
  misc_feature (1)..( 7): Result.003 file - promoters60/4771385
tggtaaa

SEQ ID NO: 140153 - DNA, 7 bp, Unknown
  misc_feature (1)..( 7): Result.003 file - promoters60/4771385
tgggaaa

SEQ ID NO: 140154 - DNA, 7 bp, Unknown
  misc_feature (1)..( 7): Result.003 file - promoters60/4771385
ttcattt

SEQ ID NO: 140155 - DNA, 7 bp, Unknown
  misc_feature (1)..( 7): Result.003 file - promoters60/4771385
ttcgttt

SEQ ID NO: 140156 - DNA, 9 bp, Unknown
  misc_feature (1)..( 9): Result.003 file - promoters60/4771385
atgtttctc

SEQ ID NO: 140157 - DNA, 9 bp, Unknown
  misc_feature (1)..( 9): Result.003 file - promoters60/4771385
atgtttaat

SEQ ID NO: 140158 - DNA, 9 bp, Unknown
  misc_feature (1)..( 9): Result.003 file - promoters60/4771385
ctgttcctc

SEQ ID NO: 140159 - DNA, 9 bp, Unknown
  misc_feature (1)..( 9): Result.003 file - promoters60/4771385
tttgtgttt

SEQ ID NO: 140160 - DNA, 9 bp, Unknown
  misc_feature (1)..( 9): Result.003 file - promoters60/4771385
tttctgttt

SEQ ID NO: 140161 - DNA, 7 bp, Unknown
  misc_feature (1)..( 7): Result.003 file - promoters60/4771385
gttcctt

SEQ ID NO: 140162 - DNA, 7 bp, Unknown
  misc_feature (1)..( 7): Result.003 file - promoters60/4771385
gttcctt

SEQ ID NO: 140163 - DNA, 9 bp, Unknown
  misc_feature (1)..( 9): Result.003 file - promoters60/4771385
aactagaaa

SEQ ID NO: 140164 - DNA, 9 bp, Unknown
  misc_feature (1)..( 9): Result.003 file - promoters60/4771385
aacaagaaa

SEQ ID NO: 140165 - DNA, 11 bp, Unknown
  misc_feature (1)..( 11): Result.003 file - promoters60/4771385
tttttaagaac

SEQ ID NO: 140166 - DNA, 11 bp, Unknown
  misc_feature (1)..( 11): Result.003 file - promoters60/4771385
tttttaggaac

SEQ ID NO: 140167 - DNA, 8 bp, Unknown
  misc_feature (1)..( 8): Result.003 file - promoters60/4771385
gtcaccga

SEQ ID NO: 140168 - DNA, 8 bp, Unknown
  misc_feature (1)..( 8): Result.003 file - promoters60/4771385
gtcagcga

SEQ ID NO: 140169 - DNA, 7 bp, Unknown
  misc_feature (1)..( 7): Result.003 file - promoters60/4771385
tcccgtg

SEQ ID NO: 140170 - DNA, 7 bp, Unknown
  misc_feature (1)..( 7): Result.003 file - promoters60/4771385
tccagtg

SEQ ID NO: 140171 - DNA, 7 bp, Unknown
  misc_feature (1)..( 7): Result.003 file - promoters60/4771385
ataccct

SEQ ID NO: 140172 - DNA, 7 bp, Unknown
  misc_feature (1)..( 7): Result.003 file - promoters60/4771385
atatcct

SEQ ID NO: 140173 - DNA, 8 bp, Unknown
  misc_feature (1)..( 8): Result.003 file - promoters60/4771385
cttccaag

SEQ ID NO: 140174 - DNA, 8 bp, Unknown
  misc_feature (1)..( 8): Result.003 file - promoters60/4771385
cttcaaag

SEQ ID NO: 140175 - DNA, 6 bp, Unknown
  misc_feature (1)..( 6): Result.003 file - promoters60/4771385
caccaa

SEQ ID NO: 140176 - DNA, 6 bp, Unknown
  misc_feature (1)..( 6): Result.003 file - promoters60/4771385
caccaa

SEQ ID NO: 140177 - DNA, 12 bp, Unknown
  misc_feature (1)..( 12): Result.003 file - promoters60/4771385
atagagaagcaa

SEQ ID NO: 140178 - DNA, 12 bp, Unknown
  misc_feature (1)..( 12): Result.003 file - promoters60/4771385
atagagaaacaa

SEQ ID NO: 140179 - DNA, 8 bp, Unknown
  misc_feature (1)..( 8): Result.003 file - promoters60/4771385
gattgatg

SEQ ID NO: 140180 - DNA, 8 bp, Unknown
  misc_feature (1)..( 8): Result.003 file - promoters60/4771385
gatcgatg

SEQ ID NO: 140181 - DNA, 7 bp, Unknown
  misc_feature (1)..( 7): Result.003 file - promoters60/4771385
tggtgtt

SEQ ID NO: 140182 - DNA, 7 bp, Unknown
  misc_feature (1)..( 7): Result.003 file - promoters60/4771385
tggagtt

SEQ ID NO: 140183 - DNA, 10 bp, Unknown
  misc_feature (1)..( 10): Result.003 file - promoters60/4771385
atatagtata

SEQ ID NO: 140184 - DNA, 10 bp, Unknown
  misc_feature (1)..( 10): Result.003 file - promoters60/4771385
atatggtata

SEQ ID NO: 140185 - DNA, 7 bp, Unknown
  misc_feature (1)..( 7): Result.003 file - promoters60/4771385
gattaaa

SEQ ID NO: 140186 - DNA, 7 bp, Unknown
  misc_feature (1)..( 7): Result.003 file - promoters60/4771385
gatcaaa

SEQ ID NO: 140187 - DNA, 8 bp, Unknown
  misc_feature (1)..( 8): Result.003 file - promoters60/4771385
agtcagaa

SEQ ID NO: 140188 - DNA, 8 bp, Unknown
  misc_feature (1)..( 8): Result.003 file - promoters60/4771385
agttagaa

SEQ ID NO: 140189 - DNA, 7 bp, Unknown
  misc_feature (1)..( 7): Result.003 file - promoters60/4771385
tttcggt

SEQ ID NO: 140190 - DNA, 7 bp, Unknown
  misc_feature (1)..( 7): Result.003 file - promoters60/4771385
ttttggt

SEQ ID NO: 140191 - DNA, 8 bp, Unknown
  misc_feature (1)..( 8): Result.003 file - promoters60/4771407
tagaatat

SEQ ID NO: 140192 - DNA, 8 bp, Unknown
  misc_feature (1)..( 8): Result.003 file - promoters60/4771407
cagattat

SEQ ID NO: 140193 - DNA, 8 bp, Unknown
  misc_feature (1)..( 8): Result.003 file - promoters60/4771407
cagtttat

SEQ ID NO: 140194 - DNA, 12 bp, Unknown
  misc_feature (1)..( 12): Result.003 file - promoters60/4771407
atcagtcaattt

SEQ ID NO: 140195 - DNA, 12 bp, Unknown
  misc_feature (1)..( 12): Result.003 file - promoters60/4771407
aaatgtcatttt

SEQ ID NO: 140196 - DNA, 12 bp, Unknown
  misc_feature (1)..( 12): Result.003 file - promoters60/4771407
aaatgttatttg

SEQ ID NO: 140197 - DNA, 7 bp, Unknown
  misc_feature (1)..( 7): Result.003 file - promoters60/4771407
attgtgt

SEQ ID NO: 140198 - DNA, 7 bp, Unknown
  misc_feature (1)..( 7): Result.003 file - promoters60/4771407
attttgt

SEQ ID NO: 140199 - DNA, 7 bp, Unknown
  misc_feature (1)..( 7): Result.003 file - promoters60/4771407
attttga

SEQ ID NO: 140200 - DNA, 9 bp, Unknown
  misc_feature (1)..( 9): Result.003 file - promoters60/4771407
aaaggaaga

SEQ ID NO: 140201 - DNA, 9 bp, Unknown
  misc_feature (1)..( 9): Result.003 file - promoters60/4771407
aatggaaga

SEQ ID NO: 140202 - DNA, 9 bp, Unknown
  misc_feature (1)..( 9): Result.003 file - promoters60/4771407
aattgaaga

SEQ ID NO: 140203 - DNA, 11 bp, Unknown
  misc_feature (1)..( 11): Result.003 file - promoters60/4771407
gatttttgtta

SEQ ID NO: 140204 - DNA, 11 bp, Unknown
  misc_feature (1)..( 11): Result.003 file - promoters60/4771407
gatttttgtta

SEQ ID NO: 140205 - DNA, 11 bp, Unknown
  misc_feature (1)..( 11): Result.003 file - promoters60/4771407
gattttgaatt

SEQ ID NO: 140206 - DNA, 11 bp, Unknown
  misc_feature (1)..( 11): Result.003 file - promoters60/4771410
aacctatattt

SEQ ID NO: 140207 - DNA, 11 bp, Unknown
  misc_feature (1)..( 11): Result.003 file - promoters60/4771410
tccctttataa

SEQ ID NO: 140208 - DNA, 11 bp, Unknown
  misc_feature (1)..( 11): Result.003 file - promoters60/4771410
tcactatatat

SEQ ID NO: 140209 - DNA, 11 bp, Unknown
  misc_feature (1)..( 11): Result.003 file - promoters60/4771410
gggttttctaa

SEQ ID NO: 140210 - DNA, 11 bp, Unknown
  misc_feature (1)..( 11): Result.003 file - promoters60/4771410
cttatttatga

SEQ ID NO: 140211 - DNA, 11 bp, Unknown
  misc_feature (1)..( 11): Result.003 file - promoters60/4771410
cttatatataa

SEQ ID NO: 140212 - DNA, 6 bp, Unknown
  misc_feature (1)..( 6): Result.003 file - promoters60/4771426
atattg

SEQ ID NO: 140213 - DNA, 6 bp, Unknown
  misc_feature (1)..( 6): Result.003 file - promoters60/4771426
atattg

SEQ ID NO: 140214 - DNA, 10 bp, Unknown
  misc_feature (1)..( 10): Result.003 file - promoters60/4771426
attacaatat

SEQ ID NO: 140215 - DNA, 10 bp, Unknown
  misc_feature (1)..( 10): Result.003 file - promoters60/4771426
attacaatat

SEQ ID NO: 140216 - DNA, 25 bp, Unknown
  misc_feature (1)..( 25): Result.003 file - promoters60/4771426
aaagttgcttcaaattatagattct

SEQ ID NO: 140217 - DNA, 25 bp, Unknown
  misc_feature (1)..( 25): Result.003 file - promoters60/4771426
aaagttgctacaaattatagattct

SEQ ID NO: 140218 - DNA, 25 bp, Unknown
  misc_feature (1)..( 25): Result.003 file - promoters60/4771426
gagtttgctagcatcaataatcaca

SEQ ID NO: 140219 - DNA, 22 bp, Unknown
  misc_feature (1)..( 22): Result.003 file - promoters60/4771426
tcttttctgattttgtttctca

SEQ ID NO: 140220 - DNA, 22 bp, Unknown
  misc_feature (1)..( 22): Result.003 file - promoters60/4771426
tcttttctgatattgtttctca

SEQ ID NO: 140221 - DNA, 22 bp, Unknown
  misc_feature (1)..( 22): Result.003 file - promoters60/4771426
atgtatcttattttgagaggtc

SEQ ID NO: 140222 - DNA, 7 bp, Unknown
  misc_feature (1)..( 7): Result.003 file - promoters60/4771426
taccaaa

SEQ ID NO: 140223 - DNA, 7 bp, Unknown
  misc_feature (1)..( 7): Result.003 file - promoters60/4771426
taccaaa

SEQ ID NO: 140224 - DNA, 8 bp, Unknown
  misc_feature (1)..( 8): Result.003 file - promoters60/4771426
caatgtga

SEQ ID NO: 140225 - DNA, 8 bp, Unknown
  misc_feature (1)..( 8): Result.003 file - promoters60/4771426
caatatga

SEQ ID NO: 140226 - DNA, 7 bp, Unknown
  misc_feature (1)..( 7): Result.003 file - promoters60/4771426
ctcaaat

SEQ ID NO: 140227 - DNA, 7 bp, Unknown
  misc_feature (1)..( 7): Result.003 file - promoters60/4771426
ctcaaat

SEQ ID NO: 140228 - DNA, 7 bp, Unknown
  misc_feature (1)..( 7): Result.003 file - promoters60/4771426
aaatata

SEQ ID NO: 140229 - DNA, 7 bp, Unknown
  misc_feature (1)..( 7): Result.003 file - promoters60/4771426
aaatata

SEQ ID NO: 140230 - DNA, 7 bp, Unknown
  misc_feature (1)..( 7): Result.003 file - promoters60/4771426
aaatata

SEQ ID NO: 140231 - DNA, 7 bp, Unknown
  misc_feature (1)..( 7): Result.003 file - promoters60/4771426
ttcaatg

SEQ ID NO: 140232 - DNA, 7 bp, Unknown
  misc_feature (1)..( 7): Result.003 file - promoters60/4771426
ttcaatg

SEQ ID NO: 140233 - DNA, 7 bp, Unknown
  misc_feature (1)..( 7): Result.003 file - promoters60/4771426
caattct

SEQ ID NO: 140234 - DNA, 7 bp, Unknown
  misc_feature (1)..( 7): Result.003 file - promoters60/4771426
caaatct

SEQ ID NO: 140235 - DNA, 7 bp, Unknown
  misc_feature (1)..( 7): Result.003 file - promoters60/4771426
aattctt

SEQ ID NO: 140236 - DNA, 7 bp, Unknown
  misc_feature (1)..( 7): Result.003 file - promoters60/4771426
aattctt

SEQ ID NO: 140237 - DNA, 8 bp, Unknown
  misc_feature (1)..( 8): Result.003 file - promoters60/4771426
tcttttct

SEQ ID NO: 140238 - DNA, 8 bp, Unknown
  misc_feature (1)..( 8): Result.003 file - promoters60/4771426
tcttttct

SEQ ID NO: 140239 - DNA, 8 bp, Unknown
  misc_feature (1)..( 8): Result.003 file - promoters60/4771426
aataaaat

SEQ ID NO: 140240 - DNA, 8 bp, Unknown
  misc_feature (1)..( 8): Result.003 file - promoters60/4771426
gataaaat

SEQ ID NO: 140241 - DNA, 8 bp, Unknown
  misc_feature (1)..( 8): Result.003 file - promoters60/4771426
gataaatt

SEQ ID NO: 140242 - DNA, 6 bp, Unknown
  misc_feature (1)..( 6): Result.003 file - promoters60/4771426
atagga

SEQ ID NO: 140243 - DNA, 6 bp, Unknown
  misc_feature (1)..( 6): Result.003 file - promoters60/4771426
atagga

SEQ ID NO: 140244 - DNA, 6 bp, Unknown
  misc_feature (1)..( 6): Result.003 file - promoters60/4771426
atagga

SEQ ID NO: 140245 - DNA, 6 bp, Unknown
  misc_feature (1)..( 6): Result.003 file - promoters60/4771426
atagga

SEQ ID NO: 140246 - DNA, 6 bp, Unknown
  misc_feature (1)..( 6): Result.003 file - promoters60/4771426
atagga

SEQ ID NO: 140247 - DNA, 8 bp, Unknown
  misc_feature (1)..( 8): Result.003 file - promoters60/4771426
ataatatt

SEQ ID NO: 140248 - DNA, 8 bp, Unknown
  misc_feature (1)..( 8): Result.003 file - promoters60/4771426
ataaaatt

SEQ ID NO: 140249 - DNA, 8 bp, Unknown
  misc_feature (1)..( 8): Result.003 file - promoters60/4771426
ataaaata

SEQ ID NO: 140250 - DNA, 6 bp, Unknown
  misc_feature (1)..( 6): Result.003 file - promoters60/4771426
aaaaaa

SEQ ID NO: 140251 - DNA, 6 bp, Unknown
  misc_feature (1)..( 6): Result.003 file - promoters60/4771426
aaaaaa

SEQ ID NO: 140252 - DNA, 12 bp, Unknown
  misc_feature (1)..( 12): Result.003 file - promoters60/4771426
aaaaaataaaaa

SEQ ID NO: 140253 - DNA, 12 bp, Unknown
  misc_feature (1)..( 12): Result.003 file - promoters60/4771426
aaaaattaaaaa

SEQ ID NO: 140254 - DNA, 12 bp, Unknown
  misc_feature (1)..( 12): Result.003 file - promoters60/4771426
ctcaaataaaat

SEQ ID NO: 140255 - DNA, 7 bp, Unknown
  misc_feature (1)..( 7): Result.003 file - promoters60/4771426
gcataaa

SEQ ID NO: 140256 - DNA, 7 bp, Unknown
  misc_feature (1)..( 7): Result.003 file - promoters60/4771426
gcacaaa

SEQ ID NO: 140257 - DNA, 6 bp, Unknown
  misc_feature (1)..( 6): Result.003 file - promoters60/4771426
ttgata

SEQ ID NO: 140258 - DNA, 6 bp, Unknown
  misc_feature (1)..( 6): Result.003 file - promoters60/4771426
ttgata

SEQ ID NO: 140259 - DNA, 7 bp, Unknown
  misc_feature (1)..( 7): Result.003 file - promoters60/4771426
tttccta

SEQ ID NO: 140260 - DNA, 7 bp, Unknown
  misc_feature (1)..( 7): Result.003 file - promoters60/4771426
tttgcta

SEQ ID NO: 140261 - DNA, 9 bp, Unknown
  misc_feature (1)..( 9): Result.003 file - promoters60/4771426
aaaaataaa

SEQ ID NO: 140262 - DNA, 9 bp, Unknown
  misc_feature (1)..( 9): Result.003 file - promoters60/4771426
aaatataaa

SEQ ID NO: 140263 - DNA, 9 bp, Unknown
  misc_feature (1)..( 9): Result.003 file - promoters60/4771426
aaataaaaa

SEQ ID NO: 140264 - DNA, 9 bp, Unknown
  misc_feature (1)..( 9): Result.003 file - promoters60/4771426
aaacaaaaa

SEQ ID NO: 140265 - DNA, 8 bp, Unknown
  misc_feature (1)..( 8): Result.003 file - promoters60/4771426
ctaaatat

SEQ ID NO: 140266 - DNA, 8 bp, Unknown
  misc_feature (1)..( 8): Result.003 file - promoters60/4771426
ctatatat

SEQ ID NO: 140267 - DNA, 6 bp, Unknown
  misc_feature (1)..( 6): Result.003 file - promoters60/4771426
aaatta

SEQ ID NO: 140268 - DNA, 6 bp, Unknown
  misc_feature (1)..( 6): Result.003 file - promoters60/4771426
aaatta

SEQ ID NO: 140269 - DNA, 7 bp, Unknown
  misc_feature (1)..( 7): Result.003 file - promoters60/4771441
atttttt

SEQ ID NO: 140270 - DNA, 7 bp, Unknown
  misc_feature (1)..( 7): Result.003 file - promoters60/4771441
gtttttt

SEQ ID NO: 140271 - DNA, 8 bp, Unknown
  misc_feature (1)..( 8): Result.003 file - promoters60/4771441
gtttgttt

SEQ ID NO: 140272 - DNA, 10 bp, Unknown
  misc_feature (1)..( 10): Result.003 file - promoters60/4771441
gtttctcatt

SEQ ID NO: 140273 - DNA, 10 bp, Unknown
  misc_feature (1)..( 10): Result.003 file - promoters60/4771441
ttttttcatt

SEQ ID NO: 140274 - DNA, 10 bp, Unknown
  misc_feature (1)..( 10): Result.003 file - promoters60/4771441
gtttgtttat

SEQ ID NO: 140275 - DNA, 10 bp, Unknown
  misc_feature (1)..( 10): Result.003 file - promoters60/4771441
tctattcttt

SEQ ID NO: 140276 - DNA, 10 bp, Unknown
  misc_feature (1)..( 10): Result.003 file - promoters60/4771441
cgaatttttt

SEQ ID NO: 140277 - DNA, 10 bp, Unknown
  misc_feature (1)..( 10): Result.003 file - promoters60/4771441
tctaatctca

SEQ ID NO: 140278 - DNA, 7 bp, Unknown
  misc_feature (1)..( 7): Result.003 file - promoters60/4771441
tttaata

SEQ ID NO: 140279 - DNA, 7 bp, Unknown
  misc_feature (1)..( 7): Result.003 file - promoters60/4771441
ttttata

SEQ ID NO: 140280 - DNA, 8 bp, Unknown
  misc_feature (1)..( 8): Result.003 file - promoters60/4771441
catgtact

SEQ ID NO: 140281 - DNA, 8 bp, Unknown
  misc_feature (1)..( 8): Result.003 file - promoters60/4771441
catatact

SEQ ID NO: 140282 - DNA, 15 bp, Unknown
  misc_feature (1)..( 15): Result.003 file - promoters60/4771441
ctatataatagtagc

SEQ ID NO: 140283 - DNA, 15 bp, Unknown
  misc_feature (1)..( 15): Result.003 file - promoters60/4771441
ctatataatggtagc

SEQ ID NO: 140284 - DNA, 6 bp, Unknown
  misc_feature (1)..( 6): Result.003 file - promoters60/4771441
catttt

SEQ ID NO: 140285 - DNA, 6 bp, Unknown
  misc_feature (1)..( 6): Result.003 file - promoters60/4771441
catttt

SEQ ID NO: 140286 - DNA, 7 bp, Unknown
  misc_feature (1)..( 7): Result.003 file - promoters60/4771441
ataccca

SEQ ID NO: 140287 - DNA, 7 bp, Unknown
  misc_feature (1)..( 7): Result.003 file - promoters60/4771441
ataacca

SEQ ID NO: 140288 - DNA, 6 bp, Unknown
  misc_feature (1)..( 6): Result.003 file - promoters60/4771441
ttatat

SEQ ID NO: 140289 - DNA, 6 bp, Unknown
  misc_feature (1)..( 6): Result.003 file - promoters60/4771441
ttatat

SEQ ID NO: 140290 - DNA, 7 bp, Unknown
  misc_feature (1)..( 7): Result.003 file - promoters60/4771441
tcaatat

SEQ ID NO: 140291 - DNA, 7 bp, Unknown
  misc_feature (1)..( 7): Result.003 file - promoters60/4771441
tcaatat

SEQ ID NO: 140292 - DNA, 6 bp, Unknown
  misc_feature (1)..( 6): Result.003 file - promoters60/4771441
ttgctt

SEQ ID NO: 140293 - DNA, 6 bp, Unknown
  misc_feature (1)..( 6): Result.003 file - promoters60/4771441
ttgctt

SEQ ID NO: 140294 - DNA, 8 bp, Unknown
  misc_feature (1)..( 8): Result.003 file - promoters60/4771441
tatcatgt

SEQ ID NO: 140295 - DNA, 8 bp, Unknown
  misc_feature (1)..( 8): Result.003 file - promoters60/4771441
tataatgt

SEQ ID NO: 140296 - DNA, 7 bp, Unknown
  misc_feature (1)..( 7): Result.003 file - promoters60/4771441
ctatttt

SEQ ID NO: 140297 - DNA, 7 bp, Unknown
  misc_feature (1)..( 7): Result.003 file - promoters60/4771441
ctatttt

SEQ ID NO: 140298 - DNA, 6 bp, Unknown
  misc_feature (1)..( 6): Result.003 file - promoters60/4771441
cagaaa

SEQ ID NO: 140299 - DNA, 6 bp, Unknown
  misc_feature (1)..( 6): Result.003 file - promoters60/4771441
cagaaa

SEQ ID NO: 140300 - DNA, 6 bp, Unknown
  misc_feature (1)..( 6): Result.003 file - promoters60/4771441
aaagag

SEQ ID NO: 140301 - DNA, 6 bp, Unknown
  misc_feature (1)..( 6): Result.003 file - promoters60/4771441
aaagag

SEQ ID NO: 140302 - DNA, 6 bp, Unknown
  misc_feature (1)..( 6): Result.003 file - promoters60/4771441
ctgaaa

SEQ ID NO: 140303 - DNA, 6 bp, Unknown
  misc_feature (1)..( 6): Result.003 file - promoters60/4771441
ctgaaa

SEQ ID NO: 140304 - DNA, 12 bp, Unknown
  misc_feature (1)..( 12): Result.003 file - promoters60/4771457
ataaaacctaaa

SEQ ID NO: 140305 - DNA, 12 bp, Unknown
  misc_feature (1)..( 12): Result.003 file - promoters60/4771457
caaaaacctgtg

SEQ ID NO: 140306 - DNA, 12 bp, Unknown
  misc_feature (1)..( 12): Result.003 file - promoters60/4771457
ataagaccgaaa

SEQ ID NO: 140307 - DNA, 7 bp, Unknown
  misc_feature (1)..( 7): Result.003 file - promoters60/4771457
atttctt

SEQ ID NO: 140308 - DNA, 7 bp, Unknown
  misc_feature (1)..( 7): Result.003 file - promoters60/4771457
attcctt

SEQ ID NO: 140309 - DNA, 7 bp, Unknown
  misc_feature (1)..( 7): Result.003 file - promoters60/4771457
cttcctt

SEQ ID NO: 140310 - DNA, 10 bp, Unknown
  misc_feature (1)..( 10): Result.003 file - promoters60/4771457
ggtttatttt

SEQ ID NO: 140311 - DNA, 10 bp, Unknown
  misc_feature (1)..( 10): Result.003 file - promoters60/4771457
ggtttattca

SEQ ID NO: 140312 - DNA, 10 bp, Unknown
  misc_feature (1)..( 10): Result.003 file - promoters60/4771457
attttatttt

SEQ ID NO: 140313 - DNA, 15 bp, Unknown
  misc_feature (1)..( 15): Result.003 file - promoters60/4771464
tctctgttctgaaac

SEQ ID NO: 140314 - DNA, 15 bp, Unknown
  misc_feature (1)..( 15): Result.003 file - promoters60/4771464
atttggttttgaagc

SEQ ID NO: 140315 - DNA, 15 bp, Unknown
  misc_feature (1)..( 15): Result.003 file - promoters60/4771464
tctttgttctttttg

SEQ ID NO: 140316 - DNA, 15 bp, Unknown
  misc_feature (1)..( 15): Result.003 file - promoters60/4771464
atattgttttgaaaa

SEQ ID NO: 140317 - DNA, 15 bp, Unknown
  misc_feature (1)..( 15): Result.003 file - promoters60/4771464
ggcaaatgttgcaaa

SEQ ID NO: 140318 - DNA, 15 bp, Unknown
  misc_feature (1)..( 15): Result.003 file - promoters60/4771464
taaaatgtctatgtg

SEQ ID NO: 140319 - DNA, 8 bp, Unknown
  misc_feature (1)..( 8): Result.003 file - promoters60/4771467
aaatatgt

SEQ ID NO: 140320 - DNA, 8 bp, Unknown
  misc_feature (1)..( 8): Result.003 file - promoters60/4771467
aaaaatgt

SEQ ID NO: 140321 - DNA, 7 bp, Unknown
  misc_feature (1)..( 7): Result.003 file - promoters60/4771467
ttcaatt

SEQ ID NO: 140322 - DNA, 7 bp, Unknown
  misc_feature (1)..( 7): Result.003 file - promoters60/4771467
ttcaatt

SEQ ID NO: 140323 - DNA, 9 bp, Unknown
  misc_feature (1)..( 9): Result.003 file - promoters60/4771467
tataatttg

SEQ ID NO: 140324 - DNA, 9 bp, Unknown
  misc_feature (1)..( 9): Result.003 file - promoters60/4771467
cataatttg

SEQ ID NO: 140325 - DNA, 9 bp, Unknown
  misc_feature (1)..( 9): Result.003 file - promoters60/4771467
tattattac

SEQ ID NO: 140326 - DNA, 7 bp, Unknown
  misc_feature (1)..( 7): Result.003 file - promoters60/4771467
tatgaaa

SEQ ID NO: 140327 - DNA, 7 bp, Unknown
  misc_feature (1)..( 7): Result.003 file - promoters60/4771467
tataaaa

SEQ ID NO: 140328 - DNA, 7 bp, Unknown
  misc_feature (1)..( 7): Result.003 file - promoters60/4771467
tgaatat

SEQ ID NO: 140329 - DNA, 7 bp, Unknown
  misc_feature (1)..( 7): Result.003 file - promoters60/4771467
tgattat

SEQ ID NO: 140330 - DNA, 7 bp, Unknown
  misc_feature (1)..( 7): Result.003 file - promoters60/4771467
aaaacaa

SEQ ID NO: 140331 - DNA, 7 bp, Unknown
  misc_feature (1)..( 7): Result.003 file - promoters60/4771467
aaaccaa

SEQ ID NO: 140332 - DNA, 7 bp, Unknown
  misc_feature (1)..( 7): Result.003 file - promoters60/4771467
atatcaa

SEQ ID NO: 140333 - DNA, 7 bp, Unknown
  misc_feature (1)..( 7): Result.003 file - promoters60/4771467
ataccaa

SEQ ID NO: 140334 - DNA, 6 bp, Unknown
  misc_feature (1)..( 6): Result.003 file - promoters60/4771467
aaaaat

SEQ ID NO: 140335 - DNA, 6 bp, Unknown
  misc_feature (1)..( 6): Result.003 file - promoters60/4771467
aaaaat

SEQ ID NO: 140336 - DNA, 7 bp, Unknown
  misc_feature (1)..( 7): Result.003 file - promoters60/4771467
aagaaag

SEQ ID NO: 140337 - DNA, 7 bp, Unknown
  misc_feature (1)..( 7): Result.003 file - promoters60/4771467
aagaaag

SEQ ID NO: 140338 - DNA, 7 bp, Unknown
  misc_feature (1)..( 7): Result.003 file - promoters60/4771467
tcataat

SEQ ID NO: 140339 - DNA, 7 bp, Unknown
  misc_feature (1)..( 7): Result.003 file - promoters60/4771467
tcataat

SEQ ID NO: 140340 - DNA, 6 bp, Unknown
  misc_feature (1)..( 6): Result.003 file - promoters60/4771467
attgtt

SEQ ID NO: 140341 - DNA, 6 bp, Unknown
  misc_feature (1)..( 6): Result.003 file - promoters60/4771467
attgtt

SEQ ID NO: 140342 - DNA, 8 bp, Unknown
  misc_feature (1)..( 8): Result.003 file - promoters60/4771472
caaatgtg

SEQ ID NO: 140343 - DNA, 8 bp, Unknown
  misc_feature (1)..( 8): Result.003 file - promoters60/4771472
ctaatgtg

SEQ ID NO: 140344 - DNA, 8 bp, Unknown
  misc_feature (1)..( 8): Result.003 file - promoters60/4771472
caaatgtc

SEQ ID NO: 140345 - DNA, 9 bp, Unknown
  misc_feature (1)..( 9): Result.003 file - promoters60/4771472
tcttctttg

SEQ ID NO: 140346 - DNA, 9 bp, Unknown
  misc_feature (1)..( 9): Result.003 file - promoters60/4771472
tcttcttta

SEQ ID NO: 140347 - DNA, 9 bp, Unknown
  misc_feature (1)..( 9): Result.003 file - promoters60/4771472
tcttcctta

SEQ ID NO: 140348 - DNA, 9 bp, Unknown
  misc_feature (1)..( 9): Result.003 file - promoters60/4771472
atacatcta

SEQ ID NO: 140349 - DNA, 9 bp, Unknown
  misc_feature (1)..( 9): Result.003 file - promoters60/4771472
ataaatcta

SEQ ID NO: 140350 - DNA, 9 bp, Unknown
  misc_feature (1)..( 9): Result.003 file - promoters60/4771472
ataaattct

SEQ ID NO: 140351 - DNA, 10 bp, Unknown
  misc_feature (1)..( 10): Result.003 file - promoters60/4771472
tgtatcgtaa

SEQ ID NO: 140352 - DNA, 10 bp, Unknown
  misc_feature (1)..( 10): Result.003 file - promoters60/4771472
tgtttcgctc

SEQ ID NO: 140353 - DNA, 10 bp, Unknown
  misc_feature (1)..( 10): Result.003 file - promoters60/4771472
gatatagtaa

SEQ ID NO: 140354 - DNA, 8 bp, Unknown
  misc_feature (1)..( 8): Result.003 file - promoters60/4771472
aagttttc

SEQ ID NO: 140355 - DNA, 8 bp, Unknown
  misc_feature (1)..( 8): Result.003 file - promoters60/4771472
aaggtttt

SEQ ID NO: 140356 - DNA, 8 bp, Unknown
  misc_feature (1)..( 8): Result.003 file - promoters60/4771472
agggtttt

SEQ ID NO: 140357 - DNA, 21 bp, Unknown
  misc_feature (1)..( 21): Result.003 file - promoters60/4771472
aacggctaatttctccttttt

SEQ ID NO: 140358 - DNA, 21 bp, Unknown
  misc_feature (1)..( 21): Result.003 file - promoters60/4771472
aacggctagtttctcttcttc

SEQ ID NO: 140359 - DNA, 21 bp, Unknown
  misc_feature (1)..( 21): Result.003 file - promoters60/4771472
tagaaactttttctcttcttc

SEQ ID NO: 140360 - DNA, 12 bp, Unknown
  misc_feature (1)..( 12): Result.003 file - promoters60/4771472
aatttctccttt

SEQ ID NO: 140361 - DNA, 12 bp, Unknown
  misc_feature (1)..( 12): Result.003 file - promoters60/4771472
tttctcttcttc

SEQ ID NO: 140362 - DNA, 12 bp, Unknown
  misc_feature (1)..( 12): Result.003 file - promoters60/4771472
tttctcttcttc

SEQ ID NO: 140363 - DNA, 7 bp, Unknown
  misc_feature (1)..( 7): Result.003 file - promoters60/4771472
caattta

SEQ ID NO: 140364 - DNA, 7 bp, Unknown
  misc_feature (1)..( 7): Result.003 file - promoters60/4771472
aaattta

SEQ ID NO: 140365 - DNA, 8 bp, Unknown
  misc_feature (1)..( 8): Result.003 file - promoters60/4771472
aaacttta

SEQ ID NO: 140366 - DNA, 12 bp, Unknown
  misc_feature (1)..( 12): Result.003 file - promoters60/4771472
ttttttttttgt

SEQ ID NO: 140367 - DNA, 12 bp, Unknown
  misc_feature (1)..( 12): Result.003 file - promoters60/4771472
tttattttctgt

SEQ ID NO: 140368 - DNA, 12 bp, Unknown
  misc_feature (1)..( 12): Result.003 file - promoters60/4771472
agtgtattctgt

SEQ ID NO: 140369 - DNA, 13 bp, Unknown
  misc_feature (1)..( 13): Result.003 file - promoters60/4771478
tatttagttaaaa

SEQ ID NO: 140370 - DNA, 13 bp, Unknown
  misc_feature (1)..( 13): Result.003 file - promoters60/4771478
aattttgtttttg

SEQ ID NO: 140371 - DNA, 14 bp, Unknown
  misc_feature (1)..( 14): Result.003 file - promoters60/4771478
tttgttagttcaaa

SEQ ID NO: 140372 - DNA, 14 bp, Unknown
  misc_feature (1)..( 14): Result.003 file - promoters60/4771478
ggggtttgttgttg

SEQ ID NO: 140373 - DNA, 13 bp, Unknown
  misc_feature (1)..( 13): Result.003 file - promoters60/4771478
aatttttctgttc

SEQ ID NO: 140374 - DNA, 14 bp, Unknown
  misc_feature (1)..( 14): Result.003 file - promoters60/4771478
tattattctctgca

SEQ ID NO: 140375 - DNA, 14 bp, Unknown
  misc_feature (1)..( 14): Result.003 file - promoters60/4771478
catttttctgatga

SEQ ID NO: 140376 - DNA, 14 bp, Unknown
  misc_feature (1)..( 14): Result.003 file - promoters60/4771478
ctaagaaaccctag

SEQ ID NO: 140377 - DNA, 14 bp, Unknown
  misc_feature (1)..( 14): Result.003 file - promoters60/4771478
tatataaatccttc

SEQ ID NO: 140378 - DNA, 14 bp, Unknown
  misc_feature (1)..( 14): Result.003 file - promoters60/4771478
actataaattcttc

SEQ ID NO: 140379 - DNA, 14 bp, Unknown
  misc_feature (1)..( 14): Result.003 file - promoters60/4771478
tttatgaatccata

SEQ ID NO: 140380 - DNA, 14 bp, Unknown
  misc_feature (1)..( 14): Result.003 file - promoters60/4771478
catataaatgaggg

SEQ ID NO: 140381 - DNA, 14 bp, Unknown
  misc_feature (1)..( 14): Result.003 file - promoters60/4771478
actataaattcaat

SEQ ID NO: 140382 - DNA, 9 bp, Unknown
  misc_feature (1)..( 9): Result.003 file - promoters60/4771478
ggtttttat

SEQ ID NO: 140383 - DNA, 9 bp, Unknown
  misc_feature (1)..( 9): Result.003 file - promoters60/4771478
tctttttac

SEQ ID NO: 140384 - DNA, 9 bp, Unknown
  misc_feature (1)..( 9): Result.003 file - promoters60/4771478
tgttgttac

SEQ ID NO: 140385 - DNA, 9 bp, Unknown
  misc_feature (1)..( 9): Result.003 file - promoters60/4771478
aatttttat

SEQ ID NO: 140386 - DNA, 9 bp, Unknown
  misc_feature (1)..( 9): Result.003 file - promoters60/4771478
tcttgttaa

SEQ ID NO: 140387 - DNA, 9 bp, Unknown
  misc_feature (1)..( 9): Result.003 file - promoters60/4771478
gcttattaa

SEQ ID NO: 140388 - DNA, 9 bp, Unknown
  misc_feature (1)..( 9): Result.003 file - promoters60/4771478
cattttttt

SEQ ID NO: 140389 - DNA, 9 bp, Unknown
  misc_feature (1)..( 9): Result.003 file - promoters60/4771478
aatttttct

SEQ ID NO: 140390 - DNA, 10 bp, Unknown
  misc_feature (1)..( 10): Result.003 file - promoters60/4771478
tttttgtttc

SEQ ID NO: 140391 - DNA, 10 bp, Unknown
  misc_feature (1)..( 10): Result.003 file - promoters60/4771478
catttttctg

SEQ ID NO: 140392 - DNA, 10 bp, Unknown
  misc_feature (1)..( 10): Result.003 file - promoters60/4771478
cgtttttttt

SEQ ID NO: 140393 - DNA, 10 bp, Unknown
  misc_feature (1)..( 10): Result.003 file - promoters60/4771478
aattttatat

SEQ ID NO: 140394 - DNA, 9 bp, Unknown
  misc_feature (1)..( 9): Result.003 file - promoters60/4771495
ttcttagta

SEQ ID NO: 140395 - DNA, 9 bp, Unknown
  misc_feature (1)..( 9): Result.003 file - promoters60/4771495
ttcttaagg

SEQ ID NO: 140396 - DNA, 9 bp, Unknown
  misc_feature (1)..( 9): Result.003 file - promoters60/4771495
ttcataaat

SEQ ID NO: 140397 - DNA, 9 bp, Unknown
  misc_feature (1)..( 9): Result.003 file - promoters60/4771495
cacataaac

SEQ ID NO: 140398 - DNA, 9 bp, Unknown
  misc_feature (1)..( 9): Result.003 file - promoters60/4771495
tacataaaa

SEQ ID NO: 140399 - DNA, 9 bp, Unknown
  misc_feature (1)..( 9): Result.003 file - promoters60/4771495
gccattaat

SEQ ID NO: 140400 - DNA, 9 bp, Unknown
  misc_feature (1)..( 9): Result.003 file - promoters60/4771495
atcattaat

SEQ ID NO: 140401 - DNA, 13 bp, Unknown
  misc_feature (1)..( 13): Result.003 file - promoters60/4771495
ttgttaggataga

SEQ ID NO: 140402 - DNA, 13 bp, Unknown
  misc_feature (1)..( 13): Result.003 file - promoters60/4771495
tcttaaggatatc

SEQ ID NO: 140403 - DNA, 13 bp, Unknown
  misc_feature (1)..( 13): Result.003 file - promoters60/4771495
ttttaaagatttt

SEQ ID NO: 140404 - DNA, 13 bp, Unknown
  misc_feature (1)..( 13): Result.003 file - promoters60/4771495
aaacaaaaattat

SEQ ID NO: 140405 - DNA, 13 bp, Unknown
  misc_feature (1)..( 13): Result.003 file - promoters60/4771495
ctaaaaaaatcct

SEQ ID NO: 140406 - DNA, 13 bp, Unknown
  misc_feature (1)..( 13): Result.003 file - promoters60/4771495
aactacaaatatc

SEQ ID NO: 140407 - DNA, 15 bp, Unknown
  misc_feature (1)..( 15): Result.003 file - promoters60/4771495
tttattgttacaaat

SEQ ID NO: 140408 - DNA, 15 bp, Unknown
  misc_feature (1)..( 15): Result.003 file - promoters60/4771495
tttaatgttactaat

SEQ ID NO: 140409 - DNA, 16 bp, Unknown
  misc_feature (1)..( 16): Result.003 file - promoters60/4771495
ggagctatcaacaaat

SEQ ID NO: 140410 - DNA, 15 bp, Unknown
  misc_feature (1)..( 15): Result.003 file - promoters60/4771495
aatattgttttatga

SEQ ID NO: 140411 - DNA, 16 bp, Unknown
  misc_feature (1)..( 16): Result.003 file - promoters60/4771495
cttctctcttaaaaaa

SEQ ID NO: 140412 - DNA, 16 bp, Unknown
  misc_feature (1)..( 16): Result.003 file - promoters60/4771495
gattttgattttctca

SEQ ID NO: 140413 - DNA, 7 bp, Unknown
  misc_feature (1)..( 7): Result.003 file - promoters60/4771502
attattt

SEQ ID NO: 140414 - DNA, 7 bp, Unknown
  misc_feature (1)..( 7): Result.003 file - promoters60/4771502
attattt

SEQ ID NO: 140415 - DNA, 7 bp, Unknown
  misc_feature (1)..( 7): Result.003 file - promoters60/4771502
caatttt

SEQ ID NO: 140416 - DNA, 7 bp, Unknown
  misc_feature (1)..( 7): Result.003 file - promoters60/4771502
taatttt

SEQ ID NO: 140417 - DNA, 7 bp, Unknown
  misc_feature (1)..( 7): Result.003 file - promoters60/4771502
caatttg

SEQ ID NO: 140418 - DNA, 13 bp, Unknown
  misc_feature (1)..( 13): Result.003 file - promoters60/4771502
ataaattacattt

SEQ ID NO: 140419 - DNA, 13 bp, Unknown
  misc_feature (1)..( 13): Result.003 file - promoters60/4771502
atatatttcattt

SEQ ID NO: 140420 - DNA, 13 bp, Unknown
  misc_feature (1)..( 13): Result.003 file - promoters60/4771502
aggtctttccttt

SEQ ID NO: 140421 - DNA, 8 bp, Unknown
  misc_feature (1)..( 8): Result.003 file - promoters60/4771502
taatcgat

SEQ ID NO: 140422 - DNA, 8 bp, Unknown
  misc_feature (1)..( 8): Result.003 file - promoters60/4771502
taatggat

SEQ ID NO: 140423 - DNA, 6 bp, Unknown
  misc_feature (1)..( 6): Result.003 file - promoters60/4771502
gtaatt

SEQ ID NO: 140424 - DNA, 6 bp, Unknown
  misc_feature (1)..( 6): Result.003 file - promoters60/4771502
gtaatt

SEQ ID NO: 140425 - DNA, 7 bp, Unknown
  misc_feature (1)..( 7): Result.003 file - promoters60/4771502
tttgata

SEQ ID NO: 140426 - DNA, 7 bp, Unknown
  misc_feature (1)..( 7): Result.003 file - promoters60/4771502
tttaata

SEQ ID NO: 140427 - DNA, 8 bp, Unknown
  misc_feature (1)..( 8): Result.003 file - promoters60/4771502
tttggttt

SEQ ID NO: 140428 - DNA, 8 bp, Unknown
  misc_feature (1)..( 8): Result.003 file - promoters60/4771502
ttttgttt

SEQ ID NO: 140429 - DNA, 6 bp, Unknown
  misc_feature (1)..( 6): Result.003 file - promoters60/4771502
attgga

SEQ ID NO: 140430 - DNA, 6 bp, Unknown
  misc_feature (1)..( 6): Result.003 file - promoters60/4771502
attgga

SEQ ID NO: 140431 - DNA, 7 bp, Unknown
  misc_feature (1)..( 7): Result.003 file - promoters60/4771502
aggccca

SEQ ID NO: 140432 - DNA, 7 bp, Unknown
  misc_feature (1)..( 7): Result.003 file - promoters60/4771502
aggccca

SEQ ID NO: 140433 - DNA, 6 bp, Unknown
  misc_feature (1)..( 6): Result.003 file - promoters60/4771502
cccaat

SEQ ID NO: 140434 - DNA, 6 bp, Unknown
  misc_feature (1)..( 6): Result.003 file - promoters60/4771502
cccaat

SEQ ID NO: 140435 - DNA, 6 bp, Unknown
  misc_feature (1)..( 6): Result.003 file - promoters60/4771502
caatta

SEQ ID NO: 140436 - DNA, 6 bp, Unknown
  misc_feature (1)..( 6): Result.003 file - promoters60/4771502
caatta

SEQ ID NO: 140437 - DNA, 7 bp, Unknown
  misc_feature (1)..( 7): Result.003 file - promoters60/4771502
tttcact

SEQ ID NO: 140438 - DNA, 7 bp, Unknown
  misc_feature (1)..( 7): Result.003 file - promoters60/4771502
tttcact

SEQ ID NO: 140439 - DNA, 13 bp, Unknown
  misc_feature (1)..( 13): Result.003 file - promoters60/4771502
caacactatactg

SEQ ID NO: 140440 - DNA, 13 bp, Unknown
  misc_feature (1)..( 13): Result.003 file - promoters60/4771502
caactctattctg

SEQ ID NO: 140441 - DNA, 6 bp, Unknown
  misc_feature (1)..( 6): Result.003 file - promoters60/4771502
tctaaa

SEQ ID NO: 140442 - DNA, 6 bp, Unknown
  misc_feature (1)..( 6): Result.003 file - promoters60/4771502
tctaaa

SEQ ID NO: 140443 - DNA, 8 bp, Unknown
  misc_feature (1)..( 8): Result.003 file - promoters60/4771502
attttcta

SEQ ID NO: 140444 - DNA, 8 bp, Unknown
  misc_feature (1)..( 8): Result.003 file - promoters60/4771502
attttcta

SEQ ID NO: 140445 - DNA, 9 bp, Unknown
  misc_feature (1)..( 9): Result.003 file - promoters60/4771502
taaaatccg

SEQ ID NO: 140446 - DNA, 9 bp, Unknown
  misc_feature (1)..( 9): Result.003 file - promoters60/4771502
taaaagccg

SEQ ID NO: 140447 - DNA, 6 bp, Unknown
  misc_feature (1)..( 6): Result.003 file - promoters60/4771502
gataaa

SEQ ID NO: 140448 - DNA, 6 bp, Unknown
  misc_feature (1)..( 6): Result.003 file - promoters60/4771502
gataaa

SEQ ID NO: 140449 - DNA, 6 bp, Unknown
  misc_feature (1)..( 6): Result.003 file - promoters60/4771502
tcacag

SEQ ID NO: 140450 - DNA, 6 bp, Unknown
  misc_feature (1)..( 6): Result.003 file - promoters60/4771502
tcacag

SEQ ID NO: 140451 - DNA, 7 bp, Unknown
  misc_feature (1)..( 7): Result.003 file - promoters60/4771502
tcagagg

SEQ ID NO: 140452 - DNA, 7 bp, Unknown
  misc_feature (1)..( 7): Result.003 file - promoters60/4771502
tcaaagg

SEQ ID NO: 140453 - DNA, 6 bp, Unknown
  misc_feature (1)..( 6): Result.003 file - promoters60/4771502
ccactt

SEQ ID NO: 140454 - DNA, 6 bp, Unknown
  misc_feature (1)..( 6): Result.003 file - promoters60/4771502
ccactt

SEQ ID NO: 140455 - DNA, 13 bp, Unknown
  misc_feature (1)..( 13): Result.003 file - promoters60/4771519
aaacctccgccga

SEQ ID NO: 140456 - DNA, 13 bp, Unknown
  misc_feature (1)..( 13): Result.003 file - promoters60/4771519
aaatctccctcta

SEQ ID NO: 140457 - DNA, 13 bp, Unknown
  misc_feature (1)..( 13): Result.003 file - promoters60/4771519
ttttctcgctcgg

SEQ ID NO: 140458 - DNA, 13 bp, Unknown
  misc_feature (1)..( 13): Result.003 file - promoters60/4771519
aaatctgtgatat

SEQ ID NO: 140459 - DNA, 13 bp, Unknown
  misc_feature (1)..( 13): Result.003 file - promoters60/4771519
taatttgttataa

SEQ ID NO: 140460 - DNA, 13 bp, Unknown
  misc_feature (1)..( 13): Result.003 file - promoters60/4771519
gaatgtgtaatat

SEQ ID NO: 140461 - DNA, 9 bp, Unknown
  misc_feature (1)..( 9): Result.003 file - promoters60/4771523
tagaaagag

SEQ ID NO: 140462 - DNA, 9 bp, Unknown
  misc_feature (1)..( 9): Result.003 file - promoters60/4771523
aagaaagta

SEQ ID NO: 140463 - DNA, 9 bp, Unknown
  misc_feature (1)..( 9): Result.003 file - promoters60/4771523
aagaaaatc

SEQ ID NO: 140464 - DNA, 9 bp, Unknown
  misc_feature (1)..( 9): Result.003 file - promoters60/4771523
tagaggaag

SEQ ID NO: 140465 - DNA, 9 bp, Unknown
  misc_feature (1)..( 9): Result.003 file - promoters60/4771523
cagatgaat

SEQ ID NO: 140466 - DNA, 9 bp, Unknown
  misc_feature (1)..( 9): Result.003 file - promoters60/4771523
gtcatgaat

SEQ ID NO: 140467 - DNA, 10 bp, Unknown
  misc_feature (1)..( 10): Result.003 file - promoters60/4771586
actatttaaa

SEQ ID NO: 140468 - DNA, 10 bp, Unknown
  misc_feature (1)..( 10): Result.003 file - promoters60/4771586
actttttttt

SEQ ID NO: 140469 - DNA, 10 bp, Unknown
  misc_feature (1)..( 10): Result.003 file - promoters60/4771586
catatataaa

SEQ ID NO: 140470 - DNA, 10 bp, Unknown
  misc_feature (1)..( 10): Result.003 file - promoters60/4771586
tctttttgtt

SEQ ID NO: 140471 - DNA, 8 bp, Unknown
  misc_feature (1)..( 8): Result.003 file - promoters60/4771638
aaaaaaaa

SEQ ID NO: 140472 - DNA, 8 bp, Unknown
  misc_feature (1)..( 8): Result.003 file - promoters60/4771638
aaaacaaa

SEQ ID NO: 140473 - DNA, 7 bp, Unknown
  misc_feature (1)..( 7): Result.003 file - promoters60/4771638
tattaaa

SEQ ID NO: 140474 - DNA, 7 bp, Unknown
  misc_feature (1)..( 7): Result.003 file - promoters60/4771638
tatcaaa

SEQ ID NO: 140475 - DNA, 6 bp, Unknown
  misc_feature (1)..( 6): Result.003 file - promoters60/4771638
tataat

SEQ ID NO: 140476 - DNA, 6 bp, Unknown
  misc_feature (1)..( 6): Result.003 file - promoters60/4771638
tataat

SEQ ID NO: 140477 - DNA, 6 bp, Unknown
  misc_feature (1)..( 6): Result.003 file - promoters60/4771638
ttttgt

SEQ ID NO: 140478 - DNA, 6 bp, Unknown
  misc_feature (1)..( 6): Result.003 file - promoters60/4771638
ttttgt

SEQ ID NO: 140479 - DNA, 11 bp, Unknown
  misc_feature (1)..( 11): Result.003 file - promoters60/4771638
atagattaatg

SEQ ID NO: 140480 - DNA, 11 bp, Unknown
  misc_feature (1)..( 11): Result.003 file - promoters60/4771638
agttattaatc

SEQ ID NO: 140481 - DNA, 11 bp, Unknown
  misc_feature (1)..( 11): Result.003 file - promoters60/4771638
agtgattcatc

SEQ ID NO: 140482 - DNA, 10 bp, Unknown
  misc_feature (1)..( 10): Result.003 file - promoters60/4771638
gcgattaaag

SEQ ID NO: 140483 - DNA, 10 bp, Unknown
  misc_feature (1)..( 10): Result.003 file - promoters60/4771638
tttattaaag

SEQ ID NO: 140484 - DNA, 10 bp, Unknown
  misc_feature (1)..( 10): Result.003 file - promoters60/4771638
ttttttaaac

SEQ ID NO: 140485 - DNA, 6 bp, Unknown
  misc_feature (1)..( 6): Result.003 file - promoters60/4771638
agctct

SEQ ID NO: 140486 - DNA, 6 bp, Unknown
  misc_feature (1)..( 6): Result.003 file - promoters60/4771638
agctct

SEQ ID NO: 140487 - DNA, 9 bp, Unknown
  misc_feature (1)..( 9): Result.003 file - promoters60/4771638
aacaatttt

SEQ ID NO: 140488 - DNA, 9 bp, Unknown
  misc_feature (1)..( 9): Result.003 file - promoters60/4771638
aacaacttt

SEQ ID NO: 140489 - DNA, 8 bp, Unknown
  misc_feature (1)..( 8): Result.003 file - promoters60/4771638
tttataca

SEQ ID NO: 140490 - DNA, 8 bp, Unknown
  misc_feature (1)..( 8): Result.003 file - promoters60/4771638
cttataca

SEQ ID NO: 140491 - DNA, 9 bp, Unknown
  misc_feature (1)..( 9): Result.003 file - promoters60/4771638
tttaataag

SEQ ID NO: 140492 - DNA, 6 bp, Unknown
  misc_feature (1)..( 6): Result.003 file - promoters60/4771638
cactat

SEQ ID NO: 140493 - DNA, 6 bp, Unknown
  misc_feature (1)..( 6): Result.003 file - promoters60/4771638
cactat

SEQ ID NO: 140494 - DNA, 8 bp, Unknown
  misc_feature (1)..( 8): Result.003 file - promoters60/4771638
acagctaa

SEQ ID NO: 140495 - DNA, 8 bp, Unknown
  misc_feature (1)..( 8): Result.003 file - promoters60/4771638
acagctaa

SEQ ID NO: 140496 - DNA, 9 bp, Unknown
  misc_feature (1)..( 9): Result.003 file - promoters60/4771638
acattaaaa

SEQ ID NO: 140497 - DNA, 9 bp, Unknown
  misc_feature (1)..( 9): Result.003 file - promoters60/4771638
acataaaaa

SEQ ID NO: 140498 - DNA, 7 bp, Unknown
  misc_feature (1)..( 7): Result.003 file - promoters60/4771638
ttgtaac

SEQ ID NO: 140499 - DNA, 7 bp, Unknown
  misc_feature (1)..( 7): Result.003 file - promoters60/4771638
ttgaaac

SEQ ID NO: 140500 - DNA, 7 bp, Unknown
  misc_feature (1)..( 7): Result.003 file - promoters60/4771638
atgtttt

SEQ ID NO: 140501 - DNA, 7 bp, Unknown
  misc_feature (1)..( 7): Result.003 file - promoters60/4771638
atgtttt

SEQ ID NO: 140502 - DNA, 7 bp, Unknown
  misc_feature (1)..( 7): Result.003 file - promoters60/4771638
ctatctc

SEQ ID NO: 140503 - DNA, 7 bp, Unknown
  misc_feature (1)..( 7): Result.003 file - promoters60/4771638
ctacctc

SEQ ID NO: 140504 - DNA, 7 bp, Unknown
  misc_feature (1)..( 7): Result.003 file - promoters60/4771638
ctctgga

SEQ ID NO: 140505 - DNA, 7 bp, Unknown
  misc_feature (1)..( 7): Result.003 file - promoters60/4771638
ctctgga

SEQ ID NO: 140506 - DNA, 7 bp, Unknown
  misc_feature (1)..( 7): Result.003 file - promoters60/4771638
agacaaa

SEQ ID NO: 140507 - DNA, 7 bp, Unknown
  misc_feature (1)..( 7): Result.003 file - promoters60/4771638
agagaaa

SEQ ID NO: 140508 - DNA, 6 bp, Unknown
  misc_feature (1)..( 6): Result.003 file - promoters60/4771638
taactc

SEQ ID NO: 140509 - DNA, 6 bp, Unknown
  misc_feature (1)..( 6): Result.003 file - promoters60/4771638
taactc

SEQ ID NO: 140510 - DNA, 6 bp, Unknown
  misc_feature (1)..( 6): Result.003 file - promoters60/4771638
acaaaa

SEQ ID NO: 140511 - DNA, 6 bp, Unknown
  misc_feature (1)..( 6): Result.003 file - promoters60/4771638
acaaaa

SEQ ID NO: 140512 - DNA, 7 bp, Unknown
  misc_feature (1)..( 7): Result.003 file - promoters60/4771638
aaaagtt

SEQ ID NO: 140513 - DNA, 7 bp, Unknown
  misc_feature (1)..( 7): Result.003 file - promoters60/4771638
aaaagtt

SEQ ID NO: 140514 - DNA, 7 bp, Unknown
  misc_feature (1)..( 7): Result.003 file - promoters60/4771638
tttctta

SEQ ID NO: 140515 - DNA, 7 bp, Unknown
  misc_feature (1)..( 7): Result.003 file - promoters60/4771638
tttttta

SEQ ID NO: 140516 - DNA, 11 bp, Unknown
  misc_feature (1)..( 11): Result.003 file - promoters60/4771646
cttttctctat

SEQ ID NO: 140517 - DNA, 11 bp, Unknown
  misc_feature (1)..( 11): Result.003 file - promoters60/4771646
tttttatctgt

SEQ ID NO: 140518 - DNA, 11 bp, Unknown
  misc_feature (1)..( 11): Result.003 file - promoters60/4771646
tttttctttgc

SEQ ID NO: 140519 - DNA, 11 bp, Unknown
  misc_feature (1)..( 11): Result.003 file - promoters60/4771646
tatttctgtgc

SEQ ID NO: 140520 - DNA, 14 bp, Unknown
  misc_feature (1)..( 14): Result.003 file - promoters60/4771677
atattattagtagg

SEQ ID NO: 140521 - DNA, 14 bp, Unknown
  misc_feature (1)..( 14): Result.003 file - promoters60/4771677
ttattatattgaga

SEQ ID NO: 140522 - DNA, 14 bp, Unknown
  misc_feature (1)..( 14): Result.003 file - promoters60/4771677
atataattattttg

SEQ ID NO: 140523 - DNA, 14 bp, Unknown
  misc_feature (1)..( 14): Result.003 file - promoters60/4771677
gattaattcttttc

SEQ ID NO: 140524 - DNA, 14 bp, Unknown
  misc_feature (1)..( 14): Result.003 file - promoters60/4771677
ttttaatgattttg

SEQ ID NO: 140525 - DNA, 15 bp, Unknown
  misc_feature (1)..( 15): Result.003 file - promoters60/4771677
cgtttacttcaaaat

SEQ ID NO: 140526 - DNA, 12 bp, Unknown
  misc_feature (1)..( 12): Result.003 file - promoters60/4771677
caaaatgaaaaa

SEQ ID NO: 140527 - DNA, 12 bp, Unknown
  misc_feature (1)..( 12): Result.003 file - promoters60/4771677
tttaatgaaatt

SEQ ID NO: 140528 - DNA, 13 bp, Unknown
  misc_feature (1)..( 13): Result.003 file - promoters60/4771677
cactatgagaaat

SEQ ID NO: 140529 - DNA, 13 bp, Unknown
  misc_feature (1)..( 13): Result.003 file - promoters60/4771677
accaatgatattc

SEQ ID NO: 140530 - DNA, 13 bp, Unknown
  misc_feature (1)..( 13): Result.003 file - promoters60/4771677
aaaaatgttattt

SEQ ID NO: 140531 - DNA, 13 bp, Unknown
  misc_feature (1)..( 13): Result.003 file - promoters60/4771677
atgctatttattt

SEQ ID NO: 140532 - DNA, 13 bp, Unknown
  misc_feature (1)..( 13): Result.003 file - promoters60/4771677
aaagattttattt

SEQ ID NO: 140533 - DNA, 13 bp, Unknown
  misc_feature (1)..( 13): Result.003 file - promoters60/4771677
aaatatgttaaca

SEQ ID NO: 140534 - DNA, 11 bp, Unknown
  misc_feature (1)..( 11): Result.003 file - promoters60/4771677
ccttgagttta

SEQ ID NO: 140535 - DNA, 11 bp, Unknown
  misc_feature (1)..( 11): Result.003 file - promoters60/4771677
tgttgagtttc

SEQ ID NO: 140536 - DNA, 11 bp, Unknown
  misc_feature (1)..( 11): Result.003 file - promoters60/4771677
tgttgaatttt

SEQ ID NO: 140537 - DNA, 11 bp, Unknown
  misc_feature (1)..( 11): Result.003 file - promoters60/4771677
attctaatttt

SEQ ID NO: 140538 - DNA, 11 bp, Unknown
  misc_feature (1)..( 11): Result.003 file - promoters60/4771677
agttaactttg

SEQ ID NO: 140539 - DNA, 11 bp, Unknown
  misc_feature (1)..( 11): Result.003 file - promoters60/4771677
agtcaacttgt

SEQ ID NO: 140540 - DNA, 11 bp, Unknown
  misc_feature (1)..( 11): Result.003 file - promoters60/4771677
tgttgactggt

SEQ ID NO: 140541 - DNA, 11 bp, Unknown
  misc_feature (1)..( 11): Result.003 file - promoters60/4771677
gaaatgtcaac

SEQ ID NO: 140542 - DNA, 11 bp, Unknown
  misc_feature (1)..( 11): Result.003 file - promoters60/4771677
aaaatgttatt

SEQ ID NO: 140543 - DNA, 11 bp, Unknown
  misc_feature (1)..( 11): Result.003 file - promoters60/4771677
ccaatgatatt

SEQ ID NO: 140544 - DNA, 12 bp, Unknown
  misc_feature (1)..( 12): Result.003 file - promoters60/4771677
caaattgtttaa

SEQ ID NO: 140545 - DNA, 12 bp, Unknown
  misc_feature (1)..( 12): Result.003 file - promoters60/4771677
aaatatgttaac

SEQ ID NO: 140546 - DNA, 12 bp, Unknown
  misc_feature (1)..( 12): Result.003 file - promoters60/4771677
ttttattttaat

SEQ ID NO: 140547 - DNA, 11 bp, Unknown
  misc_feature (1)..( 11): Result.003 file - promoters60/4771677
ataatatttca

SEQ ID NO: 140548 - DNA, 11 bp, Unknown
  misc_feature (1)..( 11): Result.003 file - promoters60/4771677
gtagtatatca

SEQ ID NO: 140549 - DNA, 11 bp, Unknown
  misc_feature (1)..( 11): Result.003 file - promoters60/4771677
tatttatttcc

SEQ ID NO: 140550 - DNA, 11 bp, Unknown
  misc_feature (1)..( 11): Result.003 file - promoters60/4771677
aaagaattttt

SEQ ID NO: 140551 - DNA, 11 bp, Unknown
  misc_feature (1)..( 11): Result.003 file - promoters60/4771677
attttatttta

SEQ ID NO: 140552 - DNA, 11 bp, Unknown
  misc_feature (1)..( 11): Result.003 file - promoters60/4771677
atgttattttt

SEQ ID NO: 140553 - DNA, 11 bp, Unknown
  misc_feature (1)..( 11): Result.003 file - promoters60/4771677
aaactttttac

SEQ ID NO: 140554 - DNA, 10 bp, Unknown
  misc_feature (1)..( 10): Result.003 file - promoters60/4771677
gtaaaatttc

SEQ ID NO: 140555 - DNA, 10 bp, Unknown
  misc_feature (1)..( 10): Result.003 file - promoters60/4771677
ccaaaattga

SEQ ID NO: 140556 - DNA, 10 bp, Unknown
  misc_feature (1)..( 10): Result.003 file - promoters60/4771677
gtaaaatttt

SEQ ID NO: 140557 - DNA, 10 bp, Unknown
  misc_feature (1)..( 10): Result.003 file - promoters60/4771677
ttctaatttt

SEQ ID NO: 140558 - DNA, 10 bp, Unknown
  misc_feature (1)..( 10): Result.003 file - promoters60/4771677
gttgaatttt

SEQ ID NO: 140559 - DNA, 10 bp, Unknown
  misc_feature (1)..( 10): Result.003 file - promoters60/4771677
gttaactttg

SEQ ID NO: 140560 - DNA, 10 bp, Unknown
  misc_feature (1)..( 10): Result.003 file - promoters60/4771677
gttgactggt

SEQ ID NO: 140561 - DNA, 11 bp, Unknown
  misc_feature (1)..( 11): Result.003 file - promoters60/4771713
gcacaataatt

SEQ ID NO: 140562 - DNA, 11 bp, Unknown
  misc_feature (1)..( 11): Result.003 file - promoters60/4771713
aaacaattatt

SEQ ID NO: 140563 - DNA, 11 bp, Unknown
  misc_feature (1)..( 11): Result.003 file - promoters60/4771713
aaacgattcca

SEQ ID NO: 140564 - DNA, 7 bp, Unknown
  misc_feature (1)..( 7): Result.003 file - promoters60/4771713
atttatt

SEQ ID NO: 140565 - DNA, 7 bp, Unknown
  misc_feature (1)..( 7): Result.003 file - promoters60/4771713
attaatt

SEQ ID NO: 140566 - DNA, 6 bp, Unknown
  misc_feature (1)..( 6): Result.003 file - promoters60/4771713
ttattt

SEQ ID NO: 140567 - DNA, 6 bp, Unknown
  misc_feature (1)..( 6): Result.003 file - promoters60/4771713
ttattt

SEQ ID NO: 140568 - DNA, 7 bp, Unknown
  misc_feature (1)..( 7): Result.003 file - promoters60/4771713
aaaattg

SEQ ID NO: 140569 - DNA, 7 bp, Unknown
  misc_feature (1)..( 7): Result.003 file - promoters60/4771713
aaatttg

SEQ ID NO: 140570 - DNA, 7 bp, Unknown
  misc_feature (1)..( 7): Result.003 file - promoters60/4771713
ccagata

SEQ ID NO: 140571 - DNA, 7 bp, Unknown
  misc_feature (1)..( 7): Result.003 file - promoters60/4771713
ccaaata

SEQ ID NO: 140572 - DNA, 7 bp, Unknown
  misc_feature (1)..( 7): Result.003 file - promoters60/4771713
ctcggca

SEQ ID NO: 140573 - DNA, 7 bp, Unknown
  misc_feature (1)..( 7): Result.003 file - promoters60/4771713
ctcagca

SEQ ID NO: 140574 - DNA, 7 bp, Unknown
  misc_feature (1)..( 7): Result.003 file - promoters60/4771713
atctgag

SEQ ID NO: 140575 - DNA, 7 bp, Unknown
  misc_feature (1)..( 7): Result.003 file - promoters60/4771713
atctgag

SEQ ID NO: 140576 - DNA, 6 bp, Unknown
  misc_feature (1)..( 6): Result.003 file - promoters60/4771713
aaattg

SEQ ID NO: 140577 - DNA, 6 bp, Unknown
  misc_feature (1)..( 6): Result.003 file - promoters60/4771713
aaattg

SEQ ID NO: 140578 - DNA, 8 bp, Unknown
  misc_feature (1)..( 8): Result.003 file - promoters60/4771713
atataaag

SEQ ID NO: 140579 - DNA, 8 bp, Unknown
  misc_feature (1)..( 8): Result.003 file - promoters60/4771713
ttattaag

SEQ ID NO: 140580 - DNA, 8 bp, Unknown
  misc_feature (1)..( 8): Result.003 file - promoters60/4771713
ttagtaat

SEQ ID NO: 140581 - DNA, 8 bp, Unknown
  misc_feature (1)..( 8): Result.003 file - promoters60/4771713
aacaaatt

SEQ ID NO: 140582 - DNA, 8 bp, Unknown
  misc_feature (1)..( 8): Result.003 file - promoters60/4771713
aaccaatt

SEQ ID NO: 140583 - DNA, 8 bp, Unknown
  misc_feature (1)..( 8): Result.003 file - promoters60/4771713
cgaatcca

SEQ ID NO: 140584 - DNA, 8 bp, Unknown
  misc_feature (1)..( 8): Result.003 file - promoters60/4771713
cgaaccca

SEQ ID NO: 140585 - DNA, 7 bp, Unknown
  misc_feature (1)..( 7): Result.003 file - promoters60/4771713
aaataaa

SEQ ID NO: 140586 - DNA, 7 bp, Unknown
  misc_feature (1)..( 7): Result.003 file - promoters60/4771713
aaagaaa

SEQ ID NO: 140587 - DNA, 7 bp, Unknown
  misc_feature (1)..( 7): Result.003 file - promoters60/4771713
aataaaa

SEQ ID NO: 140588 - DNA, 7 bp, Unknown
  misc_feature (1)..( 7): Result.003 file - promoters60/4771713
aataaaa

SEQ ID NO: 140589 - DNA, 7 bp, Unknown
  misc_feature (1)..( 7): Result.003 file - promoters60/4771713
aaatttt

SEQ ID NO: 140590 - DNA, 7 bp, Unknown
  misc_feature (1)..( 7): Result.003 file - promoters60/4771713
aaacttt

SEQ ID NO: 140591 - DNA, 7 bp, Unknown
  misc_feature (1)..( 7): Result.003 file - promoters60/4771713
ctaaaat

SEQ ID NO: 140592 - DNA, 7 bp, Unknown
  misc_feature (1)..( 7): Result.003 file - promoters60/4771713
ctacaat

SEQ ID NO: 140593 - DNA, 7 bp, Unknown
  misc_feature (1)..( 7): Result.003 file - promoters60/4771713
ttttgtt

SEQ ID NO: 140594 - DNA, 7 bp, Unknown
  misc_feature (1)..( 7): Result.003 file - promoters60/4771713
ttttgtt

SEQ ID NO: 140595 - DNA, 7 bp, Unknown
  misc_feature (1)..( 7): Result.003 file - promoters60/4771713
tcttttc

SEQ ID NO: 140596 - DNA, 7 bp, Unknown
  misc_feature (1)..( 7): Result.003 file - promoters60/4771713
tctgttc

SEQ ID NO: 140597 - DNA, 6 bp, Unknown
  misc_feature (1)..( 6): Result.003 file - promoters60/4771713
aataat

SEQ ID NO: 140598 - DNA, 6 bp, Unknown
  misc_feature (1)..( 6): Result.003 file - promoters60/4771713
aataat

SEQ ID NO: 140599 - DNA, 6 bp, Unknown
  misc_feature (1)..( 6): Result.003 file - promoters60/4771725
atcaat

SEQ ID NO: 140600 - DNA, 6 bp, Unknown
  misc_feature (1)..( 6): Result.003 file - promoters60/4771725
atcaat

SEQ ID NO: 140601 - DNA, 6 bp, Unknown
  misc_feature (1)..( 6): Result.003 file - promoters60/4771725
acactt

SEQ ID NO: 140602 - DNA, 6 bp, Unknown
  misc_feature (1)..( 6): Result.003 file - promoters60/4771725
acactt

SEQ ID NO: 140603 - DNA, 11 bp, Unknown
  misc_feature (1)..( 11): Result.003 file - promoters60/4771725
ctgcagagtaa

SEQ ID NO: 140604 - DNA, 11 bp, Unknown
  misc_feature (1)..( 11): Result.003 file - promoters60/4771725
taacagaataa

SEQ ID NO: 140605 - DNA, 11 bp, Unknown
  misc_feature (1)..( 11): Result.003 file - promoters60/4771725
taaaagaaaat

SEQ ID NO: 140606 - DNA, 6 bp, Unknown
  misc_feature (1)..( 6): Result.003 file - promoters60/4771725
gtgatc

SEQ ID NO: 140607 - DNA, 6 bp, Unknown
  misc_feature (1)..( 6): Result.003 file - promoters60/4771725
gtgatc

SEQ ID NO: 140608 - DNA, 6 bp, Unknown
  misc_feature (1)..( 6): Result.003 file - promoters60/4771725
gatcgt

SEQ ID NO: 140609 - DNA, 6 bp, Unknown
  misc_feature (1)..( 6): Result.003 file - promoters60/4771725
gatcgt

SEQ ID NO: 140610 - DNA, 13 bp, Unknown
  misc_feature (1)..( 13): Result.003 file - promoters60/4771725
aaataataataat

SEQ ID NO: 140611 - DNA, 13 bp, Unknown
  misc_feature (1)..( 13): Result.003 file - promoters60/4771725
aaagaataaaaat

SEQ ID NO: 140612 - DNA, 13 bp, Unknown
  misc_feature (1)..( 13): Result.003 file - promoters60/4771725
cgttaatcaaata

SEQ ID NO: 140613 - DNA, 6 bp, Unknown
  misc_feature (1)..( 6): Result.003 file - promoters60/4771725
agaatc

SEQ ID NO: 140614 - DNA, 6 bp, Unknown
  misc_feature (1)..( 6): Result.003 file - promoters60/4771725
agaatc

SEQ ID NO: 140615 - DNA, 8 bp, Unknown
  misc_feature (1)..( 8): Result.003 file - promoters60/4771725
agagaaga

SEQ ID NO: 140616 - DNA, 8 bp, Unknown
  misc_feature (1)..( 8): Result.003 file - promoters60/4771725
agagaaga

SEQ ID NO: 140617 - DNA, 8 bp, Unknown
  misc_feature (1)..( 8): Result.003 file - promoters60/4771725
tttaaaat

SEQ ID NO: 140618 - DNA, 8 bp, Unknown
  misc_feature (1)..( 8): Result.003 file - promoters60/4771725
aataaaat

SEQ ID NO: 140619 - DNA, 8 bp, Unknown
  misc_feature (1)..( 8): Result.003 file - promoters60/4771725
aataaaaa

SEQ ID NO: 140620 - DNA, 7 bp, Unknown
  misc_feature (1)..( 7): Result.003 file - promoters60/4771725
aaaagaa

SEQ ID NO: 140621 - DNA, 7 bp, Unknown
  misc_feature (1)..( 7): Result.003 file - promoters60/4771725
aaacgaa

SEQ ID NO: 140622 - DNA, 9 bp, Unknown
  misc_feature (1)..( 9): Result.003 file - promoters60/4771725
cttagatat

SEQ ID NO: 140623 - DNA, 9 bp, Unknown
  misc_feature (1)..( 9): Result.003 file - promoters60/4771725
cttaaatat

SEQ ID NO: 140624 - DNA, 8 bp, Unknown
  misc_feature (1)..( 8): Result.003 file - promoters60/4771725
cttcaaaa

SEQ ID NO: 140625 - DNA, 8 bp, Unknown
  misc_feature (1)..( 8): Result.003 file - promoters60/4771725
ctttaaaa

SEQ ID NO: 140626 - DNA, 6 bp, Unknown
  misc_feature (1)..( 6): Result.003 file - promoters60/4771725
atcaaa

SEQ ID NO: 140627 - DNA, 6 bp, Unknown
  misc_feature (1)..( 6): Result.003 file - promoters60/4771725
atcaaa

SEQ ID NO: 140628 - DNA, 7 bp, Unknown
  misc_feature (1)..( 7): Result.003 file - promoters60/4771725
aatagtt

SEQ ID NO: 140629 - DNA, 7 bp, Unknown
  misc_feature (1)..( 7): Result.003 file - promoters60/4771725
aattgtt

SEQ ID NO: 140630 - DNA, 7 bp, Unknown
  misc_feature (1)..( 7): Result.003 file - promoters60/4771733
aaattaa

SEQ ID NO: 140631 - DNA, 7 bp, Unknown
  misc_feature (1)..( 7): Result.003 file - promoters60/4771733
aaattaa

SEQ ID NO: 140632 - DNA, 6 bp, Unknown
  misc_feature (1)..( 6): Result.003 file - promoters60/4771733
atacaa

SEQ ID NO: 140633 - DNA, 6 bp, Unknown
  misc_feature (1)..( 6): Result.003 file - promoters60/4771733
atacaa

SEQ ID NO: 140634 - DNA, 7 bp, Unknown
  misc_feature (1)..( 7): Result.003 file - promoters60/4771733
aaatgtt

SEQ ID NO: 140635 - DNA, 7 bp, Unknown
  misc_feature (1)..( 7): Result.003 file - promoters60/4771733
aaaagtt

SEQ ID NO: 140636 - DNA, 9 bp, Unknown
  misc_feature (1)..( 9): Result.003 file - promoters60/4771733
caaaaaaaa

SEQ ID NO: 140637 - DNA, 9 bp, Unknown
  misc_feature (1)..( 9): Result.003 file - promoters60/4771733
caaaaaaaa

SEQ ID NO: 140638 - DNA, 7 bp, Unknown
  misc_feature (1)..( 7): Result.003 file - promoters60/4771733
aaaaaaa

SEQ ID NO: 140639 - DNA, 7 bp, Unknown
  misc_feature (1)..( 7): Result.003 file - promoters60/4771733
aaaaaaa

SEQ ID NO: 140640 - DNA, 8 bp, Unknown
  misc_feature (1)..( 8): Result.003 file - promoters60/4771733
ccttttta

SEQ ID NO: 140641 - DNA, 8 bp, Unknown
  misc_feature (1)..( 8): Result.003 file - promoters60/4771733
ccttatta

SEQ ID NO: 140642 - DNA, 10 bp, Unknown
  misc_feature (1)..( 10): Result.003 file - promoters60/4771733
gtgacgtaac

SEQ ID NO: 140643 - DNA, 10 bp, Unknown
  misc_feature (1)..( 10): Result.003 file - promoters60/4771733
gtgacataac

SEQ ID NO: 140644 - DNA, 7 bp, Unknown
  misc_feature (1)..( 7): Result.003 file - promoters60/4771733
tacgatt

SEQ ID NO: 140645 - DNA, 7 bp, Unknown
  misc_feature (1)..( 7): Result.003 file - promoters60/4771733
taccatt

SEQ ID NO: 140646 - DNA, 6 bp, Unknown
  misc_feature (1)..( 6): Result.003 file - promoters60/4771733
caagag

SEQ ID NO: 140647 - DNA, 6 bp, Unknown
  misc_feature (1)..( 6): Result.003 file - promoters60/4771733
caagag

SEQ ID NO: 140648 - DNA, 7 bp, Unknown
  misc_feature (1)..( 7): Result.003 file - promoters60/4771733
agattga

SEQ ID NO: 140649 - DNA, 7 bp, Unknown
  misc_feature (1)..( 7): Result.003 file - promoters60/4771733
agagtga

SEQ ID NO: 140650 - DNA, 8 bp, Unknown
  misc_feature (1)..( 8): Result.003 file - promoters60/4771733
gccgacaa

SEQ ID NO: 140651 - DNA, 8 bp, Unknown
  misc_feature (1)..( 8): Result.003 file - promoters60/4771733
gcctacaa

SEQ ID NO: 140652 - DNA, 9 bp, Unknown
  misc_feature (1)..( 9): Result.003 file - promoters60/4771733
gtcattgaa

SEQ ID NO: 140653 - DNA, 9 bp, Unknown
  misc_feature (1)..( 9): Result.003 file - promoters60/4771733
gtccttgaa

SEQ ID NO: 140654 - DNA, 7 bp, Unknown
  misc_feature (1)..( 7): Result.003 file - promoters60/4771733
aaataaa

SEQ ID NO: 140655 - DNA, 7 bp, Unknown
  misc_feature (1)..( 7): Result.003 file - promoters60/4771733
aaacaaa

SEQ ID NO: 140656 - DNA, 7 bp, Unknown
  misc_feature (1)..( 7): Result.003 file - promoters60/4771733
acgtgcc

SEQ ID NO: 140657 - DNA, 7 bp, Unknown
  misc_feature (1)..( 7): Result.003 file - promoters60/4771733
acgagcc

SEQ ID NO: 140658 - DNA, 8 bp, Unknown
  misc_feature (1)..( 8): Result.003 file - promoters60/4771733
taaattaa

SEQ ID NO: 140659 - DNA, 8 bp, Unknown
  misc_feature (1)..( 8): Result.003 file - promoters60/4771733
taaagtaa

SEQ ID NO: 140660 - DNA, 7 bp, Unknown
  misc_feature (1)..( 7): Result.003 file - promoters60/4771733
ttctaaa

SEQ ID NO: 140661 - DNA, 7 bp, Unknown
  misc_feature (1)..( 7): Result.003 file - promoters60/4771733
ttccaaa

SEQ ID NO: 140662 - DNA, 6 bp, Unknown
  misc_feature (1)..( 6): Result.003 file - promoters60/4771733
ccaaac

SEQ ID NO: 140663 - DNA, 6 bp, Unknown
  misc_feature (1)..( 6): Result.003 file - promoters60/4771733
ccaaac

SEQ ID NO: 140664 - DNA, 6 bp, Unknown
  misc_feature (1)..( 6): Result.003 file - promoters60/4771733
ggtttt

SEQ ID NO: 140665 - DNA, 6 bp, Unknown
  misc_feature (1)..( 6): Result.003 file - promoters60/4771733
ggtttt

SEQ ID NO: 140666 - DNA, 6 bp, Unknown
  misc_feature (1)..( 6): Result.003 file - promoters60/4771733
ttaatt

SEQ ID NO: 140667 - DNA, 6 bp, Unknown
  misc_feature (1)..( 6): Result.003 file - promoters60/4771733
ttaatt

SEQ ID NO: 140668 - DNA, 8 bp, Unknown
  misc_feature (1)..( 8): Result.003 file - promoters60/4771733
gttagtat

SEQ ID NO: 140669 - DNA, 8 bp, Unknown
  misc_feature (1)..( 8): Result.003 file - promoters60/4771733
gttcgtat

SEQ ID NO: 140670 - DNA, 6 bp, Unknown
  misc_feature (1)..( 6): Result.003 file - promoters60/4771733
ttggcg

SEQ ID NO: 140671 - DNA, 6 bp, Unknown
  misc_feature (1)..( 6): Result.003 file - promoters60/4771733
ttggcg

SEQ ID NO: 140672 - DNA, 7 bp, Unknown
  misc_feature (1)..( 7): Result.003 file - promoters60/4771733
atattta

SEQ ID NO: 140673 - DNA, 7 bp, Unknown
  misc_feature (1)..( 7): Result.003 file - promoters60/4771733
atattta

SEQ ID NO: 140674 - DNA, 11 bp, Unknown
  misc_feature (1)..( 11): Result.003 file - promoters60/4771745
ttaacttttaa

SEQ ID NO: 140675 - DNA, 11 bp, Unknown
  misc_feature (1)..( 11): Result.003 file - promoters60/4771745
ttaaattttaa

SEQ ID NO: 140676 - DNA, 7 bp, Unknown
  misc_feature (1)..( 7): Result.003 file - promoters60/4771745
attttgt

SEQ ID NO: 140677 - DNA, 7 bp, Unknown
  misc_feature (1)..( 7): Result.003 file - promoters60/4771745
attttgt

SEQ ID NO: 140678 - DNA, 6 bp, Unknown
  misc_feature (1)..( 6): Result.003 file - promoters60/4771745
ttaaaa

SEQ ID NO: 140679 - DNA, 6 bp, Unknown
  misc_feature (1)..( 6): Result.003 file - promoters60/4771745
ttaaaa

SEQ ID NO: 140680 - DNA, 10 bp, Unknown
  misc_feature (1)..( 10): Result.003 file - promoters60/4771745
gatcagaaat

SEQ ID NO: 140681 - DNA, 10 bp, Unknown
  misc_feature (1)..( 10): Result.003 file - promoters60/4771745
gatgagaaat

SEQ ID NO: 140682 - DNA, 6 bp, Unknown
  misc_feature (1)..( 6): Result.003 file - promoters60/4771745
gataat

SEQ ID NO: 140683 - DNA, 6 bp, Unknown
  misc_feature (1)..( 6): Result.003 file - promoters60/4771745
gataat

SEQ ID NO: 140684 - DNA, 8 bp, Unknown
  misc_feature (1)..( 8): Result.003 file - promoters60/4771745
tgaaaaaa

SEQ ID NO: 140685 - DNA, 8 bp, Unknown
  misc_feature (1)..( 8): Result.003 file - promoters60/4771745
tgaagaaa

SEQ ID NO: 140686 - DNA, 7 bp, Unknown
  misc_feature (1)..( 7): Result.003 file - promoters60/4771745
aaaatga

SEQ ID NO: 140687 - DNA, 7 bp, Unknown
  misc_feature (1)..( 7): Result.003 file - promoters60/4771745
aaattga

SEQ ID NO: 140688 - DNA, 7 bp, Unknown
  misc_feature (1)..( 7): Result.003 file - promoters60/4771745
agattgt

SEQ ID NO: 140689 - DNA, 7 bp, Unknown
  misc_feature (1)..( 7): Result.003 file - promoters60/4771745
agactgt

SEQ ID NO: 140690 - DNA, 9 bp, Unknown
  misc_feature (1)..( 9): Result.003 file - promoters60/4771745
atattatat

SEQ ID NO: 140691 - DNA, 9 bp, Unknown
  misc_feature (1)..( 9): Result.003 file - promoters60/4771745
ataatatat

SEQ ID NO: 140692 - DNA, 7 bp, Unknown
  misc_feature (1)..( 7): Result.003 file - promoters60/4771745
ttgggct

SEQ ID NO: 140693 - DNA, 7 bp, Unknown
  misc_feature (1)..( 7): Result.003 file - promoters60/4771745
ttgggct

SEQ ID NO: 140694 - DNA, 7 bp, Unknown
  misc_feature (1)..( 7): Result.003 file - promoters60/4771745
tactcaa

SEQ ID NO: 140695 - DNA, 7 bp, Unknown
  misc_feature (1)..( 7): Result.003 file - promoters60/4771745
tactcaa

SEQ ID NO: 140696 - DNA, 7 bp, Unknown
  misc_feature (1)..( 7): Result.003 file - promoters60/4771745
atttttt

SEQ ID NO: 140697 - DNA, 7 bp, Unknown
  misc_feature (1)..( 7): Result.003 file - promoters60/4771745
attgttt

SEQ ID NO: 140698 - DNA, 7 bp, Unknown
  misc_feature (1)..( 7): Result.003 file - promoters60/4771745
tagaaaa

SEQ ID NO: 140699 - DNA, 7 bp, Unknown
  misc_feature (1)..( 7): Result.003 file - promoters60/4771745
tagaaaa

SEQ ID NO: 140700 - DNA, 8 bp, Unknown
  misc_feature (1)..( 8): Result.003 file - promoters60/4771745
aaattaga

SEQ ID NO: 140701 - DNA, 8 bp, Unknown
  misc_feature (1)..( 8): Result.003 file - promoters60/4771745
aaattaga

SEQ ID NO: 140702 - DNA, 8 bp, Unknown
  misc_feature (1)..( 8): Result.003 file - promoters60/4771745
caaagtaa

SEQ ID NO: 140703 - DNA, 8 bp, Unknown
  misc_feature (1)..( 8): Result.003 file - promoters60/4771745
caaagtaa

SEQ ID NO: 140704 - DNA, 7 bp, Unknown
  misc_feature (1)..( 7): Result.003 file - promoters60/4771793
aagaata

SEQ ID NO: 140705 - DNA, 7 bp, Unknown
  misc_feature (1)..( 7): Result.003 file - promoters60/4771793
aagaata

SEQ ID NO: 140706 - DNA, 7 bp, Unknown
  misc_feature (1)..( 7): Result.003 file - promoters60/4771793
aagaatt

SEQ ID NO: 140707 - DNA, 9 bp, Unknown
  misc_feature (1)..( 9): Result.003 file - promoters60/4771793
atacttttt

SEQ ID NO: 140708 - DNA, 9 bp, Unknown
  misc_feature (1)..( 9): Result.003 file - promoters60/4771793
gtacattta

SEQ ID NO: 140709 - DNA, 9 bp, Unknown
  misc_feature (1)..( 9): Result.003 file - promoters60/4771793
atacttttt

SEQ ID NO: 140710 - DNA, 9 bp, Unknown
  misc_feature (1)..( 9): Result.003 file - promoters60/4771793
ttttttctt

SEQ ID NO: 140711 - DNA, 9 bp, Unknown
  misc_feature (1)..( 9): Result.003 file - promoters60/4771793
tttattctt

SEQ ID NO: 140712 - DNA, 9 bp, Unknown
  misc_feature (1)..( 9): Result.003 file - promoters60/4771793
ctttttctg

SEQ ID NO: 140713 - DNA, 9 bp, Unknown
  misc_feature (1)..( 9): Result.003 file - promoters60/4771793
tatatattt

SEQ ID NO: 140714 - DNA, 9 bp, Unknown
  misc_feature (1)..( 9): Result.003 file - promoters60/4771793
tatttattt

SEQ ID NO: 140715 - DNA, 9 bp, Unknown
  misc_feature (1)..( 9): Result.003 file - promoters60/4771793
tgcatattt

SEQ ID NO: 140716 - DNA, 8 bp, Unknown
  misc_feature (1)..( 8): Result.003 file - promoters60/4771793
ttgaaatt

SEQ ID NO: 140717 - DNA, 8 bp, Unknown
  misc_feature (1)..( 8): Result.003 file - promoters60/4771793
aagaaatt

SEQ ID NO: 140718 - DNA, 8 bp, Unknown
  misc_feature (1)..( 8): Result.003 file - promoters60/4771793
atgaaatt

SEQ ID NO: 140719 - DNA, 8 bp, Unknown
  misc_feature (1)..( 8): Result.003 file - promoters60/4771793
aagcaatt

SEQ ID NO: 140720 - DNA, 8 bp, Unknown
  misc_feature (1)..( 8): Result.003 file - promoters60/4771808
taggtttt

SEQ ID NO: 140721 - DNA, 8 bp, Unknown
  misc_feature (1)..( 8): Result.003 file - promoters60/4771808
tagggttt

SEQ ID NO: 140722 - DNA, 7 bp, Unknown
  misc_feature (1)..( 7): Result.003 file - promoters60/4771808
tttggat

SEQ ID NO: 140723 - DNA, 7 bp, Unknown
  misc_feature (1)..( 7): Result.003 file - promoters60/4771808
ttttgat

SEQ ID NO: 140724 - DNA, 10 bp, Unknown
  misc_feature (1)..( 10): Result.003 file - promoters60/4771808
ttgttaatgt

SEQ ID NO: 140725 - DNA, 10 bp, Unknown
  misc_feature (1)..( 10): Result.003 file - promoters60/4771808
ttgtgaatgt

SEQ ID NO: 140726 - DNA, 7 bp, Unknown
  misc_feature (1)..( 7): Result.003 file - promoters60/4771808
caataaa

SEQ ID NO: 140727 - DNA, 7 bp, Unknown
  misc_feature (1)..( 7): Result.003 file - promoters60/4771808
caaaaaa

SEQ ID NO: 140728 - DNA, 7 bp, Unknown
  misc_feature (1)..( 7): Result.003 file - promoters60/4771808
caaaaag

SEQ ID NO: 140729 - DNA, 7 bp, Unknown
  misc_feature (1)..( 7): Result.003 file - promoters60/4771808
caaaaag

SEQ ID NO: 140730 - DNA, 8 bp, Unknown
  misc_feature (1)..( 8): Result.003 file - promoters60/4771808
ctgattct

SEQ ID NO: 140731 - DNA, 8 bp, Unknown
  misc_feature (1)..( 8): Result.003 file - promoters60/4771808
ctgtttct

SEQ ID NO: 140732 - DNA, 8 bp, Unknown
  misc_feature (1)..( 8): Result.003 file - promoters60/4771808
ttttctgt

SEQ ID NO: 140733 - DNA, 8 bp, Unknown
  misc_feature (1)..( 8): Result.003 file - promoters60/4771808
tttcctgt

SEQ ID NO: 140734 - DNA, 7 bp, Unknown
  misc_feature (1)..( 7): Result.003 file - promoters60/4771808
tctttat

SEQ ID NO: 140735 - DNA, 7 bp, Unknown
  misc_feature (1)..( 7): Result.003 file - promoters60/4771808
tctgtat

SEQ ID NO: 140736 - DNA, 7 bp, Unknown
  misc_feature (1)..( 7): Result.003 file - promoters60/4771808
catatta

SEQ ID NO: 140737 - DNA, 7 bp, Unknown
  misc_feature (1)..( 7): Result.003 file - promoters60/4771808
aatatta

SEQ ID NO: 140738 - DNA, 7 bp, Unknown
  misc_feature (1)..( 7): Result.003 file - promoters60/4771808
aatattg

SEQ ID NO: 140739 - DNA, 7 bp, Unknown
  misc_feature (1)..( 7): Result.003 file - promoters60/4771808
gccttta

SEQ ID NO: 140740 - DNA, 7 bp, Unknown
  misc_feature (1)..( 7): Result.003 file - promoters60/4771808
gccatta

SEQ ID NO: 140741 - DNA, 6 bp, Unknown
  misc_feature (1)..( 6): Result.003 file - promoters60/4771808
gtacaa

SEQ ID NO: 140742 - DNA, 6 bp, Unknown
  misc_feature (1)..( 6): Result.003 file - promoters60/4771808
gtacaa

SEQ ID NO: 140743 - DNA, 9 bp, Unknown
  misc_feature (1)..( 9): Result.003 file - promoters60/4771808
tttccaatt

SEQ ID NO: 140744 - DNA, 9 bp, Unknown
  misc_feature (1)..( 9): Result.003 file - promoters60/4771808
ttttcaatt

SEQ ID NO: 140745 - DNA, 7 bp, Unknown
  misc_feature (1)..( 7): Result.003 file - promoters60/4771808
ttcaaag

SEQ ID NO: 140746 - DNA, 7 bp, Unknown
  misc_feature (1)..( 7): Result.003 file - promoters60/4771808
ttcaaag

SEQ ID NO: 140747 - DNA, 7 bp, Unknown
  misc_feature (1)..( 7): Result.003 file - promoters60/4771808
aacattt

SEQ ID NO: 140748 - DNA, 7 bp, Unknown
  misc_feature (1)..( 7): Result.003 file - promoters60/4771808
aacgttt

SEQ ID NO: 140749 - DNA, 6 bp, Unknown
  misc_feature (1)..( 6): Result.003 file - promoters60/4771808
ataatt

SEQ ID NO: 140750 - DNA, 6 bp, Unknown
  misc_feature (1)..( 6): Result.003 file - promoters60/4771808
ataatt

SEQ ID NO: 140751 - DNA, 8 bp, Unknown
  misc_feature (1)..( 8): Result.003 file - promoters60/4771808
attagtgt

SEQ ID NO: 140752 - DNA, 8 bp, Unknown
  misc_feature (1)..( 8): Result.003 file - promoters60/4771808
attattgt

SEQ ID NO: 140753 - DNA, 9 bp, Unknown
  misc_feature (1)..( 9): Result.003 file - promoters60/4771808
ataaagcaa

SEQ ID NO: 140754 - DNA, 9 bp, Unknown
  misc_feature (1)..( 9): Result.003 file - promoters60/4771808
ataaaccaa

SEQ ID NO: 140755 - DNA, 6 bp, Unknown
  misc_feature (1)..( 6): Result.003 file - promoters60/4771808
acctct

SEQ ID NO: 140756 - DNA, 6 bp, Unknown
  misc_feature (1)..( 6): Result.003 file - promoters60/4771808
acctct

SEQ ID NO: 140757 - DNA, 7 bp, Unknown
  misc_feature (1)..( 7): Result.003 file - promoters60/4771808
tttattt

SEQ ID NO: 140758 - DNA, 7 bp, Unknown
  misc_feature (1)..( 7): Result.003 file - promoters60/4771808
ttttttt

SEQ ID NO: 140759 - DNA, 9 bp, Unknown
  misc_feature (1)..( 9): Result.003 file - promoters60/4771853
gtttccttt

SEQ ID NO: 140760 - DNA, 9 bp, Unknown
  misc_feature (1)..( 9): Result.003 file - promoters60/4771853
gttaccttt

SEQ ID NO: 140761 - DNA, 9 bp, Unknown
  misc_feature (1)..( 9): Result.003 file - promoters60/4771853
gcttcgttt

SEQ ID NO: 140762 - DNA, 8 bp, Unknown
  misc_feature (1)..( 8): Result.003 file - promoters60/4771853
caccaata

SEQ ID NO: 140763 - DNA, 8 bp, Unknown
  misc_feature (1)..( 8): Result.003 file - promoters60/4771853
aaccaata

SEQ ID NO: 140764 - DNA, 8 bp, Unknown
  misc_feature (1)..( 8): Result.003 file - promoters60/4771853
aacaaata

SEQ ID NO: 140765 - DNA, 9 bp, Unknown
  misc_feature (1)..( 9): Result.003 file - promoters60/4771853
tttcctttt

SEQ ID NO: 140766 - DNA, 9 bp, Unknown
  misc_feature (1)..( 9): Result.003 file - promoters60/4771853
ttttcttaa

SEQ ID NO: 140767 - DNA, 9 bp, Unknown
  misc_feature (1)..( 9): Result.003 file - promoters60/4771853
gttcctaat

SEQ ID NO: 140768 - DNA, 11 bp, Unknown
  misc_feature (1)..( 11): Result.003 file - promoters60/4771872
aaataattttc

SEQ ID NO: 140769 - DNA, 11 bp, Unknown
  misc_feature (1)..( 11): Result.003 file - promoters60/4771872
caatcattccc

SEQ ID NO: 140770 - DNA, 12 bp, Unknown
  misc_feature (1)..( 12): Result.003 file - promoters60/4771872
ggataaatttat

SEQ ID NO: 140771 - DNA, 12 bp, Unknown
  misc_feature (1)..( 12): Result.003 file - promoters60/4771872
caggcgatcatt

SEQ ID NO: 140772 - DNA, 12 bp, Unknown
  misc_feature (1)..( 12): Result.003 file - promoters60/4771872
caaacatgagag

SEQ ID NO: 140773 - DNA, 11 bp, Unknown
  misc_feature (1)..( 11): Result.003 file - promoters60/4771872
cattaaattaa

SEQ ID NO: 140774 - DNA, 11 bp, Unknown
  misc_feature (1)..( 11): Result.003 file - promoters60/4771872
catgaaacttt

SEQ ID NO: 140775 - DNA, 11 bp, Unknown
  misc_feature (1)..( 11): Result.003 file - promoters60/4771872
aattaaattgt

SEQ ID NO: 140776 - DNA, 11 bp, Unknown
  misc_feature (1)..( 11): Result.003 file - promoters60/4771872
aattaacatat

SEQ ID NO: 140777 - DNA, 11 bp, Unknown
  misc_feature (1)..( 11): Result.003 file - promoters60/4771872
tgagaaattga

SEQ ID NO: 140778 - DNA, 11 bp, Unknown
  misc_feature (1)..( 11): Result.003 file - promoters60/4771872
aaagaaagtgt

SEQ ID NO: 140779 - DNA, 10 bp, Unknown
  misc_feature (1)..( 10): Result.003 file - promoters60/4771872
gaagataagg

SEQ ID NO: 140780 - DNA, 10 bp, Unknown
  misc_feature (1)..( 10): Result.003 file - promoters60/4771872
agagataaag

SEQ ID NO: 140781 - DNA, 10 bp, Unknown
  misc_feature (1)..( 10): Result.003 file - promoters60/4771872
tgagagaagt

SEQ ID NO: 140782 - DNA, 10 bp, Unknown
  misc_feature (1)..( 10): Result.003 file - promoters60/4771872
gaagacaagg

SEQ ID NO: 140783 - DNA, 10 bp, Unknown
  misc_feature (1)..( 10): Result.003 file - promoters60/4771872
gaaaatatat

SEQ ID NO: 140784 - DNA, 13 bp, Unknown
  misc_feature (1)..( 13): Result.003 file - promoters60/4771879
tcgtcgttttata

SEQ ID NO: 140785 - DNA, 13 bp, Unknown
  misc_feature (1)..( 13): Result.003 file - promoters60/4771879
tcgtcgtatctaa

SEQ ID NO: 140786 - DNA, 13 bp, Unknown
  misc_feature (1)..( 13): Result.003 file - promoters60/4771879
tagtcctatgtaa

SEQ ID NO: 140787 - DNA, 8 bp, Unknown
  misc_feature (1)..( 8): Result.003 file - promoters60/4771879
tatttaat

SEQ ID NO: 140788 - DNA, 8 bp, Unknown
  misc_feature (1)..( 8): Result.003 file - promoters60/4771879
tatctaag

SEQ ID NO: 140789 - DNA, 8 bp, Unknown
  misc_feature (1)..( 8): Result.003 file - promoters60/4771879
tatgtaat

SEQ ID NO: 140790 - DNA, 7 bp, Unknown
  misc_feature (1)..( 7): Result.003 file - promoters60/4771879
aatagta

SEQ ID NO: 140791 - DNA, 7 bp, Unknown
  misc_feature (1)..( 7): Result.003 file - promoters60/4771879
aatcgta

SEQ ID NO: 140792 - DNA, 6 bp, Unknown
  misc_feature (1)..( 6): Result.003 file - promoters60/4771879
aagaaa

SEQ ID NO: 140793 - DNA, 6 bp, Unknown
  misc_feature (1)..( 6): Result.003 file - promoters60/4771879
aagaaa

SEQ ID NO: 140794 - DNA, 7 bp, Unknown
  misc_feature (1)..( 7): Result.003 file - promoters60/4771879
tatatgt

SEQ ID NO: 140795 - DNA, 7 bp, Unknown
  misc_feature (1)..( 7): Result.003 file - promoters60/4771879
tatttgt

SEQ ID NO: 140796 - DNA, 8 bp, Unknown
  misc_feature (1)..( 8): Result.003 file - promoters60/4771879
gtaatttg

SEQ ID NO: 140797 - DNA, 8 bp, Unknown
  misc_feature (1)..( 8): Result.003 file - promoters60/4771879
gtaattta

SEQ ID NO: 140798 - DNA, 8 bp, Unknown
  misc_feature (1)..( 8): Result.003 file - promoters60/4771879
ataaattg

SEQ ID NO: 140799 - DNA, 6 bp, Unknown
  misc_feature (1)..( 6): Result.003 file - promoters60/4771879
caaata

SEQ ID NO: 140800 - DNA, 6 bp, Unknown
  misc_feature (1)..( 6): Result.003 file - promoters60/4771879
caaata

SEQ ID NO: 140801 - DNA, 6 bp, Unknown
  misc_feature (1)..( 6): Result.003 file - promoters60/4771879
aataaa

SEQ ID NO: 140802 - DNA, 6 bp, Unknown
  misc_feature (1)..( 6): Result.003 file - promoters60/4771879
aataaa

SEQ ID NO: 140803 - DNA, 6 bp, Unknown
  misc_feature (1)..( 6): Result.003 file - promoters60/4771879
taatat

SEQ ID NO: 140804 - DNA, 6 bp, Unknown
  misc_feature (1)..( 6): Result.003 file - promoters60/4771879
taatat

SEQ ID NO: 140805 - DNA, 8 bp, Unknown
  misc_feature (1)..( 8): Result.003 file - promoters60/4771879
ccttaatt

SEQ ID NO: 140806 - DNA, 8 bp, Unknown
  misc_feature (1)..( 8): Result.003 file - promoters60/4771879
cctgaatt

SEQ ID NO: 140807 - DNA, 8 bp, Unknown
  misc_feature (1)..( 8): Result.003 file - promoters60/4771879
taaaatat

SEQ ID NO: 140808 - DNA, 8 bp, Unknown
  misc_feature (1)..( 8): Result.003 file - promoters60/4771879
taagatat

SEQ ID NO: 140809 - DNA, 8 bp, Unknown
  misc_feature (1)..( 8): Result.003 file - promoters60/4771879
ttctcatt

SEQ ID NO: 140810 - DNA, 8 bp, Unknown
  misc_feature (1)..( 8): Result.003 file - promoters60/4771879
ttctaatt

SEQ ID NO: 140811 - DNA, 7 bp, Unknown
  misc_feature (1)..( 7): Result.003 file - promoters60/4771879
aaaaaat

SEQ ID NO: 140812 - DNA, 7 bp, Unknown
  misc_feature (1)..( 7): Result.003 file - promoters60/4771879
aaaaaat

SEQ ID NO: 140813 - DNA, 7 bp, Unknown
  misc_feature (1)..( 7): Result.003 file - promoters60/4771879
accgtat

SEQ ID NO: 140814 - DNA, 7 bp, Unknown
  misc_feature (1)..( 7): Result.003 file - promoters60/4771879
accctat

SEQ ID NO: 140815 - DNA, 6 bp, Unknown
  misc_feature (1)..( 6): Result.003 file - promoters60/4771879
aaattc

SEQ ID NO: 140816 - DNA, 6 bp, Unknown
  misc_feature (1)..( 6): Result.003 file - promoters60/4771879
aaattc

SEQ ID NO: 140817 - DNA, 8 bp, Unknown
  misc_feature (1)..( 8): Result.003 file - promoters60/4771879
catccaga

SEQ ID NO: 140818 - DNA, 8 bp, Unknown
  misc_feature (1)..( 8): Result.003 file - promoters60/4771879
catacaga

SEQ ID NO: 140819 - DNA, 11 bp, Unknown
  misc_feature (1)..( 11): Result.003 file - promoters60/4771895
ttcattaatta

SEQ ID NO: 140820 - DNA, 11 bp, Unknown
  misc_feature (1)..( 11): Result.003 file - promoters60/4771895
ttcattgatta

SEQ ID NO: 140821 - DNA, 11 bp, Unknown
  misc_feature (1)..( 11): Result.003 file - promoters60/4771895
accattaataa

SEQ ID NO: 140822 - DNA, 8 bp, Unknown
  misc_feature (1)..( 8): Result.003 file - promoters60/4771895
ttcatatc

SEQ ID NO: 140823 - DNA, 8 bp, Unknown
  misc_feature (1)..( 8): Result.003 file - promoters60/4771895
cccatatc

SEQ ID NO: 140824 - DNA, 8 bp, Unknown
  misc_feature (1)..( 8): Result.003 file - promoters60/4771895
ttcatatt

SEQ ID NO: 140825 - DNA, 7 bp, Unknown
  misc_feature (1)..( 7): Result.003 file - promoters60/4771895
tttacaa

SEQ ID NO: 140826 - DNA, 7 bp, Unknown
  misc_feature (1)..( 7): Result.003 file - promoters60/4771895
tttacaa

SEQ ID NO: 140827 - DNA, 8 bp, Unknown
  misc_feature (1)..( 8): Result.003 file - promoters60/4771895
gaaaattc

SEQ ID NO: 140828 - DNA, 8 bp, Unknown
  misc_feature (1)..( 8): Result.003 file - promoters60/4771895
gaaacttc

SEQ ID NO: 140829 - DNA, 13 bp, Unknown
  misc_feature (1)..( 13): Result.003 file - promoters60/4771895
ttcagaatcattt

SEQ ID NO: 140830 - DNA, 13 bp, Unknown
  misc_feature (1)..( 13): Result.003 file - promoters60/4771895
ttctgaataattc

SEQ ID NO: 140831 - DNA, 13 bp, Unknown
  misc_feature (1)..( 13): Result.003 file - promoters60/4771895
caaaatttcattt

SEQ ID NO: 140832 - DNA, 7 bp, Unknown
  misc_feature (1)..( 7): Result.003 file - promoters60/4771895
aatcaaa

SEQ ID NO: 140833 - DNA, 7 bp, Unknown
  misc_feature (1)..( 7): Result.003 file - promoters60/4771895
aataaaa

SEQ ID NO: 140834 - DNA, 8 bp, Unknown
  misc_feature (1)..( 8): Result.003 file - promoters60/4771895
aaaattta

SEQ ID NO: 140835 - DNA, 8 bp, Unknown
  misc_feature (1)..( 8): Result.003 file - promoters60/4771895
aaaattta

SEQ ID NO: 140836 - DNA, 6 bp, Unknown
  misc_feature (1)..( 6): Result.003 file - promoters60/4771895
tttaaa

SEQ ID NO: 140837 - DNA, 6 bp, Unknown
  misc_feature (1)..( 6): Result.003 file - promoters60/4771895
tttaaa

SEQ ID NO: 140838 - DNA, 9 bp, Unknown
  misc_feature (1)..( 9): Result.003 file - promoters60/4771895
tacttcttt

SEQ ID NO: 140839 - DNA, 9 bp, Unknown
  misc_feature (1)..( 9): Result.003 file - promoters60/4771895
atcttcttc

SEQ ID NO: 140840 - DNA, 9 bp, Unknown
  misc_feature (1)..( 9): Result.003 file - promoters60/4771895
atcatcttc

SEQ ID NO: 140841 - DNA, 6 bp, Unknown
  misc_feature (1)..( 6): Result.003 file - promoters60/4771895
tagaat

SEQ ID NO: 140842 - DNA, 6 bp, Unknown
  misc_feature (1)..( 6): Result.003 file - promoters60/4771895
tagaat

SEQ ID NO: 140843 - DNA, 9 bp, Unknown
  misc_feature (1)..( 9): Result.003 file - promoters60/4771895
attagtttg

SEQ ID NO: 140844 - DNA, 9 bp, Unknown
  misc_feature (1)..( 9): Result.003 file - promoters60/4771895
atttgtttg

SEQ ID NO: 140845 - DNA, 6 bp, Unknown
  misc_feature (1)..( 6): Result.003 file - promoters60/4771895
aaacta

SEQ ID NO: 140846 - DNA, 6 bp, Unknown
  misc_feature (1)..( 6): Result.003 file - promoters60/4771895
aaacta

SEQ ID NO: 140847 - DNA, 6 bp, Unknown
  misc_feature (1)..( 6): Result.003 file - promoters60/4771895
tatttt

SEQ ID NO: 140848 - DNA, 6 bp, Unknown
  misc_feature (1)..( 6): Result.003 file - promoters60/4771895
tatttt

SEQ ID NO: 140849 - DNA, 6 bp, Unknown
  misc_feature (1)..( 6): Result.003 file - promoters60/4771895
cgtgat

SEQ ID NO: 140850 - DNA, 6 bp, Unknown
  misc_feature (1)..( 6): Result.003 file - promoters60/4771895
cgtgat

SEQ ID NO: 140851 - DNA, 10 bp, Unknown
  misc_feature (1)..( 10): Result.003 file - promoters60/4771895
aaattagata

SEQ ID NO: 140852 - DNA, 10 bp, Unknown
  misc_feature (1)..( 10): Result.003 file - promoters60/4771895
aaattaaata

SEQ ID NO: 140853 - DNA, 7 bp, Unknown
  misc_feature (1)..( 7): Result.003 file - promoters60/4771895
tttgtta

SEQ ID NO: 140854 - DNA, 7 bp, Unknown
  misc_feature (1)..( 7): Result.003 file - promoters60/4771895
tttttta

SEQ ID NO: 140855 - DNA, 6 bp, Unknown
  misc_feature (1)..( 6): Result.003 file - promoters60/4771895
aaaaca

SEQ ID NO: 140856 - DNA, 6 bp, Unknown
  misc_feature (1)..( 6): Result.003 file - promoters60/4771895
aaaaca

SEQ ID NO: 140857 - DNA, 7 bp, Unknown
  misc_feature (1)..( 7): Result.003 file - promoters60/4771895
aaagaaa

SEQ ID NO: 140858 - DNA, 7 bp, Unknown
  misc_feature (1)..( 7): Result.003 file - promoters60/4771895
aaataaa

SEQ ID NO: 140859 - DNA, 6 bp, Unknown
  misc_feature (1)..( 6): Result.003 file - promoters60/4771895
gagaaa

SEQ ID NO: 140860 - DNA, 6 bp, Unknown
  misc_feature (1)..( 6): Result.003 file - promoters60/4771895
gagaaa

SEQ ID NO: 140861 - DNA, 8 bp, Unknown
  misc_feature (1)..( 8): Result.003 file - promoters60/4771911
ttatttag

SEQ ID NO: 140862 - DNA, 8 bp, Unknown
  misc_feature (1)..( 8): Result.003 file - promoters60/4771911
ttatttat

SEQ ID NO: 140863 - DNA, 8 bp, Unknown
  misc_feature (1)..( 8): Result.003 file - promoters60/4771911
aaatttat

SEQ ID NO: 140864 - DNA, 13 bp, Unknown
  misc_feature (1)..( 13): Result.003 file - promoters60/4771911
aaaaaaagaaaaa

SEQ ID NO: 140865 - DNA, 13 bp, Unknown
  misc_feature (1)..( 13): Result.003 file - promoters60/4771911
gccaaaagagtaa

SEQ ID NO: 140866 - DNA, 13 bp, Unknown
  misc_feature (1)..( 13): Result.003 file - promoters60/4771911
aaaaaaagaaaaa

SEQ ID NO: 140867 - DNA, 13 bp, Unknown
  misc_feature (1)..( 13): Result.003 file - promoters60/4771911
tttagaaaaataa

SEQ ID NO: 140868 - DNA, 13 bp, Unknown
  misc_feature (1)..( 13): Result.003 file - promoters60/4771911
tttggaaaagaaa

SEQ ID NO: 140869 - DNA, 13 bp, Unknown
  misc_feature (1)..( 13): Result.003 file - promoters60/4771911
aagggaaatgaaa

SEQ ID NO: 140870 - DNA, 9 bp, Unknown
  misc_feature (1)..( 9): Result.003 file - promoters60/4771911
aaaataaaa

SEQ ID NO: 140871 - DNA, 9 bp, Unknown
  misc_feature (1)..( 9): Result.003 file - promoters60/4771911
aaaataaaa

SEQ ID NO: 140872 - DNA, 9 bp, Unknown
  misc_feature (1)..( 9): Result.003 file - promoters60/4771911
gaaatgaaa

SEQ ID NO: 140873 - DNA, 8 bp, Unknown
  misc_feature (1)..( 8): Result.003 file - promoters60/4771911
aaaatatc

SEQ ID NO: 140874 - DNA, 8 bp, Unknown
  misc_feature (1)..( 8): Result.003 file - promoters60/4771911
aaaataaa

SEQ ID NO: 140875 - DNA, 8 bp, Unknown
  misc_feature (1)..( 8): Result.003 file - promoters60/4771911
gaaatatc

SEQ ID NO: 140876 - DNA, 8 bp, Unknown
  misc_feature (1)..( 8): Result.003 file - promoters60/4771911
aacaaaat

SEQ ID NO: 140877 - DNA, 8 bp, Unknown
  misc_feature (1)..( 8): Result.003 file - promoters60/4771911
cacaaaat

SEQ ID NO: 140878 - DNA, 8 bp, Unknown
  misc_feature (1)..( 8): Result.003 file - promoters60/4771911
aactaaac

SEQ ID NO: 140879 - DNA, 13 bp, Unknown
  misc_feature (1)..( 13): Result.003 file - promoters60/4771911
tatacaaatacat

SEQ ID NO: 140880 - DNA, 13 bp, Unknown
  misc_feature (1)..( 13): Result.003 file - promoters60/4771911
gaaacaaaaacat

SEQ ID NO: 140881 - DNA, 13 bp, Unknown
  misc_feature (1)..( 13): Result.003 file - promoters60/4771911
gaaagaaagcttt

SEQ ID NO: 140882 - DNA, 9 bp, Unknown
  misc_feature (1)..( 9): Result.003 file - promoters60/4771913
tgtttaaac

SEQ ID NO: 140883 - DNA, 9 bp, Unknown
  misc_feature (1)..( 9): Result.003 file - promoters60/4771913
tttttaaaa

SEQ ID NO: 140884 - DNA, 9 bp, Unknown
  misc_feature (1)..( 9): Result.003 file - promoters60/4771913
tttttaatt

SEQ ID NO: 140885 - DNA, 10 bp, Unknown
  misc_feature (1)..( 10): Result.003 file - promoters60/4771913
aatttacaaa

SEQ ID NO: 140886 - DNA, 10 bp, Unknown
  misc_feature (1)..( 10): Result.003 file - promoters60/4771913
tcaaaaaacg

SEQ ID NO: 140887 - DNA, 10 bp, Unknown
  misc_feature (1)..( 10): Result.003 file - promoters60/4771913
aaaaaaaact

SEQ ID NO: 140888 - DNA, 10 bp, Unknown
  misc_feature (1)..( 10): Result.003 file - promoters60/4771913
acaaaaaaaa

SEQ ID NO: 140889 - DNA, 10 bp, Unknown
  misc_feature (1)..( 10): Result.003 file - promoters60/4771913
acaaaaaaaa

SEQ ID NO: 140890 - DNA, 10 bp, Unknown
  misc_feature (1)..( 10): Result.003 file - promoters60/4771913
acaaaaagac

SEQ ID NO: 140891 - DNA, 8 bp, Unknown
  misc_feature (1)..( 8): Result.003 file - promoters60/4771913
gaaataaa

SEQ ID NO: 140892 - DNA, 8 bp, Unknown
  misc_feature (1)..( 8): Result.003 file - promoters60/4771913
taaataaa

SEQ ID NO: 140893 - DNA, 8 bp, Unknown
  misc_feature (1)..( 8): Result.003 file - promoters60/4771913
caaagaaa

SEQ ID NO: 140894 - DNA, 8 bp, Unknown
  misc_feature (1)..( 8): Result.003 file - promoters60/4771913
caaagata

SEQ ID NO: 140895 - DNA, 10 bp, Unknown
  misc_feature (1)..( 10): Result.003 file - promoters60/4771913
caaatttatt

SEQ ID NO: 140896 - DNA, 10 bp, Unknown
  misc_feature (1)..( 10): Result.003 file - promoters60/4771913
aaaatatatt

SEQ ID NO: 140897 - DNA, 10 bp, Unknown
  misc_feature (1)..( 10): Result.003 file - promoters60/4771913
gaaatttctg

SEQ ID NO: 140898 - DNA, 11 bp, Unknown
  misc_feature (1)..( 11): Result.003 file - promoters60/4771913
aaagatatatc

SEQ ID NO: 140899 - DNA, 12 bp, Unknown
  misc_feature (1)..( 12): Result.003 file - promoters60/4771913
tctcttttattt

SEQ ID NO: 140900 - DNA, 12 bp, Unknown
  misc_feature (1)..( 12): Result.003 file - promoters60/4771913
caactttcattt

SEQ ID NO: 140901 - DNA, 12 bp, Unknown
  misc_feature (1)..( 12): Result.003 file - promoters60/4771913
taaattttataa

SEQ ID NO: 140902 - DNA, 12 bp, Unknown
  misc_feature (1)..( 12): Result.003 file - promoters60/4771913
aatcttactcgt

SEQ ID NO: 140903 - DNA, 7 bp, Unknown
  misc_feature (1)..( 7): Result.003 file - promoters60/4771913
aaataaa

SEQ ID NO: 140904 - DNA, 7 bp, Unknown
  misc_feature (1)..( 7): Result.003 file - promoters60/4771913
aaaaaaa

SEQ ID NO: 140905 - DNA, 7 bp, Unknown
  misc_feature (1)..( 7): Result.003 file - promoters60/4771913
aaaaaaa

SEQ ID NO: 140906 - DNA, 7 bp, Unknown
  misc_feature (1)..( 7): Result.003 file - promoters60/4771913
acaaaaa

SEQ ID NO: 140907 - DNA, 10 bp, Unknown
  misc_feature (1)..( 10): Result.003 file - promoters60/4771913
ttaaatttga

SEQ ID NO: 140908 - DNA, 10 bp, Unknown
  misc_feature (1)..( 10): Result.003 file - promoters60/4771913
ttatattaac

SEQ ID NO: 140909 - DNA, 10 bp, Unknown
  misc_feature (1)..( 10): Result.003 file - promoters60/4771913
caaaattgac

SEQ ID NO: 140910 - DNA, 10 bp, Unknown
  misc_feature (1)..( 10): Result.003 file - promoters60/4771913
caatattaca

SEQ ID NO: 140911 - DNA, 10 bp, Unknown
  misc_feature (1)..( 10): Result.003 file - promoters60/4771928
atttataata

SEQ ID NO: 140912 - DNA, 10 bp, Unknown
  misc_feature (1)..( 10): Result.003 file - promoters60/4771928
gattatgata

SEQ ID NO: 140913 - DNA, 10 bp, Unknown
  misc_feature (1)..( 10): Result.003 file - promoters60/4771928
atttatagaa

SEQ ID NO: 140914 - DNA, 14 bp, Unknown
  misc_feature (1)..( 14): Result.003 file - promoters60/4771928
ggtcttacaatttt

SEQ ID NO: 140915 - DNA, 14 bp, Unknown
  misc_feature (1)..( 14): Result.003 file - promoters60/4771928
agaaatacaatttt

SEQ ID NO: 140916 - DNA, 14 bp, Unknown
  misc_feature (1)..( 14): Result.003 file - promoters60/4771928
agaactactattcg

SEQ ID NO: 140917 - DNA, 8 bp, Unknown
  misc_feature (1)..( 8): Result.003 file - promoters60/4771928
ctaaaata

SEQ ID NO: 140918 - DNA, 8 bp, Unknown
  misc_feature (1)..( 8): Result.003 file - promoters60/4771928
ctaaaaaa

SEQ ID NO: 140919 - DNA, 8 bp, Unknown
  misc_feature (1)..( 8): Result.003 file - promoters60/4771928
ttaaaaaa

SEQ ID NO: 140920 - DNA, 8 bp, Unknown
  misc_feature (1)..( 8): Result.003 file - promoters60/4771928
acttttgg

SEQ ID NO: 140921 - DNA, 8 bp, Unknown
  misc_feature (1)..( 8): Result.003 file - promoters60/4771928
atttttgg

SEQ ID NO: 140922 - DNA, 8 bp, Unknown
  misc_feature (1)..( 8): Result.003 file - promoters60/4771928
gtttttgt

SEQ ID NO: 140923 - DNA, 8 bp, Unknown
  misc_feature (1)..( 8): Result.003 file - promoters60/4771928
attgttgt

SEQ ID NO: 140924 - DNA, 10 bp, Unknown
  misc_feature (1)..( 10): Result.003 file - promoters60/4771928
ttttaaaaga

SEQ ID NO: 140925 - DNA, 10 bp, Unknown
  misc_feature (1)..( 10): Result.003 file - promoters60/4771928
tttcaaaaaa

SEQ ID NO: 140926 - DNA, 10 bp, Unknown
  misc_feature (1)..( 10): Result.003 file - promoters60/4771928
ttgcaaaaaa

SEQ ID NO: 140927 - DNA, 10 bp, Unknown
  misc_feature (1)..( 10): Result.003 file - promoters60/4771928
cttcacaaac

SEQ ID NO: 140928 - DNA, 16 bp, Unknown
  misc_feature (1)..( 16): Result.003 file - promoters60/4771928
agaactactattcgtg

SEQ ID NO: 140929 - DNA, 16 bp, Unknown
  misc_feature (1)..( 16): Result.003 file - promoters60/4771928
aagtcagctatttgtg

SEQ ID NO: 140930 - DNA, 16 bp, Unknown
  misc_feature (1)..( 16): Result.003 file - promoters60/4771928
agaaatacaattttgt

SEQ ID NO: 140931 - DNA, 6 bp, Unknown
  misc_feature (1)..( 6): Result.003 file - promoters60/4771952
attctc

SEQ ID NO: 140932 - DNA, 6 bp, Unknown
  misc_feature (1)..( 6): Result.003 file - promoters60/4771952
attctc

SEQ ID NO: 140933 - DNA, 8 bp, Unknown
  misc_feature (1)..( 8): Result.003 file - promoters60/4771952
aacaaatt

SEQ ID NO: 140934 - DNA, 8 bp, Unknown
  misc_feature (1)..( 8): Result.003 file - promoters60/4771952
ctcaaatt

SEQ ID NO: 140935 - DNA, 8 bp, Unknown
  misc_feature (1)..( 8): Result.003 file - promoters60/4771952
ctcacatt

SEQ ID NO: 140936 - DNA, 7 bp, Unknown
  misc_feature (1)..( 7): Result.003 file - promoters60/4771952
tacaaaa

SEQ ID NO: 140937 - DNA, 7 bp, Unknown
  misc_feature (1)..( 7): Result.003 file - promoters60/4771952
tacgaaa

SEQ ID NO: 140938 - DNA, 7 bp, Unknown
  misc_feature (1)..( 7): Result.003 file - promoters60/4771952
aaagagg

SEQ ID NO: 140939 - DNA, 7 bp, Unknown
  misc_feature (1)..( 7): Result.003 file - promoters60/4771952
aaaaagg

SEQ ID NO: 140940 - DNA, 6 bp, Unknown
  misc_feature (1)..( 6): Result.003 file - promoters60/4771952
tattta

SEQ ID NO: 140941 - DNA, 6 bp, Unknown
  misc_feature (1)..( 6): Result.003 file - promoters60/4771952
tattta

SEQ ID NO: 140942 - DNA, 6 bp, Unknown
  misc_feature (1)..( 6): Result.003 file - promoters60/4771952
cttcaa

SEQ ID NO: 140943 - DNA, 6 bp, Unknown
  misc_feature (1)..( 6): Result.003 file - promoters60/4771952
cttcaa

SEQ ID NO: 140944 - DNA, 6 bp, Unknown
  misc_feature (1)..( 6): Result.003 file - promoters60/4771952
tcttac

SEQ ID NO: 140945 - DNA, 6 bp, Unknown
  misc_feature (1)..( 6): Result.003 file - promoters60/4771952
tcttac

SEQ ID NO: 140946 - DNA, 6 bp, Unknown
  misc_feature (1)..( 6): Result.003 file - promoters60/4771952
tgataa

SEQ ID NO: 140947 - DNA, 6 bp, Unknown
  misc_feature (1)..( 6): Result.003 file - promoters60/4771952
tgataa

SEQ ID NO: 140948 - DNA, 7 bp, Unknown
  misc_feature (1)..( 7): Result.003 file - promoters60/4771952
ttaagtt

SEQ ID NO: 140949 - DNA, 7 bp, Unknown
  misc_feature (1)..( 7): Result.003 file - promoters60/4771952
ttaggtt

SEQ ID NO: 140950 - DNA, 8 bp, Unknown
  misc_feature (1)..( 8): Result.003 file - promoters60/4771952
tattgttg

SEQ ID NO: 140951 - DNA, 8 bp, Unknown
  misc_feature (1)..( 8): Result.003 file - promoters60/4771952
tatagttg

SEQ ID NO: 140952 - DNA, 6 bp, Unknown
  misc_feature (1)..( 6): Result.003 file - promoters60/4771952
gaaaaa

SEQ ID NO: 140953 - DNA, 6 bp, Unknown
  misc_feature (1)..( 6): Result.003 file - promoters60/4771952
gaaaaa

SEQ ID NO: 140954 - DNA, 8 bp, Unknown
  misc_feature (1)..( 8): Result.003 file - promoters60/4771952
tgtataga

SEQ ID NO: 140955 - DNA, 8 bp, Unknown
  misc_feature (1)..( 8): Result.003 file - promoters60/4771952
tgtttaga

SEQ ID NO: 140956 - DNA, 7 bp, Unknown
  misc_feature (1)..( 7): Result.003 file - promoters60/4771952
aaagata

SEQ ID NO: 140957 - DNA, 7 bp, Unknown
  misc_feature (1)..( 7): Result.003 file - promoters60/4771952
aaaaata

SEQ ID NO: 140958 - DNA, 7 bp, Unknown
  misc_feature (1)..( 7): Result.003 file - promoters60/4771952
ataatat

SEQ ID NO: 140959 - DNA, 7 bp, Unknown
  misc_feature (1)..( 7): Result.003 file - promoters60/4771952
ataatat

SEQ ID NO: 140960 - DNA, 7 bp, Unknown
  misc_feature (1)..( 7): Result.003 file - promoters60/4771952
aaatgct

SEQ ID NO: 140961 - DNA, 7 bp, Unknown
  misc_feature (1)..( 7): Result.003 file - promoters60/4771952
aaacgct

SEQ ID NO: 140962 - DNA, 9 bp, Unknown
  misc_feature (1)..( 9): Result.003 file - promoters60/4771952
aaaagaaaa

SEQ ID NO: 140963 - DNA, 9 bp, Unknown
  misc_feature (1)..( 9): Result.003 file - promoters60/4771952
aaatgaaaa

SEQ ID NO: 140964 - DNA, 7 bp, Unknown
  misc_feature (1)..( 7): Result.003 file - promoters60/4771952
ctggaat

SEQ ID NO: 140965 - DNA, 7 bp, Unknown
  misc_feature (1)..( 7): Result.003 file - promoters60/4771952
ctgtaat

SEQ ID NO: 140966 - DNA, 7 bp, Unknown
  misc_feature (1)..( 7): Result.003 file - promoters60/4771952
aaacctt

SEQ ID NO: 140967 - DNA, 7 bp, Unknown
  misc_feature (1)..( 7): Result.003 file - promoters60/4771952
aaaactt

SEQ ID NO: 140968 - DNA, 8 bp, Unknown
  misc_feature (1)..( 8): Result.003 file - promoters60/4771952
cttaatta

SEQ ID NO: 140969 - DNA, 8 bp, Unknown
  misc_feature (1)..( 8): Result.003 file - promoters60/4771952
cttattta

SEQ ID NO: 140970 - DNA, 7 bp, Unknown
  misc_feature (1)..( 7): Result.003 file - promoters60/4771952
cacatat

SEQ ID NO: 140971 - DNA, 7 bp, Unknown
  misc_feature (1)..( 7): Result.003 file - promoters60/4771952
cacctat

SEQ ID NO: 140972 - DNA, 6 bp, Unknown
  misc_feature (1)..( 6): Result.003 file - promoters60/4771956
acactg

SEQ ID NO: 140973 - DNA, 6 bp, Unknown
  misc_feature (1)..( 6): Result.003 file - promoters60/4771956
acactg

SEQ ID NO: 140974 - DNA, 6 bp, Unknown
  misc_feature (1)..( 6): Result.003 file - promoters60/4771956
ccgttg

SEQ ID NO: 140975 - DNA, 6 bp, Unknown
  misc_feature (1)..( 6): Result.003 file - promoters60/4771956
ccgttg

SEQ ID NO: 140976 - DNA, 7 bp, Unknown
  misc_feature (1)..( 7): Result.003 file - promoters60/4771956
gtttatg

SEQ ID NO: 140977 - DNA, 7 bp, Unknown
  misc_feature (1)..( 7): Result.003 file - promoters60/4771956
gtttatt

SEQ ID NO: 140978 - DNA, 7 bp, Unknown
  misc_feature (1)..( 7): Result.003 file - promoters60/4771956
ttttatt

SEQ ID NO: 140979 - DNA, 6 bp, Unknown
  misc_feature (1)..( 6): Result.003 file - promoters60/4771956
cataat

SEQ ID NO: 140980 - DNA, 6 bp, Unknown
  misc_feature (1)..( 6): Result.003 file - promoters60/4771956
cataat

SEQ ID NO: 140981 - DNA, 6 bp, Unknown
  misc_feature (1)..( 6): Result.003 file - promoters60/4771956
ataagt

SEQ ID NO: 140982 - DNA, 6 bp, Unknown
  misc_feature (1)..( 6): Result.003 file - promoters60/4771956
ataagt

SEQ ID NO: 140983 - DNA, 6 bp, Unknown
  misc_feature (1)..( 6): Result.003 file - promoters60/4771956
aacaaa

SEQ ID NO: 140984 - DNA, 6 bp, Unknown
  misc_feature (1)..( 6): Result.003 file - promoters60/4771956
aacaaa

SEQ ID NO: 140985 - DNA, 7 bp, Unknown
  misc_feature (1)..( 7): Result.003 file - promoters60/4771956
tctcaac

SEQ ID NO: 140986 - DNA, 7 bp, Unknown
  misc_feature (1)..( 7): Result.003 file - promoters60/4771956
tctgaac

SEQ ID NO: 140987 - DNA, 6 bp, Unknown
  misc_feature (1)..( 6): Result.003 file - promoters60/4771956
tagaaa

SEQ ID NO: 140988 - DNA, 6 bp, Unknown
  misc_feature (1)..( 6): Result.003 file - promoters60/4771956
tagaaa

SEQ ID NO: 140989 - DNA, 7 bp, Unknown
  misc_feature (1)..( 7): Result.003 file - promoters60/4771956
aaagtag

SEQ ID NO: 140990 - DNA, 7 bp, Unknown
  misc_feature (1)..( 7): Result.003 file - promoters60/4771956
aaaatag

SEQ ID NO: 140991 - DNA, 6 bp, Unknown
  misc_feature (1)..( 6): Result.003 file - promoters60/4771956
aaaaaa

SEQ ID NO: 140992 - DNA, 6 bp, Unknown
  misc_feature (1)..( 6): Result.003 file - promoters60/4771956
aaaaaa

SEQ ID NO: 140993 - DNA, 8 bp, Unknown
  misc_feature (1)..( 8): Result.003 file - promoters60/4771956
atttgtca

SEQ ID NO: 140994 - DNA, 8 bp, Unknown
  misc_feature (1)..( 8): Result.003 file - promoters60/4771956
atttttca

SEQ ID NO: 140995 - DNA, 7 bp, Unknown
  misc_feature (1)..( 7): Result.003 file - promoters60/4771956
ttaatta

SEQ ID NO: 140996 - DNA, 7 bp, Unknown
  misc_feature (1)..( 7): Result.003 file - promoters60/4771956
ttactta

SEQ ID NO: 140997 - DNA, 8 bp, Unknown
  misc_feature (1)..( 8): Result.003 file - promoters60/4771956
ccatcaac

SEQ ID NO: 140998 - DNA, 8 bp, Unknown
  misc_feature (1)..( 8): Result.003 file - promoters60/4771956
ccagcaac

SEQ ID NO: 140999 - DNA, 6 bp, Unknown
  misc_feature (1)..( 6): Result.003 file - promoters60/4771956
ataatt

SEQ ID NO: 141000 - DNA, 6 bp, Unknown
  misc_feature (1)..( 6): Result.003 file - promoters60/4771956
ataatt

SEQ ID NO: 141001 - DNA, 7 bp, Unknown
  misc_feature (1)..( 7): Result.003 file - promoters60/4771956
ctagttt

SEQ ID NO: 141002 - DNA, 7 bp, Unknown
  misc_feature (1)..( 7): Result.003 file - promoters60/4771956
ctatttt

SEQ ID NO: 141003 - DNA, 7 bp, Unknown
  misc_feature (1)..( 7): Result.003 file - promoters60/4771956
cactcaa

SEQ ID NO: 141004 - DNA, 7 bp, Unknown
  misc_feature (1)..( 7): Result.003 file - promoters60/4771956
cacacaa

SEQ ID NO: 141005 - DNA, 6 bp, Unknown
  misc_feature (1)..( 6): Result.003 file - promoters60/4771956
cctttt

SEQ ID NO: 141006 - DNA, 6 bp, Unknown
  misc_feature (1)..( 6): Result.003 file - promoters60/4771956
cctttt

SEQ ID NO: 141007 - DNA, 6 bp, Unknown
  misc_feature (1)..( 6): Result.003 file - promoters60/4771956
cataaa

SEQ ID NO: 141008 - DNA, 6 bp, Unknown
  misc_feature (1)..( 6): Result.003 file - promoters60/4771956
cataaa

SEQ ID NO: 141009 - DNA, 7 bp, Unknown
  misc_feature (1)..( 7): Result.003 file - promoters60/4771956
aaaactc

SEQ ID NO: 141010 - DNA, 7 bp, Unknown
  misc_feature (1)..( 7): Result.003 file - promoters60/4771956
aaatctc

SEQ ID NO: 141011 - DNA, 8 bp, Unknown
  misc_feature (1)..( 8): Result.003 file - promoters60/4771960
ttagttgc

SEQ ID NO: 141012 - DNA, 8 bp, Unknown
  misc_feature (1)..( 8): Result.003 file - promoters60/4771960
ttagttgc

SEQ ID NO: 141013 - DNA, 8 bp, Unknown
  misc_feature (1)..( 8): Result.003 file - promoters60/4771960
attacatc

SEQ ID NO: 141014 - DNA, 8 bp, Unknown
  misc_feature (1)..( 8): Result.003 file - promoters60/4771960
attaaatc

SEQ ID NO: 141015 - DNA, 9 bp, Unknown
  misc_feature (1)..( 9): Result.003 file - promoters60/4771960
gaaaattat

SEQ ID NO: 141016 - DNA, 9 bp, Unknown
  misc_feature (1)..( 9): Result.003 file - promoters60/4771960
gaaatttat

SEQ ID NO: 141017 - DNA, 8 bp, Unknown
  misc_feature (1)..( 8): Result.003 file - promoters60/4771960
tagaattc

SEQ ID NO: 141018 - DNA, 8 bp, Unknown
  misc_feature (1)..( 8): Result.003 file - promoters60/4771960
tagacttc

SEQ ID NO: 141019 - DNA, 8 bp, Unknown
  misc_feature (1)..( 8): Result.003 file - promoters60/4771960
ctttgaaa

SEQ ID NO: 141020 - DNA, 8 bp, Unknown
  misc_feature (1)..( 8): Result.003 file - promoters60/4771960
cttttaaa

SEQ ID NO: 141021 - DNA, 9 bp, Unknown
  misc_feature (1)..( 9): Result.003 file - promoters60/4771960
ctataaata

SEQ ID NO: 141022 - DNA, 9 bp, Unknown
  misc_feature (1)..( 9): Result.003 file - promoters60/4771960
ctattaata

SEQ ID NO: 141023 - DNA, 6 bp, Unknown
  misc_feature (1)..( 6): Result.003 file - promoters60/4771960
aagatt

SEQ ID NO: 141024 - DNA, 6 bp, Unknown
  misc_feature (1)..( 6): Result.003 file - promoters60/4771960
aagatt

SEQ ID NO: 141025 - DNA, 8 bp, Unknown
  misc_feature (1)..( 8): Result.003 file - promoters60/4771960
gttgtttt

SEQ ID NO: 141026 - DNA, 8 bp, Unknown
  misc_feature (1)..( 8): Result.003 file - promoters60/4771960
gttgcttt

SEQ ID NO: 141027 - DNA, 6 bp, Unknown
  misc_feature (1)..( 6): Result.003 file - promoters60/4771960
agaaga

SEQ ID NO: 141028 - DNA, 6 bp, Unknown
  misc_feature (1)..( 6): Result.003 file - promoters60/4771960
agaaga

SEQ ID NO: 141029 - DNA, 11 bp, Unknown
  misc_feature (1)..( 11): Result.003 file - promoters60/4771960
aaagtgacata

SEQ ID NO: 141030 - DNA, 11 bp, Unknown
  misc_feature (1)..( 11): Result.003 file - promoters60/4771960
aaattgatata

SEQ ID NO: 141031 - DNA, 8 bp, Unknown
  misc_feature (1)..( 8): Result.003 file - promoters60/4771960
aaaaaagt

SEQ ID NO: 141032 - DNA, 8 bp, Unknown
  misc_feature (1)..( 8): Result.003 file - promoters60/4771960
caaaaaga

SEQ ID NO: 141033 - DNA, 8 bp, Unknown
  misc_feature (1)..( 8): Result.003 file - promoters60/4771960
caataaga

SEQ ID NO: 141034 - DNA, 8 bp, Unknown
  misc_feature (1)..( 8): Result.003 file - promoters60/4771960
ccgaaaat

SEQ ID NO: 141035 - DNA, 8 bp, Unknown
  misc_feature (1)..( 8): Result.003 file - promoters60/4771960
ccgaaaat

SEQ ID NO: 141036 - DNA, 6 bp, Unknown
  misc_feature (1)..( 6): Result.003 file - promoters60/4771960
tgaaca

SEQ ID NO: 141037 - DNA, 6 bp, Unknown
  misc_feature (1)..( 6): Result.003 file - promoters60/4771960
tgaaca

SEQ ID NO: 141038 - DNA, 7 bp, Unknown
  misc_feature (1)..( 7): Result.003 file - promoters60/4771960
aaaaaca

SEQ ID NO: 141039 - DNA, 7 bp, Unknown
  misc_feature (1)..( 7): Result.003 file - promoters60/4771960
aaagaca

SEQ ID NO: 141040 - DNA, 8 bp, Unknown
  misc_feature (1)..( 8): Result.003 file - promoters60/4771960
aatacttg

SEQ ID NO: 141041 - DNA, 8 bp, Unknown
  misc_feature (1)..( 8): Result.003 file - promoters60/4771960
aatagttg

SEQ ID NO: 141042 - DNA, 8 bp, Unknown
  misc_feature (1)..( 8): Result.003 file - promoters60/4771960
aaaattac

SEQ ID NO: 141043 - DNA, 8 bp, Unknown
  misc_feature (1)..( 8): Result.003 file - promoters60/4771960
aaaattac

SEQ ID NO: 141044 - DNA, 6 bp, Unknown
  misc_feature (1)..( 6): Result.003 file - promoters60/4771960
atcaat

SEQ ID NO: 141045 - DNA, 6 bp, Unknown
  misc_feature (1)..( 6): Result.003 file - promoters60/4771960
atcaat

SEQ ID NO: 141046 - DNA, 11 bp, Unknown
  misc_feature (1)..( 11): Result.003 file - promoters60/4771960
caaaaacaaaa

SEQ ID NO: 141047 - DNA, 11 bp, Unknown
  misc_feature (1)..( 11): Result.003 file - promoters60/4771960
caaaaataaaa

SEQ ID NO: 141048 - DNA, 10 bp, Unknown
  misc_feature (1)..( 10): Result.003 file - promoters60/4771968
taaaaatgtc

SEQ ID NO: 141049 - DNA, 10 bp, Unknown
  misc_feature (1)..( 10): Result.003 file - promoters60/4771968
taaaaaaatg

SEQ ID NO: 141050 - DNA, 10 bp, Unknown
  misc_feature (1)..( 10): Result.003 file - promoters60/4771968
gaaaataatg

SEQ ID NO: 141051 - DNA, 8 bp, Unknown
  misc_feature (1)..( 8): Result.003 file - promoters60/4771968
aaaagtgt

SEQ ID NO: 141052 - DNA, 8 bp, Unknown
  misc_feature (1)..( 8): Result.003 file - promoters60/4771968
aaaaatgt

SEQ ID NO: 141053 - DNA, 8 bp, Unknown
  misc_feature (1)..( 8): Result.003 file - promoters60/4771968
aaaaatga

SEQ ID NO: 141054 - DNA, 11 bp, Unknown
  misc_feature (1)..( 11): Result.003 file - promoters60/4771968
taaagaaatct

SEQ ID NO: 141055 - DNA, 11 bp, Unknown
  misc_feature (1)..( 11): Result.003 file - promoters60/4771968
taaaaaaagga

SEQ ID NO: 141056 - DNA, 11 bp, Unknown
  misc_feature (1)..( 11): Result.003 file - promoters60/4771968
aaaaataagga

SEQ ID NO: 141057 - DNA, 9 bp, Unknown
  misc_feature (1)..( 9): Result.003 file - promoters60/4771972
ttttttttg

SEQ ID NO: 141058 - DNA, 9 bp, Unknown
  misc_feature (1)..( 9): Result.003 file - promoters60/4771972
ttttctttg

SEQ ID NO: 141059 - DNA, 7 bp, Unknown
  misc_feature (1)..( 7): Result.003 file - promoters60/4771972
taaaaat

SEQ ID NO: 141060 - DNA, 7 bp, Unknown
  misc_feature (1)..( 7): Result.003 file - promoters60/4771972
taaaaag

SEQ ID NO: 141061 - DNA, 7 bp, Unknown
  misc_feature (1)..( 7): Result.003 file - promoters60/4771972
taataat

SEQ ID NO: 141062 - DNA, 8 bp, Unknown
  misc_feature (1)..( 8): Result.003 file - promoters60/4771972
aagttatg

SEQ ID NO: 141063 - DNA, 8 bp, Unknown
  misc_feature (1)..( 8): Result.003 file - promoters60/4771972
aagatatg

SEQ ID NO: 141064 - DNA, 8 bp, Unknown
  misc_feature (1)..( 8): Result.003 file - promoters60/4771972
ttttattt

SEQ ID NO: 141065 - DNA, 8 bp, Unknown
  misc_feature (1)..( 8): Result.003 file - promoters60/4771972
ttttgttt

SEQ ID NO: 141066 - DNA, 7 bp, Unknown
  misc_feature (1)..( 7): Result.003 file - promoters60/4771972
tttcatt

SEQ ID NO: 141067 - DNA, 7 bp, Unknown
  misc_feature (1)..( 7): Result.003 file - promoters60/4771972
tttaatt

SEQ ID NO: 141068 - DNA, 9 bp, Unknown
  misc_feature (1)..( 9): Result.003 file - promoters60/4771972
ctaactaaa

SEQ ID NO: 141069 - DNA, 9 bp, Unknown
  misc_feature (1)..( 9): Result.003 file - promoters60/4771972
gaaacaaaa

SEQ ID NO: 141070 - DNA, 9 bp, Unknown
  misc_feature (1)..( 9): Result.003 file - promoters60/4771972
gaaagaaag

SEQ ID NO: 141071 - DNA, 6 bp, Unknown
  misc_feature (1)..( 6): Result.003 file - promoters60/4771972
tttgtt

SEQ ID NO: 141072 - DNA, 6 bp, Unknown
  misc_feature (1)..( 6): Result.003 file - promoters60/4771972
tttgtt

SEQ ID NO: 141073 - DNA, 6 bp, Unknown
  misc_feature (1)..( 6): Result.003 file - promoters60/4771972
aaaact

SEQ ID NO: 141074 - DNA, 6 bp, Unknown
  misc_feature (1)..( 6): Result.003 file - promoters60/4771972
aaaact

SEQ ID NO: 141075 - DNA, 7 bp, Unknown
  misc_feature (1)..( 7): Result.003 file - promoters60/4771972
atataaa

SEQ ID NO: 141076 - DNA, 7 bp, Unknown
  misc_feature (1)..( 7): Result.003 file - promoters60/4771972
ataaaaa

SEQ ID NO: 141077 - DNA, 10 bp, Unknown
  misc_feature (1)..( 10): Result.003 file - promoters60/4771972
taaaataaca

SEQ ID NO: 141078 - DNA, 10 bp, Unknown
  misc_feature (1)..( 10): Result.003 file - promoters60/4771972
taaagtaaag

SEQ ID NO: 141079 - DNA, 10 bp, Unknown
  misc_feature (1)..( 10): Result.003 file - promoters60/4771972
aaaagaaaag

SEQ ID NO: 141080 - DNA, 6 bp, Unknown
  misc_feature (1)..( 6): Result.003 file - promoters60/4771972
aaagct

SEQ ID NO: 141081 - DNA, 6 bp, Unknown
  misc_feature (1)..( 6): Result.003 file - promoters60/4771972
aaagct

SEQ ID NO: 141082 - DNA, 6 bp, Unknown
  misc_feature (1)..( 6): Result.003 file - promoters60/4771972
agtaaa

SEQ ID NO: 141083 - DNA, 6 bp, Unknown
  misc_feature (1)..( 6): Result.003 file - promoters60/4771972
agtaaa

SEQ ID NO: 141084 - DNA, 7 bp, Unknown
  misc_feature (1)..( 7): Result.003 file - promoters60/4771972
aatcggg

SEQ ID NO: 141085 - DNA, 7 bp, Unknown
  misc_feature (1)..( 7): Result.003 file - promoters60/4771972
aattggg

SEQ ID NO: 141086 - DNA, 10 bp, Unknown
  misc_feature (1)..( 10): Result.003 file - promoters60/4771972
ggaaaagaaa

SEQ ID NO: 141087 - DNA, 10 bp, Unknown
  misc_feature (1)..( 10): Result.003 file - promoters60/4771972
ggaaatgaaa

SEQ ID NO: 141088 - DNA, 7 bp, Unknown
  misc_feature (1)..( 7): Result.003 file - promoters60/4771972
cccacta

SEQ ID NO: 141089 - DNA, 7 bp, Unknown
  misc_feature (1)..( 7): Result.003 file - promoters60/4771972
cccacta

SEQ ID NO: 141090 - DNA, 7 bp, Unknown
  misc_feature (1)..( 7): Result.003 file - promoters60/4771972
gtatata

SEQ ID NO: 141091 - DNA, 7 bp, Unknown
  misc_feature (1)..( 7): Result.003 file - promoters60/4771972
gtatata

SEQ ID NO: 141092 - DNA, 7 bp, Unknown
  misc_feature (1)..( 7): Result.003 file - promoters60/4771983
aattttt

SEQ ID NO: 141093 - DNA, 7 bp, Unknown
  misc_feature (1)..( 7): Result.003 file - promoters60/4771983
aattttt

SEQ ID NO: 141094 - DNA, 8 bp, Unknown
  misc_feature (1)..( 8): Result.003 file - promoters60/4771983
tttttgtt

SEQ ID NO: 141095 - DNA, 8 bp, Unknown
  misc_feature (1)..( 8): Result.003 file - promoters60/4771983
tttttgtt

SEQ ID NO: 141096 - DNA, 7 bp, Unknown
  misc_feature (1)..( 7): Result.003 file - promoters60/4771983
ataaaat

SEQ ID NO: 141097 - DNA, 7 bp, Unknown
  misc_feature (1)..( 7): Result.003 file - promoters60/4771983
ataaaat

SEQ ID NO: 141098 - DNA, 11 bp, Unknown
  misc_feature (1)..( 11): Result.003 file - promoters60/4771983
ctaatttgata

SEQ ID NO: 141099 - DNA, 11 bp, Unknown
  misc_feature (1)..( 11): Result.003 file - promoters60/4771983
ttaattttata

SEQ ID NO: 141100 - DNA, 11 bp, Unknown
  misc_feature (1)..( 11): Result.003 file - promoters60/4771983
ttaatttattt

SEQ ID NO: 141101 - DNA, 7 bp, Unknown
  misc_feature (1)..( 7): Result.003 file - promoters60/4771983
tagcttt

SEQ ID NO: 141102 - DNA, 7 bp, Unknown
  misc_feature (1)..( 7): Result.003 file - promoters60/4771983
tagtttt

SEQ ID NO: 141103 - DNA, 7 bp, Unknown
  misc_feature (1)..( 7): Result.003 file - promoters60/4771983
tagtttt

SEQ ID NO: 141104 - DNA, 7 bp, Unknown
  misc_feature (1)..( 7): Result.003 file - promoters60/4771983
ttctctt

SEQ ID NO: 141105 - DNA, 7 bp, Unknown
  misc_feature (1)..( 7): Result.003 file - promoters60/4771983
ttctctt

SEQ ID NO: 141106 - DNA, 8 bp, Unknown
  misc_feature (1)..( 8): Result.003 file - promoters60/4771983
gttttttt

SEQ ID NO: 141107 - DNA, 8 bp, Unknown
  misc_feature (1)..( 8): Result.003 file - promoters60/4771983
gttttttt

SEQ ID NO: 141108 - DNA, 8 bp, Unknown
  misc_feature (1)..( 8): Result.003 file - promoters60/4771983
aattttcg

SEQ ID NO: 141109 - DNA, 8 bp, Unknown
  misc_feature (1)..( 8): Result.003 file - promoters60/4771983
aatattcg

SEQ ID NO: 141110 - DNA, 7 bp, Unknown
  misc_feature (1)..( 7): Result.003 file - promoters60/4771983
ttttttt

SEQ ID NO: 141111 - DNA, 7 bp, Unknown
  misc_feature (1)..( 7): Result.003 file - promoters60/4771983
tttattt

SEQ ID NO: 141112 - DNA, 7 bp, Unknown
  misc_feature (1)..( 7): Result.003 file - promoters60/4771983
taaacaa

SEQ ID NO: 141113 - DNA, 7 bp, Unknown
  misc_feature (1)..( 7): Result.003 file - promoters60/4771983
taatcaa

SEQ ID NO: 141114 - DNA, 6 bp, Unknown
  misc_feature (1)..( 6): Result.003 file - promoters60/4771983
taagaa

SEQ ID NO: 141115 - DNA, 6 bp, Unknown
  misc_feature (1)..( 6): Result.003 file - promoters60/4771983
taagaa

SEQ ID NO: 141116 - DNA, 6 bp, Unknown
  misc_feature (1)..( 6): Result.003 file - promoters60/4771983
tttggt

SEQ ID NO: 141117 - DNA, 6 bp, Unknown
  misc_feature (1)..( 6): Result.003 file - promoters60/4771983
tttggt

SEQ ID NO: 141118 - DNA, 7 bp, Unknown
  misc_feature (1)..( 7): Result.003 file - promoters60/4771983
ttaaatt

SEQ ID NO: 141119 - DNA, 7 bp, Unknown
  misc_feature (1)..( 7): Result.003 file - promoters60/4771983
ttacatt

SEQ ID NO: 141120 - DNA, 6 bp, Unknown
  misc_feature (1)..( 6): Result.003 file - promoters60/4771983
atggaa

SEQ ID NO: 141121 - DNA, 6 bp, Unknown
  misc_feature (1)..( 6): Result.003 file - promoters60/4771983
atggaa

SEQ ID NO: 141122 - DNA, 8 bp, Unknown
  misc_feature (1)..( 8): Result.003 file - promoters60/4771983
aacctttt

SEQ ID NO: 141123 - DNA, 8 bp, Unknown
  misc_feature (1)..( 8): Result.003 file - promoters60/4771983
aacatttt

SEQ ID NO: 141124 - DNA, 7 bp, Unknown
  misc_feature (1)..( 7): Result.003 file - promoters60/4771983
tatgact

SEQ ID NO: 141125 - DNA, 7 bp, Unknown
  misc_feature (1)..( 7): Result.003 file - promoters60/4771983
tataact

SEQ ID NO: 141126 - DNA, 6 bp, Unknown
  misc_feature (1)..( 6): Result.003 file - promoters60/4771983
ttttta

SEQ ID NO: 141127 - DNA, 6 bp, Unknown
  misc_feature (1)..( 6): Result.003 file - promoters60/4771983
ttttta

SEQ ID NO: 141128 - DNA, 6 bp, Unknown
  misc_feature (1)..( 6): Result.003 file - promoters60/4771990
tttatt

SEQ ID NO: 141129 - DNA, 6 bp, Unknown
  misc_feature (1)..( 6): Result.003 file - promoters60/4771990
tttatt

SEQ ID NO: 141130 - DNA, 8 bp, Unknown
  misc_feature (1)..( 8): Result.003 file - promoters60/4771990
aattaaat

SEQ ID NO: 141131 - DNA, 8 bp, Unknown
  misc_feature (1)..( 8): Result.003 file - promoters60/4771990
aataaaat

SEQ ID NO: 141132 - DNA, 8 bp, Unknown
  misc_feature (1)..( 8): Result.003 file - promoters60/4771990
aatgaaat

SEQ ID NO: 141133 - DNA, 7 bp, Unknown
  misc_feature (1)..( 7): Result.003 file - promoters60/4771990
aaaaaaa

SEQ ID NO: 141134 - DNA, 7 bp, Unknown
  misc_feature (1)..( 7): Result.003 file - promoters60/4771990
aaataaa

SEQ ID NO: 141135 - DNA, 6 bp, Unknown
  misc_feature (1)..( 6): Result.003 file - promoters60/4771990
aaataa

SEQ ID NO: 141136 - DNA, 6 bp, Unknown
  misc_feature (1)..( 6): Result.003 file - promoters60/4771990
aaataa

SEQ ID NO: 141137 - DNA, 6 bp, Unknown
  misc_feature (1)..( 6): Result.003 file - promoters60/4771990
aacatt

SEQ ID NO: 141138 - DNA, 6 bp, Unknown
  misc_feature (1)..( 6): Result.003 file - promoters60/4771990
aacatt

SEQ ID NO: 141139 - DNA, 7 bp, Unknown
  misc_feature (1)..( 7): Result.003 file - promoters60/4771990
aaaacaa

SEQ ID NO: 141140 - DNA, 7 bp, Unknown
  misc_feature (1)..( 7): Result.003 file - promoters60/4771990
aaaccaa

SEQ ID NO: 141141 - DNA, 10 bp, Unknown
  misc_feature (1)..( 10): Result.003 file - promoters60/4771990
taaacaaaaa

SEQ ID NO: 141142 - DNA, 10 bp, Unknown
  misc_feature (1)..( 10): Result.003 file - promoters60/4771990
taaagaaaaa

SEQ ID NO: 141143 - DNA, 8 bp, Unknown
  misc_feature (1)..( 8): Result.003 file - promoters60/4771990
aaaataaa

SEQ ID NO: 141144 - DNA, 8 bp, Unknown
  misc_feature (1)..( 8): Result.003 file - promoters60/4771990
aaaagaaa

SEQ ID NO: 141145 - DNA, 6 bp, Unknown
  misc_feature (1)..( 6): Result.003 file - promoters60/4771990
ttattt

SEQ ID NO: 141146 - DNA, 6 bp, Unknown
  misc_feature (1)..( 6): Result.003 file - promoters60/4771990
ttattt

SEQ ID NO: 141147 - DNA, 6 bp, Unknown
  misc_feature (1)..( 6): Result.003 file - promoters60/4771990
agtaaa

SEQ ID NO: 141148 - DNA, 6 bp, Unknown
  misc_feature (1)..( 6): Result.003 file - promoters60/4771990
agtaaa

SEQ ID NO: 141149 - DNA, 7 bp, Unknown
  misc_feature (1)..( 7): Result.003 file - promoters60/4771990
aatcggg

SEQ ID NO: 141150 - DNA, 7 bp, Unknown
  misc_feature (1)..( 7): Result.003 file - promoters60/4771990
aattggg

SEQ ID NO: 141151 - DNA, 8 bp, Unknown
  misc_feature (1)..( 8): Result.003 file - promoters60/4771990
gaaagaaa

SEQ ID NO: 141152 - DNA, 8 bp, Unknown
  misc_feature (1)..( 8): Result.003 file - promoters60/4771990
gaaacaaa

SEQ ID NO: 141153 - DNA, 7 bp, Unknown
  misc_feature (1)..( 7): Result.003 file - promoters60/4771990
cccacta

SEQ ID NO: 141154 - DNA, 7 bp, Unknown
  misc_feature (1)..( 7): Result.003 file - promoters60/4771990
cccacta

SEQ ID NO: 141155 - DNA, 9 bp, Unknown
  misc_feature (1)..( 9): Result.003 file - promoters60/4771990
aaagaaaag

SEQ ID NO: 141156 - DNA, 9 bp, Unknown
  misc_feature (1)..( 9): Result.003 file - promoters60/4771990
aaagtaaag

SEQ ID NO: 141157 - DNA, 7 bp, Unknown
  misc_feature (1)..( 7): Result.003 file - promoters60/4771990
gtatata

SEQ ID NO: 141158 - DNA, 7 bp, Unknown
  misc_feature (1)..( 7): Result.003 file - promoters60/4771990
gtatata

SEQ ID NO: 141159 - DNA, 9 bp, Unknown
  misc_feature (1)..( 9): Result.003 file - promoters60/4772062
aacaattaa

SEQ ID NO: 141160 - DNA, 9 bp, Unknown
  misc_feature (1)..( 9): Result.003 file - promoters60/4772062
tataattaa

SEQ ID NO: 141161 - DNA, 9 bp, Unknown
  misc_feature (1)..( 9): Result.003 file - promoters60/4772062
cacaactaa

SEQ ID NO: 141162 - DNA, 9 bp, Unknown
  misc_feature (1)..( 9): Result.003 file - promoters60/4772062
tatgattat

SEQ ID NO: 141163 - DNA, 9 bp, Unknown
  misc_feature (1)..( 9): Result.003 file - promoters60/4772062
tatgattat

SEQ ID NO: 141164 - DNA, 8 bp, Unknown
  misc_feature (1)..( 8): Result.003 file - promoters60/4772062
ctttctta

SEQ ID NO: 141165 - DNA, 8 bp, Unknown
  misc_feature (1)..( 8): Result.003 file - promoters60/4772062
cttacttg

SEQ ID NO: 141166 - DNA, 8 bp, Unknown
  misc_feature (1)..( 8): Result.003 file - promoters60/4772062
atttttta

SEQ ID NO: 141167 - DNA, 8 bp, Unknown
  misc_feature (1)..( 8): Result.003 file - promoters60/4772062
attatttc

SEQ ID NO: 141168 - DNA, 8 bp, Unknown
  misc_feature (1)..( 8): Result.003 file - promoters60/4772062
tatattta

SEQ ID NO: 141169 - DNA, 10 bp, Unknown
  misc_feature (1)..( 10): Result.003 file - promoters60/4772062
tgaacaaaaa

SEQ ID NO: 141170 - DNA, 10 bp, Unknown
  misc_feature (1)..( 10): Result.003 file - promoters60/4772062
ataaccaaaa

SEQ ID NO: 141171 - DNA, 10 bp, Unknown
  misc_feature (1)..( 10): Result.003 file - promoters60/4772062
agaacaatag

SEQ ID NO: 141172 - DNA, 10 bp, Unknown
  misc_feature (1)..( 10): Result.003 file - promoters60/4772062
agaacatggc

SEQ ID NO: 141173 - DNA, 9 bp, Unknown
  misc_feature (1)..( 9): Result.003 file - promoters60/4772062
atatatatg

SEQ ID NO: 141174 - DNA, 9 bp, Unknown
  misc_feature (1)..( 9): Result.003 file - promoters60/4772062
ttatataag

SEQ ID NO: 141175 - DNA, 9 bp, Unknown
  misc_feature (1)..( 9): Result.003 file - promoters60/4772062
ctataaaag

SEQ ID NO: 141176 - DNA, 9 bp, Unknown
  misc_feature (1)..( 9): Result.003 file - promoters60/4772062
ctataagaa

SEQ ID NO: 141177 - DNA, 13 bp, Unknown
  misc_feature (1)..( 13): Result.003 file - promoters60/4772062
taaaccaaaaaaa

SEQ ID NO: 141178 - DNA, 13 bp, Unknown
  misc_feature (1)..( 13): Result.003 file - promoters60/4772062
aaaactaaatgat

SEQ ID NO: 141179 - DNA, 13 bp, Unknown
  misc_feature (1)..( 13): Result.003 file - promoters60/4772062
aaaattaaaaaaa

SEQ ID NO: 141180 - DNA, 13 bp, Unknown
  misc_feature (1)..( 13): Result.003 file - promoters60/4772062
tcggctatatgat

SEQ ID NO: 141181 - DNA, 9 bp, Unknown
  misc_feature (1)..( 9): Result.003 file - promoters60/4772062
aaaagatgc

SEQ ID NO: 141182 - DNA, 9 bp, Unknown
  misc_feature (1)..( 9): Result.003 file - promoters60/4772062
aaatgatat

SEQ ID NO: 141183 - DNA, 9 bp, Unknown
  misc_feature (1)..( 9): Result.003 file - promoters60/4772062
taattataa

SEQ ID NO: 141184 - DNA, 9 bp, Unknown
  misc_feature (1)..( 9): Result.003 file - promoters60/4772062
tgattataa

SEQ ID NO: 141185 - DNA, 8 bp, Unknown
  misc_feature (1)..( 8): Result.003 file - promoters60/4772062
caaagatt

SEQ ID NO: 141186 - DNA, 8 bp, Unknown
  misc_feature (1)..( 8): Result.003 file - promoters60/4772062
gaaaaatt

SEQ ID NO: 141187 - DNA, 8 bp, Unknown
  misc_feature (1)..( 8): Result.003 file - promoters60/4772062
gaaaaaga

SEQ ID NO: 141188 - DNA, 8 bp, Unknown
  misc_feature (1)..( 8): Result.003 file - promoters60/4772062
gaaaaaag

SEQ ID NO: 141189 - DNA, 11 bp, Unknown
  misc_feature (1)..( 11): Result.003 file - promoters60/4772062
agcctttgtga

SEQ ID NO: 141190 - DNA, 11 bp, Unknown
  misc_feature (1)..( 11): Result.003 file - promoters60/4772062
catttttgtga

SEQ ID NO: 141191 - DNA, 11 bp, Unknown
  misc_feature (1)..( 11): Result.003 file - promoters60/4772062
catttttgtcg

SEQ ID NO: 141192 - DNA, 11 bp, Unknown
  misc_feature (1)..( 11): Result.003 file - promoters60/4772062
aactttagtca

SEQ ID NO: 141193 - DNA, 10 bp, Unknown
  misc_feature (1)..( 10): Result.003 file - promoters60/4772062
gaagaaatat

SEQ ID NO: 141194 - DNA, 10 bp, Unknown
  misc_feature (1)..( 10): Result.003 file - promoters60/4772062
acttaaatat

SEQ ID NO: 141195 - DNA, 10 bp, Unknown
  misc_feature (1)..( 10): Result.003 file - promoters60/4772062
tgttaattat

SEQ ID NO: 141196 - DNA, 10 bp, Unknown
  misc_feature (1)..( 10): Result.003 file - promoters60/4772062
tgtcaatttt

SEQ ID NO: 141197 - DNA, 9 bp, Unknown
  misc_feature (1)..( 9): Result.003 file - promoters60/4772062
taaacaaag

SEQ ID NO: 141198 - DNA, 9 bp, Unknown
  misc_feature (1)..( 9): Result.003 file - promoters60/4772062
aaaagaaaa

SEQ ID NO: 141199 - DNA, 9 bp, Unknown
  misc_feature (1)..( 9): Result.003 file - promoters60/4772062
aaaagaatc

SEQ ID NO: 141200 - DNA, 9 bp, Unknown
  misc_feature (1)..( 9): Result.003 file - promoters60/4772062
aaaagaaga

SEQ ID NO: 141201 - DNA, 9 bp, Unknown
  misc_feature (1)..( 9): Result.003 file - promoters60/4772062
agaaaaaga

SEQ ID NO: 141202 - DNA, 9 bp, Unknown
  misc_feature (1)..( 9): Result.003 file - promoters60/4772062
agaaaaaga

SEQ ID NO: 141203 - DNA, 9 bp, Unknown
  misc_feature (1)..( 9): Result.003 file - promoters60/4772062
cgaaaaagg

SEQ ID NO: 141204 - DNA, 9 bp, Unknown
  misc_feature (1)..( 9): Result.003 file - promoters60/4772062
gaaaaaaga

SEQ ID NO: 141205 - DNA, 7 bp, Unknown
  misc_feature (1)..( 7): Result.003 file - promoters60/4772062
tgaaaag

SEQ ID NO: 141206 - DNA, 7 bp, Unknown
  misc_feature (1)..( 7): Result.003 file - promoters60/4772062
tgaaaaa

SEQ ID NO: 141207 - DNA, 7 bp, Unknown
  misc_feature (1)..( 7): Result.003 file - promoters60/4772062
agaaaaa

SEQ ID NO: 141208 - DNA, 7 bp, Unknown
  misc_feature (1)..( 7): Result.003 file - promoters60/4772062
agaaaaa

SEQ ID NO: 141209 - DNA, 12 bp, Unknown
  misc_feature (1)..( 12): Result.003 file - promoters60/4772070
ttcttcatttat

SEQ ID NO: 141210 - DNA, 12 bp, Unknown
  misc_feature (1)..( 12): Result.003 file - promoters60/4772070
ccaatcatatat

SEQ ID NO: 141211 - DNA, 12 bp, Unknown
  misc_feature (1)..( 12): Result.003 file - promoters60/4772070
tataaaatttat

SEQ ID NO: 141212 - DNA, 12 bp, Unknown
  misc_feature (1)..( 12): Result.003 file - promoters60/4772070
ttcttctttttt

SEQ ID NO: 141213 - DNA, 10 bp, Unknown
  misc_feature (1)..( 10): Result.003 file - promoters60/4772070
aataactttt

SEQ ID NO: 141214 - DNA, 10 bp, Unknown
  misc_feature (1)..( 10): Result.003 file - promoters60/4772070
aatcactaca

SEQ ID NO: 141215 - DNA, 10 bp, Unknown
  misc_feature (1)..( 10): Result.003 file - promoters60/4772070
tatatcttaa

SEQ ID NO: 141216 - DNA, 11 bp, Unknown
  misc_feature (1)..( 11): Result.003 file - promoters60/4772070
gctaacgtttc

SEQ ID NO: 141217 - DNA, 9 bp, Unknown
  misc_feature (1)..( 9): Result.003 file - promoters60/4772070
tgatgatac

SEQ ID NO: 141218 - DNA, 9 bp, Unknown
  misc_feature (1)..( 9): Result.003 file - promoters60/4772070
agatggtac

SEQ ID NO: 141219 - DNA, 9 bp, Unknown
  misc_feature (1)..( 9): Result.003 file - promoters60/4772070
tgatgaatc

SEQ ID NO: 141220 - DNA, 9 bp, Unknown
  misc_feature (1)..( 9): Result.003 file - promoters60/4772070
ttatggtat

SEQ ID NO: 141221 - DNA, 11 bp, Unknown
  misc_feature (1)..( 11): Result.003 file - promoters60/4772070
gaaaaacaaaa

SEQ ID NO: 141222 - DNA, 11 bp, Unknown
  misc_feature (1)..( 11): Result.003 file - promoters60/4772070
caaacacaaag

SEQ ID NO: 141223 - DNA, 11 bp, Unknown
  misc_feature (1)..( 11): Result.003 file - promoters60/4772070
tctttacaaag

SEQ ID NO: 141224 - DNA, 11 bp, Unknown
  misc_feature (1)..( 11): Result.003 file - promoters60/4772070
caatcactagt

SEQ ID NO: 141225 - DNA, 7 bp, Unknown
  misc_feature (1)..( 7): Result.003 file - promoters60/4772070
tttctta

SEQ ID NO: 141226 - DNA, 7 bp, Unknown
  misc_feature (1)..( 7): Result.003 file - promoters60/4772070
tttgtta

SEQ ID NO: 141227 - DNA, 7 bp, Unknown
  misc_feature (1)..( 7): Result.003 file - promoters60/4772070
tttatta

SEQ ID NO: 141228 - DNA, 8 bp, Unknown
  misc_feature (1)..( 8): Result.003 file - promoters60/4772070
tttcgtta

SEQ ID NO: 141229 - DNA, 7 bp, Unknown
  misc_feature (1)..( 7): Result.003 file - promoters60/4772084
aaaatct

SEQ ID NO: 141230 - DNA, 7 bp, Unknown
  misc_feature (1)..( 7): Result.003 file - promoters60/4772084
aaactct

SEQ ID NO: 141231 - DNA, 7 bp, Unknown
  misc_feature (1)..( 7): Result.003 file - promoters60/4772084
ggtactt

SEQ ID NO: 141232 - DNA, 7 bp, Unknown
  misc_feature (1)..( 7): Result.003 file - promoters60/4772084
ggtactt

SEQ ID NO: 141233 - DNA, 9 bp, Unknown
  misc_feature (1)..( 9): Result.003 file - promoters60/4772084
tcactcact

SEQ ID NO: 141234 - DNA, 9 bp, Unknown
  misc_feature (1)..( 9): Result.003 file - promoters60/4772084
tcactaact

SEQ ID NO: 141235 - DNA, 6 bp, Unknown
  misc_feature (1)..( 6): Result.003 file - promoters60/4772084
aactta

SEQ ID NO: 141236 - DNA, 6 bp, Unknown
  misc_feature (1)..( 6): Result.003 file - promoters60/4772084
aactta

SEQ ID NO: 141237 - DNA, 6 bp, Unknown
  misc_feature (1)..( 6): Result.003 file - promoters60/4772084
tttctt

SEQ ID NO: 141238 - DNA, 6 bp, Unknown
  misc_feature (1)..( 6): Result.003 file - promoters60/4772084
tttctt

SEQ ID NO: 141239 - DNA, 8 bp, Unknown
  misc_feature (1)..( 8): Result.003 file - promoters60/4772084
attctatt

SEQ ID NO: 141240 - DNA, 8 bp, Unknown
  misc_feature (1)..( 8): Result.003 file - promoters60/4772084
attcaatt

SEQ ID NO: 141241 - DNA, 6 bp, Unknown
  misc_feature (1)..( 6): Result.003 file - promoters60/4772084
aaatct

SEQ ID NO: 141242 - DNA, 6 bp, Unknown
  misc_feature (1)..( 6): Result.003 file - promoters60/4772084
aaatct

SEQ ID NO: 141243 - DNA, 8 bp, Unknown
  misc_feature (1)..( 8): Result.003 file - promoters60/4772084
actccaaa

SEQ ID NO: 141244 - DNA, 8 bp, Unknown
  misc_feature (1)..( 8): Result.003 file - promoters60/4772084
actgcaaa

SEQ ID NO: 141245 - DNA, 6 bp, Unknown
  misc_feature (1)..( 6): Result.003 file - promoters60/4772084
gaagat

SEQ ID NO: 141246 - DNA, 6 bp, Unknown
  misc_feature (1)..( 6): Result.003 file - promoters60/4772084
gaagat

SEQ ID NO: 141247 - DNA, 17 bp, Unknown
  misc_feature (1)..( 17): Result.003 file - promoters60/4772103
aaaaacaaaaaagttaa

SEQ ID NO: 141248 - DNA, 17 bp, Unknown
  misc_feature (1)..( 17): Result.003 file - promoters60/4772103
aaaaagaaaaaagttaa

SEQ ID NO: 141249 - DNA, 8 bp, Unknown
  misc_feature (1)..( 8): Result.003 file - promoters60/4772103
gaaaagtc

SEQ ID NO: 141250 - DNA, 8 bp, Unknown
  misc_feature (1)..( 8): Result.003 file - promoters60/4772103
gaatagtc

SEQ ID NO: 141251 - DNA, 9 bp, Unknown
  misc_feature (1)..( 9): Result.003 file - promoters60/4772103
cgcaaattt

SEQ ID NO: 141252 - DNA, 9 bp, Unknown
  misc_feature (1)..( 9): Result.003 file - promoters60/4772103
cgcatattt

SEQ ID NO: 141253 - DNA, 7 bp, Unknown
  misc_feature (1)..( 7): Result.003 file - promoters60/4772103
tgataca

SEQ ID NO: 141254 - DNA, 7 bp, Unknown
  misc_feature (1)..( 7): Result.003 file - promoters60/4772103
tgataca

SEQ ID NO: 141255 - DNA, 15 bp, Unknown
  misc_feature (1)..( 15): Result.003 file - promoters60/4772103
accaatcagaattgt

SEQ ID NO: 141256 - DNA, 15 bp, Unknown
  misc_feature (1)..( 15): Result.003 file - promoters60/4772103
accaatcagatttgt

SEQ ID NO: 141257 - DNA, 7 bp, Unknown
  misc_feature (1)..( 7): Result.003 file - promoters60/4772103
tctagtg

SEQ ID NO: 141258 - DNA, 7 bp, Unknown
  misc_feature (1)..( 7): Result.003 file - promoters60/4772103
tctcgtg

SEQ ID NO: 141259 - DNA, 6 bp, Unknown
  misc_feature (1)..( 6): Result.003 file - promoters60/4772103
ttaaag

SEQ ID NO: 141260 - DNA, 6 bp, Unknown
  misc_feature (1)..( 6): Result.003 file - promoters60/4772103
ttaaag

SEQ ID NO: 141261 - DNA, 6 bp, Unknown
  misc_feature (1)..( 6): Result.003 file - promoters60/4772103
gtggta

SEQ ID NO: 141262 - DNA, 6 bp, Unknown
  misc_feature (1)..( 6): Result.003 file - promoters60/4772103
gtggta

SEQ ID NO: 141263 - DNA, 6 bp, Unknown
  misc_feature (1)..( 6): Result.003 file - promoters60/4772103
tttctt

SEQ ID NO: 141264 - DNA, 6 bp, Unknown
  misc_feature (1)..( 6): Result.003 file - promoters60/4772103
tttctt

SEQ ID NO: 141265 - DNA, 9 bp, Unknown
  misc_feature (1)..( 9): Result.003 file - promoters60/4772103
ttattatat

SEQ ID NO: 141266 - DNA, 9 bp, Unknown
  misc_feature (1)..( 9): Result.003 file - promoters60/4772103
ttatcatat

SEQ ID NO: 141267 - DNA, 7 bp, Unknown
  misc_feature (1)..( 7): Result.003 file - promoters60/4772103
gacaaaa

SEQ ID NO: 141268 - DNA, 7 bp, Unknown
  misc_feature (1)..( 7): Result.003 file - promoters60/4772103
gaccaaa

SEQ ID NO: 141269 - DNA, 8 bp, Unknown
  misc_feature (1)..( 8): Result.003 file - promoters60/4772122
ggacaaaa

SEQ ID NO: 141270 - DNA, 8 bp, Unknown
  misc_feature (1)..( 8): Result.003 file - promoters60/4772122
ggataaaa

SEQ ID NO: 141271 - DNA, 8 bp, Unknown
  misc_feature (1)..( 8): Result.003 file - promoters60/4772122
aaataaaa

SEQ ID NO: 141272 - DNA, 7 bp, Unknown
  misc_feature (1)..( 7): Result.003 file - promoters60/4772122
ttattac

SEQ ID NO: 141273 - DNA, 7 bp, Unknown
  misc_feature (1)..( 7): Result.003 file - promoters60/4772122
ttactac

SEQ ID NO: 141274 - DNA, 7 bp, Unknown
  misc_feature (1)..( 7): Result.003 file - promoters60/4772122
ttactaa

SEQ ID NO: 141275 - DNA, 7 bp, Unknown
  misc_feature (1)..( 7): Result.003 file - promoters60/4772122
aacaaat

SEQ ID NO: 141276 - DNA, 7 bp, Unknown
  misc_feature (1)..( 7): Result.003 file - promoters60/4772122
tacaaat

SEQ ID NO: 141277 - DNA, 7 bp, Unknown
  misc_feature (1)..( 7): Result.003 file - promoters60/4772122
aacaaac

SEQ ID NO: 141278 - DNA, 11 bp, Unknown
  misc_feature (1)..( 11): Result.003 file - promoters60/4772130
cgattgcacaa

SEQ ID NO: 141279 - DNA, 11 bp, Unknown
  misc_feature (1)..( 11): Result.003 file - promoters60/4772130
cgaatgcagcg

SEQ ID NO: 141280 - DNA, 11 bp, Unknown
  misc_feature (1)..( 11): Result.003 file - promoters60/4772130
aaatttcacaa

SEQ ID NO: 141281 - DNA, 11 bp, Unknown
  misc_feature (1)..( 11): Result.003 file - promoters60/4772130
caatttctact

SEQ ID NO: 141282 - DNA, 9 bp, Unknown
  misc_feature (1)..( 9): Result.003 file - promoters60/4772137
gagatctta

SEQ ID NO: 141283 - DNA, 9 bp, Unknown
  misc_feature (1)..( 9): Result.003 file - promoters60/4772137
ctgatttta

SEQ ID NO: 141284 - DNA, 9 bp, Unknown
  misc_feature (1)..( 9): Result.003 file - promoters60/4772137
ctgattttg

SEQ ID NO: 141285 - DNA, 7 bp, Unknown
  misc_feature (1)..( 7): Result.003 file - promoters60/4772137
tgacttg

SEQ ID NO: 141286 - DNA, 7 bp, Unknown
  misc_feature (1)..( 7): Result.003 file - promoters60/4772137
agacttg

SEQ ID NO: 141287 - DNA, 7 bp, Unknown
  misc_feature (1)..( 7): Result.003 file - promoters60/4772137
agatttg

SEQ ID NO: 141288 - DNA, 7 bp, Unknown
  misc_feature (1)..( 7): Result.003 file - promoters60/4772137
agacttg

SEQ ID NO: 141289 - DNA, 7 bp, Unknown
  misc_feature (1)..( 7): Result.003 file - promoters60/4772137
aaagtaa

SEQ ID NO: 141290 - DNA, 7 bp, Unknown
  misc_feature (1)..( 7): Result.003 file - promoters60/4772137
aaagtat

SEQ ID NO: 141291 - DNA, 8 bp, Unknown
  misc_feature (1)..( 8): Result.003 file - promoters60/4772137
aaacgtaa

SEQ ID NO: 141292 - DNA, 9 bp, Unknown
  misc_feature (1)..( 9): Result.003 file - promoters60/4772137
tatttaaaa

SEQ ID NO: 141293 - DNA, 9 bp, Unknown
  misc_feature (1)..( 9): Result.003 file - promoters60/4772137
tattcaaac

SEQ ID NO: 141294 - DNA, 9 bp, Unknown
  misc_feature (1)..( 9): Result.003 file - promoters60/4772137
actttaaaa

SEQ ID NO: 141295 - DNA, 7 bp, Unknown
  misc_feature (1)..( 7): Result.003 file - promoters60/4772137
tttatat

SEQ ID NO: 141296 - DNA, 7 bp, Unknown
  misc_feature (1)..( 7): Result.003 file - promoters60/4772137
tttttat

SEQ ID NO: 141297 - DNA, 7 bp, Unknown
  misc_feature (1)..( 7): Result.003 file - promoters60/4772137
ttttttc

SEQ ID NO: 141298 - DNA, 8 bp, Unknown
  misc_feature (1)..( 8): Result.003 file - promoters60/4772137
caatttga

SEQ ID NO: 141299 - DNA, 8 bp, Unknown
  misc_feature (1)..( 8): Result.003 file - promoters60/4772137
agatttga

SEQ ID NO: 141300 - DNA, 8 bp, Unknown
  misc_feature (1)..( 8): Result.003 file - promoters60/4772137
agacttgg

SEQ ID NO: 141301 - DNA, 8 bp, Unknown
  misc_feature (1)..( 8): Result.003 file - promoters60/4772137
agacttga

SEQ ID NO: 141302 - DNA, 8 bp, Unknown
  misc_feature (1)..( 8): Result.003 file - promoters60/4772155
aatttttt

SEQ ID NO: 141303 - DNA, 8 bp, Unknown
  misc_feature (1)..( 8): Result.003 file - promoters60/4772155
aattttaa

SEQ ID NO: 141304 - DNA, 8 bp, Unknown
  misc_feature (1)..( 8): Result.003 file - promoters60/4772155
tatttttt

SEQ ID NO: 141305 - DNA, 10 bp, Unknown
  misc_feature (1)..( 10): Result.003 file - promoters60/4772155
aaattcttgt

SEQ ID NO: 141306 - DNA, 10 bp, Unknown
  misc_feature (1)..( 10): Result.003 file - promoters60/4772155
aaaatcttgt

SEQ ID NO: 141307 - DNA, 7 bp, Unknown
  misc_feature (1)..( 7): Result.003 file - promoters60/4772155
taccatt

SEQ ID NO: 141308 - DNA, 7 bp, Unknown
  misc_feature (1)..( 7): Result.003 file - promoters60/4772155
tacgatt

SEQ ID NO: 141309 - DNA, 6 bp, Unknown
  misc_feature (1)..( 6): Result.003 file - promoters60/4772155
tcaaat

SEQ ID NO: 141310 - DNA, 6 bp, Unknown
  misc_feature (1)..( 6): Result.003 file - promoters60/4772155
tcaaat

SEQ ID NO: 141311 - DNA, 10 bp, Unknown
  misc_feature (1)..( 10): Result.003 file - promoters60/4772155
gatcataaca

SEQ ID NO: 141312 - DNA, 10 bp, Unknown
  misc_feature (1)..( 10): Result.003 file - promoters60/4772155
gatcacaaca

SEQ ID NO: 141313 - DNA, 10 bp, Unknown
  misc_feature (1)..( 10): Result.003 file - promoters60/4772155
tatcttaacc

SEQ ID NO: 141314 - DNA, 7 bp, Unknown
  misc_feature (1)..( 7): Result.003 file - promoters60/4772155
ttccact

SEQ ID NO: 141315 - DNA, 7 bp, Unknown
  misc_feature (1)..( 7): Result.003 file - promoters60/4772155
ttctact

SEQ ID NO: 141316 - DNA, 7 bp, Unknown
  misc_feature (1)..( 7): Result.003 file - promoters60/4772155
atggtca

SEQ ID NO: 141317 - DNA, 7 bp, Unknown
  misc_feature (1)..( 7): Result.003 file - promoters60/4772155
atgttca

SEQ ID NO: 141318 - DNA, 10 bp, Unknown
  misc_feature (1)..( 10): Result.003 file - promoters60/4772155
caaaaaaaaa

SEQ ID NO: 141319 - DNA, 10 bp, Unknown
  misc_feature (1)..( 10): Result.003 file - promoters60/4772155
caataaaatc

SEQ ID NO: 141320 - DNA, 10 bp, Unknown
  misc_feature (1)..( 10): Result.003 file - promoters60/4772155
ttctaaaatc

SEQ ID NO: 141321 - DNA, 6 bp, Unknown
  misc_feature (1)..( 6): Result.003 file - promoters60/4772155
tttttt

SEQ ID NO: 141322 - DNA, 6 bp, Unknown
  misc_feature (1)..( 6): Result.003 file - promoters60/4772155
tttttt

SEQ ID NO: 141323 - DNA, 7 bp, Unknown
  misc_feature (1)..( 7): Result.003 file - promoters60/4772155
atttttc

SEQ ID NO: 141324 - DNA, 7 bp, Unknown
  misc_feature (1)..( 7): Result.003 file - promoters60/4772155
atttttc

SEQ ID NO: 141325 - DNA, 8 bp, Unknown
  misc_feature (1)..( 8): Result.003 file - promoters60/4772155
ttttttct

SEQ ID NO: 141326 - DNA, 8 bp, Unknown
  misc_feature (1)..( 8): Result.003 file - promoters60/4772155
ttttatct

SEQ ID NO: 141327 - DNA, 8 bp, Unknown
  misc_feature (1)..( 8): Result.003 file - promoters60/4772155
tttgttac

SEQ ID NO: 141328 - DNA, 7 bp, Unknown
  misc_feature (1)..( 7): Result.003 file - promoters60/4772155
aggaaaa

SEQ ID NO: 141329 - DNA, 7 bp, Unknown
  misc_feature (1)..( 7): Result.003 file - promoters60/4772155
aggaaaa

SEQ ID NO: 141330 - DNA, 11 bp, Unknown
  misc_feature (1)..( 11): Result.003 file - promoters60/4772155
aaaaacagaaa

SEQ ID NO: 141331 - DNA, 11 bp, Unknown
  misc_feature (1)..( 11): Result.003 file - promoters60/4772155
aaaaacaaaaa

SEQ ID NO: 141332 - DNA, 7 bp, Unknown
  misc_feature (1)..( 7): Result.003 file - promoters60/4772155
tttgcat

SEQ ID NO: 141333 - DNA, 7 bp, Unknown
  misc_feature (1)..( 7): Result.003 file - promoters60/4772155
tttgcat

SEQ ID NO: 141334 - DNA, 8 bp, Unknown
  misc_feature (1)..( 8): Result.003 file - promoters60/4772155
tctataga

SEQ ID NO: 141335 - DNA, 8 bp, Unknown
  misc_feature (1)..( 8): Result.003 file - promoters60/4772155
tctttaga

SEQ ID NO: 141336 - DNA, 6 bp, Unknown
  misc_feature (1)..( 6): Result.003 file - promoters60/4772155
taacat

SEQ ID NO: 141337 - DNA, 6 bp, Unknown
  misc_feature (1)..( 6): Result.003 file - promoters60/4772155
taacat

SEQ ID NO: 141338 - DNA, 7 bp, Unknown
  misc_feature (1)..( 7): Result.003 file - promoters60/4772155
aacaaaa

SEQ ID NO: 141339 - DNA, 7 bp, Unknown
  misc_feature (1)..( 7): Result.003 file - promoters60/4772155
aactaaa

SEQ ID NO: 141340 - DNA, 6 bp, Unknown
  misc_feature (1)..( 6): Result.003 file - promoters60/4772155
ttctta

SEQ ID NO: 141341 - DNA, 6 bp, Unknown
  misc_feature (1)..( 6): Result.003 file - promoters60/4772155
ttctta

SEQ ID NO: 141342 - DNA, 8 bp, Unknown
  misc_feature (1)..( 8): Result.003 file - promoters60/4772155
ttttttta

SEQ ID NO: 141343 - DNA, 8 bp, Unknown
  misc_feature (1)..( 8): Result.003 file - promoters60/4772155
tttgttta

SEQ ID NO: 141344 - DNA, 10 bp, Unknown
  misc_feature (1)..( 10): Result.003 file - promoters60/4772195
gaacatgaca

SEQ ID NO: 141345 - DNA, 10 bp, Unknown
  misc_feature (1)..( 10): Result.003 file - promoters60/4772195
agacaagaca

SEQ ID NO: 141346 - DNA, 10 bp, Unknown
  misc_feature (1)..( 10): Result.003 file - promoters60/4772195
gaaaatgaac

SEQ ID NO: 141347 - DNA, 8 bp, Unknown
  misc_feature (1)..( 8): Result.003 file - promoters60/4772195
cgaaatta

SEQ ID NO: 141348 - DNA, 8 bp, Unknown
  misc_feature (1)..( 8): Result.003 file - promoters60/4772195
agaaatta

SEQ ID NO: 141349 - DNA, 8 bp, Unknown
  misc_feature (1)..( 8): Result.003 file - promoters60/4772195
cgaaatcc

SEQ ID NO: 141350 - DNA, 8 bp, Unknown
  misc_feature (1)..( 8): Result.003 file - promoters60/4772195
ctgtttaa

SEQ ID NO: 141351 - DNA, 8 bp, Unknown
  misc_feature (1)..( 8): Result.003 file - promoters60/4772195
gagtttaa

SEQ ID NO: 141352 - DNA, 8 bp, Unknown
  misc_feature (1)..( 8): Result.003 file - promoters60/4772195
ctgattat

SEQ ID NO: 141353 - DNA, 13 bp, Unknown
  misc_feature (1)..( 13): Result.003 file - promoters60/4772195
attctttaattac

SEQ ID NO: 141354 - DNA, 13 bp, Unknown
  misc_feature (1)..( 13): Result.003 file - promoters60/4772195
ttcattttatttt

SEQ ID NO: 141355 - DNA, 13 bp, Unknown
  misc_feature (1)..( 13): Result.003 file - promoters60/4772195
ttctttttctttt

SEQ ID NO: 141356 - DNA, 12 bp, Unknown
  misc_feature (1)..( 12): Result.003 file - promoters60/4772195
ttctttaattac

SEQ ID NO: 141357 - DNA, 12 bp, Unknown
  misc_feature (1)..( 12): Result.003 file - promoters60/4772195
ttctttttcttt

SEQ ID NO: 141358 - DNA, 13 bp, Unknown
  misc_feature (1)..( 13): Result.003 file - promoters60/4772195
ttcattttatttt

SEQ ID NO: 141359 - DNA, 9 bp, Unknown
  misc_feature (1)..( 9): Result.003 file - promoters60/4772195
agggtttta

SEQ ID NO: 141360 - DNA, 9 bp, Unknown
  misc_feature (1)..( 9): Result.003 file - promoters60/4772195
aggattttc

SEQ ID NO: 141361 - DNA, 9 bp, Unknown
  misc_feature (1)..( 9): Result.003 file - promoters60/4772195
tagatattc

SEQ ID NO: 141362 - DNA, 12 bp, Unknown
  misc_feature (1)..( 12): Result.003 file - promoters60/4772208
ttaaatgaagat

SEQ ID NO: 141363 - DNA, 12 bp, Unknown
  misc_feature (1)..( 12): Result.003 file - promoters60/4772208
aataatgatgat

SEQ ID NO: 141364 - DNA, 12 bp, Unknown
  misc_feature (1)..( 12): Result.003 file - promoters60/4772208
gacaatgaattg

SEQ ID NO: 141365 - DNA, 12 bp, Unknown
  misc_feature (1)..( 12): Result.003 file - promoters60/4772208
ttacatgaacag

SEQ ID NO: 141366 - DNA, 12 bp, Unknown
  misc_feature (1)..( 12): Result.003 file - promoters60/4772208
cgaaatcaatga

SEQ ID NO: 141367 - DNA, 10 bp, Unknown
  misc_feature (1)..( 10): Result.003 file - promoters60/4772208
gtcatcaaat

SEQ ID NO: 141368 - DNA, 10 bp, Unknown
  misc_feature (1)..( 10): Result.003 file - promoters60/4772208
aatttcaaat

SEQ ID NO: 141369 - DNA, 10 bp, Unknown
  misc_feature (1)..( 10): Result.003 file - promoters60/4772208
atgttcaaaa

SEQ ID NO: 141370 - DNA, 10 bp, Unknown
  misc_feature (1)..( 10): Result.003 file - promoters60/4772208
tctttcaaaa

SEQ ID NO: 141371 - DNA, 10 bp, Unknown
  misc_feature (1)..( 10): Result.003 file - promoters60/4772208
tctttcagac

SEQ ID NO: 141372 - DNA, 8 bp, Unknown
  misc_feature (1)..( 8): Result.003 file - promoters60/4772208
caaatgta

SEQ ID NO: 141373 - DNA, 8 bp, Unknown
  misc_feature (1)..( 8): Result.003 file - promoters60/4772208
taaatgtt

SEQ ID NO: 141374 - DNA, 8 bp, Unknown
  misc_feature (1)..( 8): Result.003 file - promoters60/4772208
agaatgtt

SEQ ID NO: 141375 - DNA, 8 bp, Unknown
  misc_feature (1)..( 8): Result.003 file - promoters60/4772208
taactgtc

SEQ ID NO: 141376 - DNA, 9 bp, Unknown
  misc_feature (1)..( 9): Result.003 file - promoters60/4772223
actaataaa

SEQ ID NO: 141377 - DNA, 9 bp, Unknown
  misc_feature (1)..( 9): Result.003 file - promoters60/4772223
acttatata

SEQ ID NO: 141378 - DNA, 9 bp, Unknown
  misc_feature (1)..( 9): Result.003 file - promoters60/4772223
tcttaaata

SEQ ID NO: 141379 - DNA, 8 bp, Unknown
  misc_feature (1)..( 8): Result.003 file - promoters60/4772223
atttcaaa

SEQ ID NO: 141380 - DNA, 8 bp, Unknown
  misc_feature (1)..( 8): Result.003 file - promoters60/4772223
gtttaaaa

SEQ ID NO: 141381 - DNA, 8 bp, Unknown
  misc_feature (1)..( 8): Result.003 file - promoters60/4772223
atttcaat

SEQ ID NO: 141382 - DNA, 9 bp, Unknown
  misc_feature (1)..( 9): Result.003 file - promoters60/4772223
caaaacaaa

SEQ ID NO: 141383 - DNA, 9 bp, Unknown
  misc_feature (1)..( 9): Result.003 file - promoters60/4772223
tgaaaaaaa

SEQ ID NO: 141384 - DNA, 10 bp, Unknown
  misc_feature (1)..( 10): Result.003 file - promoters60/4772223
tcaaatcaat

SEQ ID NO: 141385 - DNA, 9 bp, Unknown
  misc_feature (1)..( 9): Result.003 file - promoters60/4772223
gaaatacta

SEQ ID NO: 141386 - DNA, 9 bp, Unknown
  misc_feature (1)..( 9): Result.003 file - promoters60/4772223
caaacacta

SEQ ID NO: 141387 - DNA, 9 bp, Unknown
  misc_feature (1)..( 9): Result.003 file - promoters60/4772223
aaaacacac

SEQ ID NO: 141388 - DNA, 9 bp, Unknown
  misc_feature (1)..( 9): Result.003 file - promoters60/4772223
caatcactt

SEQ ID NO: 141389 - DNA, 8 bp, Unknown
  misc_feature (1)..( 8): Result.003 file - promoters60/4772223
ctaatttt

SEQ ID NO: 141390 - DNA, 8 bp, Unknown
  misc_feature (1)..( 8): Result.003 file - promoters60/4772223
ataatttt

SEQ ID NO: 141391 - DNA, 8 bp, Unknown
  misc_feature (1)..( 8): Result.003 file - promoters60/4772223
ataattgt

SEQ ID NO: 141392 - DNA, 9 bp, Unknown
  misc_feature (1)..( 9): Result.003 file - promoters60/4772223
caaagtaaa

SEQ ID NO: 141393 - DNA, 9 bp, Unknown
  misc_feature (1)..( 9): Result.003 file - promoters60/4772223
acaagaaaa

SEQ ID NO: 141394 - DNA, 9 bp, Unknown
  misc_feature (1)..( 9): Result.003 file - promoters60/4772223
acatgaaac

SEQ ID NO: 141395 - DNA, 10 bp, Unknown
  misc_feature (1)..( 10): Result.003 file - promoters60/4772223
cgatgagaat

SEQ ID NO: 141396 - DNA, 10 bp, Unknown
  misc_feature (1)..( 10): Result.003 file - promoters60/4772223
ttttgacaat

SEQ ID NO: 141397 - DNA, 10 bp, Unknown
  misc_feature (1)..( 10): Result.003 file - promoters60/4772223
tttagacaca

SEQ ID NO: 141398 - DNA, 12 bp, Unknown
  misc_feature (1)..( 12): Result.003 file - promoters60/4772223
ttaccaaaatga

SEQ ID NO: 141399 - DNA, 12 bp, Unknown
  misc_feature (1)..( 12): Result.003 file - promoters60/4772223
ttatcaaattga

SEQ ID NO: 141400 - DNA, 12 bp, Unknown
  misc_feature (1)..( 12): Result.003 file - promoters60/4772223
atattaaatttt

SEQ ID NO: 141401 - DNA, 8 bp, Unknown
  misc_feature (1)..( 8): Result.003 file - promoters60/4772223
ccatcaaa

SEQ ID NO: 141402 - DNA, 8 bp, Unknown
  misc_feature (1)..( 8): Result.003 file - promoters60/4772223
acatgaaa

SEQ ID NO: 141403 - DNA, 8 bp, Unknown
  misc_feature (1)..( 8): Result.003 file - promoters60/4772223
acaagaaa

SEQ ID NO: 141404 - DNA, 7 bp, Unknown
  misc_feature (1)..( 7): Result.003 file - promoters60/4772230
atttatt

SEQ ID NO: 141405 - DNA, 7 bp, Unknown
  misc_feature (1)..( 7): Result.003 file - promoters60/4772230
atttatt

SEQ ID NO: 141406 - DNA, 6 bp, Unknown
  misc_feature (1)..( 6): Result.003 file - promoters60/4772230
ttaaaa

SEQ ID NO: 141407 - DNA, 6 bp, Unknown
  misc_feature (1)..( 6): Result.003 file - promoters60/4772230
ttaaaa

SEQ ID NO: 141408 - DNA, 7 bp, Unknown
  misc_feature (1)..( 7): Result.003 file - promoters60/4772230
actaatt

SEQ ID NO: 141409 - DNA, 7 bp, Unknown
  misc_feature (1)..( 7): Result.003 file - promoters60/4772230
actaatt

SEQ ID NO: 141410 - DNA, 7 bp, Unknown
  misc_feature (1)..( 7): Result.003 file - promoters60/4772230
tctaatt

SEQ ID NO: 141411 - DNA, 6 bp, Unknown
  misc_feature (1)..( 6): Result.003 file - promoters60/4772230
tttttc

SEQ ID NO: 141412 - DNA, 6 bp, Unknown
  misc_feature (1)..( 6): Result.003 file - promoters60/4772230
tttttc

SEQ ID NO: 141413 - DNA, 9 bp, Unknown
  misc_feature (1)..( 9): Result.003 file - promoters60/4772230
aatagattt

SEQ ID NO: 141414 - DNA, 9 bp, Unknown
  misc_feature (1)..( 9): Result.003 file - promoters60/4772230
tgtagattc

SEQ ID NO: 141415 - DNA, 9 bp, Unknown
  misc_feature (1)..( 9): Result.003 file - promoters60/4772230
aatagtttt

SEQ ID NO: 141416 - DNA, 7 bp, Unknown
  misc_feature (1)..( 7): Result.003 file - promoters60/4772230
taaattt

SEQ ID NO: 141417 - DNA, 7 bp, Unknown
  misc_feature (1)..( 7): Result.003 file - promoters60/4772230
taatttt

SEQ ID NO: 141418 - DNA, 6 bp, Unknown
  misc_feature (1)..( 6): Result.003 file - promoters60/4772230
tcaaga

SEQ ID NO: 141419 - DNA, 6 bp, Unknown
  misc_feature (1)..( 6): Result.003 file - promoters60/4772230
tcaaga

SEQ ID NO: 141420 - DNA, 10 bp, Unknown
  misc_feature (1)..( 10): Result.003 file - promoters60/4772230
aaatattcac

SEQ ID NO: 141421 - DNA, 10 bp, Unknown
  misc_feature (1)..( 10): Result.003 file - promoters60/4772230
ctatatacac

SEQ ID NO: 141422 - DNA, 10 bp, Unknown
  misc_feature (1)..( 10): Result.003 file - promoters60/4772230
aaatattaat

SEQ ID NO: 141423 - DNA, 6 bp, Unknown
  misc_feature (1)..( 6): Result.003 file - promoters60/4772230
caaaca

SEQ ID NO: 141424 - DNA, 6 bp, Unknown
  misc_feature (1)..( 6): Result.003 file - promoters60/4772230
caaaca

SEQ ID NO: 141425 - DNA, 8 bp, Unknown
  misc_feature (1)..( 8): Result.003 file - promoters60/4772230
tatcttca

SEQ ID NO: 141426 - DNA, 8 bp, Unknown
  misc_feature (1)..( 8): Result.003 file - promoters60/4772230
tatcttca

SEQ ID NO: 141427 - DNA, 7 bp, Unknown
  misc_feature (1)..( 7): Result.003 file - promoters60/4772230
atagatt

SEQ ID NO: 141428 - DNA, 7 bp, Unknown
  misc_feature (1)..( 7): Result.003 file - promoters60/4772230
atatatt

SEQ ID NO: 141429 - DNA, 8 bp, Unknown
  misc_feature (1)..( 8): Result.003 file - promoters60/4772230
tttcaatt

SEQ ID NO: 141430 - DNA, 8 bp, Unknown
  misc_feature (1)..( 8): Result.003 file - promoters60/4772230
tttctatt

SEQ ID NO: 141431 - DNA, 6 bp, Unknown
  misc_feature (1)..( 6): Result.003 file - promoters60/4772230
ttttct

SEQ ID NO: 141432 - DNA, 6 bp, Unknown
  misc_feature (1)..( 6): Result.003 file - promoters60/4772230
ttttct

SEQ ID NO: 141433 - DNA, 7 bp, Unknown
  misc_feature (1)..( 7): Result.003 file - promoters60/4772230
ataaaat

SEQ ID NO: 141434 - DNA, 7 bp, Unknown
  misc_feature (1)..( 7): Result.003 file - promoters60/4772230
ataaaat

SEQ ID NO: 141435 - DNA, 7 bp, Unknown
  misc_feature (1)..( 7): Result.003 file - promoters60/4772230
aacccaa

SEQ ID NO: 141436 - DNA, 7 bp, Unknown
  misc_feature (1)..( 7): Result.003 file - promoters60/4772230
aactcaa

SEQ ID NO: 141437 - DNA, 8 bp, Unknown
  misc_feature (1)..( 8): Result.003 file - promoters60/4772230
cacgtgtc

SEQ ID NO: 141438 - DNA, 8 bp, Unknown
  misc_feature (1)..( 8): Result.003 file - promoters60/4772230
cacatgtc

SEQ ID NO: 141439 - DNA, 8 bp, Unknown
  misc_feature (1)..( 8): Result.003 file - promoters60/4772230
tttattaa

SEQ ID NO: 141440 - DNA, 8 bp, Unknown
  misc_feature (1)..( 8): Result.003 file - promoters60/4772230
tttcttaa

SEQ ID NO: 141441 - DNA, 8 bp, Unknown
  misc_feature (1)..( 8): Result.003 file - promoters60/4772230
aatttatc

SEQ ID NO: 141442 - DNA, 8 bp, Unknown
  misc_feature (1)..( 8): Result.003 file - promoters60/4772230
aatttatc

SEQ ID NO: 141443 - DNA, 8 bp, Unknown
  misc_feature (1)..( 8): Result.003 file - promoters60/4772230
atatatat

SEQ ID NO: 141444 - DNA, 8 bp, Unknown
  misc_feature (1)..( 8): Result.003 file - promoters60/4772230
atagatat

SEQ ID NO: 141445 - DNA, 7 bp, Unknown
  misc_feature (1)..( 7): Result.003 file - promoters60/4772230
tcataca

SEQ ID NO: 141446 - DNA, 7 bp, Unknown
  misc_feature (1)..( 7): Result.003 file - promoters60/4772230
tcataca

SEQ ID NO: 141447 - DNA, 7 bp, Unknown
  misc_feature (1)..( 7): Result.003 file - promoters60/4772230
catctat

SEQ ID NO: 141448 - DNA, 7 bp, Unknown
  misc_feature (1)..( 7): Result.003 file - promoters60/4772230
catctat

SEQ ID NO: 141449 - DNA, 7 bp, Unknown
  misc_feature (1)..( 7): Result.003 file - promoters60/4772230
tatatac

SEQ ID NO: 141450 - DNA, 7 bp, Unknown
  misc_feature (1)..( 7): Result.003 file - promoters60/4772230
tatttac

SEQ ID NO: 141451 - DNA, 8 bp, Unknown
  misc_feature (1)..( 8): Result.003 file - promoters60/4772230
aaacaaaa

SEQ ID NO: 141452 - DNA, 8 bp, Unknown
  misc_feature (1)..( 8): Result.003 file - promoters60/4772230
aaataaaa

SEQ ID NO: 141453 - DNA, 7 bp, Unknown
  misc_feature (1)..( 7): Result.003 file - promoters60/4772230
aaaccaa

SEQ ID NO: 141454 - DNA, 7 bp, Unknown
  misc_feature (1)..( 7): Result.003 file - promoters60/4772230
aaatcaa

SEQ ID NO: 141455 - DNA, 11 bp, Unknown
  misc_feature (1)..( 11): Result.003 file - promoters60/4772240
tagattcttca

SEQ ID NO: 141456 - DNA, 11 bp, Unknown
  misc_feature (1)..( 11): Result.003 file - promoters60/4772240
tagtttcttac

SEQ ID NO: 141457 - DNA, 11 bp, Unknown
  misc_feature (1)..( 11): Result.003 file - promoters60/4772240
caaatttttct

SEQ ID NO: 141458 - DNA, 11 bp, Unknown
  misc_feature (1)..( 11): Result.003 file - promoters60/4772240
agtattattca

SEQ ID NO: 141459 - DNA, 11 bp, Unknown
  misc_feature (1)..( 11): Result.003 file - promoters60/4772240
atttttcttca

SEQ ID NO: 141460 - DNA, 11 bp, Unknown
  misc_feature (1)..( 11): Result.003 file - promoters60/4772240
attatgatttt

SEQ ID NO: 141461 - DNA, 9 bp, Unknown
  misc_feature (1)..( 9): Result.003 file - promoters60/4772240
gctgaaaac

SEQ ID NO: 141462 - DNA, 9 bp, Unknown
  misc_feature (1)..( 9): Result.003 file - promoters60/4772240
tgagaaaac

SEQ ID NO: 141463 - DNA, 9 bp, Unknown
  misc_feature (1)..( 9): Result.003 file - promoters60/4772240
taagaaaag

SEQ ID NO: 141464 - DNA, 9 bp, Unknown
  misc_feature (1)..( 9): Result.003 file - promoters60/4772240
acagaaaaa

SEQ ID NO: 141465 - DNA, 9 bp, Unknown
  misc_feature (1)..( 9): Result.003 file - promoters60/4772240
gaaggaaat

SEQ ID NO: 141466 - DNA, 9 bp, Unknown
  misc_feature (1)..( 9): Result.003 file - promoters60/4772240
taaaaaaaa

SEQ ID NO: 141467 - DNA, 12 bp, Unknown
  misc_feature (1)..( 12): Result.003 file - promoters60/4772240
aacgaagaggaa

SEQ ID NO: 141468 - DNA, 12 bp, Unknown
  misc_feature (1)..( 12): Result.003 file - promoters60/4772240
taagaaaaggat

SEQ ID NO: 141469 - DNA, 12 bp, Unknown
  misc_feature (1)..( 12): Result.003 file - promoters60/4772240
tgagaaaactat

SEQ ID NO: 141470 - DNA, 12 bp, Unknown
  misc_feature (1)..( 12): Result.003 file - promoters60/4772240
acagaaaaatca

SEQ ID NO: 141471 - DNA, 12 bp, Unknown
  misc_feature (1)..( 12): Result.003 file - promoters60/4772240
gaaggaaataga

SEQ ID NO: 141472 - DNA, 12 bp, Unknown
  misc_feature (1)..( 12): Result.003 file - promoters60/4772240
taaaaaaaaaat

SEQ ID NO: 141473 - DNA, 12 bp, Unknown
  misc_feature (1)..( 12): Result.003 file - promoters60/4772240
ttaccaaaggat

SEQ ID NO: 141474 - DNA, 12 bp, Unknown
  misc_feature (1)..( 12): Result.003 file - promoters60/4772240
aagaacattatt

SEQ ID NO: 141475 - DNA, 12 bp, Unknown
  misc_feature (1)..( 12): Result.003 file - promoters60/4772240
gagaatattaaa

SEQ ID NO: 141476 - DNA, 12 bp, Unknown
  misc_feature (1)..( 12): Result.003 file - promoters60/4772240
cgagacattatg

SEQ ID NO: 141477 - DNA, 12 bp, Unknown
  misc_feature (1)..( 12): Result.003 file - promoters60/4772240
tcaaatattttt

SEQ ID NO: 141478 - DNA, 12 bp, Unknown
  misc_feature (1)..( 12): Result.003 file - promoters60/4772240
tataaaagttga

SEQ ID NO: 141479 - DNA, 12 bp, Unknown
  misc_feature (1)..( 12): Result.003 file - promoters60/4772240
tttgatagtaaa

SEQ ID NO: 141480 - DNA, 10 bp, Unknown
  misc_feature (1)..( 10): Result.003 file - promoters60/4772248
taaaactaaa

SEQ ID NO: 141481 - DNA, 10 bp, Unknown
  misc_feature (1)..( 10): Result.003 file - promoters60/4772248
caaaacttga

SEQ ID NO: 141482 - DNA, 10 bp, Unknown
  misc_feature (1)..( 10): Result.003 file - promoters60/4772248
taaaacgtga

SEQ ID NO: 141483 - DNA, 10 bp, Unknown
  misc_feature (1)..( 10): Result.003 file - promoters60/4772248
gcaaaccaaa

SEQ ID NO: 141484 - DNA, 10 bp, Unknown
  misc_feature (1)..( 10): Result.003 file - promoters60/4772248
tcaaaccttc

SEQ ID NO: 141485 - DNA, 10 bp, Unknown
  misc_feature (1)..( 10): Result.003 file - promoters60/4772248
cgaaaccgta

SEQ ID NO: 141486 - DNA, 13 bp, Unknown
  misc_feature (1)..( 13): Result.003 file - promoters60/4772248
cttgttttctacc

SEQ ID NO: 141487 - DNA, 13 bp, Unknown
  misc_feature (1)..( 13): Result.003 file - promoters60/4772248
ccatttttctact

SEQ ID NO: 141488 - DNA, 13 bp, Unknown
  misc_feature (1)..( 13): Result.003 file - promoters60/4772248
taacacttcaacc

SEQ ID NO: 141489 - DNA, 13 bp, Unknown
  misc_feature (1)..( 13): Result.003 file - promoters60/4772248
atatttttcataa

SEQ ID NO: 141490 - DNA, 13 bp, Unknown
  misc_feature (1)..( 13): Result.003 file - promoters60/4772248
gattttttgcatc

SEQ ID NO: 141491 - DNA, 13 bp, Unknown
  misc_feature (1)..( 13): Result.003 file - promoters60/4772248
atatctttgattt

SEQ ID NO: 141492 - DNA, 13 bp, Unknown
  misc_feature (1)..( 13): Result.003 file - promoters60/4772248
caatttatctaac

SEQ ID NO: 141493 - DNA, 14 bp, Unknown
  misc_feature (1)..( 14): Result.003 file - promoters60/4772248
atttttgaagcaca

SEQ ID NO: 141494 - DNA, 14 bp, Unknown
  misc_feature (1)..( 14): Result.003 file - promoters60/4772248
atttttaaagcatg

SEQ ID NO: 141495 - DNA, 14 bp, Unknown
  misc_feature (1)..( 14): Result.003 file - promoters60/4772248
ctttttgttctata

SEQ ID NO: 141496 - DNA, 14 bp, Unknown
  misc_feature (1)..( 14): Result.003 file - promoters60/4772248
ctttttgtgcagaa

SEQ ID NO: 141497 - DNA, 14 bp, Unknown
  misc_feature (1)..( 14): Result.003 file - promoters60/4772248
ggtttagaatgaga

SEQ ID NO: 141498 - DNA, 14 bp, Unknown
  misc_feature (1)..( 14): Result.003 file - promoters60/4772248
atcctaaaatcatg

SEQ ID NO: 141499 - DNA, 12 bp, Unknown
  misc_feature (1)..( 12): Result.003 file - promoters60/4772248
caattaagacaa

SEQ ID NO: 141500 - DNA, 12 bp, Unknown
  misc_feature (1)..( 12): Result.003 file - promoters60/4772248
aaattaaaacat

SEQ ID NO: 141501 - DNA, 13 bp, Unknown
  misc_feature (1)..( 13): Result.003 file - promoters60/4772248
aaacttataagtc

SEQ ID NO: 141502 - DNA, 13 bp, Unknown
  misc_feature (1)..( 13): Result.003 file - promoters60/4772248
ttaatcaaataat

SEQ ID NO: 141503 - DNA, 13 bp, Unknown
  misc_feature (1)..( 13): Result.003 file - promoters60/4772248
aacaaagaaacat

SEQ ID NO: 141504 - DNA, 13 bp, Unknown
  misc_feature (1)..( 13): Result.003 file - promoters60/4772248
tcacttgtaaatg

SEQ ID NO: 141505 - DNA, 13 bp, Unknown
  misc_feature (1)..( 13): Result.003 file - promoters60/4772248
ttttttttttttt

SEQ ID NO: 141506 - DNA, 13 bp, Unknown
  misc_feature (1)..( 13): Result.003 file - promoters60/4772248
tgtaatttttttc

SEQ ID NO: 141507 - DNA, 13 bp, Unknown
  misc_feature (1)..( 13): Result.003 file - promoters60/4772248
atttgttttttaa

SEQ ID NO: 141508 - DNA, 13 bp, Unknown
  misc_feature (1)..( 13): Result.003 file - promoters60/4772248
taatgtttttcta

SEQ ID NO: 141509 - DNA, 13 bp, Unknown
  misc_feature (1)..( 13): Result.003 file - promoters60/4772248
cccagttattctc

SEQ ID NO: 141510 - DNA, 13 bp, Unknown
  misc_feature (1)..( 13): Result.003 file - promoters60/4772248
acttgtgtttgat

SEQ ID NO: 141511 - DNA, 14 bp, Unknown
  misc_feature (1)..( 14): Result.003 file - promoters60/4772248
atacaaacatatat

SEQ ID NO: 141512 - DNA, 14 bp, Unknown
  misc_feature (1)..( 14): Result.003 file - promoters60/4772248
tatcaaacttataa

SEQ ID NO: 141513 - DNA, 14 bp, Unknown
  misc_feature (1)..( 14): Result.003 file - promoters60/4772248
aaagaaacatacca

SEQ ID NO: 141514 - DNA, 14 bp, Unknown
  misc_feature (1)..( 14): Result.003 file - promoters60/4772248
tagaaaaattaaaa

SEQ ID NO: 141515 - DNA, 14 bp, Unknown
  misc_feature (1)..( 14): Result.003 file - promoters60/4772248
aatcaaataataaa

SEQ ID NO: 141516 - DNA, 14 bp, Unknown
  misc_feature (1)..( 14): Result.003 file - promoters60/4772248
gtaatcacttgtaa

SEQ ID NO: 141517 - DNA, 8 bp, Unknown
  misc_feature (1)..( 8): Result.003 file - promoters60/4772258
ttttatta

SEQ ID NO: 141518 - DNA, 8 bp, Unknown
  misc_feature (1)..( 8): Result.003 file - promoters60/4772258
ttttgtta

SEQ ID NO: 141519 - DNA, 8 bp, Unknown
  misc_feature (1)..( 8): Result.003 file - promoters60/4772258
ccttgtta

SEQ ID NO: 141520 - DNA, 8 bp, Unknown
  misc_feature (1)..( 8): Result.003 file - promoters60/4772258
tcttattt

SEQ ID NO: 141521 - DNA, 8 bp, Unknown
  misc_feature (1)..( 8): Result.003 file - promoters60/4772258
tcttcttt

SEQ ID NO: 141522 - DNA, 8 bp, Unknown
  misc_feature (1)..( 8): Result.003 file - promoters60/4772258
tcttctct

SEQ ID NO: 141523 - DNA, 9 bp, Unknown
  misc_feature (1)..( 9): Result.003 file - promoters60/4772258
attttttat

SEQ ID NO: 141524 - DNA, 9 bp, Unknown
  misc_feature (1)..( 9): Result.003 file - promoters60/4772258
gttttatat

SEQ ID NO: 141525 - DNA, 9 bp, Unknown
  misc_feature (1)..( 9): Result.003 file - promoters60/4772258
atttttcgt

SEQ ID NO: 141526 - DNA, 8 bp, Unknown
  misc_feature (1)..( 8): Result.003 file - promoters60/4772258
ttaatata

SEQ ID NO: 141527 - DNA, 8 bp, Unknown
  misc_feature (1)..( 8): Result.003 file - promoters60/4772258
ttactatt

SEQ ID NO: 141528 - DNA, 8 bp, Unknown
  misc_feature (1)..( 8): Result.003 file - promoters60/4772258
ctaatata

SEQ ID NO: 141529 - DNA, 7 bp, Unknown
  misc_feature (1)..( 7): Result.003 file - promoters60/4772258
attttgg

SEQ ID NO: 141530 - DNA, 7 bp, Unknown
  misc_feature (1)..( 7): Result.003 file - promoters60/4772258
attttga

SEQ ID NO: 141531 - DNA, 7 bp, Unknown
  misc_feature (1)..( 7): Result.003 file - promoters60/4772258
attctgg

SEQ ID NO: 141532 - DNA, 9 bp, Unknown
  misc_feature (1)..( 9): Result.003 file - promoters60/4772258
agattctac

SEQ ID NO: 141533 - DNA, 9 bp, Unknown
  misc_feature (1)..( 9): Result.003 file - promoters60/4772258
agattcata

SEQ ID NO: 141534 - DNA, 9 bp, Unknown
  misc_feature (1)..( 9): Result.003 file - promoters60/4772258
tgatttata

SEQ ID NO: 141535 - DNA, 7 bp, Unknown
  misc_feature (1)..( 7): Result.003 file - promoters60/4772258
tttcttg

SEQ ID NO: 141536 - DNA, 7 bp, Unknown
  misc_feature (1)..( 7): Result.003 file - promoters60/4772258
tttcttt

SEQ ID NO: 141537 - DNA, 8 bp, Unknown
  misc_feature (1)..( 8): Result.003 file - promoters60/4772258
gttcattt

SEQ ID NO: 141538 - DNA, 8 bp, Unknown
  misc_feature (1)..( 8): Result.003 file - promoters60/4772258
agtttttt

SEQ ID NO: 141539 - DNA, 8 bp, Unknown
  misc_feature (1)..( 8): Result.003 file - promoters60/4772258
tgttgttt

SEQ ID NO: 141540 - DNA, 8 bp, Unknown
  misc_feature (1)..( 8): Result.003 file - promoters60/4772258
tgttgttg

SEQ ID NO: 141541 - DNA, 9 bp, Unknown
  misc_feature (1)..( 9): Result.003 file - promoters60/4772258
tttaacctt

SEQ ID NO: 141542 - DNA, 9 bp, Unknown
  misc_feature (1)..( 9): Result.003 file - promoters60/4772258
tttgaccaa

SEQ ID NO: 141543 - DNA, 9 bp, Unknown
  misc_feature (1)..( 9): Result.003 file - promoters60/4772258
gctgagcaa

SEQ ID NO: 141544 - DNA, 6 bp, Unknown
  misc_feature (1)..( 6): Result.003 file - promoters60/4772270
agagca

SEQ ID NO: 141545 - DNA, 6 bp, Unknown
  misc_feature (1)..( 6): Result.003 file - promoters60/4772270
agagca

SEQ ID NO: 141546 - DNA, 6 bp, Unknown
  misc_feature (1)..( 6): Result.003 file - promoters60/4772270
atagag

SEQ ID NO: 141547 - DNA, 6 bp, Unknown
  misc_feature (1)..( 6): Result.003 file - promoters60/4772270
atagag

SEQ ID NO: 141548 - DNA, 7 bp, Unknown
  misc_feature (1)..( 7): Result.003 file - promoters60/4772270
tatcttg

SEQ ID NO: 141549 - DNA, 7 bp, Unknown
  misc_feature (1)..( 7): Result.003 file - promoters60/4772270
tatattg

SEQ ID NO: 141550 - DNA, 6 bp, Unknown
  misc_feature (1)..( 6): Result.003 file - promoters60/4772270
aaagac

SEQ ID NO: 141551 - DNA, 6 bp, Unknown
  misc_feature (1)..( 6): Result.003 file - promoters60/4772270
aaagac

SEQ ID NO: 141552 - DNA, 7 bp, Unknown
  misc_feature (1)..( 7): Result.003 file - promoters60/4772270
taataaa

SEQ ID NO: 141553 - DNA, 7 bp, Unknown
  misc_feature (1)..( 7): Result.003 file - promoters60/4772270
taaaaaa

SEQ ID NO: 141554 - DNA, 6 bp, Unknown
  misc_feature (1)..( 6): Result.003 file - promoters60/4772270
taaaaa

SEQ ID NO: 141555 - DNA, 6 bp, Unknown
  misc_feature (1)..( 6): Result.003 file - promoters60/4772270
taaaaa

SEQ ID NO: 141556 - DNA, 6 bp, Unknown
  misc_feature (1)..( 6): Result.003 file - promoters60/4772270
cttcta

SEQ ID NO: 141557 - DNA, 6 bp, Unknown
  misc_feature (1)..( 6): Result.003 file - promoters60/4772270
cttcta

SEQ ID NO: 141558 - DNA, 7 bp, Unknown
  misc_feature (1)..( 7): Result.003 file - promoters60/4772270
tttctat

SEQ ID NO: 141559 - DNA, 7 bp, Unknown
  misc_feature (1)..( 7): Result.003 file - promoters60/4772270
tttgtat

SEQ ID NO: 141560 - DNA, 7 bp, Unknown
  misc_feature (1)..( 7): Result.003 file - promoters60/4772270
tatattg

SEQ ID NO: 141561 - DNA, 7 bp, Unknown
  misc_feature (1)..( 7): Result.003 file - promoters60/4772270
tatgttg

SEQ ID NO: 141562 - DNA, 8 bp, Unknown
  misc_feature (1)..( 8): Result.003 file - promoters60/4772270
tgttaaaa

SEQ ID NO: 141563 - DNA, 8 bp, Unknown
  misc_feature (1)..( 8): Result.003 file - promoters60/4772270
tgttgaaa

SEQ ID NO: 141564 - DNA, 8 bp, Unknown
  misc_feature (1)..( 8): Result.003 file - promoters60/4772270
cattaaac

SEQ ID NO: 141565 - DNA, 8 bp, Unknown
  misc_feature (1)..( 8): Result.003 file - promoters60/4772270
catttaac

SEQ ID NO: 141566 - DNA, 6 bp, Unknown
  misc_feature (1)..( 6): Result.003 file - promoters60/4772270
tctcca

SEQ ID NO: 141567 - DNA, 6 bp, Unknown
  misc_feature (1)..( 6): Result.003 file - promoters60/4772270
tctcca

SEQ ID NO: 141568 - DNA, 7 bp, Unknown
  misc_feature (1)..( 7): Result.003 file - promoters60/4772270
ccatttt

SEQ ID NO: 141569 - DNA, 7 bp, Unknown
  misc_feature (1)..( 7): Result.003 file - promoters60/4772270
ccatttt

SEQ ID NO: 141570 - DNA, 6 bp, Unknown
  misc_feature (1)..( 6): Result.003 file - promoters60/4772270
ttttca

SEQ ID NO: 141571 - DNA, 6 bp, Unknown
  misc_feature (1)..( 6): Result.003 file - promoters60/4772270
ttttca

SEQ ID NO: 141572 - DNA, 6 bp, Unknown
  misc_feature (1)..( 6): Result.003 file - promoters60/4772270
tgtctt

SEQ ID NO: 141573 - DNA, 6 bp, Unknown
  misc_feature (1)..( 6): Result.003 file - promoters60/4772270
tgtctt

SEQ ID NO: 141574 - DNA, 6 bp, Unknown
  misc_feature (1)..( 6): Result.003 file - promoters60/4772270
caagct

SEQ ID NO: 141575 - DNA, 6 bp, Unknown
  misc_feature (1)..( 6): Result.003 file - promoters60/4772270
caagct

SEQ ID NO: 141576 - DNA, 7 bp, Unknown
  misc_feature (1)..( 7): Result.003 file - promoters60/4772270
ataaata

SEQ ID NO: 141577 - DNA, 7 bp, Unknown
  misc_feature (1)..( 7): Result.003 file - promoters60/4772270
atacata

SEQ ID NO: 141578 - DNA, 6 bp, Unknown
  misc_feature (1)..( 6): Result.003 file - promoters60/4772274
ttcaga

SEQ ID NO: 141579 - DNA, 6 bp, Unknown
  misc_feature (1)..( 6): Result.003 file - promoters60/4772274
ttcaga

SEQ ID NO: 141580 - DNA, 6 bp, Unknown
  misc_feature (1)..( 6): Result.003 file - promoters60/4772274
tctgtt

SEQ ID NO: 141581 - DNA, 6 bp, Unknown
  misc_feature (1)..( 6): Result.003 file - promoters60/4772274
tctgtt

SEQ ID NO: 141582 - DNA, 6 bp, Unknown
  misc_feature (1)..( 6): Result.003 file - promoters60/4772274
ttcttt

SEQ ID NO: 141583 - DNA, 6 bp, Unknown
  misc_feature (1)..( 6): Result.003 file - promoters60/4772274
ttcttt

SEQ ID NO: 141584 - DNA, 6 bp, Unknown
  misc_feature (1)..( 6): Result.003 file - promoters60/4772274
ttcttt

SEQ ID NO: 141585 - DNA, 12 bp, Unknown
  misc_feature (1)..( 12): Result.003 file - promoters60/4772274
aaaagttatcat

SEQ ID NO: 141586 - DNA, 12 bp, Unknown
  misc_feature (1)..( 12): Result.003 file - promoters60/4772274
ttagtttaccat

SEQ ID NO: 141587 - DNA, 12 bp, Unknown
  misc_feature (1)..( 12): Result.003 file - promoters60/4772274
aaaggttatctc

SEQ ID NO: 141588 - DNA, 8 bp, Unknown
  misc_feature (1)..( 8): Result.003 file - promoters60/4772274
gtttggga

SEQ ID NO: 141589 - DNA, 8 bp, Unknown
  misc_feature (1)..( 8): Result.003 file - promoters60/4772274
gttaggga

SEQ ID NO: 141590 - DNA, 6 bp, Unknown
  misc_feature (1)..( 6): Result.003 file - promoters60/4772274
gggcct

SEQ ID NO: 141591 - DNA, 6 bp, Unknown
  misc_feature (1)..( 6): Result.003 file - promoters60/4772274
gggcct

SEQ ID NO: 141592 - DNA, 9 bp, Unknown
  misc_feature (1)..( 9): Result.003 file - promoters60/4772274
taaaaccac

SEQ ID NO: 141593 - DNA, 9 bp, Unknown
  misc_feature (1)..( 9): Result.003 file - promoters60/4772274
taaaagcac

SEQ ID NO: 141594 - DNA, 6 bp, Unknown
  misc_feature (1)..( 6): Result.003 file - promoters60/4772274
acaaaa

SEQ ID NO: 141595 - DNA, 6 bp, Unknown
  misc_feature (1)..( 6): Result.003 file - promoters60/4772274
acaaaa

SEQ ID NO: 141596 - DNA, 7 bp, Unknown
  misc_feature (1)..( 7): Result.003 file - promoters60/4772274
tatctct

SEQ ID NO: 141597 - DNA, 7 bp, Unknown
  misc_feature (1)..( 7): Result.003 file - promoters60/4772274
tatctct

SEQ ID NO: 141598 - DNA, 6 bp, Unknown
  misc_feature (1)..( 6): Result.003 file - promoters60/4772274
ttaatc

SEQ ID NO: 141599 - DNA, 6 bp, Unknown
  misc_feature (1)..( 6): Result.003 file - promoters60/4772274
ttaatc

SEQ ID NO: 141600 - DNA, 10 bp, Unknown
  misc_feature (1)..( 10): Result.003 file - promoters60/4772274
atcaaaagtg

SEQ ID NO: 141601 - DNA, 10 bp, Unknown
  misc_feature (1)..( 10): Result.003 file - promoters60/4772274
atcaaaatgt

SEQ ID NO: 141602 - DNA, 10 bp, Unknown
  misc_feature (1)..( 10): Result.003 file - promoters60/4772274
cccaaaatgt

SEQ ID NO: 141603 - DNA, 9 bp, Unknown
  misc_feature (1)..( 9): Result.003 file - promoters60/4772274
tcaaaagtg

SEQ ID NO: 141604 - DNA, 9 bp, Unknown
  misc_feature (1)..( 9): Result.003 file - promoters60/4772274
caaaatgtg

SEQ ID NO: 141605 - DNA, 9 bp, Unknown
  misc_feature (1)..( 9): Result.003 file - promoters60/4772274
caaaatgtt

SEQ ID NO: 141606 - DNA, 6 bp, Unknown
  misc_feature (1)..( 6): Result.003 file - promoters60/4772274
ttatta

SEQ ID NO: 141607 - DNA, 6 bp, Unknown
  misc_feature (1)..( 6): Result.003 file - promoters60/4772274
ttatta

SEQ ID NO: 141608 - DNA, 8 bp, Unknown
  misc_feature (1)..( 8): Result.003 file - promoters60/4772274
attttaag

SEQ ID NO: 141609 - DNA, 8 bp, Unknown
  misc_feature (1)..( 8): Result.003 file - promoters60/4772274
attgtaag

SEQ ID NO: 141610 - DNA, 6 bp, Unknown
  misc_feature (1)..( 6): Result.003 file - promoters60/4772274
tttcca

SEQ ID NO: 141611 - DNA, 6 bp, Unknown
  misc_feature (1)..( 6): Result.003 file - promoters60/4772274
tttcca

SEQ ID NO: 141612 - DNA, 7 bp, Unknown
  misc_feature (1)..( 7): Result.003 file - promoters60/4772274
ttgtatt

SEQ ID NO: 141613 - DNA, 7 bp, Unknown
  misc_feature (1)..( 7): Result.003 file - promoters60/4772274
ttgaatt

SEQ ID NO: 141614 - DNA, 7 bp, Unknown
  misc_feature (1)..( 7): Result.003 file - promoters60/4772274
tctcaga

SEQ ID NO: 141615 - DNA, 7 bp, Unknown
  misc_feature (1)..( 7): Result.003 file - promoters60/4772274
tctcaga

SEQ ID NO: 141616 - DNA, 9 bp, Unknown
  misc_feature (1)..( 9): Result.003 file - promoters60/4772274
aattgatca

SEQ ID NO: 141617 - DNA, 9 bp, Unknown
  misc_feature (1)..( 9): Result.003 file - promoters60/4772274
aatagatca

SEQ ID NO: 141618 - DNA, 7 bp, Unknown
  misc_feature (1)..( 7): Result.003 file - promoters60/4772274
caaaatt

SEQ ID NO: 141619 - DNA, 7 bp, Unknown
  misc_feature (1)..( 7): Result.003 file - promoters60/4772274
caacatt

SEQ ID NO: 141620 - DNA, 7 bp, Unknown
  misc_feature (1)..( 7): Result.003 file - promoters60/4772277
gattata

SEQ ID NO: 141621 - DNA, 7 bp, Unknown
  misc_feature (1)..( 7): Result.003 file - promoters60/4772277
gattata

SEQ ID NO: 141622 - DNA, 7 bp, Unknown
  misc_feature (1)..( 7): Result.003 file - promoters60/4772277
taaatga

SEQ ID NO: 141623 - DNA, 7 bp, Unknown
  misc_feature (1)..( 7): Result.003 file - promoters60/4772277
taaatga

SEQ ID NO: 141624 - DNA, 6 bp, Unknown
  misc_feature (1)..( 6): Result.003 file - promoters60/4772277
gtgaca

SEQ ID NO: 141625 - DNA, 6 bp, Unknown
  misc_feature (1)..( 6): Result.003 file - promoters60/4772277
gtgaca

SEQ ID NO: 141626 - DNA, 10 bp, Unknown
  misc_feature (1)..( 10): Result.003 file - promoters60/4772277
aaaacaaaaa

SEQ ID NO: 141627 - DNA, 10 bp, Unknown
  misc_feature (1)..( 10): Result.003 file - promoters60/4772277
aaaacaaaaa

SEQ ID NO: 141628 - DNA, 7 bp, Unknown
  misc_feature (1)..( 7): Result.003 file - promoters60/4772277
gcagcat

SEQ ID NO: 141629 - DNA, 7 bp, Unknown
  misc_feature (1)..( 7): Result.003 file - promoters60/4772277
gcatcat

SEQ ID NO: 141630 - DNA, 6 bp, Unknown
  misc_feature (1)..( 6): Result.003 file - promoters60/4772277
ttttat

SEQ ID NO: 141631 - DNA, 6 bp, Unknown
  misc_feature (1)..( 6): Result.003 file - promoters60/4772277
ttttat

SEQ ID NO: 141632 - DNA, 7 bp, Unknown
  misc_feature (1)..( 7): Result.003 file - promoters60/4772277
tctatgt

SEQ ID NO: 141633 - DNA, 7 bp, Unknown
  misc_feature (1)..( 7): Result.003 file - promoters60/4772277
tctgtgt

SEQ ID NO: 141634 - DNA, 6 bp, Unknown
  misc_feature (1)..( 6): Result.003 file - promoters60/4772277
aaatgt

SEQ ID NO: 141635 - DNA, 6 bp, Unknown
  misc_feature (1)..( 6): Result.003 file - promoters60/4772277
aaatgt

SEQ ID NO: 141636 - DNA, 10 bp, Unknown
  misc_feature (1)..( 10): Result.003 file - promoters60/4772277
gaaaatgtga

SEQ ID NO: 141637 - DNA, 10 bp, Unknown
  misc_feature (1)..( 10): Result.003 file - promoters60/4772277
gaaaaggtga

SEQ ID NO: 141638 - DNA, 7 bp, Unknown
  misc_feature (1)..( 7): Result.003 file - promoters60/4772277
caattta

SEQ ID NO: 141639 - DNA, 7 bp, Unknown
  misc_feature (1)..( 7): Result.003 file - promoters60/4772277
caagtta

SEQ ID NO: 141640 - DNA, 6 bp, Unknown
  misc_feature (1)..( 6): Result.003 file - promoters60/4772277
aacaaa

SEQ ID NO: 141641 - DNA, 6 bp, Unknown
  misc_feature (1)..( 6): Result.003 file - promoters60/4772277
aacaaa

SEQ ID NO: 141642 - DNA, 7 bp, Unknown
  misc_feature (1)..( 7): Result.003 file - promoters60/4772277
tgaagaa

SEQ ID NO: 141643 - DNA, 7 bp, Unknown
  misc_feature (1)..( 7): Result.003 file - promoters60/4772277
tgaagaa

SEQ ID NO: 141644 - DNA, 8 bp, Unknown
  misc_feature (1)..( 8): Result.003 file - promoters60/4772277
tatataat

SEQ ID NO: 141645 - DNA, 8 bp, Unknown
  misc_feature (1)..( 8): Result.003 file - promoters60/4772277
tatgtaat

SEQ ID NO: 141646 - DNA, 7 bp, Unknown
  misc_feature (1)..( 7): Result.003 file - promoters60/4772277
taagttg

SEQ ID NO: 141647 - DNA, 7 bp, Unknown
  misc_feature (1)..( 7): Result.003 file - promoters60/4772277
taagttg

SEQ ID NO: 141648 - DNA, 6 bp, Unknown
  misc_feature (1)..( 6): Result.003 file - promoters60/4772277
gttgac

SEQ ID NO: 141649 - DNA, 6 bp, Unknown
  misc_feature (1)..( 6): Result.003 file - promoters60/4772277
gttgac

SEQ ID NO: 141650 - DNA, 6 bp, Unknown
  misc_feature (1)..( 6): Result.003 file - promoters60/4772277
aagaaa

SEQ ID NO: 141651 - DNA, 6 bp, Unknown
  misc_feature (1)..( 6): Result.003 file - promoters60/4772277
aagaaa

SEQ ID NO: 141652 - DNA, 7 bp, Unknown
  misc_feature (1)..( 7): Result.003 file - promoters60/4772277
atgctct

SEQ ID NO: 141653 - DNA, 7 bp, Unknown
  misc_feature (1)..( 7): Result.003 file - promoters60/4772277
atgctct

SEQ ID NO: 141654 - DNA, 7 bp, Unknown
  misc_feature (1)..( 7): Result.003 file - promoters60/4772289
caacgat

SEQ ID NO: 141655 - DNA, 7 bp, Unknown
  misc_feature (1)..( 7): Result.003 file - promoters60/4772289
caaggat

SEQ ID NO: 141656 - DNA, 6 bp, Unknown
  misc_feature (1)..( 6): Result.003 file - promoters60/4772289
agatgt

SEQ ID NO: 141657 - DNA, 6 bp, Unknown
  misc_feature (1)..( 6): Result.003 file - promoters60/4772289
agatgt

SEQ ID NO: 141658 - DNA, 8 bp, Unknown
  misc_feature (1)..( 8): Result.003 file - promoters60/4772289
atgcgttg

SEQ ID NO: 141659 - DNA, 8 bp, Unknown
  misc_feature (1)..( 8): Result.003 file - promoters60/4772289
atgctttg

SEQ ID NO: 141660 - DNA, 7 bp, Unknown
  misc_feature (1)..( 7): Result.003 file - promoters60/4772289
tcaagtt

SEQ ID NO: 141661 - DNA, 7 bp, Unknown
  misc_feature (1)..( 7): Result.003 file - promoters60/4772289
tcaagtt

SEQ ID NO: 141662 - DNA, 6 bp, Unknown
  misc_feature (1)..( 6): Result.003 file - promoters60/4772289
aataaa

SEQ ID NO: 141663 - DNA, 6 bp, Unknown
  misc_feature (1)..( 6): Result.003 file - promoters60/4772289
aataaa

SEQ ID NO: 141664 - DNA, 6 bp, Unknown
  misc_feature (1)..( 6): Result.003 file - promoters60/4772289
agagct

SEQ ID NO: 141665 - DNA, 6 bp, Unknown
  misc_feature (1)..( 6): Result.003 file - promoters60/4772289
agagct

SEQ ID NO: 141666 - DNA, 8 bp, Unknown
  misc_feature (1)..( 8): Result.003 file - promoters60/4772289
gaatcaat

SEQ ID NO: 141667 - DNA, 8 bp, Unknown
  misc_feature (1)..( 8): Result.003 file - promoters60/4772289
gaaacaaa

SEQ ID NO: 141668 - DNA, 8 bp, Unknown
  misc_feature (1)..( 8): Result.003 file - promoters60/4772289
gaaagaaa

SEQ ID NO: 141669 - DNA, 6 bp, Unknown
  misc_feature (1)..( 6): Result.003 file - promoters60/4772289
ttgtta

SEQ ID NO: 141670 - DNA, 6 bp, Unknown
  misc_feature (1)..( 6): Result.003 file - promoters60/4772289
ttgtta

SEQ ID NO: 141671 - DNA, 6 bp, Unknown
  misc_feature (1)..( 6): Result.003 file - promoters60/4772289
agtaaa

SEQ ID NO: 141672 - DNA, 6 bp, Unknown
  misc_feature (1)..( 6): Result.003 file - promoters60/4772289
agtaaa

SEQ ID NO: 141673 - DNA, 7 bp, Unknown
  misc_feature (1)..( 7): Result.003 file - promoters60/4772289
aatcggg

SEQ ID NO: 141674 - DNA, 7 bp, Unknown
  misc_feature (1)..( 7): Result.003 file - promoters60/4772289
aattggg

SEQ ID NO: 141675 - DNA, 10 bp, Unknown
  misc_feature (1)..( 10): Result.003 file - promoters60/4772289
ggaaaagaaa

SEQ ID NO: 141676 - DNA, 10 bp, Unknown
  misc_feature (1)..( 10): Result.003 file - promoters60/4772289
ggaaatgaaa

SEQ ID NO: 141677 - DNA, 7 bp, Unknown
  misc_feature (1)..( 7): Result.003 file - promoters60/4772289
cccacta

SEQ ID NO: 141678 - DNA, 7 bp, Unknown
  misc_feature (1)..( 7): Result.003 file - promoters60/4772289
cccacta

SEQ ID NO: 141679 - DNA, 9 bp, Unknown
  misc_feature (1)..( 9): Result.003 file - promoters60/4772289
aaagaaaag

SEQ ID NO: 141680 - DNA, 9 bp, Unknown
  misc_feature (1)..( 9): Result.003 file - promoters60/4772289
aaagtaaag

SEQ ID NO: 141681 - DNA, 7 bp, Unknown
  misc_feature (1)..( 7): Result.003 file - promoters60/4772289
gtatata

SEQ ID NO: 141682 - DNA, 7 bp, Unknown
  misc_feature (1)..( 7): Result.003 file - promoters60/4772289
gtatata

SEQ ID NO: 141683 - DNA, 7 bp, Unknown
  misc_feature (1)..( 7): Result.003 file - promoters60/4772311
cctaaaa

SEQ ID NO: 141684 - DNA, 7 bp, Unknown
  misc_feature (1)..( 7): Result.003 file - promoters60/4772311
cctaaaa

SEQ ID NO: 141685 - DNA, 7 bp, Unknown
  misc_feature (1)..( 7): Result.003 file - promoters60/4772311
cctaaaa

SEQ ID NO: 141686 - DNA, 8 bp, Unknown
  misc_feature (1)..( 8): Result.003 file - promoters60/4772311
aaaatcgt

SEQ ID NO: 141687 - DNA, 8 bp, Unknown
  misc_feature (1)..( 8): Result.003 file - promoters60/4772311
aaaatcaa

SEQ ID NO: 141688 - DNA, 8 bp, Unknown
  misc_feature (1)..( 8): Result.003 file - promoters60/4772311
aaaacaag

SEQ ID NO: 141689 - DNA, 9 bp, Unknown
  misc_feature (1)..( 9): Result.003 file - promoters60/4772311
gtaaaattc

SEQ ID NO: 141690 - DNA, 9 bp, Unknown
  misc_feature (1)..( 9): Result.003 file - promoters60/4772311
gtaaaattt

SEQ ID NO: 141691 - DNA, 9 bp, Unknown
  misc_feature (1)..( 9): Result.003 file - promoters60/4772311
tgaaacttc

SEQ ID NO: 141692 - DNA, 6 bp, Unknown
  misc_feature (1)..( 6): Result.003 file - promoters60/4772311
tttcta

SEQ ID NO: 141693 - DNA, 6 bp, Unknown
  misc_feature (1)..( 6): Result.003 file - promoters60/4772311
tttcta

SEQ ID NO: 141694 - DNA, 6 bp, Unknown
  misc_feature (1)..( 6): Result.003 file - promoters60/4772311
ggtttg

SEQ ID NO: 141695 - DNA, 6 bp, Unknown
  misc_feature (1)..( 6): Result.003 file - promoters60/4772311
ggtttg

SEQ ID NO: 141696 - DNA, 8 bp, Unknown
  misc_feature (1)..( 8): Result.003 file - promoters60/4772311
catccaga

SEQ ID NO: 141697 - DNA, 8 bp, Unknown
  misc_feature (1)..( 8): Result.003 file - promoters60/4772311
catccaat

SEQ ID NO: 141698 - DNA, 8 bp, Unknown
  misc_feature (1)..( 8): Result.003 file - promoters60/4772311
catacaat

SEQ ID NO: 141699 - DNA, 8 bp, Unknown
  misc_feature (1)..( 8): Result.003 file - promoters60/4772311
tatcaaaa

SEQ ID NO: 141700 - DNA, 8 bp, Unknown
  misc_feature (1)..( 8): Result.003 file - promoters60/4772311
tatctaaa

SEQ ID NO: 141701 - DNA, 6 bp, Unknown
  misc_feature (1)..( 6): Result.003 file - promoters60/4772311
aaacga

SEQ ID NO: 141702 - DNA, 6 bp, Unknown
  misc_feature (1)..( 6): Result.003 file - promoters60/4772311
aaacga

SEQ ID NO: 141703 - DNA, 6 bp, Unknown
  misc_feature (1)..( 6): Result.003 file - promoters60/4772311
aagatg

SEQ ID NO: 141704 - DNA, 6 bp, Unknown
  misc_feature (1)..( 6): Result.003 file - promoters60/4772311
aagatg

SEQ ID NO: 141705 - DNA, 10 bp, Unknown
  misc_feature (1)..( 10): Result.003 file - promoters60/4772311
atgtttgtct

SEQ ID NO: 141706 - DNA, 10 bp, Unknown
  misc_feature (1)..( 10): Result.003 file - promoters60/4772311
atgtttctct

SEQ ID NO: 141707 - DNA, 7 bp, Unknown
  misc_feature (1)..( 7): Result.003 file - promoters60/4772311
gaaacaa

SEQ ID NO: 141708 - DNA, 7 bp, Unknown
  misc_feature (1)..( 7): Result.003 file - promoters60/4772311
gaaacaa

SEQ ID NO: 141709 - DNA, 6 bp, Unknown
  misc_feature (1)..( 6): Result.003 file - promoters60/4772311
tccata

SEQ ID NO: 141710 - DNA, 6 bp, Unknown
  misc_feature (1)..( 6): Result.003 file - promoters60/4772311
tccata

SEQ ID NO: 141711 - DNA, 8 bp, Unknown
  misc_feature (1)..( 8): Result.003 file - promoters60/4772329
atatataa

SEQ ID NO: 141712 - DNA, 8 bp, Unknown
  misc_feature (1)..( 8): Result.003 file - promoters60/4772329
atagataa

SEQ ID NO: 141713 - DNA, 7 bp, Unknown
  misc_feature (1)..( 7): Result.003 file - promoters60/4772329
ttatata

SEQ ID NO: 141714 - DNA, 7 bp, Unknown
  misc_feature (1)..( 7): Result.003 file - promoters60/4772329
gtatata

SEQ ID NO: 141715 - DNA, 7 bp, Unknown
  misc_feature (1)..( 7): Result.003 file - promoters60/4772329
ttatatc

SEQ ID NO: 141716 - DNA, 6 bp, Unknown
  misc_feature (1)..( 6): Result.003 file - promoters60/4772329
tatact

SEQ ID NO: 141717 - DNA, 6 bp, Unknown
  misc_feature (1)..( 6): Result.003 file - promoters60/4772329
tatact

SEQ ID NO: 141718 - DNA, 7 bp, Unknown
  misc_feature (1)..( 7): Result.003 file - promoters60/4772329
cgtatga

SEQ ID NO: 141719 - DNA, 7 bp, Unknown
  misc_feature (1)..( 7): Result.003 file - promoters60/4772329
cgtctga

SEQ ID NO: 141720 - DNA, 6 bp, Unknown
  misc_feature (1)..( 6): Result.003 file - promoters60/4772329
ttttct

SEQ ID NO: 141721 - DNA, 6 bp, Unknown
  misc_feature (1)..( 6): Result.003 file - promoters60/4772329
ttttct

SEQ ID NO: 141722 - DNA, 7 bp, Unknown
  misc_feature (1)..( 7): Result.003 file - promoters60/4772329
ttgtcta

SEQ ID NO: 141723 - DNA, 7 bp, Unknown
  misc_feature (1)..( 7): Result.003 file - promoters60/4772329
ttgtcta

SEQ ID NO: 141724 - DNA, 12 bp, Unknown
  misc_feature (1)..( 12): Result.003 file - promoters60/4772329
tatttaaacccc

SEQ ID NO: 141725 - DNA, 12 bp, Unknown
  misc_feature (1)..( 12): Result.003 file - promoters60/4772329
tatataacactc

SEQ ID NO: 141726 - DNA, 12 bp, Unknown
  misc_feature (1)..( 12): Result.003 file - promoters60/4772329
tatataaacccc

SEQ ID NO: 141727 - DNA, 6 bp, Unknown
  misc_feature (1)..( 6): Result.003 file - promoters60/4772329
aaaaca

SEQ ID NO: 141728 - DNA, 6 bp, Unknown
  misc_feature (1)..( 6): Result.003 file - promoters60/4772329
aaaaca

SEQ ID NO: 141729 - DNA, 7 bp, Unknown
  misc_feature (1)..( 7): Result.003 file - promoters60/4772329
ttgttta

SEQ ID NO: 141730 - DNA, 7 bp, Unknown
  misc_feature (1)..( 7): Result.003 file - promoters60/4772329
ttgttta

SEQ ID NO: 141731 - DNA, 9 bp, Unknown
  misc_feature (1)..( 9): Result.003 file - promoters60/4772329
taagttata

SEQ ID NO: 141732 - DNA, 9 bp, Unknown
  misc_feature (1)..( 9): Result.003 file - promoters60/4772329
taacttaat

SEQ ID NO: 141733 - DNA, 9 bp, Unknown
  misc_feature (1)..( 9): Result.003 file - promoters60/4772329
ttactcaat

SEQ ID NO: 141734 - DNA, 7 bp, Unknown
  misc_feature (1)..( 7): Result.003 file - promoters60/4772329
atactgc

SEQ ID NO: 141735 - DNA, 7 bp, Unknown
  misc_feature (1)..( 7): Result.003 file - promoters60/4772329
ataatgc

SEQ ID NO: 141736 - DNA, 9 bp, Unknown
  misc_feature (1)..( 9): Result.003 file - promoters60/4772329
tcattcatt

SEQ ID NO: 141737 - DNA, 9 bp, Unknown
  misc_feature (1)..( 9): Result.003 file - promoters60/4772329
atattcatt

SEQ ID NO: 141738 - DNA, 9 bp, Unknown
  misc_feature (1)..( 9): Result.003 file - promoters60/4772329
atattcaac

SEQ ID NO: 141739 - DNA, 7 bp, Unknown
  misc_feature (1)..( 7): Result.003 file - promoters60/4772329
aatataa

SEQ ID NO: 141740 - DNA, 7 bp, Unknown
  misc_feature (1)..( 7): Result.003 file - promoters60/4772329
aatttaa

SEQ ID NO: 141741 - DNA, 6 bp, Unknown
  misc_feature (1)..( 6): Result.003 file - promoters60/4772329
aaataa

SEQ ID NO: 141742 - DNA, 6 bp, Unknown
  misc_feature (1)..( 6): Result.003 file - promoters60/4772329
aaataa

SEQ ID NO: 141743 - DNA, 8 bp, Unknown
  misc_feature (1)..( 8): Result.003 file - promoters60/4772329
caacctga

SEQ ID NO: 141744 - DNA, 8 bp, Unknown
  misc_feature (1)..( 8): Result.003 file - promoters60/4772329
caacgtga

SEQ ID NO: 141745 - DNA, 6 bp, Unknown
  misc_feature (1)..( 6): Result.003 file - promoters60/4772329
attatt

SEQ ID NO: 141746 - DNA, 6 bp, Unknown
  misc_feature (1)..( 6): Result.003 file - promoters60/4772329
attatt

SEQ ID NO: 141747 - DNA, 7 bp, Unknown
  misc_feature (1)..( 7): Result.003 file - promoters60/4772329
tcatatt

SEQ ID NO: 141748 - DNA, 7 bp, Unknown
  misc_feature (1)..( 7): Result.003 file - promoters60/4772329
tcagatt

SEQ ID NO: 141749 - DNA, 9 bp, Unknown
  misc_feature (1)..( 9): Result.003 file - promoters60/4772329
gtagttctt

SEQ ID NO: 141750 - DNA, 9 bp, Unknown
  misc_feature (1)..( 9): Result.003 file - promoters60/4772329
gtacttctc

SEQ ID NO: 141751 - DNA, 9 bp, Unknown
  misc_feature (1)..( 9): Result.003 file - promoters60/4772329
tttcttctc

SEQ ID NO: 141752 - DNA, 9 bp, Unknown
  misc_feature (1)..( 9): Result.003 file - promoters60/4772329
aaaaggaac

SEQ ID NO: 141753 - DNA, 9 bp, Unknown
  misc_feature (1)..( 9): Result.003 file - promoters60/4772329
aaaagtaac

SEQ ID NO: 141754 - DNA, 10 bp, Unknown
  misc_feature (1)..( 10): Result.003 file - promoters60/4772329
atagtttaca

SEQ ID NO: 141755 - DNA, 10 bp, Unknown
  misc_feature (1)..( 10): Result.003 file - promoters60/4772329
atagtataca

SEQ ID NO: 141756 - DNA, 7 bp, Unknown
  misc_feature (1)..( 7): Result.003 file - promoters60/4772329
tgaaaaa

SEQ ID NO: 141757 - DNA, 7 bp, Unknown
  misc_feature (1)..( 7): Result.003 file - promoters60/4772329
tgacaaa

SEQ ID NO: 141758 - DNA, 6 bp, Unknown
  misc_feature (1)..( 6): Result.003 file - promoters60/4772329
tattta

SEQ ID NO: 141759 - DNA, 6 bp, Unknown
  misc_feature (1)..( 6): Result.003 file - promoters60/4772329
tattta

SEQ ID NO: 141760 - DNA, 8 bp, Unknown
  misc_feature (1)..( 8): Result.003 file - promoters60/4772329
aaatatta

SEQ ID NO: 141761 - DNA, 8 bp, Unknown
  misc_feature (1)..( 8): Result.003 file - promoters60/4772329
aaacatta

SEQ ID NO: 141762 - DNA, 6 bp, Unknown
  misc_feature (1)..( 6): Result.003 file - promoters60/4772329
tattat

SEQ ID NO: 141763 - DNA, 6 bp, Unknown
  misc_feature (1)..( 6): Result.003 file - promoters60/4772329
tattat

SEQ ID NO: 141764 - DNA, 8 bp, Unknown
  misc_feature (1)..( 8): Result.003 file - promoters60/4772329
caatttga

SEQ ID NO: 141765 - DNA, 8 bp, Unknown
  misc_feature (1)..( 8): Result.003 file - promoters60/4772329
caatatga

SEQ ID NO: 141766 - DNA, 7 bp, Unknown
  misc_feature (1)..( 7): Result.003 file - promoters60/4772332
aatctgt

SEQ ID NO: 141767 - DNA, 7 bp, Unknown
  misc_feature (1)..( 7): Result.003 file - promoters60/4772332
aatttgt

SEQ ID NO: 141768 - DNA, 7 bp, Unknown
  misc_feature (1)..( 7): Result.003 file - promoters60/4772332
cctacaa

SEQ ID NO: 141769 - DNA, 7 bp, Unknown
  misc_feature (1)..( 7): Result.003 file - promoters60/4772332
ccttcaa

SEQ ID NO: 141770 - DNA, 6 bp, Unknown
  misc_feature (1)..( 6): Result.003 file - promoters60/4772332
aagaga

SEQ ID NO: 141771 - DNA, 6 bp, Unknown
  misc_feature (1)..( 6): Result.003 file - promoters60/4772332
aagaga

SEQ ID NO: 141772 - DNA, 8 bp, Unknown
  misc_feature (1)..( 8): Result.003 file - promoters60/4772332
ttattttt

SEQ ID NO: 141773 - DNA, 8 bp, Unknown
  misc_feature (1)..( 8): Result.003 file - promoters60/4772332
ttattttt

SEQ ID NO: 141774 - DNA, 6 bp, Unknown
  misc_feature (1)..( 6): Result.003 file - promoters60/4772332
aaaaaa

SEQ ID NO: 141775 - DNA, 6 bp, Unknown
  misc_feature (1)..( 6): Result.003 file - promoters60/4772332
aaaaaa

SEQ ID NO: 141776 - DNA, 9 bp, Unknown
  misc_feature (1)..( 9): Result.003 file - promoters60/4772332
ttttgttat

SEQ ID NO: 141777 - DNA, 9 bp, Unknown
  misc_feature (1)..( 9): Result.003 file - promoters60/4772332
ttttggtat

SEQ ID NO: 141778 - DNA, 7 bp, Unknown
  misc_feature (1)..( 7): Result.003 file - promoters60/4772332
ttttatg

SEQ ID NO: 141779 - DNA, 7 bp, Unknown
  misc_feature (1)..( 7): Result.003 file - promoters60/4772332
tttaatg

SEQ ID NO: 141780 - DNA, 9 bp, Unknown
  misc_feature (1)..( 9): Result.003 file - promoters60/4772332
gtgtattgg

SEQ ID NO: 141781 - DNA, 9 bp, Unknown
  misc_feature (1)..( 9): Result.003 file - promoters60/4772332
gtgttttgg

SEQ ID NO: 141782 - DNA, 7 bp, Unknown
  misc_feature (1)..( 7): Result.003 file - promoters60/4772332
tgttgta

SEQ ID NO: 141783 - DNA, 7 bp, Unknown
  misc_feature (1)..( 7): Result.003 file - promoters60/4772332
tgttgta

SEQ ID NO: 141784 - DNA, 6 bp, Unknown
  misc_feature (1)..( 6): Result.003 file - promoters60/4772332
caagag

SEQ ID NO: 141785 - DNA, 6 bp, Unknown
  misc_feature (1)..( 6): Result.003 file - promoters60/4772332
caagag

SEQ ID NO: 141786 - DNA, 7 bp, Unknown
  misc_feature (1)..( 7): Result.003 file - promoters60/4772332
gactata

SEQ ID NO: 141787 - DNA, 7 bp, Unknown
  misc_feature (1)..( 7): Result.003 file - promoters60/4772332
gaccata

SEQ ID NO: 141788 - DNA, 12 bp, Unknown
  misc_feature (1)..( 12): Result.003 file - promoters60/4772336
ttatatatagaa

SEQ ID NO: 141789 - DNA, 12 bp, Unknown
  misc_feature (1)..( 12): Result.003 file - promoters60/4772336
ctatatataaaa

SEQ ID NO: 141790 - DNA, 12 bp, Unknown
  misc_feature (1)..( 12): Result.003 file - promoters60/4772336
ttatatataacc

SEQ ID NO: 141791 - DNA, 12 bp, Unknown
  misc_feature (1)..( 12): Result.003 file - promoters60/4772336
atataaataaca

SEQ ID NO: 141792 - DNA, 12 bp, Unknown
  misc_feature (1)..( 12): Result.003 file - promoters60/4772336
ctataaattaca

SEQ ID NO: 141793 - DNA, 12 bp, Unknown
  misc_feature (1)..( 12): Result.003 file - promoters60/4772336
agatataataca

SEQ ID NO: 141794 - DNA, 12 bp, Unknown
  misc_feature (1)..( 12): Result.003 file - promoters60/4772336
gtataaattgta

SEQ ID NO: 141795 - DNA, 15 bp, Unknown
  misc_feature (1)..( 15): Result.003 file - promoters60/4772336
agaatacatttcata

SEQ ID NO: 141796 - DNA, 15 bp, Unknown
  misc_feature (1)..( 15): Result.003 file - promoters60/4772336
tgataacatttcgtt

SEQ ID NO: 141797 - DNA, 15 bp, Unknown
  misc_feature (1)..( 15): Result.003 file - promoters60/4772336
ttcgtagattgcgtg

SEQ ID NO: 141798 - DNA, 15 bp, Unknown
  misc_feature (1)..( 15): Result.003 file - promoters60/4772336
tttttagtttgtgtg

SEQ ID NO: 141799 - DNA, 15 bp, Unknown
  misc_feature (1)..( 15): Result.003 file - promoters60/4772336
aatctcgtgtgcaag

SEQ ID NO: 141800 - DNA, 15 bp, Unknown
  misc_feature (1)..( 15): Result.003 file - promoters60/4772336
tttttaatttgtgtc

SEQ ID NO: 141801 - DNA, 15 bp, Unknown
  misc_feature (1)..( 15): Result.003 file - promoters60/4772336
attgtatatttagtt

SEQ ID NO: 141802 - DNA, 9 bp, Unknown
  misc_feature (1)..( 9): Result.003 file - promoters60/4772336
ataagaaat

SEQ ID NO: 141803 - DNA, 9 bp, Unknown
  misc_feature (1)..( 9): Result.003 file - promoters60/4772336
acaagaaaa

SEQ ID NO: 141804 - DNA, 9 bp, Unknown
  misc_feature (1)..( 9): Result.003 file - promoters60/4772336
ttaaaaaag

SEQ ID NO: 141805 - DNA, 9 bp, Unknown
  misc_feature (1)..( 9): Result.003 file - promoters60/4772336
acaggaaaa

SEQ ID NO: 141806 - DNA, 10 bp, Unknown
  misc_feature (1)..( 10): Result.003 file - promoters60/4772336
taaagcaaac

SEQ ID NO: 141807 - DNA, 10 bp, Unknown
  misc_feature (1)..( 10): Result.003 file - promoters60/4772336
atcttaaaat

SEQ ID NO: 141808 - DNA, 8 bp, Unknown
  misc_feature (1)..( 8): Result.003 file - promoters60/4772346
agatactt

SEQ ID NO: 141809 - DNA, 8 bp, Unknown
  misc_feature (1)..( 8): Result.003 file - promoters60/4772346
agatacag

SEQ ID NO: 141810 - DNA, 8 bp, Unknown
  misc_feature (1)..( 8): Result.003 file - promoters60/4772346
agagacat

SEQ ID NO: 141811 - DNA, 8 bp, Unknown
  misc_feature (1)..( 8): Result.003 file - promoters60/4772346
cgatccag

SEQ ID NO: 141812 - DNA, 8 bp, Unknown
  misc_feature (1)..( 8): Result.003 file - promoters60/4772370
attaaaaa

SEQ ID NO: 141813 - DNA, 8 bp, Unknown
  misc_feature (1)..( 8): Result.003 file - promoters60/4772370
attgaaaa

SEQ ID NO: 141814 - DNA, 8 bp, Unknown
  misc_feature (1)..( 8): Result.003 file - promoters60/4772370
attaaaag

SEQ ID NO: 141815 - DNA, 12 bp, Unknown
  misc_feature (1)..( 12): Result.003 file - promoters60/4772370
aagtaataacac

SEQ ID NO: 141816 - DNA, 12 bp, Unknown
  misc_feature (1)..( 12): Result.003 file - promoters60/4772370
atgtaatgacac

SEQ ID NO: 141817 - DNA, 12 bp, Unknown
  misc_feature (1)..( 12): Result.003 file - promoters60/4772370
atggaatagatc

SEQ ID NO: 141818 - DNA, 8 bp, Unknown
  misc_feature (1)..( 8): Result.003 file - promoters60/4772370
tataaaaa

SEQ ID NO: 141819 - DNA, 8 bp, Unknown
  misc_feature (1)..( 8): Result.003 file - promoters60/4772370
attaaaaa

SEQ ID NO: 141820 - DNA, 8 bp, Unknown
  misc_feature (1)..( 8): Result.003 file - promoters60/4772370
tataaaag

SEQ ID NO: 141821 - DNA, 12 bp, Unknown
  misc_feature (1)..( 12): Result.003 file - promoters60/4772370
aaaagaaacaaa

SEQ ID NO: 141822 - DNA, 12 bp, Unknown
  misc_feature (1)..( 12): Result.003 file - promoters60/4772370
aaaagaaaaaaa

SEQ ID NO: 141823 - DNA, 12 bp, Unknown
  misc_feature (1)..( 12): Result.003 file - promoters60/4772370
caattaaaaaag

SEQ ID NO: 141824 - DNA, 8 bp, Unknown
  misc_feature (1)..( 8): Result.003 file - promoters60/4772378
cttttaga

SEQ ID NO: 141825 - DNA, 8 bp, Unknown
  misc_feature (1)..( 8): Result.003 file - promoters60/4772378
gttttaga

SEQ ID NO: 141826 - DNA, 8 bp, Unknown
  misc_feature (1)..( 8): Result.003 file - promoters60/4772378
tgtttaga

SEQ ID NO: 141827 - DNA, 8 bp, Unknown
  misc_feature (1)..( 8): Result.003 file - promoters60/4772378
tgttgaga

SEQ ID NO: 141828 - DNA, 8 bp, Unknown
  misc_feature (1)..( 8): Result.003 file - promoters60/4772382
atgcagga

SEQ ID NO: 141829 - DNA, 8 bp, Unknown
  misc_feature (1)..( 8): Result.003 file - promoters60/4772382
atggagga

SEQ ID NO: 141830 - DNA, 8 bp, Unknown
  misc_feature (1)..( 8): Result.003 file - promoters60/4772382
aagtgttt

SEQ ID NO: 141831 - DNA, 8 bp, Unknown
  misc_feature (1)..( 8): Result.003 file - promoters60/4772382
gagtattt

SEQ ID NO: 141832 - DNA, 8 bp, Unknown
  misc_feature (1)..( 8): Result.003 file - promoters60/4772382
aagttttt

SEQ ID NO: 141833 - DNA, 6 bp, Unknown
  misc_feature (1)..( 6): Result.003 file - promoters60/4772382
gtaaag

SEQ ID NO: 141834 - DNA, 6 bp, Unknown
  misc_feature (1)..( 6): Result.003 file - promoters60/4772382
gtaaag

SEQ ID NO: 141835 - DNA, 8 bp, Unknown
  misc_feature (1)..( 8): Result.003 file - promoters60/4772382
gttacaac

SEQ ID NO: 141836 - DNA, 8 bp, Unknown
  misc_feature (1)..( 8): Result.003 file - promoters60/4772382
gttataac

SEQ ID NO: 141837 - DNA, 9 bp, Unknown
  misc_feature (1)..( 9): Result.003 file - promoters60/4772382
ccttttaaa

SEQ ID NO: 141838 - DNA, 9 bp, Unknown
  misc_feature (1)..( 9): Result.003 file - promoters60/4772382
ccttataaa

SEQ ID NO: 141839 - DNA, 9 bp, Unknown
  misc_feature (1)..( 9): Result.003 file - promoters60/4772382
atatataaa

SEQ ID NO: 141840 - DNA, 10 bp, Unknown
  misc_feature (1)..( 10): Result.003 file - promoters60/4772382
acatatgatt

SEQ ID NO: 141841 - DNA, 10 bp, Unknown
  misc_feature (1)..( 10): Result.003 file - promoters60/4772382
acataagatt

SEQ ID NO: 141842 - DNA, 8 bp, Unknown
  misc_feature (1)..( 8): Result.003 file - promoters60/4772382
atttacat

SEQ ID NO: 141843 - DNA, 8 bp, Unknown
  misc_feature (1)..( 8): Result.003 file - promoters60/4772382
attcacat

SEQ ID NO: 141844 - DNA, 6 bp, Unknown
  misc_feature (1)..( 6): Result.003 file - promoters60/4772382
tttcaa

SEQ ID NO: 141845 - DNA, 6 bp, Unknown
  misc_feature (1)..( 6): Result.003 file - promoters60/4772382
tttcaa

SEQ ID NO: 141846 - DNA, 7 bp, Unknown
  misc_feature (1)..( 7): Result.003 file - promoters60/4772382
attttag

SEQ ID NO: 141847 - DNA, 7 bp, Unknown
  misc_feature (1)..( 7): Result.003 file - promoters60/4772382
attttag

SEQ ID NO: 141848 - DNA, 7 bp, Unknown
  misc_feature (1)..( 7): Result.003 file - promoters60/4772382
ttttagt

SEQ ID NO: 141849 - DNA, 7 bp, Unknown
  misc_feature (1)..( 7): Result.003 file - promoters60/4772382
tttaagt

SEQ ID NO: 141850 - DNA, 8 bp, Unknown
  misc_feature (1)..( 8): Result.003 file - promoters60/4772382
tttattta

SEQ ID NO: 141851 - DNA, 8 bp, Unknown
  misc_feature (1)..( 8): Result.003 file - promoters60/4772382
ttttttta

SEQ ID NO: 141852 - DNA, 6 bp, Unknown
  misc_feature (1)..( 6): Result.003 file - promoters60/4772382
taaacg

SEQ ID NO: 141853 - DNA, 6 bp, Unknown
  misc_feature (1)..( 6): Result.003 file - promoters60/4772382
taaacg

SEQ ID NO: 141854 - DNA, 9 bp, Unknown
  misc_feature (1)..( 9): Result.003 file - promoters60/4772382
atattacca

SEQ ID NO: 141855 - DNA, 9 bp, Unknown
  misc_feature (1)..( 9): Result.003 file - promoters60/4772382
atatttcca

SEQ ID NO: 141856 - DNA, 11 bp, Unknown
  misc_feature (1)..( 11): Result.003 file - promoters60/4772382
caaaatttcaa

SEQ ID NO: 141857 - DNA, 11 bp, Unknown
  misc_feature (1)..( 11): Result.003 file - promoters60/4772382
caaaatgtcaa

SEQ ID NO: 141858 - DNA, 6 bp, Unknown
  misc_feature (1)..( 6): Result.003 file - promoters60/4772382
aaacat

SEQ ID NO: 141859 - DNA, 6 bp, Unknown
  misc_feature (1)..( 6): Result.003 file - promoters60/4772382
aaacat

SEQ ID NO: 141860 - DNA, 10 bp, Unknown
  misc_feature (1)..( 10): Result.003 file - promoters60/4772382
aaaaagaaaa

SEQ ID NO: 141861 - DNA, 10 bp, Unknown
  misc_feature (1)..( 10): Result.003 file - promoters60/4772382
aaaaaaaaaa

SEQ ID NO: 141862 - DNA, 9 bp, Unknown
  misc_feature (1)..( 9): Result.003 file - promoters60/4772382
caaaatcta

SEQ ID NO: 141863 - DNA, 9 bp, Unknown
  misc_feature (1)..( 9): Result.003 file - promoters60/4772382
caaaaccta

SEQ ID NO: 141864 - DNA, 6 bp, Unknown
  misc_feature (1)..( 6): Result.003 file - promoters60/4772382
gaaaaa

SEQ ID NO: 141865 - DNA, 6 bp, Unknown
  misc_feature (1)..( 6): Result.003 file - promoters60/4772382
gaaaaa

SEQ ID NO: 141866 - DNA, 6 bp, Unknown
  misc_feature (1)..( 6): Result.003 file - promoters60/4772382
aattca

SEQ ID NO: 141867 - DNA, 6 bp, Unknown
  misc_feature (1)..( 6): Result.003 file - promoters60/4772382
aattca

SEQ ID NO: 141868 - DNA, 7 bp, Unknown
  misc_feature (1)..( 7): Result.003 file - promoters60/4772382
attgaaa

SEQ ID NO: 141869 - DNA, 7 bp, Unknown
  misc_feature (1)..( 7): Result.003 file - promoters60/4772382
attaaaa

SEQ ID NO: 141870 - DNA, 17 bp, Unknown
  misc_feature (1)..( 17): Result.003 file - promoters60/4772389
ttggggaaaaaaaagac

SEQ ID NO: 141871 - DNA, 17 bp, Unknown
  misc_feature (1)..( 17): Result.003 file - promoters60/4772389
agacggaacaaaaccgt

SEQ ID NO: 141872 - DNA, 17 bp, Unknown
  misc_feature (1)..( 17): Result.003 file - promoters60/4772389
tgagttaaaaaatatta

SEQ ID NO: 141873 - DNA, 17 bp, Unknown
  misc_feature (1)..( 17): Result.003 file - promoters60/4772389
aaaaagaagaaaaaata

SEQ ID NO: 141874 - DNA, 17 bp, Unknown
  misc_feature (1)..( 17): Result.003 file - promoters60/4772389
tcgattaacaaactaat

SEQ ID NO: 141875 - DNA, 17 bp, Unknown
  misc_feature (1)..( 17): Result.003 file - promoters60/4772389
tgttaaaccaaaacgac

SEQ ID NO: 141876 - DNA, 17 bp, Unknown
  misc_feature (1)..( 17): Result.003 file - promoters60/4772389
ccgtaagccaaaacatc

SEQ ID NO: 141877 - DNA, 17 bp, Unknown
  misc_feature (1)..( 17): Result.003 file - promoters60/4772389
atatataagaaaatata

SEQ ID NO: 141878 - DNA, 10 bp, Unknown
  misc_feature (1)..( 10): Result.003 file - promoters60/4772389
ccaaaaataa

SEQ ID NO: 141879 - DNA, 10 bp, Unknown
  misc_feature (1)..( 10): Result.003 file - promoters60/4772389
acaaaaaaag

SEQ ID NO: 141880 - DNA, 10 bp, Unknown
  misc_feature (1)..( 10): Result.003 file - promoters60/4772389
ataaacatat

SEQ ID NO: 141881 - DNA, 10 bp, Unknown
  misc_feature (1)..( 10): Result.003 file - promoters60/4772389
acaaaagaca

SEQ ID NO: 141882 - DNA, 10 bp, Unknown
  misc_feature (1)..( 10): Result.003 file - promoters60/4772389
taaaaaaaaa

SEQ ID NO: 141883 - DNA, 10 bp, Unknown
  misc_feature (1)..( 10): Result.003 file - promoters60/4772389
ttaaacatat

SEQ ID NO: 141884 - DNA, 10 bp, Unknown
  misc_feature (1)..( 10): Result.003 file - promoters60/4772389
ttaaactgtt

SEQ ID NO: 141885 - DNA, 10 bp, Unknown
  misc_feature (1)..( 10): Result.003 file - promoters60/4772389
atttatttcg

SEQ ID NO: 141886 - DNA, 10 bp, Unknown
  misc_feature (1)..( 10): Result.003 file - promoters60/4772389
atttatgtcg

SEQ ID NO: 141887 - DNA, 10 bp, Unknown
  misc_feature (1)..( 10): Result.003 file - promoters60/4772389
attcatttta

SEQ ID NO: 141888 - DNA, 10 bp, Unknown
  misc_feature (1)..( 10): Result.003 file - promoters60/4772389
atttttttac

SEQ ID NO: 141889 - DNA, 10 bp, Unknown
  misc_feature (1)..( 10): Result.003 file - promoters60/4772389
gttttttcta

SEQ ID NO: 141890 - DNA, 10 bp, Unknown
  misc_feature (1)..( 10): Result.003 file - promoters60/4772389
ctttttacgg

SEQ ID NO: 141891 - DNA, 17 bp, Unknown
  misc_feature (1)..( 17): Result.003 file - promoters60/4772389
aagacaaacggtctaaa

SEQ ID NO: 141892 - DNA, 17 bp, Unknown
  misc_feature (1)..( 17): Result.003 file - promoters60/4772389
ttaacaaactaattaaa

SEQ ID NO: 141893 - DNA, 17 bp, Unknown
  misc_feature (1)..( 17): Result.003 file - promoters60/4772389
taaaaaaagaagaaaaa

SEQ ID NO: 141894 - DNA, 17 bp, Unknown
  misc_feature (1)..( 17): Result.003 file - promoters60/4772389
ggaacaaaaccgtgatc

SEQ ID NO: 141895 - DNA, 17 bp, Unknown
  misc_feature (1)..( 17): Result.003 file - promoters60/4772389
taaataaatttttgagt

SEQ ID NO: 141896 - DNA, 17 bp, Unknown
  misc_feature (1)..( 17): Result.003 file - promoters60/4772389
aaaataaactcattcaa

SEQ ID NO: 141897 - DNA, 12 bp, Unknown
  misc_feature (1)..( 12): Result.003 file - promoters60/4772389
gaaaaaaaagac

SEQ ID NO: 141898 - DNA, 12 bp, Unknown
  misc_feature (1)..( 12): Result.003 file - promoters60/4772389
agttaaaaagtg

SEQ ID NO: 141899 - DNA, 12 bp, Unknown
  misc_feature (1)..( 12): Result.003 file - promoters60/4772389
aaccaaaacgac

SEQ ID NO: 141900 - DNA, 12 bp, Unknown
  misc_feature (1)..( 12): Result.003 file - promoters60/4772389
gaacaaaaccgt

SEQ ID NO: 141901 - DNA, 12 bp, Unknown
  misc_feature (1)..( 12): Result.003 file - promoters60/4772389
agccaaaacatc

SEQ ID NO: 141902 - DNA, 12 bp, Unknown
  misc_feature (1)..( 12): Result.003 file - promoters60/4772389
agttaaaaaata

SEQ ID NO: 141903 - DNA, 12 bp, Unknown
  misc_feature (1)..( 12): Result.003 file - promoters60/4772389
taagaaaatata

SEQ ID NO: 141904 - DNA, 11 bp, Unknown
  misc_feature (1)..( 11): Result.003 file - promoters60/4772389
caaaaataaga

SEQ ID NO: 141905 - DNA, 11 bp, Unknown
  misc_feature (1)..( 11): Result.003 file - promoters60/4772389
gacaaataaat

SEQ ID NO: 141906 - DNA, 11 bp, Unknown
  misc_feature (1)..( 11): Result.003 file - promoters60/4772389
tacaaaaaaag

SEQ ID NO: 141907 - DNA, 11 bp, Unknown
  misc_feature (1)..( 11): Result.003 file - promoters60/4772389
ttaaaaaaaaa

SEQ ID NO: 141908 - DNA, 11 bp, Unknown
  misc_feature (1)..( 11): Result.003 file - promoters60/4772389
aacatataata

SEQ ID NO: 141909 - DNA, 11 bp, Unknown
  misc_feature (1)..( 11): Result.003 file - promoters60/4772389
gacaaataaac

SEQ ID NO: 141910 - DNA, 11 bp, Unknown
  misc_feature (1)..( 11): Result.003 file - promoters60/4772389
ttgtaatgaac

SEQ ID NO: 141911 - DNA, 12 bp, Unknown
  misc_feature (1)..( 12): Result.003 file - promoters60/4772389
ccttaattaccg

SEQ ID NO: 141912 - DNA, 12 bp, Unknown
  misc_feature (1)..( 12): Result.003 file - promoters60/4772389
atataattattt

SEQ ID NO: 141913 - DNA, 12 bp, Unknown
  misc_feature (1)..( 12): Result.003 file - promoters60/4772389
tattaattagtc

SEQ ID NO: 141914 - DNA, 12 bp, Unknown
  misc_feature (1)..( 12): Result.003 file - promoters60/4772389
aaaatattatta

SEQ ID NO: 141915 - DNA, 12 bp, Unknown
  misc_feature (1)..( 12): Result.003 file - promoters60/4772389
aactaattaaac

SEQ ID NO: 141916 - DNA, 12 bp, Unknown
  misc_feature (1)..( 12): Result.003 file - promoters60/4772389
tatgaattggat

SEQ ID NO: 141917 - DNA, 13 bp, Unknown
  misc_feature (1)..( 13): Result.003 file - promoters60/4772393
tgattgatctgtg

SEQ ID NO: 141918 - DNA, 13 bp, Unknown
  misc_feature (1)..( 13): Result.003 file - promoters60/4772393
caatttatctaac

SEQ ID NO: 141919 - DNA, 13 bp, Unknown
  misc_feature (1)..( 13): Result.003 file - promoters60/4772393
caacttaattctt

SEQ ID NO: 141920 - DNA, 13 bp, Unknown
  misc_feature (1)..( 13): Result.003 file - promoters60/4772393
ccatttttctact

SEQ ID NO: 141921 - DNA, 13 bp, Unknown
  misc_feature (1)..( 13): Result.003 file - promoters60/4772393
aaatttacgctca

SEQ ID NO: 141922 - DNA, 13 bp, Unknown
  misc_feature (1)..( 13): Result.003 file - promoters60/4772393
aatactatgtaaa

SEQ ID NO: 141923 - DNA, 13 bp, Unknown
  misc_feature (1)..( 13): Result.003 file - promoters60/4772393
cctcaaatgcaaa

SEQ ID NO: 141924 - DNA, 11 bp, Unknown
  misc_feature (1)..( 11): Result.003 file - promoters60/4772393
tctttttacag

SEQ ID NO: 141925 - DNA, 11 bp, Unknown
  misc_feature (1)..( 11): Result.003 file - promoters60/4772393
tttttctactt

SEQ ID NO: 141926 - DNA, 12 bp, Unknown
  misc_feature (1)..( 12): Result.003 file - promoters60/4772393
cactttctattt

SEQ ID NO: 141927 - DNA, 12 bp, Unknown
  misc_feature (1)..( 12): Result.003 file - promoters60/4772393
atttatctaaca

SEQ ID NO: 141928 - DNA, 12 bp, Unknown
  misc_feature (1)..( 12): Result.003 file - promoters60/4772393
tactatgtaaag

SEQ ID NO: 141929 - DNA, 12 bp, Unknown
  misc_feature (1)..( 12): Result.003 file - promoters60/4772393
tcaaatgcaaac

SEQ ID NO: 141930 - DNA, 13 bp, Unknown
  misc_feature (1)..( 13): Result.003 file - promoters60/4772398
aatgggctgggcc

SEQ ID NO: 141931 - DNA, 13 bp, Unknown
  misc_feature (1)..( 13): Result.003 file - promoters60/4772398
aatgggcctaatt

SEQ ID NO: 141932 - DNA, 13 bp, Unknown
  misc_feature (1)..( 13): Result.003 file - promoters60/4772398
tttgggcttctta

SEQ ID NO: 141933 - DNA, 13 bp, Unknown
  misc_feature (1)..( 13): Result.003 file - promoters60/4772398
aataggcccaaca

SEQ ID NO: 141934 - DNA, 13 bp, Unknown
  misc_feature (1)..( 13): Result.003 file - promoters60/4772398
gttgggcttttaa

SEQ ID NO: 141935 - DNA, 13 bp, Unknown
  misc_feature (1)..( 13): Result.003 file - promoters60/4772398
attgggcttttta

SEQ ID NO: 141936 - DNA, 8 bp, Unknown
  misc_feature (1)..( 8): Result.003 file - promoters60/4772700
tatatatt

SEQ ID NO: 141937 - DNA, 8 bp, Unknown
  misc_feature (1)..( 8): Result.003 file - promoters60/4772700
attatatt

SEQ ID NO: 141938 - DNA, 8 bp, Unknown
  misc_feature (1)..( 8): Result.003 file - promoters60/4772700
tatgtatt

SEQ ID NO: 141939 - DNA, 8 bp, Unknown
  misc_feature (1)..( 8): Result.003 file - promoters60/4772700
tatatatt

SEQ ID NO: 141940 - DNA, 8 bp, Unknown
  misc_feature (1)..( 8): Result.003 file - promoters60/4772700
cttacatt

SEQ ID NO: 141941 - DNA, 8 bp, Unknown
  misc_feature (1)..( 8): Result.003 file - promoters60/4772700
aatggatt

SEQ ID NO: 141942 - DNA, 6 bp, Unknown
  misc_feature (1)..( 6): Result.003 file - promoters60/4772706
tgatgt

SEQ ID NO: 141943 - DNA, 6 bp, Unknown
  misc_feature (1)..( 6): Result.003 file - promoters60/4772706
tgatgt

SEQ ID NO: 141944 - DNA, 7 bp, Unknown
  misc_feature (1)..( 7): Result.003 file - promoters60/4772706
cattaga

SEQ ID NO: 141945 - DNA, 7 bp, Unknown
  misc_feature (1)..( 7): Result.003 file - promoters60/4772706
catgaga

SEQ ID NO: 141946 - DNA, 6 bp, Unknown
  misc_feature (1)..( 6): Result.003 file - promoters60/4772706
taatag

SEQ ID NO: 141947 - DNA, 6 bp, Unknown
  misc_feature (1)..( 6): Result.003 file - promoters60/4772706
taatag

SEQ ID NO: 141948 - DNA, 7 bp, Unknown
  misc_feature (1)..( 7): Result.003 file - promoters60/4772706
tcagaat

SEQ ID NO: 141949 - DNA, 7 bp, Unknown
  misc_feature (1)..( 7): Result.003 file - promoters60/4772706
tcaaaat

SEQ ID NO: 141950 - DNA, 6 bp, Unknown
  misc_feature (1)..( 6): Result.003 file - promoters60/4772706
tgtctt

SEQ ID NO: 141951 - DNA, 6 bp, Unknown
  misc_feature (1)..( 6): Result.003 file - promoters60/4772706
tgtctt

SEQ ID NO: 141952 - DNA, 8 bp, Unknown
  misc_feature (1)..( 8): Result.003 file - promoters60/4772706
aacagaag

SEQ ID NO: 141953 - DNA, 8 bp, Unknown
  misc_feature (1)..( 8): Result.003 file - promoters60/4772706
aacaaaag

SEQ ID NO: 141954 - DNA, 7 bp, Unknown
  misc_feature (1)..( 7): Result.003 file - promoters60/4772706
ttttgtt

SEQ ID NO: 141955 - DNA, 7 bp, Unknown
  misc_feature (1)..( 7): Result.003 file - promoters60/4772706
gtttgtt

SEQ ID NO: 141956 - DNA, 7 bp, Unknown
  misc_feature (1)..( 7): Result.003 file - promoters60/4772706
gttagtt

SEQ ID NO: 141957 - DNA, 6 bp, Unknown
  misc_feature (1)..( 6): Result.003 file - promoters60/4772706
attttt

SEQ ID NO: 141958 - DNA, 6 bp, Unknown
  misc_feature (1)..( 6): Result.003 file - promoters60/4772706
attttt

SEQ ID NO: 141959 - DNA, 6 bp, Unknown
  misc_feature (1)..( 6): Result.003 file - promoters60/4772706
ttttgt

SEQ ID NO: 141960 - DNA, 6 bp, Unknown
  misc_feature (1)..( 6): Result.003 file - promoters60/4772706
ttttgt

SEQ ID NO: 141961 - DNA, 6 bp, Unknown
  misc_feature (1)..( 6): Result.003 file - promoters60/4772706
tgggtc

SEQ ID NO: 141962 - DNA, 6 bp, Unknown
  misc_feature (1)..( 6): Result.003 file - promoters60/4772706
tgggtc

SEQ ID NO: 141963 - DNA, 6 bp, Unknown
  misc_feature (1)..( 6): Result.003 file - promoters60/4772706
cttctt

SEQ ID NO: 141964 - DNA, 6 bp, Unknown
  misc_feature (1)..( 6): Result.003 file - promoters60/4772706
cttctt

SEQ ID NO: 141965 - DNA, 6 bp, Unknown
  misc_feature (1)..( 6): Result.003 file - promoters60/4772706
tgataa

SEQ ID NO: 141966 - DNA, 6 bp, Unknown
  misc_feature (1)..( 6): Result.003 file - promoters60/4772706
tgataa

SEQ ID NO: 141967 - DNA, 6 bp, Unknown
  misc_feature (1)..( 6): Result.003 file - promoters60/4772710
tttctt

SEQ ID NO: 141968 - DNA, 6 bp, Unknown
  misc_feature (1)..( 6): Result.003 file - promoters60/4772710
tttctt

SEQ ID NO: 141969 - DNA, 7 bp, Unknown
  misc_feature (1)..( 7): Result.003 file - promoters60/4772710
tttgctt

SEQ ID NO: 141970 - DNA, 8 bp, Unknown
  misc_feature (1)..( 8): Result.003 file - promoters60/4772710
gaatcaaa

SEQ ID NO: 141971 - DNA, 8 bp, Unknown
  misc_feature (1)..( 8): Result.003 file - promoters60/4772710
gaatcaca

SEQ ID NO: 141972 - DNA, 8 bp, Unknown
  misc_feature (1)..( 8): Result.003 file - promoters60/4772710
taataaaa

SEQ ID NO: 141973 - DNA, 10 bp, Unknown
  misc_feature (1)..( 10): Result.003 file - promoters60/4772710
gttcttttgt

SEQ ID NO: 141974 - DNA, 10 bp, Unknown
  misc_feature (1)..( 10): Result.003 file - promoters60/4772710
tttcttttgt

SEQ ID NO: 141975 - DNA, 10 bp, Unknown
  misc_feature (1)..( 10): Result.003 file - promoters60/4772710
tttattttac

SEQ ID NO: 141976 - DNA, 7 bp, Unknown
  misc_feature (1)..( 7): Result.003 file - promoters60/4772710
tttgctc

SEQ ID NO: 141977 - DNA, 7 bp, Unknown
  misc_feature (1)..( 7): Result.003 file - promoters60/4772710
tttgctt

SEQ ID NO: 141978 - DNA, 7 bp, Unknown
  misc_feature (1)..( 7): Result.003 file - promoters60/4772710
ttttctt

SEQ ID NO: 141979 - DNA, 7 bp, Unknown
  misc_feature (1)..( 7): Result.003 file - promoters60/4772710
ttttaat

SEQ ID NO: 141980 - DNA, 7 bp, Unknown
  misc_feature (1)..( 7): Result.003 file - promoters60/4772710
ctttaat

SEQ ID NO: 141981 - DNA, 7 bp, Unknown
  misc_feature (1)..( 7): Result.003 file - promoters60/4772710
cttaaat

SEQ ID NO: 141982 - DNA, 7 bp, Unknown
  misc_feature (1)..( 7): Result.003 file - promoters60/4772710
aaaattg

SEQ ID NO: 141983 - DNA, 7 bp, Unknown
  misc_feature (1)..( 7): Result.003 file - promoters60/4772710
aaaattg

SEQ ID NO: 141984 - DNA, 7 bp, Unknown
  misc_feature (1)..( 7): Result.003 file - promoters60/4772710
aaatttg

SEQ ID NO: 141985 - DNA, 10 bp, Unknown
  misc_feature (1)..( 10): Result.003 file - promoters60/4772710
atttaaattt

SEQ ID NO: 141986 - DNA, 10 bp, Unknown
  misc_feature (1)..( 10): Result.003 file - promoters60/4772710
attgaaatat

SEQ ID NO: 141987 - DNA, 10 bp, Unknown
  misc_feature (1)..( 10): Result.003 file - promoters60/4772710
gagaaaatta

SEQ ID NO: 141988 - DNA, 9 bp, Unknown
  misc_feature (1)..( 9): Result.003 file - promoters60/4772710
aattcagaa

SEQ ID NO: 141989 - DNA, 9 bp, Unknown
  misc_feature (1)..( 9): Result.003 file - promoters60/4772710
aattcaatt

SEQ ID NO: 141990 - DNA, 9 bp, Unknown
  misc_feature (1)..( 9): Result.003 file - promoters60/4772710
aattcagaa

SEQ ID NO: 141991 - DNA, 8 bp, Unknown
  misc_feature (1)..( 8): Result.003 file - promoters60/4772710
ttaattta

SEQ ID NO: 141992 - DNA, 8 bp, Unknown
  misc_feature (1)..( 8): Result.003 file - promoters60/4772710
ttattttg

SEQ ID NO: 141993 - DNA, 8 bp, Unknown
  misc_feature (1)..( 8): Result.003 file - promoters60/4772710
gtatattg

SEQ ID NO: 141994 - DNA, 7 bp, Unknown
  misc_feature (1)..( 7): Result.003 file - promoters60/4772724
ttagcct

SEQ ID NO: 141995 - DNA, 7 bp, Unknown
  misc_feature (1)..( 7): Result.003 file - promoters60/4772724
ttaccct

SEQ ID NO: 141996 - DNA, 6 bp, Unknown
  misc_feature (1)..( 6): Result.003 file - promoters60/4772724
taaccg

SEQ ID NO: 141997 - DNA, 6 bp, Unknown
  misc_feature (1)..( 6): Result.003 file - promoters60/4772724
taaccg

SEQ ID NO: 141998 - DNA, 6 bp, Unknown
  misc_feature (1)..( 6): Result.003 file - promoters60/4772724
gttaaa

SEQ ID NO: 141999 - DNA, 6 bp, Unknown
  misc_feature (1)..( 6): Result.003 file - promoters60/4772724
gttaaa

SEQ ID NO: 142000 - DNA, 7 bp, Unknown
  misc_feature (1)..( 7): Result.003 file - promoters60/4772724
caaagtc

SEQ ID NO: 142001 - DNA, 7 bp, Unknown
  misc_feature (1)..( 7): Result.003 file - promoters60/4772724
caatgtc

SEQ ID NO: 142002 - DNA, 8 bp, Unknown
  misc_feature (1)..( 8): Result.003 file - promoters60/4772724
atattttc

SEQ ID NO: 142003 - DNA, 8 bp, Unknown
  misc_feature (1)..( 8): Result.003 file - promoters60/4772724
atatcttc

SEQ ID NO: 142004 - DNA, 6 bp, Unknown
  misc_feature (1)..( 6): Result.003 file - promoters60/4772724
gagata

SEQ ID NO: 142005 - DNA, 6 bp, Unknown
  misc_feature (1)..( 6): Result.003 file - promoters60/4772724
gagata

SEQ ID NO: 142006 - DNA, 7 bp, Unknown
  misc_feature (1)..( 7): Result.003 file - promoters60/4772724
atgtggt

SEQ ID NO: 142007 - DNA, 7 bp, Unknown
  misc_feature (1)..( 7): Result.003 file - promoters60/4772724
atgtgga

SEQ ID NO: 142008 - DNA, 7 bp, Unknown
  misc_feature (1)..( 7): Result.003 file - promoters60/4772724
atgagga

SEQ ID NO: 142009 - DNA, 7 bp, Unknown
  misc_feature (1)..( 7): Result.003 file - promoters60/4772724
agctaat

SEQ ID NO: 142010 - DNA, 7 bp, Unknown
  misc_feature (1)..( 7): Result.003 file - promoters60/4772724
agcaaat

SEQ ID NO: 142011 - DNA, 6 bp, Unknown
  misc_feature (1)..( 6): Result.003 file - promoters60/4772724
aatgct

SEQ ID NO: 142012 - DNA, 6 bp, Unknown
  misc_feature (1)..( 6): Result.003 file - promoters60/4772724
aatgct

SEQ ID NO: 142013 - DNA, 7 bp, Unknown
  misc_feature (1)..( 7): Result.003 file - promoters60/4772724
caatcta

SEQ ID NO: 142014 - DNA, 7 bp, Unknown
  misc_feature (1)..( 7): Result.003 file - promoters60/4772724
caatcta

SEQ ID NO: 142015 - DNA, 8 bp, Unknown
  misc_feature (1)..( 8): Result.003 file - promoters60/4772724
atttcaaa

SEQ ID NO: 142016 - DNA, 8 bp, Unknown
  misc_feature (1)..( 8): Result.003 file - promoters60/4772724
atttcaaa

SEQ ID NO: 142017 - DNA, 8 bp, Unknown
  misc_feature (1)..( 8): Result.003 file - promoters60/4772724
tttgggaa

SEQ ID NO: 142018 - DNA, 8 bp, Unknown
  misc_feature (1)..( 8): Result.003 file - promoters60/4772724
tttgcgaa

SEQ ID NO: 142019 - DNA, 10 bp, Unknown
  misc_feature (1)..( 10): Result.003 file - promoters60/4772724
ttcaagaaga

SEQ ID NO: 142020 - DNA, 10 bp, Unknown
  misc_feature (1)..( 10): Result.003 file - promoters60/4772724
ttcaagaaga

SEQ ID NO: 142021 - DNA, 6 bp, Unknown
  misc_feature (1)..( 6): Result.003 file - promoters60/4772724
cgttga

SEQ ID NO: 142022 - DNA, 6 bp, Unknown
  misc_feature (1)..( 6): Result.003 file - promoters60/4772724
cgttga

SEQ ID NO: 142023 - DNA, 9 bp, Unknown
  misc_feature (1)..( 9): Result.003 file - promoters60/4772724
aatcaagat

SEQ ID NO: 142024 - DNA, 9 bp, Unknown
  misc_feature (1)..( 9): Result.003 file - promoters60/4772724
aataaagat

SEQ ID NO: 142025 - DNA, 6 bp, Unknown
  misc_feature (1)..( 6): Result.003 file - promoters60/4772743
attttt

SEQ ID NO: 142026 - DNA, 6 bp, Unknown
  misc_feature (1)..( 6): Result.003 file - promoters60/4772743
attttt

SEQ ID NO: 142027 - DNA, 6 bp, Unknown
  misc_feature (1)..( 6): Result.003 file - promoters60/4772743
tttact

SEQ ID NO: 142028 - DNA, 6 bp, Unknown
  misc_feature (1)..( 6): Result.003 file - promoters60/4772743
tttact

SEQ ID NO: 142029 - DNA, 8 bp, Unknown
  misc_feature (1)..( 8): Result.003 file - promoters60/4772743
tactagct

SEQ ID NO: 142030 - DNA, 8 bp, Unknown
  misc_feature (1)..( 8): Result.003 file - promoters60/4772743
tactggct

SEQ ID NO: 142031 - DNA, 6 bp, Unknown
  misc_feature (1)..( 6): Result.003 file - promoters60/4772743
agaatg

SEQ ID NO: 142032 - DNA, 6 bp, Unknown
  misc_feature (1)..( 6): Result.003 file - promoters60/4772743
agaatg

SEQ ID NO: 142033 - DNA, 13 bp, Unknown
  misc_feature (1)..( 13): Result.003 file - promoters60/4772772
agaaatataggat

SEQ ID NO: 142034 - DNA, 13 bp, Unknown
  misc_feature (1)..( 13): Result.003 file - promoters60/4772772
gaaaatattaacc

SEQ ID NO: 142035 - DNA, 13 bp, Unknown
  misc_feature (1)..( 13): Result.003 file - promoters60/4772772
ttagatatattta

SEQ ID NO: 142036 - DNA, 13 bp, Unknown
  misc_feature (1)..( 13): Result.003 file - promoters60/4772772
ttaaaaattaaat

SEQ ID NO: 142037 - DNA, 13 bp, Unknown
  misc_feature (1)..( 13): Result.003 file - promoters60/4772772
tcaaatattgcgg

SEQ ID NO: 142038 - DNA, 13 bp, Unknown
  misc_feature (1)..( 13): Result.003 file - promoters60/4772772
ttatatatgttta

SEQ ID NO: 142039 - DNA, 13 bp, Unknown
  misc_feature (1)..( 13): Result.003 file - promoters60/4772772
ggtaaaatttcat

SEQ ID NO: 142040 - DNA, 13 bp, Unknown
  misc_feature (1)..( 13): Result.003 file - promoters60/4772772
gtaacaattctaa

SEQ ID NO: 142041 - DNA, 10 bp, Unknown
  misc_feature (1)..( 10): Result.003 file - promoters60/4772772
acaacaaagt

SEQ ID NO: 142042 - DNA, 10 bp, Unknown
  misc_feature (1)..( 10): Result.003 file - promoters60/4772772
aaaacaaacg

SEQ ID NO: 142043 - DNA, 10 bp, Unknown
  misc_feature (1)..( 10): Result.003 file - promoters60/4772772
taaataaatt

SEQ ID NO: 142044 - DNA, 10 bp, Unknown
  misc_feature (1)..( 10): Result.003 file - promoters60/4772772
caaacaaatg

SEQ ID NO: 142045 - DNA, 10 bp, Unknown
  misc_feature (1)..( 10): Result.003 file - promoters60/4772772
taaaaaaaga

SEQ ID NO: 142046 - DNA, 10 bp, Unknown
  misc_feature (1)..( 10): Result.003 file - promoters60/4772772
aaaacaattc

SEQ ID NO: 142047 - DNA, 10 bp, Unknown
  misc_feature (1)..( 10): Result.003 file - promoters60/4772772
tgtatatatt

SEQ ID NO: 142048 - DNA, 10 bp, Unknown
  misc_feature (1)..( 10): Result.003 file - promoters60/4772772
tcaatcaaac

SEQ ID NO: 142049 - DNA, 10 bp, Unknown
  misc_feature (1)..( 10): Result.003 file - promoters60/4772772
tcaaccaact

SEQ ID NO: 142050 - DNA, 11 bp, Unknown
  misc_feature (1)..( 11): Result.003 file - promoters60/4772772
aagatctaaat

SEQ ID NO: 142051 - DNA, 11 bp, Unknown
  misc_feature (1)..( 11): Result.003 file - promoters60/4772772
aaaatcaaata

SEQ ID NO: 142052 - DNA, 11 bp, Unknown
  misc_feature (1)..( 11): Result.003 file - promoters60/4772772
tgaatgaaaaa

SEQ ID NO: 142053 - DNA, 11 bp, Unknown
  misc_feature (1)..( 11): Result.003 file - promoters60/4772772
tctttcaaata

SEQ ID NO: 142054 - DNA, 12 bp, Unknown
  misc_feature (1)..( 12): Result.003 file - promoters60/4772772
ccactatataag

SEQ ID NO: 142055 - DNA, 12 bp, Unknown
  misc_feature (1)..( 12): Result.003 file - promoters60/4772772
ccattatatata

SEQ ID NO: 142056 - DNA, 12 bp, Unknown
  misc_feature (1)..( 12): Result.003 file - promoters60/4772772
cgcctatatata

SEQ ID NO: 142057 - DNA, 12 bp, Unknown
  misc_feature (1)..( 12): Result.003 file - promoters60/4772772
cttttatatata

SEQ ID NO: 142058 - DNA, 12 bp, Unknown
  misc_feature (1)..( 12): Result.003 file - promoters60/4772772
cttgtatatata

SEQ ID NO: 142059 - DNA, 12 bp, Unknown
  misc_feature (1)..( 12): Result.003 file - promoters60/4772772
catatatttata

SEQ ID NO: 142060 - DNA, 13 bp, Unknown
  misc_feature (1)..( 13): Result.003 file - promoters60/4772772
tgtttgattgaat

SEQ ID NO: 142061 - DNA, 13 bp, Unknown
  misc_feature (1)..( 13): Result.003 file - promoters60/4772772
tgtttaattaaac

SEQ ID NO: 142062 - DNA, 13 bp, Unknown
  misc_feature (1)..( 13): Result.003 file - promoters60/4772772
tatttcatttcca

SEQ ID NO: 142063 - DNA, 13 bp, Unknown
  misc_feature (1)..( 13): Result.003 file - promoters60/4772772
aaataaataaaag

SEQ ID NO: 142064 - DNA, 13 bp, Unknown
  misc_feature (1)..( 13): Result.003 file - promoters60/4772772
aataaaattaata

SEQ ID NO: 142065 - DNA, 13 bp, Unknown
  misc_feature (1)..( 13): Result.003 file - promoters60/4772772
gacattataaaat

SEQ ID NO: 142066 - DNA, 13 bp, Unknown
  misc_feature (1)..( 13): Result.003 file - promoters60/4772772
tctaacataggca

SEQ ID NO: 142067 - DNA, 13 bp, Unknown
  misc_feature (1)..( 13): Result.003 file - promoters60/4772772
atttacaaacttt

SEQ ID NO: 142068 - DNA, 12 bp, Unknown
  misc_feature (1)..( 12): Result.003 file - promoters60/4772772
ttttaaaaattc

SEQ ID NO: 142069 - DNA, 12 bp, Unknown
  misc_feature (1)..( 12): Result.003 file - promoters60/4772772
ggctaaaaatga

SEQ ID NO: 142070 - DNA, 12 bp, Unknown
  misc_feature (1)..( 12): Result.003 file - promoters60/4772772
gtttcaaataca

SEQ ID NO: 142071 - DNA, 12 bp, Unknown
  misc_feature (1)..( 12): Result.003 file - promoters60/4772772
gtttccaatatg

SEQ ID NO: 142072 - DNA, 12 bp, Unknown
  misc_feature (1)..( 12): Result.003 file - promoters60/4772772
agagtaaagtga

SEQ ID NO: 142073 - DNA, 12 bp, Unknown
  misc_feature (1)..( 12): Result.003 file - promoters60/4772772
agatcaaatagg

SEQ ID NO: 142074 - DNA, 12 bp, Unknown
  misc_feature (1)..( 12): Result.003 file - promoters60/4772772
cctggaaataga

SEQ ID NO: 142075 - DNA, 12 bp, Unknown
  misc_feature (1)..( 12): Result.003 file - promoters60/4772772
aaaataaagaaa

SEQ ID NO: 142076 - DNA, 12 bp, Unknown
  misc_feature (1)..( 12): Result.003 file - promoters60/4772772
aaactaatgaca

SEQ ID NO: 142077 - DNA, 12 bp, Unknown
  misc_feature (1)..( 12): Result.003 file - promoters60/4772772
aaaataaaagtc

SEQ ID NO: 142078 - DNA, 12 bp, Unknown
  misc_feature (1)..( 12): Result.003 file - promoters60/4772772
aaaataataaat

SEQ ID NO: 142079 - DNA, 13 bp, Unknown
  misc_feature (1)..( 13): Result.003 file - promoters60/4772772
aaacctaaatcaa

SEQ ID NO: 142080 - DNA, 13 bp, Unknown
  misc_feature (1)..( 13): Result.003 file - promoters60/4772772
gaatataatataa

SEQ ID NO: 142081 - DNA, 11 bp, Unknown
  misc_feature (1)..( 11): Result.003 file - promoters60/4772772
taactttgagt

SEQ ID NO: 142082 - DNA, 11 bp, Unknown
  misc_feature (1)..( 11): Result.003 file - promoters60/4772772
taagtttcaaa

SEQ ID NO: 142083 - DNA, 11 bp, Unknown
  misc_feature (1)..( 11): Result.003 file - promoters60/4772772
atagtttaaaa

SEQ ID NO: 142084 - DNA, 12 bp, Unknown
  misc_feature (1)..( 12): Result.003 file - promoters60/4772772
taacaattctaa

SEQ ID NO: 142085 - DNA, 12 bp, Unknown
  misc_feature (1)..( 12): Result.003 file - promoters60/4772772
tgaagtatcatc

SEQ ID NO: 142086 - DNA, 12 bp, Unknown
  misc_feature (1)..( 12): Result.003 file - promoters60/4772772
atatgtttatat

SEQ ID NO: 142087 - DNA, 12 bp, Unknown
  misc_feature (1)..( 12): Result.003 file - promoters60/4772772
ttgagtttaggc

SEQ ID NO: 142088 - DNA, 12 bp, Unknown
  misc_feature (1)..( 12): Result.003 file - promoters60/4772772
ttaagtctagta

SEQ ID NO: 142089 - DNA, 12 bp, Unknown
  misc_feature (1)..( 12): Result.003 file - promoters60/4772772
gatagtttaaaa

SEQ ID NO: 142090 - DNA, 12 bp, Unknown
  misc_feature (1)..( 12): Result.003 file - promoters60/4772772
ataagtttcaaa

SEQ ID NO: 142091 - DNA, 12 bp, Unknown
  misc_feature (1)..( 12): Result.003 file - promoters60/4772772
tgaagtatcatc

SEQ ID NO: 142092 - DNA, 12 bp, Unknown
  misc_feature (1)..( 12): Result.003 file - promoters60/4772772
acaattctaatt

SEQ ID NO: 142093 - DNA, 12 bp, Unknown
  misc_feature (1)..( 12): Result.003 file - promoters60/4772772
atatgtttatat

SEQ ID NO: 142094 - DNA, 9 bp, Unknown
  misc_feature (1)..( 9): Result.003 file - promoters60/4772772
aaaaataaa

SEQ ID NO: 142095 - DNA, 9 bp, Unknown
  misc_feature (1)..( 9): Result.003 file - promoters60/4772772
aaacatata

SEQ ID NO: 142096 - DNA, 9 bp, Unknown
  misc_feature (1)..( 9): Result.003 file - promoters60/4772772
aaaattaat

SEQ ID NO: 142097 - DNA, 9 bp, Unknown
  misc_feature (1)..( 9): Result.003 file - promoters60/4772772
taaaataca

SEQ ID NO: 142098 - DNA, 9 bp, Unknown
  misc_feature (1)..( 9): Result.003 file - promoters60/4772772
aaaaattta

SEQ ID NO: 142099 - DNA, 9 bp, Unknown
  misc_feature (1)..( 9): Result.003 file - promoters60/4772772
taacatagg

SEQ ID NO: 142100 - DNA, 9 bp, Unknown
  misc_feature (1)..( 9): Result.003 file - promoters60/4772772
gataatatt

SEQ ID NO: 142101 - DNA, 10 bp, Unknown
  misc_feature (1)..( 10): Result.003 file - promoters60/4772772
atattattag

SEQ ID NO: 142102 - DNA, 10 bp, Unknown
  misc_feature (1)..( 10): Result.003 file - promoters60/4772772
atattaataa

SEQ ID NO: 142103 - DNA, 10 bp, Unknown
  misc_feature (1)..( 10): Result.003 file - promoters60/4772772
atattattag

SEQ ID NO: 142104 - DNA, 10 bp, Unknown
  misc_feature (1)..( 10): Result.003 file - promoters60/4772772
ttattatatt

SEQ ID NO: 142105 - DNA, 10 bp, Unknown
  misc_feature (1)..( 10): Result.003 file - promoters60/4772772
atataattat

SEQ ID NO: 142106 - DNA, 10 bp, Unknown
  misc_feature (1)..( 10): Result.003 file - promoters60/4772772
atataactaa

SEQ ID NO: 142107 - DNA, 9 bp, Unknown
  misc_feature (1)..( 9): Result.003 file - promoters60/4772772
gtttgttta

SEQ ID NO: 142108 - DNA, 9 bp, Unknown
  misc_feature (1)..( 9): Result.003 file - promoters60/4772772
atttattta

SEQ ID NO: 142109 - DNA, 9 bp, Unknown
  misc_feature (1)..( 9): Result.003 file - promoters60/4772772
ttttatttc

SEQ ID NO: 142110 - DNA, 9 bp, Unknown
  misc_feature (1)..( 9): Result.003 file - promoters60/4772772
ttttgtttc

SEQ ID NO: 142111 - DNA, 9 bp, Unknown
  misc_feature (1)..( 9): Result.003 file - promoters60/4772772
atttttttc

SEQ ID NO: 142112 - DNA, 9 bp, Unknown
  misc_feature (1)..( 9): Result.003 file - promoters60/4772772
ttttctttc

SEQ ID NO: 142113 - DNA, 10 bp, Unknown
  misc_feature (1)..( 10): Result.003 file - promoters60/4772776
cttttagttt

SEQ ID NO: 142114 - DNA, 10 bp, Unknown
  misc_feature (1)..( 10): Result.003 file - promoters60/4772776
aatttagtgg

SEQ ID NO: 142115 - DNA, 10 bp, Unknown
  misc_feature (1)..( 10): Result.003 file - promoters60/4772776
aaattatttt

SEQ ID NO: 142116 - DNA, 10 bp, Unknown
  misc_feature (1)..( 10): Result.003 file - promoters60/4772776
atattagttc

SEQ ID NO: 142117 - DNA, 10 bp, Unknown
  misc_feature (1)..( 10): Result.003 file - promoters60/4772776
aaattattga

SEQ ID NO: 142118 - DNA, 10 bp, Unknown
  misc_feature (1)..( 10): Result.003 file - promoters60/4772776
aaattcttga

SEQ ID NO: 142119 - DNA, 14 bp, Unknown
  misc_feature (1)..( 14): Result.003 file - promoters60/4772776
ttcttcaattgaaa

SEQ ID NO: 142120 - DNA, 14 bp, Unknown
  misc_feature (1)..( 14): Result.003 file - promoters60/4772776
tacttcaaaattta

SEQ ID NO: 142121 - DNA, 14 bp, Unknown
  misc_feature (1)..( 14): Result.003 file - promoters60/4772776
ttcttaaattaaaa

SEQ ID NO: 142122 - DNA, 14 bp, Unknown
  misc_feature (1)..( 14): Result.003 file - promoters60/4772776
atctcaaaataccg

SEQ ID NO: 142123 - DNA, 14 bp, Unknown
  misc_feature (1)..( 14): Result.003 file - promoters60/4772776
ttctcaatgaataa

SEQ ID NO: 142124 - DNA, 14 bp, Unknown
  misc_feature (1)..( 14): Result.003 file - promoters60/4772776
aacataacattggt

SEQ ID NO: 142125 - DNA, 10 bp, Unknown
  misc_feature (1)..( 10): Result.003 file - promoters60/4772813
agaatttttg

SEQ ID NO: 142126 - DNA, 10 bp, Unknown
  misc_feature (1)..( 10): Result.003 file - promoters60/4772813
taaattttct

SEQ ID NO: 142127 - DNA, 10 bp, Unknown
  misc_feature (1)..( 10): Result.003 file - promoters60/4772813
taaagtttct

SEQ ID NO: 142128 - DNA, 8 bp, Unknown
  misc_feature (1)..( 8): Result.003 file - promoters60/4772813
atttgatc

SEQ ID NO: 142129 - DNA, 8 bp, Unknown
  misc_feature (1)..( 8): Result.003 file - promoters60/4772813
attcgata

SEQ ID NO: 142130 - DNA, 8 bp, Unknown
  misc_feature (1)..( 8): Result.003 file - promoters60/4772813
gttcgata

SEQ ID NO: 142131 - DNA, 15 bp, Unknown
  misc_feature (1)..( 15): Result.003 file - promoters60/4772813
aaagttttgtgtttc

SEQ ID NO: 142132 - DNA, 15 bp, Unknown
  misc_feature (1)..( 15): Result.003 file - promoters60/4772813
aaagttttctaatca

SEQ ID NO: 142133 - DNA, 15 bp, Unknown
  misc_feature (1)..( 15): Result.003 file - promoters60/4772813
taagctttctgtttc

SEQ ID NO: 142134 - DNA, 7 bp, Unknown
  misc_feature (1)..( 7): Result.003 file - promoters60/4772813
tttcttt

SEQ ID NO: 142135 - DNA, 7 bp, Unknown
  misc_feature (1)..( 7): Result.003 file - promoters60/4772813
cttcttt

SEQ ID NO: 142136 - DNA, 7 bp, Unknown
  misc_feature (1)..( 7): Result.003 file - promoters60/4772813
cttcttg

SEQ ID NO: 142137 - DNA, 12 bp, Unknown
  misc_feature (1)..( 12): Result.003 file - promoters60/4772820
cacatttcagac

SEQ ID NO: 142138 - DNA, 12 bp, Unknown
  misc_feature (1)..( 12): Result.003 file - promoters60/4772820
ttggtttaagac

SEQ ID NO: 142139 - DNA, 12 bp, Unknown
  misc_feature (1)..( 12): Result.003 file - promoters60/4772820
ttgttttaaact

SEQ ID NO: 142140 - DNA, 11 bp, Unknown
  misc_feature (1)..( 11): Result.003 file - promoters60/4772820
tggaaaacgaa

SEQ ID NO: 142141 - DNA, 11 bp, Unknown
  misc_feature (1)..( 11): Result.003 file - promoters60/4772820
aagtaaacgaa

SEQ ID NO: 142142 - DNA, 12 bp, Unknown
  misc_feature (1)..( 12): Result.003 file - promoters60/4772820
attgaaatcgat

SEQ ID NO: 142143 - DNA, 12 bp, Unknown
  misc_feature (1)..( 12): Result.003 file - promoters60/4772820
ttggaataaaaa

SEQ ID NO: 142144 - DNA, 8 bp, Unknown
  misc_feature (1)..( 8): Result.003 file - promoters60/4772846
aatcttct

SEQ ID NO: 142145 - DNA, 8 bp, Unknown
  misc_feature (1)..( 8): Result.003 file - promoters60/4772846
aatattct

SEQ ID NO: 142146 - DNA, 8 bp, Unknown
  misc_feature (1)..( 8): Result.003 file - promoters60/4772846
aatgttct

SEQ ID NO: 142147 - DNA, 10 bp, Unknown
  misc_feature (1)..( 10): Result.003 file - promoters60/4772846
ggaaggagag

SEQ ID NO: 142148 - DNA, 10 bp, Unknown
  misc_feature (1)..( 10): Result.003 file - promoters60/4772846
gttaggagag

SEQ ID NO: 142149 - DNA, 10 bp, Unknown
  misc_feature (1)..( 10): Result.003 file - promoters60/4772846
ggaagtagag

SEQ ID NO: 142150 - DNA, 9 bp, Unknown
  misc_feature (1)..( 9): Result.003 file - promoters60/4772855
caatatgtt

SEQ ID NO: 142151 - DNA, 9 bp, Unknown
  misc_feature (1)..( 9): Result.003 file - promoters60/4772855
caatatgtt

SEQ ID NO: 142152 - DNA, 7 bp, Unknown
  misc_feature (1)..( 7): Result.003 file - promoters60/4772855
aaattta

SEQ ID NO: 142153 - DNA, 7 bp, Unknown
  misc_feature (1)..( 7): Result.003 file - promoters60/4772855
taattta

SEQ ID NO: 142154 - DNA, 7 bp, Unknown
  misc_feature (1)..( 7): Result.003 file - promoters60/4772855
aaatttt

SEQ ID NO: 142155 - DNA, 7 bp, Unknown
  misc_feature (1)..( 7): Result.003 file - promoters60/4772855
aaataaa

SEQ ID NO: 142156 - DNA, 7 bp, Unknown
  misc_feature (1)..( 7): Result.003 file - promoters60/4772855
aaataaa

SEQ ID NO: 142157 - DNA, 6 bp, Unknown
  misc_feature (1)..( 6): Result.003 file - promoters60/4772855
atatgt

SEQ ID NO: 142158 - DNA, 6 bp, Unknown
  misc_feature (1)..( 6): Result.003 file - promoters60/4772855
atatgt

SEQ ID NO: 142159 - DNA, 6 bp, Unknown
  misc_feature (1)..( 6): Result.003 file - promoters60/4772855
ttatta

SEQ ID NO: 142160 - DNA, 6 bp, Unknown
  misc_feature (1)..( 6): Result.003 file - promoters60/4772855
ttatta

SEQ ID NO: 142161 - DNA, 6 bp, Unknown
  misc_feature (1)..( 6): Result.003 file - promoters60/4772855
actaaa

SEQ ID NO: 142162 - DNA, 6 bp, Unknown
  misc_feature (1)..( 6): Result.003 file - promoters60/4772855
actaaa

SEQ ID NO: 142163 - DNA, 8 bp, Unknown
  misc_feature (1)..( 8): Result.003 file - promoters60/4772855
aaaataag

SEQ ID NO: 142164 - DNA, 8 bp, Unknown
  misc_feature (1)..( 8): Result.003 file - promoters60/4772855
aaactaag

SEQ ID NO: 142165 - DNA, 8 bp, Unknown
  misc_feature (1)..( 8): Result.003 file - promoters60/4772855
taagttgt

SEQ ID NO: 142166 - DNA, 8 bp, Unknown
  misc_feature (1)..( 8): Result.003 file - promoters60/4772855
taaattgt

SEQ ID NO: 142167 - DNA, 6 bp, Unknown
  misc_feature (1)..( 6): Result.003 file - promoters60/4772855
atagat

SEQ ID NO: 142168 - DNA, 6 bp, Unknown
  misc_feature (1)..( 6): Result.003 file - promoters60/4772855
atagat

SEQ ID NO: 142169 - DNA, 7 bp, Unknown
  misc_feature (1)..( 7): Result.003 file - promoters60/4772855
agatata

SEQ ID NO: 142170 - DNA, 7 bp, Unknown
  misc_feature (1)..( 7): Result.003 file - promoters60/4772855
agagata

SEQ ID NO: 142171 - DNA, 6 bp, Unknown
  misc_feature (1)..( 6): Result.003 file - promoters60/4772855
ttttgg

SEQ ID NO: 142172 - DNA, 6 bp, Unknown
  misc_feature (1)..( 6): Result.003 file - promoters60/4772855
ttttgg

SEQ ID NO: 142173 - DNA, 6 bp, Unknown
  misc_feature (1)..( 6): Result.003 file - promoters60/4772855
taagat

SEQ ID NO: 142174 - DNA, 6 bp, Unknown
  misc_feature (1)..( 6): Result.003 file - promoters60/4772855
taagat

SEQ ID NO: 142175 - DNA, 6 bp, Unknown
  misc_feature (1)..( 6): Result.003 file - promoters60/4772855
aaagaa

SEQ ID NO: 142176 - DNA, 6 bp, Unknown
  misc_feature (1)..( 6): Result.003 file - promoters60/4772855
aaagaa

SEQ ID NO: 142177 - DNA, 12 bp, Unknown
  misc_feature (1)..( 12): Result.003 file - promoters60/4772855
aaaaacaaaaca

SEQ ID NO: 142178 - DNA, 12 bp, Unknown
  misc_feature (1)..( 12): Result.003 file - promoters60/4772855
aaacacaataca

SEQ ID NO: 142179 - DNA, 6 bp, Unknown
  misc_feature (1)..( 6): Result.003 file - promoters60/4772855
aaaaat

SEQ ID NO: 142180 - DNA, 6 bp, Unknown
  misc_feature (1)..( 6): Result.003 file - promoters60/4772855
aaaaat

SEQ ID NO: 142181 - DNA, 6 bp, Unknown
  misc_feature (1)..( 6): Result.003 file - promoters60/4772855
taaccc

SEQ ID NO: 142182 - DNA, 6 bp, Unknown
  misc_feature (1)..( 6): Result.003 file - promoters60/4772855
taaccc

SEQ ID NO: 142183 - DNA, 10 bp, Unknown
  misc_feature (1)..( 10): Result.003 file - promoters60/4772879
taaaaatgaa

SEQ ID NO: 142184 - DNA, 10 bp, Unknown
  misc_feature (1)..( 10): Result.003 file - promoters60/4772879
taaaaagtct

SEQ ID NO: 142185 - DNA, 10 bp, Unknown
  misc_feature (1)..( 10): Result.003 file - promoters60/4772879
aaaaaaagaa

SEQ ID NO: 142186 - DNA, 10 bp, Unknown
  misc_feature (1)..( 10): Result.003 file - promoters60/4772879
caaaaatctt

SEQ ID NO: 142187 - DNA, 10 bp, Unknown
  misc_feature (1)..( 10): Result.003 file - promoters60/4772879
gaaaaagggt

SEQ ID NO: 142188 - DNA, 14 bp, Unknown
  misc_feature (1)..( 14): Result.003 file - promoters60/4772879
actcataataaata

SEQ ID NO: 142189 - DNA, 14 bp, Unknown
  misc_feature (1)..( 14): Result.003 file - promoters60/4772879
tcatataatagtaa

SEQ ID NO: 142190 - DNA, 14 bp, Unknown
  misc_feature (1)..( 14): Result.003 file - promoters60/4772879
atttataatataat

SEQ ID NO: 142191 - DNA, 14 bp, Unknown
  misc_feature (1)..( 14): Result.003 file - promoters60/4772879
acttataatgaatt

SEQ ID NO: 142192 - DNA, 14 bp, Unknown
  misc_feature (1)..( 14): Result.003 file - promoters60/4772879
taaaataaggaatt

SEQ ID NO: 142193 - DNA, 14 bp, Unknown
  misc_feature (1)..( 14): Result.003 file - promoters60/4772879
atatataataaata

SEQ ID NO: 142194 - DNA, 14 bp, Unknown
  misc_feature (1)..( 14): Result.003 file - promoters60/4772879
aagcataaaaaata

SEQ ID NO: 142195 - DNA, 14 bp, Unknown
  misc_feature (1)..( 14): Result.003 file - promoters60/4772879
aattattatacttc

SEQ ID NO: 142196 - DNA, 14 bp, Unknown
  misc_feature (1)..( 14): Result.003 file - promoters60/4772879
tcatataattatct

SEQ ID NO: 142197 - DNA, 14 bp, Unknown
  misc_feature (1)..( 14): Result.003 file - promoters60/4772879
cagtttaataacaa

SEQ ID NO: 142198 - DNA, 14 bp, Unknown
  misc_feature (1)..( 14): Result.003 file - promoters60/4772879
gcctaaaatataat

SEQ ID NO: 142199 - DNA, 14 bp, Unknown
  misc_feature (1)..( 14): Result.003 file - promoters60/4772879
tcatataacaattt

SEQ ID NO: 142200 - DNA, 11 bp, Unknown
  misc_feature (1)..( 11): Result.003 file - promoters60/4772879
tgtatatatat

SEQ ID NO: 142201 - DNA, 11 bp, Unknown
  misc_feature (1)..( 11): Result.003 file - promoters60/4772879
aaaataaatag

SEQ ID NO: 142202 - DNA, 11 bp, Unknown
  misc_feature (1)..( 11): Result.003 file - promoters60/4772879
aaaatatataa

SEQ ID NO: 142203 - DNA, 11 bp, Unknown
  misc_feature (1)..( 11): Result.003 file - promoters60/4772879
agaataaaaat

SEQ ID NO: 142204 - DNA, 11 bp, Unknown
  misc_feature (1)..( 11): Result.003 file - promoters60/4772879
aaaatataata

SEQ ID NO: 142205 - DNA, 12 bp, Unknown
  misc_feature (1)..( 12): Result.003 file - promoters60/4772879
tagaaattaata

SEQ ID NO: 142206 - DNA, 12 bp, Unknown
  misc_feature (1)..( 12): Result.003 file - promoters60/4772879
agataattaagt

SEQ ID NO: 142207 - DNA, 11 bp, Unknown
  misc_feature (1)..( 11): Result.003 file - promoters60/4772879
taaaatcaata

SEQ ID NO: 142208 - DNA, 11 bp, Unknown
  misc_feature (1)..( 11): Result.003 file - promoters60/4772879
tttaattatta

SEQ ID NO: 142209 - DNA, 12 bp, Unknown
  misc_feature (1)..( 12): Result.003 file - promoters60/4772879
ataacatcactt

SEQ ID NO: 142210 - DNA, 12 bp, Unknown
  misc_feature (1)..( 12): Result.003 file - promoters60/4772879
ggtacatcactg

SEQ ID NO: 142211 - DNA, 13 bp, Unknown
  misc_feature (1)..( 13): Result.003 file - promoters60/4772879
tttgttatataag

SEQ ID NO: 142212 - DNA, 13 bp, Unknown
  misc_feature (1)..( 13): Result.003 file - promoters60/4772879
tcctttatatatt

SEQ ID NO: 142213 - DNA, 13 bp, Unknown
  misc_feature (1)..( 13): Result.003 file - promoters60/4772879
cttattatataga

SEQ ID NO: 142214 - DNA, 13 bp, Unknown
  misc_feature (1)..( 13): Result.003 file - promoters60/4772879
cgtcccataaaga

SEQ ID NO: 142215 - DNA, 13 bp, Unknown
  misc_feature (1)..( 13): Result.003 file - promoters60/4772879
cgtcctataaata

SEQ ID NO: 142216 - DNA, 10 bp, Unknown
  misc_feature (1)..( 10): Result.003 file - promoters60/4772879
ttttatcaca

SEQ ID NO: 142217 - DNA, 10 bp, Unknown
  misc_feature (1)..( 10): Result.003 file - promoters60/4772879
ttttgtcaac

SEQ ID NO: 142218 - DNA, 10 bp, Unknown
  misc_feature (1)..( 10): Result.003 file - promoters60/4772879
ctttatccta

SEQ ID NO: 142219 - DNA, 10 bp, Unknown
  misc_feature (1)..( 10): Result.003 file - promoters60/4772879
gtataacaat

SEQ ID NO: 142220 - DNA, 10 bp, Unknown
  misc_feature (1)..( 10): Result.003 file - promoters60/4772879
gtgtaaacga

SEQ ID NO: 142221 - DNA, 10 bp, Unknown
  misc_feature (1)..( 10): Result.003 file - promoters60/4772879
ttttgtatct

SEQ ID NO: 142222 - DNA, 10 bp, Unknown
  misc_feature (1)..( 10): Result.003 file - promoters60/4772879
tcaatcaaaa

SEQ ID NO: 142223 - DNA, 10 bp, Unknown
  misc_feature (1)..( 10): Result.003 file - promoters60/4772879
caaatcaaat

SEQ ID NO: 142224 - DNA, 11 bp, Unknown
  misc_feature (1)..( 11): Result.003 file - promoters60/4772879
ttgatccaaac

SEQ ID NO: 142225 - DNA, 11 bp, Unknown
  misc_feature (1)..( 11): Result.003 file - promoters60/4772879
tcaattaaaag

SEQ ID NO: 142226 - DNA, 11 bp, Unknown
  misc_feature (1)..( 11): Result.003 file - promoters60/4772879
acctttcaaat

SEQ ID NO: 142227 - DNA, 11 bp, Unknown
  misc_feature (1)..( 11): Result.003 file - promoters60/4772879
attatcctaac

SEQ ID NO: 142228 - DNA, 8 bp, Unknown
  misc_feature (1)..( 8): Result.003 file - promoters60/4772879
ttttgttt

SEQ ID NO: 142229 - DNA, 8 bp, Unknown
  misc_feature (1)..( 8): Result.003 file - promoters60/4772879
ttttgtat

SEQ ID NO: 142230 - DNA, 8 bp, Unknown
  misc_feature (1)..( 8): Result.003 file - promoters60/4772879
atttgttt

SEQ ID NO: 142231 - DNA, 8 bp, Unknown
  misc_feature (1)..( 8): Result.003 file - promoters60/4772879
ctttgttg

SEQ ID NO: 142232 - DNA, 8 bp, Unknown
  misc_feature (1)..( 8): Result.003 file - promoters60/4772879
atttattt

SEQ ID NO: 142233 - DNA, 12 bp, Unknown
  misc_feature (1)..( 12): Result.003 file - promoters60/4772883
gaaaaaaaaaaa

SEQ ID NO: 142234 - DNA, 12 bp, Unknown
  misc_feature (1)..( 12): Result.003 file - promoters60/4772883
gaaaaaaaaaaa

SEQ ID NO: 142235 - DNA, 12 bp, Unknown
  misc_feature (1)..( 12): Result.003 file - promoters60/4772883
taaaaatcaaaa

SEQ ID NO: 142236 - DNA, 12 bp, Unknown
  misc_feature (1)..( 12): Result.003 file - promoters60/4772883
atataaacaatt

SEQ ID NO: 142237 - DNA, 11 bp, Unknown
  misc_feature (1)..( 11): Result.003 file - promoters60/4772883
atttattatgt

SEQ ID NO: 142238 - DNA, 11 bp, Unknown
  misc_feature (1)..( 11): Result.003 file - promoters60/4772883
acatattatgt

SEQ ID NO: 142239 - DNA, 11 bp, Unknown
  misc_feature (1)..( 11): Result.003 file - promoters60/4772883
atttgttaaaa

SEQ ID NO: 142240 - DNA, 11 bp, Unknown
  misc_feature (1)..( 11): Result.003 file - promoters60/4772883
tttttttaaca

SEQ ID NO: 142241 - DNA, 8 bp, Unknown
  misc_feature (1)..( 8): Result.003 file - promoters60/4772883
tgaacaaa

SEQ ID NO: 142242 - DNA, 8 bp, Unknown
  misc_feature (1)..( 8): Result.003 file - promoters60/4772883
agaataaa

SEQ ID NO: 142243 - DNA, 9 bp, Unknown
  misc_feature (1)..( 9): Result.003 file - promoters60/4772883
tgaaaataa

SEQ ID NO: 142244 - DNA, 9 bp, Unknown
  misc_feature (1)..( 9): Result.003 file - promoters60/4772883
aaagactaa

SEQ ID NO: 142245 - DNA, 14 bp, Unknown
  misc_feature (1)..( 14): Result.003 file - promoters60/4772883
tggtgaaaaaaaaa

SEQ ID NO: 142246 - DNA, 14 bp, Unknown
  misc_feature (1)..( 14): Result.003 file - promoters60/4772883
ctaataaaataaaa

SEQ ID NO: 142247 - DNA, 14 bp, Unknown
  misc_feature (1)..( 14): Result.003 file - promoters60/4772883
ctcataaaataagt

SEQ ID NO: 142248 - DNA, 14 bp, Unknown
  misc_feature (1)..( 14): Result.003 file - promoters60/4772883
ctcttaaaacttaa

SEQ ID NO: 142249 - DNA, 8 bp, Unknown
  misc_feature (1)..( 8): Result.003 file - promoters60/4772883
ataaataa

SEQ ID NO: 142250 - DNA, 8 bp, Unknown
  misc_feature (1)..( 8): Result.003 file - promoters60/4772883
ataaataa

SEQ ID NO: 142251 - DNA, 8 bp, Unknown
  misc_feature (1)..( 8): Result.003 file - promoters60/4772883
ataaatgc

SEQ ID NO: 142252 - DNA, 8 bp, Unknown
  misc_feature (1)..( 8): Result.003 file - promoters60/4772883
aaaccaat

SEQ ID NO: 142253 - DNA, 8 bp, Unknown
  misc_feature (1)..( 8): Result.003 file - promoters60/4772883
aaacaaat

SEQ ID NO: 142254 - DNA, 8 bp, Unknown
  misc_feature (1)..( 8): Result.003 file - promoters60/4772883
taacaaac

SEQ ID NO: 142255 - DNA, 9 bp, Unknown
  misc_feature (1)..( 9): Result.003 file - promoters60/4772883
taaataaat

SEQ ID NO: 142256 - DNA, 9 bp, Unknown
  misc_feature (1)..( 9): Result.003 file - promoters60/4772883
taaatacaa

SEQ ID NO: 142257 - DNA, 9 bp, Unknown
  misc_feature (1)..( 9): Result.003 file - promoters60/4772883
aaaatgcaa

SEQ ID NO: 142258 - DNA, 9 bp, Unknown
  misc_feature (1)..( 9): Result.003 file - promoters60/4772883
ataaatttt

SEQ ID NO: 142259 - DNA, 9 bp, Unknown
  misc_feature (1)..( 9): Result.003 file - promoters60/4772883
aaaaatttg

SEQ ID NO: 142260 - DNA, 9 bp, Unknown
  misc_feature (1)..( 9): Result.003 file - promoters60/4772883
ttaacttta

SEQ ID NO: 142261 - DNA, 9 bp, Unknown
  misc_feature (1)..( 9): Result.003 file - promoters60/4772883
aaaaatgca

SEQ ID NO: 142262 - DNA, 8 bp, Unknown
  misc_feature (1)..( 8): Result.003 file - promoters60/4772883
gaaacttc

SEQ ID NO: 142263 - DNA, 8 bp, Unknown
  misc_feature (1)..( 8): Result.003 file - promoters60/4772883
aaaacttc

SEQ ID NO: 142264 - DNA, 9 bp, Unknown
  misc_feature (1)..( 9): Result.003 file - promoters60/4772883
aaacactta

SEQ ID NO: 142265 - DNA, 7 bp, Unknown
  misc_feature (1)..( 7): Result.003 file - promoters60/4772883
caatttg

SEQ ID NO: 142266 - DNA, 7 bp, Unknown
  misc_feature (1)..( 7): Result.003 file - promoters60/4772883
caatttt

SEQ ID NO: 142267 - DNA, 8 bp, Unknown
  misc_feature (1)..( 8): Result.003 file - promoters60/4772883
taatatta

SEQ ID NO: 142268 - DNA, 8 bp, Unknown
  misc_feature (1)..( 8): Result.003 file - promoters60/4772883
aaaaacaa

SEQ ID NO: 142269 - DNA, 8 bp, Unknown
  misc_feature (1)..( 8): Result.003 file - promoters60/4772883
caaaacac

SEQ ID NO: 142270 - DNA, 8 bp, Unknown
  misc_feature (1)..( 8): Result.003 file - promoters60/4772883
aaaaactt

SEQ ID NO: 142271 - DNA, 10 bp, Unknown
  misc_feature (1)..( 10): Result.003 file - promoters60/4772883
aatatcaaaa

SEQ ID NO: 142272 - DNA, 10 bp, Unknown
  misc_feature (1)..( 10): Result.003 file - promoters60/4772883
aatattaaaa

SEQ ID NO: 142273 - DNA, 10 bp, Unknown
  misc_feature (1)..( 10): Result.003 file - promoters60/4772883
aattttatat

SEQ ID NO: 142274 - DNA, 8 bp, Unknown
  misc_feature (1)..( 8): Result.003 file - promoters60/4772883
gcttataa

SEQ ID NO: 142275 - DNA, 8 bp, Unknown
  misc_feature (1)..( 8): Result.003 file - promoters60/4772883
tcttttaa

SEQ ID NO: 142276 - DNA, 8 bp, Unknown
  misc_feature (1)..( 8): Result.003 file - promoters60/4772883
tattattg

SEQ ID NO: 142277 - DNA, 7 bp, Unknown
  misc_feature (1)..( 7): Result.003 file - promoters60/4772991
gttggat

SEQ ID NO: 142278 - DNA, 7 bp, Unknown
  misc_feature (1)..( 7): Result.003 file - promoters60/4772991
gtttgat

SEQ ID NO: 142279 - DNA, 7 bp, Unknown
  misc_feature (1)..( 7): Result.003 file - promoters60/4772991
cttggat

SEQ ID NO: 142280 - DNA, 6 bp, Unknown
  misc_feature (1)..( 6): Result.003 file - promoters60/4772991
tcattt

SEQ ID NO: 142281 - DNA, 6 bp, Unknown
  misc_feature (1)..( 6): Result.003 file - promoters60/4772991
tcattt

SEQ ID NO: 142282 - DNA, 7 bp, Unknown
  misc_feature (1)..( 7): Result.003 file - promoters60/4772991
ataaatg

SEQ ID NO: 142283 - DNA, 7 bp, Unknown
  misc_feature (1)..( 7): Result.003 file - promoters60/4772991
atatatg

SEQ ID NO: 142284 - DNA, 7 bp, Unknown
  misc_feature (1)..( 7): Result.003 file - promoters60/4772991
caaattg

SEQ ID NO: 142285 - DNA, 7 bp, Unknown
  misc_feature (1)..( 7): Result.003 file - promoters60/4772991
caaattt

SEQ ID NO: 142286 - DNA, 7 bp, Unknown
  misc_feature (1)..( 7): Result.003 file - promoters60/4772991
aaaattt

SEQ ID NO: 142287 - DNA, 8 bp, Unknown
  misc_feature (1)..( 8): Result.003 file - promoters60/4772991
aagtcaaa

SEQ ID NO: 142288 - DNA, 8 bp, Unknown
  misc_feature (1)..( 8): Result.003 file - promoters60/4772991
aagttaaa

SEQ ID NO: 142289 - DNA, 6 bp, Unknown
  misc_feature (1)..( 6): Result.003 file - promoters60/4772991
tctata

SEQ ID NO: 142290 - DNA, 6 bp, Unknown
  misc_feature (1)..( 6): Result.003 file - promoters60/4772991
tctata

SEQ ID NO: 142291 - DNA, 8 bp, Unknown
  misc_feature (1)..( 8): Result.003 file - promoters60/4772991
aaagtgtt

SEQ ID NO: 142292 - DNA, 8 bp, Unknown
  misc_feature (1)..( 8): Result.003 file - promoters60/4772991
aaactgtt

SEQ ID NO: 142293 - DNA, 6 bp, Unknown
  misc_feature (1)..( 6): Result.003 file - promoters60/4772991
tcaaca

SEQ ID NO: 142294 - DNA, 6 bp, Unknown
  misc_feature (1)..( 6): Result.003 file - promoters60/4772991
tcaaca

SEQ ID NO: 142295 - DNA, 6 bp, Unknown
  misc_feature (1)..( 6): Result.003 file - promoters60/4772991
gtttgt

SEQ ID NO: 142296 - DNA, 6 bp, Unknown
  misc_feature (1)..( 6): Result.003 file - promoters60/4772991
gtttgt

SEQ ID NO: 142297 - DNA, 6 bp, Unknown
  misc_feature (1)..( 6): Result.003 file - promoters60/4772991
cttcac

SEQ ID NO: 142298 - DNA, 6 bp, Unknown
  misc_feature (1)..( 6): Result.003 file - promoters60/4772991
cttcac

SEQ ID NO: 142299 - DNA, 9 bp, Unknown
  misc_feature (1)..( 9): Result.003 file - promoters60/4772991
aaaacatac

SEQ ID NO: 142300 - DNA, 9 bp, Unknown
  misc_feature (1)..( 9): Result.003 file - promoters60/4772991
aaaccatac

SEQ ID NO: 142301 - DNA, 6 bp, Unknown
  misc_feature (1)..( 6): Result.003 file - promoters60/4772991
tagaaa

SEQ ID NO: 142302 - DNA, 6 bp, Unknown
  misc_feature (1)..( 6): Result.003 file - promoters60/4772991
tagaaa

SEQ ID NO: 142303 - DNA, 8 bp, Unknown
  misc_feature (1)..( 8): Result.003 file - promoters60/4772991
aaactaac

SEQ ID NO: 142304 - DNA, 8 bp, Unknown
  misc_feature (1)..( 8): Result.003 file - promoters60/4772991
aaattaac

SEQ ID NO: 142305 - DNA, 7 bp, Unknown
  misc_feature (1)..( 7): Result.003 file - promoters60/4772991
taaccat

SEQ ID NO: 142306 - DNA, 7 bp, Unknown
  misc_feature (1)..( 7): Result.003 file - promoters60/4772991
taagcat

SEQ ID NO: 142307 - DNA, 6 bp, Unknown
  misc_feature (1)..( 6): Result.003 file - promoters60/4772991
ttcaca

SEQ ID NO: 142308 - DNA, 6 bp, Unknown
  misc_feature (1)..( 6): Result.003 file - promoters60/4772991
ttcaca

SEQ ID NO: 142309 - DNA, 8 bp, Unknown
  misc_feature (1)..( 8): Result.003 file - promoters60/4772991
tgtcgatt

SEQ ID NO: 142310 - DNA, 8 bp, Unknown
  misc_feature (1)..( 8): Result.003 file - promoters60/4772991
tgttgatt

SEQ ID NO: 142311 - DNA, 8 bp, Unknown
  misc_feature (1)..( 8): Result.003 file - promoters60/4772991
aacacaat

SEQ ID NO: 142312 - DNA, 8 bp, Unknown
  misc_feature (1)..( 8): Result.003 file - promoters60/4772991
aacaaaat

SEQ ID NO: 142313 - DNA, 8 bp, Unknown
  misc_feature (1)..( 8): Result.003 file - promoters60/4772991
ttttaagt

SEQ ID NO: 142314 - DNA, 8 bp, Unknown
  misc_feature (1)..( 8): Result.003 file - promoters60/4772991
tttaaagt

SEQ ID NO: 142315 - DNA, 7 bp, Unknown
  misc_feature (1)..( 7): Result.003 file - promoters60/4772991
tgaaaaa

SEQ ID NO: 142316 - DNA, 7 bp, Unknown
  misc_feature (1)..( 7): Result.003 file - promoters60/4772991
tgataaa

SEQ ID NO: 142317 - DNA, 7 bp, Unknown
  misc_feature (1)..( 7): Result.003 file - promoters60/4772991
ttctaag

SEQ ID NO: 142318 - DNA, 7 bp, Unknown
  misc_feature (1)..( 7): Result.003 file - promoters60/4772991
ttcaaag

SEQ ID NO: 142319 - DNA, 8 bp, Unknown
  misc_feature (1)..( 8): Result.003 file - promoters60/4772991
aaatccat

SEQ ID NO: 142320 - DNA, 8 bp, Unknown
  misc_feature (1)..( 8): Result.003 file - promoters60/4772991
aaaaccat

SEQ ID NO: 142321 - DNA, 11 bp, Unknown
  misc_feature (1)..( 11): Result.003 file - promoters60/4773011
atttgtttatt

SEQ ID NO: 142322 - DNA, 11 bp, Unknown
  misc_feature (1)..( 11): Result.003 file - promoters60/4773011
attagtttatc

SEQ ID NO: 142323 - DNA, 11 bp, Unknown
  misc_feature (1)..( 11): Result.003 file - promoters60/4773011
aactttttatt

SEQ ID NO: 142324 - DNA, 11 bp, Unknown
  misc_feature (1)..( 11): Result.003 file - promoters60/4773011
ttttgttgctg

SEQ ID NO: 142325 - DNA, 11 bp, Unknown
  misc_feature (1)..( 11): Result.003 file - promoters60/4773011
ctttttttgaa

SEQ ID NO: 142326 - DNA, 11 bp, Unknown
  misc_feature (1)..( 11): Result.003 file - promoters60/4773011
tgattctttga

SEQ ID NO: 142327 - DNA, 11 bp, Unknown
  misc_feature (1)..( 11): Result.003 file - promoters60/4773011
acatttttttc

SEQ ID NO: 142328 - DNA, 11 bp, Unknown
  misc_feature (1)..( 11): Result.003 file - promoters60/4773011
tgactctcttg

SEQ ID NO: 142329 - DNA, 11 bp, Unknown
  misc_feature (1)..( 11): Result.003 file - promoters60/4773011
ttgtttgttca

SEQ ID NO: 142330 - DNA, 11 bp, Unknown
  misc_feature (1)..( 11): Result.003 file - promoters60/4773011
tgattctttga

SEQ ID NO: 142331 - DNA, 9 bp, Unknown
  misc_feature (1)..( 9): Result.003 file - promoters60/4773011
ctttttatt

SEQ ID NO: 142332 - DNA, 9 bp, Unknown
  misc_feature (1)..( 9): Result.003 file - promoters60/4773011
ctttttacc

SEQ ID NO: 142333 - DNA, 9 bp, Unknown
  misc_feature (1)..( 9): Result.003 file - promoters60/4773011
ctttttttg

SEQ ID NO: 142334 - DNA, 9 bp, Unknown
  misc_feature (1)..( 9): Result.003 file - promoters60/4773011
ctttttatt

SEQ ID NO: 142335 - DNA, 9 bp, Unknown
  misc_feature (1)..( 9): Result.003 file - promoters60/4773011
attttgttg

SEQ ID NO: 142336 - DNA, 6 bp, Unknown
  misc_feature (1)..( 6): Result.003 file - promoters60/4773015
ttttct

SEQ ID NO: 142337 - DNA, 6 bp, Unknown
  misc_feature (1)..( 6): Result.003 file - promoters60/4773015
ttttct

SEQ ID NO: 142338 - DNA, 9 bp, Unknown
  misc_feature (1)..( 9): Result.003 file - promoters60/4773015
tttcgtttc

SEQ ID NO: 142339 - DNA, 9 bp, Unknown
  misc_feature (1)..( 9): Result.003 file - promoters60/4773015
ttttgtttc

SEQ ID NO: 142340 - DNA, 10 bp, Unknown
  misc_feature (1)..( 10): Result.003 file - promoters60/4773015
cacaaaaaaa

SEQ ID NO: 142341 - DNA, 10 bp, Unknown
  misc_feature (1)..( 10): Result.003 file - promoters60/4773015
accaaaaaaa

SEQ ID NO: 142342 - DNA, 10 bp, Unknown
  misc_feature (1)..( 10): Result.003 file - promoters60/4773015
accaaaatca

SEQ ID NO: 142343 - DNA, 9 bp, Unknown
  misc_feature (1)..( 9): Result.003 file - promoters60/4773015
gtattttct

SEQ ID NO: 142344 - DNA, 9 bp, Unknown
  misc_feature (1)..( 9): Result.003 file - promoters60/4773015
gtattatct

SEQ ID NO: 142345 - DNA, 7 bp, Unknown
  misc_feature (1)..( 7): Result.003 file - promoters60/4773015
tttcgaa

SEQ ID NO: 142346 - DNA, 7 bp, Unknown
  misc_feature (1)..( 7): Result.003 file - promoters60/4773015
tttagaa

SEQ ID NO: 142347 - DNA, 7 bp, Unknown
  misc_feature (1)..( 7): Result.003 file - promoters60/4773015
ttttttc

SEQ ID NO: 142348 - DNA, 7 bp, Unknown
  misc_feature (1)..( 7): Result.003 file - promoters60/4773015
ttttttc

SEQ ID NO: 142349 - DNA, 7 bp, Unknown
  misc_feature (1)..( 7): Result.003 file - promoters60/4773015
ttgcttc

SEQ ID NO: 142350 - DNA, 7 bp, Unknown
  misc_feature (1)..( 7): Result.003 file - promoters60/4773015
ttgattc

SEQ ID NO: 142351 - DNA, 6 bp, Unknown
  misc_feature (1)..( 6): Result.003 file - promoters60/4773015
aaagaa

SEQ ID NO: 142352 - DNA, 6 bp, Unknown
  misc_feature (1)..( 6): Result.003 file - promoters60/4773015
aaagaa

SEQ ID NO: 142353 - DNA, 7 bp, Unknown
  misc_feature (1)..( 7): Result.003 file - promoters60/4773015
ttcattt

SEQ ID NO: 142354 - DNA, 7 bp, Unknown
  misc_feature (1)..( 7): Result.003 file - promoters60/4773015
ttctttt

SEQ ID NO: 142355 - DNA, 9 bp, Unknown
  misc_feature (1)..( 9): Result.003 file - promoters60/4773015
ctttctttt

SEQ ID NO: 142356 - DNA, 9 bp, Unknown
  misc_feature (1)..( 9): Result.003 file - promoters60/4773015
ctttgtttt

SEQ ID NO: 142357 - DNA, 7 bp, Unknown
  misc_feature (1)..( 7): Result.003 file - promoters60/4773015
attacag

SEQ ID NO: 142358 - DNA, 7 bp, Unknown
  misc_feature (1)..( 7): Result.003 file - promoters60/4773015
attgcag

SEQ ID NO: 142359 - DNA, 7 bp, Unknown
  misc_feature (1)..( 7): Result.003 file - promoters60/4773027
tattttt

SEQ ID NO: 142360 - DNA, 7 bp, Unknown
  misc_feature (1)..( 7): Result.003 file - promoters60/4773027
tatattt

SEQ ID NO: 142361 - DNA, 8 bp, Unknown
  misc_feature (1)..( 8): Result.003 file - promoters60/4773027
tatgttct

SEQ ID NO: 142362 - DNA, 8 bp, Unknown
  misc_feature (1)..( 8): Result.003 file - promoters60/4773027
tattttct

SEQ ID NO: 142363 - DNA, 6 bp, Unknown
  misc_feature (1)..( 6): Result.003 file - promoters60/4773027
atattt

SEQ ID NO: 142364 - DNA, 6 bp, Unknown
  misc_feature (1)..( 6): Result.003 file - promoters60/4773027
atattt

SEQ ID NO: 142365 - DNA, 6 bp, Unknown
  misc_feature (1)..( 6): Result.003 file - promoters60/4773027
atttat

SEQ ID NO: 142366 - DNA, 6 bp, Unknown
  misc_feature (1)..( 6): Result.003 file - promoters60/4773027
atttat

SEQ ID NO: 142367 - DNA, 6 bp, Unknown
  misc_feature (1)..( 6): Result.003 file - promoters60/4773027
cctttt

SEQ ID NO: 142368 - DNA, 6 bp, Unknown
  misc_feature (1)..( 6): Result.003 file - promoters60/4773027
cctttt

SEQ ID NO: 142369 - DNA, 6 bp, Unknown
  misc_feature (1)..( 6): Result.003 file - promoters60/4773027
cttata

SEQ ID NO: 142370 - DNA, 6 bp, Unknown
  misc_feature (1)..( 6): Result.003 file - promoters60/4773027
cttata

SEQ ID NO: 142371 - DNA, 6 bp, Unknown
  misc_feature (1)..( 6): Result.003 file - promoters60/4773027
gttgga

SEQ ID NO: 142372 - DNA, 6 bp, Unknown
  misc_feature (1)..( 6): Result.003 file - promoters60/4773027
gttgga

SEQ ID NO: 142373 - DNA, 6 bp, Unknown
  misc_feature (1)..( 6): Result.003 file - promoters60/4773027
ttcgag

SEQ ID NO: 142374 - DNA, 6 bp, Unknown
  misc_feature (1)..( 6): Result.003 file - promoters60/4773027
ttcgag

SEQ ID NO: 142375 - DNA, 7 bp, Unknown
  misc_feature (1)..( 7): Result.003 file - promoters60/4773027
gacgata

SEQ ID NO: 142376 - DNA, 7 bp, Unknown
  misc_feature (1)..( 7): Result.003 file - promoters60/4773027
gacaata

SEQ ID NO: 142377 - DNA, 6 bp, Unknown
  misc_feature (1)..( 6): Result.003 file - promoters60/4773027
tatctg

SEQ ID NO: 142378 - DNA, 6 bp, Unknown
  misc_feature (1)..( 6): Result.003 file - promoters60/4773027
tatctg

SEQ ID NO: 142379 - DNA, 7 bp, Unknown
  misc_feature (1)..( 7): Result.003 file - promoters60/4773027
gaaatca

SEQ ID NO: 142380 - DNA, 7 bp, Unknown
  misc_feature (1)..( 7): Result.003 file - promoters60/4773027
gaactca

SEQ ID NO: 142381 - DNA, 7 bp, Unknown
  misc_feature (1)..( 7): Result.003 file - promoters60/4773027
ggtgctt

SEQ ID NO: 142382 - DNA, 7 bp, Unknown
  misc_feature (1)..( 7): Result.003 file - promoters60/4773027
ggtcctt

SEQ ID NO: 142383 - DNA, 6 bp, Unknown
  misc_feature (1)..( 6): Result.003 file - promoters60/4773027
atatct

SEQ ID NO: 142384 - DNA, 6 bp, Unknown
  misc_feature (1)..( 6): Result.003 file - promoters60/4773027
atatct

SEQ ID NO: 142385 - DNA, 6 bp, Unknown
  misc_feature (1)..( 6): Result.003 file - promoters60/4773027
aactaa

SEQ ID NO: 142386 - DNA, 6 bp, Unknown
  misc_feature (1)..( 6): Result.003 file - promoters60/4773027
aactaa

SEQ ID NO: 142387 - DNA, 7 bp, Unknown
  misc_feature (1)..( 7): Result.003 file - promoters60/4773027
ctaatgt

SEQ ID NO: 142388 - DNA, 7 bp, Unknown
  misc_feature (1)..( 7): Result.003 file - promoters60/4773027
ctattgt

SEQ ID NO: 142389 - DNA, 6 bp, Unknown
  misc_feature (1)..( 6): Result.003 file - promoters60/4773027
tgtgct

SEQ ID NO: 142390 - DNA, 6 bp, Unknown
  misc_feature (1)..( 6): Result.003 file - promoters60/4773027
tgtgct

SEQ ID NO: 142391 - DNA, 8 bp, Unknown
  misc_feature (1)..( 8): Result.003 file - promoters60/4773027
aaacaatt

SEQ ID NO: 142392 - DNA, 8 bp, Unknown
  misc_feature (1)..( 8): Result.003 file - promoters60/4773027
aaacgatt

SEQ ID NO: 142393 - DNA, 7 bp, Unknown
  misc_feature (1)..( 7): Result.003 file - promoters60/4773027
ctaaaat

SEQ ID NO: 142394 - DNA, 7 bp, Unknown
  misc_feature (1)..( 7): Result.003 file - promoters60/4773027
ctacaat

SEQ ID NO: 142395 - DNA, 7 bp, Unknown
  misc_feature (1)..( 7): Result.003 file - promoters60/4773027
ttttgtt

SEQ ID NO: 142396 - DNA, 7 bp, Unknown
  misc_feature (1)..( 7): Result.003 file - promoters60/4773027
ttttgtt

SEQ ID NO: 142397 - DNA, 7 bp, Unknown
  misc_feature (1)..( 7): Result.003 file - promoters60/4773027
ttagtaa

SEQ ID NO: 142398 - DNA, 7 bp, Unknown
  misc_feature (1)..( 7): Result.003 file - promoters60/4773027
ttattaa

SEQ ID NO: 142399 - DNA, 7 bp, Unknown
  misc_feature (1)..( 7): Result.003 file - promoters60/4773027
tcttttc

SEQ ID NO: 142400 - DNA, 7 bp, Unknown
  misc_feature (1)..( 7): Result.003 file - promoters60/4773027
tctgttc

SEQ ID NO: 142401 - DNA, 6 bp, Unknown
  misc_feature (1)..( 6): Result.003 file - promoters60/4773027
aataat

SEQ ID NO: 142402 - DNA, 6 bp, Unknown
  misc_feature (1)..( 6): Result.003 file - promoters60/4773027
aataat

SEQ ID NO: 142403 - DNA, 11 bp, Unknown
  misc_feature (1)..( 11): Result.003 file - promoters60/4773035
aaataaattaa

SEQ ID NO: 142404 - DNA, 11 bp, Unknown
  misc_feature (1)..( 11): Result.003 file - promoters60/4773035
gaataaacgcc

SEQ ID NO: 142405 - DNA, 11 bp, Unknown
  misc_feature (1)..( 11): Result.003 file - promoters60/4773035
caataaataat

SEQ ID NO: 142406 - DNA, 11 bp, Unknown
  misc_feature (1)..( 11): Result.003 file - promoters60/4773035
atatacattac

SEQ ID NO: 142407 - DNA, 11 bp, Unknown
  misc_feature (1)..( 11): Result.003 file - promoters60/4773035
gaaaaaacata

SEQ ID NO: 142408 - DNA, 11 bp, Unknown
  misc_feature (1)..( 11): Result.003 file - promoters60/4773035
aatgaaatcat

SEQ ID NO: 142409 - DNA, 11 bp, Unknown
  misc_feature (1)..( 11): Result.003 file - promoters60/4773035
tttcaaaaaag

SEQ ID NO: 142410 - DNA, 11 bp, Unknown
  misc_feature (1)..( 11): Result.003 file - promoters60/4773035
acccaataaag

SEQ ID NO: 142411 - DNA, 11 bp, Unknown
  misc_feature (1)..( 11): Result.003 file - promoters60/4773035
tactaattaag

SEQ ID NO: 142412 - DNA, 11 bp, Unknown
  misc_feature (1)..( 11): Result.003 file - promoters60/4773035
ttactatttat

SEQ ID NO: 142413 - DNA, 11 bp, Unknown
  misc_feature (1)..( 11): Result.003 file - promoters60/4773035
attccactaat

SEQ ID NO: 142414 - DNA, 11 bp, Unknown
  misc_feature (1)..( 11): Result.003 file - promoters60/4773035
tatccacttgt

SEQ ID NO: 142415 - DNA, 10 bp, Unknown
  misc_feature (1)..( 10): Result.003 file - promoters60/4773035
gcatataaag

SEQ ID NO: 142416 - DNA, 10 bp, Unknown
  misc_feature (1)..( 10): Result.003 file - promoters60/4773035
gtatataaat

SEQ ID NO: 142417 - DNA, 10 bp, Unknown
  misc_feature (1)..( 10): Result.003 file - promoters60/4773035
taatataaag

SEQ ID NO: 142418 - DNA, 10 bp, Unknown
  misc_feature (1)..( 10): Result.003 file - promoters60/4773035
ccatataaat

SEQ ID NO: 142419 - DNA, 10 bp, Unknown
  misc_feature (1)..( 10): Result.003 file - promoters60/4773035
ctatataaag

SEQ ID NO: 142420 - DNA, 10 bp, Unknown
  misc_feature (1)..( 10): Result.003 file - promoters60/4773035
gtatatataa

SEQ ID NO: 142421 - DNA, 10 bp, Unknown
  misc_feature (1)..( 10): Result.003 file - promoters60/4773035
ctatttaaag

SEQ ID NO: 142422 - DNA, 8 bp, Unknown
  misc_feature (1)..( 8): Result.003 file - promoters60/4773068
caataaaa

SEQ ID NO: 142423 - DNA, 8 bp, Unknown
  misc_feature (1)..( 8): Result.003 file - promoters60/4773068
caaaaaaa

SEQ ID NO: 142424 - DNA, 6 bp, Unknown
  misc_feature (1)..( 6): Result.003 file - promoters60/4773068
aaaaca

SEQ ID NO: 142425 - DNA, 6 bp, Unknown
  misc_feature (1)..( 6): Result.003 file - promoters60/4773068
aaaaca

SEQ ID NO: 142426 - DNA, 8 bp, Unknown
  misc_feature (1)..( 8): Result.003 file - promoters60/4773068
gaattaaa

SEQ ID NO: 142427 - DNA, 8 bp, Unknown
  misc_feature (1)..( 8): Result.003 file - promoters60/4773068
gaaataaa

SEQ ID NO: 142428 - DNA, 7 bp, Unknown
  misc_feature (1)..( 7): Result.003 file - promoters60/4773068
caaattt

SEQ ID NO: 142429 - DNA, 7 bp, Unknown
  misc_feature (1)..( 7): Result.003 file - promoters60/4773068
caatttt

SEQ ID NO: 142430 - DNA, 6 bp, Unknown
  misc_feature (1)..( 6): Result.003 file - promoters60/4773068
ttaaaa

SEQ ID NO: 142431 - DNA, 6 bp, Unknown
  misc_feature (1)..( 6): Result.003 file - promoters60/4773068
ttaaaa

SEQ ID NO: 142432 - DNA, 6 bp, Unknown
  misc_feature (1)..( 6): Result.003 file - promoters60/4773068
gtaacg

SEQ ID NO: 142433 - DNA, 6 bp, Unknown
  misc_feature (1)..( 6): Result.003 file - promoters60/4773068
gtaacg

SEQ ID NO: 142434 - DNA, 7 bp, Unknown
  misc_feature (1)..( 7): Result.003 file - promoters60/4773068
gtggtta

SEQ ID NO: 142435 - DNA, 7 bp, Unknown
  misc_feature (1)..( 7): Result.003 file - promoters60/4773068
gtgttta

SEQ ID NO: 142436 - DNA, 10 bp, Unknown
  misc_feature (1)..( 10): Result.003 file - promoters60/4773068
tacgtgtcaa

SEQ ID NO: 142437 - DNA, 10 bp, Unknown
  misc_feature (1)..( 10): Result.003 file - promoters60/4773068
cacgtgtcat

SEQ ID NO: 142438 - DNA, 10 bp, Unknown
  misc_feature (1)..( 10): Result.003 file - promoters60/4773068
tacgtgtcaa

SEQ ID NO: 142439 - DNA, 20 bp, Unknown
  misc_feature (1)..( 20): Result.003 file - promoters60/4773068
ttggttattgcttcaccgcc

SEQ ID NO: 142440 - DNA, 20 bp, Unknown
  misc_feature (1)..( 20): Result.003 file - promoters60/4773068
ttagctattgcttcaccgcc

SEQ ID NO: 142441 - DNA, 20 bp, Unknown
  misc_feature (1)..( 20): Result.003 file - promoters60/4773068
ttggctattgcttccacgcc

SEQ ID NO: 142442 - DNA, 22 bp, Unknown
  misc_feature (1)..( 22): Result.003 file - promoters60/4773068
tctcgtgaccgactcgtcctcg

SEQ ID NO: 142443 - DNA, 22 bp, Unknown
  misc_feature (1)..( 22): Result.003 file - promoters60/4773068
gacctagtcgtcctcgtctttt

SEQ ID NO: 142444 - DNA, 22 bp, Unknown
  misc_feature (1)..( 22): Result.003 file - promoters60/4773068
gaccgagtcgtcctcgtctttt

SEQ ID NO: 142445 - DNA, 19 bp, Unknown
  misc_feature (1)..( 19): Result.003 file - promoters60/4773068
ttcttcttctataaattaa

SEQ ID NO: 142446 - DNA, 19 bp, Unknown
  misc_feature (1)..( 19): Result.003 file - promoters60/4773068
ttcttcttctataaaacaa

SEQ ID NO: 142447 - DNA, 19 bp, Unknown
  misc_feature (1)..( 19): Result.003 file - promoters60/4773068
ttttgcttctataaatcaa

SEQ ID NO: 142448 - DNA, 6 bp, Unknown
  misc_feature (1)..( 6): Result.003 file - promoters60/4773068
gcttct

SEQ ID NO: 142449 - DNA, 6 bp, Unknown
  misc_feature (1)..( 6): Result.003 file - promoters60/4773068
gcttct

SEQ ID NO: 142450 - DNA, 8 bp, Unknown
  misc_feature (1)..( 8): Result.003 file - promoters60/4773068
ttctggcc

SEQ ID NO: 142451 - DNA, 8 bp, Unknown
  misc_feature (1)..( 8): Result.003 file - promoters60/4773068
ttcttgcc

SEQ ID NO: 142452 - DNA, 7 bp, Unknown
  misc_feature (1)..( 7): Result.003 file - promoters60/4773068
tacatat

SEQ ID NO: 142453 - DNA, 7 bp, Unknown
  misc_feature (1)..( 7): Result.003 file - promoters60/4773068
tacttat

SEQ ID NO: 142454 - DNA, 15 bp, Unknown
  misc_feature (1)..( 15): Result.003 file - promoters60/4773068
cgccttagctttctc

SEQ ID NO: 142455 - DNA, 15 bp, Unknown
  misc_feature (1)..( 15): Result.003 file - promoters60/4773068
cgccttagctttctc

SEQ ID NO: 142456 - DNA, 15 bp, Unknown
  misc_feature (1)..( 15): Result.003 file - promoters60/4773068
cgccttagctttctc

SEQ ID NO: 142457 - DNA, 6 bp, Unknown
  misc_feature (1)..( 6): Result.003 file - promoters60/4773068
tttttt

SEQ ID NO: 142458 - DNA, 6 bp, Unknown
  misc_feature (1)..( 6): Result.003 file - promoters60/4773068
tttttt

SEQ ID NO: 142459 - DNA, 9 bp, Unknown
  misc_feature (1)..( 9): Result.003 file - promoters60/4773068
acaaaaagg

SEQ ID NO: 142460 - DNA, 9 bp, Unknown
  misc_feature (1)..( 9): Result.003 file - promoters60/4773068
acacaaagg

SEQ ID NO: 142461 - DNA, 7 bp, Unknown
  misc_feature (1)..( 7): Result.003 file - promoters60/4773068
acgaaga

SEQ ID NO: 142462 - DNA, 7 bp, Unknown
  misc_feature (1)..( 7): Result.003 file - promoters60/4773068
acgcaga

SEQ ID NO: 142463 - DNA, 6 bp, Unknown
  misc_feature (1)..( 6): Result.003 file - promoters60/4773068
gttcaa

SEQ ID NO: 142464 - DNA, 6 bp, Unknown
  misc_feature (1)..( 6): Result.003 file - promoters60/4773068
gttcaa

SEQ ID NO: 142465 - DNA, 6 bp, Unknown
  misc_feature (1)..( 6): Result.003 file - promoters60/4773068
gtatat

SEQ ID NO: 142466 - DNA, 6 bp, Unknown
  misc_feature (1)..( 6): Result.003 file - promoters60/4773068
gtatat

SEQ ID NO: 142467 - DNA, 9 bp, Unknown
  misc_feature (1)..( 9): Result.003 file - promoters60/4773068
atcttatga

SEQ ID NO: 142468 - DNA, 9 bp, Unknown
  misc_feature (1)..( 9): Result.003 file - promoters60/4773068
atctaatga

SEQ ID NO: 142469 - DNA, 6 bp, Unknown
  misc_feature (1)..( 6): Result.003 file - promoters60/4773068
tcagta

SEQ ID NO: 142470 - DNA, 6 bp, Unknown
  misc_feature (1)..( 6): Result.003 file - promoters60/4773068
tcagta

SEQ ID NO: 142471 - DNA, 6 bp, Unknown
  misc_feature (1)..( 6): Result.003 file - promoters60/4773068
aacaac

SEQ ID NO: 142472 - DNA, 6 bp, Unknown
  misc_feature (1)..( 6): Result.003 file - promoters60/4773068
aacaac

SEQ ID NO: 142473 - DNA, 15 bp, Unknown
  misc_feature (1)..( 15): Result.003 file - promoters60/4773068
aatacccaaagagct

SEQ ID NO: 142474 - DNA, 15 bp, Unknown
  misc_feature (1)..( 15): Result.003 file - promoters60/4773068
aatacccaaagagct

SEQ ID NO: 142475 - DNA, 12 bp, Unknown
  misc_feature (1)..( 12): Result.003 file - promoters60/4773074
cagaatttttgc

SEQ ID NO: 142476 - DNA, 12 bp, Unknown
  misc_feature (1)..( 12): Result.003 file - promoters60/4773074
aaagattattga

SEQ ID NO: 142477 - DNA, 12 bp, Unknown
  misc_feature (1)..( 12): Result.003 file - promoters60/4773074
cactctttttga

SEQ ID NO: 142478 - DNA, 12 bp, Unknown
  misc_feature (1)..( 12): Result.003 file - promoters60/4773074
aaagactatttg

SEQ ID NO: 142479 - DNA, 12 bp, Unknown
  misc_feature (1)..( 12): Result.003 file - promoters60/4773074
gtttggttttga

SEQ ID NO: 142480 - DNA, 12 bp, Unknown
  misc_feature (1)..( 12): Result.003 file - promoters60/4773074
aaggcctattta

SEQ ID NO: 142481 - DNA, 6 bp, Unknown
  misc_feature (1)..( 6): Result.003 file - promoters60/4773077
atccaa

SEQ ID NO: 142482 - DNA, 6 bp, Unknown
  misc_feature (1)..( 6): Result.003 file - promoters60/4773077
atccaa

SEQ ID NO: 142483 - DNA, 6 bp, Unknown
  misc_feature (1)..( 6): Result.003 file - promoters60/4773077
ctcctc

SEQ ID NO: 142484 - DNA, 6 bp, Unknown
  misc_feature (1)..( 6): Result.003 file - promoters60/4773077
ctcctc

SEQ ID NO: 142485 - DNA, 7 bp, Unknown
  misc_feature (1)..( 7): Result.003 file - promoters60/4773077
acctctc

SEQ ID NO: 142486 - DNA, 7 bp, Unknown
  misc_feature (1)..( 7): Result.003 file - promoters60/4773077
accactc

SEQ ID NO: 142487 - DNA, 8 bp, Unknown
  misc_feature (1)..( 8): Result.003 file - promoters60/4773077
ctctctca

SEQ ID NO: 142488 - DNA, 8 bp, Unknown
  misc_feature (1)..( 8): Result.003 file - promoters60/4773077
ctctctca

SEQ ID NO: 142489 - DNA, 6 bp, Unknown
  misc_feature (1)..( 6): Result.003 file - promoters60/4773077
tctttc

SEQ ID NO: 142490 - DNA, 6 bp, Unknown
  misc_feature (1)..( 6): Result.003 file - promoters60/4773077
tctttc

SEQ ID NO: 142491 - DNA, 8 bp, Unknown
  misc_feature (1)..( 8): Result.003 file - promoters60/4773077
cctcttct

SEQ ID NO: 142492 - DNA, 8 bp, Unknown
  misc_feature (1)..( 8): Result.003 file - promoters60/4773077
tatcttct

SEQ ID NO: 142493 - DNA, 8 bp, Unknown
  misc_feature (1)..( 8): Result.003 file - promoters60/4773077
tattttcg

SEQ ID NO: 142494 - DNA, 9 bp, Unknown
  misc_feature (1)..( 9): Result.003 file - promoters60/4773077
tctcgttaa

SEQ ID NO: 142495 - DNA, 9 bp, Unknown
  misc_feature (1)..( 9): Result.003 file - promoters60/4773077
tctcgctaa

SEQ ID NO: 142496 - DNA, 8 bp, Unknown
  misc_feature (1)..( 8): Result.003 file - promoters60/4773077
tttagctt

SEQ ID NO: 142497 - DNA, 8 bp, Unknown
  misc_feature (1)..( 8): Result.003 file - promoters60/4773077
tttatctt

SEQ ID NO: 142498 - DNA, 6 bp, Unknown
  misc_feature (1)..( 6): Result.003 file - promoters60/4773077
gaatta

SEQ ID NO: 142499 - DNA, 6 bp, Unknown
  misc_feature (1)..( 6): Result.003 file - promoters60/4773077
gaatta

SEQ ID NO: 142500 - DNA, 6 bp, Unknown
  misc_feature (1)..( 6): Result.003 file - promoters60/4773077
gcggaa

SEQ ID NO: 142501 - DNA, 6 bp, Unknown
  misc_feature (1)..( 6): Result.003 file - promoters60/4773077
gcggaa

SEQ ID NO: 142502 - DNA, 6 bp, Unknown
  misc_feature (1)..( 6): Result.003 file - promoters60/4773077
aaagaa

SEQ ID NO: 142503 - DNA, 6 bp, Unknown
  misc_feature (1)..( 6): Result.003 file - promoters60/4773077
aaagaa

SEQ ID NO: 142504 - DNA, 6 bp, Unknown
  misc_feature (1)..( 6): Result.003 file - promoters60/4773077
tccttg

SEQ ID NO: 142505 - DNA, 6 bp, Unknown
  misc_feature (1)..( 6): Result.003 file - promoters60/4773077
tccttg

SEQ ID NO: 142506 - DNA, 7 bp, Unknown
  misc_feature (1)..( 7): Result.003 file - promoters60/4773077
gatatat

SEQ ID NO: 142507 - DNA, 7 bp, Unknown
  misc_feature (1)..( 7): Result.003 file - promoters60/4773077
gatgtat

SEQ ID NO: 142508 - DNA, 13 bp, Unknown
  misc_feature (1)..( 13): Result.003 file - promoters60/4773089
caaaaataagatt

SEQ ID NO: 142509 - DNA, 13 bp, Unknown
  misc_feature (1)..( 13): Result.003 file - promoters60/4773089
aaaacataagttt

SEQ ID NO: 142510 - DNA, 13 bp, Unknown
  misc_feature (1)..( 13): Result.003 file - promoters60/4773089
gacaaataaatcg

SEQ ID NO: 142511 - DNA, 13 bp, Unknown
  misc_feature (1)..( 13): Result.003 file - promoters60/4773089
taacgataagaga

SEQ ID NO: 142512 - DNA, 13 bp, Unknown
  misc_feature (1)..( 13): Result.003 file - promoters60/4773089
gaaaaataaacta

SEQ ID NO: 142513 - DNA, 13 bp, Unknown
  misc_feature (1)..( 13): Result.003 file - promoters60/4773089
ttgtcataaattt

SEQ ID NO: 142514 - DNA, 13 bp, Unknown
  misc_feature (1)..( 13): Result.003 file - promoters60/4773089
aaaaaacaatttg

SEQ ID NO: 142515 - DNA, 10 bp, Unknown
  misc_feature (1)..( 10): Result.003 file - promoters60/4773089
ataagattag

SEQ ID NO: 142516 - DNA, 10 bp, Unknown
  misc_feature (1)..( 10): Result.003 file - promoters60/4773089
gtaaaatttt

SEQ ID NO: 142517 - DNA, 10 bp, Unknown
  misc_feature (1)..( 10): Result.003 file - promoters60/4773089
ataagagatg

SEQ ID NO: 142518 - DNA, 10 bp, Unknown
  misc_feature (1)..( 10): Result.003 file - promoters60/4773089
cataaatttg

SEQ ID NO: 142519 - DNA, 10 bp, Unknown
  misc_feature (1)..( 10): Result.003 file - promoters60/4773089
ggaaacttta

SEQ ID NO: 142520 - DNA, 10 bp, Unknown
  misc_feature (1)..( 10): Result.003 file - promoters60/4773089
aaacaatttg

SEQ ID NO: 142521 - DNA, 12 bp, Unknown
  misc_feature (1)..( 12): Result.003 file - promoters60/4773089
aaaaaagacaaa

SEQ ID NO: 142522 - DNA, 12 bp, Unknown
  misc_feature (1)..( 12): Result.003 file - promoters60/4773089
caaaacgacgtc

SEQ ID NO: 142523 - DNA, 12 bp, Unknown
  misc_feature (1)..( 12): Result.003 file - promoters60/4773089
aaaaaatacaaa

SEQ ID NO: 142524 - DNA, 12 bp, Unknown
  misc_feature (1)..( 12): Result.003 file - promoters60/4773089
aaaaaatacgac

SEQ ID NO: 142525 - DNA, 12 bp, Unknown
  misc_feature (1)..( 12): Result.003 file - promoters60/4773089
ccaaaatataac

SEQ ID NO: 142526 - DNA, 10 bp, Unknown
  misc_feature (1)..( 10): Result.003 file - promoters60/4773089
tacatgtata

SEQ ID NO: 142527 - DNA, 10 bp, Unknown
  misc_feature (1)..( 10): Result.003 file - promoters60/4773089
agaatgtatg

SEQ ID NO: 142528 - DNA, 10 bp, Unknown
  misc_feature (1)..( 10): Result.003 file - promoters60/4773089
caaatttatt

SEQ ID NO: 142529 - DNA, 10 bp, Unknown
  misc_feature (1)..( 10): Result.003 file - promoters60/4773089
gatatttatt

SEQ ID NO: 142530 - DNA, 10 bp, Unknown
  misc_feature (1)..( 10): Result.003 file - promoters60/4773089
acaatttttc

SEQ ID NO: 142531 - DNA, 13 bp, Unknown
  misc_feature (1)..( 13): Result.003 file - promoters60/4773089
taactaaacttta

SEQ ID NO: 142532 - DNA, 13 bp, Unknown
  misc_feature (1)..( 13): Result.003 file - promoters60/4773089
aatataatcttaa

SEQ ID NO: 142533 - DNA, 13 bp, Unknown
  misc_feature (1)..( 13): Result.003 file - promoters60/4773089
ataatcaacttta

SEQ ID NO: 142534 - DNA, 13 bp, Unknown
  misc_feature (1)..( 13): Result.003 file - promoters60/4773089
atcttaaatttaa

SEQ ID NO: 142535 - DNA, 13 bp, Unknown
  misc_feature (1)..( 13): Result.003 file - promoters60/4773089
aatgtaattttat

SEQ ID NO: 142536 - DNA, 7 bp, Unknown
  misc_feature (1)..( 7): Result.003 file - promoters60/4773093
tttgcca

SEQ ID NO: 142537 - DNA, 7 bp, Unknown
  misc_feature (1)..( 7): Result.003 file - promoters60/4773093
tttccca

SEQ ID NO: 142538 - DNA, 7 bp, Unknown
  misc_feature (1)..( 7): Result.003 file - promoters60/4773093
gcaaatt

SEQ ID NO: 142539 - DNA, 7 bp, Unknown
  misc_feature (1)..( 7): Result.003 file - promoters60/4773093
gcatatt

SEQ ID NO: 142540 - DNA, 6 bp, Unknown
  misc_feature (1)..( 6): Result.003 file - promoters60/4773093
tttgat

SEQ ID NO: 142541 - DNA, 6 bp, Unknown
  misc_feature (1)..( 6): Result.003 file - promoters60/4773093
tttgat

SEQ ID NO: 142542 - DNA, 6 bp, Unknown
  misc_feature (1)..( 6): Result.003 file - promoters60/4773093
tttgat

SEQ ID NO: 142543 - DNA, 8 bp, Unknown
  misc_feature (1)..( 8): Result.003 file - promoters60/4773093
tttttatc

SEQ ID NO: 142544 - DNA, 8 bp, Unknown
  misc_feature (1)..( 8): Result.003 file - promoters60/4773093
ttttcatc

SEQ ID NO: 142545 - DNA, 8 bp, Unknown
  misc_feature (1)..( 8): Result.003 file - promoters60/4773093
ctttctct

SEQ ID NO: 142546 - DNA, 8 bp, Unknown
  misc_feature (1)..( 8): Result.003 file - promoters60/4773093
attttttt

SEQ ID NO: 142547 - DNA, 8 bp, Unknown
  misc_feature (1)..( 8): Result.003 file - promoters60/4773093
attttttt

SEQ ID NO: 142548 - DNA, 6 bp, Unknown
  misc_feature (1)..( 6): Result.003 file - promoters60/4773093
tgttat

SEQ ID NO: 142549 - DNA, 6 bp, Unknown
  misc_feature (1)..( 6): Result.003 file - promoters60/4773093
tgttat

SEQ ID NO: 142550 - DNA, 8 bp, Unknown
  misc_feature (1)..( 8): Result.003 file - promoters60/4773093
tgtttgtt

SEQ ID NO: 142551 - DNA, 8 bp, Unknown
  misc_feature (1)..( 8): Result.003 file - promoters60/4773093
tgtatgtt

SEQ ID NO: 142552 - DNA, 6 bp, Unknown
  misc_feature (1)..( 6): Result.003 file - promoters60/4773093
ctctta

SEQ ID NO: 142553 - DNA, 6 bp, Unknown
  misc_feature (1)..( 6): Result.003 file - promoters60/4773093
ctctta

SEQ ID NO: 142554 - DNA, 6 bp, Unknown
  misc_feature (1)..( 6): Result.003 file - promoters60/4773093
atttaa

SEQ ID NO: 142555 - DNA, 6 bp, Unknown
  misc_feature (1)..( 6): Result.003 file - promoters60/4773093
atttaa

SEQ ID NO: 142556 - DNA, 6 bp, Unknown
  misc_feature (1)..( 6): Result.003 file - promoters60/4773093
aaattt

SEQ ID NO: 142557 - DNA, 6 bp, Unknown
  misc_feature (1)..( 6): Result.003 file - promoters60/4773093
aaattt

SEQ ID NO: 142558 - DNA, 10 bp, Unknown
  misc_feature (1)..( 10): Result.003 file - promoters60/4773093
aatattgggc

SEQ ID NO: 142559 - DNA, 10 bp, Unknown
  misc_feature (1)..( 10): Result.003 file - promoters60/4773093
aatattcggc

SEQ ID NO: 142560 - DNA, 10 bp, Unknown
  misc_feature (1)..( 10): Result.003 file - promoters60/4773093
tacattgggc

SEQ ID NO: 142561 - DNA, 7 bp, Unknown
  misc_feature (1)..( 7): Result.003 file - promoters60/4773093
attgggc

SEQ ID NO: 142562 - DNA, 7 bp, Unknown
  misc_feature (1)..( 7): Result.003 file - promoters60/4773093
atttggc

SEQ ID NO: 142563 - DNA, 7 bp, Unknown
  misc_feature (1)..( 7): Result.003 file - promoters60/4773093
tatttga

SEQ ID NO: 142564 - DNA, 7 bp, Unknown
  misc_feature (1)..( 7): Result.003 file - promoters60/4773093
tatatga

SEQ ID NO: 142565 - DNA, 7 bp, Unknown
  misc_feature (1)..( 7): Result.003 file - promoters60/4773093
ctataaa

SEQ ID NO: 142566 - DNA, 7 bp, Unknown
  misc_feature (1)..( 7): Result.003 file - promoters60/4773093
ctagaaa

SEQ ID NO: 142567 - DNA, 7 bp, Unknown
  misc_feature (1)..( 7): Result.003 file - promoters60/4773093
tttttct

SEQ ID NO: 142568 - DNA, 7 bp, Unknown
  misc_feature (1)..( 7): Result.003 file - promoters60/4773093
tttctct

SEQ ID NO: 142569 - DNA, 7 bp, Unknown
  misc_feature (1)..( 7): Result.003 file - promoters60/4773093
gttttct

SEQ ID NO: 142570 - DNA, 7 bp, Unknown
  misc_feature (1)..( 7): Result.003 file - promoters60/4773093
gttatct

SEQ ID NO: 142571 - DNA, 8 bp, Unknown
  misc_feature (1)..( 8): Result.003 file - promoters60/4773093
caattgtc

SEQ ID NO: 142572 - DNA, 8 bp, Unknown
  misc_feature (1)..( 8): Result.003 file - promoters60/4773093
caatagtc

SEQ ID NO: 142573 - DNA, 7 bp, Unknown
  misc_feature (1)..( 7): Result.003 file - promoters60/4773093
aaagcag

SEQ ID NO: 142574 - DNA, 7 bp, Unknown
  misc_feature (1)..( 7): Result.003 file - promoters60/4773093
aaatcag

SEQ ID NO: 142575 - DNA, 10 bp, Unknown
  misc_feature (1)..( 10): Result.003 file - promoters60/4773093
aactttaaat

SEQ ID NO: 142576 - DNA, 10 bp, Unknown
  misc_feature (1)..( 10): Result.003 file - promoters60/4773093
aacttgaaat

SEQ ID NO: 142577 - DNA, 8 bp, Unknown
  misc_feature (1)..( 8): Result.003 file - promoters60/4773093
aaccctaa

SEQ ID NO: 142578 - DNA, 8 bp, Unknown
  misc_feature (1)..( 8): Result.003 file - promoters60/4773093
aaccctaa

SEQ ID NO: 142579 - DNA, 8 bp, Unknown
  misc_feature (1)..( 8): Result.003 file - promoters60/4773093
ttagcaat

SEQ ID NO: 142580 - DNA, 8 bp, Unknown
  misc_feature (1)..( 8): Result.003 file - promoters60/4773093
ttaccaat

SEQ ID NO: 142581 - DNA, 6 bp, Unknown
  misc_feature (1)..( 6): Result.003 file - promoters60/4773093
tgttcc

SEQ ID NO: 142582 - DNA, 6 bp, Unknown
  misc_feature (1)..( 6): Result.003 file - promoters60/4773093
tgttcc

SEQ ID NO: 142583 - DNA, 6 bp, Unknown
  misc_feature (1)..( 6): Result.003 file - promoters60/4773093
tgtttt

SEQ ID NO: 142584 - DNA, 6 bp, Unknown
  misc_feature (1)..( 6): Result.003 file - promoters60/4773093
tgtttt

SEQ ID NO: 142585 - DNA, 6 bp, Unknown
  misc_feature (1)..( 6): Result.003 file - promoters60/4773093
tgattt

SEQ ID NO: 142586 - DNA, 6 bp, Unknown
  misc_feature (1)..( 6): Result.003 file - promoters60/4773093
tgattt

SEQ ID NO: 142587 - DNA, 7 bp, Unknown
  misc_feature (1)..( 7): Result.003 file - promoters60/4773093
tatcgtc

SEQ ID NO: 142588 - DNA, 7 bp, Unknown
  misc_feature (1)..( 7): Result.003 file - promoters60/4773093
tattgtc

SEQ ID NO: 142589 - DNA, 8 bp, Unknown
  misc_feature (1)..( 8): Result.003 file - promoters60/4773093
ccttcttg

SEQ ID NO: 142590 - DNA, 8 bp, Unknown
  misc_feature (1)..( 8): Result.003 file - promoters60/4773093
cctttttg

SEQ ID NO: 142591 - DNA, 6 bp, Unknown
  misc_feature (1)..( 6): Result.003 file - promoters60/4773093
aaccaa

SEQ ID NO: 142592 - DNA, 6 bp, Unknown
  misc_feature (1)..( 6): Result.003 file - promoters60/4773093
aaccaa

SEQ ID NO: 142593 - DNA, 7 bp, Unknown
  misc_feature (1)..( 7): Result.003 file - promoters60/4773093
tatgaaa

SEQ ID NO: 142594 - DNA, 7 bp, Unknown
  misc_feature (1)..( 7): Result.003 file - promoters60/4773093
tatcaaa

SEQ ID NO: 142595 - DNA, 8 bp, Unknown
  misc_feature (1)..( 8): Result.003 file - promoters60/4773093
aaacaaga

SEQ ID NO: 142596 - DNA, 8 bp, Unknown
  misc_feature (1)..( 8): Result.003 file - promoters60/4773093
aaaccaga

SEQ ID NO: 142597 - DNA, 7 bp, Unknown
  misc_feature (1)..( 7): Result.003 file - promoters60/4773112
tgtattt

SEQ ID NO: 142598 - DNA, 7 bp, Unknown
  misc_feature (1)..( 7): Result.003 file - promoters60/4773112
tgtcttt

SEQ ID NO: 142599 - DNA, 8 bp, Unknown
  misc_feature (1)..( 8): Result.003 file - promoters60/4773112
cattagga

SEQ ID NO: 142600 - DNA, 8 bp, Unknown
  misc_feature (1)..( 8): Result.003 file - promoters60/4773112
cattcgga

SEQ ID NO: 142601 - DNA, 8 bp, Unknown
  misc_feature (1)..( 8): Result.003 file - promoters60/4773112
cattcggt

SEQ ID NO: 142602 - DNA, 9 bp, Unknown
  misc_feature (1)..( 9): Result.003 file - promoters60/4773112
tgttaattt

SEQ ID NO: 142603 - DNA, 9 bp, Unknown
  misc_feature (1)..( 9): Result.003 file - promoters60/4773112
tgttaaaca

SEQ ID NO: 142604 - DNA, 9 bp, Unknown
  misc_feature (1)..( 9): Result.003 file - promoters60/4773112
ggttatttt

SEQ ID NO: 142605 - DNA, 7 bp, Unknown
  misc_feature (1)..( 7): Result.003 file - promoters60/4773112
acaaatg

SEQ ID NO: 142606 - DNA, 7 bp, Unknown
  misc_feature (1)..( 7): Result.003 file - promoters60/4773112
acatatg

SEQ ID NO: 142607 - DNA, 6 bp, Unknown
  misc_feature (1)..( 6): Result.003 file - promoters60/4773112
ttcata

SEQ ID NO: 142608 - DNA, 6 bp, Unknown
  misc_feature (1)..( 6): Result.003 file - promoters60/4773112
ttcata

SEQ ID NO: 142609 - DNA, 7 bp, Unknown
  misc_feature (1)..( 7): Result.003 file - promoters60/4773112
tatatta

SEQ ID NO: 142610 - DNA, 7 bp, Unknown
  misc_feature (1)..( 7): Result.003 file - promoters60/4773112
tatttta

SEQ ID NO: 142611 - DNA, 6 bp, Unknown
  misc_feature (1)..( 6): Result.003 file - promoters60/4773112
tagtat

SEQ ID NO: 142612 - DNA, 6 bp, Unknown
  misc_feature (1)..( 6): Result.003 file - promoters60/4773112
tagtat

SEQ ID NO: 142613 - DNA, 11 bp, Unknown
  misc_feature (1)..( 11): Result.003 file - promoters60/4773112
aaacttttttt

SEQ ID NO: 142614 - DNA, 11 bp, Unknown
  misc_feature (1)..( 11): Result.003 file - promoters60/4773112
aaagtttattt

SEQ ID NO: 142615 - DNA, 8 bp, Unknown
  misc_feature (1)..( 8): Result.003 file - promoters60/4773112
ttaaattt

SEQ ID NO: 142616 - DNA, 8 bp, Unknown
  misc_feature (1)..( 8): Result.003 file - promoters60/4773112
ttaatttt

SEQ ID NO: 142617 - DNA, 7 bp, Unknown
  misc_feature (1)..( 7): Result.003 file - promoters60/4773112
tttagat

SEQ ID NO: 142618 - DNA, 7 bp, Unknown
  misc_feature (1)..( 7): Result.003 file - promoters60/4773112
tttggat

SEQ ID NO: 142619 - DNA, 6 bp, Unknown
  misc_feature (1)..( 6): Result.003 file - promoters60/4773112
tttttt

SEQ ID NO: 142620 - DNA, 6 bp, Unknown
  misc_feature (1)..( 6): Result.003 file - promoters60/4773112
tttttt

SEQ ID NO: 142621 - DNA, 7 bp, Unknown
  misc_feature (1)..( 7): Result.003 file - promoters60/4773112
atattat

SEQ ID NO: 142622 - DNA, 7 bp, Unknown
  misc_feature (1)..( 7): Result.003 file - promoters60/4773112
atattat

SEQ ID NO: 142623 - DNA, 7 bp, Unknown
  misc_feature (1)..( 7): Result.003 file - promoters60/4773112
ttacttt

SEQ ID NO: 142624 - DNA, 7 bp, Unknown
  misc_feature (1)..( 7): Result.003 file - promoters60/4773112
ttaattt

SEQ ID NO: 142625 - DNA, 6 bp, Unknown
  misc_feature (1)..( 6): Result.003 file - promoters60/4773112
tttaaa

SEQ ID NO: 142626 - DNA, 6 bp, Unknown
  misc_feature (1)..( 6): Result.003 file - promoters60/4773112
tttaaa

SEQ ID NO: 142627 - DNA, 9 bp, Unknown
  misc_feature (1)..( 9): Result.003 file - promoters60/4773112
aatcttttt

SEQ ID NO: 142628 - DNA, 9 bp, Unknown
  misc_feature (1)..( 9): Result.003 file - promoters60/4773112
aatattttt

SEQ ID NO: 142629 - DNA, 6 bp, Unknown
  misc_feature (1)..( 6): Result.003 file - promoters60/4773112
atatcc

SEQ ID NO: 142630 - DNA, 6 bp, Unknown
  misc_feature (1)..( 6): Result.003 file - promoters60/4773112
atatcc

SEQ ID NO: 142631 - DNA, 7 bp, Unknown
  misc_feature (1)..( 7): Result.003 file - promoters60/4773112
cggatat

SEQ ID NO: 142632 - DNA, 7 bp, Unknown
  misc_feature (1)..( 7): Result.003 file - promoters60/4773112
cggatat

SEQ ID NO: 142633 - DNA, 6 bp, Unknown
  misc_feature (1)..( 6): Result.003 file - promoters60/4773112
gtttca

SEQ ID NO: 142634 - DNA, 6 bp, Unknown
  misc_feature (1)..( 6): Result.003 file - promoters60/4773112
gtttca

SEQ ID NO: 142635 - DNA, 6 bp, Unknown
  misc_feature (1)..( 6): Result.003 file - promoters60/4773112
cattcg

SEQ ID NO: 142636 - DNA, 6 bp, Unknown
  misc_feature (1)..( 6): Result.003 file - promoters60/4773112
cattcg

SEQ ID NO: 142637 - DNA, 6 bp, Unknown
  misc_feature (1)..( 6): Result.003 file - promoters60/4773112
ttttat

SEQ ID NO: 142638 - DNA, 6 bp, Unknown
  misc_feature (1)..( 6): Result.003 file - promoters60/4773112
ttttat

SEQ ID NO: 142639 - DNA, 6 bp, Unknown
  misc_feature (1)..( 6): Result.003 file - promoters60/4773112
tatata

SEQ ID NO: 142640 - DNA, 6 bp, Unknown
  misc_feature (1)..( 6): Result.003 file - promoters60/4773112
tatata

SEQ ID NO: 142641 - DNA, 7 bp, Unknown
  misc_feature (1)..( 7): Result.003 file - promoters60/4773112
tatgcat

SEQ ID NO: 142642 - DNA, 7 bp, Unknown
  misc_feature (1)..( 7): Result.003 file - promoters60/4773112
tatccat

SEQ ID NO: 142643 - DNA, 6 bp, Unknown
  misc_feature (1)..( 6): Result.003 file - promoters60/4773112
tggtta

SEQ ID NO: 142644 - DNA, 6 bp, Unknown
  misc_feature (1)..( 6): Result.003 file - promoters60/4773112
tggtta

SEQ ID NO: 142645 - DNA, 6 bp, Unknown
  misc_feature (1)..( 6): Result.003 file - promoters60/4773112
ttcggt

SEQ ID NO: 142646 - DNA, 6 bp, Unknown
  misc_feature (1)..( 6): Result.003 file - promoters60/4773112
ttcggt

SEQ ID NO: 142647 - DNA, 7 bp, Unknown
  misc_feature (1)..( 7): Result.003 file - promoters60/4773112
ggtttag

SEQ ID NO: 142648 - DNA, 7 bp, Unknown
  misc_feature (1)..( 7): Result.003 file - promoters60/4773112
ggtttag

SEQ ID NO: 142649 - DNA, 7 bp, Unknown
  misc_feature (1)..( 7): Result.003 file - promoters60/4773124
atatatt

SEQ ID NO: 142650 - DNA, 7 bp, Unknown
  misc_feature (1)..( 7): Result.003 file - promoters60/4773124
atatatt

SEQ ID NO: 142651 - DNA, 6 bp, Unknown
  misc_feature (1)..( 6): Result.003 file - promoters60/4773124
acaaat

SEQ ID NO: 142652 - DNA, 6 bp, Unknown
  misc_feature (1)..( 6): Result.003 file - promoters60/4773124
acaaat

SEQ ID NO: 142653 - DNA, 6 bp, Unknown
  misc_feature (1)..( 6): Result.003 file - promoters60/4773124
ttctaa

SEQ ID NO: 142654 - DNA, 6 bp, Unknown
  misc_feature (1)..( 6): Result.003 file - promoters60/4773124
ttctaa

SEQ ID NO: 142655 - DNA, 9 bp, Unknown
  misc_feature (1)..( 9): Result.003 file - promoters60/4773124
taagtaaaa

SEQ ID NO: 142656 - DNA, 9 bp, Unknown
  misc_feature (1)..( 9): Result.003 file - promoters60/4773124
taactaaaa

SEQ ID NO: 142657 - DNA, 7 bp, Unknown
  misc_feature (1)..( 7): Result.003 file - promoters60/4773124
taaaaac

SEQ ID NO: 142658 - DNA, 7 bp, Unknown
  misc_feature (1)..( 7): Result.003 file - promoters60/4773124
taataac

SEQ ID NO: 142659 - DNA, 6 bp, Unknown
  misc_feature (1)..( 6): Result.003 file - promoters60/4773124
aagaaa

SEQ ID NO: 142660 - DNA, 6 bp, Unknown
  misc_feature (1)..( 6): Result.003 file - promoters60/4773124
aagaaa

SEQ ID NO: 142661 - DNA, 7 bp, Unknown
  misc_feature (1)..( 7): Result.003 file - promoters60/4773124
taattag

SEQ ID NO: 142662 - DNA, 7 bp, Unknown
  misc_feature (1)..( 7): Result.003 file - promoters60/4773124
taattag

SEQ ID NO: 142663 - DNA, 8 bp, Unknown
  misc_feature (1)..( 8): Result.003 file - promoters60/4773124
tgtttttg

SEQ ID NO: 142664 - DNA, 8 bp, Unknown
  misc_feature (1)..( 8): Result.003 file - promoters60/4773124
tgttgttg

SEQ ID NO: 142665 - DNA, 6 bp, Unknown
  misc_feature (1)..( 6): Result.003 file - promoters60/4773124
ttttct

SEQ ID NO: 142666 - DNA, 6 bp, Unknown
  misc_feature (1)..( 6): Result.003 file - promoters60/4773124
ttttct

SEQ ID NO: 142667 - DNA, 8 bp, Unknown
  misc_feature (1)..( 8): Result.003 file - promoters60/4773124
tttgattc

SEQ ID NO: 142668 - DNA, 8 bp, Unknown
  misc_feature (1)..( 8): Result.003 file - promoters60/4773124
tttgtttc

SEQ ID NO: 142669 - DNA, 7 bp, Unknown
  misc_feature (1)..( 7): Result.003 file - promoters60/4773124
gaattct

SEQ ID NO: 142670 - DNA, 7 bp, Unknown
  misc_feature (1)..( 7): Result.003 file - promoters60/4773124
gaattct

SEQ ID NO: 142671 - DNA, 6 bp, Unknown
  misc_feature (1)..( 6): Result.003 file - promoters60/4773124
tctctt

SEQ ID NO: 142672 - DNA, 6 bp, Unknown
  misc_feature (1)..( 6): Result.003 file - promoters60/4773124
tctctt

SEQ ID NO: 142673 - DNA, 8 bp, Unknown
  misc_feature (1)..( 8): Result.003 file - promoters60/4773124
tgatcttt

SEQ ID NO: 142674 - DNA, 8 bp, Unknown
  misc_feature (1)..( 8): Result.003 file - promoters60/4773124
tgattttt

SEQ ID NO: 142675 - DNA, 6 bp, Unknown
  misc_feature (1)..( 6): Result.003 file - promoters60/4773124
aatctc

SEQ ID NO: 142676 - DNA, 6 bp, Unknown
  misc_feature (1)..( 6): Result.003 file - promoters60/4773124
aatctc

SEQ ID NO: 142677 - DNA, 7 bp, Unknown
  misc_feature (1)..( 7): Result.003 file - promoters60/4773124
ttaactc

SEQ ID NO: 142678 - DNA, 7 bp, Unknown
  misc_feature (1)..( 7): Result.003 file - promoters60/4773124
ttatctc

SEQ ID NO: 142679 - DNA, 6 bp, Unknown
  misc_feature (1)..( 6): Result.003 file - promoters60/4773124
ttcata

SEQ ID NO: 142680 - DNA, 6 bp, Unknown
  misc_feature (1)..( 6): Result.003 file - promoters60/4773124
ttcata

SEQ ID NO: 142681 - DNA, 8 bp, Unknown
  misc_feature (1)..( 8): Result.003 file - promoters60/4773127
caatttgt

SEQ ID NO: 142682 - DNA, 8 bp, Unknown
  misc_feature (1)..( 8): Result.003 file - promoters60/4773127
caatgtgt

SEQ ID NO: 142683 - DNA, 10 bp, Unknown
  misc_feature (1)..( 10): Result.003 file - promoters60/4773127
atatcatttt

SEQ ID NO: 142684 - DNA, 10 bp, Unknown
  misc_feature (1)..( 10): Result.003 file - promoters60/4773127
atataatttt

SEQ ID NO: 142685 - DNA, 10 bp, Unknown
  misc_feature (1)..( 10): Result.003 file - promoters60/4773127
taattatagt

SEQ ID NO: 142686 - DNA, 8 bp, Unknown
  misc_feature (1)..( 8): Result.003 file - promoters60/4773127
aaaccaaa

SEQ ID NO: 142687 - DNA, 8 bp, Unknown
  misc_feature (1)..( 8): Result.003 file - promoters60/4773127
aaatcaaa

SEQ ID NO: 142688 - DNA, 7 bp, Unknown
  misc_feature (1)..( 7): Result.003 file - promoters60/4773127
tcgtcaa

SEQ ID NO: 142689 - DNA, 7 bp, Unknown
  misc_feature (1)..( 7): Result.003 file - promoters60/4773127
tcgtcaa

SEQ ID NO: 142690 - DNA, 7 bp, Unknown
  misc_feature (1)..( 7): Result.003 file - promoters60/4773127
aaagaaa

SEQ ID NO: 142691 - DNA, 7 bp, Unknown
  misc_feature (1)..( 7): Result.003 file - promoters60/4773127
aaacaaa

SEQ ID NO: 142692 - DNA, 8 bp, Unknown
  misc_feature (1)..( 8): Result.003 file - promoters60/4773127
taaatata

SEQ ID NO: 142693 - DNA, 8 bp, Unknown
  misc_feature (1)..( 8): Result.003 file - promoters60/4773127
taattata

SEQ ID NO: 142694 - DNA, 8 bp, Unknown
  misc_feature (1)..( 8): Result.003 file - promoters60/4773127
taatctta

SEQ ID NO: 142695 - DNA, 8 bp, Unknown
  misc_feature (1)..( 8): Result.003 file - promoters60/4773127
taatatta

SEQ ID NO: 142696 - DNA, 6 bp, Unknown
  misc_feature (1)..( 6): Result.003 file - promoters60/4773127
tttaaa

SEQ ID NO: 142697 - DNA, 6 bp, Unknown
  misc_feature (1)..( 6): Result.003 file - promoters60/4773127
tttaaa

SEQ ID NO: 142698 - DNA, 10 bp, Unknown
  misc_feature (1)..( 10): Result.003 file - promoters60/4773127
ttaaaaattc

SEQ ID NO: 142699 - DNA, 10 bp, Unknown
  misc_feature (1)..( 10): Result.003 file - promoters60/4773127
ttaataattc

SEQ ID NO: 142700 - DNA, 7 bp, Unknown
  misc_feature (1)..( 7): Result.003 file - promoters60/4773127
gttggtt

SEQ ID NO: 142701 - DNA, 7 bp, Unknown
  misc_feature (1)..( 7): Result.003 file - promoters60/4773127
gttggtt

SEQ ID NO: 142702 - DNA, 7 bp, Unknown
  misc_feature (1)..( 7): Result.003 file - promoters60/4773127
aaccgaa

SEQ ID NO: 142703 - DNA, 7 bp, Unknown
  misc_feature (1)..( 7): Result.003 file - promoters60/4773127
aactgaa

SEQ ID NO: 142704 - DNA, 11 bp, Unknown
  misc_feature (1)..( 11): Result.003 file - promoters60/4773127
aatccaaacac

SEQ ID NO: 142705 - DNA, 11 bp, Unknown
  misc_feature (1)..( 11): Result.003 file - promoters60/4773127
aatccaatcac

SEQ ID NO: 142706 - DNA, 9 bp, Unknown
  misc_feature (1)..( 9): Result.003 file - promoters60/4773127
tgttgcata

SEQ ID NO: 142707 - DNA, 9 bp, Unknown
  misc_feature (1)..( 9): Result.003 file - promoters60/4773127
tgtcgcata

SEQ ID NO: 142708 - DNA, 7 bp, Unknown
  misc_feature (1)..( 7): Result.003 file - promoters60/4773127
ttttttg

SEQ ID NO: 142709 - DNA, 7 bp, Unknown
  misc_feature (1)..( 7): Result.003 file - promoters60/4773127
tttattg

SEQ ID NO: 142710 - DNA, 7 bp, Unknown
  misc_feature (1)..( 7): Result.003 file - promoters60/4773134
aattttt

SEQ ID NO: 142711 - DNA, 7 bp, Unknown
  misc_feature (1)..( 7): Result.003 file - promoters60/4773134
tattttt

SEQ ID NO: 142712 - DNA, 8 bp, Unknown
  misc_feature (1)..( 8): Result.003 file - promoters60/4773134
tattgttt

SEQ ID NO: 142713 - DNA, 8 bp, Unknown
  misc_feature (1)..( 8): Result.003 file - promoters60/4773134
tgttttgg

SEQ ID NO: 142714 - DNA, 8 bp, Unknown
  misc_feature (1)..( 8): Result.003 file - promoters60/4773134
aattttgg

SEQ ID NO: 142715 - DNA, 8 bp, Unknown
  misc_feature (1)..( 8): Result.003 file - promoters60/4773134
aatattga

SEQ ID NO: 142716 - DNA, 8 bp, Unknown
  misc_feature (1)..( 8): Result.003 file - promoters60/4773134
attacaca

SEQ ID NO: 142717 - DNA, 8 bp, Unknown
  misc_feature (1)..( 8): Result.003 file - promoters60/4773134
attacaat

SEQ ID NO: 142718 - DNA, 8 bp, Unknown
  misc_feature (1)..( 8): Result.003 file - promoters60/4773134
cttaaaca

SEQ ID NO: 142719 - DNA, 14 bp, Unknown
  misc_feature (1)..( 14): Result.003 file - promoters60/4773134
atttgatagtgatt

SEQ ID NO: 142720 - DNA, 14 bp, Unknown
  misc_feature (1)..( 14): Result.003 file - promoters60/4773134
atttaatagtcatt

SEQ ID NO: 142721 - DNA, 14 bp, Unknown
  misc_feature (1)..( 14): Result.003 file - promoters60/4773134
tactaatactcaaa

SEQ ID NO: 142722 - DNA, 9 bp, Unknown
  misc_feature (1)..( 9): Result.003 file - promoters60/4773134
tatatgatt

SEQ ID NO: 142723 - DNA, 9 bp, Unknown
  misc_feature (1)..( 9): Result.003 file - promoters60/4773134
tatttgatt

SEQ ID NO: 142724 - DNA, 9 bp, Unknown
  misc_feature (1)..( 9): Result.003 file - promoters60/4773134
tatttttgt

SEQ ID NO: 142725 - DNA, 9 bp, Unknown
  misc_feature (1)..( 9): Result.003 file - promoters60/4773182
aattcatta

SEQ ID NO: 142726 - DNA, 9 bp, Unknown
  misc_feature (1)..( 9): Result.003 file - promoters60/4773182
tcttcattt

SEQ ID NO: 142727 - DNA, 10 bp, Unknown
  misc_feature (1)..( 10): Result.003 file - promoters60/4773182
aattcaatta

SEQ ID NO: 142728 - DNA, 10 bp, Unknown
  misc_feature (1)..( 10): Result.003 file - promoters60/4773182
tcttcattgt

SEQ ID NO: 142729 - DNA, 11 bp, Unknown
  misc_feature (1)..( 11): Result.003 file - promoters60/4773185
aaataataaat

SEQ ID NO: 142730 - DNA, 11 bp, Unknown
  misc_feature (1)..( 11): Result.003 file - promoters60/4773185
taattatatac

SEQ ID NO: 142731 - DNA, 11 bp, Unknown
  misc_feature (1)..( 11): Result.003 file - promoters60/4773185
ttataatataa

SEQ ID NO: 142732 - DNA, 11 bp, Unknown
  misc_feature (1)..( 11): Result.003 file - promoters60/4773185
ttttaacaaat

SEQ ID NO: 142733 - DNA, 11 bp, Unknown
  misc_feature (1)..( 11): Result.003 file - promoters60/4773185
aaatagtaaaa

SEQ ID NO: 142734 - DNA, 11 bp, Unknown
  misc_feature (1)..( 11): Result.003 file - promoters60/4773185
atatatttaat

SEQ ID NO: 142735 - DNA, 11 bp, Unknown
  misc_feature (1)..( 11): Result.003 file - promoters60/4773185
agatagtacta

SEQ ID NO: 142736 - DNA, 12 bp, Unknown
  misc_feature (1)..( 12): Result.003 file - promoters60/4773185
aaataataaata

SEQ ID NO: 142737 - DNA, 12 bp, Unknown
  misc_feature (1)..( 12): Result.003 file - promoters60/4773185
attaaataaatg

SEQ ID NO: 142738 - DNA, 12 bp, Unknown
  misc_feature (1)..( 12): Result.003 file - promoters60/4773185
ataatataaata

SEQ ID NO: 142739 - DNA, 12 bp, Unknown
  misc_feature (1)..( 12): Result.003 file - promoters60/4773185
ttttaacaaatt

SEQ ID NO: 142740 - DNA, 12 bp, Unknown
  misc_feature (1)..( 12): Result.003 file - promoters60/4773185
aaatagtaaaaa

SEQ ID NO: 142741 - DNA, 12 bp, Unknown
  misc_feature (1)..( 12): Result.003 file - promoters60/4773185
agatagtactat

SEQ ID NO: 142742 - DNA, 11 bp, Unknown
  misc_feature (1)..( 11): Result.003 file - promoters60/4773185
tgataaaacaa

SEQ ID NO: 142743 - DNA, 11 bp, Unknown
  misc_feature (1)..( 11): Result.003 file - promoters60/4773185
acataaaaatt

SEQ ID NO: 142744 - DNA, 11 bp, Unknown
  misc_feature (1)..( 11): Result.003 file - promoters60/4773185
atataaaggat

SEQ ID NO: 142745 - DNA, 11 bp, Unknown
  misc_feature (1)..( 11): Result.003 file - promoters60/4773185
ttataaattag

SEQ ID NO: 142746 - DNA, 11 bp, Unknown
  misc_feature (1)..( 11): Result.003 file - promoters60/4773185
aaatacattag

SEQ ID NO: 142747 - DNA, 8 bp, Unknown
  misc_feature (1)..( 8): Result.003 file - promoters60/4773185
aaaacaat

SEQ ID NO: 142748 - DNA, 8 bp, Unknown
  misc_feature (1)..( 8): Result.003 file - promoters60/4773185
aaaacaat

SEQ ID NO: 142749 - DNA, 8 bp, Unknown
  misc_feature (1)..( 8): Result.003 file - promoters60/4773185
aaaagaat

SEQ ID NO: 142750 - DNA, 8 bp, Unknown
  misc_feature (1)..( 8): Result.003 file - promoters60/4773185
aaaaaaat

SEQ ID NO: 142751 - DNA, 8 bp, Unknown
  misc_feature (1)..( 8): Result.003 file - promoters60/4773185
tgaagaat

SEQ ID NO: 142752 - DNA, 9 bp, Unknown
  misc_feature (1)..( 9): Result.003 file - promoters60/4773185
agatcttaa

SEQ ID NO: 142753 - DNA, 9 bp, Unknown
  misc_feature (1)..( 9): Result.003 file - promoters60/4773185
taatcttac

SEQ ID NO: 142754 - DNA, 9 bp, Unknown
  misc_feature (1)..( 9): Result.003 file - promoters60/4773185
agatattat

SEQ ID NO: 142755 - DNA, 9 bp, Unknown
  misc_feature (1)..( 9): Result.003 file - promoters60/4773185
tcatattac

SEQ ID NO: 142756 - DNA, 9 bp, Unknown
  misc_feature (1)..( 9): Result.003 file - promoters60/4773185
gaatagtat

SEQ ID NO: 142757 - DNA, 6 bp, Unknown
  misc_feature (1)..( 6): Result.003 file - promoters60/4773187
ttttta

SEQ ID NO: 142758 - DNA, 6 bp, Unknown
  misc_feature (1)..( 6): Result.003 file - promoters60/4773187
ttttta

SEQ ID NO: 142759 - DNA, 8 bp, Unknown
  misc_feature (1)..( 8): Result.003 file - promoters60/4773187
cttttgtt

SEQ ID NO: 142760 - DNA, 8 bp, Unknown
  misc_feature (1)..( 8): Result.003 file - promoters60/4773187
cttatgtt

SEQ ID NO: 142761 - DNA, 13 bp, Unknown
  misc_feature (1)..( 13): Result.003 file - promoters60/4773187
atatatttttttt

SEQ ID NO: 142762 - DNA, 13 bp, Unknown
  misc_feature (1)..( 13): Result.003 file - promoters60/4773187
atatgttttattt

SEQ ID NO: 142763 - DNA, 8 bp, Unknown
  misc_feature (1)..( 8): Result.003 file - promoters60/4773187
gtatataa

SEQ ID NO: 142764 - DNA, 8 bp, Unknown
  misc_feature (1)..( 8): Result.003 file - promoters60/4773187
gtatgtaa

SEQ ID NO: 142765 - DNA, 6 bp, Unknown
  misc_feature (1)..( 6): Result.003 file - promoters60/4773187
aattta

SEQ ID NO: 142766 - DNA, 6 bp, Unknown
  misc_feature (1)..( 6): Result.003 file - promoters60/4773187
aattta

SEQ ID NO: 142767 - DNA, 7 bp, Unknown
  misc_feature (1)..( 7): Result.003 file - promoters60/4773187
taaaata

SEQ ID NO: 142768 - DNA, 7 bp, Unknown
  misc_feature (1)..( 7): Result.003 file - promoters60/4773187
taaaata

SEQ ID NO: 142769 - DNA, 6 bp, Unknown
  misc_feature (1)..( 6): Result.003 file - promoters60/4773187
aaaaaa

SEQ ID NO: 142770 - DNA, 6 bp, Unknown
  misc_feature (1)..( 6): Result.003 file - promoters60/4773187
aaaaaa

SEQ ID NO: 142771 - DNA, 7 bp, Unknown
  misc_feature (1)..( 7): Result.003 file - promoters60/4773187
atataaa

SEQ ID NO: 142772 - DNA, 7 bp, Unknown
  misc_feature (1)..( 7): Result.003 file - promoters60/4773187
atacaaa

SEQ ID NO: 142773 - DNA, 6 bp, Unknown
  misc_feature (1)..( 6): Result.003 file - promoters60/4773187
atgtct

SEQ ID NO: 142774 - DNA, 6 bp, Unknown
  misc_feature (1)..( 6): Result.003 file - promoters60/4773187
atgtct

SEQ ID NO: 142775 - DNA, 7 bp, Unknown
  misc_feature (1)..( 7): Result.003 file - promoters60/4773187
ttggaga

SEQ ID NO: 142776 - DNA, 7 bp, Unknown
  misc_feature (1)..( 7): Result.003 file - promoters60/4773187
ttggaga

SEQ ID NO: 142777 - DNA, 6 bp, Unknown
  misc_feature (1)..( 6): Result.003 file - promoters60/4773187
gaagat

SEQ ID NO: 142778 - DNA, 6 bp, Unknown
  misc_feature (1)..( 6): Result.003 file - promoters60/4773187
gaagat

SEQ ID NO: 142779 - DNA, 6 bp, Unknown
  misc_feature (1)..( 6): Result.003 file - promoters60/4773187
gatcga

SEQ ID NO: 142780 - DNA, 6 bp, Unknown
  misc_feature (1)..( 6): Result.003 file - promoters60/4773187
gatcga

SEQ ID NO: 142781 - DNA, 6 bp, Unknown
  misc_feature (1)..( 6): Result.003 file - promoters60/4773187
aaatgc

SEQ ID NO: 142782 - DNA, 6 bp, Unknown
  misc_feature (1)..( 6): Result.003 file - promoters60/4773187
aaatgc

SEQ ID NO: 142783 - DNA, 8 bp, Unknown
  misc_feature (1)..( 8): Result.003 file - promoters60/4773187
ggatttgt

SEQ ID NO: 142784 - DNA, 8 bp, Unknown
  misc_feature (1)..( 8): Result.003 file - promoters60/4773187
ggacttgt

SEQ ID NO: 142785 - DNA, 7 bp, Unknown
  misc_feature (1)..( 7): Result.003 file - promoters60/4773205
tcataaa

SEQ ID NO: 142786 - DNA, 7 bp, Unknown
  misc_feature (1)..( 7): Result.003 file - promoters60/4773205
tcataaa

SEQ ID NO: 142787 - DNA, 7 bp, Unknown
  misc_feature (1)..( 7): Result.003 file - promoters60/4773205
ataatta

SEQ ID NO: 142788 - DNA, 7 bp, Unknown
  misc_feature (1)..( 7): Result.003 file - promoters60/4773205
atattta

SEQ ID NO: 142789 - DNA, 7 bp, Unknown
  misc_feature (1)..( 7): Result.003 file - promoters60/4773205
tttaaaa

SEQ ID NO: 142790 - DNA, 7 bp, Unknown
  misc_feature (1)..( 7): Result.003 file - promoters60/4773205
tttcaaa

SEQ ID NO: 142791 - DNA, 6 bp, Unknown
  misc_feature (1)..( 6): Result.003 file - promoters60/4773205
atttac

SEQ ID NO: 142792 - DNA, 6 bp, Unknown
  misc_feature (1)..( 6): Result.003 file - promoters60/4773205
atttac

SEQ ID NO: 142793 - DNA, 6 bp, Unknown
  misc_feature (1)..( 6): Result.003 file - promoters60/4773205
ataaaa

SEQ ID NO: 142794 - DNA, 6 bp, Unknown
  misc_feature (1)..( 6): Result.003 file - promoters60/4773205
ataaaa

SEQ ID NO: 142795 - DNA, 10 bp, Unknown
  misc_feature (1)..( 10): Result.003 file - promoters60/4773205
aaaacaattt

SEQ ID NO: 142796 - DNA, 10 bp, Unknown
  misc_feature (1)..( 10): Result.003 file - promoters60/4773205
aaaacagttt

SEQ ID NO: 142797 - DNA, 7 bp, Unknown
  misc_feature (1)..( 7): Result.003 file - promoters60/4773205
aaacgaa

SEQ ID NO: 142798 - DNA, 7 bp, Unknown
  misc_feature (1)..( 7): Result.003 file - promoters60/4773205
aaaagaa

SEQ ID NO: 142799 - DNA, 8 bp, Unknown
  misc_feature (1)..( 8): Result.003 file - promoters60/4773205
tgaaacag

SEQ ID NO: 142800 - DNA, 8 bp, Unknown
  misc_feature (1)..( 8): Result.003 file - promoters60/4773205
tgacacag

SEQ ID NO: 142801 - DNA, 7 bp, Unknown
  misc_feature (1)..( 7): Result.003 file - promoters60/4773205
gatcact

SEQ ID NO: 142802 - DNA, 7 bp, Unknown
  misc_feature (1)..( 7): Result.003 file - promoters60/4773205
gatgact

SEQ ID NO: 142803 - DNA, 6 bp, Unknown
  misc_feature (1)..( 6): Result.003 file - promoters60/4773205
ttttat

SEQ ID NO: 142804 - DNA, 6 bp, Unknown
  misc_feature (1)..( 6): Result.003 file - promoters60/4773205
ttttat

SEQ ID NO: 142805 - DNA, 7 bp, Unknown
  misc_feature (1)..( 7): Result.003 file - promoters60/4773205
tattata

SEQ ID NO: 142806 - DNA, 7 bp, Unknown
  misc_feature (1)..( 7): Result.003 file - promoters60/4773205
tatgata

SEQ ID NO: 142807 - DNA, 6 bp, Unknown
  misc_feature (1)..( 6): Result.003 file - promoters60/4773205
atggtt

SEQ ID NO: 142808 - DNA, 6 bp, Unknown
  misc_feature (1)..( 6): Result.003 file - promoters60/4773205
atggtt

SEQ ID NO: 142809 - DNA, 6 bp, Unknown
  misc_feature (1)..( 6): Result.003 file - promoters60/4773205
gagttc

SEQ ID NO: 142810 - DNA, 6 bp, Unknown
  misc_feature (1)..( 6): Result.003 file - promoters60/4773205
gagttc

SEQ ID NO: 142811 - DNA, 6 bp, Unknown
  misc_feature (1)..( 6): Result.003 file - promoters60/4773205
taaaaa

SEQ ID NO: 142812 - DNA, 6 bp, Unknown
  misc_feature (1)..( 6): Result.003 file - promoters60/4773205
taaaaa

SEQ ID NO: 142813 - DNA, 6 bp, Unknown
  misc_feature (1)..( 6): Result.003 file - promoters60/4773205
cccaaa

SEQ ID NO: 142814 - DNA, 6 bp, Unknown
  misc_feature (1)..( 6): Result.003 file - promoters60/4773205
cccaaa

SEQ ID NO: 142815 - DNA, 6 bp, Unknown
  misc_feature (1)..( 6): Result.003 file - promoters60/4773205
tttatt

SEQ ID NO: 142816 - DNA, 6 bp, Unknown
  misc_feature (1)..( 6): Result.003 file - promoters60/4773205
tttatt

SEQ ID NO: 142817 - DNA, 12 bp, Unknown
  misc_feature (1)..( 12): Result.003 file - promoters60/4773205
aataatgatgat

SEQ ID NO: 142818 - DNA, 12 bp, Unknown
  misc_feature (1)..( 12): Result.003 file - promoters60/4773205
aatgatgatgat

SEQ ID NO: 142819 - DNA, 6 bp, Unknown
  misc_feature (1)..( 6): Result.003 file - promoters60/4773205
ttgttg

SEQ ID NO: 142820 - DNA, 6 bp, Unknown
  misc_feature (1)..( 6): Result.003 file - promoters60/4773205
ttgttg

SEQ ID NO: 142821 - DNA, 6 bp, Unknown
  misc_feature (1)..( 6): Result.003 file - promoters60/4773223
tgcaag

SEQ ID NO: 142822 - DNA, 6 bp, Unknown
  misc_feature (1)..( 6): Result.003 file - promoters60/4773223
tgcaag

SEQ ID NO: 142823 - DNA, 8 bp, Unknown
  misc_feature (1)..( 8): Result.003 file - promoters60/4773223
ttggtact

SEQ ID NO: 142824 - DNA, 8 bp, Unknown
  misc_feature (1)..( 8): Result.003 file - promoters60/4773223
ttggcact

SEQ ID NO: 142825 - DNA, 9 bp, Unknown
  misc_feature (1)..( 9): Result.003 file - promoters60/4773223
tttgatttt

SEQ ID NO: 142826 - DNA, 9 bp, Unknown
  misc_feature (1)..( 9): Result.003 file - promoters60/4773223
tttggtttt

SEQ ID NO: 142827 - DNA, 9 bp, Unknown
  misc_feature (1)..( 9): Result.003 file - promoters60/4773223
tttttattt

SEQ ID NO: 142828 - DNA, 9 bp, Unknown
  misc_feature (1)..( 9): Result.003 file - promoters60/4773223
atttgattt

SEQ ID NO: 142829 - DNA, 9 bp, Unknown
  misc_feature (1)..( 9): Result.003 file - promoters60/4773223
atttaattt

SEQ ID NO: 142830 - DNA, 7 bp, Unknown
  misc_feature (1)..( 7): Result.003 file - promoters60/4773223
tcatttt

SEQ ID NO: 142831 - DNA, 7 bp, Unknown
  misc_feature (1)..( 7): Result.003 file - promoters60/4773223
tcagttt

SEQ ID NO: 142832 - DNA, 8 bp, Unknown
  misc_feature (1)..( 8): Result.003 file - promoters60/4773223
taaagtga

SEQ ID NO: 142833 - DNA, 8 bp, Unknown
  misc_feature (1)..( 8): Result.003 file - promoters60/4773223
taatgtga

SEQ ID NO: 142834 - DNA, 7 bp, Unknown
  misc_feature (1)..( 7): Result.003 file - promoters60/4773223
atatttg

SEQ ID NO: 142835 - DNA, 7 bp, Unknown
  misc_feature (1)..( 7): Result.003 file - promoters60/4773223
ataattg

SEQ ID NO: 142836 - DNA, 6 bp, Unknown
  misc_feature (1)..( 6): Result.003 file - promoters60/4773223
tatagg

SEQ ID NO: 142837 - DNA, 6 bp, Unknown
  misc_feature (1)..( 6): Result.003 file - promoters60/4773223
tatagg

SEQ ID NO: 142838 - DNA, 8 bp, Unknown
  misc_feature (1)..( 8): Result.003 file - promoters60/4773223
gccctgaa

SEQ ID NO: 142839 - DNA, 8 bp, Unknown
  misc_feature (1)..( 8): Result.003 file - promoters60/4773223
gccatgaa

SEQ ID NO: 142840 - DNA, 8 bp, Unknown
  misc_feature (1)..( 8): Result.003 file - promoters60/4773223
ctgcgatt

SEQ ID NO: 142841 - DNA, 8 bp, Unknown
  misc_feature (1)..( 8): Result.003 file - promoters60/4773223
ctgctatt

SEQ ID NO: 142842 - DNA, 7 bp, Unknown
  misc_feature (1)..( 7): Result.003 file - promoters60/4773223
gatccag

SEQ ID NO: 142843 - DNA, 7 bp, Unknown
  misc_feature (1)..( 7): Result.003 file - promoters60/4773223
gatacag

SEQ ID NO: 142844 - DNA, 6 bp, Unknown
  misc_feature (1)..( 6): Result.003 file - promoters60/4773223
attcca

SEQ ID NO: 142845 - DNA, 6 bp, Unknown
  misc_feature (1)..( 6): Result.003 file - promoters60/4773223
attcca

SEQ ID NO: 142846 - DNA, 7 bp, Unknown
  misc_feature (1)..( 7): Result.003 file - promoters60/4773223
aaacctg

SEQ ID NO: 142847 - DNA, 7 bp, Unknown
  misc_feature (1)..( 7): Result.003 file - promoters60/4773223
aaagctg

SEQ ID NO: 142848 - DNA, 6 bp, Unknown
  misc_feature (1)..( 6): Result.003 file - promoters60/4773223
tttgac

SEQ ID NO: 142849 - DNA, 6 bp, Unknown
  misc_feature (1)..( 6): Result.003 file - promoters60/4773223
tttgac

SEQ ID NO: 142850 - DNA, 6 bp, Unknown
  misc_feature (1)..( 6): Result.003 file - promoters60/4773223
acggta

SEQ ID NO: 142851 - DNA, 6 bp, Unknown
  misc_feature (1)..( 6): Result.003 file - promoters60/4773223
acggta

SEQ ID NO: 142852 - DNA, 7 bp, Unknown
  misc_feature (1)..( 7): Result.003 file - promoters60/4773223
tcacgtt

SEQ ID NO: 142853 - DNA, 7 bp, Unknown
  misc_feature (1)..( 7): Result.003 file - promoters60/4773223
tcaagtt

SEQ ID NO: 142854 - DNA, 9 bp, Unknown
  misc_feature (1)..( 9): Result.003 file - promoters60/4773225
atttagaca

SEQ ID NO: 142855 - DNA, 9 bp, Unknown
  misc_feature (1)..( 9): Result.003 file - promoters60/4773225
atttagctt

SEQ ID NO: 142856 - DNA, 9 bp, Unknown
  misc_feature (1)..( 9): Result.003 file - promoters60/4773225
ttttatctt

SEQ ID NO: 142857 - DNA, 6 bp, Unknown
  misc_feature (1)..( 6): Result.003 file - promoters60/4773225
ttaaaa

SEQ ID NO: 142858 - DNA, 6 bp, Unknown
  misc_feature (1)..( 6): Result.003 file - promoters60/4773225
ttaaaa

SEQ ID NO: 142859 - DNA, 7 bp, Unknown
  misc_feature (1)..( 7): Result.003 file - promoters60/4773225
taaaata

SEQ ID NO: 142860 - DNA, 7 bp, Unknown
  misc_feature (1)..( 7): Result.003 file - promoters60/4773225
taaaata

SEQ ID NO: 142861 - DNA, 7 bp, Unknown
  misc_feature (1)..( 7): Result.003 file - promoters60/4773225
ctgaaaa

SEQ ID NO: 142862 - DNA, 7 bp, Unknown
  misc_feature (1)..( 7): Result.003 file - promoters60/4773225
atgaaaa

SEQ ID NO: 142863 - DNA, 7 bp, Unknown
  misc_feature (1)..( 7): Result.003 file - promoters60/4773225
ctgaaag

SEQ ID NO: 142864 - DNA, 6 bp, Unknown
  misc_feature (1)..( 6): Result.003 file - promoters60/4773225
tccaaa

SEQ ID NO: 142865 - DNA, 6 bp, Unknown
  misc_feature (1)..( 6): Result.003 file - promoters60/4773225
tccaaa

SEQ ID NO: 142866 - DNA, 9 bp, Unknown
  misc_feature (1)..( 9): Result.003 file - promoters60/4773225
aaacaataa

SEQ ID NO: 142867 - DNA, 9 bp, Unknown
  misc_feature (1)..( 9): Result.003 file - promoters60/4773225
aaaaaataa

SEQ ID NO: 142868 - DNA, 9 bp, Unknown
  misc_feature (1)..( 9): Result.003 file - promoters60/4773225
aaagaatat

SEQ ID NO: 142869 - DNA, 7 bp, Unknown
  misc_feature (1)..( 7): Result.003 file - promoters60/4773225
cgaaaaa

SEQ ID NO: 142870 - DNA, 7 bp, Unknown
  misc_feature (1)..( 7): Result.003 file - promoters60/4773225
cgaaaaa

SEQ ID NO: 142871 - DNA, 8 bp, Unknown
  misc_feature (1)..( 8): Result.003 file - promoters60/4773225
cgaggtca

SEQ ID NO: 142872 - DNA, 8 bp, Unknown
  misc_feature (1)..( 8): Result.003 file - promoters60/4773225
cgatgtca

SEQ ID NO: 142873 - DNA, 7 bp, Unknown
  misc_feature (1)..( 7): Result.003 file - promoters60/4773225
attagca

SEQ ID NO: 142874 - DNA, 7 bp, Unknown
  misc_feature (1)..( 7): Result.003 file - promoters60/4773225
attggca

SEQ ID NO: 142875 - DNA, 8 bp, Unknown
  misc_feature (1)..( 8): Result.003 file - promoters60/4773225
ataattat

SEQ ID NO: 142876 - DNA, 8 bp, Unknown
  misc_feature (1)..( 8): Result.003 file - promoters60/4773225
ataattat

SEQ ID NO: 142877 - DNA, 6 bp, Unknown
  misc_feature (1)..( 6): Result.003 file - promoters60/4773225
gaatta

SEQ ID NO: 142878 - DNA, 6 bp, Unknown
  misc_feature (1)..( 6): Result.003 file - promoters60/4773225
gaatta

SEQ ID NO: 142879 - DNA, 6 bp, Unknown
  misc_feature (1)..( 6): Result.003 file - promoters60/4773225
gcggaa

SEQ ID NO: 142880 - DNA, 6 bp, Unknown
  misc_feature (1)..( 6): Result.003 file - promoters60/4773225
gcggaa

SEQ ID NO: 142881 - DNA, 7 bp, Unknown
  misc_feature (1)..( 7): Result.003 file - promoters60/4773225
tattttc

SEQ ID NO: 142882 - DNA, 7 bp, Unknown
  misc_feature (1)..( 7): Result.003 file - promoters60/4773225
tatcttc

SEQ ID NO: 142883 - DNA, 6 bp, Unknown
  misc_feature (1)..( 6): Result.003 file - promoters60/4773225
tccttg

SEQ ID NO: 142884 - DNA, 6 bp, Unknown
  misc_feature (1)..( 6): Result.003 file - promoters60/4773225
tccttg

SEQ ID NO: 142885 - DNA, 7 bp, Unknown
  misc_feature (1)..( 7): Result.003 file - promoters60/4773225
gatatat

SEQ ID NO: 142886 - DNA, 7 bp, Unknown
  misc_feature (1)..( 7): Result.003 file - promoters60/4773225
gatgtat

SEQ ID NO: 142887 - DNA, 6 bp, Unknown
  misc_feature (1)..( 6): Result.003 file - promoters60/4773229
caagac

SEQ ID NO: 142888 - DNA, 6 bp, Unknown
  misc_feature (1)..( 6): Result.003 file - promoters60/4773229
caagac

SEQ ID NO: 142889 - DNA, 8 bp, Unknown
  misc_feature (1)..( 8): Result.003 file - promoters60/4773229
tggcaaga

SEQ ID NO: 142890 - DNA, 8 bp, Unknown
  misc_feature (1)..( 8): Result.003 file - promoters60/4773229
tggaaaga

SEQ ID NO: 142891 - DNA, 6 bp, Unknown
  misc_feature (1)..( 6): Result.003 file - promoters60/4773229
tattga

SEQ ID NO: 142892 - DNA, 6 bp, Unknown
  misc_feature (1)..( 6): Result.003 file - promoters60/4773229
tattga

SEQ ID NO: 142893 - DNA, 8 bp, Unknown
  misc_feature (1)..( 8): Result.003 file - promoters60/4773229
aggacaag

SEQ ID NO: 142894 - DNA, 8 bp, Unknown
  misc_feature (1)..( 8): Result.003 file - promoters60/4773229
aggaaaag

SEQ ID NO: 142895 - DNA, 6 bp, Unknown
  misc_feature (1)..( 6): Result.003 file - promoters60/4773229
aagcag

SEQ ID NO: 142896 - DNA, 6 bp, Unknown
  misc_feature (1)..( 6): Result.003 file - promoters60/4773229
aagcag

SEQ ID NO: 142897 - DNA, 6 bp, Unknown
  misc_feature (1)..( 6): Result.003 file - promoters60/4773229
gagtcg

SEQ ID NO: 142898 - DNA, 6 bp, Unknown
  misc_feature (1)..( 6): Result.003 file - promoters60/4773229
gagtcg

SEQ ID NO: 142899 - DNA, 8 bp, Unknown
  misc_feature (1)..( 8): Result.003 file - promoters60/4773229
ttgtcaag

SEQ ID NO: 142900 - DNA, 8 bp, Unknown
  misc_feature (1)..( 8): Result.003 file - promoters60/4773229
ttgttaag

SEQ ID NO: 142901 - DNA, 7 bp, Unknown
  misc_feature (1)..( 7): Result.003 file - promoters60/4773229
tgacact

SEQ ID NO: 142902 - DNA, 7 bp, Unknown
  misc_feature (1)..( 7): Result.003 file - promoters60/4773229
tgatact

SEQ ID NO: 142903 - DNA, 6 bp, Unknown
  misc_feature (1)..( 6): Result.003 file - promoters60/4773229
gatcca

SEQ ID NO: 142904 - DNA, 6 bp, Unknown
  misc_feature (1)..( 6): Result.003 file - promoters60/4773229
gatcca

SEQ ID NO: 142905 - DNA, 9 bp, Unknown
  misc_feature (1)..( 9): Result.003 file - promoters60/4773229
cttatcttt

SEQ ID NO: 142906 - DNA, 9 bp, Unknown
  misc_feature (1)..( 9): Result.003 file - promoters60/4773229
cttgtcttt

SEQ ID NO: 142907 - DNA, 6 bp, Unknown
  misc_feature (1)..( 6): Result.003 file - promoters60/4773229
aagaag

SEQ ID NO: 142908 - DNA, 6 bp, Unknown
  misc_feature (1)..( 6): Result.003 file - promoters60/4773229
aagaag

SEQ ID NO: 142909 - DNA, 9 bp, Unknown
  misc_feature (1)..( 9): Result.003 file - promoters60/4773229
agaaaaatc

SEQ ID NO: 142910 - DNA, 9 bp, Unknown
  misc_feature (1)..( 9): Result.003 file - promoters60/4773229
agaaaaatc

SEQ ID NO: 142911 - DNA, 9 bp, Unknown
  misc_feature (1)..( 9): Result.003 file - promoters60/4773229
atattatga

SEQ ID NO: 142912 - DNA, 9 bp, Unknown
  misc_feature (1)..( 9): Result.003 file - promoters60/4773229
atatgatga

SEQ ID NO: 142913 - DNA, 7 bp, Unknown
  misc_feature (1)..( 7): Result.003 file - promoters60/4773229
atctttt

SEQ ID NO: 142914 - DNA, 7 bp, Unknown
  misc_feature (1)..( 7): Result.003 file - promoters60/4773229
atcattt

SEQ ID NO: 142915 - DNA, 7 bp, Unknown
  misc_feature (1)..( 7): Result.003 file - promoters60/4773229
tttcctt

SEQ ID NO: 142916 - DNA, 7 bp, Unknown
  misc_feature (1)..( 7): Result.003 file - promoters60/4773229
tttactt

SEQ ID NO: 142917 - DNA, 7 bp, Unknown
  misc_feature (1)..( 7): Result.003 file - promoters60/4773229
aattatt

SEQ ID NO: 142918 - DNA, 7 bp, Unknown
  misc_feature (1)..( 7): Result.003 file - promoters60/4773229
aataatt

SEQ ID NO: 142919 - DNA, 8 bp, Unknown
  misc_feature (1)..( 8): Result.003 file - promoters60/4773229
aatagaaa

SEQ ID NO: 142920 - DNA, 8 bp, Unknown
  misc_feature (1)..( 8): Result.003 file - promoters60/4773229
aatggaaa

SEQ ID NO: 142921 - DNA, 7 bp, Unknown
  misc_feature (1)..( 7): Result.003 file - promoters60/4773229
aaaatgt

SEQ ID NO: 142922 - DNA, 7 bp, Unknown
  misc_feature (1)..( 7): Result.003 file - promoters60/4773229
aaattgt

SEQ ID NO: 142923 - DNA, 6 bp, Unknown
  misc_feature (1)..( 6): Result.003 file - promoters60/4773229
tctttt

SEQ ID NO: 142924 - DNA, 6 bp, Unknown
  misc_feature (1)..( 6): Result.003 file - promoters60/4773229
tctttt

SEQ ID NO: 142925 - DNA, 6 bp, Unknown
  misc_feature (1)..( 6): Result.003 file - promoters60/4773229
ggaaaa

SEQ ID NO: 142926 - DNA, 6 bp, Unknown
  misc_feature (1)..( 6): Result.003 file - promoters60/4773229
ggaaaa

SEQ ID NO: 142927 - DNA, 7 bp, Unknown
  misc_feature (1)..( 7): Result.003 file - promoters60/4773245
attccat

SEQ ID NO: 142928 - DNA, 7 bp, Unknown
  misc_feature (1)..( 7): Result.003 file - promoters60/4773245
attccat

SEQ ID NO: 142929 - DNA, 7 bp, Unknown
  misc_feature (1)..( 7): Result.003 file - promoters60/4773245
cacccaa

SEQ ID NO: 142930 - DNA, 7 bp, Unknown
  misc_feature (1)..( 7): Result.003 file - promoters60/4773245
cacacaa

SEQ ID NO: 142931 - DNA, 8 bp, Unknown
  misc_feature (1)..( 8): Result.003 file - promoters60/4773245
ctctgttt

SEQ ID NO: 142932 - DNA, 8 bp, Unknown
  misc_feature (1)..( 8): Result.003 file - promoters60/4773245
ctcttttt

SEQ ID NO: 142933 - DNA, 9 bp, Unknown
  misc_feature (1)..( 9): Result.003 file - promoters60/4773245
atgtgtctt

SEQ ID NO: 142934 - DNA, 6 bp, Unknown
  misc_feature (1)..( 6): Result.003 file - promoters60/4773245
ccaatg

SEQ ID NO: 142935 - DNA, 6 bp, Unknown
  misc_feature (1)..( 6): Result.003 file - promoters60/4773245
ccaatg

SEQ ID NO: 142936 - DNA, 7 bp, Unknown
  misc_feature (1)..( 7): Result.003 file - promoters60/4773245
aaaactc

SEQ ID NO: 142937 - DNA, 7 bp, Unknown
  misc_feature (1)..( 7): Result.003 file - promoters60/4773245
aaagctc

SEQ ID NO: 142938 - DNA, 6 bp, Unknown
  misc_feature (1)..( 6): Result.003 file - promoters60/4773245
attgtt

SEQ ID NO: 142939 - DNA, 6 bp, Unknown
  misc_feature (1)..( 6): Result.003 file - promoters60/4773245
attgtt

SEQ ID NO: 142940 - DNA, 6 bp, Unknown
  misc_feature (1)..( 6): Result.003 file - promoters60/4773245
actgaa

SEQ ID NO: 142941 - DNA, 6 bp, Unknown
  misc_feature (1)..( 6): Result.003 file - promoters60/4773245
actgaa

SEQ ID NO: 142942 - DNA, 7 bp, Unknown
  misc_feature (1)..( 7): Result.003 file - promoters60/4773245
gaatgtg

SEQ ID NO: 142943 - DNA, 7 bp, Unknown
  misc_feature (1)..( 7): Result.003 file - promoters60/4773245
gaaggtg

SEQ ID NO: 142944 - DNA, 7 bp, Unknown
  misc_feature (1)..( 7): Result.003 file - promoters60/4773245
acaagta

SEQ ID NO: 142945 - DNA, 7 bp, Unknown
  misc_feature (1)..( 7): Result.003 file - promoters60/4773245
acaggta

SEQ ID NO: 142946 - DNA, 6 bp, Unknown
  misc_feature (1)..( 6): Result.003 file - promoters60/4773245
ccaaaa

SEQ ID NO: 142947 - DNA, 6 bp, Unknown
  misc_feature (1)..( 6): Result.003 file - promoters60/4773245
ccaaaa

SEQ ID NO: 142948 - DNA, 7 bp, Unknown
  misc_feature (1)..( 7): Result.003 file - promoters60/4773245
ttgtaga

SEQ ID NO: 142949 - DNA, 7 bp, Unknown
  misc_feature (1)..( 7): Result.003 file - promoters60/4773245
ttgcaga

SEQ ID NO: 142950 - DNA, 6 bp, Unknown
  misc_feature (1)..( 6): Result.003 file - promoters60/4773245
ggagat

SEQ ID NO: 142951 - DNA, 6 bp, Unknown
  misc_feature (1)..( 6): Result.003 file - promoters60/4773245
ggagat

SEQ ID NO: 142952 - DNA, 8 bp, Unknown
  misc_feature (1)..( 8): Result.003 file - promoters60/4773245
tgcataga

SEQ ID NO: 142953 - DNA, 8 bp, Unknown
  misc_feature (1)..( 8): Result.003 file - promoters60/4773245
tgcaaaga

SEQ ID NO: 142954 - DNA, 7 bp, Unknown
  misc_feature (1)..( 7): Result.003 file - promoters60/4773245
aacacca

SEQ ID NO: 142955 - DNA, 7 bp, Unknown
  misc_feature (1)..( 7): Result.003 file - promoters60/4773245
aacacca

SEQ ID NO: 142956 - DNA, 7 bp, Unknown
  misc_feature (1)..( 7): Result.003 file - promoters60/4773245
ttcaatt

SEQ ID NO: 142957 - DNA, 7 bp, Unknown
  misc_feature (1)..( 7): Result.003 file - promoters60/4773245
ttccatt

SEQ ID NO: 142958 - DNA, 8 bp, Unknown
  misc_feature (1)..( 8): Result.003 file - promoters60/4773264
attgtaga

SEQ ID NO: 142959 - DNA, 8 bp, Unknown
  misc_feature (1)..( 8): Result.003 file - promoters60/4773264
attggaga

SEQ ID NO: 142960 - DNA, 8 bp, Unknown
  misc_feature (1)..( 8): Result.003 file - promoters60/4773264
tagtgatt

SEQ ID NO: 142961 - DNA, 8 bp, Unknown
  misc_feature (1)..( 8): Result.003 file - promoters60/4773264
tagttatt

SEQ ID NO: 142962 - DNA, 8 bp, Unknown
  misc_feature (1)..( 8): Result.003 file - promoters60/4773264
cagtaatt

SEQ ID NO: 142963 - DNA, 8 bp, Unknown
  misc_feature (1)..( 8): Result.003 file - promoters60/4773264
ttttcgtg

SEQ ID NO: 142964 - DNA, 8 bp, Unknown
  misc_feature (1)..( 8): Result.003 file - promoters60/4773264
tttgcgtg

SEQ ID NO: 142965 - DNA, 6 bp, Unknown
  misc_feature (1)..( 6): Result.003 file - promoters60/4773264
gagatc

SEQ ID NO: 142966 - DNA, 6 bp, Unknown
  misc_feature (1)..( 6): Result.003 file - promoters60/4773264
gagatc

SEQ ID NO: 142967 - DNA, 7 bp, Unknown
  misc_feature (1)..( 7): Result.003 file - promoters60/4773264
taacgaa

SEQ ID NO: 142968 - DNA, 7 bp, Unknown
  misc_feature (1)..( 7): Result.003 file - promoters60/4773264
aaacgaa

SEQ ID NO: 142969 - DNA, 7 bp, Unknown
  misc_feature (1)..( 7): Result.003 file - promoters60/4773264
taaagaa

SEQ ID NO: 142970 - DNA, 7 bp, Unknown
  misc_feature (1)..( 7): Result.003 file - promoters60/4773264
agtatta

SEQ ID NO: 142971 - DNA, 7 bp, Unknown
  misc_feature (1)..( 7): Result.003 file - promoters60/4773264
agtttta

SEQ ID NO: 142972 - DNA, 6 bp, Unknown
  misc_feature (1)..( 6): Result.003 file - promoters60/4773264
tttgag

SEQ ID NO: 142973 - DNA, 6 bp, Unknown
  misc_feature (1)..( 6): Result.003 file - promoters60/4773264
tttgag

SEQ ID NO: 142974 - DNA, 8 bp, Unknown
  misc_feature (1)..( 8): Result.003 file - promoters60/4773264
tatttctc

SEQ ID NO: 142975 - DNA, 8 bp, Unknown
  misc_feature (1)..( 8): Result.003 file - promoters60/4773264
tatgtctc

SEQ ID NO: 142976 - DNA, 8 bp, Unknown
  misc_feature (1)..( 8): Result.003 file - promoters60/4773264
ttgttttt

SEQ ID NO: 142977 - DNA, 8 bp, Unknown
  misc_feature (1)..( 8): Result.003 file - promoters60/4773264
ttgttttt

SEQ ID NO: 142978 - DNA, 8 bp, Unknown
  misc_feature (1)..( 8): Result.003 file - promoters60/4773264
ttttaact

SEQ ID NO: 142979 - DNA, 8 bp, Unknown
  misc_feature (1)..( 8): Result.003 file - promoters60/4773264
tttttact

SEQ ID NO: 142980 - DNA, 8 bp, Unknown
  misc_feature (1)..( 8): Result.003 file - promoters60/4773264
aaagcaaa

SEQ ID NO: 142981 - DNA, 8 bp, Unknown
  misc_feature (1)..( 8): Result.003 file - promoters60/4773264
aaagcaaa

SEQ ID NO: 142982 - DNA, 6 bp, Unknown
  misc_feature (1)..( 6): Result.003 file - promoters60/4773264
atacaa

SEQ ID NO: 142983 - DNA, 6 bp, Unknown
  misc_feature (1)..( 6): Result.003 file - promoters60/4773264
atacaa

SEQ ID NO: 142984 - DNA, 7 bp, Unknown
  misc_feature (1)..( 7): Result.003 file - promoters60/4773264
agaaaat

SEQ ID NO: 142985 - DNA, 7 bp, Unknown
  misc_feature (1)..( 7): Result.003 file - promoters60/4773264
agaaaat

SEQ ID NO: 142986 - DNA, 7 bp, Unknown
  misc_feature (1)..( 7): Result.003 file - promoters60/4773264
tctttga

SEQ ID NO: 142987 - DNA, 7 bp, Unknown
  misc_feature (1)..( 7): Result.003 file - promoters60/4773264
tctctga

SEQ ID NO: 142988 - DNA, 6 bp, Unknown
  misc_feature (1)..( 6): Result.003 file - promoters60/4773264
ttaaaa

SEQ ID NO: 142989 - DNA, 6 bp, Unknown
  misc_feature (1)..( 6): Result.003 file - promoters60/4773264
ttaaaa

SEQ ID NO: 142990 - DNA, 9 bp, Unknown
  misc_feature (1)..( 9): Result.003 file - promoters60/4773355
ttaatgttt

SEQ ID NO: 142991 - DNA, 9 bp, Unknown
  misc_feature (1)..( 9): Result.003 file - promoters60/4773355
tccatgttt

SEQ ID NO: 142992 - DNA, 9 bp, Unknown
  misc_feature (1)..( 9): Result.003 file - promoters60/4773355
ttaattttt

SEQ ID NO: 142993 - DNA, 7 bp, Unknown
  misc_feature (1)..( 7): Result.003 file - promoters60/4773355
gattaat

SEQ ID NO: 142994 - DNA, 7 bp, Unknown
  misc_feature (1)..( 7): Result.003 file - promoters60/4773355
gattaaa

SEQ ID NO: 142995 - DNA, 7 bp, Unknown
  misc_feature (1)..( 7): Result.003 file - promoters60/4773355
aattaaa

SEQ ID NO: 142996 - DNA, 8 bp, Unknown
  misc_feature (1)..( 8): Result.003 file - promoters60/4773355
taatgtct

SEQ ID NO: 142997 - DNA, 8 bp, Unknown
  misc_feature (1)..( 8): Result.003 file - promoters60/4773355
aaatgtct

SEQ ID NO: 142998 - DNA, 8 bp, Unknown
  misc_feature (1)..( 8): Result.003 file - promoters60/4773355
taatgtta

SEQ ID NO: 142999 - DNA, 9 bp, Unknown
  misc_feature (1)..( 9): Result.003 file - promoters60/4773355
aaaattata

SEQ ID NO: 143000 - DNA, 9 bp, Unknown
  misc_feature (1)..( 9): Result.003 file - promoters60/4773355
aacattata

SEQ ID NO: 143001 - DNA, 9 bp, Unknown
  misc_feature (1)..( 9): Result.003 file - promoters60/4773355
aacgttatg

SEQ ID NO: 143002 - DNA, 11 bp, Unknown
  misc_feature (1)..( 11): Result.003 file - promoters60/4773355
ttacttttatt

SEQ ID NO: 143003 - DNA, 11 bp, Unknown
  misc_feature (1)..( 11): Result.003 file - promoters60/4773355
ttacttttaac

SEQ ID NO: 143004 - DNA, 11 bp, Unknown
  misc_feature (1)..( 11): Result.003 file - promoters60/4773355
ctaatttgaac

SEQ ID NO: 143005 - DNA, 9 bp, Unknown
  misc_feature (1)..( 9): Result.003 file - promoters60/4773355
ttaacaaaa

SEQ ID NO: 143006 - DNA, 9 bp, Unknown
  misc_feature (1)..( 9): Result.003 file - promoters60/4773355
ttaagaaaa

SEQ ID NO: 143007 - DNA, 9 bp, Unknown
  misc_feature (1)..( 9): Result.003 file - promoters60/4773355
ttatcaaat

SEQ ID NO: 143008 - DNA, 8 bp, Unknown
  misc_feature (1)..( 8): Result.003 file - promoters60/4773355
aaacaatt

SEQ ID NO: 143009 - DNA, 8 bp, Unknown
  misc_feature (1)..( 8): Result.003 file - promoters60/4773355
aaataatc

SEQ ID NO: 143010 - DNA, 8 bp, Unknown
  misc_feature (1)..( 8): Result.003 file - promoters60/4773355
caactatt

SEQ ID NO: 143011 - DNA, 7 bp, Unknown
  misc_feature (1)..( 7): Result.003 file - promoters60/4773355
aaaatta

SEQ ID NO: 143012 - DNA, 7 bp, Unknown
  misc_feature (1)..( 7): Result.003 file - promoters60/4773355
taaatta

SEQ ID NO: 143013 - DNA, 7 bp, Unknown
  misc_feature (1)..( 7): Result.003 file - promoters60/4773355
taaattt

SEQ ID NO: 143014 - DNA, 8 bp, Unknown
  misc_feature (1)..( 8): Result.003 file - promoters60/4773355
ttttctgt

SEQ ID NO: 143015 - DNA, 8 bp, Unknown
  misc_feature (1)..( 8): Result.003 file - promoters60/4773355
tttgctgc

SEQ ID NO: 143016 - DNA, 8 bp, Unknown
  misc_feature (1)..( 8): Result.003 file - promoters60/4773355
gtttctct

SEQ ID NO: 143017 - DNA, 12 bp, Unknown
  misc_feature (1)..( 12): Result.003 file - promoters60/4773392
ataatatccaat

SEQ ID NO: 143018 - DNA, 12 bp, Unknown
  misc_feature (1)..( 12): Result.003 file - promoters60/4773392
ataatattcaat

SEQ ID NO: 143019 - DNA, 6 bp, Unknown
  misc_feature (1)..( 6): Result.003 file - promoters60/4773392
aaaaac

SEQ ID NO: 143020 - DNA, 6 bp, Unknown
  misc_feature (1)..( 6): Result.003 file - promoters60/4773392
aaaaac

SEQ ID NO: 143021 - DNA, 6 bp, Unknown
  misc_feature (1)..( 6): Result.003 file - promoters60/4773392
aagttt

SEQ ID NO: 143022 - DNA, 6 bp, Unknown
  misc_feature (1)..( 6): Result.003 file - promoters60/4773392
aagttt

SEQ ID NO: 143023 - DNA, 7 bp, Unknown
  misc_feature (1)..( 7): Result.003 file - promoters60/4773392
aaatcat

SEQ ID NO: 143024 - DNA, 7 bp, Unknown
  misc_feature (1)..( 7): Result.003 file - promoters60/4773392
aaatcat

SEQ ID NO: 143025 - DNA, 8 bp, Unknown
  misc_feature (1)..( 8): Result.003 file - promoters60/4773392
atatttaa

SEQ ID NO: 143026 - DNA, 8 bp, Unknown
  misc_feature (1)..( 8): Result.003 file - promoters60/4773392
atatttaa

SEQ ID NO: 143027 - DNA, 6 bp, Unknown
  misc_feature (1)..( 6): Result.003 file - promoters60/4773392
agaaag

SEQ ID NO: 143028 - DNA, 6 bp, Unknown
  misc_feature (1)..( 6): Result.003 file - promoters60/4773392
agaaag

SEQ ID NO: 143029 - DNA, 7 bp, Unknown
  misc_feature (1)..( 7): Result.003 file - promoters60/4773392
aatatgc

SEQ ID NO: 143030 - DNA, 7 bp, Unknown
  misc_feature (1)..( 7): Result.003 file - promoters60/4773392
aatctgc

SEQ ID NO: 143031 - DNA, 9 bp, Unknown
  misc_feature (1)..( 9): Result.003 file - promoters60/4773392
tcagagaaa

SEQ ID NO: 143032 - DNA, 9 bp, Unknown
  misc_feature (1)..( 9): Result.003 file - promoters60/4773392
tcagagaaa

SEQ ID NO: 143033 - DNA, 6 bp, Unknown
  misc_feature (1)..( 6): Result.003 file - promoters60/4773392
aaagat

SEQ ID NO: 143034 - DNA, 6 bp, Unknown
  misc_feature (1)..( 6): Result.003 file - promoters60/4773392
aaagat

SEQ ID NO: 143035 - DNA, 7 bp, Unknown
  misc_feature (1)..( 7): Result.003 file - promoters60/4773392
gcatggc

SEQ ID NO: 143036 - DNA, 7 bp, Unknown
  misc_feature (1)..( 7): Result.003 file - promoters60/4773392
gcacggc

SEQ ID NO: 143037 - DNA, 14 bp, Unknown
  misc_feature (1)..( 14): Result.003 file - promoters60/4773392
ttggtaaaatattt

SEQ ID NO: 143038 - DNA, 14 bp, Unknown
  misc_feature (1)..( 14): Result.003 file - promoters60/4773392
aaacaaaaataaat

SEQ ID NO: 143039 - DNA, 14 bp, Unknown
  misc_feature (1)..( 14): Result.003 file - promoters60/4773392
taaacaaaaaaaaa

SEQ ID NO: 143040 - DNA, 6 bp, Unknown
  misc_feature (1)..( 6): Result.003 file - promoters60/4773392
tcaaaa

SEQ ID NO: 143041 - DNA, 6 bp, Unknown
  misc_feature (1)..( 6): Result.003 file - promoters60/4773392
tcaaaa

SEQ ID NO: 143042 - DNA, 7 bp, Unknown
  misc_feature (1)..( 7): Result.003 file - promoters60/4773392
aaaatta

SEQ ID NO: 143043 - DNA, 7 bp, Unknown
  misc_feature (1)..( 7): Result.003 file - promoters60/4773392
aaaatta

SEQ ID NO: 143044 - DNA, 7 bp, Unknown
  misc_feature (1)..( 7): Result.003 file - promoters60/4773392
atattat

SEQ ID NO: 143045 - DNA, 7 bp, Unknown
  misc_feature (1)..( 7): Result.003 file - promoters60/4773392
atagtat

SEQ ID NO: 143046 - DNA, 6 bp, Unknown
  misc_feature (1)..( 6): Result.003 file - promoters60/4773392
tttttt

SEQ ID NO: 143047 - DNA, 6 bp, Unknown
  misc_feature (1)..( 6): Result.003 file - promoters60/4773392
tttttt

SEQ ID NO: 143048 - DNA, 7 bp, Unknown
  misc_feature (1)..( 7): Result.003 file - promoters60/4773392
tttgttt

SEQ ID NO: 143049 - DNA, 7 bp, Unknown
  misc_feature (1)..( 7): Result.003 file - promoters60/4773392
tttcttt

SEQ ID NO: 143050 - DNA, 6 bp, Unknown
  misc_feature (1)..( 6): Result.003 file - promoters60/4773392
cgttta

SEQ ID NO: 143051 - DNA, 6 bp, Unknown
  misc_feature (1)..( 6): Result.003 file - promoters60/4773392
cgttta

SEQ ID NO: 143052 - DNA, 6 bp, Unknown
  misc_feature (1)..( 6): Result.003 file - promoters60/4773795
gctttc

SEQ ID NO: 143053 - DNA, 6 bp, Unknown
  misc_feature (1)..( 6): Result.003 file - promoters60/4773795
gctttc

SEQ ID NO: 143054 - DNA, 6 bp, Unknown
  misc_feature (1)..( 6): Result.003 file - promoters60/4773795
tctctc

SEQ ID NO: 143055 - DNA, 6 bp, Unknown
  misc_feature (1)..( 6): Result.003 file - promoters60/4773795
tctctc

SEQ ID NO: 143056 - DNA, 7 bp, Unknown
  misc_feature (1)..( 7): Result.003 file - promoters60/4773795
tctgctc

SEQ ID NO: 143057 - DNA, 7 bp, Unknown
  misc_feature (1)..( 7): Result.003 file - promoters60/4773795
tctcctc

SEQ ID NO: 143058 - DNA, 9 bp, Unknown
  misc_feature (1)..( 9): Result.003 file - promoters60/4773795
taaatgcaa

SEQ ID NO: 143059 - DNA, 9 bp, Unknown
  misc_feature (1)..( 9): Result.003 file - promoters60/4773795
taaatacaa

SEQ ID NO: 143060 - DNA, 7 bp, Unknown
  misc_feature (1)..( 7): Result.003 file - promoters60/4773795
agtggga

SEQ ID NO: 143061 - DNA, 7 bp, Unknown
  misc_feature (1)..( 7): Result.003 file - promoters60/4773795
agtggga

SEQ ID NO: 143062 - DNA, 9 bp, Unknown
  misc_feature (1)..( 9): Result.003 file - promoters60/4773795
tttaatttt

SEQ ID NO: 143063 - DNA, 9 bp, Unknown
  misc_feature (1)..( 9): Result.003 file - promoters60/4773795
tttgatttt

SEQ ID NO: 143064 - DNA, 6 bp, Unknown
  misc_feature (1)..( 6): Result.003 file - promoters60/4773795
ctctgt

SEQ ID NO: 143065 - DNA, 6 bp, Unknown
  misc_feature (1)..( 6): Result.003 file - promoters60/4773795
ctctgt

SEQ ID NO: 143066 - DNA, 6 bp, Unknown
  misc_feature (1)..( 6): Result.003 file - promoters60/4773795
tctatc

SEQ ID NO: 143067 - DNA, 6 bp, Unknown
  misc_feature (1)..( 6): Result.003 file - promoters60/4773795
tctatc

SEQ ID NO: 143068 - DNA, 12 bp, Unknown
  misc_feature (1)..( 12): Result.003 file - promoters60/4773795
tcaatgatattt

SEQ ID NO: 143069 - DNA, 12 bp, Unknown
  misc_feature (1)..( 12): Result.003 file - promoters60/4773795
tcactgattttt

SEQ ID NO: 143070 - DNA, 7 bp, Unknown
  misc_feature (1)..( 7): Result.003 file - promoters60/4773795
attaaag

SEQ ID NO: 143071 - DNA, 7 bp, Unknown
  misc_feature (1)..( 7): Result.003 file - promoters60/4773795
attcaag

SEQ ID NO: 143072 - DNA, 7 bp, Unknown
  misc_feature (1)..( 7): Result.003 file - promoters60/4773795
tgtatat

SEQ ID NO: 143073 - DNA, 7 bp, Unknown
  misc_feature (1)..( 7): Result.003 file - promoters60/4773795
tgtctat

SEQ ID NO: 143074 - DNA, 8 bp, Unknown
  misc_feature (1)..( 8): Result.003 file - promoters60/4773795
tctggttt

SEQ ID NO: 143075 - DNA, 8 bp, Unknown
  misc_feature (1)..( 8): Result.003 file - promoters60/4773795
tctggttt

SEQ ID NO: 143076 - DNA, 7 bp, Unknown
  misc_feature (1)..( 7): Result.003 file - promoters60/4773795
tttactt

SEQ ID NO: 143077 - DNA, 7 bp, Unknown
  misc_feature (1)..( 7): Result.003 file - promoters60/4773795
tttgctt

SEQ ID NO: 143078 - DNA, 8 bp, Unknown
  misc_feature (1)..( 8): Result.003 file - promoters60/4773795
cttttctc

SEQ ID NO: 143079 - DNA, 8 bp, Unknown
  misc_feature (1)..( 8): Result.003 file - promoters60/4773795
cttgtctc

SEQ ID NO: 143080 - DNA, 7 bp, Unknown
  misc_feature (1)..( 7): Result.003 file - promoters60/4773795
ttgaagc

SEQ ID NO: 143081 - DNA, 7 bp, Unknown
  misc_feature (1)..( 7): Result.003 file - promoters60/4773795
ttgaagc

SEQ ID NO: 143082 - DNA, 6 bp, Unknown
  misc_feature (1)..( 6): Result.003 file - promoters60/4773795
cctttt

SEQ ID NO: 143083 - DNA, 6 bp, Unknown
  misc_feature (1)..( 6): Result.003 file - promoters60/4773795
cctttt

SEQ ID NO: 143084 - DNA, 7 bp, Unknown
  misc_feature (1)..( 7): Result.003 file - promoters60/4773795
ttttttt

SEQ ID NO: 143085 - DNA, 7 bp, Unknown
  misc_feature (1)..( 7): Result.003 file - promoters60/4773795
ttttttt

SEQ ID NO: 143086 - DNA, 7 bp, Unknown
  misc_feature (1)..( 7): Result.003 file - promoters60/4773795
ggcctat

SEQ ID NO: 143087 - DNA, 7 bp, Unknown
  misc_feature (1)..( 7): Result.003 file - promoters60/4773795
ggcctat

SEQ ID NO: 143088 - DNA, 12 bp, Unknown
  misc_feature (1)..( 12): Result.003 file - promoters60/4773819
cttgaaaaagag

SEQ ID NO: 143089 - DNA, 12 bp, Unknown
  misc_feature (1)..( 12): Result.003 file - promoters60/4773819
gtataaaaagaa

SEQ ID NO: 143090 - DNA, 12 bp, Unknown
  misc_feature (1)..( 12): Result.003 file - promoters60/4773819
ttggtgaaagag

SEQ ID NO: 143091 - DNA, 12 bp, Unknown
  misc_feature (1)..( 12): Result.003 file - promoters60/4773819
tatcaaaatttg

SEQ ID NO: 143092 - DNA, 12 bp, Unknown
  misc_feature (1)..( 12): Result.003 file - promoters60/4773819
tatctaaacgct

SEQ ID NO: 143093 - DNA, 12 bp, Unknown
  misc_feature (1)..( 12): Result.003 file - promoters60/4773819
tctcaaaatgta

SEQ ID NO: 143094 - DNA, 12 bp, Unknown
  misc_feature (1)..( 12): Result.003 file - promoters60/4773819
agtctaaaactg

SEQ ID NO: 143095 - DNA, 12 bp, Unknown
  misc_feature (1)..( 12): Result.003 file - promoters60/4773819
tcttcttttctt

SEQ ID NO: 143096 - DNA, 12 bp, Unknown
  misc_feature (1)..( 12): Result.003 file - promoters60/4773819
ggttcatttcaa

SEQ ID NO: 143097 - DNA, 12 bp, Unknown
  misc_feature (1)..( 12): Result.003 file - promoters60/4773819
gattctttgacg

SEQ ID NO: 143098 - DNA, 12 bp, Unknown
  misc_feature (1)..( 12): Result.003 file - promoters60/4773819
gatgctttttaa

SEQ ID NO: 143099 - DNA, 12 bp, Unknown
  misc_feature (1)..( 12): Result.003 file - promoters60/4773819
tatgatttagcc

SEQ ID NO: 143100 - DNA, 12 bp, Unknown
  misc_feature (1)..( 12): Result.003 file - promoters60/4773819
gaaaaattgcaa

SEQ ID NO: 143101 - DNA, 7 bp, Unknown
  misc_feature (1)..( 7): Result.003 file - promoters60/4773819
ttttaac

SEQ ID NO: 143102 - DNA, 7 bp, Unknown
  misc_feature (1)..( 7): Result.003 file - promoters60/4773819
gtttaac

SEQ ID NO: 143103 - DNA, 8 bp, Unknown
  misc_feature (1)..( 8): Result.003 file - promoters60/4773819
atttcaac

SEQ ID NO: 143104 - DNA, 8 bp, Unknown
  misc_feature (1)..( 8): Result.003 file - promoters60/4773819
attttaca

SEQ ID NO: 143105 - DNA, 8 bp, Unknown
  misc_feature (1)..( 8): Result.003 file - promoters60/4773819
attgcaat

SEQ ID NO: 143106 - DNA, 8 bp, Unknown
  misc_feature (1)..( 8): Result.003 file - promoters60/4773819
ctttcaag

SEQ ID NO: 143107 - DNA, 8 bp, Unknown
  misc_feature (1)..( 8): Result.003 file - promoters60/4773823
cctctctt

SEQ ID NO: 143108 - DNA, 8 bp, Unknown
  misc_feature (1)..( 8): Result.003 file - promoters60/4773823
tctctctc

SEQ ID NO: 143109 - DNA, 8 bp, Unknown
  misc_feature (1)..( 8): Result.003 file - promoters60/4773823
tctttctc

SEQ ID NO: 143110 - DNA, 8 bp, Unknown
  misc_feature (1)..( 8): Result.003 file - promoters60/4773823
actttttt

SEQ ID NO: 143111 - DNA, 8 bp, Unknown
  misc_feature (1)..( 8): Result.003 file - promoters60/4773823
actttttg

SEQ ID NO: 143112 - DNA, 8 bp, Unknown
  misc_feature (1)..( 8): Result.003 file - promoters60/4773823
cctttttt

SEQ ID NO: 143113 - DNA, 11 bp, Unknown
  misc_feature (1)..( 11): Result.003 file - promoters60/4773823
ttgtattctaa

SEQ ID NO: 143114 - DNA, 11 bp, Unknown
  misc_feature (1)..( 11): Result.003 file - promoters60/4773823
atgtattttac

SEQ ID NO: 143115 - DNA, 12 bp, Unknown
  misc_feature (1)..( 12): Result.003 file - promoters60/4773823
atgtaatttgaa

SEQ ID NO: 143116 - DNA, 12 bp, Unknown
  misc_feature (1)..( 12): Result.003 file - promoters60/4773823
ttgtttttcaca

SEQ ID NO: 143117 - DNA, 12 bp, Unknown
  misc_feature (1)..( 12): Result.003 file - promoters60/4773823
gtgtcattcaat

SEQ ID NO: 143118 - DNA, 12 bp, Unknown
  misc_feature (1)..( 12): Result.003 file - promoters60/4773823
aagtttttttgc

SEQ ID NO: 143119 - DNA, 13 bp, Unknown
  misc_feature (1)..( 13): Result.003 file - promoters60/4773823
aatttgttgtatt

SEQ ID NO: 143120 - DNA, 13 bp, Unknown
  misc_feature (1)..( 13): Result.003 file - promoters60/4773823
agtttgttaagtt

SEQ ID NO: 143121 - DNA, 13 bp, Unknown
  misc_feature (1)..( 13): Result.003 file - promoters60/4773823
aatatgtaatttg

SEQ ID NO: 143122 - DNA, 13 bp, Unknown
  misc_feature (1)..( 13): Result.003 file - promoters60/4773823
gtttttttgctga

SEQ ID NO: 143123 - DNA, 13 bp, Unknown
  misc_feature (1)..( 13): Result.003 file - promoters60/4773823
catttgtttttca

SEQ ID NO: 143124 - DNA, 13 bp, Unknown
  misc_feature (1)..( 13): Result.003 file - promoters60/4773823
attttgctgaatc

SEQ ID NO: 143125 - DNA, 9 bp, Unknown
  misc_feature (1)..( 9): Result.003 file - promoters60/4773836
atttatcgc

SEQ ID NO: 143126 - DNA, 9 bp, Unknown
  misc_feature (1)..( 9): Result.003 file - promoters60/4773836
atttatcat

SEQ ID NO: 143127 - DNA, 9 bp, Unknown
  misc_feature (1)..( 9): Result.003 file - promoters60/4773836
ttttatcat

SEQ ID NO: 143128 - DNA, 9 bp, Unknown
  misc_feature (1)..( 9): Result.003 file - promoters60/4773836
ctcaaaaaa

SEQ ID NO: 143129 - DNA, 9 bp, Unknown
  misc_feature (1)..( 9): Result.003 file - promoters60/4773836
gtcaaaaaa

SEQ ID NO: 143130 - DNA, 9 bp, Unknown
  misc_feature (1)..( 9): Result.003 file - promoters60/4773836
gtcaaatcc

SEQ ID NO: 143131 - DNA, 10 bp, Unknown
  misc_feature (1)..( 10): Result.003 file - promoters60/4773846
tattaaaaaa

SEQ ID NO: 143132 - DNA, 10 bp, Unknown
  misc_feature (1)..( 10): Result.003 file - promoters60/4773846
tattaaaaaa

SEQ ID NO: 143133 - DNA, 10 bp, Unknown
  misc_feature (1)..( 10): Result.003 file - promoters60/4773846
gatgaaaaaa

SEQ ID NO: 143134 - DNA, 6 bp, Unknown
  misc_feature (1)..( 6): Result.003 file - promoters60/4773846
aataca

SEQ ID NO: 143135 - DNA, 6 bp, Unknown
  misc_feature (1)..( 6): Result.003 file - promoters60/4773846
aataca

SEQ ID NO: 143136 - DNA, 8 bp, Unknown
  misc_feature (1)..( 8): Result.003 file - promoters60/4773846
attatatt

SEQ ID NO: 143137 - DNA, 8 bp, Unknown
  misc_feature (1)..( 8): Result.003 file - promoters60/4773846
gatatatt

SEQ ID NO: 143138 - DNA, 8 bp, Unknown
  misc_feature (1)..( 8): Result.003 file - promoters60/4773846
attttatc

SEQ ID NO: 143139 - DNA, 7 bp, Unknown
  misc_feature (1)..( 7): Result.003 file - promoters60/4773846
tattgta

SEQ ID NO: 143140 - DNA, 7 bp, Unknown
  misc_feature (1)..( 7): Result.003 file - promoters60/4773846
tatggta

SEQ ID NO: 143141 - DNA, 8 bp, Unknown
  misc_feature (1)..( 8): Result.003 file - promoters60/4773846
tatccaca

SEQ ID NO: 143142 - DNA, 8 bp, Unknown
  misc_feature (1)..( 8): Result.003 file - promoters60/4773846
tatctaca

SEQ ID NO: 143143 - DNA, 6 bp, Unknown
  misc_feature (1)..( 6): Result.003 file - promoters60/4773846
aataat

SEQ ID NO: 143144 - DNA, 6 bp, Unknown
  misc_feature (1)..( 6): Result.003 file - promoters60/4773846
aataat

SEQ ID NO: 143145 - DNA, 6 bp, Unknown
  misc_feature (1)..( 6): Result.003 file - promoters60/4773846
tacttg

SEQ ID NO: 143146 - DNA, 6 bp, Unknown
  misc_feature (1)..( 6): Result.003 file - promoters60/4773846
tacttg

SEQ ID NO: 143147 - DNA, 6 bp, Unknown
  misc_feature (1)..( 6): Result.003 file - promoters60/4773846
agacaa

SEQ ID NO: 143148 - DNA, 6 bp, Unknown
  misc_feature (1)..( 6): Result.003 file - promoters60/4773846
agacaa

SEQ ID NO: 143149 - DNA, 8 bp, Unknown
  misc_feature (1)..( 8): Result.003 file - promoters60/4773846
tatagaac

SEQ ID NO: 143150 - DNA, 8 bp, Unknown
  misc_feature (1)..( 8): Result.003 file - promoters60/4773846
aatacaac

SEQ ID NO: 143151 - DNA, 8 bp, Unknown
  misc_feature (1)..( 8): Result.003 file - promoters60/4773846
aattcaaa

SEQ ID NO: 143152 - DNA, 7 bp, Unknown
  misc_feature (1)..( 7): Result.003 file - promoters60/4773846
aaaaata

SEQ ID NO: 143153 - DNA, 7 bp, Unknown
  misc_feature (1)..( 7): Result.003 file - promoters60/4773846
aaagata

SEQ ID NO: 143154 - DNA, 9 bp, Unknown
  misc_feature (1)..( 9): Result.003 file - promoters60/4773846
tttttataa

SEQ ID NO: 143155 - DNA, 9 bp, Unknown
  misc_feature (1)..( 9): Result.003 file - promoters60/4773846
attttatct

SEQ ID NO: 143156 - DNA, 9 bp, Unknown
  misc_feature (1)..( 9): Result.003 file - promoters60/4773846
atttgatct

SEQ ID NO: 143157 - DNA, 9 bp, Unknown
  misc_feature (1)..( 9): Result.003 file - promoters60/4773846
ttttgttat

SEQ ID NO: 143158 - DNA, 9 bp, Unknown
  misc_feature (1)..( 9): Result.003 file - promoters60/4773846
ttttcttat

SEQ ID NO: 143159 - DNA, 7 bp, Unknown
  misc_feature (1)..( 7): Result.003 file - promoters60/4773846
gattaaa

SEQ ID NO: 143160 - DNA, 7 bp, Unknown
  misc_feature (1)..( 7): Result.003 file - promoters60/4773846
gataaaa

SEQ ID NO: 143161 - DNA, 6 bp, Unknown
  misc_feature (1)..( 6): Result.003 file - promoters60/4773846
catata

SEQ ID NO: 143162 - DNA, 6 bp, Unknown
  misc_feature (1)..( 6): Result.003 file - promoters60/4773846
catata

SEQ ID NO: 143163 - DNA, 10 bp, Unknown
  misc_feature (1)..( 10): Result.003 file - promoters60/4773846
cattaaaata

SEQ ID NO: 143164 - DNA, 10 bp, Unknown
  misc_feature (1)..( 10): Result.003 file - promoters60/4773846
aattcaaata

SEQ ID NO: 143165 - DNA, 10 bp, Unknown
  misc_feature (1)..( 10): Result.003 file - promoters60/4773846
aatacaacca

SEQ ID NO: 143166 - DNA, 8 bp, Unknown
  misc_feature (1)..( 8): Result.003 file - promoters60/4773846
tctcaaat

SEQ ID NO: 143167 - DNA, 8 bp, Unknown
  misc_feature (1)..( 8): Result.003 file - promoters60/4773846
attcaaat

SEQ ID NO: 143168 - DNA, 8 bp, Unknown
  misc_feature (1)..( 8): Result.003 file - promoters60/4773846
attcaaag

SEQ ID NO: 143169 - DNA, 7 bp, Unknown
  misc_feature (1)..( 7): Result.003 file - promoters60/4773846
aagcaaa

SEQ ID NO: 143170 - DNA, 7 bp, Unknown
  misc_feature (1)..( 7): Result.003 file - promoters60/4773846
aagaaaa

SEQ ID NO: 143171 - DNA, 6 bp, Unknown
  misc_feature (1)..( 6): Result.003 file - promoters60/4773846
cagcaa

SEQ ID NO: 143172 - DNA, 6 bp, Unknown
  misc_feature (1)..( 6): Result.003 file - promoters60/4773846
cagcaa

SEQ ID NO: 143173 - DNA, 6 bp, Unknown
  misc_feature (1)..( 6): Result.003 file - promoters60/4773846
acgtac

SEQ ID NO: 143174 - DNA, 6 bp, Unknown
  misc_feature (1)..( 6): Result.003 file - promoters60/4773846
acgtac

SEQ ID NO: 143175 - DNA, 7 bp, Unknown
  misc_feature (1)..( 7): Result.003 file - promoters60/4773846
aatcaaa

SEQ ID NO: 143176 - DNA, 7 bp, Unknown
  misc_feature (1)..( 7): Result.003 file - promoters60/4773846
aattaaa

SEQ ID NO: 143177 - DNA, 12 bp, Unknown
  misc_feature (1)..( 12): Result.003 file - promoters60/4773846
atttgatacttt

SEQ ID NO: 143178 - DNA, 12 bp, Unknown
  misc_feature (1)..( 12): Result.003 file - promoters60/4773846
attagataattt

SEQ ID NO: 143179 - DNA, 9 bp, Unknown
  misc_feature (1)..( 9): Result.003 file - promoters60/4802537
aaattaatt

SEQ ID NO: 143180 - DNA, 9 bp, Unknown
  misc_feature (1)..( 9): Result.003 file - promoters60/4802537
tgattgatt

SEQ ID NO: 143181 - DNA, 9 bp, Unknown
  misc_feature (1)..( 9): Result.003 file - promoters60/4802537
aaagtaaat

SEQ ID NO: 143182 - DNA, 9 bp, Unknown
  misc_feature (1)..( 9): Result.003 file - promoters60/4802537
aaactaaat

SEQ ID NO: 143183 - DNA, 14 bp, Unknown
  misc_feature (1)..( 14): Result.003 file - promoters60/4802537
aaaaaaatactaat

SEQ ID NO: 143184 - DNA, 14 bp, Unknown
  misc_feature (1)..( 14): Result.003 file - promoters60/4802537
aaataaaccaaagt

SEQ ID NO: 143185 - DNA, 14 bp, Unknown
  misc_feature (1)..( 14): Result.003 file - promoters60/4802537
taataaactaaagt

SEQ ID NO: 143186 - DNA, 14 bp, Unknown
  misc_feature (1)..( 14): Result.003 file - promoters60/4802537
tactgaagaagact

SEQ ID NO: 143187 - DNA, 10 bp, Unknown
  misc_feature (1)..( 10): Result.003 file - promoters60/4802537
tatttatata

SEQ ID NO: 143188 - DNA, 10 bp, Unknown
  misc_feature (1)..( 10): Result.003 file - promoters60/4802537
atattaaata

SEQ ID NO: 143189 - DNA, 10 bp, Unknown
  misc_feature (1)..( 10): Result.003 file - promoters60/4802537
tatttaaaca

SEQ ID NO: 143190 - DNA, 10 bp, Unknown
  misc_feature (1)..( 10): Result.003 file - promoters60/4802537
gctataaaag

SEQ ID NO: 143191 - DNA, 13 bp, Unknown
  misc_feature (1)..( 13): Result.003 file - promoters60/4802537
atatggaaaagaa

SEQ ID NO: 143192 - DNA, 13 bp, Unknown
  misc_feature (1)..( 13): Result.003 file - promoters60/4802537
tttacgaaaagtg

SEQ ID NO: 143193 - DNA, 13 bp, Unknown
  misc_feature (1)..( 13): Result.003 file - promoters60/4802537
aagtgaaaaagaa

SEQ ID NO: 143194 - DNA, 13 bp, Unknown
  misc_feature (1)..( 13): Result.003 file - promoters60/4802537
tttacgaaaaagg

SEQ ID NO: 143195 - DNA, 8 bp, Unknown
  misc_feature (1)..( 8): Result.003 file - promoters60/4803329
ctttttac

SEQ ID NO: 143196 - DNA, 8 bp, Unknown
  misc_feature (1)..( 8): Result.003 file - promoters60/4803329
ctttttat

SEQ ID NO: 143197 - DNA, 8 bp, Unknown
  misc_feature (1)..( 8): Result.003 file - promoters60/4803329
atttttaa

SEQ ID NO: 143198 - DNA, 8 bp, Unknown
  misc_feature (1)..( 8): Result.003 file - promoters60/4803329
atttgtac

SEQ ID NO: 143199 - DNA, 10 bp, Unknown
  misc_feature (1)..( 10): Result.003 file - promoters60/4803329
tttttttttt

SEQ ID NO: 143200 - DNA, 10 bp, Unknown
  misc_feature (1)..( 10): Result.003 file - promoters60/4803329
tttattttaa

SEQ ID NO: 143201 - DNA, 10 bp, Unknown
  misc_feature (1)..( 10): Result.003 file - promoters60/4803329
tctattttaa

SEQ ID NO: 143202 - DNA, 10 bp, Unknown
  misc_feature (1)..( 10): Result.003 file - promoters60/4803329
catatattat

SEQ ID NO: 143203 - DNA, 11 bp, Unknown
  misc_feature (1)..( 11): Result.003 file - promoters60/4803329
gaagataaaga

SEQ ID NO: 143204 - DNA, 11 bp, Unknown
  misc_feature (1)..( 11): Result.003 file - promoters60/4803329
gaagacaaacc

SEQ ID NO: 143205 - DNA, 11 bp, Unknown
  misc_feature (1)..( 11): Result.003 file - promoters60/4803329
gtggataaaat

SEQ ID NO: 143206 - DNA, 11 bp, Unknown
  misc_feature (1)..( 11): Result.003 file - promoters60/4803329
ttctacaaact

SEQ ID NO: 143207 - DNA, 11 bp, Unknown
  misc_feature (1)..( 11): Result.003 file - promoters60/4803329
acgactaaaaa

SEQ ID NO: 143208 - DNA, 13 bp, Unknown
  misc_feature (1)..( 13): Result.003 file - promoters60/4803329
tttgttgactttg

SEQ ID NO: 143209 - DNA, 13 bp, Unknown
  misc_feature (1)..( 13): Result.003 file - promoters60/4803329
aaaattgaatttg

SEQ ID NO: 143210 - DNA, 13 bp, Unknown
  misc_feature (1)..( 13): Result.003 file - promoters60/4803329
aaaactgaaatca

SEQ ID NO: 143211 - DNA, 13 bp, Unknown
  misc_feature (1)..( 13): Result.003 file - promoters60/4803329
tatattgaagttt

SEQ ID NO: 143212 - DNA, 7 bp, Unknown
  misc_feature (1)..( 7): Result.003 file - promoters60/4806023
cagcttt

SEQ ID NO: 143213 - DNA, 7 bp, Unknown
  misc_feature (1)..( 7): Result.003 file - promoters60/4806023
cagtttt

SEQ ID NO: 143214 - DNA, 8 bp, Unknown
  misc_feature (1)..( 8): Result.003 file - promoters60/4806023
aaatttat

SEQ ID NO: 143215 - DNA, 8 bp, Unknown
  misc_feature (1)..( 8): Result.003 file - promoters60/4806023
aaacttat

SEQ ID NO: 143216 - DNA, 6 bp, Unknown
  misc_feature (1)..( 6): Result.003 file - promoters60/4806023
caactt

SEQ ID NO: 143217 - DNA, 6 bp, Unknown
  misc_feature (1)..( 6): Result.003 file - promoters60/4806023
caactt

SEQ ID NO: 143218 - DNA, 6 bp, Unknown
  misc_feature (1)..( 6): Result.003 file - promoters60/4806023
ggccca

SEQ ID NO: 143219 - DNA, 6 bp, Unknown
  misc_feature (1)..( 6): Result.003 file - promoters60/4806023
ggccca

SEQ ID NO: 143220 - DNA, 6 bp, Unknown
  misc_feature (1)..( 6): Result.003 file - promoters60/4806023
aacaaa

SEQ ID NO: 143221 - DNA, 6 bp, Unknown
  misc_feature (1)..( 6): Result.003 file - promoters60/4806023
aacaaa

SEQ ID NO: 143222 - DNA, 6 bp, Unknown
  misc_feature (1)..( 6): Result.003 file - promoters60/4806023
caaaaa

SEQ ID NO: 143223 - DNA, 6 bp, Unknown
  misc_feature (1)..( 6): Result.003 file - promoters60/4806023
caaaaa

SEQ ID NO: 143224 - DNA, 6 bp, Unknown
  misc_feature (1)..( 6): Result.003 file - promoters60/4806023
tcactt

SEQ ID NO: 143225 - DNA, 6 bp, Unknown
  misc_feature (1)..( 6): Result.003 file - promoters60/4806023
tcactt

SEQ ID NO: 143226 - DNA, 7 bp, Unknown
  misc_feature (1)..( 7): Result.003 file - promoters60/4806023
aaccgtt

SEQ ID NO: 143227 - DNA, 7 bp, Unknown
  misc_feature (1)..( 7): Result.003 file - promoters60/4806023
gaccgtt

SEQ ID NO: 143228 - DNA, 7 bp, Unknown
  misc_feature (1)..( 7): Result.003 file - promoters60/4806023
gaccgtg

SEQ ID NO: 143229 - DNA, 10 bp, Unknown
  misc_feature (1)..( 10): Result.003 file - promoters60/4806023
ctctttattt

SEQ ID NO: 143230 - DNA, 10 bp, Unknown
  misc_feature (1)..( 10): Result.003 file - promoters60/4806023
atcttgattt

SEQ ID NO: 143231 - DNA, 10 bp, Unknown
  misc_feature (1)..( 10): Result.003 file - promoters60/4806023
atcttgaata

SEQ ID NO: 143232 - DNA, 7 bp, Unknown
  misc_feature (1)..( 7): Result.003 file - promoters60/4806023
ggtgtca

SEQ ID NO: 143233 - DNA, 7 bp, Unknown
  misc_feature (1)..( 7): Result.003 file - promoters60/4806023
ggtctca

SEQ ID NO: 143234 - DNA, 6 bp, Unknown
  misc_feature (1)..( 6): Result.003 file - promoters60/4806023
tcaaga

SEQ ID NO: 143235 - DNA, 6 bp, Unknown
  misc_feature (1)..( 6): Result.003 file - promoters60/4806023
tcaaga

SEQ ID NO: 143236 - DNA, 6 bp, Unknown
  misc_feature (1)..( 6): Result.003 file - promoters60/4806023
ctgttt

SEQ ID NO: 143237 - DNA, 6 bp, Unknown
  misc_feature (1)..( 6): Result.003 file - promoters60/4806023
ctgttt

SEQ ID NO: 143238 - DNA, 9 bp, Unknown
  misc_feature (1)..( 9): Result.003 file - promoters60/4806023
tcacaattc

SEQ ID NO: 143239 - DNA, 9 bp, Unknown
  misc_feature (1)..( 9): Result.003 file - promoters60/4806023
tcataattc

SEQ ID NO: 143240 - DNA, 7 bp, Unknown
  misc_feature (1)..( 7): Result.003 file - promoters60/4806023
tcaaata

SEQ ID NO: 143241 - DNA, 7 bp, Unknown
  misc_feature (1)..( 7): Result.003 file - promoters60/4806023
tcacata

SEQ ID NO: 143242 - DNA, 6 bp, Unknown
  misc_feature (1)..( 6): Result.003 file - promoters60/4806023
ccattg

SEQ ID NO: 143243 - DNA, 6 bp, Unknown
  misc_feature (1)..( 6): Result.003 file - promoters60/4806023
ccattg

SEQ ID NO: 143244 - DNA, 7 bp, Unknown
  misc_feature (1)..( 7): Result.003 file - promoters60/4806023
ttctgga

SEQ ID NO: 143245 - DNA, 7 bp, Unknown
  misc_feature (1)..( 7): Result.003 file - promoters60/4806023
ttccgga

SEQ ID NO: 143246 - DNA, 8 bp, Unknown
  misc_feature (1)..( 8): Result.003 file - promoters60/4806023
gtttaaat

SEQ ID NO: 143247 - DNA, 8 bp, Unknown
  misc_feature (1)..( 8): Result.003 file - promoters60/4806023
gttttaat

SEQ ID NO: 143248 - DNA, 12 bp, Unknown
  misc_feature (1)..( 12): Result.003 file - promoters60/4807018
caatttcactcc

SEQ ID NO: 143249 - DNA, 12 bp, Unknown
  misc_feature (1)..( 12): Result.003 file - promoters60/4807018
acgttttactga

SEQ ID NO: 143250 - DNA, 12 bp, Unknown
  misc_feature (1)..( 12): Result.003 file - promoters60/4807018
aaatatcagtgg

SEQ ID NO: 143251 - DNA, 12 bp, Unknown
  misc_feature (1)..( 12): Result.003 file - promoters60/4807018
tgtttttacgtg

SEQ ID NO: 143252 - DNA, 12 bp, Unknown
  misc_feature (1)..( 12): Result.003 file - promoters60/4807018
actttttagtga

SEQ ID NO: 143253 - DNA, 13 bp, Unknown
  misc_feature (1)..( 13): Result.003 file - promoters60/4807018
tacttcttattgg

SEQ ID NO: 143254 - DNA, 13 bp, Unknown
  misc_feature (1)..( 13): Result.003 file - promoters60/4807018
ctctgcttgtaaa

SEQ ID NO: 143255 - DNA, 10 bp, Unknown
  misc_feature (1)..( 10): Result.003 file - promoters60/4807018
caaaaccaaa

SEQ ID NO: 143256 - DNA, 10 bp, Unknown
  misc_feature (1)..( 10): Result.003 file - promoters60/4807018
aaaaatcaaa

SEQ ID NO: 143257 - DNA, 10 bp, Unknown
  misc_feature (1)..( 10): Result.003 file - promoters60/4807018
caaaacatag

SEQ ID NO: 143258 - DNA, 10 bp, Unknown
  misc_feature (1)..( 10): Result.003 file - promoters60/4807018
aagaaccaat

SEQ ID NO: 143259 - DNA, 10 bp, Unknown
  misc_feature (1)..( 10): Result.003 file - promoters60/4807018
tataaccaaa

SEQ ID NO: 143260 - DNA, 10 bp, Unknown
  misc_feature (1)..( 10): Result.003 file - promoters60/4807018
aataacaaat

SEQ ID NO: 143261 - DNA, 14 bp, Unknown
  misc_feature (1)..( 14): Result.003 file - promoters60/4807018
ttcttttatttcct

SEQ ID NO: 143262 - DNA, 14 bp, Unknown
  misc_feature (1)..( 14): Result.003 file - promoters60/4807018
atctattagtgtgg

SEQ ID NO: 143263 - DNA, 14 bp, Unknown
  misc_feature (1)..( 14): Result.003 file - promoters60/4807018
actttttgtttcct

SEQ ID NO: 143264 - DNA, 14 bp, Unknown
  misc_feature (1)..( 14): Result.003 file - promoters60/4807018
tattattagatccg

SEQ ID NO: 143265 - DNA, 14 bp, Unknown
  misc_feature (1)..( 14): Result.003 file - promoters60/4807018
atctatgatttctt

SEQ ID NO: 143266 - DNA, 14 bp, Unknown
  misc_feature (1)..( 14): Result.003 file - promoters60/4807018
tcctttttgtatca

SEQ ID NO: 143267 - DNA, 18 bp, Unknown
  misc_feature (1)..( 18): Result.003 file - promoters60/4807026
tacaacaaagttttgata

SEQ ID NO: 143268 - DNA, 18 bp, Unknown
  misc_feature (1)..( 18): Result.003 file - promoters60/4807026
accaaaaaagaagagcga

SEQ ID NO: 143269 - DNA, 18 bp, Unknown
  misc_feature (1)..( 18): Result.003 file - promoters60/4807026
gaaaaaaaagacaaacgg

SEQ ID NO: 143270 - DNA, 18 bp, Unknown
  misc_feature (1)..( 18): Result.003 file - promoters60/4807026
gttaaaaaatattattag

SEQ ID NO: 143271 - DNA, 18 bp, Unknown
  misc_feature (1)..( 18): Result.003 file - promoters60/4807026
ttaaaaaaagaagaaaaa

SEQ ID NO: 143272 - DNA, 18 bp, Unknown
  misc_feature (1)..( 18): Result.003 file - promoters60/4807026
atcgaaatagataacgtt

SEQ ID NO: 143273 - DNA, 18 bp, Unknown
  misc_feature (1)..( 18): Result.003 file - promoters60/4807026
accagaaatgaatttaga

SEQ ID NO: 143274 - DNA, 11 bp, Unknown
  misc_feature (1)..( 11): Result.003 file - promoters60/4807026
actatataaga

SEQ ID NO: 143275 - DNA, 11 bp, Unknown
  misc_feature (1)..( 11): Result.003 file - promoters60/4807026
catatataaat

SEQ ID NO: 143276 - DNA, 11 bp, Unknown
  misc_feature (1)..( 11): Result.003 file - promoters60/4807026
gagatataata

SEQ ID NO: 143277 - DNA, 11 bp, Unknown
  misc_feature (1)..( 11): Result.003 file - promoters60/4807026
tccctataaat

SEQ ID NO: 143278 - DNA, 11 bp, Unknown
  misc_feature (1)..( 11): Result.003 file - promoters60/4807026
tccttataaat

SEQ ID NO: 143279 - DNA, 11 bp, Unknown
  misc_feature (1)..( 11): Result.003 file - promoters60/4807026
tgatgatcctt

SEQ ID NO: 143280 - DNA, 11 bp, Unknown
  misc_feature (1)..( 11): Result.003 file - promoters60/4807026
gccttaaaaac

SEQ ID NO: 143281 - DNA, 11 bp, Unknown
  misc_feature (1)..( 11): Result.003 file - promoters60/4807026
ttcttatatct

SEQ ID NO: 143282 - DNA, 9 bp, Unknown
  misc_feature (1)..( 9): Result.003 file - promoters60/4807026
atattaata

SEQ ID NO: 143283 - DNA, 9 bp, Unknown
  misc_feature (1)..( 9): Result.003 file - promoters60/4807026
atataaata

SEQ ID NO: 143284 - DNA, 9 bp, Unknown
  misc_feature (1)..( 9): Result.003 file - promoters60/4807026
aaattaata

SEQ ID NO: 143285 - DNA, 9 bp, Unknown
  misc_feature (1)..( 9): Result.003 file - promoters60/4807026
ttataaaat

SEQ ID NO: 143286 - DNA, 9 bp, Unknown
  misc_feature (1)..( 9): Result.003 file - promoters60/4807026
ttataatca

SEQ ID NO: 143287 - DNA, 9 bp, Unknown
  misc_feature (1)..( 9): Result.003 file - promoters60/4807026
gtatcaaac

SEQ ID NO: 143288 - DNA, 15 bp, Unknown
  misc_feature (1)..( 15): Result.003 file - promoters60/4807026
atttggataaaacgc

SEQ ID NO: 143289 - DNA, 15 bp, Unknown
  misc_feature (1)..( 15): Result.003 file - promoters60/4807026
ctttgaataaaagct

SEQ ID NO: 143290 - DNA, 15 bp, Unknown
  misc_feature (1)..( 15): Result.003 file - promoters60/4807026
atatggataagtata

SEQ ID NO: 143291 - DNA, 15 bp, Unknown
  misc_feature (1)..( 15): Result.003 file - promoters60/4807026
gcttctttaacagct

SEQ ID NO: 143292 - DNA, 15 bp, Unknown
  misc_feature (1)..( 15): Result.003 file - promoters60/4807026
atcccacaaacagca

SEQ ID NO: 143293 - DNA, 15 bp, Unknown
  misc_feature (1)..( 15): Result.003 file - promoters60/4807026
ctttgaacattaaag

SEQ ID NO: 143294 - DNA, 15 bp, Unknown
  misc_feature (1)..( 15): Result.003 file - promoters60/4807026
atttgaacgtcgaat

SEQ ID NO: 143295 - DNA, 13 bp, Unknown
  misc_feature (1)..( 13): Result.003 file - promoters60/4807236
ttttaagtaaact

SEQ ID NO: 143296 - DNA, 13 bp, Unknown
  misc_feature (1)..( 13): Result.003 file - promoters60/4807236
ttttaacaataag

SEQ ID NO: 143297 - DNA, 13 bp, Unknown
  misc_feature (1)..( 13): Result.003 file - promoters60/4807236
atttagcaaaaag

SEQ ID NO: 143298 - DNA, 13 bp, Unknown
  misc_feature (1)..( 13): Result.003 file - promoters60/4807236
tcttagcaataaa

SEQ ID NO: 143299 - DNA, 9 bp, Unknown
  misc_feature (1)..( 9): Result.003 file - promoters60/4807258
cttgttttg

SEQ ID NO: 143300 - DNA, 9 bp, Unknown
  misc_feature (1)..( 9): Result.003 file - promoters60/4807258
tatgttttt

SEQ ID NO: 143301 - DNA, 9 bp, Unknown
  misc_feature (1)..( 9): Result.003 file - promoters60/4807258
cttgtttca

SEQ ID NO: 143302 - DNA, 9 bp, Unknown
  misc_feature (1)..( 9): Result.003 file - promoters60/4807258
tgagttttt

SEQ ID NO: 143303 - DNA, 7 bp, Unknown
  misc_feature (1)..( 7): Result.003 file - promoters60/4808052
gaaccat

SEQ ID NO: 143304 - DNA, 7 bp, Unknown
  misc_feature (1)..( 7): Result.003 file - promoters60/4808052
aaaccat

SEQ ID NO: 143305 - DNA, 7 bp, Unknown
  misc_feature (1)..( 7): Result.003 file - promoters60/4808052
aaaccaa

SEQ ID NO: 143306 - DNA, 10 bp, Unknown
  misc_feature (1)..( 10): Result.003 file - promoters60/4808052
ggtcaaaaac

SEQ ID NO: 143307 - DNA, 10 bp, Unknown
  misc_feature (1)..( 10): Result.003 file - promoters60/4808052
ggacaaaaac

SEQ ID NO: 143308 - DNA, 10 bp, Unknown
  misc_feature (1)..( 10): Result.003 file - promoters60/4808052
gaccaaaaga

SEQ ID NO: 143309 - DNA, 7 bp, Unknown
  misc_feature (1)..( 7): Result.003 file - promoters60/4808052
ttacaaa

SEQ ID NO: 143310 - DNA, 7 bp, Unknown
  misc_feature (1)..( 7): Result.003 file - promoters60/4808052
ttaaaaa

SEQ ID NO: 143311 - DNA, 7 bp, Unknown
  misc_feature (1)..( 7): Result.003 file - promoters60/4808052
ttaaaat

SEQ ID NO: 143312 - DNA, 7 bp, Unknown
  misc_feature (1)..( 7): Result.003 file - promoters60/4808052
caaatta

SEQ ID NO: 143313 - DNA, 7 bp, Unknown
  misc_feature (1)..( 7): Result.003 file - promoters60/4808052
aaaatta

SEQ ID NO: 143314 - DNA, 7 bp, Unknown
  misc_feature (1)..( 7): Result.003 file - promoters60/4808052
aaaattt

SEQ ID NO: 143315 - DNA, 7 bp, Unknown
  misc_feature (1)..( 7): Result.003 file - promoters60/4808052
agaccaa

SEQ ID NO: 143316 - DNA, 7 bp, Unknown
  misc_feature (1)..( 7): Result.003 file - promoters60/4808052
agatcaa

SEQ ID NO: 143317 - DNA, 7 bp, Unknown
  misc_feature (1)..( 7): Result.003 file - promoters60/4808052
ggatcaa

SEQ ID NO: 143318 - DNA, 6 bp, Unknown
  misc_feature (1)..( 6): Result.003 file - promoters60/4809801
ttttgc

SEQ ID NO: 143319 - DNA, 6 bp, Unknown
  misc_feature (1)..( 6): Result.003 file - promoters60/4809801
ttttgc

SEQ ID NO: 143320 - DNA, 9 bp, Unknown
  misc_feature (1)..( 9): Result.003 file - promoters60/4809801
atttccatg

SEQ ID NO: 143321 - DNA, 9 bp, Unknown
  misc_feature (1)..( 9): Result.003 file - promoters60/4809801
tcctccatg

SEQ ID NO: 143322 - DNA, 9 bp, Unknown
  misc_feature (1)..( 9): Result.003 file - promoters60/4809801
attgccatc

SEQ ID NO: 143323 - DNA, 7 bp, Unknown
  misc_feature (1)..( 7): Result.003 file - promoters60/4809801
atgtatg

SEQ ID NO: 143324 - DNA, 7 bp, Unknown
  misc_feature (1)..( 7): Result.003 file - promoters60/4809801
atgcatg

SEQ ID NO: 143325 - DNA, 7 bp, Unknown
  misc_feature (1)..( 7): Result.003 file - promoters60/4809801
ctaagga

SEQ ID NO: 143326 - DNA, 7 bp, Unknown
  misc_feature (1)..( 7): Result.003 file - promoters60/4809801
ctatgga

SEQ ID NO: 143327 - DNA, 7 bp, Unknown
  misc_feature (1)..( 7): Result.003 file - promoters60/4809801
ttgtgtt

SEQ ID NO: 143328 - DNA, 7 bp, Unknown
  misc_feature (1)..( 7): Result.003 file - promoters60/4809801
ttgtgtt

SEQ ID NO: 143329 - DNA, 7 bp, Unknown
  misc_feature (1)..( 7): Result.003 file - promoters60/4809801
caggaga

SEQ ID NO: 143330 - DNA, 7 bp, Unknown
  misc_feature (1)..( 7): Result.003 file - promoters60/4809801
cagaaga

SEQ ID NO: 143331 - DNA, 6 bp, Unknown
  misc_feature (1)..( 6): Result.003 file - promoters60/4809801
agatct

SEQ ID NO: 143332 - DNA, 6 bp, Unknown
  misc_feature (1)..( 6): Result.003 file - promoters60/4809801
agatct

SEQ ID NO: 143333 - DNA, 6 bp, Unknown
  misc_feature (1)..( 6): Result.003 file - promoters60/4809801
gaagaa

SEQ ID NO: 143334 - DNA, 6 bp, Unknown
  misc_feature (1)..( 6): Result.003 file - promoters60/4809801
gaagaa

SEQ ID NO: 143335 - DNA, 6 bp, Unknown
  misc_feature (1)..( 6): Result.003 file - promoters60/4809801
tttctt

SEQ ID NO: 143336 - DNA, 6 bp, Unknown
  misc_feature (1)..( 6): Result.003 file - promoters60/4809801
tttctt

SEQ ID NO: 143337 - DNA, 6 bp, Unknown
  misc_feature (1)..( 6): Result.003 file - promoters60/4809801
tttcaa

SEQ ID NO: 143338 - DNA, 6 bp, Unknown
  misc_feature (1)..( 6): Result.003 file - promoters60/4809801
tttcaa

SEQ ID NO: 143339 - DNA, 6 bp, Unknown
  misc_feature (1)..( 6): Result.003 file - promoters60/4809801
ctcatt

SEQ ID NO: 143340 - DNA, 6 bp, Unknown
  misc_feature (1)..( 6): Result.003 file - promoters60/4809801
ctcatt

SEQ ID NO: 143341 - DNA, 7 bp, Unknown
  misc_feature (1)..( 7): Result.003 file - promoters60/4809801
ctcttcc

SEQ ID NO: 143342 - DNA, 7 bp, Unknown
  misc_feature (1)..( 7): Result.003 file - promoters60/4809801
ctcctcc

SEQ ID NO: 143343 - DNA, 6 bp, Unknown
  misc_feature (1)..( 6): Result.003 file - promoters60/4811854
atctct

SEQ ID NO: 143344 - DNA, 6 bp, Unknown
  misc_feature (1)..( 6): Result.003 file - promoters60/4811854
atctct

SEQ ID NO: 143345 - DNA, 6 bp, Unknown
  misc_feature (1)..( 6): Result.003 file - promoters60/4811854
atatgt

SEQ ID NO: 143346 - DNA, 6 bp, Unknown
  misc_feature (1)..( 6): Result.003 file - promoters60/4811854
atatgt

SEQ ID NO: 143347 - DNA, 8 bp, Unknown
  misc_feature (1)..( 8): Result.003 file - promoters60/4811854
tttaattt

SEQ ID NO: 143348 - DNA, 8 bp, Unknown
  misc_feature (1)..( 8): Result.003 file - promoters60/4811854
attagttt

SEQ ID NO: 143349 - DNA, 8 bp, Unknown
  misc_feature (1)..( 8): Result.003 file - promoters60/4811854
tttcattc

SEQ ID NO: 143350 - DNA, 6 bp, Unknown
  misc_feature (1)..( 6): Result.003 file - promoters60/4811854
tttcat

SEQ ID NO: 143351 - DNA, 6 bp, Unknown
  misc_feature (1)..( 6): Result.003 file - promoters60/4811854
tttcat

SEQ ID NO: 143352 - DNA, 6 bp, Unknown
  misc_feature (1)..( 6): Result.003 file - promoters60/4811854
tttcat

SEQ ID NO: 143353 - DNA, 8 bp, Unknown
  misc_feature (1)..( 8): Result.003 file - promoters60/4811854
aagtataa

SEQ ID NO: 143354 - DNA, 8 bp, Unknown
  misc_feature (1)..( 8): Result.003 file - promoters60/4811854
aagtttaa

SEQ ID NO: 143355 - DNA, 13 bp, Unknown
  misc_feature (1)..( 13): Result.003 file - promoters60/4811854
cgacgattatata

SEQ ID NO: 143356 - DNA, 13 bp, Unknown
  misc_feature (1)..( 13): Result.003 file - promoters60/4811854
aaattattttata

SEQ ID NO: 143357 - DNA, 13 bp, Unknown
  misc_feature (1)..( 13): Result.003 file - promoters60/4811854
ttaaaattaattt

SEQ ID NO: 143358 - DNA, 7 bp, Unknown
  misc_feature (1)..( 7): Result.003 file - promoters60/4811854
aaatatg

SEQ ID NO: 143359 - DNA, 7 bp, Unknown
  misc_feature (1)..( 7): Result.003 file - promoters60/4811854
aaaaatg

SEQ ID NO: 143360 - DNA, 12 bp, Unknown
  misc_feature (1)..( 12): Result.003 file - promoters60/4811854
tcctcacgatta

SEQ ID NO: 143361 - DNA, 12 bp, Unknown
  misc_feature (1)..( 12): Result.003 file - promoters60/4811854
tcctcgcgatta

SEQ ID NO: 143362 - DNA, 6 bp, Unknown
  misc_feature (1)..( 6): Result.003 file - promoters60/4811854
gctctt

SEQ ID NO: 143363 - DNA, 6 bp, Unknown
  misc_feature (1)..( 6): Result.003 file - promoters60/4811854
gctctt

SEQ ID NO: 143364 - DNA, 6 bp, Unknown
  misc_feature (1)..( 6): Result.003 file - promoters60/4811854
cctcaa

SEQ ID NO: 143365 - DNA, 6 bp, Unknown
  misc_feature (1)..( 6): Result.003 file - promoters60/4811854
cctcaa

SEQ ID NO: 143366 - DNA, 8 bp, Unknown
  misc_feature (1)..( 8): Result.003 file - promoters60/4811854
tctaaatt

SEQ ID NO: 143367 - DNA, 8 bp, Unknown
  misc_feature (1)..( 8): Result.003 file - promoters60/4811854
tctatatt

SEQ ID NO: 143368 - DNA, 8 bp, Unknown
  misc_feature (1)..( 8): Result.003 file - promoters60/4811854
tctctatc

SEQ ID NO: 143369 - DNA, 6 bp, Unknown
  misc_feature (1)..( 6): Result.003 file - promoters60/4811854
gatttt

SEQ ID NO: 143370 - DNA, 6 bp, Unknown
  misc_feature (1)..( 6): Result.003 file - promoters60/4811854
gatttt

SEQ ID NO: 143371 - DNA, 6 bp, Unknown
  misc_feature (1)..( 6): Result.003 file - promoters60/4811854
tacata

SEQ ID NO: 143372 - DNA, 6 bp, Unknown
  misc_feature (1)..( 6): Result.003 file - promoters60/4811854
tacata

SEQ ID NO: 143373 - DNA, 10 bp, Unknown
  misc_feature (1)..( 10): Result.003 file - promoters60/4811854
attaatattt

SEQ ID NO: 143374 - DNA, 10 bp, Unknown
  misc_feature (1)..( 10): Result.003 file - promoters60/4811854
attaattttt

SEQ ID NO: 143375 - DNA, 10 bp, Unknown
  misc_feature (1)..( 10): Result.003 file - promoters60/4811854
tataatttaa

SEQ ID NO: 143376 - DNA, 7 bp, Unknown
  misc_feature (1)..( 7): Result.003 file - promoters60/4811854
catcaca

SEQ ID NO: 143377 - DNA, 7 bp, Unknown
  misc_feature (1)..( 7): Result.003 file - promoters60/4811854
catcaca

SEQ ID NO: 143378 - DNA, 8 bp, Unknown
  misc_feature (1)..( 8): Result.003 file - promoters60/4811854
aaaataca

SEQ ID NO: 143379 - DNA, 8 bp, Unknown
  misc_feature (1)..( 8): Result.003 file - promoters60/4811854
aaaaaaca

SEQ ID NO: 143380 - DNA, 6 bp, Unknown
  misc_feature (1)..( 6): Result.003 file - promoters60/4811854
tttaaa

SEQ ID NO: 143381 - DNA, 6 bp, Unknown
  misc_feature (1)..( 6): Result.003 file - promoters60/4811854
tttaaa

SEQ ID NO: 143382 - DNA, 9 bp, Unknown
  misc_feature (1)..( 9): Result.003 file - promoters60/4811854
atctaattt

SEQ ID NO: 143383 - DNA, 9 bp, Unknown
  misc_feature (1)..( 9): Result.003 file - promoters60/4811854
atctcattt

SEQ ID NO: 143384 - DNA, 7 bp, Unknown
  misc_feature (1)..( 7): Result.003 file - promoters60/4811854
ttaaaat

SEQ ID NO: 143385 - DNA, 7 bp, Unknown
  misc_feature (1)..( 7): Result.003 file - promoters60/4811854
ttaaaat

SEQ ID NO: 143386 - DNA, 6 bp, Unknown
  misc_feature (1)..( 6): Result.003 file - promoters60/4811854
aaatta

SEQ ID NO: 143387 - DNA, 6 bp, Unknown
  misc_feature (1)..( 6): Result.003 file - promoters60/4811854
aaatta

SEQ ID NO: 143388 - DNA, 9 bp, Unknown
  misc_feature (1)..( 9): Result.003 file - promoters60/4811854
gtatttttc

SEQ ID NO: 143389 - DNA, 9 bp, Unknown
  misc_feature (1)..( 9): Result.003 file - promoters60/4811854
gtatatttc

SEQ ID NO: 143390 - DNA, 7 bp, Unknown
  misc_feature (1)..( 7): Result.003 file - promoters60/4811854
ggatgct

SEQ ID NO: 143391 - DNA, 7 bp, Unknown
  misc_feature (1)..( 7): Result.003 file - promoters60/4811854
ggacgct

SEQ ID NO: 143392 - DNA, 6 bp, Unknown
  misc_feature (1)..( 6): Result.003 file - promoters60/4811854
aaataa

SEQ ID NO: 143393 - DNA, 6 bp, Unknown
  misc_feature (1)..( 6): Result.003 file - promoters60/4811854
aaataa

SEQ ID NO: 143394 - DNA, 6 bp, Unknown
  misc_feature (1)..( 6): Result.003 file - promoters60/4811854
taaata

SEQ ID NO: 143395 - DNA, 6 bp, Unknown
  misc_feature (1)..( 6): Result.003 file - promoters60/4811854
taaata

SEQ ID NO: 143396 - DNA, 6 bp, Unknown
  misc_feature (1)..( 6): Result.003 file - promoters60/4811854
attaaa

SEQ ID NO: 143397 - DNA, 6 bp, Unknown
  misc_feature (1)..( 6): Result.003 file - promoters60/4811854
attaaa

SEQ ID NO: 143398 - DNA, 8 bp, Unknown
  misc_feature (1)..( 8): Result.003 file - promoters60/4811854
aaaagtta

SEQ ID NO: 143399 - DNA, 8 bp, Unknown
  misc_feature (1)..( 8): Result.003 file - promoters60/4811854
aaaagtta

SEQ ID NO: 143400 - DNA, 7 bp, Unknown
  misc_feature (1)..( 7): Result.003 file - promoters60/4811854
catctat

SEQ ID NO: 143401 - DNA, 7 bp, Unknown
  misc_feature (1)..( 7): Result.003 file - promoters60/4811854
catttat

SEQ ID NO: 143402 - DNA, 8 bp, Unknown
  misc_feature (1)..( 8): Result.003 file - promoters60/4811975
atattact

SEQ ID NO: 143403 - DNA, 8 bp, Unknown
  misc_feature (1)..( 8): Result.003 file - promoters60/4811975
atactact

SEQ ID NO: 143404 - DNA, 7 bp, Unknown
  misc_feature (1)..( 7): Result.003 file - promoters60/4811975
caaatac

SEQ ID NO: 143405 - DNA, 7 bp, Unknown
  misc_feature (1)..( 7): Result.003 file - promoters60/4811975
caattac

SEQ ID NO: 143406 - DNA, 11 bp, Unknown
  misc_feature (1)..( 11): Result.003 file - promoters60/4811975
tatattaaata

SEQ ID NO: 143407 - DNA, 11 bp, Unknown
  misc_feature (1)..( 11): Result.003 file - promoters60/4811975
tatattttttt

SEQ ID NO: 143408 - DNA, 11 bp, Unknown
  misc_feature (1)..( 11): Result.003 file - promoters60/4811975
gatattttttt

SEQ ID NO: 143409 - DNA, 6 bp, Unknown
  misc_feature (1)..( 6): Result.003 file - promoters60/4811975
tatatg

SEQ ID NO: 143410 - DNA, 6 bp, Unknown
  misc_feature (1)..( 6): Result.003 file - promoters60/4811975
tatatg

SEQ ID NO: 143411 - DNA, 6 bp, Unknown
  misc_feature (1)..( 6): Result.003 file - promoters60/4811975
ttcaaa

SEQ ID NO: 143412 - DNA, 6 bp, Unknown
  misc_feature (1)..( 6): Result.003 file - promoters60/4811975
ttcaaa

SEQ ID NO: 143413 - DNA, 9 bp, Unknown
  misc_feature (1)..( 9): Result.003 file - promoters60/4811975
atactctca

SEQ ID NO: 143414 - DNA, 9 bp, Unknown
  misc_feature (1)..( 9): Result.003 file - promoters60/4811975
atattctca

SEQ ID NO: 143415 - DNA, 6 bp, Unknown
  misc_feature (1)..( 6): Result.003 file - promoters60/4811975
tcaaac

SEQ ID NO: 143416 - DNA, 6 bp, Unknown
  misc_feature (1)..( 6): Result.003 file - promoters60/4811975
tcaaac

SEQ ID NO: 143417 - DNA, 6 bp, Unknown
  misc_feature (1)..( 6): Result.003 file - promoters60/4811975
ttttct

SEQ ID NO: 143418 - DNA, 6 bp, Unknown
  misc_feature (1)..( 6): Result.003 file - promoters60/4811975
ttttct

SEQ ID NO: 143419 - DNA, 7 bp, Unknown
  misc_feature (1)..( 7): Result.003 file - promoters60/4811975
gaattca

SEQ ID NO: 143420 - DNA, 7 bp, Unknown
  misc_feature (1)..( 7): Result.003 file - promoters60/4811975
gaaatca

SEQ ID NO: 143421 - DNA, 6 bp, Unknown
  misc_feature (1)..( 6): Result.003 file - promoters60/4811975
atcttg

SEQ ID NO: 143422 - DNA, 6 bp, Unknown
  misc_feature (1)..( 6): Result.003 file - promoters60/4811975
atcttg

SEQ ID NO: 143423 - DNA, 6 bp, Unknown
  misc_feature (1)..( 6): Result.003 file - promoters60/4811975
acacaa

SEQ ID NO: 143424 - DNA, 6 bp, Unknown
  misc_feature (1)..( 6): Result.003 file - promoters60/4811975
acacaa

SEQ ID NO: 143425 - DNA, 12 bp, Unknown
  misc_feature (1)..( 12): Result.003 file - promoters60/4811975
atgttttcaata

SEQ ID NO: 143426 - DNA, 12 bp, Unknown
  misc_feature (1)..( 12): Result.003 file - promoters60/4811975
atttttttaata

SEQ ID NO: 143427 - DNA, 12 bp, Unknown
  misc_feature (1)..( 12): Result.003 file - promoters60/4811975
atattttttttt

SEQ ID NO: 143428 - DNA, 7 bp, Unknown
  misc_feature (1)..( 7): Result.003 file - promoters60/4811975
actattc

SEQ ID NO: 143429 - DNA, 7 bp, Unknown
  misc_feature (1)..( 7): Result.003 file - promoters60/4811975
actcttc

SEQ ID NO: 143430 - DNA, 11 bp, Unknown
  misc_feature (1)..( 11): Result.003 file - promoters60/4811975
accggttatta

SEQ ID NO: 143431 - DNA, 11 bp, Unknown
  misc_feature (1)..( 11): Result.003 file - promoters60/4811975
accggatatta

SEQ ID NO: 143432 - DNA, 6 bp, Unknown
  misc_feature (1)..( 6): Result.003 file - promoters60/4811975
tactgt

SEQ ID NO: 143433 - DNA, 6 bp, Unknown
  misc_feature (1)..( 6): Result.003 file - promoters60/4811975
tactgt

SEQ ID NO: 143434 - DNA, 9 bp, Unknown
  misc_feature (1)..( 9): Result.003 file - promoters60/4811975
tcaaaattt

SEQ ID NO: 143435 - DNA, 9 bp, Unknown
  misc_feature (1)..( 9): Result.003 file - promoters60/4811975
tcagaattt

SEQ ID NO: 143436 - DNA, 6 bp, Unknown
  misc_feature (1)..( 6): Result.003 file - promoters60/4811975
ttgaaa

SEQ ID NO: 143437 - DNA, 6 bp, Unknown
  misc_feature (1)..( 6): Result.003 file - promoters60/4811975
ttgaaa

SEQ ID NO: 143438 - DNA, 7 bp, Unknown
  misc_feature (1)..( 7): Result.003 file - promoters60/4811975
cttctcc

SEQ ID NO: 143439 - DNA, 7 bp, Unknown
  misc_feature (1)..( 7): Result.003 file - promoters60/4811975
cttgtcc

SEQ ID NO: 143440 - DNA, 7 bp, Unknown
  misc_feature (1)..( 7): Result.003 file - promoters60/4811975
ttcatgt

SEQ ID NO: 143441 - DNA, 7 bp, Unknown
  misc_feature (1)..( 7): Result.003 file - promoters60/4811975
ttcatgt

SEQ ID NO: 143442 - DNA, 7 bp, Unknown
  misc_feature (1)..( 7): Result.003 file - promoters60/4811975
aagcttt

SEQ ID NO: 143443 - DNA, 7 bp, Unknown
  misc_feature (1)..( 7): Result.003 file - promoters60/4811975
aagattt

SEQ ID NO: 143444 - DNA, 7 bp, Unknown
  misc_feature (1)..( 7): Result.003 file - promoters60/4811975
tacctca

SEQ ID NO: 143445 - DNA, 7 bp, Unknown
  misc_feature (1)..( 7): Result.003 file - promoters60/4811975
tacctca

SEQ ID NO: 143446 - DNA, 7 bp, Unknown
  misc_feature (1)..( 7): Result.003 file - promoters60/4811975
ttttata

SEQ ID NO: 143447 - DNA, 7 bp, Unknown
  misc_feature (1)..( 7): Result.003 file - promoters60/4811975
tttgata

SEQ ID NO: 143448 - DNA, 9 bp, Unknown
  misc_feature (1)..( 9): Result.003 file - promoters60/4811975
catccttat

SEQ ID NO: 143449 - DNA, 9 bp, Unknown
  misc_feature (1)..( 9): Result.003 file - promoters60/4811975
catcattat

SEQ ID NO: 143450 - DNA, 7 bp, Unknown
  misc_feature (1)..( 7): Result.003 file - promoters60/4854186
caccgaa

SEQ ID NO: 143451 - DNA, 7 bp, Unknown
  misc_feature (1)..( 7): Result.003 file - promoters60/4854186
cacagaa

SEQ ID NO: 143452 - DNA, 8 bp, Unknown
  misc_feature (1)..( 8): Result.003 file - promoters60/4854186
aatcgata

SEQ ID NO: 143453 - DNA, 8 bp, Unknown
  misc_feature (1)..( 8): Result.003 file - promoters60/4854186
aatagata

SEQ ID NO: 143454 - DNA, 8 bp, Unknown
  misc_feature (1)..( 8): Result.003 file - promoters60/4854186
aatctata

SEQ ID NO: 143455 - DNA, 7 bp, Unknown
  misc_feature (1)..( 7): Result.003 file - promoters60/4854186
agaacgg

SEQ ID NO: 143456 - DNA, 7 bp, Unknown
  misc_feature (1)..( 7): Result.003 file - promoters60/4854186
agagcgg

SEQ ID NO: 143457 - DNA, 6 bp, Unknown
  misc_feature (1)..( 6): Result.003 file - promoters60/4854186
tgggct

SEQ ID NO: 143458 - DNA, 6 bp, Unknown
  misc_feature (1)..( 6): Result.003 file - promoters60/4854186
tgggct

SEQ ID NO: 143459 - DNA, 8 bp, Unknown
  misc_feature (1)..( 8): Result.003 file - promoters60/4854186
tttgatta

SEQ ID NO: 143460 - DNA, 8 bp, Unknown
  misc_feature (1)..( 8): Result.003 file - promoters60/4854186
ttttatta

SEQ ID NO: 143461 - DNA, 8 bp, Unknown
  misc_feature (1)..( 8): Result.003 file - promoters60/4854186
tattcata

SEQ ID NO: 143462 - DNA, 8 bp, Unknown
  misc_feature (1)..( 8): Result.003 file - promoters60/4854186
tatgcata

SEQ ID NO: 143463 - DNA, 6 bp, Unknown
  misc_feature (1)..( 6): Result.003 file - promoters60/4854186
ttagtg

SEQ ID NO: 143464 - DNA, 6 bp, Unknown
  misc_feature (1)..( 6): Result.003 file - promoters60/4854186
ttagtg

SEQ ID NO: 143465 - DNA, 7 bp, Unknown
  misc_feature (1)..( 7): Result.003 file - promoters60/4854186
ccctaat

SEQ ID NO: 143466 - DNA, 7 bp, Unknown
  misc_feature (1)..( 7): Result.003 file - promoters60/4854186
cccaaat

SEQ ID NO: 143467 - DNA, 7 bp, Unknown
  misc_feature (1)..( 7): Result.003 file - promoters60/4854186
aactaat

SEQ ID NO: 143468 - DNA, 7 bp, Unknown
  misc_feature (1)..( 7): Result.003 file - promoters60/4854186
aacaaat

SEQ ID NO: 143469 - DNA, 6 bp, Unknown
  misc_feature (1)..( 6): Result.003 file - promoters60/4854186
aaaatt

SEQ ID NO: 143470 - DNA, 6 bp, Unknown
  misc_feature (1)..( 6): Result.003 file - promoters60/4854186
aaaatt

SEQ ID NO: 143471 - DNA, 7 bp, Unknown
  misc_feature (1)..( 7): Result.003 file - promoters60/4854186
ataaaaa

SEQ ID NO: 143472 - DNA, 7 bp, Unknown
  misc_feature (1)..( 7): Result.003 file - promoters60/4854186
ataaaaa

SEQ ID NO: 143473 - DNA, 6 bp, Unknown
  misc_feature (1)..( 6): Result.003 file - promoters60/4854186
ggccca

SEQ ID NO: 143474 - DNA, 6 bp, Unknown
  misc_feature (1)..( 6): Result.003 file - promoters60/4854186
ggccca

SEQ ID NO: 143475 - DNA, 8 bp, Unknown
  misc_feature (1)..( 8): Result.003 file - promoters60/4899822
ttagaaaa

SEQ ID NO: 143476 - DNA, 8 bp, Unknown
  misc_feature (1)..( 8): Result.003 file - promoters60/4899822
aaagaaaa

SEQ ID NO: 143477 - DNA, 8 bp, Unknown
  misc_feature (1)..( 8): Result.003 file - promoters60/4899822
aaacaaaa

SEQ ID NO: 143478 - DNA, 8 bp, Unknown
  misc_feature (1)..( 8): Result.003 file - promoters60/4899822
aaataaaa

SEQ ID NO: 143479 - DNA, 8 bp, Unknown
  misc_feature (1)..( 8): Result.003 file - promoters60/4899822
taagaaaa

SEQ ID NO: 143480 - DNA, 13 bp, Unknown
  misc_feature (1)..( 13): Result.003 file - promoters60/4899822
aaattatataaag

SEQ ID NO: 143481 - DNA, 13 bp, Unknown
  misc_feature (1)..( 13): Result.003 file - promoters60/4899822
tgtaaataaaaag

SEQ ID NO: 143482 - DNA, 13 bp, Unknown
  misc_feature (1)..( 13): Result.003 file - promoters60/4899822
accaaacaaaacc

SEQ ID NO: 143483 - DNA, 13 bp, Unknown
  misc_feature (1)..( 13): Result.003 file - promoters60/4899822
tgtaaagaaaaga

SEQ ID NO: 143484 - DNA, 13 bp, Unknown
  misc_feature (1)..( 13): Result.003 file - promoters60/4899822
ctttaagaaaagc

SEQ ID NO: 143485 - DNA, 14 bp, Unknown
  misc_feature (1)..( 14): Result.003 file - promoters60/4899822
aaacaaaaccgaat

SEQ ID NO: 143486 - DNA, 14 bp, Unknown
  misc_feature (1)..( 14): Result.003 file - promoters60/4899822
aaaagaaactgaat

SEQ ID NO: 143487 - DNA, 14 bp, Unknown
  misc_feature (1)..( 14): Result.003 file - promoters60/4899822
aaaagaaaatgata

SEQ ID NO: 143488 - DNA, 14 bp, Unknown
  misc_feature (1)..( 14): Result.003 file - promoters60/4899822
ttaagaaaagccca

SEQ ID NO: 143489 - DNA, 15 bp, Unknown
  misc_feature (1)..( 15): Result.003 file - promoters60/4899822
ggctgaataataatt

SEQ ID NO: 143490 - DNA, 8 bp, Unknown
  misc_feature (1)..( 8): Result.003 file - promoters60/4899880
attattag

SEQ ID NO: 143491 - DNA, 8 bp, Unknown
  misc_feature (1)..( 8): Result.003 file - promoters60/4899880
atttttag

SEQ ID NO: 143492 - DNA, 8 bp, Unknown
  misc_feature (1)..( 8): Result.003 file - promoters60/4899880
atttgtag

SEQ ID NO: 143493 - DNA, 8 bp, Unknown
  misc_feature (1)..( 8): Result.003 file - promoters60/4899880
tcaccatg

SEQ ID NO: 143494 - DNA, 8 bp, Unknown
  misc_feature (1)..( 8): Result.003 file - promoters60/4899880
tcagcatg

SEQ ID NO: 143495 - DNA, 6 bp, Unknown
  misc_feature (1)..( 6): Result.003 file - promoters60/4899880
catgag

SEQ ID NO: 143496 - DNA, 6 bp, Unknown
  misc_feature (1)..( 6): Result.003 file - promoters60/4899880
catgag

SEQ ID NO: 143497 - DNA, 6 bp, Unknown
  misc_feature (1)..( 6): Result.003 file - promoters60/4899880
tatcat

SEQ ID NO: 143498 - DNA, 6 bp, Unknown
  misc_feature (1)..( 6): Result.003 file - promoters60/4899880
tatcat

SEQ ID NO: 143499 - DNA, 7 bp, Unknown
  misc_feature (1)..( 7): Result.003 file - promoters60/4899880
gacaagt

SEQ ID NO: 143500 - DNA, 7 bp, Unknown
  misc_feature (1)..( 7): Result.003 file - promoters60/4899880
gacaagt

SEQ ID NO: 143501 - DNA, 8 bp, Unknown
  misc_feature (1)..( 8): Result.003 file - promoters60/4899880
ccaacaaa

SEQ ID NO: 143502 - DNA, 8 bp, Unknown
  misc_feature (1)..( 8): Result.003 file - promoters60/4899880
ccaataaa

SEQ ID NO: 143503 - DNA, 7 bp, Unknown
  misc_feature (1)..( 7): Result.003 file - promoters60/4899880
gaatagt

SEQ ID NO: 143504 - DNA, 7 bp, Unknown
  misc_feature (1)..( 7): Result.003 file - promoters60/4899880
gaaaagt

SEQ ID NO: 143505 - DNA, 6 bp, Unknown
  misc_feature (1)..( 6): Result.003 file - promoters60/4899880
ttaaat

SEQ ID NO: 143506 - DNA, 6 bp, Unknown
  misc_feature (1)..( 6): Result.003 file - promoters60/4899880
ttaaat

SEQ ID NO: 143507 - DNA, 6 bp, Unknown
  misc_feature (1)..( 6): Result.003 file - promoters60/4899880
tttgta

SEQ ID NO: 143508 - DNA, 6 bp, Unknown
  misc_feature (1)..( 6): Result.003 file - promoters60/4899880
tttgta

SEQ ID NO: 143509 - DNA, 8 bp, Unknown
  misc_feature (1)..( 8): Result.003 file - promoters60/4899880
taaagaag

SEQ ID NO: 143510 - DNA, 8 bp, Unknown
  misc_feature (1)..( 8): Result.003 file - promoters60/4899880
taaacaag

SEQ ID NO: 143511 - DNA, 6 bp, Unknown
  misc_feature (1)..( 6): Result.003 file - promoters60/4899880
gaaaaa

SEQ ID NO: 143512 - DNA, 6 bp, Unknown
  misc_feature (1)..( 6): Result.003 file - promoters60/4899880
gaaaaa

SEQ ID NO: 143513 - DNA, 10 bp, Unknown
  misc_feature (1)..( 10): Result.003 file - promoters60/4899880
aaaacaattc

SEQ ID NO: 143514 - DNA, 10 bp, Unknown
  misc_feature (1)..( 10): Result.003 file - promoters60/4899880
aaaataattc

SEQ ID NO: 143515 - DNA, 9 bp, Unknown
  misc_feature (1)..( 9): Result.003 file - promoters60/4899880
ctataattt

SEQ ID NO: 143516 - DNA, 9 bp, Unknown
  misc_feature (1)..( 9): Result.003 file - promoters60/4899880
ctatcattt

SEQ ID NO: 143517 - DNA, 11 bp, Unknown
  misc_feature (1)..( 11): Result.003 file - promoters60/4899880
aaaataaaaat

SEQ ID NO: 143518 - DNA, 11 bp, Unknown
  misc_feature (1)..( 11): Result.003 file - promoters60/4899880
aaaataaaaat

SEQ ID NO: 143519 - DNA, 10 bp, Unknown
  misc_feature (1)..( 10): Result.003 file - promoters60/4899880
taaaatcggt

SEQ ID NO: 143520 - DNA, 10 bp, Unknown
  misc_feature (1)..( 10): Result.003 file - promoters60/4899880
taaaataagt

SEQ ID NO: 143521 - DNA, 10 bp, Unknown
  misc_feature (1)..( 10): Result.003 file - promoters60/4899880
tcaaatcaaa

SEQ ID NO: 143522 - DNA, 6 bp, Unknown
  misc_feature (1)..( 6): Result.003 file - promoters60/4899880
caaaga

SEQ ID NO: 143523 - DNA, 6 bp, Unknown
  misc_feature (1)..( 6): Result.003 file - promoters60/4899880
caaaga

SEQ ID NO: 143524 - DNA, 7 bp, Unknown
  misc_feature (1)..( 7): Result.003 file - promoters60/4899880
gtacgag

SEQ ID NO: 143525 - DNA, 7 bp, Unknown
  misc_feature (1)..( 7): Result.003 file - promoters60/4899880
gtaggag

SEQ ID NO: 143526 - DNA, 8 bp, Unknown
  misc_feature (1)..( 8): Result.003 file - promoters60/4899880
ctttggaa

SEQ ID NO: 143527 - DNA, 8 bp, Unknown
  misc_feature (1)..( 8): Result.003 file - promoters60/4899880
ctttggaa

SEQ ID NO: 143528 - DNA, 6 bp, Unknown
  misc_feature (1)..( 6): Result.003 file - promoters60/4899880
gtggtt

SEQ ID NO: 143529 - DNA, 6 bp, Unknown
  misc_feature (1)..( 6): Result.003 file - promoters60/4899880
gtggtt

SEQ ID NO: 143530 - DNA, 6 bp, Unknown
  misc_feature (1)..( 6): Result.003 file - promoters60/4899880
aggaaa

SEQ ID NO: 143531 - DNA, 6 bp, Unknown
  misc_feature (1)..( 6): Result.003 file - promoters60/4899880
aggaaa

SEQ ID NO: 143532 - DNA, 6 bp, Unknown
  misc_feature (1)..( 6): Result.003 file - promoters60/4899880
atctac

SEQ ID NO: 143533 - DNA, 6 bp, Unknown
  misc_feature (1)..( 6): Result.003 file - promoters60/4899880
atctac

SEQ ID NO: 143534 - DNA, 6 bp, Unknown
  misc_feature (1)..( 6): Result.003 file - promoters60/4899880
tctttt

SEQ ID NO: 143535 - DNA, 6 bp, Unknown
  misc_feature (1)..( 6): Result.003 file - promoters60/4899880
tctttt

SEQ ID NO: 143536 - DNA, 7 bp, Unknown
  misc_feature (1)..( 7): Result.003 file - promoters60/4899880
ttttgta

SEQ ID NO: 143537 - DNA, 7 bp, Unknown
  misc_feature (1)..( 7): Result.003 file - promoters60/4899880
ttttgta

SEQ ID NO: 143538 - DNA, 8 bp, Unknown
  misc_feature (1)..( 8): Result.003 file - promoters60/4899880
tttaagtg

SEQ ID NO: 143539 - DNA, 8 bp, Unknown
  misc_feature (1)..( 8): Result.003 file - promoters60/4899880
tttatgtg

SEQ ID NO: 143540 - DNA, 8 bp, Unknown
  misc_feature (1)..( 8): Result.003 file - promoters60/4899880
ttgagata

SEQ ID NO: 143541 - DNA, 8 bp, Unknown
  misc_feature (1)..( 8): Result.003 file - promoters60/4899880
ttgatata

SEQ ID NO: 143542 - DNA, 11 bp, Unknown
  misc_feature (1)..( 11): Result.003 file - promoters60/4900035
taataattaaa

SEQ ID NO: 143543 - DNA, 11 bp, Unknown
  misc_feature (1)..( 11): Result.003 file - promoters60/4900035
caataatggcc

SEQ ID NO: 143544 - DNA, 11 bp, Unknown
  misc_feature (1)..( 11): Result.003 file - promoters60/4900035
aaataattctt

SEQ ID NO: 143545 - DNA, 11 bp, Unknown
  misc_feature (1)..( 11): Result.003 file - promoters60/4900035
gaatagttaaa

SEQ ID NO: 143546 - DNA, 11 bp, Unknown
  misc_feature (1)..( 11): Result.003 file - promoters60/4900035
aaaaaattact

SEQ ID NO: 143547 - DNA, 12 bp, Unknown
  misc_feature (1)..( 12): Result.003 file - promoters60/4900035
atttagatcgga

SEQ ID NO: 143548 - DNA, 10 bp, Unknown
  misc_feature (1)..( 10): Result.003 file - promoters60/4900035
agaatgtatt

SEQ ID NO: 143549 - DNA, 10 bp, Unknown
  misc_feature (1)..( 10): Result.003 file - promoters60/4900035
aaaatatatt

SEQ ID NO: 143550 - DNA, 10 bp, Unknown
  misc_feature (1)..( 10): Result.003 file - promoters60/4900035
agagtgtaca

SEQ ID NO: 143551 - DNA, 10 bp, Unknown
  misc_feature (1)..( 10): Result.003 file - promoters60/4900035
aaaacataac

SEQ ID NO: 143552 - DNA, 10 bp, Unknown
  misc_feature (1)..( 10): Result.003 file - promoters60/4900035
aaaacaaatt

SEQ ID NO: 143553 - DNA, 10 bp, Unknown
  misc_feature (1)..( 10): Result.003 file - promoters60/4900035
taaacttaat

SEQ ID NO: 143554 - DNA, 9 bp, Unknown
  misc_feature (1)..( 9): Result.003 file - promoters60/4900035
gataaaacc

SEQ ID NO: 143555 - DNA, 9 bp, Unknown
  misc_feature (1)..( 9): Result.003 file - promoters60/4900035
tataaaaat

SEQ ID NO: 143556 - DNA, 9 bp, Unknown
  misc_feature (1)..( 9): Result.003 file - promoters60/4900035
gattaaatt

SEQ ID NO: 143557 - DNA, 9 bp, Unknown
  misc_feature (1)..( 9): Result.003 file - promoters60/4900035
gatgaaaga

SEQ ID NO: 143558 - DNA, 9 bp, Unknown
  misc_feature (1)..( 9): Result.003 file - promoters60/4900035
gattaatac

SEQ ID NO: 143559 - DNA, 9 bp, Unknown
  misc_feature (1)..( 9): Result.003 file - promoters60/4900035
agttaaatc

SEQ ID NO: 143560 - DNA, 9 bp, Unknown
  misc_feature (1)..( 9): Result.003 file - promoters60/4900035
aatgagaga

SEQ ID NO: 143561 - DNA, 13 bp, Unknown
  misc_feature (1)..( 13): Result.003 file - promoters60/4900035
gttatatcaatca

SEQ ID NO: 143562 - DNA, 13 bp, Unknown
  misc_feature (1)..( 13): Result.003 file - promoters60/4900035
tttatctcacaaa

SEQ ID NO: 143563 - DNA, 13 bp, Unknown
  misc_feature (1)..( 13): Result.003 file - promoters60/4900035
cttagatccgcca

SEQ ID NO: 143564 - DNA, 13 bp, Unknown
  misc_feature (1)..( 13): Result.003 file - promoters60/4900035
aagttatcaatca

SEQ ID NO: 143565 - DNA, 13 bp, Unknown
  misc_feature (1)..( 13): Result.003 file - promoters60/4900035
tttttctttgaaa

SEQ ID NO: 143566 - DNA, 13 bp, Unknown
  misc_feature (1)..( 13): Result.003 file - promoters60/4900035
ggtttatccggat

SEQ ID NO: 143567 - DNA, 15 bp, Unknown
  misc_feature (1)..( 15): Result.003 file - promoters60/4900353
ccaaacaaaacatat

SEQ ID NO: 143568 - DNA, 15 bp, Unknown
  misc_feature (1)..( 15): Result.003 file - promoters60/4900353
ttctataaaaaatat

SEQ ID NO: 143569 - DNA, 15 bp, Unknown
  misc_feature (1)..( 15): Result.003 file - promoters60/4900353
agatacaaaacccta

SEQ ID NO: 143570 - DNA, 15 bp, Unknown
  misc_feature (1)..( 15): Result.003 file - promoters60/4900353
aattttaaaaaatgt

SEQ ID NO: 143571 - DNA, 15 bp, Unknown
  misc_feature (1)..( 15): Result.003 file - promoters60/4900353
ctatataaaaccaag

SEQ ID NO: 143572 - DNA, 15 bp, Unknown
  misc_feature (1)..( 15): Result.003 file - promoters60/4900353
tggtgataaatattc

SEQ ID NO: 143573 - DNA, 15 bp, Unknown
  misc_feature (1)..( 15): Result.003 file - promoters60/4900353
ggctttataatattg

SEQ ID NO: 143574 - DNA, 7 bp, Unknown
  misc_feature (1)..( 7): Result.003 file - promoters60/4900589
gtagatc

SEQ ID NO: 143575 - DNA, 7 bp, Unknown
  misc_feature (1)..( 7): Result.003 file - promoters60/4900589
gtaaatc

SEQ ID NO: 143576 - DNA, 7 bp, Unknown
  misc_feature (1)..( 7): Result.003 file - promoters60/4900589
ttagatc

SEQ ID NO: 143577 - DNA, 11 bp, Unknown
  misc_feature (1)..( 11): Result.003 file - promoters60/4900589
taataaattga

SEQ ID NO: 143578 - DNA, 11 bp, Unknown
  misc_feature (1)..( 11): Result.003 file - promoters60/4900589
gtataaattga

SEQ ID NO: 143579 - DNA, 11 bp, Unknown
  misc_feature (1)..( 11): Result.003 file - promoters60/4900589
gtaaaaatatc

SEQ ID NO: 143580 - DNA, 8 bp, Unknown
  misc_feature (1)..( 8): Result.003 file - promoters60/4900589
tttctttt

SEQ ID NO: 143581 - DNA, 8 bp, Unknown
  misc_feature (1)..( 8): Result.003 file - promoters60/4900589
tttgtttg

SEQ ID NO: 143582 - DNA, 8 bp, Unknown
  misc_feature (1)..( 8): Result.003 file - promoters60/4900589
tttgtttt

SEQ ID NO: 143583 - DNA, 12 bp, Unknown
  misc_feature (1)..( 12): Result.003 file - promoters60/4900589
atctaaattttg

SEQ ID NO: 143584 - DNA, 12 bp, Unknown
  misc_feature (1)..( 12): Result.003 file - promoters60/4900589
atccaaaatttg

SEQ ID NO: 143585 - DNA, 12 bp, Unknown
  misc_feature (1)..( 12): Result.003 file - promoters60/4900589
cctacaattttg

SEQ ID NO: 143586 - DNA, 8 bp, Unknown
  misc_feature (1)..( 8): Result.003 file - promoters60/4900589
ctataatt

SEQ ID NO: 143587 - DNA, 8 bp, Unknown
  misc_feature (1)..( 8): Result.003 file - promoters60/4900589
ctattatt

SEQ ID NO: 143588 - DNA, 7 bp, Unknown
  misc_feature (1)..( 7): Result.003 file - promoters60/4900589
tcttaat

SEQ ID NO: 143589 - DNA, 7 bp, Unknown
  misc_feature (1)..( 7): Result.003 file - promoters60/4900589
tctaaat

SEQ ID NO: 143590 - DNA, 7 bp, Unknown
  misc_feature (1)..( 7): Result.003 file - promoters60/4900589
tggattt

SEQ ID NO: 143591 - DNA, 7 bp, Unknown
  misc_feature (1)..( 7): Result.003 file - promoters60/4900589
tgggttt

SEQ ID NO: 143592 - DNA, 8 bp, Unknown
  misc_feature (1)..( 8): Result.003 file - promoters60/4900589
ttttaatt

SEQ ID NO: 143593 - DNA, 8 bp, Unknown
  misc_feature (1)..( 8): Result.003 file - promoters60/4900589
ttttaatt

SEQ ID NO: 143594 - DNA, 6 bp, Unknown
  misc_feature (1)..( 6): Result.003 file - promoters60/4900589
aatttt

SEQ ID NO: 143595 - DNA, 6 bp, Unknown
  misc_feature (1)..( 6): Result.003 file - promoters60/4900589
aatttt

SEQ ID NO: 143596 - DNA, 11 bp, Unknown
  misc_feature (1)..( 11): Result.003 file - promoters60/4900589
ctatacataaa

SEQ ID NO: 143597 - DNA, 11 bp, Unknown
  misc_feature (1)..( 11): Result.003 file - promoters60/4900589
tgaaacaaaaa

SEQ ID NO: 143598 - DNA, 11 bp, Unknown
  misc_feature (1)..( 11): Result.003 file - promoters60/4900589
tgaagcaaacc

SEQ ID NO: 143599 - DNA, 7 bp, Unknown
  misc_feature (1)..( 7): Result.003 file - promoters60/4900589
tcttctg

SEQ ID NO: 143600 - DNA, 7 bp, Unknown
  misc_feature (1)..( 7): Result.003 file - promoters60/4900589
tctactg

SEQ ID NO: 143601 - DNA, 6 bp, Unknown
  misc_feature (1)..( 6): Result.003 file - promoters60/4900589
taaaga

SEQ ID NO: 143602 - DNA, 6 bp, Unknown
  misc_feature (1)..( 6): Result.003 file - promoters60/4900589
taaaga

SEQ ID NO: 143603 - DNA, 9 bp, Unknown
  misc_feature (1)..( 9): Result.003 file - promoters60/4900589
caaaaagag

SEQ ID NO: 143604 - DNA, 9 bp, Unknown
  misc_feature (1)..( 9): Result.003 file - promoters60/4900589
caaagagag

SEQ ID NO: 143605 - DNA, 6 bp, Unknown
  misc_feature (1)..( 6): Result.003 file - promoters60/4900589
aaattg

SEQ ID NO: 143606 - DNA, 6 bp, Unknown
  misc_feature (1)..( 6): Result.003 file - promoters60/4900589
aaattg

SEQ ID NO: 143607 - DNA, 7 bp, Unknown
  misc_feature (1)..( 7): Result.003 file - promoters60/4900589
tattgtg

SEQ ID NO: 143608 - DNA, 7 bp, Unknown
  misc_feature (1)..( 7): Result.003 file - promoters60/4900589
tattgtg

SEQ ID NO: 143609 - DNA, 9 bp, Unknown
  misc_feature (1)..( 9): Result.003 file - promoters60/4900589
tatttattt

SEQ ID NO: 143610 - DNA, 9 bp, Unknown
  misc_feature (1)..( 9): Result.003 file - promoters60/4900589
tatttattt

SEQ ID NO: 143611 - DNA, 11 bp, Unknown
  misc_feature (1)..( 11): Result.003 file - promoters60/4900643
atacaaaatca

SEQ ID NO: 143612 - DNA, 11 bp, Unknown
  misc_feature (1)..( 11): Result.003 file - promoters60/4900643
atacaacatca

SEQ ID NO: 143613 - DNA, 9 bp, Unknown
  misc_feature (1)..( 9): Result.003 file - promoters60/4900643
aaaaatcaa

SEQ ID NO: 143614 - DNA, 9 bp, Unknown
  misc_feature (1)..( 9): Result.003 file - promoters60/4900643
aaaaaccaa

SEQ ID NO: 143615 - DNA, 9 bp, Unknown
  misc_feature (1)..( 9): Result.003 file - promoters60/4900643
aagatctcc

SEQ ID NO: 143616 - DNA, 9 bp, Unknown
  misc_feature (1)..( 9): Result.003 file - promoters60/4900643
aagttctcc

SEQ ID NO: 143617 - DNA, 8 bp, Unknown
  misc_feature (1)..( 8): Result.003 file - promoters60/4900643
tgtgggtt

SEQ ID NO: 143618 - DNA, 8 bp, Unknown
  misc_feature (1)..( 8): Result.003 file - promoters60/4900643
tgtcggtt

SEQ ID NO: 143619 - DNA, 8 bp, Unknown
  misc_feature (1)..( 8): Result.003 file - promoters60/4900643
attgggtt

SEQ ID NO: 143620 - DNA, 6 bp, Unknown
  misc_feature (1)..( 6): Result.003 file - promoters60/4900643
ctttga

SEQ ID NO: 143621 - DNA, 6 bp, Unknown
  misc_feature (1)..( 6): Result.003 file - promoters60/4900643
ctttga

SEQ ID NO: 143622 - DNA, 7 bp, Unknown
  misc_feature (1)..( 7): Result.003 file - promoters60/4900643
tgtaata

SEQ ID NO: 143623 - DNA, 7 bp, Unknown
  misc_feature (1)..( 7): Result.003 file - promoters60/4900643
tgtaata

SEQ ID NO: 143624 - DNA, 16 bp, Unknown
  misc_feature (1)..( 16): Result.003 file - promoters60/4900643
ggaaaacgtgaggact

SEQ ID NO: 143625 - DNA, 16 bp, Unknown
  misc_feature (1)..( 16): Result.003 file - promoters60/4900643
ggataacttgagaact

SEQ ID NO: 143626 - DNA, 6 bp, Unknown
  misc_feature (1)..( 6): Result.003 file - promoters60/4900643
tgtttt

SEQ ID NO: 143627 - DNA, 6 bp, Unknown
  misc_feature (1)..( 6): Result.003 file - promoters60/4900643
tgtttt

SEQ ID NO: 143628 - DNA, 8 bp, Unknown
  misc_feature (1)..( 8): Result.003 file - promoters60/4900643
tgtcatta

SEQ ID NO: 143629 - DNA, 8 bp, Unknown
  misc_feature (1)..( 8): Result.003 file - promoters60/4900643
tgttatta

SEQ ID NO: 143630 - DNA, 7 bp, Unknown
  misc_feature (1)..( 7): Result.003 file - promoters60/4900643
ctctact

SEQ ID NO: 143631 - DNA, 7 bp, Unknown
  misc_feature (1)..( 7): Result.003 file - promoters60/4900643
ctctact

SEQ ID NO: 143632 - DNA, 8 bp, Unknown
  misc_feature (1)..( 8): Result.003 file - promoters60/4900643
tgtgttct

SEQ ID NO: 143633 - DNA, 8 bp, Unknown
  misc_feature (1)..( 8): Result.003 file - promoters60/4900643
tgtgctct

SEQ ID NO: 143634 - DNA, 9 bp, Unknown
  misc_feature (1)..( 9): Result.003 file - promoters60/4900643
agaagaaaa

SEQ ID NO: 143635 - DNA, 9 bp, Unknown
  misc_feature (1)..( 9): Result.003 file - promoters60/4900643
agaaaaaaa

SEQ ID NO: 143636 - DNA, 7 bp, Unknown
  misc_feature (1)..( 7): Result.003 file - promoters60/4900643
aaaactt

SEQ ID NO: 143637 - DNA, 7 bp, Unknown
  misc_feature (1)..( 7): Result.003 file - promoters60/4900643
aaaactt

SEQ ID NO: 143638 - DNA, 9 bp, Unknown
  misc_feature (1)..( 9): Result.003 file - promoters60/4900643
tttcttttc

SEQ ID NO: 143639 - DNA, 9 bp, Unknown
  misc_feature (1)..( 9): Result.003 file - promoters60/4900643
tttatttac

SEQ ID NO: 143640 - DNA, 9 bp, Unknown
  misc_feature (1)..( 9): Result.003 file - promoters60/4900643
catatttac

SEQ ID NO: 143641 - DNA, 7 bp, Unknown
  misc_feature (1)..( 7): Result.003 file - promoters60/4900643
ttctaaa

SEQ ID NO: 143642 - DNA, 7 bp, Unknown
  misc_feature (1)..( 7): Result.003 file - promoters60/4900643
ttccaaa

SEQ ID NO: 143643 - DNA, 6 bp, Unknown
  misc_feature (1)..( 6): Result.003 file - promoters60/4900643
ccaaac

SEQ ID NO: 143644 - DNA, 6 bp, Unknown
  misc_feature (1)..( 6): Result.003 file - promoters60/4900643
ccaaac

SEQ ID NO: 143645 - DNA, 6 bp, Unknown
  misc_feature (1)..( 6): Result.003 file - promoters60/4900643
ggtttt

SEQ ID NO: 143646 - DNA, 6 bp, Unknown
  misc_feature (1)..( 6): Result.003 file - promoters60/4900643
ggtttt

SEQ ID NO: 143647 - DNA, 6 bp, Unknown
  misc_feature (1)..( 6): Result.003 file - promoters60/4900643
ttaatt

SEQ ID NO: 143648 - DNA, 6 bp, Unknown
  misc_feature (1)..( 6): Result.003 file - promoters60/4900643
ttaatt

SEQ ID NO: 143649 - DNA, 8 bp, Unknown
  misc_feature (1)..( 8): Result.003 file - promoters60/4900643
gttagtat

SEQ ID NO: 143650 - DNA, 8 bp, Unknown
  misc_feature (1)..( 8): Result.003 file - promoters60/4900643
gttcgtat

SEQ ID NO: 143651 - DNA, 6 bp, Unknown
  misc_feature (1)..( 6): Result.003 file - promoters60/4900643
ttggcg

SEQ ID NO: 143652 - DNA, 6 bp, Unknown
  misc_feature (1)..( 6): Result.003 file - promoters60/4900643
ttggcg

SEQ ID NO: 143653 - DNA, 7 bp, Unknown
  misc_feature (1)..( 7): Result.003 file - promoters60/4900643
atattta

SEQ ID NO: 143654 - DNA, 7 bp, Unknown
  misc_feature (1)..( 7): Result.003 file - promoters60/4900643
atattta

SEQ ID NO: 143655 - DNA, 7 bp, Unknown
  misc_feature (1)..( 7): Result.003 file - promoters60/4900722
ctagatt

SEQ ID NO: 143656 - DNA, 7 bp, Unknown
  misc_feature (1)..( 7): Result.003 file - promoters60/4900722
ctacatt

SEQ ID NO: 143657 - DNA, 8 bp, Unknown
  misc_feature (1)..( 8): Result.003 file - promoters60/4900722
ttataaat

SEQ ID NO: 143658 - DNA, 8 bp, Unknown
  misc_feature (1)..( 8): Result.003 file - promoters60/4900722
ttataaat

SEQ ID NO: 143659 - DNA, 6 bp, Unknown
  misc_feature (1)..( 6): Result.003 file - promoters60/4900722
agattt

SEQ ID NO: 143660 - DNA, 6 bp, Unknown
  misc_feature (1)..( 6): Result.003 file - promoters60/4900722
agattt

SEQ ID NO: 143661 - DNA, 7 bp, Unknown
  misc_feature (1)..( 7): Result.003 file - promoters60/4900722
atttaca

SEQ ID NO: 143662 - DNA, 7 bp, Unknown
  misc_feature (1)..( 7): Result.003 file - promoters60/4900722
atttacc

SEQ ID NO: 143663 - DNA, 7 bp, Unknown
  misc_feature (1)..( 7): Result.003 file - promoters60/4900722
attaacc

SEQ ID NO: 143664 - DNA, 8 bp, Unknown
  misc_feature (1)..( 8): Result.003 file - promoters60/4900722
atatctga

SEQ ID NO: 143665 - DNA, 8 bp, Unknown
  misc_feature (1)..( 8): Result.003 file - promoters60/4900722
atatatga

SEQ ID NO: 143666 - DNA, 7 bp, Unknown
  misc_feature (1)..( 7): Result.003 file - promoters60/4900722
tttaata

SEQ ID NO: 143667 - DNA, 7 bp, Unknown
  misc_feature (1)..( 7): Result.003 file - promoters60/4900722
tttgata

SEQ ID NO: 143668 - DNA, 6 bp, Unknown
  misc_feature (1)..( 6): Result.003 file - promoters60/4900722
gtgtgt

SEQ ID NO: 143669 - DNA, 6 bp, Unknown
  misc_feature (1)..( 6): Result.003 file - promoters60/4900722
gtgtgt

SEQ ID NO: 143670 - DNA, 6 bp, Unknown
  misc_feature (1)..( 6): Result.003 file - promoters60/4900722
acagct

SEQ ID NO: 143671 - DNA, 6 bp, Unknown
  misc_feature (1)..( 6): Result.003 file - promoters60/4900722
acagct

SEQ ID NO: 143672 - DNA, 6 bp, Unknown
  misc_feature (1)..( 6): Result.003 file - promoters60/4900722
ccatat

SEQ ID NO: 143673 - DNA, 6 bp, Unknown
  misc_feature (1)..( 6): Result.003 file - promoters60/4900722
ccatat

SEQ ID NO: 143674 - DNA, 8 bp, Unknown
  misc_feature (1)..( 8): Result.003 file - promoters60/4900722
tgcgtcag

SEQ ID NO: 143675 - DNA, 8 bp, Unknown
  misc_feature (1)..( 8): Result.003 file - promoters60/4900722
tgcctcag

SEQ ID NO: 143676 - DNA, 7 bp, Unknown
  misc_feature (1)..( 7): Result.003 file - promoters60/4900722
ttctgtt

SEQ ID NO: 143677 - DNA, 7 bp, Unknown
  misc_feature (1)..( 7): Result.003 file - promoters60/4900722
ttcggtt

SEQ ID NO: 143678 - DNA, 8 bp, Unknown
  misc_feature (1)..( 8): Result.003 file - promoters60/4900722
gtgtgtat

SEQ ID NO: 143679 - DNA, 8 bp, Unknown
  misc_feature (1)..( 8): Result.003 file - promoters60/4900722
gtgggtat

SEQ ID NO: 143680 - DNA, 12 bp, Unknown
  misc_feature (1)..( 12): Result.003 file - promoters60/4900939
aaaataaaaagt

SEQ ID NO: 143681 - DNA, 12 bp, Unknown
  misc_feature (1)..( 12): Result.003 file - promoters60/4900939
taaacaaataat

SEQ ID NO: 143682 - DNA, 12 bp, Unknown
  misc_feature (1)..( 12): Result.003 file - promoters60/4900939
ataataagtcaa

SEQ ID NO: 143683 - DNA, 7 bp, Unknown
  misc_feature (1)..( 7): Result.003 file - promoters60/4900939
aaaattc

SEQ ID NO: 143684 - DNA, 7 bp, Unknown
  misc_feature (1)..( 7): Result.003 file - promoters60/4900939
aaaattt

SEQ ID NO: 143685 - DNA, 7 bp, Unknown
  misc_feature (1)..( 7): Result.003 file - promoters60/4900939
caaattc

SEQ ID NO: 143686 - DNA, 9 bp, Unknown
  misc_feature (1)..( 9): Result.003 file - promoters60/4900939
ttagacgct

SEQ ID NO: 143687 - DNA, 9 bp, Unknown
  misc_feature (1)..( 9): Result.003 file - promoters60/4900939
ttaaacgaa

SEQ ID NO: 143688 - DNA, 9 bp, Unknown
  misc_feature (1)..( 9): Result.003 file - promoters60/4900939
gaaaacgaa

SEQ ID NO: 143689 - DNA, 7 bp, Unknown
  misc_feature (1)..( 7): Result.003 file - promoters60/4900939
ttttgtt

SEQ ID NO: 143690 - DNA, 7 bp, Unknown
  misc_feature (1)..( 7): Result.003 file - promoters60/4900939
ttttgtt

SEQ ID NO: 143691 - DNA, 7 bp, Unknown
  misc_feature (1)..( 7): Result.003 file - promoters60/4900939
ttttgtg

SEQ ID NO: 143692 - DNA, 12 bp, Unknown
  misc_feature (1)..( 12): Result.003 file - promoters60/4901133
aaataggcccaa

SEQ ID NO: 143693 - DNA, 12 bp, Unknown
  misc_feature (1)..( 12): Result.003 file - promoters60/4901133
aaatgggcctct

SEQ ID NO: 143694 - DNA, 12 bp, Unknown
  misc_feature (1)..( 12): Result.003 file - promoters60/4901133
aaataggcccaa

SEQ ID NO: 143695 - DNA, 12 bp, Unknown
  misc_feature (1)..( 12): Result.003 file - promoters60/4901133
gaaaaggcccat

SEQ ID NO: 143696 - DNA, 12 bp, Unknown
  misc_feature (1)..( 12): Result.003 file - promoters60/4901133
taatgggccgaa

SEQ ID NO: 143697 - DNA, 12 bp, Unknown
  misc_feature (1)..( 12): Result.003 file - promoters60/4901133
atatgggcctta

SEQ ID NO: 143698 - DNA, 9 bp, Unknown
  misc_feature (1)..( 9): Result.003 file - promoters60/4901133
tatttatat

SEQ ID NO: 143699 - DNA, 9 bp, Unknown
  misc_feature (1)..( 9): Result.003 file - promoters60/4901133
tatttaagg

SEQ ID NO: 143700 - DNA, 9 bp, Unknown
  misc_feature (1)..( 9): Result.003 file - promoters60/4901133
tatataaat

SEQ ID NO: 143701 - DNA, 9 bp, Unknown
  misc_feature (1)..( 9): Result.003 file - promoters60/4901133
tatataaag

SEQ ID NO: 143702 - DNA, 9 bp, Unknown
  misc_feature (1)..( 9): Result.003 file - promoters60/4901133
actataaat

SEQ ID NO: 143703 - DNA, 9 bp, Unknown
  misc_feature (1)..( 9): Result.003 file - promoters60/4901133
tatatatta

SEQ ID NO: 143704 - DNA, 13 bp, Unknown
  misc_feature (1)..( 13): Result.003 file - promoters60/4901133
caaaaattatact

SEQ ID NO: 143705 - DNA, 13 bp, Unknown
  misc_feature (1)..( 13): Result.003 file - promoters60/4901133
aaagaattatttt

SEQ ID NO: 143706 - DNA, 13 bp, Unknown
  misc_feature (1)..( 13): Result.003 file - promoters60/4901133
cttaaattattct

SEQ ID NO: 143707 - DNA, 13 bp, Unknown
  misc_feature (1)..( 13): Result.003 file - promoters60/4901133
caaaaattaaact

SEQ ID NO: 143708 - DNA, 13 bp, Unknown
  misc_feature (1)..( 13): Result.003 file - promoters60/4901133
agagaattaaaat

SEQ ID NO: 143709 - DNA, 13 bp, Unknown
  misc_feature (1)..( 13): Result.003 file - promoters60/4901133
ttaaacttacatg

SEQ ID NO: 143710 - DNA, 6 bp, Unknown
  misc_feature (1)..( 6): Result.003 file - promoters60/4901225
tgattg

SEQ ID NO: 143711 - DNA, 6 bp, Unknown
  misc_feature (1)..( 6): Result.003 file - promoters60/4901225
tgattg

SEQ ID NO: 143712 - DNA, 13 bp, Unknown
  misc_feature (1)..( 13): Result.003 file - promoters60/4901225
acacaaaaaaaaa

SEQ ID NO: 143713 - DNA, 13 bp, Unknown
  misc_feature (1)..( 13): Result.003 file - promoters60/4901225
acacacaaacaaa

SEQ ID NO: 143714 - DNA, 7 bp, Unknown
  misc_feature (1)..( 7): Result.003 file - promoters60/4901225
aaagctg

SEQ ID NO: 143715 - DNA, 7 bp, Unknown
  misc_feature (1)..( 7): Result.003 file - promoters60/4901225
aaaactg

SEQ ID NO: 143716 - DNA, 7 bp, Unknown
  misc_feature (1)..( 7): Result.003 file - promoters60/4901225
aagaaga

SEQ ID NO: 143717 - DNA, 7 bp, Unknown
  misc_feature (1)..( 7): Result.003 file - promoters60/4901225
aagaaga

SEQ ID NO: 143718 - DNA, 11 bp, Unknown
  misc_feature (1)..( 11): Result.003 file - promoters60/4901225
agaagaagaag

SEQ ID NO: 143719 - DNA, 11 bp, Unknown
  misc_feature (1)..( 11): Result.003 file - promoters60/4901225
agaagaaaaag

SEQ ID NO: 143720 - DNA, 10 bp, Unknown
  misc_feature (1)..( 10): Result.003 file - promoters60/4901225
acaaaacacg

SEQ ID NO: 143721 - DNA, 10 bp, Unknown
  misc_feature (1)..( 10): Result.003 file - promoters60/4901225
taaaaaaacg

SEQ ID NO: 143722 - DNA, 10 bp, Unknown
  misc_feature (1)..( 10): Result.003 file - promoters60/4901225
acaatacact

SEQ ID NO: 143723 - DNA, 10 bp, Unknown
  misc_feature (1)..( 10): Result.003 file - promoters60/4901225
acatttttcc

SEQ ID NO: 143724 - DNA, 10 bp, Unknown
  misc_feature (1)..( 10): Result.003 file - promoters60/4901225
acatttatcc

SEQ ID NO: 143725 - DNA, 6 bp, Unknown
  misc_feature (1)..( 6): Result.003 file - promoters60/4901225
aatttt

SEQ ID NO: 143726 - DNA, 6 bp, Unknown
  misc_feature (1)..( 6): Result.003 file - promoters60/4901225
aatttt

SEQ ID NO: 143727 - DNA, 7 bp, Unknown
  misc_feature (1)..( 7): Result.003 file - promoters60/4901225
aaaaagg

SEQ ID NO: 143728 - DNA, 7 bp, Unknown
  misc_feature (1)..( 7): Result.003 file - promoters60/4901225
aaaaagg

SEQ ID NO: 143729 - DNA, 7 bp, Unknown
  misc_feature (1)..( 7): Result.003 file - promoters60/4901225
tttcgac

SEQ ID NO: 143730 - DNA, 7 bp, Unknown
  misc_feature (1)..( 7): Result.003 file - promoters60/4901225
ttttgac

SEQ ID NO: 143731 - DNA, 8 bp, Unknown
  misc_feature (1)..( 8): Result.003 file - promoters60/4901225
ttatcaat

SEQ ID NO: 143732 - DNA, 8 bp, Unknown
  misc_feature (1)..( 8): Result.003 file - promoters60/4901225
ttaacaat

SEQ ID NO: 143733 - DNA, 8 bp, Unknown
  misc_feature (1)..( 8): Result.003 file - promoters60/4901225
atctcatc

SEQ ID NO: 143734 - DNA, 8 bp, Unknown
  misc_feature (1)..( 8): Result.003 file - promoters60/4901225
atcacatc

SEQ ID NO: 143735 - DNA, 7 bp, Unknown
  misc_feature (1)..( 7): Result.003 file - promoters60/4901225
tgggtcg

SEQ ID NO: 143736 - DNA, 7 bp, Unknown
  misc_feature (1)..( 7): Result.003 file - promoters60/4901225
tggatcg

SEQ ID NO: 143737 - DNA, 13 bp, Unknown
  misc_feature (1)..( 13): Result.003 file - promoters60/4901241
acaaatctattaa

SEQ ID NO: 143738 - DNA, 13 bp, Unknown
  misc_feature (1)..( 13): Result.003 file - promoters60/4901241
tcaaatcaaaatg

SEQ ID NO: 143739 - DNA, 13 bp, Unknown
  misc_feature (1)..( 13): Result.003 file - promoters60/4901241
taaaatatattta

SEQ ID NO: 143740 - DNA, 14 bp, Unknown
  misc_feature (1)..( 14): Result.003 file - promoters60/4901241
ttaaactatagttg

SEQ ID NO: 143741 - DNA, 14 bp, Unknown
  misc_feature (1)..( 14): Result.003 file - promoters60/4901241
ttgacatattttta

SEQ ID NO: 143742 - DNA, 14 bp, Unknown
  misc_feature (1)..( 14): Result.003 file - promoters60/4901241
agaaatatttttat

SEQ ID NO: 143743 - DNA, 14 bp, Unknown
  misc_feature (1)..( 14): Result.003 file - promoters60/4901241
aataatattcaaat

SEQ ID NO: 143744 - DNA, 14 bp, Unknown
  misc_feature (1)..( 14): Result.003 file - promoters60/4901241
taaaatatatttaa

SEQ ID NO: 143745 - DNA, 15 bp, Unknown
  misc_feature (1)..( 15): Result.003 file - promoters60/4901241
ttgacatatttttat

SEQ ID NO: 143746 - DNA, 15 bp, Unknown
  misc_feature (1)..( 15): Result.003 file - promoters60/4901241
ttaaactatagttgg

SEQ ID NO: 143747 - DNA, 10 bp, Unknown
  misc_feature (1)..( 10): Result.003 file - promoters60/4901241
atgaataatt

SEQ ID NO: 143748 - DNA, 10 bp, Unknown
  misc_feature (1)..( 10): Result.003 file - promoters60/4901241
ataaattatt

SEQ ID NO: 143749 - DNA, 10 bp, Unknown
  misc_feature (1)..( 10): Result.003 file - promoters60/4901241
atgaagaatc

SEQ ID NO: 143750 - DNA, 10 bp, Unknown
  misc_feature (1)..( 10): Result.003 file - promoters60/4901241
cgaaaatata

SEQ ID NO: 143751 - DNA, 10 bp, Unknown
  misc_feature (1)..( 10): Result.003 file - promoters60/4901241
aaaaagaatt

SEQ ID NO: 143752 - DNA, 12 bp, Unknown
  misc_feature (1)..( 12): Result.003 file - promoters60/4901241
cattcaaaagat

SEQ ID NO: 143753 - DNA, 12 bp, Unknown
  misc_feature (1)..( 12): Result.003 file - promoters60/4901241
catgcaacgaat

SEQ ID NO: 143754 - DNA, 12 bp, Unknown
  misc_feature (1)..( 12): Result.003 file - promoters60/4901241
gttgcaactaat

SEQ ID NO: 143755 - DNA, 12 bp, Unknown
  misc_feature (1)..( 12): Result.003 file - promoters60/4901241
ctcctaattccc

SEQ ID NO: 143756 - DNA, 11 bp, Unknown
  misc_feature (1)..( 11): Result.003 file - promoters60/4901241
cgactaattaa

SEQ ID NO: 143757 - DNA, 11 bp, Unknown
  misc_feature (1)..( 11): Result.003 file - promoters60/4901241
agactaattaa

SEQ ID NO: 143758 - DNA, 11 bp, Unknown
  misc_feature (1)..( 11): Result.003 file - promoters60/4901241
attgtaaataa

SEQ ID NO: 143759 - DNA, 11 bp, Unknown
  misc_feature (1)..( 11): Result.003 file - promoters60/4901241
cgattaaatga

SEQ ID NO: 143760 - DNA, 9 bp, Unknown
  misc_feature (1)..( 9): Result.003 file - promoters60/4901241
tataaaagc

SEQ ID NO: 143761 - DNA, 9 bp, Unknown
  misc_feature (1)..( 9): Result.003 file - promoters60/4901241
tataaagac

SEQ ID NO: 143762 - DNA, 9 bp, Unknown
  misc_feature (1)..( 9): Result.003 file - promoters60/4901241
tataaacaa

SEQ ID NO: 143763 - DNA, 9 bp, Unknown
  misc_feature (1)..( 9): Result.003 file - promoters60/4901241
tataaaaag

SEQ ID NO: 143764 - DNA, 11 bp, Unknown
  misc_feature (1)..( 11): Result.003 file - promoters60/4901241
ctgaaaataca

SEQ ID NO: 143765 - DNA, 11 bp, Unknown
  misc_feature (1)..( 11): Result.003 file - promoters60/4901241
attaaaatata

SEQ ID NO: 143766 - DNA, 11 bp, Unknown
  misc_feature (1)..( 11): Result.003 file - promoters60/4901241
attcaaatcaa

SEQ ID NO: 143767 - DNA, 11 bp, Unknown
  misc_feature (1)..( 11): Result.003 file - promoters60/4901241
tttaaactata

SEQ ID NO: 143768 - DNA, 13 bp, Unknown
  misc_feature (1)..( 13): Result.003 file - promoters60/4901241
ttaaacattgtcc

SEQ ID NO: 143769 - DNA, 13 bp, Unknown
  misc_feature (1)..( 13): Result.003 file - promoters60/4901241
ttaatcataggag

SEQ ID NO: 143770 - DNA, 13 bp, Unknown
  misc_feature (1)..( 13): Result.003 file - promoters60/4901241
aaaaacatcttat

SEQ ID NO: 143771 - DNA, 13 bp, Unknown
  misc_feature (1)..( 13): Result.003 file - promoters60/4901241
tgcaacttcttat

SEQ ID NO: 143772 - DNA, 8 bp, Unknown
  misc_feature (1)..( 8): Result.003 file - promoters60/4901241
tctatttt

SEQ ID NO: 143773 - DNA, 8 bp, Unknown
  misc_feature (1)..( 8): Result.003 file - promoters60/4901241
tctgtttg

SEQ ID NO: 143774 - DNA, 9 bp, Unknown
  misc_feature (1)..( 9): Result.003 file - promoters60/4901241
cctaatttg

SEQ ID NO: 143775 - DNA, 9 bp, Unknown
  misc_feature (1)..( 9): Result.003 file - promoters60/4901241
cctaatttc

SEQ ID NO: 143776 - DNA, 9 bp, Unknown
  misc_feature (1)..( 9): Result.003 file - promoters60/4901241
taaccttac

SEQ ID NO: 143777 - DNA, 9 bp, Unknown
  misc_feature (1)..( 9): Result.003 file - promoters60/4901241
aaactttaa

SEQ ID NO: 143778 - DNA, 9 bp, Unknown
  misc_feature (1)..( 9): Result.003 file - promoters60/4901241
taatcttac

SEQ ID NO: 143779 - DNA, 9 bp, Unknown
  misc_feature (1)..( 9): Result.003 file - promoters60/4901241
taacttttc

SEQ ID NO: 143780 - DNA, 10 bp, Unknown
  misc_feature (1)..( 10): Result.003 file - promoters60/4901241
actacataag

SEQ ID NO: 143781 - DNA, 10 bp, Unknown
  misc_feature (1)..( 10): Result.003 file - promoters60/4901241
tctatatata

SEQ ID NO: 143782 - DNA, 10 bp, Unknown
  misc_feature (1)..( 10): Result.003 file - promoters60/4901241
tctataaaaa

SEQ ID NO: 143783 - DNA, 10 bp, Unknown
  misc_feature (1)..( 10): Result.003 file - promoters60/4901241
agtatatata

SEQ ID NO: 143784 - DNA, 6 bp, Unknown
  misc_feature (1)..( 6): Result.003 file - promoters60/4901333
ttcatc

SEQ ID NO: 143785 - DNA, 6 bp, Unknown
  misc_feature (1)..( 6): Result.003 file - promoters60/4901333
ttcatc

SEQ ID NO: 143786 - DNA, 7 bp, Unknown
  misc_feature (1)..( 7): Result.003 file - promoters60/4901333
atttgtt

SEQ ID NO: 143787 - DNA, 7 bp, Unknown
  misc_feature (1)..( 7): Result.003 file - promoters60/4901333
atttgtt

SEQ ID NO: 143788 - DNA, 6 bp, Unknown
  misc_feature (1)..( 6): Result.003 file - promoters60/4901333
tctcgc

SEQ ID NO: 143789 - DNA, 6 bp, Unknown
  misc_feature (1)..( 6): Result.003 file - promoters60/4901333
tctcgc

SEQ ID NO: 143790 - DNA, 11 bp, Unknown
  misc_feature (1)..( 11): Result.003 file - promoters60/4901333
ctttatttgat

SEQ ID NO: 143791 - DNA, 11 bp, Unknown
  misc_feature (1)..( 11): Result.003 file - promoters60/4901333
ctttattcgat

SEQ ID NO: 143792 - DNA, 6 bp, Unknown
  misc_feature (1)..( 6): Result.003 file - promoters60/4901333
gaacat

SEQ ID NO: 143793 - DNA, 6 bp, Unknown
  misc_feature (1)..( 6): Result.003 file - promoters60/4901333
gaacat

SEQ ID NO: 143794 - DNA, 6 bp, Unknown
  misc_feature (1)..( 6): Result.003 file - promoters60/4901333
aagaaa

SEQ ID NO: 143795 - DNA, 6 bp, Unknown
  misc_feature (1)..( 6): Result.003 file - promoters60/4901333
aagaaa

SEQ ID NO: 143796 - DNA, 6 bp, Unknown
  misc_feature (1)..( 6): Result.003 file - promoters60/4901333
ttttaa

SEQ ID NO: 143797 - DNA, 6 bp, Unknown
  misc_feature (1)..( 6): Result.003 file - promoters60/4901333
ttttaa

SEQ ID NO: 143798 - DNA, 6 bp, Unknown
  misc_feature (1)..( 6): Result.003 file - promoters60/4901333
aacttc

SEQ ID NO: 143799 - DNA, 6 bp, Unknown
  misc_feature (1)..( 6): Result.003 file - promoters60/4901333
aacttc

SEQ ID NO: 143800 - DNA, 7 bp, Unknown
  misc_feature (1)..( 7): Result.003 file - promoters60/4901333
attcatc

SEQ ID NO: 143801 - DNA, 7 bp, Unknown
  misc_feature (1)..( 7): Result.003 file - promoters60/4901333
atttatc

SEQ ID NO: 143802 - DNA, 7 bp, Unknown
  misc_feature (1)..( 7): Result.003 file - promoters60/4901333
atttttg

SEQ ID NO: 143803 - DNA, 7 bp, Unknown
  misc_feature (1)..( 7): Result.003 file - promoters60/4901333
atttttg

SEQ ID NO: 143804 - DNA, 7 bp, Unknown
  misc_feature (1)..( 7): Result.003 file - promoters60/4901333
agtcttt

SEQ ID NO: 143805 - DNA, 7 bp, Unknown
  misc_feature (1)..( 7): Result.003 file - promoters60/4901333
agtgttt

SEQ ID NO: 143806 - DNA, 8 bp, Unknown
  misc_feature (1)..( 8): Result.003 file - promoters60/4901333
cgacttct

SEQ ID NO: 143807 - DNA, 8 bp, Unknown
  misc_feature (1)..( 8): Result.003 file - promoters60/4901333
cgacttct

SEQ ID NO: 143808 - DNA, 6 bp, Unknown
  misc_feature (1)..( 6): Result.003 file - promoters60/4901333
tttaat

SEQ ID NO: 143809 - DNA, 6 bp, Unknown
  misc_feature (1)..( 6): Result.003 file - promoters60/4901333
tttaat

SEQ ID NO: 143810 - DNA, 7 bp, Unknown
  misc_feature (1)..( 7): Result.003 file - promoters60/4901333
tagataa

SEQ ID NO: 143811 - DNA, 7 bp, Unknown
  misc_feature (1)..( 7): Result.003 file - promoters60/4901333
tagataa

SEQ ID NO: 143812 - DNA, 7 bp, Unknown
  misc_feature (1)..( 7): Result.003 file - promoters60/4901333
aaagaca

SEQ ID NO: 143813 - DNA, 7 bp, Unknown
  misc_feature (1)..( 7): Result.003 file - promoters60/4901333
aaaaaca

SEQ ID NO: 143814 - DNA, 9 bp, Unknown
  misc_feature (1)..( 9): Result.003 file - promoters60/4901333
acgttttag

SEQ ID NO: 143815 - DNA, 9 bp, Unknown
  misc_feature (1)..( 9): Result.003 file - promoters60/4901333
acgttatag

SEQ ID NO: 143816 - DNA, 7 bp, Unknown
  misc_feature (1)..( 7): Result.003 file - promoters60/4901333
ttataat

SEQ ID NO: 143817 - DNA, 7 bp, Unknown
  misc_feature (1)..( 7): Result.003 file - promoters60/4901333
ttataat

SEQ ID NO: 143818 - DNA, 10 bp, Unknown
  misc_feature (1)..( 10): Result.003 file - promoters60/4901333
taattggttc

SEQ ID NO: 143819 - DNA, 10 bp, Unknown
  misc_feature (1)..( 10): Result.003 file - promoters60/4901333
taatgggttc

SEQ ID NO: 143820 - DNA, 6 bp, Unknown
  misc_feature (1)..( 6): Result.003 file - promoters60/4901516
gttttg

SEQ ID NO: 143821 - DNA, 6 bp, Unknown
  misc_feature (1)..( 6): Result.003 file - promoters60/4901516
gttttg

SEQ ID NO: 143822 - DNA, 6 bp, Unknown
  misc_feature (1)..( 6): Result.003 file - promoters60/4901516
acattc

SEQ ID NO: 143823 - DNA, 6 bp, Unknown
  misc_feature (1)..( 6): Result.003 file - promoters60/4901516
acattc

SEQ ID NO: 143824 - DNA, 8 bp, Unknown
  misc_feature (1)..( 8): Result.003 file - promoters60/4901516
aatgattt

SEQ ID NO: 143825 - DNA, 8 bp, Unknown
  misc_feature (1)..( 8): Result.003 file - promoters60/4901516
aatgcttt

SEQ ID NO: 143826 - DNA, 9 bp, Unknown
  misc_feature (1)..( 9): Result.003 file - promoters60/4901516
taaagtcaa

SEQ ID NO: 143827 - DNA, 9 bp, Unknown
  misc_feature (1)..( 9): Result.003 file - promoters60/4901516
taacgtcaa

SEQ ID NO: 143828 - DNA, 10 bp, Unknown
  misc_feature (1)..( 10): Result.003 file - promoters60/4901516
tactaagata

SEQ ID NO: 143829 - DNA, 10 bp, Unknown
  misc_feature (1)..( 10): Result.003 file - promoters60/4901516
aaataaaata

SEQ ID NO: 143830 - DNA, 10 bp, Unknown
  misc_feature (1)..( 10): Result.003 file - promoters60/4901516
aaatgaaata

SEQ ID NO: 143831 - DNA, 8 bp, Unknown
  misc_feature (1)..( 8): Result.003 file - promoters60/4901516
tatatatt

SEQ ID NO: 143832 - DNA, 8 bp, Unknown
  misc_feature (1)..( 8): Result.003 file - promoters60/4901516
tatataaa

SEQ ID NO: 143833 - DNA, 8 bp, Unknown
  misc_feature (1)..( 8): Result.003 file - promoters60/4901516
tatttatt

SEQ ID NO: 143834 - DNA, 6 bp, Unknown
  misc_feature (1)..( 6): Result.003 file - promoters60/4901516
tcgaaa

SEQ ID NO: 143835 - DNA, 6 bp, Unknown
  misc_feature (1)..( 6): Result.003 file - promoters60/4901516
tcgaaa

SEQ ID NO: 143836 - DNA, 7 bp, Unknown
  misc_feature (1)..( 7): Result.003 file - promoters60/4901516
aagttat

SEQ ID NO: 143837 - DNA, 7 bp, Unknown
  misc_feature (1)..( 7): Result.003 file - promoters60/4901516
aagatat

SEQ ID NO: 143838 - DNA, 6 bp, Unknown
  misc_feature (1)..( 6): Result.003 file - promoters60/4901516
ttttgt

SEQ ID NO: 143839 - DNA, 6 bp, Unknown
  misc_feature (1)..( 6): Result.003 file - promoters60/4901516
ttttgt

SEQ ID NO: 143840 - DNA, 14 bp, Unknown
  misc_feature (1)..( 14): Result.003 file - promoters60/4901516
aatacaaacacatt

SEQ ID NO: 143841 - DNA, 14 bp, Unknown
  misc_feature (1)..( 14): Result.003 file - promoters60/4901516
gaaacaaaaacatt

SEQ ID NO: 143842 - DNA, 14 bp, Unknown
  misc_feature (1)..( 14): Result.003 file - promoters60/4901516
gaaagaaagctttg

SEQ ID NO: 143843 - DNA, 6 bp, Unknown
  misc_feature (1)..( 6): Result.003 file - promoters60/4901516
actgtt

SEQ ID NO: 143844 - DNA, 6 bp, Unknown
  misc_feature (1)..( 6): Result.003 file - promoters60/4901516
actgtt

SEQ ID NO: 143845 - DNA, 9 bp, Unknown
  misc_feature (1)..( 9): Result.003 file - promoters60/4901516
aacacaaaa

SEQ ID NO: 143846 - DNA, 9 bp, Unknown
  misc_feature (1)..( 9): Result.003 file - promoters60/4901516
cccactaaa

SEQ ID NO: 143847 - DNA, 9 bp, Unknown
  misc_feature (1)..( 9): Result.003 file - promoters60/4901516
cccactaga

SEQ ID NO: 143848 - DNA, 7 bp, Unknown
  misc_feature (1)..( 7): Result.003 file - promoters60/4901516
aaacaaa

SEQ ID NO: 143849 - DNA, 7 bp, Unknown
  misc_feature (1)..( 7): Result.003 file - promoters60/4901516
aaagaaa

SEQ ID NO: 143850 - DNA, 6 bp, Unknown
  misc_feature (1)..( 6): Result.003 file - promoters60/4901516
ctcctt

SEQ ID NO: 143851 - DNA, 6 bp, Unknown
  misc_feature (1)..( 6): Result.003 file - promoters60/4901516
ctcctt

SEQ ID NO: 143852 - DNA, 6 bp, Unknown
  misc_feature (1)..( 6): Result.003 file - promoters60/4901516
agtaaa

SEQ ID NO: 143853 - DNA, 6 bp, Unknown
  misc_feature (1)..( 6): Result.003 file - promoters60/4901516
agtaaa

SEQ ID NO: 143854 - DNA, 7 bp, Unknown
  misc_feature (1)..( 7): Result.003 file - promoters60/4901516
aatcggg

SEQ ID NO: 143855 - DNA, 7 bp, Unknown
  misc_feature (1)..( 7): Result.003 file - promoters60/4901516
aattggg

SEQ ID NO: 143856 - DNA, 10 bp, Unknown
  misc_feature (1)..( 10): Result.003 file - promoters60/4901516
ggaaaagaaa

SEQ ID NO: 143857 - DNA, 10 bp, Unknown
  misc_feature (1)..( 10): Result.003 file - promoters60/4901516
ggaaatgaaa

SEQ ID NO: 143858 - DNA, 9 bp, Unknown
  misc_feature (1)..( 9): Result.003 file - promoters60/4901516
aaagaaaag

SEQ ID NO: 143859 - DNA, 9 bp, Unknown
  misc_feature (1)..( 9): Result.003 file - promoters60/4901516
aaagtaaag

SEQ ID NO: 143860 - DNA, 7 bp, Unknown
  misc_feature (1)..( 7): Result.003 file - promoters60/4901528
tcagagc

SEQ ID NO: 143861 - DNA, 7 bp, Unknown
  misc_feature (1)..( 7): Result.003 file - promoters60/4901528
tcatagc

SEQ ID NO: 143862 - DNA, 8 bp, Unknown
  misc_feature (1)..( 8): Result.003 file - promoters60/4901528
agtatatt

SEQ ID NO: 143863 - DNA, 8 bp, Unknown
  misc_feature (1)..( 8): Result.003 file - promoters60/4901528
agtttatt

SEQ ID NO: 143864 - DNA, 7 bp, Unknown
  misc_feature (1)..( 7): Result.003 file - promoters60/4901528
ttaaaaa

SEQ ID NO: 143865 - DNA, 7 bp, Unknown
  misc_feature (1)..( 7): Result.003 file - promoters60/4901528
ttataaa

SEQ ID NO: 143866 - DNA, 7 bp, Unknown
  misc_feature (1)..( 7): Result.003 file - promoters60/4901528
ttaaaag

SEQ ID NO: 143867 - DNA, 8 bp, Unknown
  misc_feature (1)..( 8): Result.003 file - promoters60/4901528
taaccaaa

SEQ ID NO: 143868 - DNA, 8 bp, Unknown
  misc_feature (1)..( 8): Result.003 file - promoters60/4901528
taacaaaa

SEQ ID NO: 143869 - DNA, 6 bp, Unknown
  misc_feature (1)..( 6): Result.003 file - promoters60/4901528
ttatca

SEQ ID NO: 143870 - DNA, 6 bp, Unknown
  misc_feature (1)..( 6): Result.003 file - promoters60/4901528
ttatca

SEQ ID NO: 143871 - DNA, 7 bp, Unknown
  misc_feature (1)..( 7): Result.003 file - promoters60/4901528
tttttta

SEQ ID NO: 143872 - DNA, 7 bp, Unknown
  misc_feature (1)..( 7): Result.003 file - promoters60/4901528
tttatta

SEQ ID NO: 143873 - DNA, 7 bp, Unknown
  misc_feature (1)..( 7): Result.003 file - promoters60/4901528
gtatatt

SEQ ID NO: 143874 - DNA, 7 bp, Unknown
  misc_feature (1)..( 7): Result.003 file - promoters60/4901528
gtagatt

SEQ ID NO: 143875 - DNA, 7 bp, Unknown
  misc_feature (1)..( 7): Result.003 file - promoters60/4901528
ttccaaa

SEQ ID NO: 143876 - DNA, 7 bp, Unknown
  misc_feature (1)..( 7): Result.003 file - promoters60/4901528
ttctaaa

SEQ ID NO: 143877 - DNA, 7 bp, Unknown
  misc_feature (1)..( 7): Result.003 file - promoters60/4901528
tttgatt

SEQ ID NO: 143878 - DNA, 7 bp, Unknown
  misc_feature (1)..( 7): Result.003 file - promoters60/4901528
tttgatt

SEQ ID NO: 143879 - DNA, 6 bp, Unknown
  misc_feature (1)..( 6): Result.003 file - promoters60/4901528
gtctcc

SEQ ID NO: 143880 - DNA, 6 bp, Unknown
  misc_feature (1)..( 6): Result.003 file - promoters60/4901528
gtctcc

SEQ ID NO: 143881 - DNA, 11 bp, Unknown
  misc_feature (1)..( 11): Result.003 file - promoters60/4901528
accctagtttt

SEQ ID NO: 143882 - DNA, 11 bp, Unknown
  misc_feature (1)..( 11): Result.003 file - promoters60/4901528
accgtagattt

SEQ ID NO: 143883 - DNA, 10 bp, Unknown
  misc_feature (1)..( 10): Result.003 file - promoters60/4901564
tttcctaatt

SEQ ID NO: 143884 - DNA, 10 bp, Unknown
  misc_feature (1)..( 10): Result.003 file - promoters60/4901564
ttttctaaaa

SEQ ID NO: 143885 - DNA, 10 bp, Unknown
  misc_feature (1)..( 10): Result.003 file - promoters60/4901564
atttctattg

SEQ ID NO: 143886 - DNA, 10 bp, Unknown
  misc_feature (1)..( 10): Result.003 file - promoters60/4901564
gtttataaaa

SEQ ID NO: 143887 - DNA, 10 bp, Unknown
  misc_feature (1)..( 10): Result.003 file - promoters60/4901564
gcttataagt

SEQ ID NO: 143888 - DNA, 12 bp, Unknown
  misc_feature (1)..( 12): Result.003 file - promoters60/4901564
tttatgggccgt

SEQ ID NO: 143889 - DNA, 12 bp, Unknown
  misc_feature (1)..( 12): Result.003 file - promoters60/4901564
ggtttggaccgt

SEQ ID NO: 143890 - DNA, 12 bp, Unknown
  misc_feature (1)..( 12): Result.003 file - promoters60/4901564
catatgggctta

SEQ ID NO: 143891 - DNA, 12 bp, Unknown
  misc_feature (1)..( 12): Result.003 file - promoters60/4901564
ggttttgactat

SEQ ID NO: 143892 - DNA, 12 bp, Unknown
  misc_feature (1)..( 12): Result.003 file - promoters60/4901564
attacgggcttt

SEQ ID NO: 143893 - DNA, 9 bp, Unknown
  misc_feature (1)..( 9): Result.003 file - promoters60/4901673
tatttaagc

SEQ ID NO: 143894 - DNA, 9 bp, Unknown
  misc_feature (1)..( 9): Result.003 file - promoters60/4901673
gttttcagc

SEQ ID NO: 143895 - DNA, 9 bp, Unknown
  misc_feature (1)..( 9): Result.003 file - promoters60/4901673
tatttaatt

SEQ ID NO: 143896 - DNA, 7 bp, Unknown
  misc_feature (1)..( 7): Result.003 file - promoters60/4901673
aattcaa

SEQ ID NO: 143897 - DNA, 7 bp, Unknown
  misc_feature (1)..( 7): Result.003 file - promoters60/4901673
aattcat

SEQ ID NO: 143898 - DNA, 7 bp, Unknown
  misc_feature (1)..( 7): Result.003 file - promoters60/4901673
gattcaa

SEQ ID NO: 143899 - DNA, 8 bp, Unknown
  misc_feature (1)..( 8): Result.003 file - promoters60/4901673
attccata

SEQ ID NO: 143900 - DNA, 8 bp, Unknown
  misc_feature (1)..( 8): Result.003 file - promoters60/4901673
tttcaata

SEQ ID NO: 143901 - DNA, 8 bp, Unknown
  misc_feature (1)..( 8): Result.003 file - promoters60/4901673
attccagc

SEQ ID NO: 143902 - DNA, 13 bp, Unknown
  misc_feature (1)..( 13): Result.003 file - promoters60/4901673
gattccgatccag

SEQ ID NO: 143903 - DNA, 13 bp, Unknown
  misc_feature (1)..( 13): Result.003 file - promoters60/4901673
ttcctagatacag

SEQ ID NO: 143904 - DNA, 13 bp, Unknown
  misc_feature (1)..( 13): Result.003 file - promoters60/4901673
ttcttagctacgt

SEQ ID NO: 143905 - DNA, 9 bp, Unknown
  misc_feature (1)..( 9): Result.003 file - promoters60/4901783
aaataatga

SEQ ID NO: 143906 - DNA, 9 bp, Unknown
  misc_feature (1)..( 9): Result.003 file - promoters60/4901783
aaaaaatct

SEQ ID NO: 143907 - DNA, 9 bp, Unknown
  misc_feature (1)..( 9): Result.003 file - promoters60/4901783
aaacaattt

SEQ ID NO: 143908 - DNA, 9 bp, Unknown
  misc_feature (1)..( 9): Result.003 file - promoters60/4901783
tacaaattt

SEQ ID NO: 143909 - DNA, 8 bp, Unknown
  misc_feature (1)..( 8): Result.003 file - promoters60/4901783
caaagaaa

SEQ ID NO: 143910 - DNA, 8 bp, Unknown
  misc_feature (1)..( 8): Result.003 file - promoters60/4901783
caaacaaa

SEQ ID NO: 143911 - DNA, 8 bp, Unknown
  misc_feature (1)..( 8): Result.003 file - promoters60/4901783
ggaagaaa

SEQ ID NO: 143912 - DNA, 8 bp, Unknown
  misc_feature (1)..( 8): Result.003 file - promoters60/4901783
caaccaat

SEQ ID NO: 143913 - DNA, 9 bp, Unknown
  misc_feature (1)..( 9): Result.003 file - promoters60/4901783
tagatgtca

SEQ ID NO: 143914 - DNA, 9 bp, Unknown
  misc_feature (1)..( 9): Result.003 file - promoters60/4901783
aaaatgtca

SEQ ID NO: 143915 - DNA, 9 bp, Unknown
  misc_feature (1)..( 9): Result.003 file - promoters60/4901783
taaatatca

SEQ ID NO: 143916 - DNA, 9 bp, Unknown
  misc_feature (1)..( 9): Result.003 file - promoters60/4901783
taagtatct

SEQ ID NO: 143917 - DNA, 9 bp, Unknown
  misc_feature (1)..( 9): Result.003 file - promoters60/4901783
tgagaacat

SEQ ID NO: 143918 - DNA, 9 bp, Unknown
  misc_feature (1)..( 9): Result.003 file - promoters60/4901783
tgaaaacta

SEQ ID NO: 143919 - DNA, 9 bp, Unknown
  misc_feature (1)..( 9): Result.003 file - promoters60/4901783
aaaaatcta

SEQ ID NO: 143920 - DNA, 9 bp, Unknown
  misc_feature (1)..( 9): Result.003 file - promoters60/4901783
agaaaacaa

SEQ ID NO: 143921 - DNA, 8 bp, Unknown
  misc_feature (1)..( 8): Result.003 file - promoters60/4901783
caaaaatc

SEQ ID NO: 143922 - DNA, 8 bp, Unknown
  misc_feature (1)..( 8): Result.003 file - promoters60/4901783
caaaaaaa

SEQ ID NO: 143923 - DNA, 8 bp, Unknown
  misc_feature (1)..( 8): Result.003 file - promoters60/4901783
taaatatc

SEQ ID NO: 143924 - DNA, 8 bp, Unknown
  misc_feature (1)..( 8): Result.003 file - promoters60/4901783
taagtatc

SEQ ID NO: 143925 - DNA, 7 bp, Unknown
  misc_feature (1)..( 7): Result.003 file - promoters60/4901822
catttga

SEQ ID NO: 143926 - DNA, 7 bp, Unknown
  misc_feature (1)..( 7): Result.003 file - promoters60/4901822
catgtga

SEQ ID NO: 143927 - DNA, 11 bp, Unknown
  misc_feature (1)..( 11): Result.003 file - promoters60/4901822
aacatcaagag

SEQ ID NO: 143928 - DNA, 11 bp, Unknown
  misc_feature (1)..( 11): Result.003 file - promoters60/4901822
aacctcatgag

SEQ ID NO: 143929 - DNA, 7 bp, Unknown
  misc_feature (1)..( 7): Result.003 file - promoters60/4901822
tcttcag

SEQ ID NO: 143930 - DNA, 7 bp, Unknown
  misc_feature (1)..( 7): Result.003 file - promoters60/4901822
tctgcag

SEQ ID NO: 143931 - DNA, 7 bp, Unknown
  misc_feature (1)..( 7): Result.003 file - promoters60/4901822
aagcagt

SEQ ID NO: 143932 - DNA, 7 bp, Unknown
  misc_feature (1)..( 7): Result.003 file - promoters60/4901822
aagtagt

SEQ ID NO: 143933 - DNA, 8 bp, Unknown
  misc_feature (1)..( 8): Result.003 file - promoters60/4901822
ggttctaa

SEQ ID NO: 143934 - DNA, 8 bp, Unknown
  misc_feature (1)..( 8): Result.003 file - promoters60/4901822
ggtactaa

SEQ ID NO: 143935 - DNA, 9 bp, Unknown
  misc_feature (1)..( 9): Result.003 file - promoters60/4901822
tttctccaa

SEQ ID NO: 143936 - DNA, 9 bp, Unknown
  misc_feature (1)..( 9): Result.003 file - promoters60/4901822
tttctacaa

SEQ ID NO: 143937 - DNA, 6 bp, Unknown
  misc_feature (1)..( 6): Result.003 file - promoters60/4901822
aaaaca

SEQ ID NO: 143938 - DNA, 6 bp, Unknown
  misc_feature (1)..( 6): Result.003 file - promoters60/4901822
aaaaca

SEQ ID NO: 143939 - DNA, 6 bp, Unknown
  misc_feature (1)..( 6): Result.003 file - promoters60/4901822
taatta

SEQ ID NO: 143940 - DNA, 6 bp, Unknown
  misc_feature (1)..( 6): Result.003 file - promoters60/4901822
taatta

SEQ ID NO: 143941 - DNA, 10 bp, Unknown
  misc_feature (1)..( 10): Result.003 file - promoters60/4901822
agaattccgg

SEQ ID NO: 143942 - DNA, 10 bp, Unknown
  misc_feature (1)..( 10): Result.003 file - promoters60/4901822
agatttccgg

SEQ ID NO: 143943 - DNA, 8 bp, Unknown
  misc_feature (1)..( 8): Result.003 file - promoters60/4901822
aacctaca

SEQ ID NO: 143944 - DNA, 8 bp, Unknown
  misc_feature (1)..( 8): Result.003 file - promoters60/4901822
aacctaca

SEQ ID NO: 143945 - DNA, 7 bp, Unknown
  misc_feature (1)..( 7): Result.003 file - promoters60/4901822
tggaaat

SEQ ID NO: 143946 - DNA, 7 bp, Unknown
  misc_feature (1)..( 7): Result.003 file - promoters60/4901822
tggtaat

SEQ ID NO: 143947 - DNA, 7 bp, Unknown
  misc_feature (1)..( 7): Result.003 file - promoters60/4901822
tttgtct

SEQ ID NO: 143948 - DNA, 7 bp, Unknown
  misc_feature (1)..( 7): Result.003 file - promoters60/4901822
tttttct

SEQ ID NO: 143949 - DNA, 10 bp, Unknown
  misc_feature (1)..( 10): Result.003 file - promoters60/4901822
tgagtcaata

SEQ ID NO: 143950 - DNA, 10 bp, Unknown
  misc_feature (1)..( 10): Result.003 file - promoters60/4901822
tgaatcaata

SEQ ID NO: 143951 - DNA, 8 bp, Unknown
  misc_feature (1)..( 8): Result.003 file - promoters60/4901822
ggtttttg

SEQ ID NO: 143952 - DNA, 8 bp, Unknown
  misc_feature (1)..( 8): Result.003 file - promoters60/4901822
ggtgtttg

SEQ ID NO: 143953 - DNA, 6 bp, Unknown
  misc_feature (1)..( 6): Result.003 file - promoters60/4901822
acaaac

SEQ ID NO: 143954 - DNA, 6 bp, Unknown
  misc_feature (1)..( 6): Result.003 file - promoters60/4901822
acaaac

SEQ ID NO: 143955 - DNA, 7 bp, Unknown
  misc_feature (1)..( 7): Result.003 file - promoters60/4901884
aaacaaa

SEQ ID NO: 143956 - DNA, 7 bp, Unknown
  misc_feature (1)..( 7): Result.003 file - promoters60/4901884
aaagaaa

SEQ ID NO: 143957 - DNA, 6 bp, Unknown
  misc_feature (1)..( 6): Result.003 file - promoters60/4901884
acaaaa

SEQ ID NO: 143958 - DNA, 6 bp, Unknown
  misc_feature (1)..( 6): Result.003 file - promoters60/4901884
acaaaa

SEQ ID NO: 143959 - DNA, 6 bp, Unknown
  misc_feature (1)..( 6): Result.003 file - promoters60/4901884
acaata

SEQ ID NO: 143960 - DNA, 6 bp, Unknown
  misc_feature (1)..( 6): Result.003 file - promoters60/4901884
acaata

SEQ ID NO: 143961 - DNA, 8 bp, Unknown
  misc_feature (1)..( 8): Result.003 file - promoters60/4901884
ggccatga

SEQ ID NO: 143962 - DNA, 8 bp, Unknown
  misc_feature (1)..( 8): Result.003 file - promoters60/4901884
ggccatga

SEQ ID NO: 143963 - DNA, 7 bp, Unknown
  misc_feature (1)..( 7): Result.003 file - promoters60/4901884
ataaaaa

SEQ ID NO: 143964 - DNA, 7 bp, Unknown
  misc_feature (1)..( 7): Result.003 file - promoters60/4901884
ataaaac

SEQ ID NO: 143965 - DNA, 7 bp, Unknown
  misc_feature (1)..( 7): Result.003 file - promoters60/4901884
ttaaaac

SEQ ID NO: 143966 - DNA, 6 bp, Unknown
  misc_feature (1)..( 6): Result.003 file - promoters60/4901884
gcaaac

SEQ ID NO: 143967 - DNA, 6 bp, Unknown
  misc_feature (1)..( 6): Result.003 file - promoters60/4901884
gcaaac

SEQ ID NO: 143968 - DNA, 10 bp, Unknown
  misc_feature (1)..( 10): Result.003 file - promoters60/4901884
aaaaaaatta

SEQ ID NO: 143969 - DNA, 10 bp, Unknown
  misc_feature (1)..( 10): Result.003 file - promoters60/4901884
aaaaaactta

SEQ ID NO: 143970 - DNA, 10 bp, Unknown
  misc_feature (1)..( 10): Result.003 file - promoters60/4901884
ataaaacttt

SEQ ID NO: 143971 - DNA, 9 bp, Unknown
  misc_feature (1)..( 9): Result.003 file - promoters60/4901884
tgagacact

SEQ ID NO: 143972 - DNA, 9 bp, Unknown
  misc_feature (1)..( 9): Result.003 file - promoters60/4901884
tgagatact

SEQ ID NO: 143973 - DNA, 6 bp, Unknown
  misc_feature (1)..( 6): Result.003 file - promoters60/4901884
tcattt

SEQ ID NO: 143974 - DNA, 6 bp, Unknown
  misc_feature (1)..( 6): Result.003 file - promoters60/4901884
tcattt

SEQ ID NO: 143975 - DNA, 6 bp, Unknown
  misc_feature (1)..( 6): Result.003 file - promoters60/4901884
tataca

SEQ ID NO: 143976 - DNA, 6 bp, Unknown
  misc_feature (1)..( 6): Result.003 file - promoters60/4901884
tataca

SEQ ID NO: 143977 - DNA, 6 bp, Unknown
  misc_feature (1)..( 6): Result.003 file - promoters60/4901884
aattta

SEQ ID NO: 143978 - DNA, 6 bp, Unknown
  misc_feature (1)..( 6): Result.003 file - promoters60/4901884
aattta

SEQ ID NO: 143979 - DNA, 6 bp, Unknown
  misc_feature (1)..( 6): Result.003 file - promoters60/4901884
ataatt

SEQ ID NO: 143980 - DNA, 6 bp, Unknown
  misc_feature (1)..( 6): Result.003 file - promoters60/4901884
ataatt

SEQ ID NO: 143981 - DNA, 6 bp, Unknown
  misc_feature (1)..( 6): Result.003 file - promoters60/4901884
ttttaa

SEQ ID NO: 143982 - DNA, 6 bp, Unknown
  misc_feature (1)..( 6): Result.003 file - promoters60/4901884
ttttaa

SEQ ID NO: 143983 - DNA, 6 bp, Unknown
  misc_feature (1)..( 6): Result.003 file - promoters60/4901884
aataat

SEQ ID NO: 143984 - DNA, 6 bp, Unknown
  misc_feature (1)..( 6): Result.003 file - promoters60/4901884
aataat

SEQ ID NO: 143985 - DNA, 6 bp, Unknown
  misc_feature (1)..( 6): Result.003 file - promoters60/4902082
ctttta

SEQ ID NO: 143986 - DNA, 6 bp, Unknown
  misc_feature (1)..( 6): Result.003 file - promoters60/4902082
ctttta

SEQ ID NO: 143987 - DNA, 7 bp, Unknown
  misc_feature (1)..( 7): Result.003 file - promoters60/4902082
tttgtta

SEQ ID NO: 143988 - DNA, 7 bp, Unknown
  misc_feature (1)..( 7): Result.003 file - promoters60/4902082
tttatta

SEQ ID NO: 143989 - DNA, 8 bp, Unknown
  misc_feature (1)..( 8): Result.003 file - promoters60/4902082
gtaaattt

SEQ ID NO: 143990 - DNA, 8 bp, Unknown
  misc_feature (1)..( 8): Result.003 file - promoters60/4902082
ataatttt

SEQ ID NO: 143991 - DNA, 9 bp, Unknown
  misc_feature (1)..( 9): Result.003 file - promoters60/4902082
ataatgttt

SEQ ID NO: 143992 - DNA, 6 bp, Unknown
  misc_feature (1)..( 6): Result.003 file - promoters60/4902082
attgaa

SEQ ID NO: 143993 - DNA, 6 bp, Unknown
  misc_feature (1)..( 6): Result.003 file - promoters60/4902082
attgaa

SEQ ID NO: 143994 - DNA, 13 bp, Unknown
  misc_feature (1)..( 13): Result.003 file - promoters60/4902082
ttccttcacattg

SEQ ID NO: 143995 - DNA, 13 bp, Unknown
  misc_feature (1)..( 13): Result.003 file - promoters60/4902082
ttccctcacattg

SEQ ID NO: 143996 - DNA, 13 bp, Unknown
  misc_feature (1)..( 13): Result.003 file - promoters60/4902082
agtattcccatta

SEQ ID NO: 143997 - DNA, 8 bp, Unknown
  misc_feature (1)..( 8): Result.003 file - promoters60/4902082
ttagatcc

SEQ ID NO: 143998 - DNA, 8 bp, Unknown
  misc_feature (1)..( 8): Result.003 file - promoters60/4902082
ttaaatcc

SEQ ID NO: 143999 - DNA, 9 bp, Unknown
  misc_feature (1)..( 9): Result.003 file - promoters60/4902082
acactgatg

SEQ ID NO: 144000 - DNA, 9 bp, Unknown
  misc_feature (1)..( 9): Result.003 file - promoters60/4902082
acaatgatg

SEQ ID NO: 144001 - DNA, 6 bp, Unknown
  misc_feature (1)..( 6): Result.003 file - promoters60/4902082
caaatg

SEQ ID NO: 144002 - DNA, 6 bp, Unknown
  misc_feature (1)..( 6): Result.003 file - promoters60/4902082
caaatg

SEQ ID NO: 144003 - DNA, 6 bp, Unknown
  misc_feature (1)..( 6): Result.003 file - promoters60/4902082
agtata

SEQ ID NO: 144004 - DNA, 6 bp, Unknown
  misc_feature (1)..( 6): Result.003 file - promoters60/4902082
agtata

SEQ ID NO: 144005 - DNA, 8 bp, Unknown
  misc_feature (1)..( 8): Result.003 file - promoters60/4902082
caactggt

SEQ ID NO: 144006 - DNA, 8 bp, Unknown
  misc_feature (1)..( 8): Result.003 file - promoters60/4902082
caaatggt

SEQ ID NO: 144007 - DNA, 7 bp, Unknown
  misc_feature (1)..( 7): Result.003 file - promoters60/4902082
attattt

SEQ ID NO: 144008 - DNA, 7 bp, Unknown
  misc_feature (1)..( 7): Result.003 file - promoters60/4902082
atttttt

SEQ ID NO: 144009 - DNA, 7 bp, Unknown
  misc_feature (1)..( 7): Result.003 file - promoters60/4902082
atagata

SEQ ID NO: 144010 - DNA, 7 bp, Unknown
  misc_feature (1)..( 7): Result.003 file - promoters60/4902082
atatata

SEQ ID NO: 144011 - DNA, 7 bp, Unknown
  misc_feature (1)..( 7): Result.003 file - promoters60/4902082
atgtaat

SEQ ID NO: 144012 - DNA, 7 bp, Unknown
  misc_feature (1)..( 7): Result.003 file - promoters60/4902082
atggaat

SEQ ID NO: 144013 - DNA, 7 bp, Unknown
  misc_feature (1)..( 7): Result.003 file - promoters60/4902082
acctaat

SEQ ID NO: 144014 - DNA, 7 bp, Unknown
  misc_feature (1)..( 7): Result.003 file - promoters60/4902082
accaaat

SEQ ID NO: 144015 - DNA, 6 bp, Unknown
  misc_feature (1)..( 6): Result.003 file - promoters60/4902082
tattat

SEQ ID NO: 144016 - DNA, 6 bp, Unknown
  misc_feature (1)..( 6): Result.003 file - promoters60/4902082
tattat

SEQ ID NO: 144017 - DNA, 6 bp, Unknown
  misc_feature (1)..( 6): Result.003 file - promoters60/4902082
aaaaaa

SEQ ID NO: 144018 - DNA, 6 bp, Unknown
  misc_feature (1)..( 6): Result.003 file - promoters60/4902082
aaaaaa

SEQ ID NO: 144019 - DNA, 6 bp, Unknown
  misc_feature (1)..( 6): Result.003 file - promoters60/4902082
gtcaaa

SEQ ID NO: 144020 - DNA, 6 bp, Unknown
  misc_feature (1)..( 6): Result.003 file - promoters60/4902082
gtcaaa

SEQ ID NO: 144021 - DNA, 6 bp, Unknown
  misc_feature (1)..( 6): Result.003 file - promoters60/4902082
ggcgag

SEQ ID NO: 144022 - DNA, 6 bp, Unknown
  misc_feature (1)..( 6): Result.003 file - promoters60/4902082
ggcgag

SEQ ID NO: 144023 - DNA, 7 bp, Unknown
  misc_feature (1)..( 7): Result.003 file - promoters60/4902143
accagaa

SEQ ID NO: 144024 - DNA, 7 bp, Unknown
  misc_feature (1)..( 7): Result.003 file - promoters60/4902143
accagaa

SEQ ID NO: 144025 - DNA, 7 bp, Unknown
  misc_feature (1)..( 7): Result.003 file - promoters60/4902143
accagaa

SEQ ID NO: 144026 - DNA, 7 bp, Unknown
  misc_feature (1)..( 7): Result.003 file - promoters60/4902143
aaacacc

SEQ ID NO: 144027 - DNA, 7 bp, Unknown
  misc_feature (1)..( 7): Result.003 file - promoters60/4902143
aaaaacc

SEQ ID NO: 144028 - DNA, 7 bp, Unknown
  misc_feature (1)..( 7): Result.003 file - promoters60/4902143
aaacacc

SEQ ID NO: 144029 - DNA, 7 bp, Unknown
  misc_feature (1)..( 7): Result.003 file - promoters60/4902143
aaaatca

SEQ ID NO: 144030 - DNA, 7 bp, Unknown
  misc_feature (1)..( 7): Result.003 file - promoters60/4902143
aaaatca

SEQ ID NO: 144031 - DNA, 7 bp, Unknown
  misc_feature (1)..( 7): Result.003 file - promoters60/4902143
aaaatca

SEQ ID NO: 144032 - DNA, 7 bp, Unknown
  misc_feature (1)..( 7): Result.003 file - promoters60/4902143
cggttta

SEQ ID NO: 144033 - DNA, 7 bp, Unknown
  misc_feature (1)..( 7): Result.003 file - promoters60/4902143
tggttta

SEQ ID NO: 144034 - DNA, 7 bp, Unknown
  misc_feature (1)..( 7): Result.003 file - promoters60/4902143
atgtttt

SEQ ID NO: 144035 - DNA, 7 bp, Unknown
  misc_feature (1)..( 7): Result.003 file - promoters60/4902143
atgtttt

SEQ ID NO: 144036 - DNA, 8 bp, Unknown
  misc_feature (1)..( 8): Result.003 file - promoters60/4902143
gaaaatat

SEQ ID NO: 144037 - DNA, 8 bp, Unknown
  misc_feature (1)..( 8): Result.003 file - promoters60/4902143
taaaatat

SEQ ID NO: 144038 - DNA, 8 bp, Unknown
  misc_feature (1)..( 8): Result.003 file - promoters60/4902143
taaaatgc

SEQ ID NO: 144039 - DNA, 12 bp, Unknown
  misc_feature (1)..( 12): Result.003 file - promoters60/4902143
taaaaaataaat

SEQ ID NO: 144040 - DNA, 12 bp, Unknown
  misc_feature (1)..( 12): Result.003 file - promoters60/4902143
gaaacaataaat

SEQ ID NO: 144041 - DNA, 12 bp, Unknown
  misc_feature (1)..( 12): Result.003 file - promoters60/4902143
taaacagacggt

SEQ ID NO: 144042 - DNA, 9 bp, Unknown
  misc_feature (1)..( 9): Result.003 file - promoters60/4902288
acaatttac

SEQ ID NO: 144043 - DNA, 9 bp, Unknown
  misc_feature (1)..( 9): Result.003 file - promoters60/4902288
taaatctac

SEQ ID NO: 144044 - DNA, 9 bp, Unknown
  misc_feature (1)..( 9): Result.003 file - promoters60/4902288
ttaatttat

SEQ ID NO: 144045 - DNA, 9 bp, Unknown
  misc_feature (1)..( 9): Result.003 file - promoters60/4902288
aaaaactat

SEQ ID NO: 144046 - DNA, 9 bp, Unknown
  misc_feature (1)..( 9): Result.003 file - promoters60/4902288
aaaaacatg

SEQ ID NO: 144047 - DNA, 10 bp, Unknown
  misc_feature (1)..( 10): Result.003 file - promoters60/4902288
aaaagatagc

SEQ ID NO: 144048 - DNA, 10 bp, Unknown
  misc_feature (1)..( 10): Result.003 file - promoters60/4902288
gaaatatata

SEQ ID NO: 144049 - DNA, 10 bp, Unknown
  misc_feature (1)..( 10): Result.003 file - promoters60/4902288
gaaatagatt

SEQ ID NO: 144050 - DNA, 10 bp, Unknown
  misc_feature (1)..( 10): Result.003 file - promoters60/4902288
ttagtagatt

SEQ ID NO: 144051 - DNA, 10 bp, Unknown
  misc_feature (1)..( 10): Result.003 file - promoters60/4902288
ttaatttatt

SEQ ID NO: 144052 - DNA, 10 bp, Unknown
  misc_feature (1)..( 10): Result.003 file - promoters60/4902288
tgattacttt

SEQ ID NO: 144053 - DNA, 15 bp, Unknown
  misc_feature (1)..( 15): Result.003 file - promoters60/4902387
cttatatgatgattg

SEQ ID NO: 144054 - DNA, 15 bp, Unknown
  misc_feature (1)..( 15): Result.003 file - promoters60/4902387
ttggtatcatgttta

SEQ ID NO: 144055 - DNA, 15 bp, Unknown
  misc_feature (1)..( 15): Result.003 file - promoters60/4902387
aaaatatgagataaa

SEQ ID NO: 144056 - DNA, 15 bp, Unknown
  misc_feature (1)..( 15): Result.003 file - promoters60/4902387
tttccttcattttta

SEQ ID NO: 144057 - DNA, 15 bp, Unknown
  misc_feature (1)..( 15): Result.003 file - promoters60/4902387
caaatatgaaaatct

SEQ ID NO: 144058 - DNA, 15 bp, Unknown
  misc_feature (1)..( 15): Result.003 file - promoters60/4902387
caaataaacaaactc

SEQ ID NO: 144059 - DNA, 7 bp, Unknown
  misc_feature (1)..( 7): Result.003 file - promoters60/4902387
tttcaac

SEQ ID NO: 144060 - DNA, 7 bp, Unknown
  misc_feature (1)..( 7): Result.003 file - promoters60/4902387
tttgaac

SEQ ID NO: 144061 - DNA, 7 bp, Unknown
  misc_feature (1)..( 7): Result.003 file - promoters60/4902387
tttgaaa

SEQ ID NO: 144062 - DNA, 8 bp, Unknown
  misc_feature (1)..( 8): Result.003 file - promoters60/4902387
tttagaaa

SEQ ID NO: 144063 - DNA, 8 bp, Unknown
  misc_feature (1)..( 8): Result.003 file - promoters60/4902387
ttaaaaaa

SEQ ID NO: 144064 - DNA, 8 bp, Unknown
  misc_feature (1)..( 8): Result.003 file - promoters60/4902387
aaaagaaa

SEQ ID NO: 144065 - DNA, 8 bp, Unknown
  misc_feature (1)..( 8): Result.003 file - promoters60/4902387
tcagtttc

SEQ ID NO: 144066 - DNA, 8 bp, Unknown
  misc_feature (1)..( 8): Result.003 file - promoters60/4902387
tcattttt

SEQ ID NO: 144067 - DNA, 9 bp, Unknown
  misc_feature (1)..( 9): Result.003 file - promoters60/4902387
tcatgttta

SEQ ID NO: 144068 - DNA, 9 bp, Unknown
  misc_feature (1)..( 9): Result.003 file - promoters60/4902387
caatgatta

SEQ ID NO: 144069 - DNA, 9 bp, Unknown
  misc_feature (1)..( 9): Result.003 file - promoters60/4902387
acatatttt

SEQ ID NO: 144070 - DNA, 9 bp, Unknown
  misc_feature (1)..( 9): Result.003 file - promoters60/4902387
caatgttta

SEQ ID NO: 144071 - DNA, 9 bp, Unknown
  misc_feature (1)..( 9): Result.003 file - promoters60/4902387
aaaaaatat

SEQ ID NO: 144072 - DNA, 9 bp, Unknown
  misc_feature (1)..( 9): Result.003 file - promoters60/4902387
acatatata

SEQ ID NO: 144073 - DNA, 11 bp, Unknown
  misc_feature (1)..( 11): Result.003 file - promoters60/4902387
tatgatgattg

SEQ ID NO: 144074 - DNA, 11 bp, Unknown
  misc_feature (1)..( 11): Result.003 file - promoters60/4902387
ttcaatgatta

SEQ ID NO: 144075 - DNA, 11 bp, Unknown
  misc_feature (1)..( 11): Result.003 file - promoters60/4902387
tatcatgttta

SEQ ID NO: 144076 - DNA, 11 bp, Unknown
  misc_feature (1)..( 11): Result.003 file - promoters60/4902387
aaacatatttt

SEQ ID NO: 144077 - DNA, 11 bp, Unknown
  misc_feature (1)..( 11): Result.003 file - promoters60/4902387
accaatgttta

SEQ ID NO: 144078 - DNA, 11 bp, Unknown
  misc_feature (1)..( 11): Result.003 file - promoters60/4902387
aaaaatatgag

SEQ ID NO: 144079 - DNA, 11 bp, Unknown
  misc_feature (1)..( 11): Result.003 file - promoters60/4902387
gtacatatata

SEQ ID NO: 144080 - DNA, 9 bp, Unknown
  misc_feature (1)..( 9): Result.003 file - promoters60/4902387
tcatgttta

SEQ ID NO: 144081 - DNA, 9 bp, Unknown
  misc_feature (1)..( 9): Result.003 file - promoters60/4902387
caatgttta

SEQ ID NO: 144082 - DNA, 9 bp, Unknown
  misc_feature (1)..( 9): Result.003 file - promoters60/4902387
tcattttta

SEQ ID NO: 144083 - DNA, 9 bp, Unknown
  misc_feature (1)..( 9): Result.003 file - promoters60/4902387
caatgatta

SEQ ID NO: 144084 - DNA, 9 bp, Unknown
  misc_feature (1)..( 9): Result.003 file - promoters60/4902387
acatatttt

SEQ ID NO: 144085 - DNA, 9 bp, Unknown
  misc_feature (1)..( 9): Result.003 file - promoters60/4902387
aaatgttga

SEQ ID NO: 144086 - DNA, 9 bp, Unknown
  misc_feature (1)..( 9): Result.003 file - promoters60/4902387
acatatata

SEQ ID NO: 144087 - DNA, 11 bp, Unknown
  misc_feature (1)..( 11): Result.003 file - promoters60/4902387
taggcaacaaa

SEQ ID NO: 144088 - DNA, 11 bp, Unknown
  misc_feature (1)..( 11): Result.003 file - promoters60/4902387
tattaaacaaa

SEQ ID NO: 144089 - DNA, 11 bp, Unknown
  misc_feature (1)..( 11): Result.003 file - promoters60/4902387
atctaaataaa

SEQ ID NO: 144090 - DNA, 11 bp, Unknown
  misc_feature (1)..( 11): Result.003 file - promoters60/4902387
atctgaatact

SEQ ID NO: 144091 - DNA, 11 bp, Unknown
  misc_feature (1)..( 11): Result.003 file - promoters60/4902387
aatcaaataaa

SEQ ID NO: 144092 - DNA, 11 bp, Unknown
  misc_feature (1)..( 11): Result.003 file - promoters60/4902387
tgctgaatctt

SEQ ID NO: 144093 - DNA, 14 bp, Unknown
  misc_feature (1)..( 14): Result.003 file - promoters60/4902387
atctaaataaattt

SEQ ID NO: 144094 - DNA, 14 bp, Unknown
  misc_feature (1)..( 14): Result.003 file - promoters60/4902387
ccagaaatgaattt

SEQ ID NO: 144095 - DNA, 14 bp, Unknown
  misc_feature (1)..( 14): Result.003 file - promoters60/4902387
tattaaacaaacca

SEQ ID NO: 144096 - DNA, 14 bp, Unknown
  misc_feature (1)..( 14): Result.003 file - promoters60/4902387
gaaaatctgaatac

SEQ ID NO: 144097 - DNA, 14 bp, Unknown
  misc_feature (1)..( 14): Result.003 file - promoters60/4902387
aatcaaataaacaa

SEQ ID NO: 144098 - DNA, 14 bp, Unknown
  misc_feature (1)..( 14): Result.003 file - promoters60/4902387
cagtaatgaagaag

SEQ ID NO: 144099 - DNA, 10 bp, Unknown
  misc_feature (1)..( 10): Result.003 file - promoters60/4902791
aaaactaaaa

SEQ ID NO: 144100 - DNA, 9 bp, Unknown
  misc_feature (1)..( 9): Result.003 file - promoters60/4902791
gaacaaaaa

SEQ ID NO: 144101 - DNA, 10 bp, Unknown
  misc_feature (1)..( 10): Result.003 file - promoters60/4902791
caaaccaaac

SEQ ID NO: 144102 - DNA, 10 bp, Unknown
  misc_feature (1)..( 10): Result.003 file - promoters60/4902791
tacacacaaa

SEQ ID NO: 144103 - DNA, 10 bp, Unknown
  misc_feature (1)..( 10): Result.003 file - promoters60/4902791
gcaacccatt

SEQ ID NO: 144104 - DNA, 9 bp, Unknown
  misc_feature (1)..( 9): Result.003 file - promoters60/4902791
tctcaaacc

SEQ ID NO: 144105 - DNA, 10 bp, Unknown
  misc_feature (1)..( 10): Result.003 file - promoters60/4902791
atataataaa

SEQ ID NO: 144106 - DNA, 10 bp, Unknown
  misc_feature (1)..( 10): Result.003 file - promoters60/4902791
gaatactaaa

SEQ ID NO: 144107 - DNA, 10 bp, Unknown
  misc_feature (1)..( 10): Result.003 file - promoters60/4902791
agttaaaaaa

SEQ ID NO: 144108 - DNA, 10 bp, Unknown
  misc_feature (1)..( 10): Result.003 file - promoters60/4902791
aaataataat

SEQ ID NO: 144109 - DNA, 10 bp, Unknown
  misc_feature (1)..( 10): Result.003 file - promoters60/4902791
agaaaatagt

SEQ ID NO: 144110 - DNA, 10 bp, Unknown
  misc_feature (1)..( 10): Result.003 file - promoters60/4902791
aaattatatc

SEQ ID NO: 144111 - DNA, 9 bp, Unknown
  misc_feature (1)..( 9): Result.003 file - promoters60/4903407
taaataaaa

SEQ ID NO: 144112 - DNA, 9 bp, Unknown
  misc_feature (1)..( 9): Result.003 file - promoters60/4903407
taaatatgt

SEQ ID NO: 144113 - DNA, 9 bp, Unknown
  misc_feature (1)..( 9): Result.003 file - promoters60/4903407
caaataaaa

SEQ ID NO: 144114 - DNA, 9 bp, Unknown
  misc_feature (1)..( 9): Result.003 file - promoters60/4903407
aaaatattt

SEQ ID NO: 144115 - DNA, 8 bp, Unknown
  misc_feature (1)..( 8): Result.003 file - promoters60/4903407
aaagacta

SEQ ID NO: 144116 - DNA, 8 bp, Unknown
  misc_feature (1)..( 8): Result.003 file - promoters60/4903407
aaaaactt

SEQ ID NO: 144117 - DNA, 8 bp, Unknown
  misc_feature (1)..( 8): Result.003 file - promoters60/4903407
aaagacag

SEQ ID NO: 144118 - DNA, 8 bp, Unknown
  misc_feature (1)..( 8): Result.003 file - promoters60/4903407
aaaaacta

SEQ ID NO: 144119 - DNA, 10 bp, Unknown
  misc_feature (1)..( 10): Result.003 file - promoters60/4903407
ctaaaaagta

SEQ ID NO: 144120 - DNA, 10 bp, Unknown
  misc_feature (1)..( 10): Result.003 file - promoters60/4903407
ataaaaaaaa

SEQ ID NO: 144121 - DNA, 10 bp, Unknown
  misc_feature (1)..( 10): Result.003 file - promoters60/4903407
acaaaaaaaa

SEQ ID NO: 144122 - DNA, 10 bp, Unknown
  misc_feature (1)..( 10): Result.003 file - promoters60/4903407
acaaaaagac

SEQ ID NO: 144123 - DNA, 10 bp, Unknown
  misc_feature (1)..( 10): Result.003 file - promoters60/4903407
gtttttctta

SEQ ID NO: 144124 - DNA, 10 bp, Unknown
  misc_feature (1)..( 10): Result.003 file - promoters60/4903407
gtttatctcc

SEQ ID NO: 144125 - DNA, 10 bp, Unknown
  misc_feature (1)..( 10): Result.003 file - promoters60/4903407
gtctttcttt

SEQ ID NO: 144126 - DNA, 10 bp, Unknown
  misc_feature (1)..( 10): Result.003 file - promoters60/4903407
acttttgttt

SEQ ID NO: 144127 - DNA, 11 bp, Unknown
  misc_feature (1)..( 11): Result.003 file - promoters60/4903407
aaaaataaata

SEQ ID NO: 144128 - DNA, 11 bp, Unknown
  misc_feature (1)..( 11): Result.003 file - promoters60/4903407
aaaaatatatt

SEQ ID NO: 144129 - DNA, 11 bp, Unknown
  misc_feature (1)..( 11): Result.003 file - promoters60/4903407
acaaatttatt

SEQ ID NO: 144130 - DNA, 11 bp, Unknown
  misc_feature (1)..( 11): Result.003 file - promoters60/4903407
aaagatatatc

SEQ ID NO: 144131 - DNA, 6 bp, Unknown
  misc_feature (1)..( 6): Result.003 file - promoters60/4903614
gattga

SEQ ID NO: 144132 - DNA, 6 bp, Unknown
  misc_feature (1)..( 6): Result.003 file - promoters60/4903614
gattga

SEQ ID NO: 144133 - DNA, 8 bp, Unknown
  misc_feature (1)..( 8): Result.003 file - promoters60/4903614
tcggtttt

SEQ ID NO: 144134 - DNA, 8 bp, Unknown
  misc_feature (1)..( 8): Result.003 file - promoters60/4903614
tcgatttt

SEQ ID NO: 144135 - DNA, 6 bp, Unknown
  misc_feature (1)..( 6): Result.003 file - promoters60/4903614
atttta

SEQ ID NO: 144136 - DNA, 6 bp, Unknown
  misc_feature (1)..( 6): Result.003 file - promoters60/4903614
atttta

SEQ ID NO: 144137 - DNA, 10 bp, Unknown
  misc_feature (1)..( 10): Result.003 file - promoters60/4903614
ttaatataaa

SEQ ID NO: 144138 - DNA, 10 bp, Unknown
  misc_feature (1)..( 10): Result.003 file - promoters60/4903614
acaatttaaa

SEQ ID NO: 144139 - DNA, 10 bp, Unknown
  misc_feature (1)..( 10): Result.003 file - promoters60/4903614
ttattataaa

SEQ ID NO: 144140 - DNA, 6 bp, Unknown
  misc_feature (1)..( 6): Result.003 file - promoters60/4903614
aaccgt

SEQ ID NO: 144141 - DNA, 6 bp, Unknown
  misc_feature (1)..( 6): Result.003 file - promoters60/4903614
aaccgt

SEQ ID NO: 144142 - DNA, 7 bp, Unknown
  misc_feature (1)..( 7): Result.003 file - promoters60/4903614
taatcta

SEQ ID NO: 144143 - DNA, 7 bp, Unknown
  misc_feature (1)..( 7): Result.003 file - promoters60/4903614
taaacta

SEQ ID NO: 144144 - DNA, 6 bp, Unknown
  misc_feature (1)..( 6): Result.003 file - promoters60/4903614
aatatt

SEQ ID NO: 144145 - DNA, 6 bp, Unknown
  misc_feature (1)..( 6): Result.003 file - promoters60/4903614
aatatt

SEQ ID NO: 144146 - DNA, 7 bp, Unknown
  misc_feature (1)..( 7): Result.003 file - promoters60/4903614
attctaa

SEQ ID NO: 144147 - DNA, 7 bp, Unknown
  misc_feature (1)..( 7): Result.003 file - promoters60/4903614
attataa

SEQ ID NO: 144148 - DNA, 8 bp, Unknown
  misc_feature (1)..( 8): Result.003 file - promoters60/4903614
tattttaa

SEQ ID NO: 144149 - DNA, 8 bp, Unknown
  misc_feature (1)..( 8): Result.003 file - promoters60/4903614
tattataa

SEQ ID NO: 144150 - DNA, 8 bp, Unknown
  misc_feature (1)..( 8): Result.003 file - promoters60/4903614
tttatggt

SEQ ID NO: 144151 - DNA, 8 bp, Unknown
  misc_feature (1)..( 8): Result.003 file - promoters60/4903614
tttctggt

SEQ ID NO: 144152 - DNA, 7 bp, Unknown
  misc_feature (1)..( 7): Result.003 file - promoters60/4903614
aatgaaa

SEQ ID NO: 144153 - DNA, 7 bp, Unknown
  misc_feature (1)..( 7): Result.003 file - promoters60/4903614
aataaaa

SEQ ID NO: 144154 - DNA, 7 bp, Unknown
  misc_feature (1)..( 7): Result.003 file - promoters60/4903614
acaaatt

SEQ ID NO: 144155 - DNA, 7 bp, Unknown
  misc_feature (1)..( 7): Result.003 file - promoters60/4903614
acacatt

SEQ ID NO: 144156 - DNA, 6 bp, Unknown
  misc_feature (1)..( 6): Result.003 file - promoters60/4903614
agaaaa

SEQ ID NO: 144157 - DNA, 6 bp, Unknown
  misc_feature (1)..( 6): Result.003 file - promoters60/4903614
agaaaa

SEQ ID NO: 144158 - DNA, 6 bp, Unknown
  misc_feature (1)..( 6): Result.003 file - promoters60/4903614
taataa

SEQ ID NO: 144159 - DNA, 6 bp, Unknown
  misc_feature (1)..( 6): Result.003 file - promoters60/4903614
taataa

SEQ ID NO: 144160 - DNA, 7 bp, Unknown
  misc_feature (1)..( 7): Result.003 file - promoters60/4903614
tgtttga

SEQ ID NO: 144161 - DNA, 7 bp, Unknown
  misc_feature (1)..( 7): Result.003 file - promoters60/4903614
tgtgtga

SEQ ID NO: 144162 - DNA, 6 bp, Unknown
  misc_feature (1)..( 6): Result.003 file - promoters60/4903614
taaaca

SEQ ID NO: 144163 - DNA, 6 bp, Unknown
  misc_feature (1)..( 6): Result.003 file - promoters60/4903614
taaaca

SEQ ID NO: 144164 - DNA, 7 bp, Unknown
  misc_feature (1)..( 7): Result.003 file - promoters60/4903614
acaaaat

SEQ ID NO: 144165 - DNA, 7 bp, Unknown
  misc_feature (1)..( 7): Result.003 file - promoters60/4903614
acaaaat

SEQ ID NO: 144166 - DNA, 8 bp, Unknown
  misc_feature (1)..( 8): Result.003 file - promoters60/4903614
gttaaata

SEQ ID NO: 144167 - DNA, 8 bp, Unknown
  misc_feature (1)..( 8): Result.003 file - promoters60/4903614
gttatata

SEQ ID NO: 144168 - DNA, 6 bp, Unknown
  misc_feature (1)..( 6): Result.003 file - promoters60/4903614
aaacct

SEQ ID NO: 144169 - DNA, 6 bp, Unknown
  misc_feature (1)..( 6): Result.003 file - promoters60/4903614
aaacct

SEQ ID NO: 144170 - DNA, 8 bp, Unknown
  misc_feature (1)..( 8): Result.003 file - promoters60/4903653
aaacatag

SEQ ID NO: 144171 - DNA, 8 bp, Unknown
  misc_feature (1)..( 8): Result.003 file - promoters60/4903653
aaaaatag

SEQ ID NO: 144172 - DNA, 8 bp, Unknown
  misc_feature (1)..( 8): Result.003 file - promoters60/4903653
caaagtag

SEQ ID NO: 144173 - DNA, 9 bp, Unknown
  misc_feature (1)..( 9): Result.003 file - promoters60/4903653
ataaaaacg

SEQ ID NO: 144174 - DNA, 9 bp, Unknown
  misc_feature (1)..( 9): Result.003 file - promoters60/4903653
ccaaaaacc

SEQ ID NO: 144175 - DNA, 9 bp, Unknown
  misc_feature (1)..( 9): Result.003 file - promoters60/4903653
ttaaaaaaa

SEQ ID NO: 144176 - DNA, 7 bp, Unknown
  misc_feature (1)..( 7): Result.003 file - promoters60/4903653
aaagtat

SEQ ID NO: 144177 - DNA, 7 bp, Unknown
  misc_feature (1)..( 7): Result.003 file - promoters60/4903653
aaagtag

SEQ ID NO: 144178 - DNA, 7 bp, Unknown
  misc_feature (1)..( 7): Result.003 file - promoters60/4903653
aaaatag

SEQ ID NO: 144179 - DNA, 13 bp, Unknown
  misc_feature (1)..( 13): Result.003 file - promoters60/4904511
tgtttcttttttc

SEQ ID NO: 144180 - DNA, 13 bp, Unknown
  misc_feature (1)..( 13): Result.003 file - promoters60/4904511
tgtttctgtttga

SEQ ID NO: 144181 - DNA, 13 bp, Unknown
  misc_feature (1)..( 13): Result.003 file - promoters60/4904511
aagagcttttttc

SEQ ID NO: 144182 - DNA, 13 bp, Unknown
  misc_feature (1)..( 13): Result.003 file - promoters60/4904511
gtcatatgttttt

SEQ ID NO: 144183 - DNA, 13 bp, Unknown
  misc_feature (1)..( 13): Result.003 file - promoters60/4904511
taacaattactaa

SEQ ID NO: 144184 - DNA, 13 bp, Unknown
  misc_feature (1)..( 13): Result.003 file - promoters60/4904511
tctcaatttctac

SEQ ID NO: 144185 - DNA, 13 bp, Unknown
  misc_feature (1)..( 13): Result.003 file - promoters60/4904511
taataattatcac

SEQ ID NO: 144186 - DNA, 13 bp, Unknown
  misc_feature (1)..( 13): Result.003 file - promoters60/4904511
tgtcaataactat

SEQ ID NO: 144187 - DNA, 9 bp, Unknown
  misc_feature (1)..( 9): Result.003 file - promoters60/4904511
agttaaata

SEQ ID NO: 144188 - DNA, 9 bp, Unknown
  misc_feature (1)..( 9): Result.003 file - promoters60/4904511
ttataaata

SEQ ID NO: 144189 - DNA, 9 bp, Unknown
  misc_feature (1)..( 9): Result.003 file - promoters60/4904511
ttataaata

SEQ ID NO: 144190 - DNA, 9 bp, Unknown
  misc_feature (1)..( 9): Result.003 file - promoters60/4904511
ttataaatt

SEQ ID NO: 144191 - DNA, 10 bp, Unknown
  misc_feature (1)..( 10): Result.003 file - promoters60/4904511
tctactcttc

SEQ ID NO: 144192 - DNA, 10 bp, Unknown
  misc_feature (1)..( 10): Result.003 file - promoters60/4904511
tcgactctta

SEQ ID NO: 144193 - DNA, 10 bp, Unknown
  misc_feature (1)..( 10): Result.003 file - promoters60/4904511
tcgacacttc

SEQ ID NO: 144194 - DNA, 10 bp, Unknown
  misc_feature (1)..( 10): Result.003 file - promoters60/4904511
ataactatta

SEQ ID NO: 144195 - DNA, 7 bp, Unknown
  misc_feature (1)..( 7): Result.003 file - promoters60/4906198
atcaaaa

SEQ ID NO: 144196 - DNA, 7 bp, Unknown
  misc_feature (1)..( 7): Result.003 file - promoters60/4906198
atctaaa

SEQ ID NO: 144197 - DNA, 7 bp, Unknown
  misc_feature (1)..( 7): Result.003 file - promoters60/4906198
ctctaaa

SEQ ID NO: 144198 - DNA, 9 bp, Unknown
  misc_feature (1)..( 9): Result.003 file - promoters60/4906198
aaacatttt

SEQ ID NO: 144199 - DNA, 9 bp, Unknown
  misc_feature (1)..( 9): Result.003 file - promoters60/4906198
caacaattt

SEQ ID NO: 144200 - DNA, 9 bp, Unknown
  misc_feature (1)..( 9): Result.003 file - promoters60/4906198
caataatga

SEQ ID NO: 144201 - DNA, 8 bp, Unknown
  misc_feature (1)..( 8): Result.003 file - promoters60/4906198
attagaat

SEQ ID NO: 144202 - DNA, 8 bp, Unknown
  misc_feature (1)..( 8): Result.003 file - promoters60/4906198
tttacaat

SEQ ID NO: 144203 - DNA, 8 bp, Unknown
  misc_feature (1)..( 8): Result.003 file - promoters60/4906198
tttccaac

SEQ ID NO: 144204 - DNA, 8 bp, Unknown
  misc_feature (1)..( 8): Result.003 file - promoters60/4906198
atatgcac

SEQ ID NO: 144205 - DNA, 8 bp, Unknown
  misc_feature (1)..( 8): Result.003 file - promoters60/4906198
atattcac

SEQ ID NO: 144206 - DNA, 8 bp, Unknown
  misc_feature (1)..( 8): Result.003 file - promoters60/4906198
atattcga

SEQ ID NO: 144207 - DNA, 8 bp, Unknown
  misc_feature (1)..( 8): Result.003 file - promoters60/4906198
aatcaaat

SEQ ID NO: 144208 - DNA, 8 bp, Unknown
  misc_feature (1)..( 8): Result.003 file - promoters60/4906198
aataaaaa

SEQ ID NO: 144209 - DNA, 8 bp, Unknown
  misc_feature (1)..( 8): Result.003 file - promoters60/4906198
cttaaaaa

SEQ ID NO: 144210 - DNA, 9 bp, Unknown
  misc_feature (1)..( 9): Result.003 file - promoters60/4909449
catataaag

SEQ ID NO: 144211 - DNA, 9 bp, Unknown
  misc_feature (1)..( 9): Result.003 file - promoters60/4909449
catatatac

SEQ ID NO: 144212 - DNA, 9 bp, Unknown
  misc_feature (1)..( 9): Result.003 file - promoters60/4909449
tatataaac

SEQ ID NO: 144213 - DNA, 9 bp, Unknown
  misc_feature (1)..( 9): Result.003 file - promoters60/4909449
aatataaag

SEQ ID NO: 144214 - DNA, 9 bp, Unknown
  misc_feature (1)..( 9): Result.003 file - promoters60/4909449
tatataaag

SEQ ID NO: 144215 - DNA, 9 bp, Unknown
  misc_feature (1)..( 9): Result.003 file - promoters60/4909449
tatagataa

SEQ ID NO: 144216 - DNA, 10 bp, Unknown
  misc_feature (1)..( 10): Result.003 file - promoters60/4909449
aaagttatag

SEQ ID NO: 144217 - DNA, 10 bp, Unknown
  misc_feature (1)..( 10): Result.003 file - promoters60/4909449
aaatttaatt

SEQ ID NO: 144218 - DNA, 10 bp, Unknown
  misc_feature (1)..( 10): Result.003 file - promoters60/4909449
aaaattagtg

SEQ ID NO: 144219 - DNA, 10 bp, Unknown
  misc_feature (1)..( 10): Result.003 file - promoters60/4909449
gaaactagat

SEQ ID NO: 144220 - DNA, 10 bp, Unknown
  misc_feature (1)..( 10): Result.003 file - promoters60/4909449
agaactagaa

SEQ ID NO: 144221 - DNA, 10 bp, Unknown
  misc_feature (1)..( 10): Result.003 file - promoters60/4909449
acaattaaat

SEQ ID NO: 144222 - DNA, 7 bp, Unknown
  misc_feature (1)..( 7): Result.003 file - promoters60/4910362
acacatg

SEQ ID NO: 144223 - DNA, 7 bp, Unknown
  misc_feature (1)..( 7): Result.003 file - promoters60/4910362
acaaatg

SEQ ID NO: 144224 - DNA, 8 bp, Unknown
  misc_feature (1)..( 8): Result.003 file - promoters60/4910362
atttatct

SEQ ID NO: 144225 - DNA, 8 bp, Unknown
  misc_feature (1)..( 8): Result.003 file - promoters60/4910362
atttgtct

SEQ ID NO: 144226 - DNA, 8 bp, Unknown
  misc_feature (1)..( 8): Result.003 file - promoters60/4910362
ttttgtca

SEQ ID NO: 144227 - DNA, 7 bp, Unknown
  misc_feature (1)..( 7): Result.003 file - promoters60/4910362
ttctttg

SEQ ID NO: 144228 - DNA, 7 bp, Unknown
  misc_feature (1)..( 7): Result.003 file - promoters60/4910362
ctctttg

SEQ ID NO: 144229 - DNA, 7 bp, Unknown
  misc_feature (1)..( 7): Result.003 file - promoters60/4910362
ttcattg

SEQ ID NO: 144230 - DNA, 7 bp, Unknown
  misc_feature (1)..( 7): Result.003 file - promoters60/4910362
aactaaa

SEQ ID NO: 144231 - DNA, 7 bp, Unknown
  misc_feature (1)..( 7): Result.003 file - promoters60/4910362
aacaaaa

SEQ ID NO: 144232 - DNA, 7 bp, Unknown
  misc_feature (1)..( 7): Result.003 file - promoters60/4910362
taatttc

SEQ ID NO: 144233 - DNA, 7 bp, Unknown
  misc_feature (1)..( 7): Result.003 file - promoters60/4910362
taaattc

SEQ ID NO: 144234 - DNA, 9 bp, Unknown
  misc_feature (1)..( 9): Result.003 file - promoters60/4910362
tctttgctt

SEQ ID NO: 144235 - DNA, 9 bp, Unknown
  misc_feature (1)..( 9): Result.003 file - promoters60/4910362
aatttactt

SEQ ID NO: 144236 - DNA, 9 bp, Unknown
  misc_feature (1)..( 9): Result.003 file - promoters60/4910362
aatatacta

SEQ ID NO: 144237 - DNA, 7 bp, Unknown
  misc_feature (1)..( 7): Result.003 file - promoters60/4910362
ttatttt

SEQ ID NO: 144238 - DNA, 7 bp, Unknown
  misc_feature (1)..( 7): Result.003 file - promoters60/4910362
ttatttt

SEQ ID NO: 144239 - DNA, 8 bp, Unknown
  misc_feature (1)..( 8): Result.003 file - promoters60/4910362
tatatatt

SEQ ID NO: 144240 - DNA, 8 bp, Unknown
  misc_feature (1)..( 8): Result.003 file - promoters60/4910362
tatttatt

SEQ ID NO: 144241 - DNA, 9 bp, Unknown
  misc_feature (1)..( 9): Result.003 file - promoters60/4910362
tttttattt

SEQ ID NO: 144242 - DNA, 9 bp, Unknown
  misc_feature (1)..( 9): Result.003 file - promoters60/4910362
tttttgttt

SEQ ID NO: 144243 - DNA, 10 bp, Unknown
  misc_feature (1)..( 10): Result.003 file - promoters60/4910362
ttgaccttat

SEQ ID NO: 144244 - DNA, 10 bp, Unknown
  misc_feature (1)..( 10): Result.003 file - promoters60/4910362
ttgcccttat

SEQ ID NO: 144245 - DNA, 8 bp, Unknown
  misc_feature (1)..( 8): Result.003 file - promoters60/4910362
atttcaca

SEQ ID NO: 144246 - DNA, 8 bp, Unknown
  misc_feature (1)..( 8): Result.003 file - promoters60/4910362
atttaaca

SEQ ID NO: 144247 - DNA, 7 bp, Unknown
  misc_feature (1)..( 7): Result.003 file - promoters60/4910362
ttagtaa

SEQ ID NO: 144248 - DNA, 7 bp, Unknown
  misc_feature (1)..( 7): Result.003 file - promoters60/4910362
ttactaa

SEQ ID NO: 144249 - DNA, 8 bp, Unknown
  misc_feature (1)..( 8): Result.003 file - promoters60/4910362
attctaat

SEQ ID NO: 144250 - DNA, 8 bp, Unknown
  misc_feature (1)..( 8): Result.003 file - promoters60/4910362
attttaat

SEQ ID NO: 144251 - DNA, 9 bp, Unknown
  misc_feature (1)..( 9): Result.003 file - promoters60/4910362
taatctatt

SEQ ID NO: 144252 - DNA, 9 bp, Unknown
  misc_feature (1)..( 9): Result.003 file - promoters60/4910362
taatttatt

SEQ ID NO: 144253 - DNA, 6 bp, Unknown
  misc_feature (1)..( 6): Result.003 file - promoters60/4910362
actgta

SEQ ID NO: 144254 - DNA, 6 bp, Unknown
  misc_feature (1)..( 6): Result.003 file - promoters60/4910362
actgta

SEQ ID NO: 144255 - DNA, 6 bp, Unknown
  misc_feature (1)..( 6): Result.003 file - promoters60/4910362
tttgta

SEQ ID NO: 144256 - DNA, 6 bp, Unknown
  misc_feature (1)..( 6): Result.003 file - promoters60/4910362
tttgta

SEQ ID NO: 144257 - DNA, 7 bp, Unknown
  misc_feature (1)..( 7): Result.003 file - promoters60/4910362
ttttctt

SEQ ID NO: 144258 - DNA, 7 bp, Unknown
  misc_feature (1)..( 7): Result.003 file - promoters60/4910362
tttcctt

SEQ ID NO: 144259 - DNA, 6 bp, Unknown
  misc_feature (1)..( 6): Result.003 file - promoters60/4910362
tatttt

SEQ ID NO: 144260 - DNA, 6 bp, Unknown
  misc_feature (1)..( 6): Result.003 file - promoters60/4910362
tatttt

SEQ ID NO: 144261 - DNA, 7 bp, Unknown
  misc_feature (1)..( 7): Result.003 file - promoters60/4910362
gaaaaaa

SEQ ID NO: 144262 - DNA, 7 bp, Unknown
  misc_feature (1)..( 7): Result.003 file - promoters60/4910362
gaaaaaa

SEQ ID NO: 144263 - DNA, 7 bp, Unknown
  misc_feature (1)..( 7): Result.003 file - promoters60/4910362
aaaatct

SEQ ID NO: 144264 - DNA, 7 bp, Unknown
  misc_feature (1)..( 7): Result.003 file - promoters60/4910362
aaaatct

SEQ ID NO: 144265 - DNA, 7 bp, Unknown
  misc_feature (1)..( 7): Result.003 file - promoters60/4910362
aaccaaa

SEQ ID NO: 144266 - DNA, 7 bp, Unknown
  misc_feature (1)..( 7): Result.003 file - promoters60/4910362
aactaaa

SEQ ID NO: 144267 - DNA, 9 bp, Unknown
  misc_feature (1)..( 9): Result.003 file - promoters60/4910426
tttaattag

SEQ ID NO: 144268 - DNA, 9 bp, Unknown
  misc_feature (1)..( 9): Result.003 file - promoters60/4910426
cttaattac

SEQ ID NO: 144269 - DNA, 9 bp, Unknown
  misc_feature (1)..( 9): Result.003 file - promoters60/4910426
ctttattat

SEQ ID NO: 144270 - DNA, 9 bp, Unknown
  misc_feature (1)..( 9): Result.003 file - promoters60/4910426
cattagtat

SEQ ID NO: 144271 - DNA, 8 bp, Unknown
  misc_feature (1)..( 8): Result.003 file - promoters60/4910426
atatttaa

SEQ ID NO: 144272 - DNA, 8 bp, Unknown
  misc_feature (1)..( 8): Result.003 file - promoters60/4910426
ttatttat

SEQ ID NO: 144273 - DNA, 8 bp, Unknown
  misc_feature (1)..( 8): Result.003 file - promoters60/4910426
ttaattat

SEQ ID NO: 144274 - DNA, 8 bp, Unknown
  misc_feature (1)..( 8): Result.003 file - promoters60/4910426
acaattat

SEQ ID NO: 144275 - DNA, 11 bp, Unknown
  misc_feature (1)..( 11): Result.003 file - promoters60/4910426
ctatatataca

SEQ ID NO: 144276 - DNA, 11 bp, Unknown
  misc_feature (1)..( 11): Result.003 file - promoters60/4910426
gtatttattaa

SEQ ID NO: 144277 - DNA, 11 bp, Unknown
  misc_feature (1)..( 11): Result.003 file - promoters60/4910426
ctatatatata

SEQ ID NO: 144278 - DNA, 11 bp, Unknown
  misc_feature (1)..( 11): Result.003 file - promoters60/4910426
ctataaatata

SEQ ID NO: 144279 - DNA, 11 bp, Unknown
  misc_feature (1)..( 11): Result.003 file - promoters60/4910426
atatacatata

SEQ ID NO: 144280 - DNA, 11 bp, Unknown
  misc_feature (1)..( 11): Result.003 file - promoters60/4910426
ctataaatata

SEQ ID NO: 144281 - DNA, 11 bp, Unknown
  misc_feature (1)..( 11): Result.003 file - promoters60/4910426
atataaatttg

SEQ ID NO: 144282 - DNA, 11 bp, Unknown
  misc_feature (1)..( 11): Result.003 file - promoters60/4910426
ctatatatata

SEQ ID NO: 144283 - DNA, 6 bp, Unknown
  misc_feature (1)..( 6): Result.003 file - promoters60/4911303
tttaag

SEQ ID NO: 144284 - DNA, 6 bp, Unknown
  misc_feature (1)..( 6): Result.003 file - promoters60/4911303
tttaag

SEQ ID NO: 144285 - DNA, 7 bp, Unknown
  misc_feature (1)..( 7): Result.003 file - promoters60/4911303
caattta

SEQ ID NO: 144286 - DNA, 7 bp, Unknown
  misc_feature (1)..( 7): Result.003 file - promoters60/4911303
taattta

SEQ ID NO: 144287 - DNA, 7 bp, Unknown
  misc_feature (1)..( 7): Result.003 file - promoters60/4911303
taagtta

SEQ ID NO: 144288 - DNA, 11 bp, Unknown
  misc_feature (1)..( 11): Result.003 file - promoters60/4911303
agagtaaataa

SEQ ID NO: 144289 - DNA, 11 bp, Unknown
  misc_feature (1)..( 11): Result.003 file - promoters60/4911303
agaggaaatga

SEQ ID NO: 144290 - DNA, 11 bp, Unknown
  misc_feature (1)..( 11): Result.003 file - promoters60/4911303
tcttgaagtga

SEQ ID NO: 144291 - DNA, 9 bp, Unknown
  misc_feature (1)..( 9): Result.003 file - promoters60/4911303
tcttttttt

SEQ ID NO: 144292 - DNA, 9 bp, Unknown
  misc_feature (1)..( 9): Result.003 file - promoters60/4911303
tctatttaa

SEQ ID NO: 144293 - DNA, 9 bp, Unknown
  misc_feature (1)..( 9): Result.003 file - promoters60/4911303
tctaattaa

SEQ ID NO: 144294 - DNA, 9 bp, Unknown
  misc_feature (1)..( 9): Result.003 file - promoters60/4911303
tttttttta

SEQ ID NO: 144295 - DNA, 9 bp, Unknown
  misc_feature (1)..( 9): Result.003 file - promoters60/4911303
ttttcttta

SEQ ID NO: 144296 - DNA, 6 bp, Unknown
  misc_feature (1)..( 6): Result.003 file - promoters60/4911303
atcatt

SEQ ID NO: 144297 - DNA, 6 bp, Unknown
  misc_feature (1)..( 6): Result.003 file - promoters60/4911303
atcatt

SEQ ID NO: 144298 - DNA, 8 bp, Unknown
  misc_feature (1)..( 8): Result.003 file - promoters60/4911303
aagtttta

SEQ ID NO: 144299 - DNA, 8 bp, Unknown
  misc_feature (1)..( 8): Result.003 file - promoters60/4911303
aagtatta

SEQ ID NO: 144300 - DNA, 7 bp, Unknown
  misc_feature (1)..( 7): Result.003 file - promoters60/4911303
taagtta

SEQ ID NO: 144301 - DNA, 7 bp, Unknown
  misc_feature (1)..( 7): Result.003 file - promoters60/4911303
taagtta

SEQ ID NO: 144302 - DNA, 7 bp, Unknown
  misc_feature (1)..( 7): Result.003 file - promoters60/4911303
taattta

SEQ ID NO: 144303 - DNA, 8 bp, Unknown
  misc_feature (1)..( 8): Result.003 file - promoters60/4911303
aaaagaaa

SEQ ID NO: 144304 - DNA, 8 bp, Unknown
  misc_feature (1)..( 8): Result.003 file - promoters60/4911303
aaacgaaa

SEQ ID NO: 144305 - DNA, 11 bp, Unknown
  misc_feature (1)..( 11): Result.003 file - promoters60/4911303
aaaagaaacta

SEQ ID NO: 144306 - DNA, 11 bp, Unknown
  misc_feature (1)..( 11): Result.003 file - promoters60/4911303
aaaagaaacta

SEQ ID NO: 144307 - DNA, 8 bp, Unknown
  misc_feature (1)..( 8): Result.003 file - promoters60/4911303
atttcttt

SEQ ID NO: 144308 - DNA, 8 bp, Unknown
  misc_feature (1)..( 8): Result.003 file - promoters60/4911303
atttgttt

SEQ ID NO: 144309 - DNA, 6 bp, Unknown
  misc_feature (1)..( 6): Result.003 file - promoters60/4911303
ttattt

SEQ ID NO: 144310 - DNA, 6 bp, Unknown
  misc_feature (1)..( 6): Result.003 file - promoters60/4911303
ttattt

SEQ ID NO: 144311 - DNA, 7 bp, Unknown
  misc_feature (1)..( 7): Result.003 file - promoters60/4911303
gacatga

SEQ ID NO: 144312 - DNA, 7 bp, Unknown
  misc_feature (1)..( 7): Result.003 file - promoters60/4911303
gacgtga

SEQ ID NO: 144313 - DNA, 7 bp, Unknown
  misc_feature (1)..( 7): Result.003 file - promoters60/4911303
ccgtgta

SEQ ID NO: 144314 - DNA, 7 bp, Unknown
  misc_feature (1)..( 7): Result.003 file - promoters60/4911303
ccgcgta

SEQ ID NO: 144315 - DNA, 8 bp, Unknown
  misc_feature (1)..( 8): Result.003 file - promoters60/4911303
cgcgggaa

SEQ ID NO: 144316 - DNA, 8 bp, Unknown
  misc_feature (1)..( 8): Result.003 file - promoters60/4911303
cgcgtgaa

SEQ ID NO: 144317 - DNA, 6 bp, Unknown
  misc_feature (1)..( 6): Result.003 file - promoters60/4911303
tttata

SEQ ID NO: 144318 - DNA, 6 bp, Unknown
  misc_feature (1)..( 6): Result.003 file - promoters60/4911303
tttata

SEQ ID NO: 144319 - DNA, 10 bp, Unknown
  misc_feature (1)..( 10): Result.003 file - promoters60/4911303
atacagagat

SEQ ID NO: 144320 - DNA, 10 bp, Unknown
  misc_feature (1)..( 10): Result.003 file - promoters60/4911303
taacagagat

SEQ ID NO: 144321 - DNA, 10 bp, Unknown
  misc_feature (1)..( 10): Result.003 file - promoters60/4911303
taacagaaaa

SEQ ID NO: 144322 - DNA, 6 bp, Unknown
  misc_feature (1)..( 6): Result.003 file - promoters60/4911303
tttata

SEQ ID NO: 144323 - DNA, 6 bp, Unknown
  misc_feature (1)..( 6): Result.003 file - promoters60/4911303
tttata

SEQ ID NO: 144324 - DNA, 6 bp, Unknown
  misc_feature (1)..( 6): Result.003 file - promoters60/4911303
aaacag

SEQ ID NO: 144325 - DNA, 6 bp, Unknown
  misc_feature (1)..( 6): Result.003 file - promoters60/4911303
aaacag

SEQ ID NO: 144326 - DNA, 7 bp, Unknown
  misc_feature (1)..( 7): Result.003 file - promoters60/4911303
ttttatt

SEQ ID NO: 144327 - DNA, 7 bp, Unknown
  misc_feature (1)..( 7): Result.003 file - promoters60/4911303
tttaatt

SEQ ID NO: 144328 - DNA, 6 bp, Unknown
  misc_feature (1)..( 6): Result.003 file - promoters60/4911303
tccact

SEQ ID NO: 144329 - DNA, 6 bp, Unknown
  misc_feature (1)..( 6): Result.003 file - promoters60/4911303
tccact

SEQ ID NO: 144330 - DNA, 8 bp, Unknown
  misc_feature (1)..( 8): Result.003 file - promoters60/4911303
attaatga

SEQ ID NO: 144331 - DNA, 8 bp, Unknown
  misc_feature (1)..( 8): Result.003 file - promoters60/4911303
attgatga

SEQ ID NO: 144332 - DNA, 6 bp, Unknown
  misc_feature (1)..( 6): Result.003 file - promoters60/4911303
cgggtc

SEQ ID NO: 144333 - DNA, 6 bp, Unknown
  misc_feature (1)..( 6): Result.003 file - promoters60/4911303
cgggtc

SEQ ID NO: 144334 - DNA, 12 bp, Unknown
  misc_feature (1)..( 12): Result.003 file - promoters60/4911309
caaaatttcttg

SEQ ID NO: 144335 - DNA, 12 bp, Unknown
  misc_feature (1)..( 12): Result.003 file - promoters60/4911309
caacattgcttg

SEQ ID NO: 144336 - DNA, 12 bp, Unknown
  misc_feature (1)..( 12): Result.003 file - promoters60/4911309
gaaagttttctc

SEQ ID NO: 144337 - DNA, 6 bp, Unknown
  misc_feature (1)..( 6): Result.003 file - promoters60/4911309
ttttct

SEQ ID NO: 144338 - DNA, 6 bp, Unknown
  misc_feature (1)..( 6): Result.003 file - promoters60/4911309
ttttct

SEQ ID NO: 144339 - DNA, 6 bp, Unknown
  misc_feature (1)..( 6): Result.003 file - promoters60/4911309
ttttct

SEQ ID NO: 144340 - DNA, 9 bp, Unknown
  misc_feature (1)..( 9): Result.003 file - promoters60/4911309
gatgcttat

SEQ ID NO: 144341 - DNA, 9 bp, Unknown
  misc_feature (1)..( 9): Result.003 file - promoters60/4911309
aatgtttat

SEQ ID NO: 144342 - DNA, 9 bp, Unknown
  misc_feature (1)..( 9): Result.003 file - promoters60/4911309
tcttcttac

SEQ ID NO: 144343 - DNA, 9 bp, Unknown
  misc_feature (1)..( 9): Result.003 file - promoters60/4911309
tctccttat

SEQ ID NO: 144344 - DNA, 9 bp, Unknown
  misc_feature (1)..( 9): Result.003 file - promoters60/4911309
gcttattat

SEQ ID NO: 144345 - DNA, 9 bp, Unknown
  misc_feature (1)..( 9): Result.003 file - promoters60/4911309
cattattat

SEQ ID NO: 144346 - DNA, 9 bp, Unknown
  misc_feature (1)..( 9): Result.003 file - promoters60/4911309
tcttcttac

SEQ ID NO: 144347 - DNA, 9 bp, Unknown
  misc_feature (1)..( 9): Result.003 file - promoters60/4911309
tctccttat

SEQ ID NO: 144348 - DNA, 10 bp, Unknown
  misc_feature (1)..( 10): Result.003 file - promoters60/4911309
ttcatttgaa

SEQ ID NO: 144349 - DNA, 10 bp, Unknown
  misc_feature (1)..( 10): Result.003 file - promoters60/4911309
ttcttttgag

SEQ ID NO: 144350 - DNA, 10 bp, Unknown
  misc_feature (1)..( 10): Result.003 file - promoters60/4911309
gacttttagt

SEQ ID NO: 144351 - DNA, 11 bp, Unknown
  misc_feature (1)..( 11): Result.003 file - promoters60/4911312
aattttaatct

SEQ ID NO: 144352 - DNA, 11 bp, Unknown
  misc_feature (1)..( 11): Result.003 file - promoters60/4911312
atttttattct

SEQ ID NO: 144353 - DNA, 11 bp, Unknown
  misc_feature (1)..( 11): Result.003 file - promoters60/4911312
aattctaaaat

SEQ ID NO: 144354 - DNA, 11 bp, Unknown
  misc_feature (1)..( 11): Result.003 file - promoters60/4911312
gattttagaaa

SEQ ID NO: 144355 - DNA, 11 bp, Unknown
  misc_feature (1)..( 11): Result.003 file - promoters60/4911312
tattctaaaaa

SEQ ID NO: 144356 - DNA, 12 bp, Unknown
  misc_feature (1)..( 12): Result.003 file - promoters60/4911312
gtttttgattca

SEQ ID NO: 144357 - DNA, 7 bp, Unknown
  misc_feature (1)..( 7): Result.003 file - promoters60/4911314
gagttgg

SEQ ID NO: 144358 - DNA, 7 bp, Unknown
  misc_feature (1)..( 7): Result.003 file - promoters60/4911314
gagttgt

SEQ ID NO: 144359 - DNA, 7 bp, Unknown
  misc_feature (1)..( 7): Result.003 file - promoters60/4911314
cagttgt

SEQ ID NO: 144360 - DNA, 9 bp, Unknown
  misc_feature (1)..( 9): Result.003 file - promoters60/4911314
ctgatgaaa

SEQ ID NO: 144361 - DNA, 9 bp, Unknown
  misc_feature (1)..( 9): Result.003 file - promoters60/4911314
gggatcaaa

SEQ ID NO: 144362 - DNA, 9 bp, Unknown
  misc_feature (1)..( 9): Result.003 file - promoters60/4911314
ctgttgaca

SEQ ID NO: 144363 - DNA, 6 bp, Unknown
  misc_feature (1)..( 6): Result.003 file - promoters60/4911314
aatctt

SEQ ID NO: 144364 - DNA, 6 bp, Unknown
  misc_feature (1)..( 6): Result.003 file - promoters60/4911314
aatctt

SEQ ID NO: 144365 - DNA, 8 bp, Unknown
  misc_feature (1)..( 8): Result.003 file - promoters60/4911314
aacttaaa

SEQ ID NO: 144366 - DNA, 8 bp, Unknown
  misc_feature (1)..( 8): Result.003 file - promoters60/4911314
aacttaaa

SEQ ID NO: 144367 - DNA, 6 bp, Unknown
  misc_feature (1)..( 6): Result.003 file - promoters60/4911314
tagtct

SEQ ID NO: 144368 - DNA, 6 bp, Unknown
  misc_feature (1)..( 6): Result.003 file - promoters60/4911314
tagtct

SEQ ID NO: 144369 - DNA, 6 bp, Unknown
  misc_feature (1)..( 6): Result.003 file - promoters60/4911314
ctaaac

SEQ ID NO: 144370 - DNA, 6 bp, Unknown
  misc_feature (1)..( 6): Result.003 file - promoters60/4911314
ctaaac

SEQ ID NO: 144371 - DNA, 6 bp, Unknown
  misc_feature (1)..( 6): Result.003 file - promoters60/4911314
agttgt

SEQ ID NO: 144372 - DNA, 6 bp, Unknown
  misc_feature (1)..( 6): Result.003 file - promoters60/4911314
agttgt

SEQ ID NO: 144373 - DNA, 6 bp, Unknown
  misc_feature (1)..( 6): Result.003 file - promoters60/4911314
agttgt

SEQ ID NO: 144374 - DNA, 8 bp, Unknown
  misc_feature (1)..( 8): Result.003 file - promoters60/4911314
atgtagct

SEQ ID NO: 144375 - DNA, 8 bp, Unknown
  misc_feature (1)..( 8): Result.003 file - promoters60/4911314
atgtagct

SEQ ID NO: 144376 - DNA, 8 bp, Unknown
  misc_feature (1)..( 8): Result.003 file - promoters60/4911314
ttgagagt

SEQ ID NO: 144377 - DNA, 8 bp, Unknown
  misc_feature (1)..( 8): Result.003 file - promoters60/4911314
ttgacagt

SEQ ID NO: 144378 - DNA, 9 bp, Unknown
  misc_feature (1)..( 9): Result.003 file - promoters60/4911314
tttgtgtaa

SEQ ID NO: 144379 - DNA, 9 bp, Unknown
  misc_feature (1)..( 9): Result.003 file - promoters60/4911314
tttgtctaa

SEQ ID NO: 144380 - DNA, 7 bp, Unknown
  misc_feature (1)..( 7): Result.003 file - promoters60/4911314
tcttctc

SEQ ID NO: 144381 - DNA, 7 bp, Unknown
  misc_feature (1)..( 7): Result.003 file - promoters60/4911314
tcttctc

SEQ ID NO: 144382 - DNA, 7 bp, Unknown
  misc_feature (1)..( 7): Result.003 file - promoters60/4911314
ttccctt

SEQ ID NO: 144383 - DNA, 7 bp, Unknown
  misc_feature (1)..( 7): Result.003 file - promoters60/4911314
ttcactt

SEQ ID NO: 144384 - DNA, 6 bp, Unknown
  misc_feature (1)..( 6): Result.003 file - promoters60/4911314
atttaa

SEQ ID NO: 144385 - DNA, 6 bp, Unknown
  misc_feature (1)..( 6): Result.003 file - promoters60/4911314
atttaa

SEQ ID NO: 144386 - DNA, 7 bp, Unknown
  misc_feature (1)..( 7): Result.003 file - promoters60/4911314
aaagtaa

SEQ ID NO: 144387 - DNA, 7 bp, Unknown
  misc_feature (1)..( 7): Result.003 file - promoters60/4911314
aaattaa

SEQ ID NO: 144388 - DNA, 9 bp, Unknown
  misc_feature (1)..( 9): Result.003 file - promoters60/4911314
cacgtgtga

SEQ ID NO: 144389 - DNA, 9 bp, Unknown
  misc_feature (1)..( 9): Result.003 file - promoters60/4911314
cacgtgtga

SEQ ID NO: 144390 - DNA, 7 bp, Unknown
  misc_feature (1)..( 7): Result.003 file - promoters60/4911314
aagtcaa

SEQ ID NO: 144391 - DNA, 7 bp, Unknown
  misc_feature (1)..( 7): Result.003 file - promoters60/4911314
aagtcaa

SEQ ID NO: 144392 - DNA, 6 bp, Unknown
  misc_feature (1)..( 6): Result.003 file - promoters60/4911314
tcaagt

SEQ ID NO: 144393 - DNA, 6 bp, Unknown
  misc_feature (1)..( 6): Result.003 file - promoters60/4911314
tcaagt

SEQ ID NO: 144394 - DNA, 7 bp, Unknown
  misc_feature (1)..( 7): Result.003 file - promoters60/4911314
acaaaca

SEQ ID NO: 144395 - DNA, 7 bp, Unknown
  misc_feature (1)..( 7): Result.003 file - promoters60/4911314
acaaaca

SEQ ID NO: 144396 - DNA, 10 bp, Unknown
  misc_feature (1)..( 10): Result.003 file - promoters60/4911457
gttgaatttg

SEQ ID NO: 144397 - DNA, 10 bp, Unknown
  misc_feature (1)..( 10): Result.003 file - promoters60/4911457
ggagaatttg

SEQ ID NO: 144398 - DNA, 10 bp, Unknown
  misc_feature (1)..( 10): Result.003 file - promoters60/4911457
gttggatttt

SEQ ID NO: 144399 - DNA, 8 bp, Unknown
  misc_feature (1)..( 8): Result.003 file - promoters60/4911457
tttggata

SEQ ID NO: 144400 - DNA, 8 bp, Unknown
  misc_feature (1)..( 8): Result.003 file - promoters60/4911457
tttagata

SEQ ID NO: 144401 - DNA, 8 bp, Unknown
  misc_feature (1)..( 8): Result.003 file - promoters60/4911457
tttagaat

SEQ ID NO: 144402 - DNA, 7 bp, Unknown
  misc_feature (1)..( 7): Result.003 file - promoters60/4911457
catcaat

SEQ ID NO: 144403 - DNA, 7 bp, Unknown
  misc_feature (1)..( 7): Result.003 file - promoters60/4911457
catcaaa

SEQ ID NO: 144404 - DNA, 7 bp, Unknown
  misc_feature (1)..( 7): Result.003 file - promoters60/4911457
aatcaat

SEQ ID NO: 144405 - DNA, 9 bp, Unknown
  misc_feature (1)..( 9): Result.003 file - promoters60/4911457
tgtgacatc

SEQ ID NO: 144406 - DNA, 9 bp, Unknown
  misc_feature (1)..( 9): Result.003 file - promoters60/4911457
tgtaacatt

SEQ ID NO: 144407 - DNA, 9 bp, Unknown
  misc_feature (1)..( 9): Result.003 file - promoters60/4911457
tttaagatt

SEQ ID NO: 144408 - DNA, 8 bp, Unknown
  misc_feature (1)..( 8): Result.003 file - promoters60/4911457
gtgattta

SEQ ID NO: 144409 - DNA, 8 bp, Unknown
  misc_feature (1)..( 8): Result.003 file - promoters60/4911457
ttgatttc

SEQ ID NO: 144410 - DNA, 8 bp, Unknown
  misc_feature (1)..( 8): Result.003 file - promoters60/4911457
ttggtttc

SEQ ID NO: 144411 - DNA, 8 bp, Unknown
  misc_feature (1)..( 8): Result.003 file - promoters60/4911457
ttgtttta

SEQ ID NO: 144412 - DNA, 8 bp, Unknown
  misc_feature (1)..( 8): Result.003 file - promoters60/4911457
ttggtttc

SEQ ID NO: 144413 - DNA, 8 bp, Unknown
  misc_feature (1)..( 8): Result.003 file - promoters60/4911457
ttgatttc

SEQ ID NO: 144414 - DNA, 13 bp, Unknown
  misc_feature (1)..( 13): Result.003 file - promoters60/4911457
tttgagtccctgg

SEQ ID NO: 144415 - DNA, 13 bp, Unknown
  misc_feature (1)..( 13): Result.003 file - promoters60/4911457
cttgagtcgttta

SEQ ID NO: 144416 - DNA, 13 bp, Unknown
  misc_feature (1)..( 13): Result.003 file - promoters60/4911457
ctttagtctttta

SEQ ID NO: 144417 - DNA, 11 bp, Unknown
  misc_feature (1)..( 11): Result.003 file - promoters60/4911457
gaatttggata

SEQ ID NO: 144418 - DNA, 11 bp, Unknown
  misc_feature (1)..( 11): Result.003 file - promoters60/4911457
gaatttgagat

SEQ ID NO: 144419 - DNA, 11 bp, Unknown
  misc_feature (1)..( 11): Result.003 file - promoters60/4911457
caattttagat

SEQ ID NO: 144420 - DNA, 8 bp, Unknown
  misc_feature (1)..( 8): Result.003 file - promoters60/4911457
ggtattta

SEQ ID NO: 144421 - DNA, 8 bp, Unknown
  misc_feature (1)..( 8): Result.003 file - promoters60/4911457
ggtctttt

SEQ ID NO: 144422 - DNA, 8 bp, Unknown
  misc_feature (1)..( 8): Result.003 file - promoters60/4911457
agtctttt

SEQ ID NO: 144423 - DNA, 9 bp, Unknown
  misc_feature (1)..( 9): Result.003 file - promoters60/4911457
tgttggaga

SEQ ID NO: 144424 - DNA, 9 bp, Unknown
  misc_feature (1)..( 9): Result.003 file - promoters60/4911457
ctttgcaga

SEQ ID NO: 144425 - DNA, 9 bp, Unknown
  misc_feature (1)..( 9): Result.003 file - promoters60/4911457
tgttggatt

SEQ ID NO: 144426 - DNA, 10 bp, Unknown
  misc_feature (1)..( 10): Result.003 file - promoters60/4911457
aattttagat

SEQ ID NO: 144427 - DNA, 10 bp, Unknown
  misc_feature (1)..( 10): Result.003 file - promoters60/4911457
aatattaaaa

SEQ ID NO: 144428 - DNA, 10 bp, Unknown
  misc_feature (1)..( 10): Result.003 file - promoters60/4911457
aatttgagat

SEQ ID NO: 144429 - DNA, 12 bp, Unknown
  misc_feature (1)..( 12): Result.003 file - promoters60/4911457
aacattatggtt

SEQ ID NO: 144430 - DNA, 12 bp, Unknown
  misc_feature (1)..( 12): Result.003 file - promoters60/4911457
ataagtattgtt

SEQ ID NO: 144431 - DNA, 12 bp, Unknown
  misc_feature (1)..( 12): Result.003 file - promoters60/4911457
ataagtattgga

SEQ ID NO: 144432 - DNA, 17 bp, Unknown
  misc_feature (1)..( 17): Result.003 file - promoters60/4911485
tcacttttatgggccgt

SEQ ID NO: 144433 - DNA, 17 bp, Unknown
  misc_feature (1)..( 17): Result.003 file - promoters60/4911485
attattttatttttttt

SEQ ID NO: 144434 - DNA, 17 bp, Unknown
  misc_feature (1)..( 17): Result.003 file - promoters60/4911485
ctcattttaatgggccg

SEQ ID NO: 144435 - DNA, 17 bp, Unknown
  misc_feature (1)..( 17): Result.003 file - promoters60/4911485
caatgtttattaaaaaa

SEQ ID NO: 144436 - DNA, 17 bp, Unknown
  misc_feature (1)..( 17): Result.003 file - promoters60/4911485
tatatataaatgggcct

SEQ ID NO: 144437 - DNA, 17 bp, Unknown
  misc_feature (1)..( 17): Result.003 file - promoters60/4911485
tattaaagtttgggcca

SEQ ID NO: 144438 - DNA, 17 bp, Unknown
  misc_feature (1)..( 17): Result.003 file - promoters60/4911485
atactatatatgggcct

SEQ ID NO: 144439 - DNA, 8 bp, Unknown
  misc_feature (1)..( 8): Result.003 file - promoters60/4911485
tatgggcc

SEQ ID NO: 144440 - DNA, 8 bp, Unknown
  misc_feature (1)..( 8): Result.003 file - promoters60/4911485
aatgggcc

SEQ ID NO: 144441 - DNA, 8 bp, Unknown
  misc_feature (1)..( 8): Result.003 file - promoters60/4911485
tttgggcc

SEQ ID NO: 144442 - DNA, 8 bp, Unknown
  misc_feature (1)..( 8): Result.003 file - promoters60/4911485
tatgggcc

SEQ ID NO: 144443 - DNA, 8 bp, Unknown
  misc_feature (1)..( 8): Result.003 file - promoters60/4911485
aatgggct

SEQ ID NO: 144444 - DNA, 8 bp, Unknown
  misc_feature (1)..( 8): Result.003 file - promoters60/4911485
aatgggcc

SEQ ID NO: 144445 - DNA, 16 bp, Unknown
  misc_feature (1)..( 16): Result.003 file - promoters60/4911485
ggcctataaggcccaa

SEQ ID NO: 144446 - DNA, 16 bp, Unknown
  misc_feature (1)..( 16): Result.003 file - promoters60/4911485
aaaaaataaagcccaa

SEQ ID NO: 144447 - DNA, 16 bp, Unknown
  misc_feature (1)..( 16): Result.003 file - promoters60/4911485
taaacctaaggcccaa

SEQ ID NO: 144448 - DNA, 16 bp, Unknown
  misc_feature (1)..( 16): Result.003 file - promoters60/4911485
ttgaaataaaacaaat

SEQ ID NO: 144449 - DNA, 16 bp, Unknown
  misc_feature (1)..( 16): Result.003 file - promoters60/4911485
cacttaataagcccat

SEQ ID NO: 144450 - DNA, 16 bp, Unknown
  misc_feature (1)..( 16): Result.003 file - promoters60/4911485
ttgagatagccacata

SEQ ID NO: 144451 - DNA, 11 bp, Unknown
  misc_feature (1)..( 11): Result.003 file - promoters60/4911492
aattattttca

SEQ ID NO: 144452 - DNA, 11 bp, Unknown
  misc_feature (1)..( 11): Result.003 file - promoters60/4911492
ttatatattct

SEQ ID NO: 144453 - DNA, 11 bp, Unknown
  misc_feature (1)..( 11): Result.003 file - promoters60/4911492
gtttatttact

SEQ ID NO: 144454 - DNA, 11 bp, Unknown
  misc_feature (1)..( 11): Result.003 file - promoters60/4911492
ttttatttcat

SEQ ID NO: 144455 - DNA, 11 bp, Unknown
  misc_feature (1)..( 11): Result.003 file - promoters60/4911492
tggtatttact

SEQ ID NO: 144456 - DNA, 11 bp, Unknown
  misc_feature (1)..( 11): Result.003 file - promoters60/4911492
ttttatttcac

SEQ ID NO: 144457 - DNA, 11 bp, Unknown
  misc_feature (1)..( 11): Result.003 file - promoters60/4911492
agtataattag

SEQ ID NO: 144458 - DNA, 11 bp, Unknown
  misc_feature (1)..( 11): Result.003 file - promoters60/4911492
ttagtaaatag

SEQ ID NO: 144459 - DNA, 11 bp, Unknown
  misc_feature (1)..( 11): Result.003 file - promoters60/4911492
ttaataattag

SEQ ID NO: 144460 - DNA, 11 bp, Unknown
  misc_feature (1)..( 11): Result.003 file - promoters60/4911492
ttaaaaattcg

SEQ ID NO: 144461 - DNA, 11 bp, Unknown
  misc_feature (1)..( 11): Result.003 file - promoters60/4911492
aaaaaaattcc

SEQ ID NO: 144462 - DNA, 11 bp, Unknown
  misc_feature (1)..( 11): Result.003 file - promoters60/4911492
tatttatataa

SEQ ID NO: 144463 - DNA, 11 bp, Unknown
  misc_feature (1)..( 11): Result.003 file - promoters60/4911492
aatttagataa

SEQ ID NO: 144464 - DNA, 11 bp, Unknown
  misc_feature (1)..( 11): Result.003 file - promoters60/4911492
gatacatatta

SEQ ID NO: 144465 - DNA, 11 bp, Unknown
  misc_feature (1)..( 11): Result.003 file - promoters60/4911492
gattaataatt

SEQ ID NO: 144466 - DNA, 11 bp, Unknown
  misc_feature (1)..( 11): Result.003 file - promoters60/4911492
gattaaaaact

SEQ ID NO: 144467 - DNA, 9 bp, Unknown
  misc_feature (1)..( 9): Result.003 file - promoters60/4911492
gtaaaattt

SEQ ID NO: 144468 - DNA, 9 bp, Unknown
  misc_feature (1)..( 9): Result.003 file - promoters60/4911492
ataaaataa

SEQ ID NO: 144469 - DNA, 9 bp, Unknown
  misc_feature (1)..( 9): Result.003 file - promoters60/4911492
gtataatgg

SEQ ID NO: 144470 - DNA, 9 bp, Unknown
  misc_feature (1)..( 9): Result.003 file - promoters60/4911492
ggaaacttt

SEQ ID NO: 144471 - DNA, 9 bp, Unknown
  misc_feature (1)..( 9): Result.003 file - promoters60/4911492
caaaaataa

SEQ ID NO: 144472 - DNA, 8 bp, Unknown
  misc_feature (1)..( 8): Result.003 file - promoters60/4912240
gaaagcac

SEQ ID NO: 144473 - DNA, 8 bp, Unknown
  misc_feature (1)..( 8): Result.003 file - promoters60/4912240
caaaacac

SEQ ID NO: 144474 - DNA, 8 bp, Unknown
  misc_feature (1)..( 8): Result.003 file - promoters60/4912240
caaaacct

SEQ ID NO: 144475 - DNA, 16 bp, Unknown
  misc_feature (1)..( 16): Result.003 file - promoters60/4912240
taagtgatggtgagag

SEQ ID NO: 144476 - DNA, 16 bp, Unknown
  misc_feature (1)..( 16): Result.003 file - promoters60/4912240
taattgattcaaaatt

SEQ ID NO: 144477 - DNA, 16 bp, Unknown
  misc_feature (1)..( 16): Result.003 file - promoters60/4912240
agcttgaatcaatatt

SEQ ID NO: 144478 - DNA, 7 bp, Unknown
  misc_feature (1)..( 7): Result.003 file - promoters60/4912240
ttttaat

SEQ ID NO: 144479 - DNA, 7 bp, Unknown
  misc_feature (1)..( 7): Result.003 file - promoters60/4912240
ttttaac

SEQ ID NO: 144480 - DNA, 7 bp, Unknown
  misc_feature (1)..( 7): Result.003 file - promoters60/4912240
tttgacc

SEQ ID NO: 144481 - DNA, 11 bp, Unknown
  misc_feature (1)..( 11): Result.003 file - promoters60/4912541
ggctcctgtga

SEQ ID NO: 144482 - DNA, 11 bp, Unknown
  misc_feature (1)..( 11): Result.003 file - promoters60/4912541
ggctcttgtga

SEQ ID NO: 144483 - DNA, 8 bp, Unknown
  misc_feature (1)..( 8): Result.003 file - promoters60/4912541
ctttcaat

SEQ ID NO: 144484 - DNA, 8 bp, Unknown
  misc_feature (1)..( 8): Result.003 file - promoters60/4912541
gtttaaat

SEQ ID NO: 144485 - DNA, 8 bp, Unknown
  misc_feature (1)..( 8): Result.003 file - promoters60/4912541
gtttaaga

SEQ ID NO: 144486 - DNA, 13 bp, Unknown
  misc_feature (1)..( 13): Result.003 file - promoters60/4912541
aaattctctgtct

SEQ ID NO: 144487 - DNA, 13 bp, Unknown
  misc_feature (1)..( 13): Result.003 file - promoters60/4912541
aaattctcagtct

SEQ ID NO: 144488 - DNA, 9 bp, Unknown
  misc_feature (1)..( 9): Result.003 file - promoters60/4912541
gattctaat

SEQ ID NO: 144489 - DNA, 9 bp, Unknown
  misc_feature (1)..( 9): Result.003 file - promoters60/4912541
tgttcaaat

SEQ ID NO: 144490 - DNA, 9 bp, Unknown
  misc_feature (1)..( 9): Result.003 file - promoters60/4912541
gattctaga

SEQ ID NO: 144491 - DNA, 7 bp, Unknown
  misc_feature (1)..( 7): Result.003 file - promoters60/4912541
tgtttaa

SEQ ID NO: 144492 - DNA, 7 bp, Unknown
  misc_feature (1)..( 7): Result.003 file - promoters60/4912541
tgtgtaa

SEQ ID NO: 144493 - DNA, 7 bp, Unknown
  misc_feature (1)..( 7): Result.003 file - promoters60/4912541
gaaaccc

SEQ ID NO: 144494 - DNA, 7 bp, Unknown
  misc_feature (1)..( 7): Result.003 file - promoters60/4912541
gaaaccc

SEQ ID NO: 144495 - DNA, 7 bp, Unknown
  misc_feature (1)..( 7): Result.003 file - promoters60/4912541
aagggct

SEQ ID NO: 144496 - DNA, 7 bp, Unknown
  misc_feature (1)..( 7): Result.003 file - promoters60/4912541
aagggct

SEQ ID NO: 144497 - DNA, 6 bp, Unknown
  misc_feature (1)..( 6): Result.003 file - promoters60/4912541
gctaaa

SEQ ID NO: 144498 - DNA, 6 bp, Unknown
  misc_feature (1)..( 6): Result.003 file - promoters60/4912541
gctaaa

SEQ ID NO: 144499 - DNA, 8 bp, Unknown
  misc_feature (1)..( 8): Result.003 file - promoters60/4912541
ccggtcaa

SEQ ID NO: 144500 - DNA, 8 bp, Unknown
  misc_feature (1)..( 8): Result.003 file - promoters60/4912541
ccggtcaa

SEQ ID NO: 144501 - DNA, 6 bp, Unknown
  misc_feature (1)..( 6): Result.003 file - promoters60/4912541
aaagtt

SEQ ID NO: 144502 - DNA, 6 bp, Unknown
  misc_feature (1)..( 6): Result.003 file - promoters60/4912541
aaagtt

SEQ ID NO: 144503 - DNA, 7 bp, Unknown
  misc_feature (1)..( 7): Result.003 file - promoters60/4912541
ccgtttt

SEQ ID NO: 144504 - DNA, 7 bp, Unknown
  misc_feature (1)..( 7): Result.003 file - promoters60/4912541
ccgtttt

SEQ ID NO: 144505 - DNA, 7 bp, Unknown
  misc_feature (1)..( 7): Result.003 file - promoters60/4912541
tttgttt

SEQ ID NO: 144506 - DNA, 7 bp, Unknown
  misc_feature (1)..( 7): Result.003 file - promoters60/4912541
ttttttt

SEQ ID NO: 144507 - DNA, 6 bp, Unknown
  misc_feature (1)..( 6): Result.003 file - promoters60/4912541
gatttg

SEQ ID NO: 144508 - DNA, 6 bp, Unknown
  misc_feature (1)..( 6): Result.003 file - promoters60/4912541
gatttg

SEQ ID NO: 144509 - DNA, 8 bp, Unknown
  misc_feature (1)..( 8): Result.003 file - promoters60/4912541
aaggagaa

SEQ ID NO: 144510 - DNA, 8 bp, Unknown
  misc_feature (1)..( 8): Result.003 file - promoters60/4912541
aaggggaa

SEQ ID NO: 144511 - DNA, 14 bp, Unknown
  misc_feature (1)..( 14): Result.003 file - promoters60/4913068
ttttgtaaattttg

SEQ ID NO: 144512 - DNA, 14 bp, Unknown
  misc_feature (1)..( 14): Result.003 file - promoters60/4913068
gtttgtatgtttct

SEQ ID NO: 144513 - DNA, 14 bp, Unknown
  misc_feature (1)..( 14): Result.003 file - promoters60/4913068
agttgtaaaaattt

SEQ ID NO: 144514 - DNA, 14 bp, Unknown
  misc_feature (1)..( 14): Result.003 file - promoters60/4913068
cgatgtaaaaatta

SEQ ID NO: 144515 - DNA, 14 bp, Unknown
  misc_feature (1)..( 14): Result.003 file - promoters60/4913068
gttttaaaatttag

SEQ ID NO: 144516 - DNA, 14 bp, Unknown
  misc_feature (1)..( 14): Result.003 file - promoters60/4913068
caacgtaaacttta

SEQ ID NO: 144517 - DNA, 9 bp, Unknown
  misc_feature (1)..( 9): Result.003 file - promoters60/4913068
aaaaatact

SEQ ID NO: 144518 - DNA, 9 bp, Unknown
  misc_feature (1)..( 9): Result.003 file - promoters60/4913068
aaaaataaa

SEQ ID NO: 144519 - DNA, 9 bp, Unknown
  misc_feature (1)..( 9): Result.003 file - promoters60/4913068
aaaaattat

SEQ ID NO: 144520 - DNA, 9 bp, Unknown
  misc_feature (1)..( 9): Result.003 file - promoters60/4913068
aaaaatttg

SEQ ID NO: 144521 - DNA, 9 bp, Unknown
  misc_feature (1)..( 9): Result.003 file - promoters60/4913068
taaaattta

SEQ ID NO: 144522 - DNA, 9 bp, Unknown
  misc_feature (1)..( 9): Result.003 file - promoters60/4913068
taaacttta

SEQ ID NO: 144523 - DNA, 18 bp, Unknown
  misc_feature (1)..( 18): Result.003 file - promoters60/4913068
aacaacttaattcttttt

SEQ ID NO: 144524 - DNA, 18 bp, Unknown
  misc_feature (1)..( 18): Result.003 file - promoters60/4913068
tacgctcactttctattt

SEQ ID NO: 144525 - DNA, 18 bp, Unknown
  misc_feature (1)..( 18): Result.003 file - promoters60/4913068
aaaattgtaatccttttg

SEQ ID NO: 144526 - DNA, 18 bp, Unknown
  misc_feature (1)..( 18): Result.003 file - promoters60/4913068
aaaatagtaatcaaaatt

SEQ ID NO: 144527 - DNA, 8 bp, Unknown
  misc_feature (1)..( 8): Result.003 file - promoters60/4913068
agttggat

SEQ ID NO: 144528 - DNA, 8 bp, Unknown
  misc_feature (1)..( 8): Result.003 file - promoters60/4913068
ctttggat

SEQ ID NO: 144529 - DNA, 8 bp, Unknown
  misc_feature (1)..( 8): Result.003 file - promoters60/4913068
ctttggaa

SEQ ID NO: 144530 - DNA, 8 bp, Unknown
  misc_feature (1)..( 8): Result.003 file - promoters60/4913068
ttttagaa

SEQ ID NO: 144531 - DNA, 8 bp, Unknown
  misc_feature (1)..( 8): Result.003 file - promoters60/4913068
gtttggaa

SEQ ID NO: 144532 - DNA, 12 bp, Unknown
  misc_feature (1)..( 12): Result.003 file - promoters60/4913068
ttgtattatcaa

SEQ ID NO: 144533 - DNA, 12 bp, Unknown
  misc_feature (1)..( 12): Result.003 file - promoters60/4913068
ttttattatttc

SEQ ID NO: 144534 - DNA, 12 bp, Unknown
  misc_feature (1)..( 12): Result.003 file - promoters60/4913068
ttcgattatttt

SEQ ID NO: 144535 - DNA, 12 bp, Unknown
  misc_feature (1)..( 12): Result.003 file - promoters60/4913068
ttttcttacgtt

SEQ ID NO: 144536 - DNA, 12 bp, Unknown
  misc_feature (1)..( 12): Result.003 file - promoters60/4913068
tgaaattgtttt

SEQ ID NO: 144537 - DNA, 14 bp, Unknown
  misc_feature (1)..( 14): Result.003 file - promoters60/4913068
tataattttatata

SEQ ID NO: 144538 - DNA, 14 bp, Unknown
  misc_feature (1)..( 14): Result.003 file - promoters60/4913068
ataaattttttata

SEQ ID NO: 144539 - DNA, 14 bp, Unknown
  misc_feature (1)..( 14): Result.003 file - promoters60/4913068
tatgatttatcgtg

SEQ ID NO: 144540 - DNA, 14 bp, Unknown
  misc_feature (1)..( 14): Result.003 file - promoters60/4913068
ggtcatttttggat

SEQ ID NO: 144541 - DNA, 13 bp, Unknown
  misc_feature (1)..( 13): Result.003 file - promoters60/4913068
aagaaaaaaaaaa

SEQ ID NO: 144542 - DNA, 13 bp, Unknown
  misc_feature (1)..( 13): Result.003 file - promoters60/4913068
tagaagaaacaaa

SEQ ID NO: 144543 - DNA, 13 bp, Unknown
  misc_feature (1)..( 13): Result.003 file - promoters60/4913068
atctagaaagaaa

SEQ ID NO: 144544 - DNA, 13 bp, Unknown
  misc_feature (1)..( 13): Result.003 file - promoters60/4913068
tagtagaatttac

SEQ ID NO: 144545 - DNA, 13 bp, Unknown
  misc_feature (1)..( 13): Result.003 file - promoters60/4913068
tttaagaaaaaaa

SEQ ID NO: 144546 - DNA, 12 bp, Unknown
  misc_feature (1)..( 12): Result.003 file - promoters60/4913068
tttcaaaaatac

SEQ ID NO: 144547 - DNA, 12 bp, Unknown
  misc_feature (1)..( 12): Result.003 file - promoters60/4913068
ttttaaaattta

SEQ ID NO: 144548 - DNA, 12 bp, Unknown
  misc_feature (1)..( 12): Result.003 file - promoters60/4913068
cgttaaaaataa

SEQ ID NO: 144549 - DNA, 12 bp, Unknown
  misc_feature (1)..( 12): Result.003 file - promoters60/4913068
tggtaaaaaata

SEQ ID NO: 144550 - DNA, 12 bp, Unknown
  misc_feature (1)..( 12): Result.003 file - promoters60/4913068
atgtaaaaatta

SEQ ID NO: 144551 - DNA, 12 bp, Unknown
  misc_feature (1)..( 12): Result.003 file - promoters60/4913068
acgtaaacttta

SEQ ID NO: 144552 - DNA, 15 bp, Unknown
  misc_feature (1)..( 15): Result.003 file - promoters60/4913068
ttgtataattttata

SEQ ID NO: 144553 - DNA, 15 bp, Unknown
  misc_feature (1)..( 15): Result.003 file - promoters60/4913068
ttggatattttcagt

SEQ ID NO: 144554 - DNA, 15 bp, Unknown
  misc_feature (1)..( 15): Result.003 file - promoters60/4913068
tcgtataaaaaaaat

SEQ ID NO: 144555 - DNA, 15 bp, Unknown
  misc_feature (1)..( 15): Result.003 file - promoters60/4913068
atatataaaaatttt

SEQ ID NO: 144556 - DNA, 11 bp, Unknown
  misc_feature (1)..( 11): Result.003 file - promoters60/4913068
tcaaaaaaaaa

SEQ ID NO: 144557 - DNA, 11 bp, Unknown
  misc_feature (1)..( 11): Result.003 file - promoters60/4913068
ataaaaaaaaa

SEQ ID NO: 144558 - DNA, 11 bp, Unknown
  misc_feature (1)..( 11): Result.003 file - promoters60/4913068
gtaaaaaatct

SEQ ID NO: 144559 - DNA, 11 bp, Unknown
  misc_feature (1)..( 11): Result.003 file - promoters60/4913068
atataaaaatt

SEQ ID NO: 144560 - DNA, 8 bp, Unknown
  misc_feature (1)..( 8): Result.003 file - promoters60/4913068
ctttggaa

SEQ ID NO: 144561 - DNA, 8 bp, Unknown
  misc_feature (1)..( 8): Result.003 file - promoters60/4913068
ctttggca

SEQ ID NO: 144562 - DNA, 8 bp, Unknown
  misc_feature (1)..( 8): Result.003 file - promoters60/4913068
ttttagaa

SEQ ID NO: 144563 - DNA, 8 bp, Unknown
  misc_feature (1)..( 8): Result.003 file - promoters60/4913068
gtttggaa

SEQ ID NO: 144564 - DNA, 11 bp, Unknown
  misc_feature (1)..( 11): Result.003 file - promoters60/4913068
gatgattttgg

SEQ ID NO: 144565 - DNA, 11 bp, Unknown
  misc_feature (1)..( 11): Result.003 file - promoters60/4913068
gattattttgg

SEQ ID NO: 144566 - DNA, 11 bp, Unknown
  misc_feature (1)..( 11): Result.003 file - promoters60/4913068
tattatttcaa

SEQ ID NO: 144567 - DNA, 11 bp, Unknown
  misc_feature (1)..( 11): Result.003 file - promoters60/4913068
aattgttttcg

SEQ ID NO: 144568 - DNA, 8 bp, Unknown
  misc_feature (1)..( 8): Result.003 file - promoters60/4913068
gtatcttt

SEQ ID NO: 144569 - DNA, 8 bp, Unknown
  misc_feature (1)..( 8): Result.003 file - promoters60/4913068
aaatcttt

SEQ ID NO: 144570 - DNA, 8 bp, Unknown
  misc_feature (1)..( 8): Result.003 file - promoters60/4913068
aaattttt

SEQ ID NO: 144571 - DNA, 8 bp, Unknown
  misc_feature (1)..( 8): Result.003 file - promoters60/4913068
aaatattt

SEQ ID NO: 144572 - DNA, 13 bp, Unknown
  misc_feature (1)..( 13): Result.003 file - promoters60/4913068
tctaatgaaattt

SEQ ID NO: 144573 - DNA, 13 bp, Unknown
  misc_feature (1)..( 13): Result.003 file - promoters60/4913068
acaaattaaattt

SEQ ID NO: 144574 - DNA, 13 bp, Unknown
  misc_feature (1)..( 13): Result.003 file - promoters60/4913068
acaaagtaaagtg

SEQ ID NO: 144575 - DNA, 13 bp, Unknown
  misc_feature (1)..( 13): Result.003 file - promoters60/4913068
aattatttaatct

SEQ ID NO: 144576 - DNA, 10 bp, Unknown
  misc_feature (1)..( 10): Result.003 file - promoters60/4913068
ttaatgtttg

SEQ ID NO: 144577 - DNA, 10 bp, Unknown
  misc_feature (1)..( 10): Result.003 file - promoters60/4913068
ttaatctttt

SEQ ID NO: 144578 - DNA, 10 bp, Unknown
  misc_feature (1)..( 10): Result.003 file - promoters60/4913068
catttgtttg

SEQ ID NO: 144579 - DNA, 10 bp, Unknown
  misc_feature (1)..( 10): Result.003 file - promoters60/4913068
ttaatattta

SEQ ID NO: 144580 - DNA, 8 bp, Unknown
  misc_feature (1)..( 8): Result.003 file - promoters60/4913083
ttattaaa

SEQ ID NO: 144581 - DNA, 8 bp, Unknown
  misc_feature (1)..( 8): Result.003 file - promoters60/4913083
ttactaaa

SEQ ID NO: 144582 - DNA, 7 bp, Unknown
  misc_feature (1)..( 7): Result.003 file - promoters60/4913083
gactaaa

SEQ ID NO: 144583 - DNA, 8 bp, Unknown
  misc_feature (1)..( 8): Result.003 file - promoters60/4913083
gtactaac

SEQ ID NO: 144584 - DNA, 8 bp, Unknown
  misc_feature (1)..( 8): Result.003 file - promoters60/4913083
agtgtgct

SEQ ID NO: 144585 - DNA, 8 bp, Unknown
  misc_feature (1)..( 8): Result.003 file - promoters60/4913083
agtgggct

SEQ ID NO: 144586 - DNA, 9 bp, Unknown
  misc_feature (1)..( 9): Result.003 file - promoters60/4913083
cgtgatgtt

SEQ ID NO: 144587 - DNA, 9 bp, Unknown
  misc_feature (1)..( 9): Result.003 file - promoters60/4913083
gatgatgta

SEQ ID NO: 144588 - DNA, 13 bp, Unknown
  misc_feature (1)..( 13): Result.003 file - promoters60/4913724
aacagtttgctgt

SEQ ID NO: 144589 - DNA, 13 bp, Unknown
  misc_feature (1)..( 13): Result.003 file - promoters60/4913724
aacattttggttt

SEQ ID NO: 144590 - DNA, 13 bp, Unknown
  misc_feature (1)..( 13): Result.003 file - promoters60/4913724
tttcttttggttt

SEQ ID NO: 144591 - DNA, 8 bp, Unknown
  misc_feature (1)..( 8): Result.003 file - promoters60/4913724
attgctgt

SEQ ID NO: 144592 - DNA, 8 bp, Unknown
  misc_feature (1)..( 8): Result.003 file - promoters60/4913724
gttgatgt

SEQ ID NO: 144593 - DNA, 8 bp, Unknown
  misc_feature (1)..( 8): Result.003 file - promoters60/4913724
gttgattt

SEQ ID NO: 144594 - DNA, 13 bp, Unknown
  misc_feature (1)..( 13): Result.003 file - promoters60/4913724
atactaagcattg

SEQ ID NO: 144595 - DNA, 13 bp, Unknown
  misc_feature (1)..( 13): Result.003 file - promoters60/4913724
gagataagtattg

SEQ ID NO: 144596 - DNA, 13 bp, Unknown
  misc_feature (1)..( 13): Result.003 file - promoters60/4913724
gagagaagttgat

SEQ ID NO: 144597 - DNA, 7 bp, Unknown
  misc_feature (1)..( 7): Result.003 file - promoters60/4914111
ttttccg

SEQ ID NO: 144598 - DNA, 7 bp, Unknown
  misc_feature (1)..( 7): Result.003 file - promoters60/4914111
tttgccg

SEQ ID NO: 144599 - DNA, 8 bp, Unknown
  misc_feature (1)..( 8): Result.003 file - promoters60/4914111
ctgtttat

SEQ ID NO: 144600 - DNA, 8 bp, Unknown
  misc_feature (1)..( 8): Result.003 file - promoters60/4914111
gtgtatat

SEQ ID NO: 144601 - DNA, 8 bp, Unknown
  misc_feature (1)..( 8): Result.003 file - promoters60/4914111
ctgttttc

SEQ ID NO: 144602 - DNA, 9 bp, Unknown
  misc_feature (1)..( 9): Result.003 file - promoters60/4914111
ctgtgttga

SEQ ID NO: 144603 - DNA, 9 bp, Unknown
  misc_feature (1)..( 9): Result.003 file - promoters60/4914111
ctgtgtctc

SEQ ID NO: 144604 - DNA, 9 bp, Unknown
  misc_feature (1)..( 9): Result.003 file - promoters60/4914111
ttgtttctc

SEQ ID NO: 144605 - DNA, 7 bp, Unknown
  misc_feature (1)..( 7): Result.003 file - promoters60/4914111
tcttgtt

SEQ ID NO: 144606 - DNA, 7 bp, Unknown
  misc_feature (1)..( 7): Result.003 file - promoters60/4914111
tctggtt

SEQ ID NO: 144607 - DNA, 7 bp, Unknown
  misc_feature (1)..( 7): Result.003 file - promoters60/4914111
gatgcag

SEQ ID NO: 144608 - DNA, 7 bp, Unknown
  misc_feature (1)..( 7): Result.003 file - promoters60/4914111
gatgcac

SEQ ID NO: 144609 - DNA, 7 bp, Unknown
  misc_feature (1)..( 7): Result.003 file - promoters60/4914111
tatgcag

SEQ ID NO: 144610 - DNA, 7 bp, Unknown
  misc_feature (1)..( 7): Result.003 file - promoters60/4914111
acatgtg

SEQ ID NO: 144611 - DNA, 7 bp, Unknown
  misc_feature (1)..( 7): Result.003 file - promoters60/4914111
acaagtg

SEQ ID NO: 144612 - DNA, 7 bp, Unknown
  misc_feature (1)..( 7): Result.003 file - promoters60/4914111
aatagtt

SEQ ID NO: 144613 - DNA, 7 bp, Unknown
  misc_feature (1)..( 7): Result.003 file - promoters60/4914111
aatggtt

SEQ ID NO: 144614 - DNA, 9 bp, Unknown
  misc_feature (1)..( 9): Result.003 file - promoters60/4914111
attggactt

SEQ ID NO: 144615 - DNA, 9 bp, Unknown
  misc_feature (1)..( 9): Result.003 file - promoters60/4914111
attgtactt

SEQ ID NO: 144616 - DNA, 6 bp, Unknown
  misc_feature (1)..( 6): Result.003 file - promoters60/4914111
aatttc

SEQ ID NO: 144617 - DNA, 6 bp, Unknown
  misc_feature (1)..( 6): Result.003 file - promoters60/4914111
aatttc

SEQ ID NO: 144618 - DNA, 7 bp, Unknown
  misc_feature (1)..( 7): Result.003 file - promoters60/4914111
tctgtct

SEQ ID NO: 144619 - DNA, 7 bp, Unknown
  misc_feature (1)..( 7): Result.003 file - promoters60/4914111
tctttct

SEQ ID NO: 144620 - DNA, 8 bp, Unknown
  misc_feature (1)..( 8): Result.003 file - promoters60/4914111
aatggttt

SEQ ID NO: 144621 - DNA, 8 bp, Unknown
  misc_feature (1)..( 8): Result.003 file - promoters60/4914111
aatgattt

SEQ ID NO: 144622 - DNA, 6 bp, Unknown
  misc_feature (1)..( 6): Result.003 file - promoters60/4914111
aacagt

SEQ ID NO: 144623 - DNA, 6 bp, Unknown
  misc_feature (1)..( 6): Result.003 file - promoters60/4914111
aacagt

SEQ ID NO: 144624 - DNA, 6 bp, Unknown
  misc_feature (1)..( 6): Result.003 file - promoters60/4914111
attgga

SEQ ID NO: 144625 - DNA, 6 bp, Unknown
  misc_feature (1)..( 6): Result.003 file - promoters60/4914111
attgga

SEQ ID NO: 144626 - DNA, 6 bp, Unknown
  misc_feature (1)..( 6): Result.003 file - promoters60/4914111
taattt

SEQ ID NO: 144627 - DNA, 6 bp, Unknown
  misc_feature (1)..( 6): Result.003 file - promoters60/4914111
taattt

SEQ ID NO: 144628 - DNA, 7 bp, Unknown
  misc_feature (1)..( 7): Result.003 file - promoters60/4914111
tttattg

SEQ ID NO: 144629 - DNA, 7 bp, Unknown
  misc_feature (1)..( 7): Result.003 file - promoters60/4914111
tttattg

SEQ ID NO: 144630 - DNA, 6 bp, Unknown
  misc_feature (1)..( 6): Result.003 file - promoters60/4914111
tctaga

SEQ ID NO: 144631 - DNA, 6 bp, Unknown
  misc_feature (1)..( 6): Result.003 file - promoters60/4914111
tctaga

SEQ ID NO: 144632 - DNA, 10 bp, Unknown
  misc_feature (1)..( 10): Result.003 file - promoters60/4915127
tatatactta

SEQ ID NO: 144633 - DNA, 10 bp, Unknown
  misc_feature (1)..( 10): Result.003 file - promoters60/4915127
aatacactag

SEQ ID NO: 144634 - DNA, 10 bp, Unknown
  misc_feature (1)..( 10): Result.003 file - promoters60/4915127
tatatatata

SEQ ID NO: 144635 - DNA, 10 bp, Unknown
  misc_feature (1)..( 10): Result.003 file - promoters60/4915127
tatatagata

SEQ ID NO: 144636 - DNA, 10 bp, Unknown
  misc_feature (1)..( 10): Result.003 file - promoters60/4915127
tatataaact

SEQ ID NO: 144637 - DNA, 10 bp, Unknown
  misc_feature (1)..( 10): Result.003 file - promoters60/4915127
aataaaaagc

SEQ ID NO: 144638 - DNA, 8 bp, Unknown
  misc_feature (1)..( 8): Result.003 file - promoters60/4915163
gaaaatat

SEQ ID NO: 144639 - DNA, 8 bp, Unknown
  misc_feature (1)..( 8): Result.003 file - promoters60/4915163
caaattat

SEQ ID NO: 144640 - DNA, 8 bp, Unknown
  misc_feature (1)..( 8): Result.003 file - promoters60/4915163
aaaaatat

SEQ ID NO: 144641 - DNA, 8 bp, Unknown
  misc_feature (1)..( 8): Result.003 file - promoters60/4915163
caaattct

SEQ ID NO: 144642 - DNA, 11 bp, Unknown
  misc_feature (1)..( 11): Result.003 file - promoters60/4915163
taatataagta

SEQ ID NO: 144643 - DNA, 11 bp, Unknown
  misc_feature (1)..( 11): Result.003 file - promoters60/4915163
taatgtaattt

SEQ ID NO: 144644 - DNA, 11 bp, Unknown
  misc_feature (1)..( 11): Result.003 file - promoters60/4915163
ctttataagta

SEQ ID NO: 144645 - DNA, 11 bp, Unknown
  misc_feature (1)..( 11): Result.003 file - promoters60/4915163
gaatgtatata

SEQ ID NO: 144646 - DNA, 10 bp, Unknown
  misc_feature (1)..( 10): Result.003 file - promoters60/4915163
ttgattcatc

SEQ ID NO: 144647 - DNA, 10 bp, Unknown
  misc_feature (1)..( 10): Result.003 file - promoters60/4915163
taatttcatc

SEQ ID NO: 144648 - DNA, 10 bp, Unknown
  misc_feature (1)..( 10): Result.003 file - promoters60/4915163
attattcata

SEQ ID NO: 144649 - DNA, 10 bp, Unknown
  misc_feature (1)..( 10): Result.003 file - promoters60/4915163
attgttcatt

SEQ ID NO: 144650 - DNA, 7 bp, Unknown
  misc_feature (1)..( 7): Result.003 file - promoters60/4915163
attttaa

SEQ ID NO: 144651 - DNA, 7 bp, Unknown
  misc_feature (1)..( 7): Result.003 file - promoters60/4915163
attttaa

SEQ ID NO: 144652 - DNA, 7 bp, Unknown
  misc_feature (1)..( 7): Result.003 file - promoters60/4915163
attctaa

SEQ ID NO: 144653 - DNA, 7 bp, Unknown
  misc_feature (1)..( 7): Result.003 file - promoters60/4915163
cttttaa

SEQ ID NO: 144654 - DNA, 13 bp, Unknown
  misc_feature (1)..( 13): Result.003 file - promoters60/4915163
aatataagtaaca

SEQ ID NO: 144655 - DNA, 13 bp, Unknown
  misc_feature (1)..( 13): Result.003 file - promoters60/4915163
agatgaagtcaca

SEQ ID NO: 144656 - DNA, 13 bp, Unknown
  misc_feature (1)..( 13): Result.003 file - promoters60/4915163
tttataagtataa

SEQ ID NO: 144657 - DNA, 13 bp, Unknown
  misc_feature (1)..( 13): Result.003 file - promoters60/4915163
gaaatttgtaact

SEQ ID NO: 144658 - DNA, 13 bp, Unknown
  misc_feature (1)..( 13): Result.003 file - promoters60/4915163
tttaaaagtaaga

SEQ ID NO: 144659 - DNA, 11 bp, Unknown
  misc_feature (1)..( 11): Result.003 file - promoters60/4915163
ataatattctc

SEQ ID NO: 144660 - DNA, 11 bp, Unknown
  misc_feature (1)..( 11): Result.003 file - promoters60/4915163
ataatatattt

SEQ ID NO: 144661 - DNA, 11 bp, Unknown
  misc_feature (1)..( 11): Result.003 file - promoters60/4915163
aaaatatgttt

SEQ ID NO: 144662 - DNA, 11 bp, Unknown
  misc_feature (1)..( 11): Result.003 file - promoters60/4915163
ttaacatataa

SEQ ID NO: 144663 - DNA, 17 bp, Unknown
  misc_feature (1)..( 17): Result.003 file - promoters60/4915163
taaattttgaaataatt

SEQ ID NO: 144664 - DNA, 17 bp, Unknown
  misc_feature (1)..( 17): Result.003 file - promoters60/4915163
taaattttaaaattatt

SEQ ID NO: 144665 - DNA, 17 bp, Unknown
  misc_feature (1)..( 17): Result.003 file - promoters60/4915163
taattgttaatcttttg

SEQ ID NO: 144666 - DNA, 17 bp, Unknown
  misc_feature (1)..( 17): Result.003 file - promoters60/4915163
cagaaactaagattata

SEQ ID NO: 144667 - DNA, 10 bp, Unknown
  misc_feature (1)..( 10): Result.003 file - promoters60/4915163
atttaaattg

SEQ ID NO: 144668 - DNA, 10 bp, Unknown
  misc_feature (1)..( 10): Result.003 file - promoters60/4915163
atttaaatca

SEQ ID NO: 144669 - DNA, 10 bp, Unknown
  misc_feature (1)..( 10): Result.003 file - promoters60/4915163
gtttaaaaga

SEQ ID NO: 144670 - DNA, 10 bp, Unknown
  misc_feature (1)..( 10): Result.003 file - promoters60/4915163
gtgtaagttg

SEQ ID NO: 144671 - DNA, 10 bp, Unknown
  misc_feature (1)..( 10): Result.003 file - promoters60/4915163
tattttactt

SEQ ID NO: 144672 - DNA, 10 bp, Unknown
  misc_feature (1)..( 10): Result.003 file - promoters60/4915163
tattttaatt

SEQ ID NO: 144673 - DNA, 10 bp, Unknown
  misc_feature (1)..( 10): Result.003 file - promoters60/4915163
gattttacac

SEQ ID NO: 144674 - DNA, 10 bp, Unknown
  misc_feature (1)..( 10): Result.003 file - promoters60/4915163
acttttgatt

SEQ ID NO: 144675 - DNA, 9 bp, Unknown
  misc_feature (1)..( 9): Result.003 file - promoters60/4915163
ttatgtaaa

SEQ ID NO: 144676 - DNA, 9 bp, Unknown
  misc_feature (1)..( 9): Result.003 file - promoters60/4915163
gtatttaag

SEQ ID NO: 144677 - DNA, 9 bp, Unknown
  misc_feature (1)..( 9): Result.003 file - promoters60/4915163
ttatgtatt

SEQ ID NO: 144678 - DNA, 10 bp, Unknown
  misc_feature (1)..( 10): Result.003 file - promoters60/4915163
aattgttaat

SEQ ID NO: 144679 - DNA, 13 bp, Unknown
  misc_feature (1)..( 13): Result.003 file - promoters60/4915163
tttctacgattga

SEQ ID NO: 144680 - DNA, 13 bp, Unknown
  misc_feature (1)..( 13): Result.003 file - promoters60/4915163
aaactaagattat

SEQ ID NO: 144681 - DNA, 13 bp, Unknown
  misc_feature (1)..( 13): Result.003 file - promoters60/4915163
attttaaaattat

SEQ ID NO: 144682 - DNA, 13 bp, Unknown
  misc_feature (1)..( 13): Result.003 file - promoters60/4915163
attctaaaatatt

SEQ ID NO: 144683 - DNA, 12 bp, Unknown
  misc_feature (1)..( 12): Result.003 file - promoters60/4915163
ccataaaagcag

SEQ ID NO: 144684 - DNA, 12 bp, Unknown
  misc_feature (1)..( 12): Result.003 file - promoters60/4915163
ctataaaaacca

SEQ ID NO: 144685 - DNA, 13 bp, Unknown
  misc_feature (1)..( 13): Result.003 file - promoters60/4915163
atataataaccaa

SEQ ID NO: 144686 - DNA, 13 bp, Unknown
  misc_feature (1)..( 13): Result.003 file - promoters60/4915163
ctataaatatcac

SEQ ID NO: 144687 - DNA, 8 bp, Unknown
  misc_feature (1)..( 8): Result.003 file - promoters60/4915163
catattat

SEQ ID NO: 144688 - DNA, 8 bp, Unknown
  misc_feature (1)..( 8): Result.003 file - promoters60/4915163
catattga

SEQ ID NO: 144689 - DNA, 8 bp, Unknown
  misc_feature (1)..( 8): Result.003 file - promoters60/4915163
gatattat

SEQ ID NO: 144690 - DNA, 9 bp, Unknown
  misc_feature (1)..( 9): Result.003 file - promoters60/4915163
tataattgt

SEQ ID NO: 144691 - DNA, 11 bp, Unknown
  misc_feature (1)..( 11): Result.003 file - promoters60/4915163
gtatatataat

SEQ ID NO: 144692 - DNA, 11 bp, Unknown
  misc_feature (1)..( 11): Result.003 file - promoters60/4915163
cgataaatatc

SEQ ID NO: 144693 - DNA, 11 bp, Unknown
  misc_feature (1)..( 11): Result.003 file - promoters60/4915163
ctataaatatc

SEQ ID NO: 144694 - DNA, 11 bp, Unknown
  misc_feature (1)..( 11): Result.003 file - promoters60/4915163
ctataaaaacc

SEQ ID NO: 144695 - DNA, 7 bp, Unknown
  misc_feature (1)..( 7): Result.003 file - promoters60/4915199
tgtgttg

SEQ ID NO: 144696 - DNA, 7 bp, Unknown
  misc_feature (1)..( 7): Result.003 file - promoters60/4915199
tgttttg

SEQ ID NO: 144697 - DNA, 7 bp, Unknown
  misc_feature (1)..( 7): Result.003 file - promoters60/4915199
ttgcttc

SEQ ID NO: 144698 - DNA, 7 bp, Unknown
  misc_feature (1)..( 7): Result.003 file - promoters60/4915199
ttggttc

SEQ ID NO: 144699 - DNA, 8 bp, Unknown
  misc_feature (1)..( 8): Result.003 file - promoters60/4915199
acccaaaa

SEQ ID NO: 144700 - DNA, 8 bp, Unknown
  misc_feature (1)..( 8): Result.003 file - promoters60/4915199
accaaaaa

SEQ ID NO: 144701 - DNA, 7 bp, Unknown
  misc_feature (1)..( 7): Result.003 file - promoters60/4915199
ttttact

SEQ ID NO: 144702 - DNA, 7 bp, Unknown
  misc_feature (1)..( 7): Result.003 file - promoters60/4915199
ttttact

SEQ ID NO: 144703 - DNA, 6 bp, Unknown
  misc_feature (1)..( 6): Result.003 file - promoters60/4915199
aaagct

SEQ ID NO: 144704 - DNA, 6 bp, Unknown
  misc_feature (1)..( 6): Result.003 file - promoters60/4915199
aaagct

SEQ ID NO: 144705 - DNA, 6 bp, Unknown
  misc_feature (1)..( 6): Result.003 file - promoters60/4915199
gtttgt

SEQ ID NO: 144706 - DNA, 6 bp, Unknown
  misc_feature (1)..( 6): Result.003 file - promoters60/4915199
gtttgt

SEQ ID NO: 144707 - DNA, 9 bp, Unknown
  misc_feature (1)..( 9): Result.003 file - promoters60/4915199
tgtctgtgt

SEQ ID NO: 144708 - DNA, 9 bp, Unknown
  misc_feature (1)..( 9): Result.003 file - promoters60/4915199
tgtttgtgt

SEQ ID NO: 144709 - DNA, 6 bp, Unknown
  misc_feature (1)..( 6): Result.003 file - promoters60/4915199
aaaaat

SEQ ID NO: 144710 - DNA, 6 bp, Unknown
  misc_feature (1)..( 6): Result.003 file - promoters60/4915199
aaaaat

SEQ ID NO: 144711 - DNA, 10 bp, Unknown
  misc_feature (1)..( 10): Result.003 file - promoters60/4915199
tattctgtga

SEQ ID NO: 144712 - DNA, 10 bp, Unknown
  misc_feature (1)..( 10): Result.003 file - promoters60/4915199
gtttctctga

SEQ ID NO: 144713 - DNA, 10 bp, Unknown
  misc_feature (1)..( 10): Result.003 file - promoters60/4915199
gtttctctac

SEQ ID NO: 144714 - DNA, 7 bp, Unknown
  misc_feature (1)..( 7): Result.003 file - promoters60/4915199
attagat

SEQ ID NO: 144715 - DNA, 7 bp, Unknown
  misc_feature (1)..( 7): Result.003 file - promoters60/4915199
tttagat

SEQ ID NO: 144716 - DNA, 8 bp, Unknown
  misc_feature (1)..( 8): Result.003 file - promoters60/4915199
gttaagag

SEQ ID NO: 144717 - DNA, 8 bp, Unknown
  misc_feature (1)..( 8): Result.003 file - promoters60/4915199
aaaattat

SEQ ID NO: 144718 - DNA, 8 bp, Unknown
  misc_feature (1)..( 8): Result.003 file - promoters60/4915199
aaaaatat

SEQ ID NO: 144719 - DNA, 8 bp, Unknown
  misc_feature (1)..( 8): Result.003 file - promoters60/4915199
acacaaat

SEQ ID NO: 144720 - DNA, 8 bp, Unknown
  misc_feature (1)..( 8): Result.003 file - promoters60/4915199
acacaaat

SEQ ID NO: 144721 - DNA, 6 bp, Unknown
  misc_feature (1)..( 6): Result.003 file - promoters60/4915199
gataaa

SEQ ID NO: 144722 - DNA, 6 bp, Unknown
  misc_feature (1)..( 6): Result.003 file - promoters60/4915199
gataaa

SEQ ID NO: 144723 - DNA, 6 bp, Unknown
  misc_feature (1)..( 6): Result.003 file - promoters60/4915199
gttgtt

SEQ ID NO: 144724 - DNA, 6 bp, Unknown
  misc_feature (1)..( 6): Result.003 file - promoters60/4915199
gttgtt

SEQ ID NO: 144725 - DNA, 7 bp, Unknown
  misc_feature (1)..( 7): Result.003 file - promoters60/4915199
aatcgta

SEQ ID NO: 144726 - DNA, 7 bp, Unknown
  misc_feature (1)..( 7): Result.003 file - promoters60/4915199
aattgta

SEQ ID NO: 144727 - DNA, 7 bp, Unknown
  misc_feature (1)..( 7): Result.003 file - promoters60/4915199
aaaataa

SEQ ID NO: 144728 - DNA, 7 bp, Unknown
  misc_feature (1)..( 7): Result.003 file - promoters60/4915199
aaattaa

SEQ ID NO: 144729 - DNA, 7 bp, Unknown
  misc_feature (1)..( 7): Result.003 file - promoters60/4915199
attttca

SEQ ID NO: 144730 - DNA, 7 bp, Unknown
  misc_feature (1)..( 7): Result.003 file - promoters60/4915199
attctca

SEQ ID NO: 144731 - DNA, 7 bp, Unknown
  misc_feature (1)..( 7): Result.003 file - promoters60/4915199
atctcaa

SEQ ID NO: 144732 - DNA, 7 bp, Unknown
  misc_feature (1)..( 7): Result.003 file - promoters60/4915199
atcacaa

SEQ ID NO: 144733 - DNA, 6 bp, Unknown
  misc_feature (1)..( 6): Result.003 file - promoters60/4915199
aatcaa

SEQ ID NO: 144734 - DNA, 6 bp, Unknown
  misc_feature (1)..( 6): Result.003 file - promoters60/4915199
aatcaa

SEQ ID NO: 144735 - DNA, 6 bp, Unknown
  misc_feature (1)..( 6): Result.003 file - promoters60/4915199
tttctt

SEQ ID NO: 144736 - DNA, 6 bp, Unknown
  misc_feature (1)..( 6): Result.003 file - promoters60/4915199
tttctt

SEQ ID NO: 144737 - DNA, 9 bp, Unknown
  misc_feature (1)..( 9): Result.003 file - promoters60/4915199
tcactgttt

SEQ ID NO: 144738 - DNA, 9 bp, Unknown
  misc_feature (1)..( 9): Result.003 file - promoters60/4915199
tcactgttt

SEQ ID NO: 144739 - DNA, 8 bp, Unknown
  misc_feature (1)..( 8): Result.003 file - promoters60/4915199
acaccaat

SEQ ID NO: 144740 - DNA, 8 bp, Unknown
  misc_feature (1)..( 8): Result.003 file - promoters60/4915199
acaccaat

SEQ ID NO: 144741 - DNA, 7 bp, Unknown
  misc_feature (1)..( 7): Result.003 file - promoters60/4915199
ctgttga

SEQ ID NO: 144742 - DNA, 7 bp, Unknown
  misc_feature (1)..( 7): Result.003 file - promoters60/4915199
ctggtga

SEQ ID NO: 144743 - DNA, 14 bp, Unknown
  misc_feature (1)..( 14): Result.003 file - promoters60/4915244
tttgcttacaattt

SEQ ID NO: 144744 - DNA, 14 bp, Unknown
  misc_feature (1)..( 14): Result.003 file - promoters60/4915244
ttttcttttcatat

SEQ ID NO: 144745 - DNA, 14 bp, Unknown
  misc_feature (1)..( 14): Result.003 file - promoters60/4915244
gttgtttatataaa

SEQ ID NO: 144746 - DNA, 14 bp, Unknown
  misc_feature (1)..( 14): Result.003 file - promoters60/4915244
tttgctaccgatat

SEQ ID NO: 144747 - DNA, 14 bp, Unknown
  misc_feature (1)..( 14): Result.003 file - promoters60/4915244
catgtttaatctga

SEQ ID NO: 144748 - DNA, 14 bp, Unknown
  misc_feature (1)..( 14): Result.003 file - promoters60/4915244
aaagttaaataaat

SEQ ID NO: 144749 - DNA, 14 bp, Unknown
  misc_feature (1)..( 14): Result.003 file - promoters60/4915244
ttattcaagtaaaa

SEQ ID NO: 144750 - DNA, 14 bp, Unknown
  misc_feature (1)..( 14): Result.003 file - promoters60/4915244
gaatttaaattttt

SEQ ID NO: 144751 - DNA, 10 bp, Unknown
  misc_feature (1)..( 10): Result.003 file - promoters60/4915244
tatatgcaga

SEQ ID NO: 144752 - DNA, 10 bp, Unknown
  misc_feature (1)..( 10): Result.003 file - promoters60/4915244
actatgtaga

SEQ ID NO: 144753 - DNA, 10 bp, Unknown
  misc_feature (1)..( 10): Result.003 file - promoters60/4915244
tatatgtaca

SEQ ID NO: 144754 - DNA, 10 bp, Unknown
  misc_feature (1)..( 10): Result.003 file - promoters60/4915244
gttatatagt

SEQ ID NO: 144755 - DNA, 10 bp, Unknown
  misc_feature (1)..( 10): Result.003 file - promoters60/4915244
gttaaataaa

SEQ ID NO: 144756 - DNA, 10 bp, Unknown
  misc_feature (1)..( 10): Result.003 file - promoters60/4915244
tttaaatttt

SEQ ID NO: 144757 - DNA, 9 bp, Unknown
  misc_feature (1)..( 9): Result.003 file - promoters60/4915244
caatttcac

SEQ ID NO: 144758 - DNA, 9 bp, Unknown
  misc_feature (1)..( 9): Result.003 file - promoters60/4915244
aaatatcag

SEQ ID NO: 144759 - DNA, 9 bp, Unknown
  misc_feature (1)..( 9): Result.003 file - promoters60/4915244
caatttaaa

SEQ ID NO: 144760 - DNA, 9 bp, Unknown
  misc_feature (1)..( 9): Result.003 file - promoters60/4915244
taatataaa

SEQ ID NO: 144761 - DNA, 9 bp, Unknown
  misc_feature (1)..( 9): Result.003 file - promoters60/4915244
aaatataaa

SEQ ID NO: 144762 - DNA, 9 bp, Unknown
  misc_feature (1)..( 9): Result.003 file - promoters60/4915244
gaatttaaa

SEQ ID NO: 144763 - DNA, 17 bp, Unknown
  misc_feature (1)..( 17): Result.003 file - promoters60/4915244
taatataaattagtact

SEQ ID NO: 144764 - DNA, 17 bp, Unknown
  misc_feature (1)..( 17): Result.003 file - promoters60/4915244
aaatataaaatacatga

SEQ ID NO: 144765 - DNA, 17 bp, Unknown
  misc_feature (1)..( 17): Result.003 file - promoters60/4915244
tcaagtaaaagtactat

SEQ ID NO: 144766 - DNA, 17 bp, Unknown
  misc_feature (1)..( 17): Result.003 file - promoters60/4915244
gaatttaaattttttgt

SEQ ID NO: 144767 - DNA, 17 bp, Unknown
  misc_feature (1)..( 17): Result.003 file - promoters60/4915244
caatttaaaaagttaaa

SEQ ID NO: 144768 - DNA, 17 bp, Unknown
  misc_feature (1)..( 17): Result.003 file - promoters60/4915244
aaatatcagtggttata

SEQ ID NO: 144769 - DNA, 9 bp, Unknown
  misc_feature (1)..( 9): Result.003 file - promoters60/4915244
ccaattttt

SEQ ID NO: 144770 - DNA, 9 bp, Unknown
  misc_feature (1)..( 9): Result.003 file - promoters60/4915244
gatattttt

SEQ ID NO: 144771 - DNA, 10 bp, Unknown
  misc_feature (1)..( 10): Result.003 file - promoters60/4915244
ttaattattt

SEQ ID NO: 144772 - DNA, 10 bp, Unknown
  misc_feature (1)..( 10): Result.003 file - promoters60/4915244
ccaatatttt

SEQ ID NO: 144773 - DNA, 10 bp, Unknown
  misc_feature (1)..( 10): Result.003 file - promoters60/4915244
ccaacattct

SEQ ID NO: 144774 - DNA, 10 bp, Unknown
  misc_feature (1)..( 10): Result.003 file - promoters60/4915244
caaatgtttt

SEQ ID NO: 144775 - DNA, 9 bp, Unknown
  misc_feature (1)..( 9): Result.003 file - promoters60/4915244
tttttcttt

SEQ ID NO: 144776 - DNA, 9 bp, Unknown
  misc_feature (1)..( 9): Result.003 file - promoters60/4915244
tttttcatg

SEQ ID NO: 144777 - DNA, 9 bp, Unknown
  misc_feature (1)..( 9): Result.003 file - promoters60/4915244
tttctctac

SEQ ID NO: 144778 - DNA, 9 bp, Unknown
  misc_feature (1)..( 9): Result.003 file - promoters60/4915244
tttttttaa

SEQ ID NO: 144779 - DNA, 9 bp, Unknown
  misc_feature (1)..( 9): Result.003 file - promoters60/4915244
tttgttaaa

SEQ ID NO: 144780 - DNA, 9 bp, Unknown
  misc_feature (1)..( 9): Result.003 file - promoters60/4915244
tttacatat

SEQ ID NO: 144781 - DNA, 8 bp, Unknown
  misc_feature (1)..( 8): Result.003 file - promoters60/4915347
ttttttac

SEQ ID NO: 144782 - DNA, 8 bp, Unknown
  misc_feature (1)..( 8): Result.003 file - promoters60/4915347
ttttttac

SEQ ID NO: 144783 - DNA, 7 bp, Unknown
  misc_feature (1)..( 7): Result.003 file - promoters60/4915347
catttat

SEQ ID NO: 144784 - DNA, 7 bp, Unknown
  misc_feature (1)..( 7): Result.003 file - promoters60/4915347
catatat

SEQ ID NO: 144785 - DNA, 6 bp, Unknown
  misc_feature (1)..( 6): Result.003 file - promoters60/4915347
ttatat

SEQ ID NO: 144786 - DNA, 6 bp, Unknown
  misc_feature (1)..( 6): Result.003 file - promoters60/4915347
ttatat

SEQ ID NO: 144787 - DNA, 7 bp, Unknown
  misc_feature (1)..( 7): Result.003 file - promoters60/4915347
acaatca

SEQ ID NO: 144788 - DNA, 7 bp, Unknown
  misc_feature (1)..( 7): Result.003 file - promoters60/4915347
acattca

SEQ ID NO: 144789 - DNA, 7 bp, Unknown
  misc_feature (1)..( 7): Result.003 file - promoters60/4915347
tgaaaac

SEQ ID NO: 144790 - DNA, 7 bp, Unknown
  misc_feature (1)..( 7): Result.003 file - promoters60/4915347
tgacaac

SEQ ID NO: 144791 - DNA, 6 bp, Unknown
  misc_feature (1)..( 6): Result.003 file - promoters60/4915347
tttttt

SEQ ID NO: 144792 - DNA, 6 bp, Unknown
  misc_feature (1)..( 6): Result.003 file - promoters60/4915347
tttttt

SEQ ID NO: 144793 - DNA, 7 bp, Unknown
  misc_feature (1)..( 7): Result.003 file - promoters60/4915347
gttttaa

SEQ ID NO: 144794 - DNA, 7 bp, Unknown
  misc_feature (1)..( 7): Result.003 file - promoters60/4915347
gttttaa

SEQ ID NO: 144795 - DNA, 7 bp, Unknown
  misc_feature (1)..( 7): Result.003 file - promoters60/4915347
ctctctc

SEQ ID NO: 144796 - DNA, 7 bp, Unknown
  misc_feature (1)..( 7): Result.003 file - promoters60/4915347
ctctctc

SEQ ID NO: 144797 - DNA, 7 bp, Unknown
  misc_feature (1)..( 7): Result.003 file - promoters60/4915347
attggta

SEQ ID NO: 144798 - DNA, 7 bp, Unknown
  misc_feature (1)..( 7): Result.003 file - promoters60/4915347
attggta

SEQ ID NO: 144799 - DNA, 8 bp, Unknown
  misc_feature (1)..( 8): Result.003 file - promoters60/4915347
aatcatat

SEQ ID NO: 144800 - DNA, 8 bp, Unknown
  misc_feature (1)..( 8): Result.003 file - promoters60/4915347
aatcctat

SEQ ID NO: 144801 - DNA, 7 bp, Unknown
  misc_feature (1)..( 7): Result.003 file - promoters60/4915347
tcctttt

SEQ ID NO: 144802 - DNA, 7 bp, Unknown
  misc_feature (1)..( 7): Result.003 file - promoters60/4915347
tcctttt

SEQ ID NO: 144803 - DNA, 7 bp, Unknown
  misc_feature (1)..( 7): Result.003 file - promoters60/4915347
aaacaca

SEQ ID NO: 144804 - DNA, 7 bp, Unknown
  misc_feature (1)..( 7): Result.003 file - promoters60/4915347
aaacaca

SEQ ID NO: 144805 - DNA, 6 bp, Unknown
  misc_feature (1)..( 6): Result.003 file - promoters60/4915347
taataa

SEQ ID NO: 144806 - DNA, 6 bp, Unknown
  misc_feature (1)..( 6): Result.003 file - promoters60/4915347
taataa

SEQ ID NO: 144807 - DNA, 11 bp, Unknown
  misc_feature (1)..( 11): Result.003 file - promoters60/4915347
aacttttgaat

SEQ ID NO: 144808 - DNA, 11 bp, Unknown
  misc_feature (1)..( 11): Result.003 file - promoters60/4915347
atttttttaat

SEQ ID NO: 144809 - DNA, 11 bp, Unknown
  misc_feature (1)..( 11): Result.003 file - promoters60/4915347
atatttttttt

SEQ ID NO: 144810 - DNA, 7 bp, Unknown
  misc_feature (1)..( 7): Result.003 file - promoters60/4915347
gtgggaa

SEQ ID NO: 144811 - DNA, 7 bp, Unknown
  misc_feature (1)..( 7): Result.003 file - promoters60/4915347
gtgtgaa

SEQ ID NO: 144812 - DNA, 6 bp, Unknown
  misc_feature (1)..( 6): Result.003 file - promoters60/4915347
tactgt

SEQ ID NO: 144813 - DNA, 6 bp, Unknown
  misc_feature (1)..( 6): Result.003 file - promoters60/4915347
tactgt

SEQ ID NO: 144814 - DNA, 9 bp, Unknown
  misc_feature (1)..( 9): Result.003 file - promoters60/4915347
tcaaaattt

SEQ ID NO: 144815 - DNA, 9 bp, Unknown
  misc_feature (1)..( 9): Result.003 file - promoters60/4915347
tcagaattt

SEQ ID NO: 144816 - DNA, 6 bp, Unknown
  misc_feature (1)..( 6): Result.003 file - promoters60/4915347
ttgaaa

SEQ ID NO: 144817 - DNA, 6 bp, Unknown
  misc_feature (1)..( 6): Result.003 file - promoters60/4915347
ttgaaa

SEQ ID NO: 144818 - DNA, 7 bp, Unknown
  misc_feature (1)..( 7): Result.003 file - promoters60/4915347
cttctcc

SEQ ID NO: 144819 - DNA, 7 bp, Unknown
  misc_feature (1)..( 7): Result.003 file - promoters60/4915347
cttgtcc

SEQ ID NO: 144820 - DNA, 7 bp, Unknown
  misc_feature (1)..( 7): Result.003 file - promoters60/4915347
ttcatgt

SEQ ID NO: 144821 - DNA, 7 bp, Unknown
  misc_feature (1)..( 7): Result.003 file - promoters60/4915347
ttcatgt

SEQ ID NO: 144822 - DNA, 7 bp, Unknown
  misc_feature (1)..( 7): Result.003 file - promoters60/4915347
aagcttt

SEQ ID NO: 144823 - DNA, 7 bp, Unknown
  misc_feature (1)..( 7): Result.003 file - promoters60/4915347
aagattt

SEQ ID NO: 144824 - DNA, 7 bp, Unknown
  misc_feature (1)..( 7): Result.003 file - promoters60/4915347
tacctca

SEQ ID NO: 144825 - DNA, 7 bp, Unknown
  misc_feature (1)..( 7): Result.003 file - promoters60/4915347
tacctca

SEQ ID NO: 144826 - DNA, 7 bp, Unknown
  misc_feature (1)..( 7): Result.003 file - promoters60/4915347
ttttata

SEQ ID NO: 144827 - DNA, 7 bp, Unknown
  misc_feature (1)..( 7): Result.003 file - promoters60/4915347
tttgata

SEQ ID NO: 144828 - DNA, 9 bp, Unknown
  misc_feature (1)..( 9): Result.003 file - promoters60/4915347
catccttat

SEQ ID NO: 144829 - DNA, 9 bp, Unknown
  misc_feature (1)..( 9): Result.003 file - promoters60/4915347
catcattat

SEQ ID NO: 144830 - DNA, 10 bp, Unknown
  misc_feature (1)..( 10): Result.003 file - promoters60/4915384
tttcaataac

SEQ ID NO: 144831 - DNA, 10 bp, Unknown
  misc_feature (1)..( 10): Result.003 file - promoters60/4915384
tttaaataat

SEQ ID NO: 144832 - DNA, 10 bp, Unknown
  misc_feature (1)..( 10): Result.003 file - promoters60/4915384
cagcaaaaac

SEQ ID NO: 144833 - DNA, 7 bp, Unknown
  misc_feature (1)..( 7): Result.003 file - promoters60/4915384
ttttaag

SEQ ID NO: 144834 - DNA, 7 bp, Unknown
  misc_feature (1)..( 7): Result.003 file - promoters60/4915384
ttttaat

SEQ ID NO: 144835 - DNA, 7 bp, Unknown
  misc_feature (1)..( 7): Result.003 file - promoters60/4915384
tttgatt

SEQ ID NO: 144836 - DNA, 10 bp, Unknown
  misc_feature (1)..( 10): Result.003 file - promoters60/4915384
ttattatttt

SEQ ID NO: 144837 - DNA, 10 bp, Unknown
  misc_feature (1)..( 10): Result.003 file - promoters60/4915384
ggtttatttt

SEQ ID NO: 144838 - DNA, 10 bp, Unknown
  misc_feature (1)..( 10): Result.003 file - promoters60/4915384
ggtttattca

SEQ ID NO: 144839 - DNA, 10 bp, Unknown
  misc_feature (1)..( 10): Result.003 file - promoters60/4915384
attttatttt

SEQ ID NO: 144840 - DNA, 8 bp, Unknown
  misc_feature (1)..( 8): Result.003 file - promoters60/4915384
caaaggta

SEQ ID NO: 144841 - DNA, 8 bp, Unknown
  misc_feature (1)..( 8): Result.003 file - promoters60/4915384
gaaaagta

SEQ ID NO: 144842 - DNA, 8 bp, Unknown
  misc_feature (1)..( 8): Result.003 file - promoters60/4915384
gaaaagaa

SEQ ID NO: 144843 - DNA, 8 bp, Unknown
  misc_feature (1)..( 8): Result.003 file - promoters60/4915384
tcaaattg

SEQ ID NO: 144844 - DNA, 8 bp, Unknown
  misc_feature (1)..( 8): Result.003 file - promoters60/4915384
tcacattc

SEQ ID NO: 144845 - DNA, 8 bp, Unknown
  misc_feature (1)..( 8): Result.003 file - promoters60/4915384
aaaaatga

SEQ ID NO: 144846 - DNA, 8 bp, Unknown
  misc_feature (1)..( 8): Result.003 file - promoters60/4915384
aaatttgt

SEQ ID NO: 144847 - DNA, 8 bp, Unknown
  misc_feature (1)..( 8): Result.003 file - promoters60/4915384
agatttgt

SEQ ID NO: 144848 - DNA, 8 bp, Unknown
  misc_feature (1)..( 8): Result.003 file - promoters60/4915384
aaatatgt

SEQ ID NO: 144849 - DNA, 8 bp, Unknown
  misc_feature (1)..( 8): Result.003 file - promoters60/4915384
ataagaga

SEQ ID NO: 144850 - DNA, 8 bp, Unknown
  misc_feature (1)..( 8): Result.003 file - promoters60/4915384
tcaagaga

SEQ ID NO: 144851 - DNA, 8 bp, Unknown
  misc_feature (1)..( 8): Result.003 file - promoters60/4915384
ttaagaga

SEQ ID NO: 144852 - DNA, 8 bp, Unknown
  misc_feature (1)..( 8): Result.003 file - promoters60/4915384
ttaagaat

SEQ ID NO: 144853 - DNA, 10 bp, Unknown
  misc_feature (1)..( 10): Result.003 file - promoters60/4915384
atttgattat

SEQ ID NO: 144854 - DNA, 10 bp, Unknown
  misc_feature (1)..( 10): Result.003 file - promoters60/4915384
attttatttt

SEQ ID NO: 144855 - DNA, 10 bp, Unknown
  misc_feature (1)..( 10): Result.003 file - promoters60/4915384
ggtttatttt

SEQ ID NO: 144856 - DNA, 11 bp, Unknown
  misc_feature (1)..( 11): Result.003 file - promoters60/4915409
attgttcaaac

SEQ ID NO: 144857 - DNA, 11 bp, Unknown
  misc_feature (1)..( 11): Result.003 file - promoters60/4915409
actcttcaaac

SEQ ID NO: 144858 - DNA, 11 bp, Unknown
  misc_feature (1)..( 11): Result.003 file - promoters60/4915409
atagttcaaaa

SEQ ID NO: 144859 - DNA, 11 bp, Unknown
  misc_feature (1)..( 11): Result.003 file - promoters60/4915409
atagttcacag

SEQ ID NO: 144860 - DNA, 7 bp, Unknown
  misc_feature (1)..( 7): Result.003 file - promoters60/4915409
tttgaga

SEQ ID NO: 144861 - DNA, 7 bp, Unknown
  misc_feature (1)..( 7): Result.003 file - promoters60/4915409
ttttaga

SEQ ID NO: 144862 - DNA, 7 bp, Unknown
  misc_feature (1)..( 7): Result.003 file - promoters60/4915409
ttatata

SEQ ID NO: 144863 - DNA, 7 bp, Unknown
  misc_feature (1)..( 7): Result.003 file - promoters60/4915409
ctatata

SEQ ID NO: 144864 - DNA, 12 bp, Unknown
  misc_feature (1)..( 12): Result.003 file - promoters60/4915420
ttaaaaatccaa

SEQ ID NO: 144865 - DNA, 12 bp, Unknown
  misc_feature (1)..( 12): Result.003 file - promoters60/4915420
ataaatatcctc

SEQ ID NO: 144866 - DNA, 12 bp, Unknown
  misc_feature (1)..( 12): Result.003 file - promoters60/4915420
aacaaaatccaa

SEQ ID NO: 144867 - DNA, 12 bp, Unknown
  misc_feature (1)..( 12): Result.003 file - promoters60/4915420
ttaaaaacaatt

SEQ ID NO: 144868 - DNA, 12 bp, Unknown
  misc_feature (1)..( 12): Result.003 file - promoters60/4915420
ttaaaaacattt

SEQ ID NO: 144869 - DNA, 12 bp, Unknown
  misc_feature (1)..( 12): Result.003 file - promoters60/4915420
aaaaaaagaata

SEQ ID NO: 144870 - DNA, 8 bp, Unknown
  misc_feature (1)..( 8): Result.003 file - promoters60/4915420
tattttga

SEQ ID NO: 144871 - DNA, 8 bp, Unknown
  misc_feature (1)..( 8): Result.003 file - promoters60/4915420
tattttat

SEQ ID NO: 144872 - DNA, 8 bp, Unknown
  misc_feature (1)..( 8): Result.003 file - promoters60/4915420
tattatat

SEQ ID NO: 144873 - DNA, 9 bp, Unknown
  misc_feature (1)..( 9): Result.003 file - promoters60/4915420
tatatatga

SEQ ID NO: 144874 - DNA, 9 bp, Unknown
  misc_feature (1)..( 9): Result.003 file - promoters60/4915420
tatatttta

SEQ ID NO: 144875 - DNA, 9 bp, Unknown
  misc_feature (1)..( 9): Result.003 file - promoters60/4915420
ttcatatga

SEQ ID NO: 144876 - DNA, 14 bp, Unknown
  misc_feature (1)..( 14): Result.003 file - promoters60/4915420
caacaatgtacaaa

SEQ ID NO: 144877 - DNA, 14 bp, Unknown
  misc_feature (1)..( 14): Result.003 file - promoters60/4915420
caataatttacatt

SEQ ID NO: 144878 - DNA, 14 bp, Unknown
  misc_feature (1)..( 14): Result.003 file - promoters60/4915420
acacaatatacaga

SEQ ID NO: 144879 - DNA, 14 bp, Unknown
  misc_feature (1)..( 14): Result.003 file - promoters60/4915420
atttaatttaatat

SEQ ID NO: 144880 - DNA, 14 bp, Unknown
  misc_feature (1)..( 14): Result.003 file - promoters60/4915420
acctgattttatta

SEQ ID NO: 144881 - DNA, 14 bp, Unknown
  misc_feature (1)..( 14): Result.003 file - promoters60/4915420
tgaaaatttatacg

SEQ ID NO: 144882 - DNA, 14 bp, Unknown
  misc_feature (1)..( 14): Result.003 file - promoters60/4915420
atgcaaaatacaga

SEQ ID NO: 144883 - DNA, 9 bp, Unknown
  misc_feature (1)..( 9): Result.003 file - promoters60/4915420
gttatatca

SEQ ID NO: 144884 - DNA, 9 bp, Unknown
  misc_feature (1)..( 9): Result.003 file - promoters60/4915420
tttatctca

SEQ ID NO: 144885 - DNA, 9 bp, Unknown
  misc_feature (1)..( 9): Result.003 file - promoters60/4915420
cttagatcc

SEQ ID NO: 144886 - DNA, 9 bp, Unknown
  misc_feature (1)..( 9): Result.003 file - promoters60/4915420
tttttcttt

SEQ ID NO: 144887 - DNA, 9 bp, Unknown
  misc_feature (1)..( 9): Result.003 file - promoters60/4915420
attttgttt

SEQ ID NO: 144888 - DNA, 9 bp, Unknown
  misc_feature (1)..( 9): Result.003 file - promoters60/4915420
aatttgtta

SEQ ID NO: 144889 - DNA, 13 bp, Unknown
  misc_feature (1)..( 13): Result.003 file - promoters60/4915420
aagattttttatt

SEQ ID NO: 144890 - DNA, 13 bp, Unknown
  misc_feature (1)..( 13): Result.003 file - promoters60/4915420
gagaatttttgta

SEQ ID NO: 144891 - DNA, 13 bp, Unknown
  misc_feature (1)..( 13): Result.003 file - promoters60/4915420
tatattttatatt

SEQ ID NO: 144892 - DNA, 13 bp, Unknown
  misc_feature (1)..( 13): Result.003 file - promoters60/4915420
ttgattttgacta

SEQ ID NO: 144893 - DNA, 13 bp, Unknown
  misc_feature (1)..( 13): Result.003 file - promoters60/4915420
gaaattttcatgt

SEQ ID NO: 144894 - DNA, 13 bp, Unknown
  misc_feature (1)..( 13): Result.003 file - promoters60/4915420
acatgattatatg

SEQ ID NO: 144895 - DNA, 13 bp, Unknown
  misc_feature (1)..( 13): Result.003 file - promoters60/4915420
ttcatatgagtga

SEQ ID NO: 144896 - DNA, 10 bp, Unknown
  misc_feature (1)..( 10): Result.003 file - promoters60/4915420
tatttataaa

SEQ ID NO: 144897 - DNA, 10 bp, Unknown
  misc_feature (1)..( 10): Result.003 file - promoters60/4915420
tttttttaat

SEQ ID NO: 144898 - DNA, 10 bp, Unknown
  misc_feature (1)..( 10): Result.003 file - promoters60/4915420
gattaataca

SEQ ID NO: 144899 - DNA, 10 bp, Unknown
  misc_feature (1)..( 10): Result.003 file - promoters60/4915420
gattaaattg

SEQ ID NO: 144900 - DNA, 10 bp, Unknown
  misc_feature (1)..( 10): Result.003 file - promoters60/4915420
tatttgaatt

SEQ ID NO: 144901 - DNA, 10 bp, Unknown
  misc_feature (1)..( 10): Result.003 file - promoters60/4915420
aatttataac

SEQ ID NO: 144902 - DNA, 17 bp, Unknown
  misc_feature (1)..( 17): Result.003 file - promoters60/4915606
tcatcgttaatttttga

SEQ ID NO: 144903 - DNA, 17 bp, Unknown
  misc_feature (1)..( 17): Result.003 file - promoters60/4915606
tatttgtttatttatga

SEQ ID NO: 144904 - DNA, 17 bp, Unknown
  misc_feature (1)..( 17): Result.003 file - promoters60/4915606
tactgttgaattttttt

SEQ ID NO: 144905 - DNA, 17 bp, Unknown
  misc_feature (1)..( 17): Result.003 file - promoters60/4915606
ataaagttaactttgta

SEQ ID NO: 144906 - DNA, 17 bp, Unknown
  misc_feature (1)..( 17): Result.003 file - promoters60/4915606
tatatgtttatatgacc

SEQ ID NO: 144907 - DNA, 17 bp, Unknown
  misc_feature (1)..( 17): Result.003 file - promoters60/4915606
agtatcatcacttggta

SEQ ID NO: 144908 - DNA, 17 bp, Unknown
  misc_feature (1)..( 17): Result.003 file - promoters60/4915606
tgacagtcaacttgtac

SEQ ID NO: 144909 - DNA, 17 bp, Unknown
  misc_feature (1)..( 17): Result.003 file - promoters60/4915606
tgactgttgactggttc

SEQ ID NO: 144910 - DNA, 13 bp, Unknown
  misc_feature (1)..( 13): Result.003 file - promoters60/4915606
aaatatataaatg

SEQ ID NO: 144911 - DNA, 13 bp, Unknown
  misc_feature (1)..( 13): Result.003 file - promoters60/4915606
ttagatatgaatt

SEQ ID NO: 144912 - DNA, 13 bp, Unknown
  misc_feature (1)..( 13): Result.003 file - promoters60/4915606
tccgataaaaaaa

SEQ ID NO: 144913 - DNA, 13 bp, Unknown
  misc_feature (1)..( 13): Result.003 file - promoters60/4915606
tccgttaaagtta

SEQ ID NO: 144914 - DNA, 13 bp, Unknown
  misc_feature (1)..( 13): Result.003 file - promoters60/4915606
tgagaaagaaaca

SEQ ID NO: 144915 - DNA, 13 bp, Unknown
  misc_feature (1)..( 13): Result.003 file - promoters60/4915606
atttagatggatt

SEQ ID NO: 144916 - DNA, 9 bp, Unknown
  misc_feature (1)..( 9): Result.003 file - promoters60/4915606
actttatta

SEQ ID NO: 144917 - DNA, 9 bp, Unknown
  misc_feature (1)..( 9): Result.003 file - promoters60/4915606
ccttcattt

SEQ ID NO: 144918 - DNA, 9 bp, Unknown
  misc_feature (1)..( 9): Result.003 file - promoters60/4915606
attttttta

SEQ ID NO: 144919 - DNA, 9 bp, Unknown
  misc_feature (1)..( 9): Result.003 file - promoters60/4915606
atttcattt

SEQ ID NO: 144920 - DNA, 9 bp, Unknown
  misc_feature (1)..( 9): Result.003 file - promoters60/4915606
attttattt

SEQ ID NO: 144921 - DNA, 9 bp, Unknown
  misc_feature (1)..( 9): Result.003 file - promoters60/4915606
gaattttta

SEQ ID NO: 144922 - DNA, 9 bp, Unknown
  misc_feature (1)..( 9): Result.003 file - promoters60/4915623
ccatttctg

SEQ ID NO: 144923 - DNA, 9 bp, Unknown
  misc_feature (1)..( 9): Result.003 file - promoters60/4915623
tcatatctg

SEQ ID NO: 144924 - DNA, 9 bp, Unknown
  misc_feature (1)..( 9): Result.003 file - promoters60/4915623
tcatattta

SEQ ID NO: 144925 - DNA, 8 bp, Unknown
  misc_feature (1)..( 8): Result.003 file - promoters60/4915623
tttaaatt

SEQ ID NO: 144926 - DNA, 8 bp, Unknown
  misc_feature (1)..( 8): Result.003 file - promoters60/4915623
tttacatt

SEQ ID NO: 144927 - DNA, 8 bp, Unknown
  misc_feature (1)..( 8): Result.003 file - promoters60/4915623
tttcaatc

SEQ ID NO: 144928 - DNA, 9 bp, Unknown
  misc_feature (1)..( 9): Result.003 file - promoters60/4915623
aatttattt

SEQ ID NO: 144929 - DNA, 9 bp, Unknown
  misc_feature (1)..( 9): Result.003 file - promoters60/4915623
aatctattg

SEQ ID NO: 144930 - DNA, 9 bp, Unknown
  misc_feature (1)..( 9): Result.003 file - promoters60/4915623
ttcttattt

SEQ ID NO: 144931 - DNA, 9 bp, Unknown
  misc_feature (1)..( 9): Result.003 file - promoters60/4915623
ttacattag

SEQ ID NO: 144932 - DNA, 9 bp, Unknown
  misc_feature (1)..( 9): Result.003 file - promoters60/4915623
ttatatttt

SEQ ID NO: 144933 - DNA, 9 bp, Unknown
  misc_feature (1)..( 9): Result.003 file - promoters60/4915623
taacattag

SEQ ID NO: 144934 - DNA, 8 bp, Unknown
  misc_feature (1)..( 8): Result.003 file - promoters60/4915623
ttatgatc

SEQ ID NO: 144935 - DNA, 8 bp, Unknown
  misc_feature (1)..( 8): Result.003 file - promoters60/4915623
atatcatc

SEQ ID NO: 144936 - DNA, 8 bp, Unknown
  misc_feature (1)..( 8): Result.003 file - promoters60/4915623
ttatgaac

SEQ ID NO: 144937 - DNA, 7 bp, Unknown
  misc_feature (1)..( 7): Result.003 file - promoters60/4915623
taacact

SEQ ID NO: 144938 - DNA, 7 bp, Unknown
  misc_feature (1)..( 7): Result.003 file - promoters60/4915623
aaacact

SEQ ID NO: 144939 - DNA, 7 bp, Unknown
  misc_feature (1)..( 7): Result.003 file - promoters60/4915623
aaacact

SEQ ID NO: 144940 - DNA, 9 bp, Unknown
  misc_feature (1)..( 9): Result.003 file - promoters60/4915623
caaataatt

SEQ ID NO: 144941 - DNA, 9 bp, Unknown
  misc_feature (1)..( 9): Result.003 file - promoters60/4915623
tcaataata

SEQ ID NO: 144942 - DNA, 9 bp, Unknown
  misc_feature (1)..( 9): Result.003 file - promoters60/4915623
caaataatt

SEQ ID NO: 144943 - DNA, 6 bp, Unknown
  misc_feature (1)..( 6): Result.003 file - promoters60/4915694
ctactt

SEQ ID NO: 144944 - DNA, 6 bp, Unknown
  misc_feature (1)..( 6): Result.003 file - promoters60/4915694
ctactt

SEQ ID NO: 144945 - DNA, 6 bp, Unknown
  misc_feature (1)..( 6): Result.003 file - promoters60/4915694
tttcaa

SEQ ID NO: 144946 - DNA, 6 bp, Unknown
  misc_feature (1)..( 6): Result.003 file - promoters60/4915694
tttcaa

SEQ ID NO: 144947 - DNA, 7 bp, Unknown
  misc_feature (1)..( 7): Result.003 file - promoters60/4915694
attattt

SEQ ID NO: 144948 - DNA, 7 bp, Unknown
  misc_feature (1)..( 7): Result.003 file - promoters60/4915694
atttttt

SEQ ID NO: 144949 - DNA, 7 bp, Unknown
  misc_feature (1)..( 7): Result.003 file - promoters60/4915694
atttaaa

SEQ ID NO: 144950 - DNA, 7 bp, Unknown
  misc_feature (1)..( 7): Result.003 file - promoters60/4915694
atttaaa

SEQ ID NO: 144951 - DNA, 6 bp, Unknown
  misc_feature (1)..( 6): Result.003 file - promoters60/4915694
ccaaag

SEQ ID NO: 144952 - DNA, 6 bp, Unknown
  misc_feature (1)..( 6): Result.003 file - promoters60/4915694
ccaaag

SEQ ID NO: 144953 - DNA, 8 bp, Unknown
  misc_feature (1)..( 8): Result.003 file - promoters60/4915694
aaatcttg

SEQ ID NO: 144954 - DNA, 8 bp, Unknown
  misc_feature (1)..( 8): Result.003 file - promoters60/4915694
aaatgttg

SEQ ID NO: 144955 - DNA, 8 bp, Unknown
  misc_feature (1)..( 8): Result.003 file - promoters60/4915694
ttttacgt

SEQ ID NO: 144956 - DNA, 8 bp, Unknown
  misc_feature (1)..( 8): Result.003 file - promoters60/4915694
tttaacgt

SEQ ID NO: 144957 - DNA, 6 bp, Unknown
  misc_feature (1)..( 6): Result.003 file - promoters60/4915694
tattta

SEQ ID NO: 144958 - DNA, 6 bp, Unknown
  misc_feature (1)..( 6): Result.003 file - promoters60/4915694
tattta

SEQ ID NO: 144959 - DNA, 6 bp, Unknown
  misc_feature (1)..( 6): Result.003 file - promoters60/4915694
tcaata

SEQ ID NO: 144960 - DNA, 6 bp, Unknown
  misc_feature (1)..( 6): Result.003 file - promoters60/4915694
tcaata

SEQ ID NO: 144961 - DNA, 6 bp, Unknown
  misc_feature (1)..( 6): Result.003 file - promoters60/4915694
aacaaa

SEQ ID NO: 144962 - DNA, 6 bp, Unknown
  misc_feature (1)..( 6): Result.003 file - promoters60/4915694
aacaaa

SEQ ID NO: 144963 - DNA, 8 bp, Unknown
  misc_feature (1)..( 8): Result.003 file - promoters60/4915694
aaagacaa

SEQ ID NO: 144964 - DNA, 8 bp, Unknown
  misc_feature (1)..( 8): Result.003 file - promoters60/4915694
aaaaacaa

SEQ ID NO: 144965 - DNA, 8 bp, Unknown
  misc_feature (1)..( 8): Result.003 file - promoters60/4915694
ttacaaaa

SEQ ID NO: 144966 - DNA, 8 bp, Unknown
  misc_feature (1)..( 8): Result.003 file - promoters60/4915694
ctacaaaa

SEQ ID NO: 144967 - DNA, 8 bp, Unknown
  misc_feature (1)..( 8): Result.003 file - promoters60/4915694
ctacaaga

SEQ ID NO: 144968 - DNA, 8 bp, Unknown
  misc_feature (1)..( 8): Result.003 file - promoters60/4915694
ctaaattc

SEQ ID NO: 144969 - DNA, 8 bp, Unknown
  misc_feature (1)..( 8): Result.003 file - promoters60/4915694
ctaatttc

SEQ ID NO: 144970 - DNA, 8 bp, Unknown
  misc_feature (1)..( 8): Result.003 file - promoters60/4915694
gattcaaa

SEQ ID NO: 144971 - DNA, 8 bp, Unknown
  misc_feature (1)..( 8): Result.003 file - promoters60/4915694
gatttaaa

SEQ ID NO: 144972 - DNA, 7 bp, Unknown
  misc_feature (1)..( 7): Result.003 file - promoters60/4915694
ttttcaa

SEQ ID NO: 144973 - DNA, 7 bp, Unknown
  misc_feature (1)..( 7): Result.003 file - promoters60/4915694
tttacaa

SEQ ID NO: 144974 - DNA, 6 bp, Unknown
  misc_feature (1)..( 6): Result.003 file - promoters60/4915694
gttttg

SEQ ID NO: 144975 - DNA, 6 bp, Unknown
  misc_feature (1)..( 6): Result.003 file - promoters60/4915694
gttttg

SEQ ID NO: 144976 - DNA, 7 bp, Unknown
  misc_feature (1)..( 7): Result.003 file - promoters60/4915694
aaagaaa

SEQ ID NO: 144977 - DNA, 7 bp, Unknown
  misc_feature (1)..( 7): Result.003 file - promoters60/4915694
aaataaa

SEQ ID NO: 144978 - DNA, 7 bp, Unknown
  misc_feature (1)..( 7): Result.003 file - promoters60/4915694
cacattt

SEQ ID NO: 144979 - DNA, 7 bp, Unknown
  misc_feature (1)..( 7): Result.003 file - promoters60/4915694
cactttt

SEQ ID NO: 144980 - DNA, 8 bp, Unknown
  misc_feature (1)..( 8): Result.003 file - promoters60/4915694
taacaatt

SEQ ID NO: 144981 - DNA, 8 bp, Unknown
  misc_feature (1)..( 8): Result.003 file - promoters60/4915694
taacaatt

SEQ ID NO: 144982 - DNA, 6 bp, Unknown
  misc_feature (1)..( 6): Result.003 file - promoters60/4915694
acaaaa

SEQ ID NO: 144983 - DNA, 6 bp, Unknown
  misc_feature (1)..( 6): Result.003 file - promoters60/4915694
acaaaa

SEQ ID NO: 144984 - DNA, 8 bp, Unknown
  misc_feature (1)..( 8): Result.003 file - promoters60/4915816
atttgttt

SEQ ID NO: 144985 - DNA, 8 bp, Unknown
  misc_feature (1)..( 8): Result.003 file - promoters60/4915816
atttcttt

SEQ ID NO: 144986 - DNA, 7 bp, Unknown
  misc_feature (1)..( 7): Result.003 file - promoters60/4915816
atgattg

SEQ ID NO: 144987 - DNA, 7 bp, Unknown
  misc_feature (1)..( 7): Result.003 file - promoters60/4915816
atgattt

SEQ ID NO: 144988 - DNA, 8 bp, Unknown
  misc_feature (1)..( 8): Result.003 file - promoters60/4915816
ttgaattg

SEQ ID NO: 144989 - DNA, 6 bp, Unknown
  misc_feature (1)..( 6): Result.003 file - promoters60/4915816
acatga

SEQ ID NO: 144990 - DNA, 6 bp, Unknown
  misc_feature (1)..( 6): Result.003 file - promoters60/4915816
acatga

SEQ ID NO: 144991 - DNA, 9 bp, Unknown
  misc_feature (1)..( 9): Result.003 file - promoters60/4915816
ggcaaggaa

SEQ ID NO: 144992 - DNA, 9 bp, Unknown
  misc_feature (1)..( 9): Result.003 file - promoters60/4915816
ggcgaggaa

SEQ ID NO: 144993 - DNA, 9 bp, Unknown
  misc_feature (1)..( 9): Result.003 file - promoters60/4915816
agaaacata

SEQ ID NO: 144994 - DNA, 9 bp, Unknown
  misc_feature (1)..( 9): Result.003 file - promoters60/4915816
agaatcata

SEQ ID NO: 144995 - DNA, 6 bp, Unknown
  misc_feature (1)..( 6): Result.003 file - promoters60/4915816
aggaag

SEQ ID NO: 144996 - DNA, 6 bp, Unknown
  misc_feature (1)..( 6): Result.003 file - promoters60/4915816
aggaag

SEQ ID NO: 144997 - DNA, 7 bp, Unknown
  misc_feature (1)..( 7): Result.003 file - promoters60/4915816
atatacc

SEQ ID NO: 144998 - DNA, 7 bp, Unknown
  misc_feature (1)..( 7): Result.003 file - promoters60/4915816
ataaacc

SEQ ID NO: 144999 - DNA, 8 bp, Unknown
  misc_feature (1)..( 8): Result.003 file - promoters60/4915816
taaggatt

SEQ ID NO: 145000 - DNA, 8 bp, Unknown
  misc_feature (1)..( 8): Result.003 file - promoters60/4915816
taaagatt

SEQ ID NO: 145001 - DNA, 6 bp, Unknown
  misc_feature (1)..( 6): Result.003 file - promoters60/4915816
attggg

SEQ ID NO: 145002 - DNA, 6 bp, Unknown
  misc_feature (1)..( 6): Result.003 file - promoters60/4915816
attggg

SEQ ID NO: 145003 - DNA, 6 bp, Unknown
  misc_feature (1)..( 6): Result.003 file - promoters60/4915816
ccattt

SEQ ID NO: 145004 - DNA, 6 bp, Unknown
  misc_feature (1)..( 6): Result.003 file - promoters60/4915816
ccattt

SEQ ID NO: 145005 - DNA, 7 bp, Unknown
  misc_feature (1)..( 7): Result.003 file - promoters60/4915816
aatggcg

SEQ ID NO: 145006 - DNA, 7 bp, Unknown
  misc_feature (1)..( 7): Result.003 file - promoters60/4915816
aatggcg

SEQ ID NO: 145007 - DNA, 7 bp, Unknown
  misc_feature (1)..( 7): Result.003 file - promoters60/4915816
agattgg

SEQ ID NO: 145008 - DNA, 7 bp, Unknown
  misc_feature (1)..( 7): Result.003 file - promoters60/4915816
agattgg

SEQ ID NO: 145009 - DNA, 7 bp, Unknown
  misc_feature (1)..( 7): Result.003 file - promoters60/4915816
ttttctt

SEQ ID NO: 145010 - DNA, 7 bp, Unknown
  misc_feature (1)..( 7): Result.003 file - promoters60/4915816
ttttctt

SEQ ID NO: 145011 - DNA, 6 bp, Unknown
  misc_feature (1)..( 6): Result.003 file - promoters60/4915816
aatgga

SEQ ID NO: 145012 - DNA, 6 bp, Unknown
  misc_feature (1)..( 6): Result.003 file - promoters60/4915816
aatgga

SEQ ID NO: 145013 - DNA, 6 bp, Unknown
  misc_feature (1)..( 6): Result.003 file - promoters60/4915816
aatatt

SEQ ID NO: 145014 - DNA, 6 bp, Unknown
  misc_feature (1)..( 6): Result.003 file - promoters60/4915816
aatatt

SEQ ID NO: 145015 - DNA, 8 bp, Unknown
  misc_feature (1)..( 8): Result.003 file - promoters60/4915816
gaaattag

SEQ ID NO: 145016 - DNA, 8 bp, Unknown
  misc_feature (1)..( 8): Result.003 file - promoters60/4915816
gaatttag

SEQ ID NO: 145017 - DNA, 6 bp, Unknown
  misc_feature (1)..( 6): Result.003 file - promoters60/4915816
aaaaat

SEQ ID NO: 145018 - DNA, 6 bp, Unknown
  misc_feature (1)..( 6): Result.003 file - promoters60/4915816
aaaaat

SEQ ID NO: 145019 - DNA, 6 bp, Unknown
  misc_feature (1)..( 6): Result.003 file - promoters60/4915816
aaatag

SEQ ID NO: 145020 - DNA, 6 bp, Unknown
  misc_feature (1)..( 6): Result.003 file - promoters60/4915816
aaatag

SEQ ID NO: 145021 - DNA, 6 bp, Unknown
  misc_feature (1)..( 6): Result.003 file - promoters60/4915816
atttta

SEQ ID NO: 145022 - DNA, 6 bp, Unknown
  misc_feature (1)..( 6): Result.003 file - promoters60/4915816
atttta

SEQ ID NO: 145023 - DNA, 12 bp, Unknown
  misc_feature (1)..( 12): Result.003 file - promoters60/4915819
aaagaaaaaatt

SEQ ID NO: 145024 - DNA, 12 bp, Unknown
  misc_feature (1)..( 12): Result.003 file - promoters60/4915819
aaataaaacatt

SEQ ID NO: 145025 - DNA, 12 bp, Unknown
  misc_feature (1)..( 12): Result.003 file - promoters60/4915819
aaatttaagata

SEQ ID NO: 145026 - DNA, 12 bp, Unknown
  misc_feature (1)..( 12): Result.003 file - promoters60/4915819
gtgtaaaacgtt

SEQ ID NO: 145027 - DNA, 14 bp, Unknown
  misc_feature (1)..( 14): Result.003 file - promoters60/4915819
aaaccaaacatgtt

SEQ ID NO: 145028 - DNA, 14 bp, Unknown
  misc_feature (1)..( 14): Result.003 file - promoters60/4915819
aaactaaagatgac

SEQ ID NO: 145029 - DNA, 14 bp, Unknown
  misc_feature (1)..( 14): Result.003 file - promoters60/4915819
agagaatacaagtt

SEQ ID NO: 145030 - DNA, 14 bp, Unknown
  misc_feature (1)..( 14): Result.003 file - promoters60/4915819
caataaaagccaac

SEQ ID NO: 145031 - DNA, 8 bp, Unknown
  misc_feature (1)..( 8): Result.003 file - promoters60/4915819
aatcaaac

SEQ ID NO: 145032 - DNA, 8 bp, Unknown
  misc_feature (1)..( 8): Result.003 file - promoters60/4915819
aataaaag

SEQ ID NO: 145033 - DNA, 8 bp, Unknown
  misc_feature (1)..( 8): Result.003 file - promoters60/4915819
aataaaat

SEQ ID NO: 145034 - DNA, 8 bp, Unknown
  misc_feature (1)..( 8): Result.003 file - promoters60/4915819
aatacaag

SEQ ID NO: 145035 - DNA, 10 bp, Unknown
  misc_feature (1)..( 10): Result.003 file - promoters60/4921122
aaatacgata

SEQ ID NO: 145036 - DNA, 10 bp, Unknown
  misc_feature (1)..( 10): Result.003 file - promoters60/4921122
aaatacaata

SEQ ID NO: 145037 - DNA, 10 bp, Unknown
  misc_feature (1)..( 10): Result.003 file - promoters60/4921122
aaacacatga

SEQ ID NO: 145038 - DNA, 8 bp, Unknown
  misc_feature (1)..( 8): Result.003 file - promoters60/4921122
cacgaggc

SEQ ID NO: 145039 - DNA, 8 bp, Unknown
  misc_feature (1)..( 8): Result.003 file - promoters60/4921122
cacaaggc

SEQ ID NO: 145040 - DNA, 8 bp, Unknown
  misc_feature (1)..( 8): Result.003 file - promoters60/4921122
cacaagaa

SEQ ID NO: 145041 - DNA, 6 bp, Unknown
  misc_feature (1)..( 6): Result.003 file - promoters60/4921291
acattt

SEQ ID NO: 145042 - DNA, 6 bp, Unknown
  misc_feature (1)..( 6): Result.003 file - promoters60/4921291
acattt

SEQ ID NO: 145043 - DNA, 11 bp, Unknown
  misc_feature (1)..( 11): Result.003 file - promoters60/4921291
tcctttatgtc

SEQ ID NO: 145044 - DNA, 11 bp, Unknown
  misc_feature (1)..( 11): Result.003 file - promoters60/4921291
tctgatatgtc

SEQ ID NO: 145045 - DNA, 11 bp, Unknown
  misc_feature (1)..( 11): Result.003 file - promoters60/4921291
tccgttatgta

SEQ ID NO: 145046 - DNA, 7 bp, Unknown
  misc_feature (1)..( 7): Result.003 file - promoters60/4921291
acaataa

SEQ ID NO: 145047 - DNA, 7 bp, Unknown
  misc_feature (1)..( 7): Result.003 file - promoters60/4921291
acattaa

SEQ ID NO: 145048 - DNA, 7 bp, Unknown
  misc_feature (1)..( 7): Result.003 file - promoters60/4921291
aatttag

SEQ ID NO: 145049 - DNA, 7 bp, Unknown
  misc_feature (1)..( 7): Result.003 file - promoters60/4921291
aatgtag

SEQ ID NO: 145050 - DNA, 6 bp, Unknown
  misc_feature (1)..( 6): Result.003 file - promoters60/4921291
tctgaa

SEQ ID NO: 145051 - DNA, 6 bp, Unknown
  misc_feature (1)..( 6): Result.003 file - promoters60/4921291
tctgaa

SEQ ID NO: 145052 - DNA, 7 bp, Unknown
  misc_feature (1)..( 7): Result.003 file - promoters60/4921291
atattta

SEQ ID NO: 145053 - DNA, 7 bp, Unknown
  misc_feature (1)..( 7): Result.003 file - promoters60/4921291
ataatta

SEQ ID NO: 145054 - DNA, 7 bp, Unknown
  misc_feature (1)..( 7): Result.003 file - promoters60/4921291
caaaatt

SEQ ID NO: 145055 - DNA, 7 bp, Unknown
  misc_feature (1)..( 7): Result.003 file - promoters60/4921291
caagatt

SEQ ID NO: 145056 - DNA, 7 bp, Unknown
  misc_feature (1)..( 7): Result.003 file - promoters60/4921291
ttcataa

SEQ ID NO: 145057 - DNA, 7 bp, Unknown
  misc_feature (1)..( 7): Result.003 file - promoters60/4921291
ttcataa

SEQ ID NO: 145058 - DNA, 8 bp, Unknown
  misc_feature (1)..( 8): Result.003 file - promoters60/4921291
ttttcctt

SEQ ID NO: 145059 - DNA, 8 bp, Unknown
  misc_feature (1)..( 8): Result.003 file - promoters60/4921291
ttttactt

SEQ ID NO: 145060 - DNA, 7 bp, Unknown
  misc_feature (1)..( 7): Result.003 file - promoters60/4921291
acgcact

SEQ ID NO: 145061 - DNA, 7 bp, Unknown
  misc_feature (1)..( 7): Result.003 file - promoters60/4921291
acgaact

SEQ ID NO: 145062 - DNA, 7 bp, Unknown
  misc_feature (1)..( 7): Result.003 file - promoters60/4921291
tatctcg

SEQ ID NO: 145063 - DNA, 7 bp, Unknown
  misc_feature (1)..( 7): Result.003 file - promoters60/4921291
tatgtcg

SEQ ID NO: 145064 - DNA, 8 bp, Unknown
  misc_feature (1)..( 8): Result.003 file - promoters60/4921291
attttcac

SEQ ID NO: 145065 - DNA, 8 bp, Unknown
  misc_feature (1)..( 8): Result.003 file - promoters60/4921291
atttgcac

SEQ ID NO: 145066 - DNA, 7 bp, Unknown
  misc_feature (1)..( 7): Result.003 file - promoters60/4921291
ttaatat

SEQ ID NO: 145067 - DNA, 7 bp, Unknown
  misc_feature (1)..( 7): Result.003 file - promoters60/4921291
ttaatat

SEQ ID NO: 145068 - DNA, 6 bp, Unknown
  misc_feature (1)..( 6): Result.003 file - promoters60/4921291
aatata

SEQ ID NO: 145069 - DNA, 6 bp, Unknown
  misc_feature (1)..( 6): Result.003 file - promoters60/4921291
aatata

SEQ ID NO: 145070 - DNA, 7 bp, Unknown
  misc_feature (1)..( 7): Result.003 file - promoters60/4921291
tgactaa

SEQ ID NO: 145071 - DNA, 7 bp, Unknown
  misc_feature (1)..( 7): Result.003 file - promoters60/4921291
tgattaa

SEQ ID NO: 145072 - DNA, 6 bp, Unknown
  misc_feature (1)..( 6): Result.003 file - promoters60/4921291
atttat

SEQ ID NO: 145073 - DNA, 6 bp, Unknown
  misc_feature (1)..( 6): Result.003 file - promoters60/4921291
atttat

SEQ ID NO: 145074 - DNA, 7 bp, Unknown
  misc_feature (1)..( 7): Result.003 file - promoters60/4921291
tttattt

SEQ ID NO: 145075 - DNA, 7 bp, Unknown
  misc_feature (1)..( 7): Result.003 file - promoters60/4921291
tttgttt

SEQ ID NO: 145076 - DNA, 8 bp, Unknown
  misc_feature (1)..( 8): Result.003 file - promoters60/4921291
taagtata

SEQ ID NO: 145077 - DNA, 8 bp, Unknown
  misc_feature (1)..( 8): Result.003 file - promoters60/4921291
taaatata

SEQ ID NO: 145078 - DNA, 7 bp, Unknown
  misc_feature (1)..( 7): Result.003 file - promoters60/4921373
atgctta

SEQ ID NO: 145079 - DNA, 7 bp, Unknown
  misc_feature (1)..( 7): Result.003 file - promoters60/4921373
atgatta

SEQ ID NO: 145080 - DNA, 6 bp, Unknown
  misc_feature (1)..( 6): Result.003 file - promoters60/4921373
attaca

SEQ ID NO: 145081 - DNA, 6 bp, Unknown
  misc_feature (1)..( 6): Result.003 file - promoters60/4921373
attaca

SEQ ID NO: 145082 - DNA, 7 bp, Unknown
  misc_feature (1)..( 7): Result.003 file - promoters60/4921373
aattata

SEQ ID NO: 145083 - DNA, 7 bp, Unknown
  misc_feature (1)..( 7): Result.003 file - promoters60/4921373
gattata

SEQ ID NO: 145084 - DNA, 7 bp, Unknown
  misc_feature (1)..( 7): Result.003 file - promoters60/4921373
aataata

SEQ ID NO: 145085 - DNA, 8 bp, Unknown
  misc_feature (1)..( 8): Result.003 file - promoters60/4921373
aaagctta

SEQ ID NO: 145086 - DNA, 8 bp, Unknown
  misc_feature (1)..( 8): Result.003 file - promoters60/4921373
aaagatta

SEQ ID NO: 145087 - DNA, 7 bp, Unknown
  misc_feature (1)..( 7): Result.003 file - promoters60/4921373
aaaagtg

SEQ ID NO: 145088 - DNA, 7 bp, Unknown
  misc_feature (1)..( 7): Result.003 file - promoters60/4921373
aaacgtg

SEQ ID NO: 145089 - DNA, 7 bp, Unknown
  misc_feature (1)..( 7): Result.003 file - promoters60/4921373
tttcatt

SEQ ID NO: 145090 - DNA, 7 bp, Unknown
  misc_feature (1)..( 7): Result.003 file - promoters60/4921373
ttttatt

SEQ ID NO: 145091 - DNA, 6 bp, Unknown
  misc_feature (1)..( 6): Result.003 file - promoters60/4921373
ttcaaa

SEQ ID NO: 145092 - DNA, 6 bp, Unknown
  misc_feature (1)..( 6): Result.003 file - promoters60/4921373
ttcaaa

SEQ ID NO: 145093 - DNA, 9 bp, Unknown
  misc_feature (1)..( 9): Result.003 file - promoters60/4921373
ctataaata

SEQ ID NO: 145094 - DNA, 9 bp, Unknown
  misc_feature (1)..( 9): Result.003 file - promoters60/4921373
ctataaata

SEQ ID NO: 145095 - DNA, 9 bp, Unknown
  misc_feature (1)..( 9): Result.003 file - promoters60/4921373
ctataaaac

SEQ ID NO: 145096 - DNA, 6 bp, Unknown
  misc_feature (1)..( 6): Result.003 file - promoters60/4921373
agtata

SEQ ID NO: 145097 - DNA, 6 bp, Unknown
  misc_feature (1)..( 6): Result.003 file - promoters60/4921373
agtata

SEQ ID NO: 145098 - DNA, 8 bp, Unknown
  misc_feature (1)..( 8): Result.003 file - promoters60/4921373
agttaatt

SEQ ID NO: 145099 - DNA, 8 bp, Unknown
  misc_feature (1)..( 8): Result.003 file - promoters60/4921373
agttgatt

SEQ ID NO: 145100 - DNA, 6 bp, Unknown
  misc_feature (1)..( 6): Result.003 file - promoters60/4921373
taaaag

SEQ ID NO: 145101 - DNA, 6 bp, Unknown
  misc_feature (1)..( 6): Result.003 file - promoters60/4921373
taaaag

SEQ ID NO: 145102 - DNA, 8 bp, Unknown
  misc_feature (1)..( 8): Result.003 file - promoters60/4921373
atgaattt

SEQ ID NO: 145103 - DNA, 8 bp, Unknown
  misc_feature (1)..( 8): Result.003 file - promoters60/4921373
atgacttt

SEQ ID NO: 145104 - DNA, 7 bp, Unknown
  misc_feature (1)..( 7): Result.003 file - promoters60/4921373
tttatgt

SEQ ID NO: 145105 - DNA, 7 bp, Unknown
  misc_feature (1)..( 7): Result.003 file - promoters60/4921373
tttatgt

SEQ ID NO: 145106 - DNA, 6 bp, Unknown
  misc_feature (1)..( 6): Result.003 file - promoters60/4921373
tatatt

SEQ ID NO: 145107 - DNA, 6 bp, Unknown
  misc_feature (1)..( 6): Result.003 file - promoters60/4921373
tatatt

SEQ ID NO: 145108 - DNA, 6 bp, Unknown
  misc_feature (1)..( 6): Result.003 file - promoters60/4921373
tctaaa

SEQ ID NO: 145109 - DNA, 6 bp, Unknown
  misc_feature (1)..( 6): Result.003 file - promoters60/4921373
tctaaa

SEQ ID NO: 145110 - DNA, 10 bp, Unknown
  misc_feature (1)..( 10): Result.003 file - promoters60/4921381
aaaaattgaa

SEQ ID NO: 145111 - DNA, 10 bp, Unknown
  misc_feature (1)..( 10): Result.003 file - promoters60/4921381
aaatatttta

SEQ ID NO: 145112 - DNA, 10 bp, Unknown
  misc_feature (1)..( 10): Result.003 file - promoters60/4921381
tcaaattgaa

SEQ ID NO: 145113 - DNA, 10 bp, Unknown
  misc_feature (1)..( 10): Result.003 file - promoters60/4921381
aaatatcaga

SEQ ID NO: 145114 - DNA, 8 bp, Unknown
  misc_feature (1)..( 8): Result.003 file - promoters60/4921433
cagatttt

SEQ ID NO: 145115 - DNA, 8 bp, Unknown
  misc_feature (1)..( 8): Result.003 file - promoters60/4921433
cagattac

SEQ ID NO: 145116 - DNA, 8 bp, Unknown
  misc_feature (1)..( 8): Result.003 file - promoters60/4921433
aagatttt

SEQ ID NO: 145117 - DNA, 8 bp, Unknown
  misc_feature (1)..( 8): Result.003 file - promoters60/4921433
cagattga

SEQ ID NO: 145118 - DNA, 9 bp, Unknown
  misc_feature (1)..( 9): Result.003 file - promoters60/4921433
aaattgaaa

SEQ ID NO: 145119 - DNA, 9 bp, Unknown
  misc_feature (1)..( 9): Result.003 file - promoters60/4921433
gaatttaaa

SEQ ID NO: 145120 - DNA, 9 bp, Unknown
  misc_feature (1)..( 9): Result.003 file - promoters60/4921433
gaattttgg

SEQ ID NO: 145121 - DNA, 9 bp, Unknown
  misc_feature (1)..( 9): Result.003 file - promoters60/4921433
ggttttaag

SEQ ID NO: 145122 - DNA, 13 bp, Unknown
  misc_feature (1)..( 13): Result.003 file - promoters60/4921433
atggagaggaaga

SEQ ID NO: 145123 - DNA, 13 bp, Unknown
  misc_feature (1)..( 13): Result.003 file - promoters60/4921433
gcacagatgaatt

SEQ ID NO: 145124 - DNA, 13 bp, Unknown
  misc_feature (1)..( 13): Result.003 file - promoters60/4921433
atgtagaggggct

SEQ ID NO: 145125 - DNA, 13 bp, Unknown
  misc_feature (1)..( 13): Result.003 file - promoters60/4921433
ttaaggataaatt

SEQ ID NO: 145126 - DNA, 13 bp, Unknown
  misc_feature (1)..( 13): Result.003 file - promoters60/4921433
gaagtcatgaata

SEQ ID NO: 145127 - DNA, 12 bp, Unknown
  misc_feature (1)..( 12): Result.003 file - promoters60/4921433
aaaaaaaataac

SEQ ID NO: 145128 - DNA, 12 bp, Unknown
  misc_feature (1)..( 12): Result.003 file - promoters60/4921433
gtgaaaaatcgt

SEQ ID NO: 145129 - DNA, 12 bp, Unknown
  misc_feature (1)..( 12): Result.003 file - promoters60/4921433
ggtcaaaataat

SEQ ID NO: 145130 - DNA, 12 bp, Unknown
  misc_feature (1)..( 12): Result.003 file - promoters60/4921433
ggtcaagataca

SEQ ID NO: 145131 - DNA, 8 bp, Unknown
  misc_feature (1)..( 8): Result.003 file - promoters60/4934904
gagctctc

SEQ ID NO: 145132 - DNA, 8 bp, Unknown
  misc_feature (1)..( 8): Result.003 file - promoters60/4934904
cagctctc

SEQ ID NO: 145133 - DNA, 8 bp, Unknown
  misc_feature (1)..( 8): Result.003 file - promoters60/4934904
gagctccg

SEQ ID NO: 145134 - DNA, 8 bp, Unknown
  misc_feature (1)..( 8): Result.003 file - promoters60/4934904
acagctct

SEQ ID NO: 145135 - DNA, 8 bp, Unknown
  misc_feature (1)..( 8): Result.003 file - promoters60/4934904
acatctca

SEQ ID NO: 145136 - DNA, 8 bp, Unknown
  misc_feature (1)..( 8): Result.003 file - promoters60/4934904
gtatctca

SEQ ID NO: 145137 - DNA, 13 bp, Unknown
  misc_feature (1)..( 13): Result.003 file - promoters60/4934904
tctggggaatcgg

SEQ ID NO: 145138 - DNA, 13 bp, Unknown
  misc_feature (1)..( 13): Result.003 file - promoters60/4934904
tctgggaaatcgg

SEQ ID NO: 145139 - DNA, 13 bp, Unknown
  misc_feature (1)..( 13): Result.003 file - promoters60/4934904
atgcggaaattaa

SEQ ID NO: 145140 - DNA, 6 bp, Unknown
  misc_feature (1)..( 6): Result.003 file - promoters60/4934904
tttcaa

SEQ ID NO: 145141 - DNA, 6 bp, Unknown
  misc_feature (1)..( 6): Result.003 file - promoters60/4934904
tttcaa

SEQ ID NO: 145142 - DNA, 6 bp, Unknown
  misc_feature (1)..( 6): Result.003 file - promoters60/4934904
tttcaa

SEQ ID NO: 145143 - DNA, 6 bp, Unknown
  misc_feature (1)..( 6): Result.003 file - promoters60/4934904
ggaaat

SEQ ID NO: 145144 - DNA, 6 bp, Unknown
  misc_feature (1)..( 6): Result.003 file - promoters60/4934904
ggaaat

SEQ ID NO: 145145 - DNA, 6 bp, Unknown
  misc_feature (1)..( 6): Result.003 file - promoters60/4934904
ggaaat

SEQ ID NO: 145146 - DNA, 9 bp, Unknown
  misc_feature (1)..( 9): Result.003 file - promoters60/4938731
aattaaaaa

SEQ ID NO: 145147 - DNA, 9 bp, Unknown
  misc_feature (1)..( 9): Result.003 file - promoters60/4938731
cattaaagc

SEQ ID NO: 145148 - DNA, 9 bp, Unknown
  misc_feature (1)..( 9): Result.003 file - promoters60/4938731
ttttaaaaa

SEQ ID NO: 145149 - DNA, 9 bp, Unknown
  misc_feature (1)..( 9): Result.003 file - promoters60/4938731
atttaaacc

SEQ ID NO: 145150 - DNA, 9 bp, Unknown
  misc_feature (1)..( 9): Result.003 file - promoters60/4938731
cgttaaagc

SEQ ID NO: 145151 - DNA, 9 bp, Unknown
  misc_feature (1)..( 9): Result.003 file - promoters60/4938731
taataaatc

SEQ ID NO: 145152 - DNA, 10 bp, Unknown
  misc_feature (1)..( 10): Result.003 file - promoters60/4938731
ctatatataa

SEQ ID NO: 145153 - DNA, 10 bp, Unknown
  misc_feature (1)..( 10): Result.003 file - promoters60/4938731
ttataaatat

SEQ ID NO: 145154 - DNA, 10 bp, Unknown
  misc_feature (1)..( 10): Result.003 file - promoters60/4938731
atataataca

SEQ ID NO: 145155 - DNA, 10 bp, Unknown
  misc_feature (1)..( 10): Result.003 file - promoters60/4938731
ttataaataa

SEQ ID NO: 145156 - DNA, 10 bp, Unknown
  misc_feature (1)..( 10): Result.003 file - promoters60/4938731
ttaaaaaagc

SEQ ID NO: 145157 - DNA, 10 bp, Unknown
  misc_feature (1)..( 10): Result.003 file - promoters60/4938731
gtataaataa

SEQ ID NO: 145158 - DNA, 10 bp, Unknown
  misc_feature (1)..( 10): Result.003 file - promoters60/4938731
atataaatag

SEQ ID NO: 145159 - DNA, 16 bp, Unknown
  misc_feature (1)..( 16): Result.003 file - promoters60/4938731
ttctatttctatgtgt

SEQ ID NO: 145160 - DNA, 16 bp, Unknown
  misc_feature (1)..( 16): Result.003 file - promoters60/4938731
aaacctttttataatc

SEQ ID NO: 145161 - DNA, 16 bp, Unknown
  misc_feature (1)..( 16): Result.003 file - promoters60/4938731
acagctttctatgtct

SEQ ID NO: 145162 - DNA, 16 bp, Unknown
  misc_feature (1)..( 16): Result.003 file - promoters60/4938731
cattatttcttaaatt

SEQ ID NO: 145163 - DNA, 16 bp, Unknown
  misc_feature (1)..( 16): Result.003 file - promoters60/4938731
tgttatttgagttatg

SEQ ID NO: 145164 - DNA, 16 bp, Unknown
  misc_feature (1)..( 16): Result.003 file - promoters60/4938731
cataattttgcacgtg

SEQ ID NO: 145165 - DNA, 12 bp, Unknown
  misc_feature (1)..( 12): Result.003 file - promoters60/4938731
cgattcatcttc

SEQ ID NO: 145166 - DNA, 12 bp, Unknown
  misc_feature (1)..( 12): Result.003 file - promoters60/4938731
tttttcttcttc

SEQ ID NO: 145167 - DNA, 12 bp, Unknown
  misc_feature (1)..( 12): Result.003 file - promoters60/4938731
tgatttatccta

SEQ ID NO: 145168 - DNA, 12 bp, Unknown
  misc_feature (1)..( 12): Result.003 file - promoters60/4938731
ctatttatttcc

SEQ ID NO: 145169 - DNA, 12 bp, Unknown
  misc_feature (1)..( 12): Result.003 file - promoters60/4938731
tgagttatgtga

SEQ ID NO: 145170 - DNA, 12 bp, Unknown
  misc_feature (1)..( 12): Result.003 file - promoters60/4938731
cattatttctta

SEQ ID NO: 145171 - DNA, 6 bp, Unknown
  misc_feature (1)..( 6): Result.003 file - promoters60/4943425
taaaag

SEQ ID NO: 145172 - DNA, 6 bp, Unknown
  misc_feature (1)..( 6): Result.003 file - promoters60/4943425
taaaag

SEQ ID NO: 145173 - DNA, 8 bp, Unknown
  misc_feature (1)..( 8): Result.003 file - promoters60/4943425
ctgtcaaa

SEQ ID NO: 145174 - DNA, 8 bp, Unknown
  misc_feature (1)..( 8): Result.003 file - promoters60/4943425
ctgtaaaa

SEQ ID NO: 145175 - DNA, 6 bp, Unknown
  misc_feature (1)..( 6): Result.003 file - promoters60/4943425
ggtggt

SEQ ID NO: 145176 - DNA, 6 bp, Unknown
  misc_feature (1)..( 6): Result.003 file - promoters60/4943425
ggtggt

SEQ ID NO: 145177 - DNA, 6 bp, Unknown
  misc_feature (1)..( 6): Result.003 file - promoters60/4943425
ttgagt

SEQ ID NO: 145178 - DNA, 6 bp, Unknown
  misc_feature (1)..( 6): Result.003 file - promoters60/4943425
ttgagt

SEQ ID NO: 145179 - DNA, 7 bp, Unknown
  misc_feature (1)..( 7): Result.003 file - promoters60/4943425
ttttatt

SEQ ID NO: 145180 - DNA, 7 bp, Unknown
  misc_feature (1)..( 7): Result.003 file - promoters60/4943425
tttgatt

SEQ ID NO: 145181 - DNA, 6 bp, Unknown
  misc_feature (1)..( 6): Result.003 file - promoters60/4943425
tcaaaa

SEQ ID NO: 145182 - DNA, 6 bp, Unknown
  misc_feature (1)..( 6): Result.003 file - promoters60/4943425
tcaaaa

SEQ ID NO: 145183 - DNA, 8 bp, Unknown
  misc_feature (1)..( 8): Result.003 file - promoters60/4943425
ctctcgtt

SEQ ID NO: 145184 - DNA, 8 bp, Unknown
  misc_feature (1)..( 8): Result.003 file - promoters60/4943425
ctcttgtt

SEQ ID NO: 145185 - DNA, 7 bp, Unknown
  misc_feature (1)..( 7): Result.003 file - promoters60/4943425
atggtaa

SEQ ID NO: 145186 - DNA, 7 bp, Unknown
  misc_feature (1)..( 7): Result.003 file - promoters60/4943425
atgataa

SEQ ID NO: 145187 - DNA, 7 bp, Unknown
  misc_feature (1)..( 7): Result.003 file - promoters60/4943425
aacctgt

SEQ ID NO: 145188 - DNA, 7 bp, Unknown
  misc_feature (1)..( 7): Result.003 file - promoters60/4943425
aacttgt

SEQ ID NO: 145189 - DNA, 8 bp, Unknown
  misc_feature (1)..( 8): Result.003 file - promoters60/4943425
ttggatat

SEQ ID NO: 145190 - DNA, 8 bp, Unknown
  misc_feature (1)..( 8): Result.003 file - promoters60/4943425
ttgcatat

SEQ ID NO: 145191 - DNA, 8 bp, Unknown
  misc_feature (1)..( 8): Result.003 file - promoters60/4943425
tgttatgc

SEQ ID NO: 145192 - DNA, 8 bp, Unknown
  misc_feature (1)..( 8): Result.003 file - promoters60/4943425
tgttttgc

SEQ ID NO: 145193 - DNA, 7 bp, Unknown
  misc_feature (1)..( 7): Result.003 file - promoters60/4943425
ttgctaa

SEQ ID NO: 145194 - DNA, 7 bp, Unknown
  misc_feature (1)..( 7): Result.003 file - promoters60/4943425
ttgttaa

SEQ ID NO: 145195 - DNA, 6 bp, Unknown
  misc_feature (1)..( 6): Result.003 file - promoters60/4943425
ttcctt

SEQ ID NO: 145196 - DNA, 6 bp, Unknown
  misc_feature (1)..( 6): Result.003 file - promoters60/4943425
ttcctt

SEQ ID NO: 145197 - DNA, 6 bp, Unknown
  misc_feature (1)..( 6): Result.003 file - promoters60/4943425
aagaga

SEQ ID NO: 145198 - DNA, 6 bp, Unknown
  misc_feature (1)..( 6): Result.003 file - promoters60/4943425
aagaga

SEQ ID NO: 145199 - DNA, 7 bp, Unknown
  misc_feature (1)..( 7): Result.003 file - promoters60/4943425
aaggaag

SEQ ID NO: 145200 - DNA, 7 bp, Unknown
  misc_feature (1)..( 7): Result.003 file - promoters60/4943425
aagaaag

SEQ ID NO: 145201 - DNA, 12 bp, Unknown
  misc_feature (1)..( 12): Result.003 file - promoters60/4943637
tcggtttaaaag

SEQ ID NO: 145202 - DNA, 12 bp, Unknown
  misc_feature (1)..( 12): Result.003 file - promoters60/4943637
aatgtttgaaac

SEQ ID NO: 145203 - DNA, 12 bp, Unknown
  misc_feature (1)..( 12): Result.003 file - promoters60/4943637
ttggtctaaata

SEQ ID NO: 145204 - DNA, 12 bp, Unknown
  misc_feature (1)..( 12): Result.003 file - promoters60/4943637
ttagtttgttct

SEQ ID NO: 145205 - DNA, 8 bp, Unknown
  misc_feature (1)..( 8): Result.003 file - promoters60/4943637
tgagaaag

SEQ ID NO: 145206 - DNA, 8 bp, Unknown
  misc_feature (1)..( 8): Result.003 file - promoters60/4943637
aaagaaag

SEQ ID NO: 145207 - DNA, 8 bp, Unknown
  misc_feature (1)..( 8): Result.003 file - promoters60/4943637
tgagaaaa

SEQ ID NO: 145208 - DNA, 10 bp, Unknown
  misc_feature (1)..( 10): Result.003 file - promoters60/4943637
ggtctggtct

SEQ ID NO: 145209 - DNA, 12 bp, Unknown
  misc_feature (1)..( 12): Result.003 file - promoters60/4943637
ttagtttggtct

SEQ ID NO: 145210 - DNA, 12 bp, Unknown
  misc_feature (1)..( 12): Result.003 file - promoters60/4943637
ttagtttgttct

SEQ ID NO: 145211 - DNA, 7 bp, Unknown
  misc_feature (1)..( 7): Result.003 file - promoters60/4943637
tattttt

SEQ ID NO: 145212 - DNA, 7 bp, Unknown
  misc_feature (1)..( 7): Result.003 file - promoters60/4943637
tattttg

SEQ ID NO: 145213 - DNA, 7 bp, Unknown
  misc_feature (1)..( 7): Result.003 file - promoters60/4943637
aattttt

SEQ ID NO: 145214 - DNA, 12 bp, Unknown
  misc_feature (1)..( 12): Result.003 file - promoters60/4943637
gaggtttgtacc

SEQ ID NO: 145215 - DNA, 12 bp, Unknown
  misc_feature (1)..( 12): Result.003 file - promoters60/4943637
ttagtttgttct

SEQ ID NO: 145216 - DNA, 12 bp, Unknown
  misc_feature (1)..( 12): Result.003 file - promoters60/4943637
ttagtttggtct

SEQ ID NO: 145217 - DNA, 10 bp, Unknown
  misc_feature (1)..( 10): Result.003 file - promoters60/4943637
taaatttgct

SEQ ID NO: 145218 - DNA, 10 bp, Unknown
  misc_feature (1)..( 10): Result.003 file - promoters60/4943637
taaatttaaa

SEQ ID NO: 145219 - DNA, 10 bp, Unknown
  misc_feature (1)..( 10): Result.003 file - promoters60/4943637
tgaatctgct

SEQ ID NO: 145220 - DNA, 11 bp, Unknown
  misc_feature (1)..( 11): Result.003 file - promoters60/4949707
attaaaataag

SEQ ID NO: 145221 - DNA, 11 bp, Unknown
  misc_feature (1)..( 11): Result.003 file - promoters60/4949707
attaaaaaaat

SEQ ID NO: 145222 - DNA, 11 bp, Unknown
  misc_feature (1)..( 11): Result.003 file - promoters60/4949707
tctaaaatctt

SEQ ID NO: 145223 - DNA, 11 bp, Unknown
  misc_feature (1)..( 11): Result.003 file - promoters60/4949707
actaaaatatc

SEQ ID NO: 145224 - DNA, 12 bp, Unknown
  misc_feature (1)..( 12): Result.003 file - promoters60/4949707
tttagaaaagtc

SEQ ID NO: 145225 - DNA, 12 bp, Unknown
  misc_feature (1)..( 12): Result.003 file - promoters60/4949707
agaagaaactct

SEQ ID NO: 145226 - DNA, 11 bp, Unknown
  misc_feature (1)..( 11): Result.003 file - promoters60/4949707
taagaatagtg

SEQ ID NO: 145227 - DNA, 11 bp, Unknown
  misc_feature (1)..( 11): Result.003 file - promoters60/4949707
ttagaaaagtc

SEQ ID NO: 145228 - DNA, 11 bp, Unknown
  misc_feature (1)..( 11): Result.003 file - promoters60/4949707
ttaaaaaaatg

SEQ ID NO: 145229 - DNA, 11 bp, Unknown
  misc_feature (1)..( 11): Result.003 file - promoters60/4949707
ctaaaatcttc

SEQ ID NO: 145230 - DNA, 11 bp, Unknown
  misc_feature (1)..( 11): Result.003 file - promoters60/4949707
catcaatcttt

SEQ ID NO: 145231 - DNA, 11 bp, Unknown
  misc_feature (1)..( 11): Result.003 file - promoters60/4949707
gaagaaactct

SEQ ID NO: 145232 - DNA, 11 bp, Unknown
  misc_feature (1)..( 11): Result.003 file - promoters60/4952527
tcgtgaagcct

SEQ ID NO: 145233 - DNA, 11 bp, Unknown
  misc_feature (1)..( 11): Result.003 file - promoters60/4952527
caatgaaacct

SEQ ID NO: 145234 - DNA, 11 bp, Unknown
  misc_feature (1)..( 11): Result.003 file - promoters60/4952527
actggaaacct

SEQ ID NO: 145235 - DNA, 11 bp, Unknown
  misc_feature (1)..( 11): Result.003 file - promoters60/4952527
caatcaaataa

SEQ ID NO: 145236 - DNA, 6 bp, Unknown
  misc_feature (1)..( 6): Result.003 file - promoters60/4974495
ctaatt

SEQ ID NO: 145237 - DNA, 6 bp, Unknown
  misc_feature (1)..( 6): Result.003 file - promoters60/4974495
ctaatt

SEQ ID NO: 145238 - DNA, 7 bp, Unknown
  misc_feature (1)..( 7): Result.003 file - promoters60/4974495
gaatcag

SEQ ID NO: 145239 - DNA, 7 bp, Unknown
  misc_feature (1)..( 7): Result.003 file - promoters60/4974495
gaaacag

SEQ ID NO: 145240 - DNA, 6 bp, Unknown
  misc_feature (1)..( 6): Result.003 file - promoters60/4974495
aagaga

SEQ ID NO: 145241 - DNA, 6 bp, Unknown
  misc_feature (1)..( 6): Result.003 file - promoters60/4974495
aagaga

SEQ ID NO: 145242 - DNA, 6 bp, Unknown
  misc_feature (1)..( 6): Result.003 file - promoters60/4974495
atcata

SEQ ID NO: 145243 - DNA, 6 bp, Unknown
  misc_feature (1)..( 6): Result.003 file - promoters60/4974495
atcata

SEQ ID NO: 145244 - DNA, 7 bp, Unknown
  misc_feature (1)..( 7): Result.003 file - promoters60/4974495
tgtgttt

SEQ ID NO: 145245 - DNA, 7 bp, Unknown
  misc_feature (1)..( 7): Result.003 file - promoters60/4974495
tgtgttt

SEQ ID NO: 145246 - DNA, 11 bp, Unknown
  misc_feature (1)..( 11): Result.003 file - promoters60/4974495
cgaggaagcag

SEQ ID NO: 145247 - DNA, 11 bp, Unknown
  misc_feature (1)..( 11): Result.003 file - promoters60/4974495
ttaggatgcag

SEQ ID NO: 145248 - DNA, 11 bp, Unknown
  misc_feature (1)..( 11): Result.003 file - promoters60/4974495
ttaagatttct

SEQ ID NO: 145249 - DNA, 8 bp, Unknown
  misc_feature (1)..( 8): Result.003 file - promoters60/4974495
aatggatg

SEQ ID NO: 145250 - DNA, 8 bp, Unknown
  misc_feature (1)..( 8): Result.003 file - promoters60/4974495
aatgcatg

SEQ ID NO: 145251 - DNA, 7 bp, Unknown
  misc_feature (1)..( 7): Result.003 file - promoters60/4974495
ttgtttg

SEQ ID NO: 145252 - DNA, 7 bp, Unknown
  misc_feature (1)..( 7): Result.003 file - promoters60/4974495
ttggttg

SEQ ID NO: 145253 - DNA, 6 bp, Unknown
  misc_feature (1)..( 6): Result.003 file - promoters60/4974495
gagatg

SEQ ID NO: 145254 - DNA, 6 bp, Unknown
  misc_feature (1)..( 6): Result.003 file - promoters60/4974495
gagatg

SEQ ID NO: 145255 - DNA, 7 bp, Unknown
  misc_feature (1)..( 7): Result.003 file - promoters60/4974495
ttaatta

SEQ ID NO: 145256 - DNA, 7 bp, Unknown
  misc_feature (1)..( 7): Result.003 file - promoters60/4974495
ttattta

SEQ ID NO: 145257 - DNA, 6 bp, Unknown
  misc_feature (1)..( 6): Result.003 file - promoters60/4974495
agttca

SEQ ID NO: 145258 - DNA, 6 bp, Unknown
  misc_feature (1)..( 6): Result.003 file - promoters60/4974495
agttca

SEQ ID NO: 145259 - DNA, 7 bp, Unknown
  misc_feature (1)..( 7): Result.003 file - promoters60/4974495
ggaagaa

SEQ ID NO: 145260 - DNA, 7 bp, Unknown
  misc_feature (1)..( 7): Result.003 file - promoters60/4974495
ggaagaa

SEQ ID NO: 145261 - DNA, 7 bp, Unknown
  misc_feature (1)..( 7): Result.003 file - promoters60/4974495
aataaaa

SEQ ID NO: 145262 - DNA, 7 bp, Unknown
  misc_feature (1)..( 7): Result.003 file - promoters60/4974495
aatcaaa

SEQ ID NO: 145263 - DNA, 6 bp, Unknown
  misc_feature (1)..( 6): Result.003 file - promoters60/4974495
tgcaca

SEQ ID NO: 145264 - DNA, 6 bp, Unknown
  misc_feature (1)..( 6): Result.003 file - promoters60/4974495
tgcaca

SEQ ID NO: 145265 - DNA, 10 bp, Unknown
  misc_feature (1)..( 10): Result.003 file - promoters60/4974495
tttatccaag

SEQ ID NO: 145266 - DNA, 10 bp, Unknown
  misc_feature (1)..( 10): Result.003 file - promoters60/4974495
tttatgcaag

SEQ ID NO: 145267 - DNA, 17 bp, Unknown
  misc_feature (1)..( 17): Result.003 file - promoters60/4978201
ctcacttttatgggccg

SEQ ID NO: 145268 - DNA, 17 bp, Unknown
  misc_feature (1)..( 17): Result.003 file - promoters60/4978201
tggttacaaatgggcct

SEQ ID NO: 145269 - DNA, 17 bp, Unknown
  misc_feature (1)..( 17): Result.003 file - promoters60/4978201
ctcattttaatgggccg

SEQ ID NO: 145270 - DNA, 17 bp, Unknown
  misc_feature (1)..( 17): Result.003 file - promoters60/4978201
atatgtacaatgggctg

SEQ ID NO: 145271 - DNA, 17 bp, Unknown
  misc_feature (1)..( 17): Result.003 file - promoters60/4978201
gaattggaaataggccc

SEQ ID NO: 145272 - DNA, 17 bp, Unknown
  misc_feature (1)..( 17): Result.003 file - promoters60/4978201
gtggaaattattttatt

SEQ ID NO: 145273 - DNA, 17 bp, Unknown
  misc_feature (1)..( 17): Result.003 file - promoters60/4978201
aaattaaaaatgggtct

SEQ ID NO: 145274 - DNA, 10 bp, Unknown
  misc_feature (1)..( 10): Result.003 file - promoters60/4992383
tttcgatgta

SEQ ID NO: 145275 - DNA, 10 bp, Unknown
  misc_feature (1)..( 10): Result.003 file - promoters60/4992383
ttttgatttg

SEQ ID NO: 145276 - DNA, 10 bp, Unknown
  misc_feature (1)..( 10): Result.003 file - promoters60/4992383
ttttgatttg

SEQ ID NO: 145277 - DNA, 10 bp, Unknown
  misc_feature (1)..( 10): Result.003 file - promoters60/4992383
ctttgctttg

SEQ ID NO: 145278 - DNA, 9 bp, Unknown
  misc_feature (1)..( 9): Result.003 file - promoters60/4992383
aatttattt

SEQ ID NO: 145279 - DNA, 9 bp, Unknown
  misc_feature (1)..( 9): Result.003 file - promoters60/4992383
agtttattc

SEQ ID NO: 145280 - DNA, 9 bp, Unknown
  misc_feature (1)..( 9): Result.003 file - promoters60/4992383
aatatattt

SEQ ID NO: 145281 - DNA, 11 bp, Unknown
  misc_feature (1)..( 11): Result.003 file - promoters60/4992383
tacgtaacatg

SEQ ID NO: 145282 - DNA, 11 bp, Unknown
  misc_feature (1)..( 11): Result.003 file - promoters60/4992383
gtattaatatg

SEQ ID NO: 145283 - DNA, 11 bp, Unknown
  misc_feature (1)..( 11): Result.003 file - promoters60/4992383
tacgttacaat

SEQ ID NO: 145284 - DNA, 12 bp, Unknown
  misc_feature (1)..( 12): Result.003 file - promoters60/4992383
ttattttcagta

SEQ ID NO: 145285 - DNA, 12 bp, Unknown
  misc_feature (1)..( 12): Result.003 file - promoters60/4992383
aacttttaagta

SEQ ID NO: 145286 - DNA, 12 bp, Unknown
  misc_feature (1)..( 12): Result.003 file - promoters60/4992383
aacctttatgta

SEQ ID NO: 145287 - DNA, 8 bp, Unknown
  misc_feature (1)..( 8): Result.003 file - promoters60/4992383
tatttcta

SEQ ID NO: 145288 - DNA, 8 bp, Unknown
  misc_feature (1)..( 8): Result.003 file - promoters60/4992383
agtttcta

SEQ ID NO: 145289 - DNA, 8 bp, Unknown
  misc_feature (1)..( 8): Result.003 file - promoters60/4992383
agtatctg

SEQ ID NO: 145290 - DNA, 8 bp, Unknown
  misc_feature (1)..( 8): Result.003 file - promoters60/4992383
cttatttt

SEQ ID NO: 145291 - DNA, 8 bp, Unknown
  misc_feature (1)..( 8): Result.003 file - promoters60/4992383
tttagttt

SEQ ID NO: 145292 - DNA, 8 bp, Unknown
  misc_feature (1)..( 8): Result.003 file - promoters60/4992383
tttagtta

SEQ ID NO: 145293 - DNA, 7 bp, Unknown
  misc_feature (1)..( 7): Result.003 file - promoters60/4992383
aatattt

SEQ ID NO: 145294 - DNA, 7 bp, Unknown
  misc_feature (1)..( 7): Result.003 file - promoters60/4992383
aatgttt

SEQ ID NO: 145295 - DNA, 7 bp, Unknown
  misc_feature (1)..( 7): Result.003 file - promoters60/4992383
aatgttt

SEQ ID NO: 145296 - DNA, 7 bp, Unknown
  misc_feature (1)..( 7): Result.003 file - promoters60/4992383
actttta

SEQ ID NO: 145297 - DNA, 7 bp, Unknown
  misc_feature (1)..( 7): Result.003 file - promoters60/4992383
actttta

SEQ ID NO: 145298 - DNA, 7 bp, Unknown
  misc_feature (1)..( 7): Result.003 file - promoters60/4992383
acttttt

SEQ ID NO: 145299 - DNA, 10 bp, Unknown
  misc_feature (1)..( 10): Result.003 file - promoters60/4992383
caatttatat

SEQ ID NO: 145300 - DNA, 10 bp, Unknown
  misc_feature (1)..( 10): Result.003 file - promoters60/4992383
aaattgatat

SEQ ID NO: 145301 - DNA, 10 bp, Unknown
  misc_feature (1)..( 10): Result.003 file - promoters60/4992383
aaattgttca

SEQ ID NO: 145302 - DNA, 10 bp, Unknown
  misc_feature (1)..( 10): Result.003 file - promoters60/4992383
ataatataaa

SEQ ID NO: 145303 - DNA, 10 bp, Unknown
  misc_feature (1)..( 10): Result.003 file - promoters60/4992383
tttgtataaa

SEQ ID NO: 145304 - DNA, 10 bp, Unknown
  misc_feature (1)..( 10): Result.003 file - promoters60/4992383
tttgtttaag

SEQ ID NO: 145305 - DNA, 8 bp, Unknown
  misc_feature (1)..( 8): Result.003 file - promoters60/4992383
cggtttgg

SEQ ID NO: 145306 - DNA, 8 bp, Unknown
  misc_feature (1)..( 8): Result.003 file - promoters60/4992383
cggtttaa

SEQ ID NO: 145307 - DNA, 8 bp, Unknown
  misc_feature (1)..( 8): Result.003 file - promoters60/4992383
tggtctgg

SEQ ID NO: 145308 - DNA, 8 bp, Unknown
  misc_feature (1)..( 8): Result.003 file - promoters60/4992383
aggttaat

SEQ ID NO: 145309 - DNA, 8 bp, Unknown
  misc_feature (1)..( 8): Result.003 file - promoters60/4992383
tagttaat

SEQ ID NO: 145310 - DNA, 8 bp, Unknown
  misc_feature (1)..( 8): Result.003 file - promoters60/4992383
tagctaaa

SEQ ID NO: 145311 - DNA, 9 bp, Unknown
  misc_feature (1)..( 9): Result.003 file - promoters60/4992383
acataatat

SEQ ID NO: 145312 - DNA, 9 bp, Unknown
  misc_feature (1)..( 9): Result.003 file - promoters60/4992383
tattaatat

SEQ ID NO: 145313 - DNA, 9 bp, Unknown
  misc_feature (1)..( 9): Result.003 file - promoters60/4992383
tattgataa

SEQ ID NO: 145314 - DNA, 9 bp, Unknown
  misc_feature (1)..( 9): Result.003 file - promoters60/4992383
ttttagaaa

SEQ ID NO: 145315 - DNA, 9 bp, Unknown
  misc_feature (1)..( 9): Result.003 file - promoters60/4992383
tttaagact

SEQ ID NO: 145316 - DNA, 9 bp, Unknown
  misc_feature (1)..( 9): Result.003 file - promoters60/4992383
aattacaaa

SEQ ID NO: 145317 - DNA, 11 bp, Unknown
  misc_feature (1)..( 11): Result.003 file - promoters60/4992383
tgttttctttt

SEQ ID NO: 145318 - DNA, 11 bp, Unknown
  misc_feature (1)..( 11): Result.003 file - promoters60/4992383
tgttttgtttt

SEQ ID NO: 145319 - DNA, 11 bp, Unknown
  misc_feature (1)..( 11): Result.003 file - promoters60/4992383
gcttttgattt

SEQ ID NO: 145320 - DNA, 12 bp, Unknown
  misc_feature (1)..( 12): Result.003 file - promoters60/4992383
aaccaactaaca

SEQ ID NO: 145321 - DNA, 12 bp, Unknown
  misc_feature (1)..( 12): Result.003 file - promoters60/4992383
ttttaactaaca

SEQ ID NO: 145322 - DNA, 12 bp, Unknown
  misc_feature (1)..( 12): Result.003 file - promoters60/4992383
ttttcactaatg

SEQ ID NO: 145323 - DNA, 8 bp, Unknown
  misc_feature (1)..( 8): Result.003 file - promoters60/5003710
agaggaat

SEQ ID NO: 145324 - DNA, 8 bp, Unknown
  misc_feature (1)..( 8): Result.003 file - promoters60/5003710
agaggaat

SEQ ID NO: 145325 - DNA, 13 bp, Unknown
  misc_feature (1)..( 13): Result.003 file - promoters60/5003710
tcctttaaacatt

SEQ ID NO: 145326 - DNA, 13 bp, Unknown
  misc_feature (1)..( 13): Result.003 file - promoters60/5003710
tattcaaaacata

SEQ ID NO: 145327 - DNA, 13 bp, Unknown
  misc_feature (1)..( 13): Result.003 file - promoters60/5003710
tatacaaaatata

SEQ ID NO: 145328 - DNA, 13 bp, Unknown
  misc_feature (1)..( 13): Result.003 file - promoters60/5003710
gtttcaaacggtt

SEQ ID NO: 145329 - DNA, 13 bp, Unknown
  misc_feature (1)..( 13): Result.003 file - promoters60/5003710
tattcaaaacata

SEQ ID NO: 145330 - DNA, 13 bp, Unknown
  misc_feature (1)..( 13): Result.003 file - promoters60/5003710
tatacaaaatata

SEQ ID NO: 145331 - DNA, 12 bp, Unknown
  misc_feature (1)..( 12): Result.003 file - promoters60/5003710
ttttcttgttgt

SEQ ID NO: 145332 - DNA, 12 bp, Unknown
  misc_feature (1)..( 12): Result.003 file - promoters60/5003710
ttttcttattgt

SEQ ID NO: 145333 - DNA, 8 bp, Unknown
  misc_feature (1)..( 8): Result.003 file - promoters60/5003710
atacaaaa

SEQ ID NO: 145334 - DNA, 8 bp, Unknown
  misc_feature (1)..( 8): Result.003 file - promoters60/5003710
atagaaaa

SEQ ID NO: 145335 - DNA, 6 bp, Unknown
  misc_feature (1)..( 6): Result.003 file - promoters60/5003710
atcaca

SEQ ID NO: 145336 - DNA, 6 bp, Unknown
  misc_feature (1)..( 6): Result.003 file - promoters60/5003710
atcaca

SEQ ID NO: 145337 - DNA, 10 bp, Unknown
  misc_feature (1)..( 10): Result.003 file - promoters60/5003710
tactatttta

SEQ ID NO: 145338 - DNA, 10 bp, Unknown
  misc_feature (1)..( 10): Result.003 file - promoters60/5003710
tactttttta

SEQ ID NO: 145339 - DNA, 7 bp, Unknown
  misc_feature (1)..( 7): Result.003 file - promoters60/5003710
caaaact

SEQ ID NO: 145340 - DNA, 7 bp, Unknown
  misc_feature (1)..( 7): Result.003 file - promoters60/5003710
caaaact

SEQ ID NO: 145341 - DNA, 10 bp, Unknown
  misc_feature (1)..( 10): Result.003 file - promoters60/5003710
atatcttttc

SEQ ID NO: 145342 - DNA, 10 bp, Unknown
  misc_feature (1)..( 10): Result.003 file - promoters60/5003710
atatattttc

SEQ ID NO: 145343 - DNA, 7 bp, Unknown
  misc_feature (1)..( 7): Result.003 file - promoters60/5003710
aaaatag

SEQ ID NO: 145344 - DNA, 7 bp, Unknown
  misc_feature (1)..( 7): Result.003 file - promoters60/5003710
aaaatat

SEQ ID NO: 145345 - DNA, 7 bp, Unknown
  misc_feature (1)..( 7): Result.003 file - promoters60/5003710
aaattat

SEQ ID NO: 145346 - DNA, 9 bp, Unknown
  misc_feature (1)..( 9): Result.003 file - promoters60/5003710
aatactaca

SEQ ID NO: 145347 - DNA, 9 bp, Unknown
  misc_feature (1)..( 9): Result.003 file - promoters60/5003710
aataataca

SEQ ID NO: 145348 - DNA, 7 bp, Unknown
  misc_feature (1)..( 7): Result.003 file - promoters60/5003710
aaattat

SEQ ID NO: 145349 - DNA, 7 bp, Unknown
  misc_feature (1)..( 7): Result.003 file - promoters60/5003710
aaaatat

SEQ ID NO: 145350 - DNA, 6 bp, Unknown
  misc_feature (1)..( 6): Result.003 file - promoters60/5003710
gtggaa

SEQ ID NO: 145351 - DNA, 6 bp, Unknown
  misc_feature (1)..( 6): Result.003 file - promoters60/5003710
gtggaa

SEQ ID NO: 145352 - DNA, 7 bp, Unknown
  misc_feature (1)..( 7): Result.003 file - promoters60/5003710
tatccgt

SEQ ID NO: 145353 - DNA, 7 bp, Unknown
  misc_feature (1)..( 7): Result.003 file - promoters60/5003710
tattcgt

SEQ ID NO: 145354 - DNA, 7 bp, Unknown
  misc_feature (1)..( 7): Result.003 file - promoters60/5003710
atccaag

SEQ ID NO: 145355 - DNA, 7 bp, Unknown
  misc_feature (1)..( 7): Result.003 file - promoters60/5003710
atcaaag

SEQ ID NO: 145356 - DNA, 7 bp, Unknown
  misc_feature (1)..( 7): Result.003 file - promoters60/5003710
tttccat

SEQ ID NO: 145357 - DNA, 7 bp, Unknown
  misc_feature (1)..( 7): Result.003 file - promoters60/5003710
tttccat

SEQ ID NO: 145358 - DNA, 6 bp, Unknown
  misc_feature (1)..( 6): Result.003 file - promoters60/5003710
tatatt

SEQ ID NO: 145359 - DNA, 6 bp, Unknown
  misc_feature (1)..( 6): Result.003 file - promoters60/5003710
tatatt

SEQ ID NO: 145360 - DNA, 7 bp, Unknown
  misc_feature (1)..( 7): Result.003 file - promoters60/5003710
acaaaac

SEQ ID NO: 145361 - DNA, 7 bp, Unknown
  misc_feature (1)..( 7): Result.003 file - promoters60/5003710
acagaac

SEQ ID NO: 145362 - DNA, 6 bp, Unknown
  misc_feature (1)..( 6): Result.003 file - promoters60/5003710
gaccta

SEQ ID NO: 145363 - DNA, 6 bp, Unknown
  misc_feature (1)..( 6): Result.003 file - promoters60/5003710
gaccta

SEQ ID NO: 145364 - DNA, 9 bp, Unknown
  misc_feature (1)..( 9): Result.003 file - promoters60/5003848
tcaagaaag

SEQ ID NO: 145365 - DNA, 9 bp, Unknown
  misc_feature (1)..( 9): Result.003 file - promoters60/5003848
tcatgaaag

SEQ ID NO: 145366 - DNA, 6 bp, Unknown
  misc_feature (1)..( 6): Result.003 file - promoters60/5003848
attgtt

SEQ ID NO: 145367 - DNA, 6 bp, Unknown
  misc_feature (1)..( 6): Result.003 file - promoters60/5003848
attgtt

SEQ ID NO: 145368 - DNA, 8 bp, Unknown
  misc_feature (1)..( 8): Result.003 file - promoters60/5003848
ctaagttt

SEQ ID NO: 145369 - DNA, 8 bp, Unknown
  misc_feature (1)..( 8): Result.003 file - promoters60/5003848
ctaaattt

SEQ ID NO: 145370 - DNA, 7 bp, Unknown
  misc_feature (1)..( 7): Result.003 file - promoters60/5003848
ttttgag

SEQ ID NO: 145371 - DNA, 7 bp, Unknown
  misc_feature (1)..( 7): Result.003 file - promoters60/5003848
tttggag

SEQ ID NO: 145372 - DNA, 7 bp, Unknown
  misc_feature (1)..( 7): Result.003 file - promoters60/5003848
gagtgta

SEQ ID NO: 145373 - DNA, 7 bp, Unknown
  misc_feature (1)..( 7): Result.003 file - promoters60/5003848
gagtgta

SEQ ID NO: 145374 - DNA, 6 bp, Unknown
  misc_feature (1)..( 6): Result.003 file - promoters60/5003848
gaacca

SEQ ID NO: 145375 - DNA, 6 bp, Unknown
  misc_feature (1)..( 6): Result.003 file - promoters60/5003848
gaacca

SEQ ID NO: 145376 - DNA, 7 bp, Unknown
  misc_feature (1)..( 7): Result.003 file - promoters60/5003848
tagaaag

SEQ ID NO: 145377 - DNA, 7 bp, Unknown
  misc_feature (1)..( 7): Result.003 file - promoters60/5003848
tagcaag

SEQ ID NO: 145378 - DNA, 7 bp, Unknown
  misc_feature (1)..( 7): Result.003 file - promoters60/5003848
gttctga

SEQ ID NO: 145379 - DNA, 7 bp, Unknown
  misc_feature (1)..( 7): Result.003 file - promoters60/5003848
gttgtga

SEQ ID NO: 145380 - DNA, 6 bp, Unknown
  misc_feature (1)..( 6): Result.003 file - promoters60/5003848
tagtca

SEQ ID NO: 145381 - DNA, 6 bp, Unknown
  misc_feature (1)..( 6): Result.003 file - promoters60/5003848
tagtca

SEQ ID NO: 145382 - DNA, 8 bp, Unknown
  misc_feature (1)..( 8): Result.003 file - promoters60/5003848
tcaaaacc

SEQ ID NO: 145383 - DNA, 8 bp, Unknown
  misc_feature (1)..( 8): Result.003 file - promoters60/5003848
tcacaacc

SEQ ID NO: 145384 - DNA, 8 bp, Unknown
  misc_feature (1)..( 8): Result.003 file - promoters60/5003848
tttgtttt

SEQ ID NO: 145385 - DNA, 8 bp, Unknown
  misc_feature (1)..( 8): Result.003 file - promoters60/5003848
tttgtttt

SEQ ID NO: 145386 - DNA, 6 bp, Unknown
  misc_feature (1)..( 6): Result.003 file - promoters60/5003848
ctttga

SEQ ID NO: 145387 - DNA, 6 bp, Unknown
  misc_feature (1)..( 6): Result.003 file - promoters60/5003848
ctttga

SEQ ID NO: 145388 - DNA, 14 bp, Unknown
  misc_feature (1)..( 14): Result.003 file - promoters60/5662739
caaaaagaaaaaaa

SEQ ID NO: 145389 - DNA, 14 bp, Unknown
  misc_feature (1)..( 14): Result.003 file - promoters60/5662739
tttacccaaaaaat

SEQ ID NO: 145390 - DNA, 14 bp, Unknown
  misc_feature (1)..( 14): Result.003 file - promoters60/5662739
gagaaggaaaaaag

SEQ ID NO: 145391 - DNA, 14 bp, Unknown
  misc_feature (1)..( 14): Result.003 file - promoters60/5662739
aagaagaaaaaaaa

SEQ ID NO: 145392 - DNA, 14 bp, Unknown
  misc_feature (1)..( 14): Result.003 file - promoters60/5662739
aaaaagagaaaaca

SEQ ID NO: 145393 - DNA, 14 bp, Unknown
  misc_feature (1)..( 14): Result.003 file - promoters60/5662739
gtttagaagaagtt

SEQ ID NO: 145394 - DNA, 8 bp, Unknown
  misc_feature (1)..( 8): Result.003 file - promoters60/5662749
catatttt

SEQ ID NO: 145395 - DNA, 8 bp, Unknown
  misc_feature (1)..( 8): Result.003 file - promoters60/5662749
tatatttg

SEQ ID NO: 145396 - DNA, 8 bp, Unknown
  misc_feature (1)..( 8): Result.003 file - promoters60/5662749
catttttt

SEQ ID NO: 145397 - DNA, 8 bp, Unknown
  misc_feature (1)..( 8): Result.003 file - promoters60/5662749
aatttttt

SEQ ID NO: 145398 - DNA, 12 bp, Unknown
  misc_feature (1)..( 12): Result.003 file - promoters60/5662749
actcccaaaaat

SEQ ID NO: 145399 - DNA, 12 bp, Unknown
  misc_feature (1)..( 12): Result.003 file - promoters60/5662749
actcctaaaata

SEQ ID NO: 145400 - DNA, 12 bp, Unknown
  misc_feature (1)..( 12): Result.003 file - promoters60/5662749
cagagtaaaatg

SEQ ID NO: 145401 - DNA, 12 bp, Unknown
  misc_feature (1)..( 12): Result.003 file - promoters60/5662749
taggagaaaatg

SEQ ID NO: 145402 - DNA, 10 bp, Unknown
  misc_feature (1)..( 10): Result.003 file - promoters60/5662749
aaaaataaga

SEQ ID NO: 145403 - DNA, 10 bp, Unknown
  misc_feature (1)..( 10): Result.003 file - promoters60/5662749
taaaataatc

SEQ ID NO: 145404 - DNA, 10 bp, Unknown
  misc_feature (1)..( 10): Result.003 file - promoters60/5662749
gaaaatgatc

SEQ ID NO: 145405 - DNA, 10 bp, Unknown
  misc_feature (1)..( 10): Result.003 file - promoters60/5662749
taaaatgcga

SEQ ID NO: 145406 - DNA, 9 bp, Unknown
  misc_feature (1)..( 9): Result.003 file - promoters60/5662749
atttatttc

SEQ ID NO: 145407 - DNA, 9 bp, Unknown
  misc_feature (1)..( 9): Result.003 file - promoters60/5662749
ttttctttc

SEQ ID NO: 145408 - DNA, 9 bp, Unknown
  misc_feature (1)..( 9): Result.003 file - promoters60/5662749
ctttgtttt

SEQ ID NO: 145409 - DNA, 9 bp, Unknown
  misc_feature (1)..( 9): Result.003 file - promoters60/5662749
ctttgtcct

SEQ ID NO: 145410 - DNA, 8 bp, Unknown
  misc_feature (1)..( 8): Result.003 file - promoters60/5662749
caagtctt

SEQ ID NO: 145411 - DNA, 8 bp, Unknown
  misc_feature (1)..( 8): Result.003 file - promoters60/5662749
aaagtctt

SEQ ID NO: 145412 - DNA, 8 bp, Unknown
  misc_feature (1)..( 8): Result.003 file - promoters60/5662749
aaattctg

SEQ ID NO: 145413 - DNA, 8 bp, Unknown
  misc_feature (1)..( 8): Result.003 file - promoters60/5662749
aaaatctc

SEQ ID NO: 145414 - DNA, 8 bp, Unknown
  misc_feature (1)..( 8): Result.003 file - promoters60/5662749
aaaattca

SEQ ID NO: 145415 - DNA, 8 bp, Unknown
  misc_feature (1)..( 8): Result.003 file - promoters60/5662749
aaaattct

SEQ ID NO: 145416 - DNA, 8 bp, Unknown
  misc_feature (1)..( 8): Result.003 file - promoters60/5662749
taaagtct

SEQ ID NO: 145417 - DNA, 8 bp, Unknown
  misc_feature (1)..( 8): Result.003 file - promoters60/5662749
aaaaatct

SEQ ID NO: 145418 - DNA, 8 bp, Unknown
  misc_feature (1)..( 8): Result.003 file - promoters60/5662749
tataaatt

SEQ ID NO: 145419 - DNA, 8 bp, Unknown
  misc_feature (1)..( 8): Result.003 file - promoters60/5662749
tataaacc

SEQ ID NO: 145420 - DNA, 8 bp, Unknown
  misc_feature (1)..( 8): Result.003 file - promoters60/5662749
cataaatg

SEQ ID NO: 145421 - DNA, 8 bp, Unknown
  misc_feature (1)..( 8): Result.003 file - promoters60/5662749
aataaaaa

SEQ ID NO: 145422 - DNA, 8 bp, Unknown
  misc_feature (1)..( 8): Result.003 file - promoters60/5662763
ttttaata

SEQ ID NO: 145423 - DNA, 8 bp, Unknown
  misc_feature (1)..( 8): Result.003 file - promoters60/5662763
ttttaaaa

SEQ ID NO: 145424 - DNA, 8 bp, Unknown
  misc_feature (1)..( 8): Result.003 file - promoters60/5662763
ttttaata

SEQ ID NO: 145425 - DNA, 7 bp, Unknown
  misc_feature (1)..( 7): Result.003 file - promoters60/5662763
aatcaat

SEQ ID NO: 145426 - DNA, 7 bp, Unknown
  misc_feature (1)..( 7): Result.003 file - promoters60/5662763
aatgaat

SEQ ID NO: 145427 - DNA, 13 bp, Unknown
  misc_feature (1)..( 13): Result.003 file - promoters60/5662763
tgttatgttgtgt

SEQ ID NO: 145428 - DNA, 13 bp, Unknown
  misc_feature (1)..( 13): Result.003 file - promoters60/5662763
tgttgtgtggtgt

SEQ ID NO: 145429 - DNA, 7 bp, Unknown
  misc_feature (1)..( 7): Result.003 file - promoters60/5662763
atttgca

SEQ ID NO: 145430 - DNA, 7 bp, Unknown
  misc_feature (1)..( 7): Result.003 file - promoters60/5662763
attcgca

SEQ ID NO: 145431 - DNA, 9 bp, Unknown
  misc_feature (1)..( 9): Result.003 file - promoters60/5662763
ggagttttt

SEQ ID NO: 145432 - DNA, 9 bp, Unknown
  misc_feature (1)..( 9): Result.003 file - promoters60/5662763
tttgttttt

SEQ ID NO: 145433 - DNA, 9 bp, Unknown
  misc_feature (1)..( 9): Result.003 file - promoters60/5662763
tttgttttg

SEQ ID NO: 145434 - DNA, 7 bp, Unknown
  misc_feature (1)..( 7): Result.003 file - promoters60/5662763
tttgttt

SEQ ID NO: 145435 - DNA, 7 bp, Unknown
  misc_feature (1)..( 7): Result.003 file - promoters60/5662763
tttgttt

SEQ ID NO: 145436 - DNA, 9 bp, Unknown
  misc_feature (1)..( 9): Result.003 file - promoters60/5662763
atgattttg

SEQ ID NO: 145437 - DNA, 9 bp, Unknown
  misc_feature (1)..( 9): Result.003 file - promoters60/5662763
atgaatttg

SEQ ID NO: 145438 - DNA, 11 bp, Unknown
  misc_feature (1)..( 11): Result.003 file - promoters60/5662763
aatttgtttga

SEQ ID NO: 145439 - DNA, 11 bp, Unknown
  misc_feature (1)..( 11): Result.003 file - promoters60/5662763
aatatgtttta

SEQ ID NO: 145440 - DNA, 11 bp, Unknown
  misc_feature (1)..( 11): Result.003 file - promoters60/5662763
tcattgtatga

SEQ ID NO: 145441 - DNA, 6 bp, Unknown
  misc_feature (1)..( 6): Result.003 file - promoters60/5662763
ggtgtt

SEQ ID NO: 145442 - DNA, 6 bp, Unknown
  misc_feature (1)..( 6): Result.003 file - promoters60/5662763
ggtgtt

SEQ ID NO: 145443 - DNA, 7 bp, Unknown
  misc_feature (1)..( 7): Result.003 file - promoters60/5662763
atagttt

SEQ ID NO: 145444 - DNA, 7 bp, Unknown
  misc_feature (1)..( 7): Result.003 file - promoters60/5662763
ataattt

SEQ ID NO: 145445 - DNA, 6 bp, Unknown
  misc_feature (1)..( 6): Result.003 file - promoters60/5662763
ttattt

SEQ ID NO: 145446 - DNA, 6 bp, Unknown
  misc_feature (1)..( 6): Result.003 file - promoters60/5662763
ttattt

SEQ ID NO: 145447 - DNA, 9 bp, Unknown
  misc_feature (1)..( 9): Result.003 file - promoters60/5662763
tttctgttt

SEQ ID NO: 145448 - DNA, 9 bp, Unknown
  misc_feature (1)..( 9): Result.003 file - promoters60/5662763
tttttgttt

SEQ ID NO: 145449 - DNA, 9 bp, Unknown
  misc_feature (1)..( 9): Result.003 file - promoters60/5662763
tttctgttt

SEQ ID NO: 145450 - DNA, 6 bp, Unknown
  misc_feature (1)..( 6): Result.003 file - promoters60/5662763
tttcag

SEQ ID NO: 145451 - DNA, 6 bp, Unknown
  misc_feature (1)..( 6): Result.003 file - promoters60/5662763
tttcag

SEQ ID NO: 145452 - DNA, 7 bp, Unknown
  misc_feature (1)..( 7): Result.003 file - promoters60/5662763
aaccaaa

SEQ ID NO: 145453 - DNA, 7 bp, Unknown
  misc_feature (1)..( 7): Result.003 file - promoters60/5662763
aacaaaa

SEQ ID NO: 145454 - DNA, 8 bp, Unknown
  misc_feature (1)..( 8): Result.003 file - promoters60/5662763
taacaaca

SEQ ID NO: 145455 - DNA, 8 bp, Unknown
  misc_feature (1)..( 8): Result.003 file - promoters60/5662763
taacaaaa

SEQ ID NO: 145456 - DNA, 8 bp, Unknown
  misc_feature (1)..( 8): Result.003 file - promoters60/5662763
taaaaaaa

SEQ ID NO: 145457 - DNA, 7 bp, Unknown
  misc_feature (1)..( 7): Result.003 file - promoters60/5662763
tttttct

SEQ ID NO: 145458 - DNA, 7 bp, Unknown
  misc_feature (1)..( 7): Result.003 file - promoters60/5662763
tttttct

SEQ ID NO: 145459 - DNA, 7 bp, Unknown
  misc_feature (1)..( 7): Result.003 file - promoters60/5662763
aaaattg

SEQ ID NO: 145460 - DNA, 7 bp, Unknown
  misc_feature (1)..( 7): Result.003 file - promoters60/5662763
aaatttg

SEQ ID NO: 145461 - DNA, 9 bp, Unknown
  misc_feature (1)..( 9): Result.003 file - promoters60/5662763
ggttcgatt

SEQ ID NO: 145462 - DNA, 9 bp, Unknown
  misc_feature (1)..( 9): Result.003 file - promoters60/5662763
ggttggatt

SEQ ID NO: 145463 - DNA, 7 bp, Unknown
  misc_feature (1)..( 7): Result.003 file - promoters60/5662763
caacgtc

SEQ ID NO: 145464 - DNA, 7 bp, Unknown
  misc_feature (1)..( 7): Result.003 file - promoters60/5662763
caaagtc

SEQ ID NO: 145465 - DNA, 12 bp, Unknown
  misc_feature (1)..( 12): Result.003 file - promoters60/5662765
cggaacaaaatc

SEQ ID NO: 145466 - DNA, 12 bp, Unknown
  misc_feature (1)..( 12): Result.003 file - promoters60/5662765
agaaacaaaatc

SEQ ID NO: 145467 - DNA, 11 bp, Unknown
  misc_feature (1)..( 11): Result.003 file - promoters60/5662765
agaaaaaaaga

SEQ ID NO: 145468 - DNA, 12 bp, Unknown
  misc_feature (1)..( 12): Result.003 file - promoters60/5662765
agatacaaatgt

SEQ ID NO: 145469 - DNA, 12 bp, Unknown
  misc_feature (1)..( 12): Result.003 file - promoters60/5662765
gaaaataaataa

SEQ ID NO: 145470 - DNA, 12 bp, Unknown
  misc_feature (1)..( 12): Result.003 file - promoters60/5662765
gagataaaaata

SEQ ID NO: 145471 - DNA, 12 bp, Unknown
  misc_feature (1)..( 12): Result.003 file - promoters60/5662765
gaatttagaaaa

SEQ ID NO: 145472 - DNA, 12 bp, Unknown
  misc_feature (1)..( 12): Result.003 file - promoters60/5662765
tttattaaaaaa

SEQ ID NO: 145473 - DNA, 12 bp, Unknown
  misc_feature (1)..( 12): Result.003 file - promoters60/5662765
tttcttaaaagc

SEQ ID NO: 145474 - DNA, 12 bp, Unknown
  misc_feature (1)..( 12): Result.003 file - promoters60/5662765
gccattaaatta

SEQ ID NO: 145475 - DNA, 12 bp, Unknown
  misc_feature (1)..( 12): Result.003 file - promoters60/5662765
ataattaaagac

SEQ ID NO: 145476 - DNA, 12 bp, Unknown
  misc_feature (1)..( 12): Result.003 file - promoters60/5662765
cgtattaaagtt

SEQ ID NO: 145477 - DNA, 10 bp, Unknown
  misc_feature (1)..( 10): Result.003 file - promoters60/5662765
cagcccatat

SEQ ID NO: 145478 - DNA, 10 bp, Unknown
  misc_feature (1)..( 10): Result.003 file - promoters60/5662765
aagcccaagc

SEQ ID NO: 145479 - DNA, 10 bp, Unknown
  misc_feature (1)..( 10): Result.003 file - promoters60/5662765
aggcccatat

SEQ ID NO: 145480 - DNA, 10 bp, Unknown
  misc_feature (1)..( 10): Result.003 file - promoters60/5662765
aggcccataa

SEQ ID NO: 145481 - DNA, 10 bp, Unknown
  misc_feature (1)..( 10): Result.003 file - promoters60/5662765
aggcccaatt

SEQ ID NO: 145482 - DNA, 10 bp, Unknown
  misc_feature (1)..( 10): Result.003 file - promoters60/5662765
aggcccatat

SEQ ID NO: 145483 - DNA, 13 bp, Unknown
  misc_feature (1)..( 13): Result.003 file - promoters60/5662765
attttttttattt

SEQ ID NO: 145484 - DNA, 13 bp, Unknown
  misc_feature (1)..( 13): Result.003 file - promoters60/5662765
aaatttcttaaaa

SEQ ID NO: 145485 - DNA, 13 bp, Unknown
  misc_feature (1)..( 13): Result.003 file - promoters60/5662765
attatttttagca

SEQ ID NO: 145486 - DNA, 13 bp, Unknown
  misc_feature (1)..( 13): Result.003 file - promoters60/5662765
atgtttattaaaa

SEQ ID NO: 145487 - DNA, 13 bp, Unknown
  misc_feature (1)..( 13): Result.003 file - promoters60/5662765
agcataattaaag

SEQ ID NO: 145488 - DNA, 13 bp, Unknown
  misc_feature (1)..( 13): Result.003 file - promoters60/5662765
agccgtattaaag

SEQ ID NO: 145489 - DNA, 7 bp, Unknown
  misc_feature (1)..( 7): Result.003 file - promoters60/5662769
aataaat

SEQ ID NO: 145490 - DNA, 7 bp, Unknown
  misc_feature (1)..( 7): Result.003 file - promoters60/5662769
aatgaat

SEQ ID NO: 145491 - DNA, 7 bp, Unknown
  misc_feature (1)..( 7): Result.003 file - promoters60/5662769
aaaaaaa

SEQ ID NO: 145492 - DNA, 7 bp, Unknown
  misc_feature (1)..( 7): Result.003 file - promoters60/5662769
aataaaa

SEQ ID NO: 145493 - DNA, 8 bp, Unknown
  misc_feature (1)..( 8): Result.003 file - promoters60/5662769
atttttaa

SEQ ID NO: 145494 - DNA, 8 bp, Unknown
  misc_feature (1)..( 8): Result.003 file - promoters60/5662769
ctttttaa

SEQ ID NO: 145495 - DNA, 8 bp, Unknown
  misc_feature (1)..( 8): Result.003 file - promoters60/5662769
ctttttat

SEQ ID NO: 145496 - DNA, 8 bp, Unknown
  misc_feature (1)..( 8): Result.003 file - promoters60/5662769
cttttttt

SEQ ID NO: 145497 - DNA, 7 bp, Unknown
  misc_feature (1)..( 7): Result.003 file - promoters60/5662769
aaaaagc

SEQ ID NO: 145498 - DNA, 7 bp, Unknown
  misc_feature (1)..( 7): Result.003 file - promoters60/5662769
aaaaagg

SEQ ID NO: 145499 - DNA, 7 bp, Unknown
  misc_feature (1)..( 7): Result.003 file - promoters60/5662769
aaaaaaa

SEQ ID NO: 145500 - DNA, 8 bp, Unknown
  misc_feature (1)..( 8): Result.003 file - promoters60/5662769
ataaaaaa

SEQ ID NO: 145501 - DNA, 8 bp, Unknown
  misc_feature (1)..( 8): Result.003 file - promoters60/5662769
ggaaaaaa

SEQ ID NO: 145502 - DNA, 8 bp, Unknown
  misc_feature (1)..( 8): Result.003 file - promoters60/5662769
ataaaaaa

SEQ ID NO: 145503 - DNA, 11 bp, Unknown
  misc_feature (1)..( 11): Result.003 file - promoters60/5662769
tattattatac

SEQ ID NO: 145504 - DNA, 11 bp, Unknown
  misc_feature (1)..( 11): Result.003 file - promoters60/5662769
tattatcataa

SEQ ID NO: 145505 - DNA, 11 bp, Unknown
  misc_feature (1)..( 11): Result.003 file - promoters60/5662769
gatcatcaatg

SEQ ID NO: 145506 - DNA, 11 bp, Unknown
  misc_feature (1)..( 11): Result.003 file - promoters60/5662769
tttctatcaac

SEQ ID NO: 145507 - DNA, 11 bp, Unknown
  misc_feature (1)..( 11): Result.003 file - promoters60/5662769
tttctaattcc

SEQ ID NO: 145508 - DNA, 11 bp, Unknown
  misc_feature (1)..( 11): Result.003 file - promoters60/5662769
tttttaactcc

SEQ ID NO: 145509 - DNA, 9 bp, Unknown
  misc_feature (1)..( 9): Result.003 file - promoters60/5662769
ttaacaaaa

SEQ ID NO: 145510 - DNA, 9 bp, Unknown
  misc_feature (1)..( 9): Result.003 file - promoters60/5662769
ttaaaaaaa

SEQ ID NO: 145511 - DNA, 9 bp, Unknown
  misc_feature (1)..( 9): Result.003 file - promoters60/5662769
gtaataaag

SEQ ID NO: 145512 - DNA, 8 bp, Unknown
  misc_feature (1)..( 8): Result.003 file - promoters60/5662771
tgagatga

SEQ ID NO: 145513 - DNA, 8 bp, Unknown
  misc_feature (1)..( 8): Result.003 file - promoters60/5662771
tgatatga

SEQ ID NO: 145514 - DNA, 6 bp, Unknown
  misc_feature (1)..( 6): Result.003 file - promoters60/5662771
ttttat

SEQ ID NO: 145515 - DNA, 6 bp, Unknown
  misc_feature (1)..( 6): Result.003 file - promoters60/5662771
ttttat

SEQ ID NO: 145516 - DNA, 8 bp, Unknown
  misc_feature (1)..( 8): Result.003 file - promoters60/5662771
gaatcttt

SEQ ID NO: 145517 - DNA, 8 bp, Unknown
  misc_feature (1)..( 8): Result.003 file - promoters60/5662771
gaatattt

SEQ ID NO: 145518 - DNA, 9 bp, Unknown
  misc_feature (1)..( 9): Result.003 file - promoters60/5662771
cccaaccca

SEQ ID NO: 145519 - DNA, 9 bp, Unknown
  misc_feature (1)..( 9): Result.003 file - promoters60/5662771
cccaaacca

SEQ ID NO: 145520 - DNA, 11 bp, Unknown
  misc_feature (1)..( 11): Result.003 file - promoters60/5662771
aattttgtttg

SEQ ID NO: 145521 - DNA, 11 bp, Unknown
  misc_feature (1)..( 11): Result.003 file - promoters60/5662771
aatttcgtttg

SEQ ID NO: 145522 - DNA, 7 bp, Unknown
  misc_feature (1)..( 7): Result.003 file - promoters60/5662771
atttttg

SEQ ID NO: 145523 - DNA, 7 bp, Unknown
  misc_feature (1)..( 7): Result.003 file - promoters60/5662771
attattg

SEQ ID NO: 145524 - DNA, 6 bp, Unknown
  misc_feature (1)..( 6): Result.003 file - promoters60/5662771
cacatt

SEQ ID NO: 145525 - DNA, 6 bp, Unknown
  misc_feature (1)..( 6): Result.003 file - promoters60/5662771
cacatt

SEQ ID NO: 145526 - DNA, 9 bp, Unknown
  misc_feature (1)..( 9): Result.003 file - promoters60/5662771
atccgaatt

SEQ ID NO: 145527 - DNA, 9 bp, Unknown
  misc_feature (1)..( 9): Result.003 file - promoters60/5662771
atcccaatt

SEQ ID NO: 145528 - DNA, 8 bp, Unknown
  misc_feature (1)..( 8): Result.003 file - promoters60/5662771
taactttt

SEQ ID NO: 145529 - DNA, 8 bp, Unknown
  misc_feature (1)..( 8): Result.003 file - promoters60/5662771
taagtttt

SEQ ID NO: 145530 - DNA, 8 bp, Unknown
  misc_feature (1)..( 8): Result.003 file - promoters60/5662771
ttttgttt

SEQ ID NO: 145531 - DNA, 8 bp, Unknown
  misc_feature (1)..( 8): Result.003 file - promoters60/5662771
ttttattt

SEQ ID NO: 145532 - DNA, 8 bp, Unknown
  misc_feature (1)..( 8): Result.003 file - promoters60/5662771
tttctttt

SEQ ID NO: 145533 - DNA, 8 bp, Unknown
  misc_feature (1)..( 8): Result.003 file - promoters60/5662771
tttgtttt

SEQ ID NO: 145534 - DNA, 8 bp, Unknown
  misc_feature (1)..( 8): Result.003 file - promoters60/5662771
tttgctca

SEQ ID NO: 145535 - DNA, 8 bp, Unknown
  misc_feature (1)..( 8): Result.003 file - promoters60/5662771
ttttctca

SEQ ID NO: 145536 - DNA, 6 bp, Unknown
  misc_feature (1)..( 6): Result.003 file - promoters60/5662771
aatatt

SEQ ID NO: 145537 - DNA, 6 bp, Unknown
  misc_feature (1)..( 6): Result.003 file - promoters60/5662771
aatatt

SEQ ID NO: 145538 - DNA, 7 bp, Unknown
  misc_feature (1)..( 7): Result.003 file - promoters60/5662779
aaaagat

SEQ ID NO: 145539 - DNA, 7 bp, Unknown
  misc_feature (1)..( 7): Result.003 file - promoters60/5662779
aaaggat

SEQ ID NO: 145540 - DNA, 7 bp, Unknown
  misc_feature (1)..( 7): Result.003 file - promoters60/5662779
ttagttt

SEQ ID NO: 145541 - DNA, 7 bp, Unknown
  misc_feature (1)..( 7): Result.003 file - promoters60/5662779
ttagttt

SEQ ID NO: 145542 - DNA, 9 bp, Unknown
  misc_feature (1)..( 9): Result.003 file - promoters60/5662779
tttggagaa

SEQ ID NO: 145543 - DNA, 9 bp, Unknown
  misc_feature (1)..( 9): Result.003 file - promoters60/5662779
tttgcagaa

SEQ ID NO: 145544 - DNA, 11 bp, Unknown
  misc_feature (1)..( 11): Result.003 file - promoters60/5662779
agtcaaagaaa

SEQ ID NO: 145545 - DNA, 11 bp, Unknown
  misc_feature (1)..( 11): Result.003 file - promoters60/5662779
agttaaataaa

SEQ ID NO: 145546 - DNA, 9 bp, Unknown
  misc_feature (1)..( 9): Result.003 file - promoters60/5662779
ttaatgtaa

SEQ ID NO: 145547 - DNA, 9 bp, Unknown
  misc_feature (1)..( 9): Result.003 file - promoters60/5662779
ttaatataa

SEQ ID NO: 145548 - DNA, 8 bp, Unknown
  misc_feature (1)..( 8): Result.003 file - promoters60/5662779
gatttaac

SEQ ID NO: 145549 - DNA, 8 bp, Unknown
  misc_feature (1)..( 8): Result.003 file - promoters60/5662779
gatgtaac

SEQ ID NO: 145550 - DNA, 7 bp, Unknown
  misc_feature (1)..( 7): Result.003 file - promoters60/5662779
aatttgt

SEQ ID NO: 145551 - DNA, 7 bp, Unknown
  misc_feature (1)..( 7): Result.003 file - promoters60/5662779
aatatgt

SEQ ID NO: 145552 - DNA, 13 bp, Unknown
  misc_feature (1)..( 13): Result.003 file - promoters60/5662779
agaagaagacgca

SEQ ID NO: 145553 - DNA, 13 bp, Unknown
  misc_feature (1)..( 13): Result.003 file - promoters60/5662779
tgcaaaagaggca

SEQ ID NO: 145554 - DNA, 14 bp, Unknown
  misc_feature (1)..( 14): Result.003 file - promoters60/5662779
ttgcaaatgagccc

SEQ ID NO: 145555 - DNA, 6 bp, Unknown
  misc_feature (1)..( 6): Result.003 file - promoters60/5662779
ttttga

SEQ ID NO: 145556 - DNA, 6 bp, Unknown
  misc_feature (1)..( 6): Result.003 file - promoters60/5662779
ttttga

SEQ ID NO: 145557 - DNA, 6 bp, Unknown
  misc_feature (1)..( 6): Result.003 file - promoters60/5662779
cttgcc

SEQ ID NO: 145558 - DNA, 6 bp, Unknown
  misc_feature (1)..( 6): Result.003 file - promoters60/5662779
cttgcc

SEQ ID NO: 145559 - DNA, 7 bp, Unknown
  misc_feature (1)..( 7): Result.003 file - promoters60/5662779
ctcctgc

SEQ ID NO: 145560 - DNA, 7 bp, Unknown
  misc_feature (1)..( 7): Result.003 file - promoters60/5662779
ctcgtgc

SEQ ID NO: 145561 - DNA, 6 bp, Unknown
  misc_feature (1)..( 6): Result.003 file - promoters60/5662785
aatgtg

SEQ ID NO: 145562 - DNA, 6 bp, Unknown
  misc_feature (1)..( 6): Result.003 file - promoters60/5662785
aatgtg

SEQ ID NO: 145563 - DNA, 6 bp, Unknown
  misc_feature (1)..( 6): Result.003 file - promoters60/5662785
ttctta

SEQ ID NO: 145564 - DNA, 6 bp, Unknown
  misc_feature (1)..( 6): Result.003 file - promoters60/5662785
ttctta

SEQ ID NO: 145565 - DNA, 7 bp, Unknown
  misc_feature (1)..( 7): Result.003 file - promoters60/5662785
gattaaa

SEQ ID NO: 145566 - DNA, 7 bp, Unknown
  misc_feature (1)..( 7): Result.003 file - promoters60/5662785
gattaaa

SEQ ID NO: 145567 - DNA, 8 bp, Unknown
  misc_feature (1)..( 8): Result.003 file - promoters60/5662785
tttgggcc

SEQ ID NO: 145568 - DNA, 8 bp, Unknown
  misc_feature (1)..( 8): Result.003 file - promoters60/5662785
tttgggcc

SEQ ID NO: 145569 - DNA, 8 bp, Unknown
  misc_feature (1)..( 8): Result.003 file - promoters60/5662785
tctcttgg

SEQ ID NO: 145570 - DNA, 8 bp, Unknown
  misc_feature (1)..( 8): Result.003 file - promoters60/5662785
tcttttgg

SEQ ID NO: 145571 - DNA, 7 bp, Unknown
  misc_feature (1)..( 7): Result.003 file - promoters60/5662785
ataattt

SEQ ID NO: 145572 - DNA, 7 bp, Unknown
  misc_feature (1)..( 7): Result.003 file - promoters60/5662785
atatttt

SEQ ID NO: 145573 - DNA, 6 bp, Unknown
  misc_feature (1)..( 6): Result.003 file - promoters60/5662785
tgattt

SEQ ID NO: 145574 - DNA, 6 bp, Unknown
  misc_feature (1)..( 6): Result.003 file - promoters60/5662785
tgattt

SEQ ID NO: 145575 - DNA, 8 bp, Unknown
  misc_feature (1)..( 8): Result.003 file - promoters60/5662785
tttcgttt

SEQ ID NO: 145576 - DNA, 8 bp, Unknown
  misc_feature (1)..( 8): Result.003 file - promoters60/5662785
tttccttt

SEQ ID NO: 145577 - DNA, 7 bp, Unknown
  misc_feature (1)..( 7): Result.003 file - promoters60/5662785
atctttg

SEQ ID NO: 145578 - DNA, 7 bp, Unknown
  misc_feature (1)..( 7): Result.003 file - promoters60/5662785
atctttg

SEQ ID NO: 145579 - DNA, 6 bp, Unknown
  misc_feature (1)..( 6): Result.003 file - promoters60/5662785
tttgat

SEQ ID NO: 145580 - DNA, 6 bp, Unknown
  misc_feature (1)..( 6): Result.003 file - promoters60/5662785
tttgat

SEQ ID NO: 145581 - DNA, 6 bp, Unknown
  misc_feature (1)..( 6): Result.003 file - promoters60/5662785
attctt

SEQ ID NO: 145582 - DNA, 6 bp, Unknown
  misc_feature (1)..( 6): Result.003 file - promoters60/5662785
attctt

SEQ ID NO: 145583 - DNA, 8 bp, Unknown
  misc_feature (1)..( 8): Result.003 file - promoters60/5662785
tttctctt

SEQ ID NO: 145584 - DNA, 8 bp, Unknown
  misc_feature (1)..( 8): Result.003 file - promoters60/5662785
tttatctt

SEQ ID NO: 145585 - DNA, 6 bp, Unknown
  misc_feature (1)..( 6): Result.003 file - promoters60/5662785
ttatat

SEQ ID NO: 145586 - DNA, 6 bp, Unknown
  misc_feature (1)..( 6): Result.003 file - promoters60/5662785
ttatat

SEQ ID NO: 145587 - DNA, 8 bp, Unknown
  misc_feature (1)..( 8): Result.003 file - promoters60/5662785
atatatct

SEQ ID NO: 145588 - DNA, 8 bp, Unknown
  misc_feature (1)..( 8): Result.003 file - promoters60/5662785
atatctct

SEQ ID NO: 145589 - DNA, 7 bp, Unknown
  misc_feature (1)..( 7): Result.003 file - promoters60/5662785
cttggtt

SEQ ID NO: 145590 - DNA, 7 bp, Unknown
  misc_feature (1)..( 7): Result.003 file - promoters60/5662785
cttagtt

SEQ ID NO: 145591 - DNA, 7 bp, Unknown
  misc_feature (1)..( 7): Result.003 file - promoters60/5662785
gtttttt

SEQ ID NO: 145592 - DNA, 7 bp, Unknown
  misc_feature (1)..( 7): Result.003 file - promoters60/5662785
gttattt

SEQ ID NO: 145593 - DNA, 13 bp, Unknown
  misc_feature (1)..( 13): Result.003 file - promoters60/5662799
taagaaaattgac

SEQ ID NO: 145594 - DNA, 13 bp, Unknown
  misc_feature (1)..( 13): Result.003 file - promoters60/5662799
tgtcaaatttgtc

SEQ ID NO: 145595 - DNA, 13 bp, Unknown
  misc_feature (1)..( 13): Result.003 file - promoters60/5662799
aaagaaatttgct

SEQ ID NO: 145596 - DNA, 13 bp, Unknown
  misc_feature (1)..( 13): Result.003 file - promoters60/5662799
aaacaaatcaaat

SEQ ID NO: 145597 - DNA, 13 bp, Unknown
  misc_feature (1)..( 13): Result.003 file - promoters60/5662799
ggtcagattgttc

SEQ ID NO: 145598 - DNA, 13 bp, Unknown
  misc_feature (1)..( 13): Result.003 file - promoters60/5662799
tcccaattttgcc

SEQ ID NO: 145599 - DNA, 13 bp, Unknown
  misc_feature (1)..( 13): Result.003 file - promoters60/5662799
acggagttttgct

SEQ ID NO: 145600 - DNA, 13 bp, Unknown
  misc_feature (1)..( 13): Result.003 file - promoters60/5662799
gaattattttgct

SEQ ID NO: 145601 - DNA, 8 bp, Unknown
  misc_feature (1)..( 8): Result.003 file - promoters60/5662809
tttgttat

SEQ ID NO: 145602 - DNA, 8 bp, Unknown
  misc_feature (1)..( 8): Result.003 file - promoters60/5662809
ttttttag

SEQ ID NO: 145603 - DNA, 8 bp, Unknown
  misc_feature (1)..( 8): Result.003 file - promoters60/5662809
tttgatat

SEQ ID NO: 145604 - DNA, 6 bp, Unknown
  misc_feature (1)..( 6): Result.003 file - promoters60/5662809
ataaaa

SEQ ID NO: 145605 - DNA, 6 bp, Unknown
  misc_feature (1)..( 6): Result.003 file - promoters60/5662809
ataaaa

SEQ ID NO: 145606 - DNA, 13 bp, Unknown
  misc_feature (1)..( 13): Result.003 file - promoters60/5662809
attcttttaaagt

SEQ ID NO: 145607 - DNA, 13 bp, Unknown
  misc_feature (1)..( 13): Result.003 file - promoters60/5662809
attgtttaaaaca

SEQ ID NO: 145608 - DNA, 13 bp, Unknown
  misc_feature (1)..( 13): Result.003 file - promoters60/5662809
atcaattaaagtt

SEQ ID NO: 145609 - DNA, 11 bp, Unknown
  misc_feature (1)..( 11): Result.003 file - promoters60/5662809
ttaaagttcaa

SEQ ID NO: 145610 - DNA, 11 bp, Unknown
  misc_feature (1)..( 11): Result.003 file - promoters60/5662809
acaaaggtcaa

SEQ ID NO: 145611 - DNA, 11 bp, Unknown
  misc_feature (1)..( 11): Result.003 file - promoters60/5662809
ttaaagttggg

SEQ ID NO: 145612 - DNA, 7 bp, Unknown
  misc_feature (1)..( 7): Result.003 file - promoters60/5662809
aatattt

SEQ ID NO: 145613 - DNA, 7 bp, Unknown
  misc_feature (1)..( 7): Result.003 file - promoters60/5662809
aatcttt

SEQ ID NO: 145614 - DNA, 7 bp, Unknown
  misc_feature (1)..( 7): Result.003 file - promoters60/5662809
tttgttt

SEQ ID NO: 145615 - DNA, 7 bp, Unknown
  misc_feature (1)..( 7): Result.003 file - promoters60/5662809
tttcttt

SEQ ID NO: 145616 - DNA, 6 bp, Unknown
  misc_feature (1)..( 6): Result.003 file - promoters60/5662809
cagaca

SEQ ID NO: 145617 - DNA, 6 bp, Unknown
  misc_feature (1)..( 6): Result.003 file - promoters60/5662809
cagaca

SEQ ID NO: 145618 - DNA, 6 bp, Unknown
  misc_feature (1)..( 6): Result.003 file - promoters60/5662809
tttttt

SEQ ID NO: 145619 - DNA, 6 bp, Unknown
  misc_feature (1)..( 6): Result.003 file - promoters60/5662809
tttttt

SEQ ID NO: 145620 - DNA, 6 bp, Unknown
  misc_feature (1)..( 6): Result.003 file - promoters60/5662809
ctttta

SEQ ID NO: 145621 - DNA, 6 bp, Unknown
  misc_feature (1)..( 6): Result.003 file - promoters60/5662809
ctttta

SEQ ID NO: 145622 - DNA, 6 bp, Unknown
  misc_feature (1)..( 6): Result.003 file - promoters60/5662809
caaaaa

SEQ ID NO: 145623 - DNA, 6 bp, Unknown
  misc_feature (1)..( 6): Result.003 file - promoters60/5662809
caaaaa

SEQ ID NO: 145624 - DNA, 11 bp, Unknown
  misc_feature (1)..( 11): Result.003 file - promoters60/5662809
aaacaacaaat

SEQ ID NO: 145625 - DNA, 11 bp, Unknown
  misc_feature (1)..( 11): Result.003 file - promoters60/5662809
aaataacaaat

SEQ ID NO: 145626 - DNA, 7 bp, Unknown
  misc_feature (1)..( 7): Result.003 file - promoters60/5662809
ctattta

SEQ ID NO: 145627 - DNA, 7 bp, Unknown
  misc_feature (1)..( 7): Result.003 file - promoters60/5662809
ctattta

SEQ ID NO: 145628 - DNA, 7 bp, Unknown
  misc_feature (1)..( 7): Result.003 file - promoters60/5662809
ttttctt

SEQ ID NO: 145629 - DNA, 7 bp, Unknown
  misc_feature (1)..( 7): Result.003 file - promoters60/5662809
ttttctt

SEQ ID NO: 145630 - DNA, 6 bp, Unknown
  misc_feature (1)..( 6): Result.004 file - promoters60/5662809
tttatt

SEQ ID NO: 145631 - DNA, 6 bp, Unknown
  misc_feature (1)..( 6): Result.004 file - promoters60/5662809
tttatt

SEQ ID NO: 145632 - DNA, 8 bp, Unknown
  misc_feature (1)..( 8): Result.004 file - promoters60/5662809
ctaattaa

SEQ ID NO: 145633 - DNA, 8 bp, Unknown
  misc_feature (1)..( 8): Result.004 file - promoters60/5662809
ctaattaa

SEQ ID NO: 145634 - DNA, 6 bp, Unknown
  misc_feature (1)..( 6): Result.004 file - promoters60/5662809
aataaa

SEQ ID NO: 145635 - DNA, 6 bp, Unknown
  misc_feature (1)..( 6): Result.004 file - promoters60/5662809
aataaa

SEQ ID NO: 145636 - DNA, 7 bp, Unknown
  misc_feature (1)..( 7): Result.004 file - promoters60/5662809
tttttta

SEQ ID NO: 145637 - DNA, 7 bp, Unknown
  misc_feature (1)..( 7): Result.004 file - promoters60/5662809
tttgtta

SEQ ID NO: 145638 - DNA, 7 bp, Unknown
  misc_feature (1)..( 7): Result.004 file - promoters60/5662809
aaagaaa

SEQ ID NO: 145639 - DNA, 7 bp, Unknown
  misc_feature (1)..( 7): Result.004 file - promoters60/5662809
aaagaaa

SEQ ID NO: 145640 - DNA, 7 bp, Unknown
  misc_feature (1)..( 7): Result.004 file - promoters60/5662809
cgcgttt

SEQ ID NO: 145641 - DNA, 7 bp, Unknown
  misc_feature (1)..( 7): Result.004 file - promoters60/5662828
cgctttt

SEQ ID NO: 145642 - DNA, 8 bp, Unknown
  misc_feature (1)..( 8): Result.004 file - promoters60/5662828
aaatcctc

SEQ ID NO: 145643 - DNA, 8 bp, Unknown
  misc_feature (1)..( 8): Result.004 file - promoters60/5662828
aaattctc

SEQ ID NO: 145644 - DNA, 7 bp, Unknown
  misc_feature (1)..( 7): Result.004 file - promoters60/5662828
aatttct

SEQ ID NO: 145645 - DNA, 7 bp, Unknown
  misc_feature (1)..( 7): Result.004 file - promoters60/5662828
aatatct

SEQ ID NO: 145646 - DNA, 7 bp, Unknown
  misc_feature (1)..( 7): Result.004 file - promoters60/5662828
tttgtaa

SEQ ID NO: 145647 - DNA, 7 bp, Unknown
  misc_feature (1)..( 7): Result.004 file - promoters60/5662828
tttataa

SEQ ID NO: 145648 - DNA, 6 bp, Unknown
  misc_feature (1)..( 6): Result.004 file - promoters60/5662828
ttgtta

SEQ ID NO: 145649 - DNA, 6 bp, Unknown
  misc_feature (1)..( 6): Result.004 file - promoters60/5662828
ttgtta

SEQ ID NO: 145650 - DNA, 7 bp, Unknown
  misc_feature (1)..( 7): Result.004 file - promoters60/5662828
ttttgaa

SEQ ID NO: 145651 - DNA, 7 bp, Unknown
  misc_feature (1)..( 7): Result.004 file - promoters60/5662828
ttttgat

SEQ ID NO: 145652 - DNA, 7 bp, Unknown
  misc_feature (1)..( 7): Result.004 file - promoters60/5662828
tttagat

SEQ ID NO: 145653 - DNA, 8 bp, Unknown
  misc_feature (1)..( 8): Result.004 file - promoters60/5662828
agaccctt

SEQ ID NO: 145654 - DNA, 8 bp, Unknown
  misc_feature (1)..( 8): Result.004 file - promoters60/5662828
agactctt

SEQ ID NO: 145655 - DNA, 6 bp, Unknown
  misc_feature (1)..( 6): Result.004 file - promoters60/5662828
ttgaga

SEQ ID NO: 145656 - DNA, 6 bp, Unknown
  misc_feature (1)..( 6): Result.004 file - promoters60/5662828
ttgaga

SEQ ID NO: 145657 - DNA, 7 bp, Unknown
  misc_feature (1)..( 7): Result.004 file - promoters60/5662828
taaattg

SEQ ID NO: 145658 - DNA, 7 bp, Unknown
  misc_feature (1)..( 7): Result.004 file - promoters60/5662828
taagttg

SEQ ID NO: 145659 - DNA, 6 bp, Unknown
  misc_feature (1)..( 6): Result.004 file - promoters60/5662828
ttttaa

SEQ ID NO: 145660 - DNA, 6 bp, Unknown
  misc_feature (1)..( 6): Result.004 file - promoters60/5662828
ttttaa

SEQ ID NO: 145661 - DNA, 6 bp, Unknown
  misc_feature (1)..( 6): Result.004 file - promoters60/5662828
atacct

SEQ ID NO: 145662 - DNA, 6 bp, Unknown
  misc_feature (1)..( 6): Result.004 file - promoters60/5662828
atacct

SEQ ID NO: 145663 - DNA, 6 bp, Unknown
  misc_feature (1)..( 6): Result.004 file - promoters60/5662828
ataatt

SEQ ID NO: 145664 - DNA, 6 bp, Unknown
  misc_feature (1)..( 6): Result.004 file - promoters60/5662828
ataatt

SEQ ID NO: 145665 - DNA, 6 bp, Unknown
  misc_feature (1)..( 6): Result.004 file - promoters60/5662828
ctacgt

SEQ ID NO: 145666 - DNA, 6 bp, Unknown
  misc_feature (1)..( 6): Result.004 file - promoters60/5662828
ctacgt

SEQ ID NO: 145667 - DNA, 6 bp, Unknown
  misc_feature (1)..( 6): Result.004 file - promoters60/5662828
gttgat

SEQ ID NO: 145668 - DNA, 6 bp, Unknown
  misc_feature (1)..( 6): Result.004 file - promoters60/5662828
gttgat

SEQ ID NO: 145669 - DNA, 8 bp, Unknown
  misc_feature (1)..( 8): Result.004 file - promoters60/5662828
aatttctc

SEQ ID NO: 145670 - DNA, 8 bp, Unknown
  misc_feature (1)..( 8): Result.004 file - promoters60/5662828
aatatctc

SEQ ID NO: 145671 - DNA, 6 bp, Unknown
  misc_feature (1)..( 6): Result.004 file - promoters60/5662828
gggttt

SEQ ID NO: 145672 - DNA, 6 bp, Unknown
  misc_feature (1)..( 6): Result.004 file - promoters60/5662828
gggttt

SEQ ID NO: 145673 - DNA, 6 bp, Unknown
  misc_feature (1)..( 6): Result.004 file - promoters60/5662828
acaaat

SEQ ID NO: 145674 - DNA, 6 bp, Unknown
  misc_feature (1)..( 6): Result.004 file - promoters60/5662828
acaaat

SEQ ID NO: 145675 - DNA, 7 bp, Unknown
  misc_feature (1)..( 7): Result.004 file - promoters60/5662828
tctaaaa

SEQ ID NO: 145676 - DNA, 7 bp, Unknown
  misc_feature (1)..( 7): Result.004 file - promoters60/5662828
tctaaaa

SEQ ID NO: 145677 - DNA, 6 bp, Unknown
  misc_feature (1)..( 6): Result.004 file - promoters60/5662828
aatgtc

SEQ ID NO: 145678 - DNA, 6 bp, Unknown
  misc_feature (1)..( 6): Result.004 file - promoters60/5662828
aatgtc

SEQ ID NO: 145679 - DNA, 7 bp, Unknown
  misc_feature (1)..( 7): Result.004 file - promoters60/5662828
aatctac

SEQ ID NO: 145680 - DNA, 7 bp, Unknown
  misc_feature (1)..( 7): Result.004 file - promoters60/5662835
aatctac

SEQ ID NO: 145681 - DNA, 7 bp, Unknown
  misc_feature (1)..( 7): Result.004 file - promoters60/5662835
tttctga

SEQ ID NO: 145682 - DNA, 7 bp, Unknown
  misc_feature (1)..( 7): Result.004 file - promoters60/5662835
tttatga

SEQ ID NO: 145683 - DNA, 7 bp, Unknown
  misc_feature (1)..( 7): Result.004 file - promoters60/5662835
actcttg

SEQ ID NO: 145684 - DNA, 7 bp, Unknown
  misc_feature (1)..( 7): Result.004 file - promoters60/5662835
actattg

SEQ ID NO: 145685 - DNA, 6 bp, Unknown
  misc_feature (1)..( 6): Result.004 file - promoters60/5662835
taacca

SEQ ID NO: 145686 - DNA, 6 bp, Unknown
  misc_feature (1)..( 6): Result.004 file - promoters60/5662835
taacca

SEQ ID NO: 145687 - DNA, 6 bp, Unknown
  misc_feature (1)..( 6): Result.004 file - promoters60/5662835
gatgag

SEQ ID NO: 145688 - DNA, 6 bp, Unknown
  misc_feature (1)..( 6): Result.004 file - promoters60/5662835
gatgag

SEQ ID NO: 145689 - DNA, 6 bp, Unknown
  misc_feature (1)..( 6): Result.004 file - promoters60/5662835
ttggaa

SEQ ID NO: 145690 - DNA, 6 bp, Unknown
  misc_feature (1)..( 6): Result.004 file - promoters60/5662835
ttggaa

SEQ ID NO: 145691 - DNA, 8 bp, Unknown
  misc_feature (1)..( 8): Result.004 file - promoters60/5662835
acacattc

SEQ ID NO: 145692 - DNA, 8 bp, Unknown
  misc_feature (1)..( 8): Result.004 file - promoters60/5662835
acaaattt

SEQ ID NO: 145693 - DNA, 8 bp, Unknown
  misc_feature (1)..( 8): Result.004 file - promoters60/5662835
tcaatttt

SEQ ID NO: 145694 - DNA, 7 bp, Unknown
  misc_feature (1)..( 7): Result.004 file - promoters60/5662835
ttgcctt

SEQ ID NO: 145695 - DNA, 7 bp, Unknown
  misc_feature (1)..( 7): Result.004 file - promoters60/5662835
ttgactt

SEQ ID NO: 145696 - DNA, 8 bp, Unknown
  misc_feature (1)..( 8): Result.004 file - promoters60/5662835
ttgattta

SEQ ID NO: 145697 - DNA, 8 bp, Unknown
  misc_feature (1)..( 8): Result.004 file - promoters60/5662835
ttgtttta

SEQ ID NO: 145698 - DNA, 6 bp, Unknown
  misc_feature (1)..( 6): Result.004 file - promoters60/5662835
aaacaa

SEQ ID NO: 145699 - DNA, 6 bp, Unknown
  misc_feature (1)..( 6): Result.004 file - promoters60/5662835
aaacaa

SEQ ID NO: 145700 - DNA, 6 bp, Unknown
  misc_feature (1)..( 6): Result.004 file - promoters60/5662835
acacgt

SEQ ID NO: 145701 - DNA, 6 bp, Unknown
  misc_feature (1)..( 6): Result.004 file - promoters60/5662835
acacgt

SEQ ID NO: 145702 - DNA, 6 bp, Unknown
  misc_feature (1)..( 6): Result.004 file - promoters60/5662835
ttaacc

SEQ ID NO: 145703 - DNA, 6 bp, Unknown
  misc_feature (1)..( 6): Result.004 file - promoters60/5662835
ttaacc

SEQ ID NO: 145704 - DNA, 7 bp, Unknown
  misc_feature (1)..( 7): Result.004 file - promoters60/5662835
ttttgaa

SEQ ID NO: 145705 - DNA, 7 bp, Unknown
  misc_feature (1)..( 7): Result.004 file - promoters60/5662835
tttggaa

SEQ ID NO: 145706 - DNA, 6 bp, Unknown
  misc_feature (1)..( 6): Result.004 file - promoters60/5662835
aatttg

SEQ ID NO: 145707 - DNA, 6 bp, Unknown
  misc_feature (1)..( 6): Result.004 file - promoters60/5662835
aatttg

SEQ ID NO: 145708 - DNA, 7 bp, Unknown
  misc_feature (1)..( 7): Result.004 file - promoters60/5662835
attaatt

SEQ ID NO: 145709 - DNA, 7 bp, Unknown
  misc_feature (1)..( 7): Result.004 file - promoters60/5662835
attaatt

SEQ ID NO: 145710 - DNA, 6 bp, Unknown
  misc_feature (1)..( 6): Result.004 file - promoters60/5662835
ttaaaa

SEQ ID NO: 145711 - DNA, 6 bp, Unknown
  misc_feature (1)..( 6): Result.004 file - promoters60/5662893
ttaaaa

SEQ ID NO: 145712 - DNA, 9 bp, Unknown
  misc_feature (1)..( 9): Result.004 file - promoters60/5662893
catataaag

SEQ ID NO: 145713 - DNA, 9 bp, Unknown
  misc_feature (1)..( 9): Result.004 file - promoters60/5662893
catatatac

SEQ ID NO: 145714 - DNA, 9 bp, Unknown
  misc_feature (1)..( 9): Result.004 file - promoters60/5662893
aataaaaag

SEQ ID NO: 145715 - DNA, 9 bp, Unknown
  misc_feature (1)..( 9): Result.004 file - promoters60/5662893
tatagataa

SEQ ID NO: 145716 - DNA, 9 bp, Unknown
  misc_feature (1)..( 9): Result.004 file - promoters60/5662893
tataaaacc

SEQ ID NO: 145717 - DNA, 10 bp, Unknown
  misc_feature (1)..( 10): Result.004 file - promoters60/5662895
actattaaag

SEQ ID NO: 145718 - DNA, 9 bp, Unknown
  misc_feature (1)..( 9): Result.004 file - promoters60/5662895
aattgaaac

SEQ ID NO: 145719 - DNA, 9 bp, Unknown
  misc_feature (1)..( 9): Result.004 file - promoters60/5662895
aattaaaac

SEQ ID NO: 145720 - DNA, 8 bp, Unknown
  misc_feature (1)..( 8): Result.004 file - promoters60/5662895
ttttgttt

SEQ ID NO: 145721 - DNA, 8 bp, Unknown
  misc_feature (1)..( 8): Result.004 file - promoters60/5662895
ttttgttt

SEQ ID NO: 145722 - DNA, 7 bp, Unknown
  misc_feature (1)..( 7): Result.004 file - promoters60/5662895
cattttt

SEQ ID NO: 145723 - DNA, 7 bp, Unknown
  misc_feature (1)..( 7): Result.004 file - promoters60/5662895
cattttt

SEQ ID NO: 145724 - DNA, 6 bp, Unknown
  misc_feature (1)..( 6): Result.004 file - promoters60/5662895
taaatt

SEQ ID NO: 145725 - DNA, 6 bp, Unknown
  misc_feature (1)..( 6): Result.004 file - promoters60/5662895
taaatt

SEQ ID NO: 145726 - DNA, 6 bp, Unknown
  misc_feature (1)..( 6): Result.004 file - promoters60/5662895
ttctta

SEQ ID NO: 145727 - DNA, 6 bp, Unknown
  misc_feature (1)..( 6): Result.004 file - promoters60/5662895
ttctta

SEQ ID NO: 145728 - DNA, 8 bp, Unknown
  misc_feature (1)..( 8): Result.004 file - promoters60/5662895
aaaatttt

SEQ ID NO: 145729 - DNA, 8 bp, Unknown
  misc_feature (1)..( 8): Result.004 file - promoters60/5662895
aaaatttt

SEQ ID NO: 145730 - DNA, 7 bp, Unknown
  misc_feature (1)..( 7): Result.004 file - promoters60/5662895
caacttc

SEQ ID NO: 145731 - DNA, 7 bp, Unknown
  misc_feature (1)..( 7): Result.004 file - promoters60/5662895
caatttc

SEQ ID NO: 145732 - DNA, 6 bp, Unknown
  misc_feature (1)..( 6): Result.004 file - promoters60/5662895
tgattc

SEQ ID NO: 145733 - DNA, 6 bp, Unknown
  misc_feature (1)..( 6): Result.004 file - promoters60/5662895
tgattc

SEQ ID NO: 145734 - DNA, 6 bp, Unknown
  misc_feature (1)..( 6): Result.004 file - promoters60/5662895
aaaaac

SEQ ID NO: 145735 - DNA, 6 bp, Unknown
  misc_feature (1)..( 6): Result.004 file - promoters60/5662895
aaaaac

SEQ ID NO: 145736 - DNA, 6 bp, Unknown
  misc_feature (1)..( 6): Result.004 file - promoters60/5662895
tttatt

SEQ ID NO: 145737 - DNA, 6 bp, Unknown
  misc_feature (1)..( 6): Result.004 file - promoters60/5662895
tttatt

SEQ ID NO: 145738 - DNA, 9 bp, Unknown
  misc_feature (1)..( 9): Result.004 file - promoters60/5662895
tttccatac

SEQ ID NO: 145739 - DNA, 9 bp, Unknown
  misc_feature (1)..( 9): Result.004 file - promoters60/5662895
ttttcataa

SEQ ID NO: 145740 - DNA, 9 bp, Unknown
  misc_feature (1)..( 9): Result.004 file - promoters60/5662895
tttacataa

SEQ ID NO: 145741 - DNA, 7 bp, Unknown
  misc_feature (1)..( 7): Result.004 file - promoters60/5662895
agaagaa

SEQ ID NO: 145742 - DNA, 7 bp, Unknown
  misc_feature (1)..( 7): Result.004 file - promoters60/5662895
agatgaa

SEQ ID NO: 145743 - DNA, 9 bp, Unknown
  misc_feature (1)..( 9): Result.004 file - promoters60/5662895
tgtgtattt

SEQ ID NO: 145744 - DNA, 9 bp, Unknown
  misc_feature (1)..( 9): Result.004 file - promoters60/5662895
tgtggattt

SEQ ID NO: 145745 - DNA, 6 bp, Unknown
  misc_feature (1)..( 6): Result.004 file - promoters60/5662895
tcgaat

SEQ ID NO: 145746 - DNA, 6 bp, Unknown
  misc_feature (1)..( 6): Result.004 file - promoters60/5662895
tcgaat

SEQ ID NO: 145747 - DNA, 7 bp, Unknown
  misc_feature (1)..( 7): Result.004 file - promoters60/5662895
cattaaa

SEQ ID NO: 145748 - DNA, 7 bp, Unknown
  misc_feature (1)..( 7): Result.004 file - promoters60/5662895
cataaaa

SEQ ID NO: 145749 - DNA, 7 bp, Unknown
  misc_feature (1)..( 7): Result.004 file - promoters60/5662895
aatcgga

SEQ ID NO: 145750 - DNA, 7 bp, Unknown
  misc_feature (1)..( 7): Result.004 file - promoters60/5662895
aattgga

SEQ ID NO: 145751 - DNA, 7 bp, Unknown
  misc_feature (1)..( 7): Result.004 file - promoters60/5662895
ttcggat

SEQ ID NO: 145752 - DNA, 7 bp, Unknown
  misc_feature (1)..( 7): Result.004 file - promoters60/5662895
ttcagat

SEQ ID NO: 145753 - DNA, 6 bp, Unknown
  misc_feature (1)..( 6): Result.004 file - promoters60/5662895
ctgtaa

SEQ ID NO: 145754 - DNA, 6 bp, Unknown
  misc_feature (1)..( 6): Result.004 file - promoters60/5662895
ctgtaa

SEQ ID NO: 145755 - DNA, 6 bp, Unknown
  misc_feature (1)..( 6): Result.004 file - promoters60/5662895
aaaatg

SEQ ID NO: 145756 - DNA, 6 bp, Unknown
  misc_feature (1)..( 6): Result.004 file - promoters60/5662895
aaaatg

SEQ ID NO: 145757 - DNA, 8 bp, Unknown
  misc_feature (1)..( 8): Result.004 file - promoters60/5662895
ttatctaa

SEQ ID NO: 145758 - DNA, 8 bp, Unknown
  misc_feature (1)..( 8): Result.004 file - promoters60/5662895
ttatgtaa

SEQ ID NO: 145759 - DNA, 7 bp, Unknown
  misc_feature (1)..( 7): Result.004 file - promoters60/5662895
ttatctt

SEQ ID NO: 145760 - DNA, 7 bp, Unknown
  misc_feature (1)..( 7): Result.004 file - promoters60/5662895
ttatctt

SEQ ID NO: 145761 - DNA, 6 bp, Unknown
  misc_feature (1)..( 6): Result.004 file - promoters60/5662895
attttt

SEQ ID NO: 145762 - DNA, 6 bp, Unknown
  misc_feature (1)..( 6): Result.004 file - promoters60/5662914
attttt

SEQ ID NO: 145763 - DNA, 13 bp, Unknown
  misc_feature (1)..( 13): Result.004 file - promoters60/5662914
gaatttagaaaac

SEQ ID NO: 145764 - DNA, 13 bp, Unknown
  misc_feature (1)..( 13): Result.004 file - promoters60/5662914
caatttaaaaaca

SEQ ID NO: 145765 - DNA, 13 bp, Unknown
  misc_feature (1)..( 13): Result.004 file - promoters60/5662914
ttattaaaaaaaa

SEQ ID NO: 145766 - DNA, 13 bp, Unknown
  misc_feature (1)..( 13): Result.004 file - promoters60/5662914
tattttaaaacaa

SEQ ID NO: 145767 - DNA, 13 bp, Unknown
  misc_feature (1)..( 13): Result.004 file - promoters60/5662914
ttattgaaacgtt

SEQ ID NO: 145768 - DNA, 13 bp, Unknown
  misc_feature (1)..( 13): Result.004 file - promoters60/5662914
tttcttaaaagct

SEQ ID NO: 145769 - DNA, 13 bp, Unknown
  misc_feature (1)..( 13): Result.004 file - promoters60/5662914
caattaaacgctg

SEQ ID NO: 145770 - DNA, 12 bp, Unknown
  misc_feature (1)..( 12): Result.004 file - promoters60/5662914
aatttagaaaac

SEQ ID NO: 145771 - DNA, 12 bp, Unknown
  misc_feature (1)..( 12): Result.004 file - promoters60/5662914
ttattaaaaaaa

SEQ ID NO: 145772 - DNA, 12 bp, Unknown
  misc_feature (1)..( 12): Result.004 file - promoters60/5662914
aatttaaaaaca

SEQ ID NO: 145773 - DNA, 12 bp, Unknown
  misc_feature (1)..( 12): Result.004 file - promoters60/5662914
ttcttaaaagct

SEQ ID NO: 145774 - DNA, 12 bp, Unknown
  misc_feature (1)..( 12): Result.004 file - promoters60/5662914
attttaaaacaa

SEQ ID NO: 145775 - DNA, 12 bp, Unknown
  misc_feature (1)..( 12): Result.004 file - promoters60/5662914
tattgaaacgtt

SEQ ID NO: 145776 - DNA, 12 bp, Unknown
  misc_feature (1)..( 12): Result.004 file - promoters60/5662921
caattaaacgct

SEQ ID NO: 145777 - DNA, 7 bp, Unknown
  misc_feature (1)..( 7): Result.004 file - promoters60/5662921
tttctta

SEQ ID NO: 145778 - DNA, 7 bp, Unknown
  misc_feature (1)..( 7): Result.004 file - promoters60/5662921
tttttta

SEQ ID NO: 145779 - DNA, 6 bp, Unknown
  misc_feature (1)..( 6): Result.004 file - promoters60/5662921
aatgtt

SEQ ID NO: 145780 - DNA, 6 bp, Unknown
  misc_feature (1)..( 6): Result.004 file - promoters60/5662921
aatgtt

SEQ ID NO: 145781 - DNA, 9 bp, Unknown
  misc_feature (1)..( 9): Result.004 file - promoters60/5662921
taatttcaa

SEQ ID NO: 145782 - DNA, 9 bp, Unknown
  misc_feature (1)..( 9): Result.004 file - promoters60/5662921
taatttcca

SEQ ID NO: 145783 - DNA, 9 bp, Unknown
  misc_feature (1)..( 9): Result.004 file - promoters60/5662921
aaatttcaa

SEQ ID NO: 145784 - DNA, 8 bp, Unknown
  misc_feature (1)..( 8): Result.004 file - promoters60/5662921
tggtgtgt

SEQ ID NO: 145785 - DNA, 8 bp, Unknown
  misc_feature (1)..( 8): Result.004 file - promoters60/5662921
tggcgtgt

SEQ ID NO: 145786 - DNA, 8 bp, Unknown
  misc_feature (1)..( 8): Result.004 file - promoters60/5662921
caatctta

SEQ ID NO: 145787 - DNA, 8 bp, Unknown
  misc_feature (1)..( 8): Result.004 file - promoters60/5662921
aaatttta

SEQ ID NO: 145788 - DNA, 8 bp, Unknown
  misc_feature (1)..( 8): Result.004 file - promoters60/5662921
aaatttgt

SEQ ID NO: 145789 - DNA, 8 bp, Unknown
  misc_feature (1)..( 8): Result.004 file - promoters60/5662921
tatttaaa

SEQ ID NO: 145790 - DNA, 8 bp, Unknown
  misc_feature (1)..( 8): Result.004 file - promoters60/5662921
tatataaa

SEQ ID NO: 145791 - DNA, 7 bp, Unknown
  misc_feature (1)..( 7): Result.004 file - promoters60/5662921
aataatt

SEQ ID NO: 145792 - DNA, 7 bp, Unknown
  misc_feature (1)..( 7): Result.004 file - promoters60/5662921
aattatt

SEQ ID NO: 145793 - DNA, 7 bp, Unknown
  misc_feature (1)..( 7): Result.004 file - promoters60/5662921
taaaaaa

SEQ ID NO: 145794 - DNA, 7 bp, Unknown
  misc_feature (1)..( 7): Result.004 file - promoters60/5662921
taaaaaa

SEQ ID NO: 145795 - DNA, 6 bp, Unknown
  misc_feature (1)..( 6): Result.004 file - promoters60/5662921
gttcaa

SEQ ID NO: 145796 - DNA, 6 bp, Unknown
  misc_feature (1)..( 6): Result.004 file - promoters60/5662921
gttcaa

SEQ ID NO: 145797 - DNA, 6 bp, Unknown
  misc_feature (1)..( 6): Result.004 file - promoters60/5662921
ttttgg

SEQ ID NO: 145798 - DNA, 6 bp, Unknown
  misc_feature (1)..( 6): Result.004 file - promoters60/5662921
ttttgg

SEQ ID NO: 145799 - DNA, 8 bp, Unknown
  misc_feature (1)..( 8): Result.004 file - promoters60/5662921
ttgttttt

SEQ ID NO: 145800 - DNA, 8 bp, Unknown
  misc_feature (1)..( 8): Result.004 file - promoters60/5662921
ttggtttt

SEQ ID NO: 145801 - DNA, 8 bp, Unknown
  misc_feature (1)..( 8): Result.004 file - promoters60/5662921
aaacaaaa

SEQ ID NO: 145802 - DNA, 8 bp, Unknown
  misc_feature (1)..( 8): Result.004 file - promoters60/5662921
aaaaaaaa

SEQ ID NO: 145803 - DNA, 8 bp, Unknown
  misc_feature (1)..( 8): Result.004 file - promoters60/5662921
atacacaa

SEQ ID NO: 145804 - DNA, 8 bp, Unknown
  misc_feature (1)..( 8): Result.004 file - promoters60/5662921
atagacaa

SEQ ID NO: 145805 - DNA, 7 bp, Unknown
  misc_feature (1)..( 7): Result.004 file - promoters60/5662921
attataa

SEQ ID NO: 145806 - DNA, 7 bp, Unknown
  misc_feature (1)..( 7): Result.004 file - promoters60/5662921
attataa

SEQ ID NO: 145807 - DNA, 7 bp, Unknown
  misc_feature (1)..( 7): Result.004 file - promoters60/5662921
gtccttt

SEQ ID NO: 145808 - DNA, 7 bp, Unknown
  misc_feature (1)..( 7): Result.004 file - promoters60/5662921
gtctttt

SEQ ID NO: 145809 - DNA, 6 bp, Unknown
  misc_feature (1)..( 6): Result.004 file - promoters60/5662921
ttaaaa

SEQ ID NO: 145810 - DNA, 6 bp, Unknown
  misc_feature (1)..( 6): Result.004 file - promoters60/5662921
ttaaaa

SEQ ID NO: 145811 - DNA, 6 bp, Unknown
  misc_feature (1)..( 6): Result.004 file - promoters60/5662921
gaataa

SEQ ID NO: 145812 - DNA, 6 bp, Unknown
  misc_feature (1)..( 6): Result.004 file - promoters60/5662921
gaataa

SEQ ID NO: 145813 - DNA, 6 bp, Unknown
  misc_feature (1)..( 6): Result.004 file - promoters60/5662921
gagaga

SEQ ID NO: 145814 - DNA, 6 bp, Unknown
  misc_feature (1)..( 6): Result.004 file - promoters60/5662945
gagaga

SEQ ID NO: 145815 - DNA, 9 bp, Unknown
  misc_feature (1)..( 9): Result.004 file - promoters60/5662945
gaatgtgaa

SEQ ID NO: 145816 - DNA, 9 bp, Unknown
  misc_feature (1)..( 9): Result.004 file - promoters60/5662945
gaatttgaa

SEQ ID NO: 145817 - DNA, 7 bp, Unknown
  misc_feature (1)..( 7): Result.004 file - promoters60/5662945
ccaagaa

SEQ ID NO: 145818 - DNA, 7 bp, Unknown
  misc_feature (1)..( 7): Result.004 file - promoters60/5662945
ccaagaa

SEQ ID NO: 145819 - DNA, 7 bp, Unknown
  misc_feature (1)..( 7): Result.004 file - promoters60/5662945
ccaagat

SEQ ID NO: 145820 - DNA, 6 bp, Unknown
  misc_feature (1)..( 6): Result.004 file - promoters60/5662945
tttcct

SEQ ID NO: 145821 - DNA, 6 bp, Unknown
  misc_feature (1)..( 6): Result.004 file - promoters60/5662945
tttcct

SEQ ID NO: 145822 - DNA, 7 bp, Unknown
  misc_feature (1)..( 7): Result.004 file - promoters60/5662945
agaatct

SEQ ID NO: 145823 - DNA, 7 bp, Unknown
  misc_feature (1)..( 7): Result.004 file - promoters60/5662945
agagtct

SEQ ID NO: 145824 - DNA, 8 bp, Unknown
  misc_feature (1)..( 8): Result.004 file - promoters60/5662945
ttgtagaa

SEQ ID NO: 145825 - DNA, 8 bp, Unknown
  misc_feature (1)..( 8): Result.004 file - promoters60/5662945
ttgcagaa

SEQ ID NO: 145826 - DNA, 6 bp, Unknown
  misc_feature (1)..( 6): Result.004 file - promoters60/5662945
caaaac

SEQ ID NO: 145827 - DNA, 6 bp, Unknown
  misc_feature (1)..( 6): Result.004 file - promoters60/5662945
caaaac

SEQ ID NO: 145828 - DNA, 8 bp, Unknown
  misc_feature (1)..( 8): Result.004 file - promoters60/5662945
attgtttg

SEQ ID NO: 145829 - DNA, 8 bp, Unknown
  misc_feature (1)..( 8): Result.004 file - promoters60/5662945
attatttg

SEQ ID NO: 145830 - DNA, 8 bp, Unknown
  misc_feature (1)..( 8): Result.004 file - promoters60/5662945
tttgtttg

SEQ ID NO: 145831 - DNA, 7 bp, Unknown
  misc_feature (1)..( 7): Result.004 file - promoters60/5662945
caactga

SEQ ID NO: 145832 - DNA, 7 bp, Unknown
  misc_feature (1)..( 7): Result.004 file - promoters60/5662945
caaatga

SEQ ID NO: 145833 - DNA, 8 bp, Unknown
  misc_feature (1)..( 8): Result.004 file - promoters60/5662945
acacgtgg

SEQ ID NO: 145834 - DNA, 8 bp, Unknown
  misc_feature (1)..( 8): Result.004 file - promoters60/5662945
acatgtgg

SEQ ID NO: 145835 - DNA, 6 bp, Unknown
  misc_feature (1)..( 6): Result.004 file - promoters60/5662945
ttgttt

SEQ ID NO: 145836 - DNA, 6 bp, Unknown
  misc_feature (1)..( 6): Result.004 file - promoters60/5662945
ttgttt

SEQ ID NO: 145837 - DNA, 6 bp, Unknown
  misc_feature (1)..( 6): Result.004 file - promoters60/5662945
tttctt

SEQ ID NO: 145838 - DNA, 6 bp, Unknown
  misc_feature (1)..( 6): Result.004 file - promoters60/5662945
tttctt

SEQ ID NO: 145839 - DNA, 10 bp, Unknown
  misc_feature (1)..( 10): Result.004 file - promoters60/5662945
gtcatattga

SEQ ID NO: 145840 - DNA, 10 bp, Unknown
  misc_feature (1)..( 10): Result.004 file - promoters60/5662945
gtcattttga

SEQ ID NO: 145841 - DNA, 6 bp, Unknown
  misc_feature (1)..( 6): Result.004 file - promoters60/5662945
aattga

SEQ ID NO: 145842 - DNA, 6 bp, Unknown
  misc_feature (1)..( 6): Result.004 file - promoters60/5662945
aattga

SEQ ID NO: 145843 - DNA, 6 bp, Unknown
  misc_feature (1)..( 6): Result.004 file - promoters60/5662945
ctacct

SEQ ID NO: 145844 - DNA, 6 bp, Unknown
  misc_feature (1)..( 6): Result.004 file - promoters60/5662945
ctacct

SEQ ID NO: 145845 - DNA, 9 bp, Unknown
  misc_feature (1)..( 9): Result.004 file - promoters60/5662945
acgtgaccg

SEQ ID NO: 145846 - DNA, 9 bp, Unknown
  misc_feature (1)..( 9): Result.004 file - promoters60/5662948
acgtaaccg

SEQ ID NO: 145847 - DNA, 6 bp, Unknown
  misc_feature (1)..( 6): Result.004 file - promoters60/5662948
ggaacc

SEQ ID NO: 145848 - DNA, 6 bp, Unknown
  misc_feature (1)..( 6): Result.004 file - promoters60/5662948
ggaacc

SEQ ID NO: 145849 - DNA, 10 bp, Unknown
  misc_feature (1)..( 10): Result.004 file - promoters60/5662948
tatcactgca

SEQ ID NO: 145850 - DNA, 10 bp, Unknown
  misc_feature (1)..( 10): Result.004 file - promoters60/5662948
tatctctgca

SEQ ID NO: 145851 - DNA, 7 bp, Unknown
  misc_feature (1)..( 7): Result.004 file - promoters60/5662948
tgtcgtt

SEQ ID NO: 145852 - DNA, 7 bp, Unknown
  misc_feature (1)..( 7): Result.004 file - promoters60/5662948
tgtggtt

SEQ ID NO: 145853 - DNA, 6 bp, Unknown
  misc_feature (1)..( 6): Result.004 file - promoters60/5662948
aagata

SEQ ID NO: 145854 - DNA, 6 bp, Unknown
  misc_feature (1)..( 6): Result.004 file - promoters60/5662948
aagata

SEQ ID NO: 145855 - DNA, 10 bp, Unknown
  misc_feature (1)..( 10): Result.004 file - promoters60/5662948
tacgatcatc

SEQ ID NO: 145856 - DNA, 10 bp, Unknown
  misc_feature (1)..( 10): Result.004 file - promoters60/5662948
tactatcatc

SEQ ID NO: 145857 - DNA, 7 bp, Unknown
  misc_feature (1)..( 7): Result.004 file - promoters60/5662948
tcttgta

SEQ ID NO: 145858 - DNA, 7 bp, Unknown
  misc_feature (1)..( 7): Result.004 file - promoters60/5662948
tctggta

SEQ ID NO: 145859 - DNA, 7 bp, Unknown
  misc_feature (1)..( 7): Result.004 file - promoters60/5662948
tttgttg

SEQ ID NO: 145860 - DNA, 7 bp, Unknown
  misc_feature (1)..( 7): Result.004 file - promoters60/5662948
tttcttg

SEQ ID NO: 145861 - DNA, 6 bp, Unknown
  misc_feature (1)..( 6): Result.004 file - promoters60/5662948
tccatt

SEQ ID NO: 145862 - DNA, 6 bp, Unknown
  misc_feature (1)..( 6): Result.004 file - promoters60/5662948
tccatt

SEQ ID NO: 145863 - DNA, 9 bp, Unknown
  misc_feature (1)..( 9): Result.004 file - promoters60/5662948
tttattgtt

SEQ ID NO: 145864 - DNA, 9 bp, Unknown
  misc_feature (1)..( 9): Result.004 file - promoters60/5662948
ttttttgtt

SEQ ID NO: 145865 - DNA, 7 bp, Unknown
  misc_feature (1)..( 7): Result.004 file - promoters60/5662948
caagatt

SEQ ID NO: 145866 - DNA, 7 bp, Unknown
  misc_feature (1)..( 7): Result.004 file - promoters60/5662948
caatatt

SEQ ID NO: 145867 - DNA, 7 bp, Unknown
  misc_feature (1)..( 7): Result.004 file - promoters60/5662948
acatgtt

SEQ ID NO: 145868 - DNA, 7 bp, Unknown
  misc_feature (1)..( 7): Result.004 file - promoters60/5662967
acaagtt

SEQ ID NO: 145869 - DNA, 11 bp, Unknown
  misc_feature (1)..( 11): Result.004 file - promoters60/5662967
aaaatattaac

SEQ ID NO: 145870 - DNA, 11 bp, Unknown
  misc_feature (1)..( 11): Result.004 file - promoters60/5662967
taaaaattaaa

SEQ ID NO: 145871 - DNA, 11 bp, Unknown
  misc_feature (1)..( 11): Result.004 file - promoters60/5662967
ggattattaac

SEQ ID NO: 145872 - DNA, 11 bp, Unknown
  misc_feature (1)..( 11): Result.004 file - promoters60/5662967
gtaaaatttca

SEQ ID NO: 145873 - DNA, 11 bp, Unknown
  misc_feature (1)..( 11): Result.004 file - promoters60/5662967
taacaattcta

SEQ ID NO: 145874 - DNA, 11 bp, Unknown
  misc_feature (1)..( 11): Result.004 file - promoters60/5662967
gaacaagtctc

SEQ ID NO: 145875 - DNA, 11 bp, Unknown
  misc_feature (1)..( 11): Result.004 file - promoters60/5662967
taacaaaaaag

SEQ ID NO: 145876 - DNA, 15 bp, Unknown
  misc_feature (1)..( 15): Result.004 file - promoters60/5662967
taaccttgagtttag

SEQ ID NO: 145877 - DNA, 15 bp, Unknown
  misc_feature (1)..( 15): Result.004 file - promoters60/5662967
agttggatagtttaa

SEQ ID NO: 145878 - DNA, 15 bp, Unknown
  misc_feature (1)..( 15): Result.004 file - promoters60/5662967
caactatgactttat

SEQ ID NO: 145879 - DNA, 15 bp, Unknown
  misc_feature (1)..( 15): Result.004 file - promoters60/5662967
gtagattgatttttg

SEQ ID NO: 145880 - DNA, 15 bp, Unknown
  misc_feature (1)..( 15): Result.004 file - promoters60/5662967
caactaagactgagc

SEQ ID NO: 145881 - DNA, 15 bp, Unknown
  misc_feature (1)..( 15): Result.004 file - promoters60/5662967
gcacaatgatggatt

SEQ ID NO: 145882 - DNA, 9 bp, Unknown
  misc_feature (1)..( 9): Result.004 file - promoters60/5662967
aaaaataaa

SEQ ID NO: 145883 - DNA, 9 bp, Unknown
  misc_feature (1)..( 9): Result.004 file - promoters60/5662967
aaaattaat

SEQ ID NO: 145884 - DNA, 9 bp, Unknown
  misc_feature (1)..( 9): Result.004 file - promoters60/5662967
taaaataca

SEQ ID NO: 145885 - DNA, 9 bp, Unknown
  misc_feature (1)..( 9): Result.004 file - promoters60/5662967
gataatatt

SEQ ID NO: 145886 - DNA, 9 bp, Unknown
  misc_feature (1)..( 9): Result.004 file - promoters60/5662967
tatattaat

SEQ ID NO: 145887 - DNA, 9 bp, Unknown
  misc_feature (1)..( 9): Result.004 file - promoters60/5662967
aaaattcct

SEQ ID NO: 145888 - DNA, 10 bp, Unknown
  misc_feature (1)..( 10): Result.004 file - promoters60/5662967
aaataaaagc

SEQ ID NO: 145889 - DNA, 10 bp, Unknown
  misc_feature (1)..( 10): Result.004 file - promoters60/5662967
caataaaatt

SEQ ID NO: 145890 - DNA, 10 bp, Unknown
  misc_feature (1)..( 10): Result.004 file - promoters60/5662967
ttataaaata

SEQ ID NO: 145891 - DNA, 10 bp, Unknown
  misc_feature (1)..( 10): Result.004 file - promoters60/5662967
agataatatt

SEQ ID NO: 145892 - DNA, 10 bp, Unknown
  misc_feature (1)..( 10): Result.004 file - promoters60/5662967
caaaaaactt

SEQ ID NO: 145893 - DNA, 10 bp, Unknown
  misc_feature (1)..( 10): Result.004 file - promoters60/5662967
atatagttct

SEQ ID NO: 145894 - DNA, 9 bp, Unknown
  misc_feature (1)..( 9): Result.004 file - promoters60/5662967
aaaaacaaa

SEQ ID NO: 145895 - DNA, 9 bp, Unknown
  misc_feature (1)..( 9): Result.004 file - promoters60/5662967
ataaataaa

SEQ ID NO: 145896 - DNA, 9 bp, Unknown
  misc_feature (1)..( 9): Result.004 file - promoters60/5662967
tcaaacaaa

SEQ ID NO: 145897 - DNA, 9 bp, Unknown
  misc_feature (1)..( 9): Result.004 file - promoters60/5662967
ttaaaaaaa

SEQ ID NO: 145898 - DNA, 9 bp, Unknown
  misc_feature (1)..( 9): Result.004 file - promoters60/5662967
ttaactaat

SEQ ID NO: 145899 - DNA, 9 bp, Unknown
  misc_feature (1)..( 9): Result.004 file - promoters60/5662967
ttaaaaatg

SEQ ID NO: 145900 - DNA, 12 bp, Unknown
  misc_feature (1)..( 12): Result.004 file - promoters60/5662967
tcatattattag

SEQ ID NO: 145901 - DNA, 12 bp, Unknown
  misc_feature (1)..( 12): Result.004 file - promoters60/5662967
aaatattattag

SEQ ID NO: 145902 - DNA, 12 bp, Unknown
  misc_feature (1)..( 12): Result.004 file - promoters60/5662967
tgttattatatt

SEQ ID NO: 145903 - DNA, 12 bp, Unknown
  misc_feature (1)..( 12): Result.004 file - promoters60/5662967
tgatataattat

SEQ ID NO: 145904 - DNA, 12 bp, Unknown
  misc_feature (1)..( 12): Result.004 file - promoters60/5662967
tcatattcgtat

SEQ ID NO: 145905 - DNA, 12 bp, Unknown
  misc_feature (1)..( 12): Result.004 file - promoters60/5662967
gaatattactaa

SEQ ID NO: 145906 - DNA, 12 bp, Unknown
  misc_feature (1)..( 12): Result.004 file - promoters60/5662967
gattatcatttt

SEQ ID NO: 145907 - DNA, 7 bp, Unknown
  misc_feature (1)..( 7): Result.004 file - promoters60/5662967
tttgttt

SEQ ID NO: 145908 - DNA, 7 bp, Unknown
  misc_feature (1)..( 7): Result.004 file - promoters60/5662967
tttattt

SEQ ID NO: 145909 - DNA, 7 bp, Unknown
  misc_feature (1)..( 7): Result.004 file - promoters60/5662967
tttgttt

SEQ ID NO: 145910 - DNA, 7 bp, Unknown
  misc_feature (1)..( 7): Result.004 file - promoters60/5662967
tttgttt

SEQ ID NO: 145911 - DNA, 7 bp, Unknown
  misc_feature (1)..( 7): Result.004 file - promoters60/5662967
tatgtct

SEQ ID NO: 145912 - DNA, 8 bp, Unknown
  misc_feature (1)..( 8): Result.004 file - promoters60/5662967
tttcattt

SEQ ID NO: 145913 - DNA, 8 bp, Unknown
  misc_feature (1)..( 8): Result.004 file - promoters60/5662967
ttttataa

SEQ ID NO: 145914 - DNA, 13 bp, Unknown
  misc_feature (1)..( 13): Result.004 file - promoters60/5662967
gtttccaatatgt

SEQ ID NO: 145915 - DNA, 13 bp, Unknown
  misc_feature (1)..( 13): Result.004 file - promoters60/5662967
gtttcaaatacaa

SEQ ID NO: 145916 - DNA, 13 bp, Unknown
  misc_feature (1)..( 13): Result.004 file - promoters60/5662967
agatcaaataggt

SEQ ID NO: 145917 - DNA, 13 bp, Unknown
  misc_feature (1)..( 13): Result.004 file - promoters60/5662967
gaaaaaaagacaa

SEQ ID NO: 145918 - DNA, 13 bp, Unknown
  misc_feature (1)..( 13): Result.004 file - promoters60/5662967
aagcaaaatagaa

SEQ ID NO: 145919 - DNA, 13 bp, Unknown
  misc_feature (1)..( 13): Result.004 file - promoters60/5662967
ggtcacaatatat

SEQ ID NO: 145920 - DNA, 11 bp, Unknown
  misc_feature (1)..( 11): Result.004 file - promoters60/5662967
aaaaactaatg

SEQ ID NO: 145921 - DNA, 11 bp, Unknown
  misc_feature (1)..( 11): Result.004 file - promoters60/5662967
gaaaactcatt

SEQ ID NO: 145922 - DNA, 12 bp, Unknown
  misc_feature (1)..( 12): Result.004 file - promoters60/5662967
gtgaaagtaatg

SEQ ID NO: 145923 - DNA, 12 bp, Unknown
  misc_feature (1)..( 12): Result.004 file - promoters60/5662967
aaataactaata

SEQ ID NO: 145924 - DNA, 12 bp, Unknown
  misc_feature (1)..( 12): Result.004 file - promoters60/5662967
attaaagtcaca

SEQ ID NO: 145925 - DNA, 12 bp, Unknown
  misc_feature (1)..( 12): Result.004 file - promoters60/5662977
aaataaacaaaa

SEQ ID NO: 145926 - DNA, 7 bp, Unknown
  misc_feature (1)..( 7): Result.004 file - promoters60/5662977
gttcctt

SEQ ID NO: 145927 - DNA, 7 bp, Unknown
  misc_feature (1)..( 7): Result.004 file - promoters60/5662977
gtttctt

SEQ ID NO: 145928 - DNA, 7 bp, Unknown
  misc_feature (1)..( 7): Result.004 file - promoters60/5662977
gttcctc

SEQ ID NO: 145929 - DNA, 8 bp, Unknown
  misc_feature (1)..( 8): Result.004 file - promoters60/5662977
aaatgtta

SEQ ID NO: 145930 - DNA, 8 bp, Unknown
  misc_feature (1)..( 8): Result.004 file - promoters60/5662977
aaaagttt

SEQ ID NO: 145931 - DNA, 8 bp, Unknown
  misc_feature (1)..( 8): Result.004 file - promoters60/5662977
caatttta

SEQ ID NO: 145932 - DNA, 7 bp, Unknown
  misc_feature (1)..( 7): Result.004 file - promoters60/5662977
gttgatt

SEQ ID NO: 145933 - DNA, 7 bp, Unknown
  misc_feature (1)..( 7): Result.004 file - promoters60/5662977
gttgatg

SEQ ID NO: 145934 - DNA, 7 bp, Unknown
  misc_feature (1)..( 7): Result.004 file - promoters60/5662977
gttaatt

SEQ ID NO: 145935 - DNA, 8 bp, Unknown
  misc_feature (1)..( 8): Result.004 file - promoters60/5662977
cgacatgt

SEQ ID NO: 145936 - DNA, 8 bp, Unknown
  misc_feature (1)..( 8): Result.004 file - promoters60/5662977
cgacatta

SEQ ID NO: 145937 - DNA, 8 bp, Unknown
  misc_feature (1)..( 8): Result.004 file - promoters60/5662977
cgacatgt

SEQ ID NO: 145938 - DNA, 8 bp, Unknown
  misc_feature (1)..( 8): Result.004 file - promoters60/5662977
acacatgt

SEQ ID NO: 145939 - DNA, 6 bp, Unknown
  misc_feature (1)..( 6): Result.004 file - promoters60/5662977
acatgt

SEQ ID NO: 145940 - DNA, 6 bp, Unknown
  misc_feature (1)..( 6): Result.004 file - promoters60/5662977
acatgt

SEQ ID NO: 145941 - DNA, 6 bp, Unknown
  misc_feature (1)..( 6): Result.004 file - promoters60/5662992
acatgt

SEQ ID NO: 145942 - DNA, 6 bp, Unknown
  misc_feature (1)..( 6): Result.004 file - promoters60/5662992
tatttc

SEQ ID NO: 145943 - DNA, 6 bp, Unknown
  misc_feature (1)..( 6): Result.004 file - promoters60/5662992
tatttc

SEQ ID NO: 145944 - DNA, 6 bp, Unknown
  misc_feature (1)..( 6): Result.004 file - promoters60/5662992
acattt

SEQ ID NO: 145945 - DNA, 6 bp, Unknown
  misc_feature (1)..( 6): Result.004 file - promoters60/5662992
acattt

SEQ ID NO: 145946 - DNA, 9 bp, Unknown
  misc_feature (1)..( 9): Result.004 file - promoters60/5662992
atttatata

SEQ ID NO: 145947 - DNA, 9 bp, Unknown
  misc_feature (1)..( 9): Result.004 file - promoters60/5662992
attaatatc

SEQ ID NO: 145948 - DNA, 9 bp, Unknown
  misc_feature (1)..( 9): Result.004 file - promoters60/5662992
aattatata

SEQ ID NO: 145949 - DNA, 8 bp, Unknown
  misc_feature (1)..( 8): Result.004 file - promoters60/5662992
ctatttaa

SEQ ID NO: 145950 - DNA, 8 bp, Unknown
  misc_feature (1)..( 8): Result.004 file - promoters60/5662992
atatataa

SEQ ID NO: 145951 - DNA, 8 bp, Unknown
  misc_feature (1)..( 8): Result.004 file - promoters60/5662992
atatatta

SEQ ID NO: 145952 - DNA, 7 bp, Unknown
  misc_feature (1)..( 7): Result.004 file - promoters60/5662992
ttcgttt

SEQ ID NO: 145953 - DNA, 7 bp, Unknown
  misc_feature (1)..( 7): Result.004 file - promoters60/5662992
ttctttt

SEQ ID NO: 145954 - DNA, 8 bp, Unknown
  misc_feature (1)..( 8): Result.004 file - promoters60/5662992
attttact

SEQ ID NO: 145955 - DNA, 8 bp, Unknown
  misc_feature (1)..( 8): Result.004 file - promoters60/5662992
attttaaa

SEQ ID NO: 145956 - DNA, 8 bp, Unknown
  misc_feature (1)..( 8): Result.004 file - promoters60/5662992
gttttaaa

SEQ ID NO: 145957 - DNA, 11 bp, Unknown
  misc_feature (1)..( 11): Result.004 file - promoters60/5662992
tcacaatttac

SEQ ID NO: 145958 - DNA, 11 bp, Unknown
  misc_feature (1)..( 11): Result.004 file - promoters60/5662992
aactaatttaa

SEQ ID NO: 145959 - DNA, 11 bp, Unknown
  misc_feature (1)..( 11): Result.004 file - promoters60/5662992
aacaaatgtaa

SEQ ID NO: 145960 - DNA, 6 bp, Unknown
  misc_feature (1)..( 6): Result.004 file - promoters60/5662992
atataa

SEQ ID NO: 145961 - DNA, 6 bp, Unknown
  misc_feature (1)..( 6): Result.004 file - promoters60/5662992
atataa

SEQ ID NO: 145962 - DNA, 10 bp, Unknown
  misc_feature (1)..( 10): Result.004 file - promoters60/5662992
aattattttc

SEQ ID NO: 145963 - DNA, 10 bp, Unknown
  misc_feature (1)..( 10): Result.004 file - promoters60/5662992
aatttttttc

SEQ ID NO: 145964 - DNA, 6 bp, Unknown
  misc_feature (1)..( 6): Result.004 file - promoters60/5662992
tttggt

SEQ ID NO: 145965 - DNA, 6 bp, Unknown
  misc_feature (1)..( 6): Result.004 file - promoters60/5662992
tttggt

SEQ ID NO: 145966 - DNA, 7 bp, Unknown
  misc_feature (1)..( 7): Result.004 file - promoters60/5662992
tcttaaa

SEQ ID NO: 145967 - DNA, 7 bp, Unknown
  misc_feature (1)..( 7): Result.004 file - promoters60/5662992
tctaaaa

SEQ ID NO: 145968 - DNA, 6 bp, Unknown
  misc_feature (1)..( 6): Result.004 file - promoters60/5662992
gtaact

SEQ ID NO: 145969 - DNA, 6 bp, Unknown
  misc_feature (1)..( 6): Result.004 file - promoters60/5662992
gtaact

SEQ ID NO: 145970 - DNA, 6 bp, Unknown
  misc_feature (1)..( 6): Result.004 file - promoters60/5662992
cgaaaa

SEQ ID NO: 145971 - DNA, 6 bp, Unknown
  misc_feature (1)..( 6): Result.004 file - promoters60/5662992
cgaaaa

SEQ ID NO: 145972 - DNA, 7 bp, Unknown
  misc_feature (1)..( 7): Result.004 file - promoters60/5662992
aaattat

SEQ ID NO: 145973 - DNA, 7 bp, Unknown
  misc_feature (1)..( 7): Result.004 file - promoters60/5662992
aaaatat

SEQ ID NO: 145974 - DNA, 6 bp, Unknown
  misc_feature (1)..( 6): Result.004 file - promoters60/5662992
tatttt

SEQ ID NO: 145975 - DNA, 6 bp, Unknown
  misc_feature (1)..( 6): Result.004 file - promoters60/5662992
tatttt

SEQ ID NO: 145976 - DNA, 7 bp, Unknown
  misc_feature (1)..( 7): Result.004 file - promoters60/5662992
tttccta

SEQ ID NO: 145977 - DNA, 7 bp, Unknown
  misc_feature (1)..( 7): Result.004 file - promoters60/5662992
ttttcta

SEQ ID NO: 145978 - DNA, 10 bp, Unknown
  misc_feature (1)..( 10): Result.004 file - promoters60/5662992
taattagaaa

SEQ ID NO: 145979 - DNA, 10 bp, Unknown
  misc_feature (1)..( 10): Result.004 file - promoters60/5662992
taattcgaaa

SEQ ID NO: 145980 - DNA, 6 bp, Unknown
  misc_feature (1)..( 6): Result.004 file - promoters60/5662992
aaacat

SEQ ID NO: 145981 - DNA, 6 bp, Unknown
  misc_feature (1)..( 6): Result.004 file - promoters60/5662999
aaacat

SEQ ID NO: 145982 - DNA, 9 bp, Unknown
  misc_feature (1)..( 9): Result.004 file - promoters60/5662999
tagagaatg

SEQ ID NO: 145983 - DNA, 9 bp, Unknown
  misc_feature (1)..( 9): Result.004 file - promoters60/5662999
tagacaatg

SEQ ID NO: 145984 - DNA, 7 bp, Unknown
  misc_feature (1)..( 7): Result.004 file - promoters60/5662999
gatgttg

SEQ ID NO: 145985 - DNA, 7 bp, Unknown
  misc_feature (1)..( 7): Result.004 file - promoters60/5662999
gatgttg

SEQ ID NO: 145986 - DNA, 7 bp, Unknown
  misc_feature (1)..( 7): Result.004 file - promoters60/5662999
ctggttc

SEQ ID NO: 145987 - DNA, 7 bp, Unknown
  misc_feature (1)..( 7): Result.004 file - promoters60/5662999
ctgcttc

SEQ ID NO: 145988 - DNA, 7 bp, Unknown
  misc_feature (1)..( 7): Result.004 file - promoters60/5662999
ctgaatc

SEQ ID NO: 145989 - DNA, 7 bp, Unknown
  misc_feature (1)..( 7): Result.004 file - promoters60/5662999
ctgcatc

SEQ ID NO: 145990 - DNA, 7 bp, Unknown
  misc_feature (1)..( 7): Result.004 file - promoters60/5662999
tgtatag

SEQ ID NO: 145991 - DNA, 7 bp, Unknown
  misc_feature (1)..( 7): Result.004 file - promoters60/5662999
tgtatag

SEQ ID NO: 145992 - DNA, 7 bp, Unknown
  misc_feature (1)..( 7): Result.004 file - promoters60/5662999
aataagt

SEQ ID NO: 145993 - DNA, 7 bp, Unknown
  misc_feature (1)..( 7): Result.004 file - promoters60/5662999
aatgagt

SEQ ID NO: 145994 - DNA, 7 bp, Unknown
  misc_feature (1)..( 7): Result.004 file - promoters60/5662999
caaaaga

SEQ ID NO: 145995 - DNA, 7 bp, Unknown
  misc_feature (1)..( 7): Result.004 file - promoters60/5662999
caagaga

SEQ ID NO: 145996 - DNA, 7 bp, Unknown
  misc_feature (1)..( 7): Result.004 file - promoters60/5662999
ctcctca

SEQ ID NO: 145997 - DNA, 7 bp, Unknown
  misc_feature (1)..( 7): Result.004 file - promoters60/5662999
ctcttca

SEQ ID NO: 145998 - DNA, 6 bp, Unknown
  misc_feature (1)..( 6): Result.004 file - promoters60/5662999
atataa

SEQ ID NO: 145999 - DNA, 6 bp, Unknown
  misc_feature (1)..( 6): Result.004 file - promoters60/5662999
atataa

SEQ ID NO: 146000 - DNA, 6 bp, Unknown
  misc_feature (1)..( 6): Result.004 file - promoters60/5662999
aatctg

SEQ ID NO: 146001 - DNA, 6 bp, Unknown
  misc_feature (1)..( 6): Result.004 file - promoters60/5662999
aatctg

SEQ ID NO: 146002 - DNA, 7 bp, Unknown
  misc_feature (1)..( 7): Result.004 file - promoters60/5662999
tttttaa

SEQ ID NO: 146003 - DNA, 7 bp, Unknown
  misc_feature (1)..( 7): Result.004 file - promoters60/5662999
tttttaa

SEQ ID NO: 146004 - DNA, 8 bp, Unknown
  misc_feature (1)..( 8): Result.004 file - promoters60/5662999
acatttta

SEQ ID NO: 146005 - DNA, 8 bp, Unknown
  misc_feature (1)..( 8): Result.004 file - promoters60/5662999
acaattta

SEQ ID NO: 146006 - DNA, 7 bp, Unknown
  misc_feature (1)..( 7): Result.004 file - promoters60/5662999
caagaaa

SEQ ID NO: 146007 - DNA, 7 bp, Unknown
  misc_feature (1)..( 7): Result.004 file - promoters60/5662999
caataaa

SEQ ID NO: 146008 - DNA, 9 bp, Unknown
  misc_feature (1)..( 9): Result.004 file - promoters60/5662999
aaaagagta

SEQ ID NO: 146009 - DNA, 9 bp, Unknown
  misc_feature (1)..( 9): Result.004 file - promoters60/5662999
aaaagggta

SEQ ID NO: 146010 - DNA, 6 bp, Unknown
  misc_feature (1)..( 6): Result.004 file - promoters60/5662999
ttttgt

SEQ ID NO: 146011 - DNA, 6 bp, Unknown
  misc_feature (1)..( 6): Result.004 file - promoters60/5662999
ttttgt

SEQ ID NO: 146012 - DNA, 8 bp, Unknown
  misc_feature (1)..( 8): Result.004 file - promoters60/5662999
attgcata

SEQ ID NO: 146013 - DNA, 8 bp, Unknown
  misc_feature (1)..( 8): Result.004 file - promoters60/5662999
attgtata

SEQ ID NO: 146014 - DNA, 7 bp, Unknown
  misc_feature (1)..( 7): Result.004 file - promoters60/5662999
tggagtg

SEQ ID NO: 146015 - DNA, 7 bp, Unknown
  misc_feature (1)..( 7): Result.004 file - promoters60/5662999
tggtgtg

SEQ ID NO: 146016 - DNA, 6 bp, Unknown
  misc_feature (1)..( 6): Result.004 file - promoters60/5662999
catatt

SEQ ID NO: 146017 - DNA, 6 bp, Unknown
  misc_feature (1)..( 6): Result.004 file - promoters60/5662999
catatt

SEQ ID NO: 146018 - DNA, 6 bp, Unknown
  misc_feature (1)..( 6): Result.004 file - promoters60/5662999
tttact

SEQ ID NO: 146019 - DNA, 6 bp, Unknown
  misc_feature (1)..( 6): Result.004 file - promoters60/5662999
tttact

SEQ ID NO: 146020 - DNA, 6 bp, Unknown
  misc_feature (1)..( 6): Result.004 file - promoters60/5662999
ttttgt

SEQ ID NO: 146021 - DNA, 6 bp, Unknown
  misc_feature (1)..( 6): Result.004 file - promoters60/5662999
ttttgt

SEQ ID NO: 146022 - DNA, 10 bp, Unknown
  misc_feature (1)..( 10): Result.004 file - promoters60/5662999
agttattctc

SEQ ID NO: 146023 - DNA, 10 bp, Unknown
  misc_feature (1)..( 10): Result.004 file - promoters60/5663003
agttaatctc

SEQ ID NO: 146024 - DNA, 12 bp, Unknown
  misc_feature (1)..( 12): Result.004 file - promoters60/5663003
ccctctcttcct

SEQ ID NO: 146025 - DNA, 12 bp, Unknown
  misc_feature (1)..( 12): Result.004 file - promoters60/5663003
ttctcttttcct

SEQ ID NO: 146026 - DNA, 12 bp, Unknown
  misc_feature (1)..( 12): Result.004 file - promoters60/5663003
acctcttttggg

SEQ ID NO: 146027 - DNA, 12 bp, Unknown
  misc_feature (1)..( 12): Result.004 file - promoters60/5663003
accccttagccg

SEQ ID NO: 146028 - DNA, 8 bp, Unknown
  misc_feature (1)..( 8): Result.004 file - promoters60/5663003
taaaacaa

SEQ ID NO: 146029 - DNA, 8 bp, Unknown
  misc_feature (1)..( 8): Result.004 file - promoters60/5663003
aaaaacag

SEQ ID NO: 146030 - DNA, 8 bp, Unknown
  misc_feature (1)..( 8): Result.004 file - promoters60/5663003
agaaacaa

SEQ ID NO: 146031 - DNA, 8 bp, Unknown
  misc_feature (1)..( 8): Result.004 file - promoters60/5663003
aaaaacaa

SEQ ID NO: 146032 - DNA, 13 bp, Unknown
  misc_feature (1)..( 13): Result.004 file - promoters60/5663003
ctaaaatagtaaa

SEQ ID NO: 146033 - DNA, 13 bp, Unknown
  misc_feature (1)..( 13): Result.004 file - promoters60/5663003
aaataattgtata

SEQ ID NO: 146034 - DNA, 13 bp, Unknown
  misc_feature (1)..( 13): Result.004 file - promoters60/5663003
tcatatttgtata

SEQ ID NO: 146035 - DNA, 13 bp, Unknown
  misc_feature (1)..( 13): Result.004 file - promoters60/5663003
aaagaattgaaca

SEQ ID NO: 146036 - DNA, 10 bp, Unknown
  misc_feature (1)..( 10): Result.004 file - promoters60/5663003
gaaaaagata

SEQ ID NO: 146037 - DNA, 10 bp, Unknown
  misc_feature (1)..( 10): Result.004 file - promoters60/5663003
gaaatagatt

SEQ ID NO: 146038 - DNA, 10 bp, Unknown
  misc_feature (1)..( 10): Result.004 file - promoters60/5663003
ttagtagatt

SEQ ID NO: 146039 - DNA, 10 bp, Unknown
  misc_feature (1)..( 10): Result.004 file - promoters60/5663003
tatataaatt

SEQ ID NO: 146040 - DNA, 10 bp, Unknown
  misc_feature (1)..( 10): Result.004 file - promoters60/5663003
ttactaaaat

SEQ ID NO: 146041 - DNA, 10 bp, Unknown
  misc_feature (1)..( 10): Result.004 file - promoters60/5663003
ttattaattt

SEQ ID NO: 146042 - DNA, 11 bp, Unknown
  misc_feature (1)..( 11): Result.004 file - promoters60/5663003
gaactgaaaga

SEQ ID NO: 146043 - DNA, 11 bp, Unknown
  misc_feature (1)..( 11): Result.004 file - promoters60/5663034
ttgtataaatt

SEQ ID NO: 146044 - DNA, 7 bp, Unknown
  misc_feature (1)..( 7): Result.004 file - promoters60/5663034
ttctaaa

SEQ ID NO: 146045 - DNA, 7 bp, Unknown
  misc_feature (1)..( 7): Result.004 file - promoters60/5663034
ttcaaaa

SEQ ID NO: 146046 - DNA, 14 bp, Unknown
  misc_feature (1)..( 14): Result.004 file - promoters60/5663034
aactgattgacacg

SEQ ID NO: 146047 - DNA, 14 bp, Unknown
  misc_feature (1)..( 14): Result.004 file - promoters60/5663034
aactcattttctta

SEQ ID NO: 146048 - DNA, 14 bp, Unknown
  misc_feature (1)..( 14): Result.004 file - promoters60/5663034
ctctctttttatta

SEQ ID NO: 146049 - DNA, 8 bp, Unknown
  misc_feature (1)..( 8): Result.004 file - promoters60/5663034
aattaata

SEQ ID NO: 146050 - DNA, 8 bp, Unknown
  misc_feature (1)..( 8): Result.004 file - promoters60/5663034
gatttata

SEQ ID NO: 146051 - DNA, 8 bp, Unknown
  misc_feature (1)..( 8): Result.004 file - promoters60/5663034
tttttatt

SEQ ID NO: 146052 - DNA, 8 bp, Unknown
  misc_feature (1)..( 8): Result.004 file - promoters60/5663034
caatatta

SEQ ID NO: 146053 - DNA, 8 bp, Unknown
  misc_feature (1)..( 8): Result.004 file - promoters60/5663034
caatttta

SEQ ID NO: 146054 - DNA, 7 bp, Unknown
  misc_feature (1)..( 7): Result.004 file - promoters60/5663034
tagattt

SEQ ID NO: 146055 - DNA, 7 bp, Unknown
  misc_feature (1)..( 7): Result.004 file - promoters60/5663034
taggttt

SEQ ID NO: 146056 - DNA, 6 bp, Unknown
  misc_feature (1)..( 6): Result.004 file - promoters60/5663034
gttttt

SEQ ID NO: 146057 - DNA, 6 bp, Unknown
  misc_feature (1)..( 6): Result.004 file - promoters60/5663034
gttttt

SEQ ID NO: 146058 - DNA, 9 bp, Unknown
  misc_feature (1)..( 9): Result.004 file - promoters60/5663034
aagaaacaa

SEQ ID NO: 146059 - DNA, 9 bp, Unknown
  misc_feature (1)..( 9): Result.004 file - promoters60/5663034
aagatacaa

SEQ ID NO: 146060 - DNA, 8 bp, Unknown
  misc_feature (1)..( 8): Result.004 file - promoters60/5663034
attttgtt

SEQ ID NO: 146061 - DNA, 8 bp, Unknown
  misc_feature (1)..( 8): Result.004 file - promoters60/5663034
attttgtt

SEQ ID NO: 146062 - DNA, 8 bp, Unknown
  misc_feature (1)..( 8): Result.004 file - promoters60/5663034
gttttgta

SEQ ID NO: 146063 - DNA, 8 bp, Unknown
  misc_feature (1)..( 8): Result.004 file - promoters60/5663034
aaaaatat

SEQ ID NO: 146064 - DNA, 8 bp, Unknown
  misc_feature (1)..( 8): Result.004 file - promoters60/5663034
aaagatat

SEQ ID NO: 146065 - DNA, 6 bp, Unknown
  misc_feature (1)..( 6): Result.004 file - promoters60/5663034
attatt

SEQ ID NO: 146066 - DNA, 6 bp, Unknown
  misc_feature (1)..( 6): Result.004 file - promoters60/5663034
attatt

SEQ ID NO: 146067 - DNA, 7 bp, Unknown
  misc_feature (1)..( 7): Result.004 file - promoters60/5663034
tcaaatc

SEQ ID NO: 146068 - DNA, 7 bp, Unknown
  misc_feature (1)..( 7): Result.004 file - promoters60/5663034
tcacatc

SEQ ID NO: 146069 - DNA, 7 bp, Unknown
  misc_feature (1)..( 7): Result.004 file - promoters60/5663034
atgtcta

SEQ ID NO: 146070 - DNA, 7 bp, Unknown
  misc_feature (1)..( 7): Result.004 file - promoters60/5663034
atgtcta

SEQ ID NO: 146071 - DNA, 6 bp, Unknown
  misc_feature (1)..( 6): Result.004 file - promoters60/5663034
agctaa

SEQ ID NO: 146072 - DNA, 6 bp, Unknown
  misc_feature (1)..( 6): Result.004 file - promoters60/5663034
agctaa

SEQ ID NO: 146073 - DNA, 7 bp, Unknown
  misc_feature (1)..( 7): Result.004 file - promoters60/5663034
cttaaga

SEQ ID NO: 146074 - DNA, 7 bp, Unknown
  misc_feature (1)..( 7): Result.004 file - promoters60/5663034
cttgaga

SEQ ID NO: 146075 - DNA, 6 bp, Unknown
  misc_feature (1)..( 6): Result.004 file - promoters60/5663034
ttttat

SEQ ID NO: 146076 - DNA, 6 bp, Unknown
  misc_feature (1)..( 6): Result.004 file - promoters60/5663034
ttttat

SEQ ID NO: 146077 - DNA, 6 bp, Unknown
  misc_feature (1)..( 6): Result.004 file - promoters60/5663034
ttgcaa

SEQ ID NO: 146078 - DNA, 6 bp, Unknown
  misc_feature (1)..( 6): Result.004 file - promoters60/5663034
ttgcaa

SEQ ID NO: 146079 - DNA, 7 bp, Unknown
  misc_feature (1)..( 7): Result.004 file - promoters60/5663034
aatttta

SEQ ID NO: 146080 - DNA, 7 bp, Unknown
  misc_feature (1)..( 7): Result.004 file - promoters60/5663034
aatctta

SEQ ID NO: 146081 - DNA, 6 bp, Unknown
  misc_feature (1)..( 6): Result.004 file - promoters60/5663034
atttat

SEQ ID NO: 146082 - DNA, 6 bp, Unknown
  misc_feature (1)..( 6): Result.004 file - promoters60/5663034
atttat

SEQ ID NO: 146083 - DNA, 9 bp, Unknown
  misc_feature (1)..( 9): Result.004 file - promoters60/5663034
cctattaaa

SEQ ID NO: 146084 - DNA, 9 bp, Unknown
  misc_feature (1)..( 9): Result.004 file - promoters60/5663050
cctactaaa

SEQ ID NO: 146085 - DNA, 6 bp, Unknown
  misc_feature (1)..( 6): Result.004 file - promoters60/5663050
attctc

SEQ ID NO: 146086 - DNA, 6 bp, Unknown
  misc_feature (1)..( 6): Result.004 file - promoters60/5663050
attctc

SEQ ID NO: 146087 - DNA, 8 bp, Unknown
  misc_feature (1)..( 8): Result.004 file - promoters60/5663050
aacaaatt

SEQ ID NO: 146088 - DNA, 8 bp, Unknown
  misc_feature (1)..( 8): Result.004 file - promoters60/5663050
ctcaaatt

SEQ ID NO: 146089 - DNA, 8 bp, Unknown
  misc_feature (1)..( 8): Result.004 file - promoters60/5663050
ctcacatt

SEQ ID NO: 146090 - DNA, 7 bp, Unknown
  misc_feature (1)..( 7): Result.004 file - promoters60/5663050
tacaaaa

SEQ ID NO: 146091 - DNA, 7 bp, Unknown
  misc_feature (1)..( 7): Result.004 file - promoters60/5663050
tacgaaa

SEQ ID NO: 146092 - DNA, 7 bp, Unknown
  misc_feature (1)..( 7): Result.004 file - promoters60/5663050
aaagagg

SEQ ID NO: 146093 - DNA, 7 bp, Unknown
  misc_feature (1)..( 7): Result.004 file - promoters60/5663050
aaaaagg

SEQ ID NO: 146094 - DNA, 6 bp, Unknown
  misc_feature (1)..( 6): Result.004 file - promoters60/5663050
tattta

SEQ ID NO: 146095 - DNA, 6 bp, Unknown
  misc_feature (1)..( 6): Result.004 file - promoters60/5663050
tattta

SEQ ID NO: 146096 - DNA, 6 bp, Unknown
  misc_feature (1)..( 6): Result.004 file - promoters60/5663050
cttcaa

SEQ ID NO: 146097 - DNA, 6 bp, Unknown
  misc_feature (1)..( 6): Result.004 file - promoters60/5663050
cttcaa

SEQ ID NO: 146098 - DNA, 6 bp, Unknown
  misc_feature (1)..( 6): Result.004 file - promoters60/5663050
tcttac

SEQ ID NO: 146099 - DNA, 6 bp, Unknown
  misc_feature (1)..( 6): Result.004 file - promoters60/5663050
tcttac

SEQ ID NO: 146100 - DNA, 6 bp, Unknown
  misc_feature (1)..( 6): Result.004 file - promoters60/5663050
tgataa

SEQ ID NO: 146101 - DNA, 6 bp, Unknown
  misc_feature (1)..( 6): Result.004 file - promoters60/5663050
tgataa

SEQ ID NO: 146102 - DNA, 7 bp, Unknown
  misc_feature (1)..( 7): Result.004 file - promoters60/5663050
ttaagtt

SEQ ID NO: 146103 - DNA, 7 bp, Unknown
  misc_feature (1)..( 7): Result.004 file - promoters60/5663050
ttaggtt

SEQ ID NO: 146104 - DNA, 8 bp, Unknown
  misc_feature (1)..( 8): Result.004 file - promoters60/5663050
tattgttg

SEQ ID NO: 146105 - DNA, 8 bp, Unknown
  misc_feature (1)..( 8): Result.004 file - promoters60/5663050
tatagttg

SEQ ID NO: 146106 - DNA, 6 bp, Unknown
  misc_feature (1)..( 6): Result.004 file - promoters60/5663050
gaaaaa

SEQ ID NO: 146107 - DNA, 6 bp, Unknown
  misc_feature (1)..( 6): Result.004 file - promoters60/5663050
gaaaaa

SEQ ID NO: 146108 - DNA, 8 bp, Unknown
  misc_feature (1)..( 8): Result.004 file - promoters60/5663050
tgtataga

SEQ ID NO: 146109 - DNA, 8 bp, Unknown
  misc_feature (1)..( 8): Result.004 file - promoters60/5663050
tgtttaga

SEQ ID NO: 146110 - DNA, 7 bp, Unknown
  misc_feature (1)..( 7): Result.004 file - promoters60/5663050
aaagata

SEQ ID NO: 146111 - DNA, 7 bp, Unknown
  misc_feature (1)..( 7): Result.004 file - promoters60/5663050
aaaaata

SEQ ID NO: 146112 - DNA, 7 bp, Unknown
  misc_feature (1)..( 7): Result.004 file - promoters60/5663050
ataatat

SEQ ID NO: 146113 - DNA, 7 bp, Unknown
  misc_feature (1)..( 7): Result.004 file - promoters60/5663050
ataatat

SEQ ID NO: 146114 - DNA, 7 bp, Unknown
  misc_feature (1)..( 7): Result.004 file - promoters60/5663050
aaatgct

SEQ ID NO: 146115 - DNA, 7 bp, Unknown
  misc_feature (1)..( 7): Result.004 file - promoters60/5663050
aaacgct

SEQ ID NO: 146116 - DNA, 9 bp, Unknown
  misc_feature (1)..( 9): Result.004 file - promoters60/5663050
aaaagaaaa

SEQ ID NO: 146117 - DNA, 9 bp, Unknown
  misc_feature (1)..( 9): Result.004 file - promoters60/5663050
aaatgaaaa

SEQ ID NO: 146118 - DNA, 7 bp, Unknown
  misc_feature (1)..( 7): Result.004 file - promoters60/5663050
ctggaat

SEQ ID NO: 146119 - DNA, 7 bp, Unknown
  misc_feature (1)..( 7): Result.004 file - promoters60/5663050
ctgtaat

SEQ ID NO: 146120 - DNA, 7 bp, Unknown
  misc_feature (1)..( 7): Result.004 file - promoters60/5663050
aaacctt

SEQ ID NO: 146121 - DNA, 7 bp, Unknown
  misc_feature (1)..( 7): Result.004 file - promoters60/5663050
aaaactt

SEQ ID NO: 146122 - DNA, 8 bp, Unknown
  misc_feature (1)..( 8): Result.004 file - promoters60/5663050
cttaatta

SEQ ID NO: 146123 - DNA, 8 bp, Unknown
  misc_feature (1)..( 8): Result.004 file - promoters60/5663050
cttattta

SEQ ID NO: 146124 - DNA, 7 bp, Unknown
  misc_feature (1)..( 7): Result.004 file - promoters60/5663050
cacatat

SEQ ID NO: 146125 - DNA, 7 bp, Unknown
  misc_feature (1)..( 7): Result.004 file - promoters60/5663069
cacctat

SEQ ID NO: 146126 - DNA, 7 bp, Unknown
  misc_feature (1)..( 7): Result.004 file - promoters60/5663069
taaaaat

SEQ ID NO: 146127 - DNA, 7 bp, Unknown
  misc_feature (1)..( 7): Result.004 file - promoters60/5663069
taataat

SEQ ID NO: 146128 - DNA, 6 bp, Unknown
  misc_feature (1)..( 6): Result.004 file - promoters60/5663069
cgagtt

SEQ ID NO: 146129 - DNA, 6 bp, Unknown
  misc_feature (1)..( 6): Result.004 file - promoters60/5663069
cgagtt

SEQ ID NO: 146130 - DNA, 6 bp, Unknown
  misc_feature (1)..( 6): Result.004 file - promoters60/5663069
aaaact

SEQ ID NO: 146131 - DNA, 6 bp, Unknown
  misc_feature (1)..( 6): Result.004 file - promoters60/5663069
aaaact

SEQ ID NO: 146132 - DNA, 6 bp, Unknown
  misc_feature (1)..( 6): Result.004 file - promoters60/5663069
ttcgta

SEQ ID NO: 146133 - DNA, 6 bp, Unknown
  misc_feature (1)..( 6): Result.004 file - promoters60/5663069
ttcgta

SEQ ID NO: 146134 - DNA, 9 bp, Unknown
  misc_feature (1)..( 9): Result.004 file - promoters60/5663069
tggagaatg

SEQ ID NO: 146135 - DNA, 9 bp, Unknown
  misc_feature (1)..( 9): Result.004 file - promoters60/5663069
tggacaatg

SEQ ID NO: 146136 - DNA, 8 bp, Unknown
  misc_feature (1)..( 8): Result.004 file - promoters60/5663069
attttaag

SEQ ID NO: 146137 - DNA, 8 bp, Unknown
  misc_feature (1)..( 8): Result.004 file - promoters60/5663069
atttcaag

SEQ ID NO: 146138 - DNA, 10 bp, Unknown
  misc_feature (1)..( 10): Result.004 file - promoters60/5663069
gtccaaaaat

SEQ ID NO: 146139 - DNA, 10 bp, Unknown
  misc_feature (1)..( 10): Result.004 file - promoters60/5663069
ataaaaaaat

SEQ ID NO: 146140 - DNA, 10 bp, Unknown
  misc_feature (1)..( 10): Result.004 file - promoters60/5663069
gtctaaaaac

SEQ ID NO: 146141 - DNA, 6 bp, Unknown
  misc_feature (1)..( 6): Result.004 file - promoters60/5663069
taaatg

SEQ ID NO: 146142 - DNA, 6 bp, Unknown
  misc_feature (1)..( 6): Result.004 file - promoters60/5663069
taaatg

SEQ ID NO: 146143 - DNA, 9 bp, Unknown
  misc_feature (1)..( 9): Result.004 file - promoters60/5663069
taaaaacca

SEQ ID NO: 146144 - DNA, 9 bp, Unknown
  misc_feature (1)..( 9): Result.004 file - promoters60/5663069
taaacacca

SEQ ID NO: 146145 - DNA, 7 bp, Unknown
  misc_feature (1)..( 7): Result.004 file - promoters60/5663069
aaccaat

SEQ ID NO: 146146 - DNA, 7 bp, Unknown
  misc_feature (1)..( 7): Result.004 file - promoters60/5663069
aactaat

SEQ ID NO: 146147 - DNA, 6 bp, Unknown
  misc_feature (1)..( 6): Result.004 file - promoters60/5663069
aaatcc

SEQ ID NO: 146148 - DNA, 6 bp, Unknown
  misc_feature (1)..( 6): Result.004 file - promoters60/5663069
aaatcc

SEQ ID NO: 146149 - DNA, 7 bp, Unknown
  misc_feature (1)..( 7): Result.004 file - promoters60/5663069
atctaaa

SEQ ID NO: 146150 - DNA, 7 bp, Unknown
  misc_feature (1)..( 7): Result.004 file - promoters60/5663069
atccaaa

SEQ ID NO: 146151 - DNA, 8 bp, Unknown
  misc_feature (1)..( 8): Result.004 file - promoters60/5663069
aaaagata

SEQ ID NO: 146152 - DNA, 8 bp, Unknown
  misc_feature (1)..( 8): Result.004 file - promoters60/5663069
aaaaaata

SEQ ID NO: 146153 - DNA, 7 bp, Unknown
  misc_feature (1)..( 7): Result.004 file - promoters60/5663069
attctat

SEQ ID NO: 146154 - DNA, 7 bp, Unknown
  misc_feature (1)..( 7): Result.004 file - promoters60/5663069
attttat

SEQ ID NO: 146155 - DNA, 11 bp, Unknown
  misc_feature (1)..( 11): Result.004 file - promoters60/5663069
ttttcgaaaaa

SEQ ID NO: 146156 - DNA, 11 bp, Unknown
  misc_feature (1)..( 11): Result.004 file - promoters60/5663069
ttttcgaaaaa

SEQ ID NO: 146157 - DNA, 6 bp, Unknown
  misc_feature (1)..( 6): Result.004 file - promoters60/5663069
tataaa

SEQ ID NO: 146158 - DNA, 6 bp, Unknown
  misc_feature (1)..( 6): Result.004 file - promoters60/5663138
tataaa

SEQ ID NO: 146159 - DNA, 14 bp, Unknown
  misc_feature (1)..( 14): Result.004 file - promoters60/5663138
acaaatcaaatcga

SEQ ID NO: 146160 - DNA, 14 bp, Unknown
  misc_feature (1)..( 14): Result.004 file - promoters60/5663138
tcatgtcaaatttg

SEQ ID NO: 146161 - DNA, 14 bp, Unknown
  misc_feature (1)..( 14): Result.004 file - promoters60/5663138
gaaaaacaaaatgg

SEQ ID NO: 146162 - DNA, 14 bp, Unknown
  misc_feature (1)..( 14): Result.004 file - promoters60/5663138
tattaacaattttt

SEQ ID NO: 146163 - DNA, 14 bp, Unknown
  misc_feature (1)..( 14): Result.004 file - promoters60/5663138
tcaatcagaataac

SEQ ID NO: 146164 - DNA, 14 bp, Unknown
  misc_feature (1)..( 14): Result.004 file - promoters60/5663138
gaaaaacatcagaa

SEQ ID NO: 146165 - DNA, 10 bp, Unknown
  misc_feature (1)..( 10): Result.004 file - promoters60/5663138
ggaatcagaa

SEQ ID NO: 146166 - DNA, 10 bp, Unknown
  misc_feature (1)..( 10): Result.004 file - promoters60/5663138
gaaatcagca

SEQ ID NO: 146167 - DNA, 10 bp, Unknown
  misc_feature (1)..( 10): Result.004 file - promoters60/5663138
tgaatcacat

SEQ ID NO: 146168 - DNA, 10 bp, Unknown
  misc_feature (1)..( 10): Result.004 file - promoters60/5663138
gaaatcaaaa

SEQ ID NO: 146169 - DNA, 10 bp, Unknown
  misc_feature (1)..( 10): Result.004 file - promoters60/5663138
ttaattaaaa

SEQ ID NO: 146170 - DNA, 9 bp, Unknown
  misc_feature (1)..( 9): Result.004 file - promoters60/5663138
cgaaatcga

SEQ ID NO: 146171 - DNA, 9 bp, Unknown
  misc_feature (1)..( 9): Result.004 file - promoters60/5663138
cgatatccg

SEQ ID NO: 146172 - DNA, 9 bp, Unknown
  misc_feature (1)..( 9): Result.004 file - promoters60/5663138
agatttccg

SEQ ID NO: 146173 - DNA, 9 bp, Unknown
  misc_feature (1)..( 9): Result.004 file - promoters60/5663138
agatttatt

SEQ ID NO: 146174 - DNA, 7 bp, Unknown
  misc_feature (1)..( 7): Result.004 file - promoters60/5663138
atttcct

SEQ ID NO: 146175 - DNA, 12 bp, Unknown
  misc_feature (1)..( 12): Result.004 file - promoters60/5663138
gctaaacaaaaa

SEQ ID NO: 146176 - DNA, 12 bp, Unknown
  misc_feature (1)..( 12): Result.004 file - promoters60/5663138
gaaaaagaaaaa

SEQ ID NO: 146177 - DNA, 12 bp, Unknown
  misc_feature (1)..( 12): Result.004 file - promoters60/5663138
tcaaaagagaaa

SEQ ID NO: 146178 - DNA, 12 bp, Unknown
  misc_feature (1)..( 12): Result.004 file - promoters60/5663138
agaaaagatgaa

SEQ ID NO: 146179 - DNA, 12 bp, Unknown
  misc_feature (1)..( 12): Result.004 file - promoters60/5663138
ctaaaagattac

SEQ ID NO: 146180 - DNA, 12 bp, Unknown
  misc_feature (1)..( 12): Result.004 file - promoters60/5663138
gaaaaacaaaat

SEQ ID NO: 146181 - DNA, 9 bp, Unknown
  misc_feature (1)..( 9): Result.004 file - promoters60/5663138
taataacaa

SEQ ID NO: 146182 - DNA, 9 bp, Unknown
  misc_feature (1)..( 9): Result.004 file - promoters60/5663138
aaatgacag

SEQ ID NO: 146183 - DNA, 9 bp, Unknown
  misc_feature (1)..( 9): Result.004 file - promoters60/5663138
taataatgt

SEQ ID NO: 146184 - DNA, 9 bp, Unknown
  misc_feature (1)..( 9): Result.004 file - promoters60/5663138
gaatcatgt

SEQ ID NO: 146185 - DNA, 10 bp, Unknown
  misc_feature (1)..( 10): Result.004 file - promoters60/5663138
aaactgacaa

SEQ ID NO: 146186 - DNA, 9 bp, Unknown
  misc_feature (1)..( 9): Result.004 file - promoters60/5663138
caaatttgt

SEQ ID NO: 146187 - DNA, 9 bp, Unknown
  misc_feature (1)..( 9): Result.004 file - promoters60/5663138
aaaaattgt

SEQ ID NO: 146188 - DNA, 9 bp, Unknown
  misc_feature (1)..( 9): Result.004 file - promoters60/5663138
acaattttt

SEQ ID NO: 146189 - DNA, 9 bp, Unknown
  misc_feature (1)..( 9): Result.004 file - promoters60/5663138
gacaattgt

SEQ ID NO: 146190 - DNA, 9 bp, Unknown
  misc_feature (1)..( 9): Result.004 file - promoters60/5663142
aaaaatgac

SEQ ID NO: 146191 - DNA, 10 bp, Unknown
  misc_feature (1)..( 10): Result.004 file - promoters60/5663142
taaaaatgaa

SEQ ID NO: 146192 - DNA, 10 bp, Unknown
  misc_feature (1)..( 10): Result.004 file - promoters60/5663142
taaaaagtct

SEQ ID NO: 146193 - DNA, 10 bp, Unknown
  misc_feature (1)..( 10): Result.004 file - promoters60/5663142
aaaaaaagaa

SEQ ID NO: 146194 - DNA, 10 bp, Unknown
  misc_feature (1)..( 10): Result.004 file - promoters60/5663142
caaaaatctt

SEQ ID NO: 146195 - DNA, 8 bp, Unknown
  misc_feature (1)..( 8): Result.004 file - promoters60/5663142
gctaatga

SEQ ID NO: 146196 - DNA, 8 bp, Unknown
  misc_feature (1)..( 8): Result.004 file - promoters60/5663142
attaatga

SEQ ID NO: 146197 - DNA, 8 bp, Unknown
  misc_feature (1)..( 8): Result.004 file - promoters60/5663142
aataatga

SEQ ID NO: 146198 - DNA, 8 bp, Unknown
  misc_feature (1)..( 8): Result.004 file - promoters60/5663142
aataatta

SEQ ID NO: 146199 - DNA, 14 bp, Unknown
  misc_feature (1)..( 14): Result.004 file - promoters60/5663142
actcataataaata

SEQ ID NO: 146200 - DNA, 14 bp, Unknown
  misc_feature (1)..( 14): Result.004 file - promoters60/5663142
tcatataatagtaa

SEQ ID NO: 146201 - DNA, 14 bp, Unknown
  misc_feature (1)..( 14): Result.004 file - promoters60/5663142
atttataatataat

SEQ ID NO: 146202 - DNA, 14 bp, Unknown
  misc_feature (1)..( 14): Result.004 file - promoters60/5663142
acttataatgaatt

SEQ ID NO: 146203 - DNA, 14 bp, Unknown
  misc_feature (1)..( 14): Result.004 file - promoters60/5663142
taaaataaggaatt

SEQ ID NO: 146204 - DNA, 14 bp, Unknown
  misc_feature (1)..( 14): Result.004 file - promoters60/5663142
atatataataaata

SEQ ID NO: 146205 - DNA, 14 bp, Unknown
  misc_feature (1)..( 14): Result.004 file - promoters60/5663142
aagcataaaaaata

SEQ ID NO: 146206 - DNA, 14 bp, Unknown
  misc_feature (1)..( 14): Result.004 file - promoters60/5663142
tcatataattatct

SEQ ID NO: 146207 - DNA, 14 bp, Unknown
  misc_feature (1)..( 14): Result.004 file - promoters60/5663142
cagtttaataacaa

SEQ ID NO: 146208 - DNA, 14 bp, Unknown
  misc_feature (1)..( 14): Result.004 file - promoters60/5663142
gcctaaaatataat

SEQ ID NO: 146209 - DNA, 14 bp, Unknown
  misc_feature (1)..( 14): Result.004 file - promoters60/5663142
tcatataacaattt

SEQ ID NO: 146210 - DNA, 11 bp, Unknown
  misc_feature (1)..( 11): Result.004 file - promoters60/5663142
tgtatatatat

SEQ ID NO: 146211 - DNA, 11 bp, Unknown
  misc_feature (1)..( 11): Result.004 file - promoters60/5663142
aaaataaatag

SEQ ID NO: 146212 - DNA, 11 bp, Unknown
  misc_feature (1)..( 11): Result.004 file - promoters60/5663142
aaaatatataa

SEQ ID NO: 146213 - DNA, 11 bp, Unknown
  misc_feature (1)..( 11): Result.004 file - promoters60/5663142
agaataaaaat

SEQ ID NO: 146214 - DNA, 11 bp, Unknown
  misc_feature (1)..( 11): Result.004 file - promoters60/5663142
aaaatataata

SEQ ID NO: 146215 - DNA, 12 bp, Unknown
  misc_feature (1)..( 12): Result.004 file - promoters60/5663142
tagaaattaata

SEQ ID NO: 146216 - DNA, 12 bp, Unknown
  misc_feature (1)..( 12): Result.004 file - promoters60/5663142
agataattaagt

SEQ ID NO: 146217 - DNA, 11 bp, Unknown
  misc_feature (1)..( 11): Result.004 file - promoters60/5663142
taaaatcaata

SEQ ID NO: 146218 - DNA, 12 bp, Unknown
  misc_feature (1)..( 12): Result.004 file - promoters60/5663142
ataacatcactt

SEQ ID NO: 146219 - DNA, 12 bp, Unknown
  misc_feature (1)..( 12): Result.004 file - promoters60/5663142
ggtacatcactg

SEQ ID NO: 146220 - DNA, 10 bp, Unknown
  misc_feature (1)..( 10): Result.004 file - promoters60/5663142
ttttatcaca

SEQ ID NO: 146221 - DNA, 10 bp, Unknown
  misc_feature (1)..( 10): Result.004 file - promoters60/5663142
ttttgtcaac

SEQ ID NO: 146222 - DNA, 10 bp, Unknown
  misc_feature (1)..( 10): Result.004 file - promoters60/5663142
ctttatccta

SEQ ID NO: 146223 - DNA, 10 bp, Unknown
  misc_feature (1)..( 10): Result.004 file - promoters60/5663142
gtataacaat

SEQ ID NO: 146224 - DNA, 10 bp, Unknown
  misc_feature (1)..( 10): Result.004 file - promoters60/5663142
gtgtaaacga

SEQ ID NO: 146225 - DNA, 11 bp, Unknown
  misc_feature (1)..( 11): Result.004 file - promoters60/5663142
tcaatcaaaag

SEQ ID NO: 146226 - DNA, 11 bp, Unknown
  misc_feature (1)..( 11): Result.004 file - promoters60/5663142
caaatcaaatt

SEQ ID NO: 146227 - DNA, 11 bp, Unknown
  misc_feature (1)..( 11): Result.004 file - promoters60/5663142
tcaattaaaag

SEQ ID NO: 146228 - DNA, 11 bp, Unknown
  misc_feature (1)..( 11): Result.004 file - promoters60/5663142
cctttcaaata

SEQ ID NO: 146229 - DNA, 11 bp, Unknown
  misc_feature (1)..( 11): Result.004 file - promoters60/5663142
tatttgaaatt

SEQ ID NO: 146230 - DNA, 12 bp, Unknown
  misc_feature (1)..( 12): Result.004 file - promoters60/5663142
agacataataaa

SEQ ID NO: 146231 - DNA, 12 bp, Unknown
  misc_feature (1)..( 12): Result.004 file - promoters60/5663142
atttataataaa

SEQ ID NO: 146232 - DNA, 12 bp, Unknown
  misc_feature (1)..( 12): Result.004 file - promoters60/5663142
agacaaaataaa

SEQ ID NO: 146233 - DNA, 12 bp, Unknown
  misc_feature (1)..( 12): Result.004 file - promoters60/5663142
tataacaataaa

SEQ ID NO: 146234 - DNA, 8 bp, Unknown
  misc_feature (1)..( 8): Result.004 file - promoters60/5663142
atatataa

SEQ ID NO: 146235 - DNA, 8 bp, Unknown
  misc_feature (1)..( 8): Result.004 file - promoters60/5663142
tcatataa

SEQ ID NO: 146236 - DNA, 8 bp, Unknown
  misc_feature (1)..( 8): Result.004 file - promoters60/5663142
tcaaatat

SEQ ID NO: 146237 - DNA, 8 bp, Unknown
  misc_feature (1)..( 8): Result.004 file - promoters60/5663142
tcatataa

SEQ ID NO: 146238 - DNA, 8 bp, Unknown
  misc_feature (1)..( 8): Result.004 file - promoters60/5663142
caatcttg

SEQ ID NO: 146239 - DNA, 8 bp, Unknown
  misc_feature (1)..( 8): Result.004 file - promoters60/5663142
aaatcttg

SEQ ID NO: 146240 - DNA, 8 bp, Unknown
  misc_feature (1)..( 8): Result.004 file - promoters60/5663142
aaatctat

SEQ ID NO: 146241 - DNA, 8 bp, Unknown
  misc_feature (1)..( 8): Result.004 file - promoters60/5663142
aaagcttc

SEQ ID NO: 146242 - DNA, 8 bp, Unknown
  misc_feature (1)..( 8): Result.004 file - promoters60/5663142
tttaaaac

SEQ ID NO: 146243 - DNA, 8 bp, Unknown
  misc_feature (1)..( 8): Result.004 file - promoters60/5663142
tttcaaat

SEQ ID NO: 146244 - DNA, 8 bp, Unknown
  misc_feature (1)..( 8): Result.004 file - promoters60/5663142
aatcaaat

SEQ ID NO: 146245 - DNA, 8 bp, Unknown
  misc_feature (1)..( 8): Result.004 file - promoters60/5663142
tttgaaat

SEQ ID NO: 146246 - DNA, 7 bp, Unknown
  misc_feature (1)..( 7): Result.004 file - promoters60/5663142
cattttt

SEQ ID NO: 146247 - DNA, 7 bp, Unknown
  misc_feature (1)..( 7): Result.004 file - promoters60/5663142
tattttt

SEQ ID NO: 146248 - DNA, 7 bp, Unknown
  misc_feature (1)..( 7): Result.004 file - promoters60/5663142
aattttt

SEQ ID NO: 146249 - DNA, 7 bp, Unknown
  misc_feature (1)..( 7): Result.004 file - promoters60/5663142
aatcttt

SEQ ID NO: 146250 - DNA, 8 bp, Unknown
  misc_feature (1)..( 8): Result.004 file - promoters60/5663142
ttttgttt

SEQ ID NO: 146251 - DNA, 8 bp, Unknown
  misc_feature (1)..( 8): Result.004 file - promoters60/5663142
atttgttt

SEQ ID NO: 146252 - DNA, 8 bp, Unknown
  misc_feature (1)..( 8): Result.004 file - promoters60/5663142
ctttgttg

SEQ ID NO: 146253 - DNA, 8 bp, Unknown
  misc_feature (1)..( 8): Result.004 file - promoters60/5663151
atttattt

SEQ ID NO: 146254 - DNA, 6 bp, Unknown
  misc_feature (1)..( 6): Result.004 file - promoters60/5663151
caattt

SEQ ID NO: 146255 - DNA, 6 bp, Unknown
  misc_feature (1)..( 6): Result.004 file - promoters60/5663151
caattt

SEQ ID NO: 146256 - DNA, 8 bp, Unknown
  misc_feature (1)..( 8): Result.004 file - promoters60/5663151
agaatcca

SEQ ID NO: 146257 - DNA, 8 bp, Unknown
  misc_feature (1)..( 8): Result.004 file - promoters60/5663151
agaatcca

SEQ ID NO: 146258 - DNA, 10 bp, Unknown
  misc_feature (1)..( 10): Result.004 file - promoters60/5663151
aagaaatgat

SEQ ID NO: 146259 - DNA, 10 bp, Unknown
  misc_feature (1)..( 10): Result.004 file - promoters60/5663151
tagatatgat

SEQ ID NO: 146260 - DNA, 10 bp, Unknown
  misc_feature (1)..( 10): Result.004 file - promoters60/5663151
aagaaacgaa

SEQ ID NO: 146261 - DNA, 8 bp, Unknown
  misc_feature (1)..( 8): Result.004 file - promoters60/5663151
aataaaac

SEQ ID NO: 146262 - DNA, 8 bp, Unknown
  misc_feature (1)..( 8): Result.004 file - promoters60/5663151
aatgaaac

SEQ ID NO: 146263 - DNA, 6 bp, Unknown
  misc_feature (1)..( 6): Result.004 file - promoters60/5663151
ccaaaa

SEQ ID NO: 146264 - DNA, 6 bp, Unknown
  misc_feature (1)..( 6): Result.004 file - promoters60/5663151
ccaaaa

SEQ ID NO: 146265 - DNA, 9 bp, Unknown
  misc_feature (1)..( 9): Result.004 file - promoters60/5663151
aaaacgcaa

SEQ ID NO: 146266 - DNA, 9 bp, Unknown
  misc_feature (1)..( 9): Result.004 file - promoters60/5663151
caaacccaa

SEQ ID NO: 146267 - DNA, 9 bp, Unknown
  misc_feature (1)..( 9): Result.004 file - promoters60/5663151
caaacctga

SEQ ID NO: 146268 - DNA, 6 bp, Unknown
  misc_feature (1)..( 6): Result.004 file - promoters60/5663151
aagaat

SEQ ID NO: 146269 - DNA, 6 bp, Unknown
  misc_feature (1)..( 6): Result.004 file - promoters60/5663151
aagaat

SEQ ID NO: 146270 - DNA, 7 bp, Unknown
  misc_feature (1)..( 7): Result.004 file - promoters60/5663151
aaattga

SEQ ID NO: 146271 - DNA, 7 bp, Unknown
  misc_feature (1)..( 7): Result.004 file - promoters60/5663151
aaactga

SEQ ID NO: 146272 - DNA, 7 bp, Unknown
  misc_feature (1)..( 7): Result.004 file - promoters60/5663151
attatct

SEQ ID NO: 146273 - DNA, 7 bp, Unknown
  misc_feature (1)..( 7): Result.004 file - promoters60/5663151
attatct

SEQ ID NO: 146274 - DNA, 6 bp, Unknown
  misc_feature (1)..( 6): Result.004 file - promoters60/5663151
caagaa

SEQ ID NO: 146275 - DNA, 6 bp, Unknown
  misc_feature (1)..( 6): Result.004 file - promoters60/5663151
caagaa

SEQ ID NO: 146276 - DNA, 7 bp, Unknown
  misc_feature (1)..( 7): Result.004 file - promoters60/5663151
tttaggt

SEQ ID NO: 146277 - DNA, 7 bp, Unknown
  misc_feature (1)..( 7): Result.004 file - promoters60/5663151
ttttggt

SEQ ID NO: 146278 - DNA, 6 bp, Unknown
  misc_feature (1)..( 6): Result.004 file - promoters60/5663151
ttcagt

SEQ ID NO: 146279 - DNA, 6 bp, Unknown
  misc_feature (1)..( 6): Result.004 file - promoters60/5663154
ttcagt

SEQ ID NO: 146280 - DNA, 8 bp, Unknown
  misc_feature (1)..( 8): Result.004 file - promoters60/5663154
ttttcttt

SEQ ID NO: 146281 - DNA, 8 bp, Unknown
  misc_feature (1)..( 8): Result.004 file - promoters60/5663154
tttccttt

SEQ ID NO: 146282 - DNA, 8 bp, Unknown
  misc_feature (1)..( 8): Result.004 file - promoters60/5663154
tttactta

SEQ ID NO: 146283 - DNA, 6 bp, Unknown
  misc_feature (1)..( 6): Result.004 file - promoters60/5663154
ttattt

SEQ ID NO: 146284 - DNA, 6 bp, Unknown
  misc_feature (1)..( 6): Result.004 file - promoters60/5663154
ttattt

SEQ ID NO: 146285 - DNA, 8 bp, Unknown
  misc_feature (1)..( 8): Result.004 file - promoters60/5663154
ttttattc

SEQ ID NO: 146286 - DNA, 8 bp, Unknown
  misc_feature (1)..( 8): Result.004 file - promoters60/5663154
ttttgttc

SEQ ID NO: 146287 - DNA, 8 bp, Unknown
  misc_feature (1)..( 8): Result.004 file - promoters60/5663154
attctttt

SEQ ID NO: 146288 - DNA, 8 bp, Unknown
  misc_feature (1)..( 8): Result.004 file - promoters60/5663154
attttttt

SEQ ID NO: 146289 - DNA, 6 bp, Unknown
  misc_feature (1)..( 6): Result.004 file - promoters60/5663154
agtttg

SEQ ID NO: 146290 - DNA, 6 bp, Unknown
  misc_feature (1)..( 6): Result.004 file - promoters60/5663154
agtttg

SEQ ID NO: 146291 - DNA, 7 bp, Unknown
  misc_feature (1)..( 7): Result.004 file - promoters60/5663154
ttcataa

SEQ ID NO: 146292 - DNA, 7 bp, Unknown
  misc_feature (1)..( 7): Result.004 file - promoters60/5663154
ttcataa

SEQ ID NO: 146293 - DNA, 8 bp, Unknown
  misc_feature (1)..( 8): Result.004 file - promoters60/5663154
aaatataa

SEQ ID NO: 146294 - DNA, 8 bp, Unknown
  misc_feature (1)..( 8): Result.004 file - promoters60/5663154
aaagataa

SEQ ID NO: 146295 - DNA, 8 bp, Unknown
  misc_feature (1)..( 8): Result.004 file - promoters60/5663154
ggatataa

SEQ ID NO: 146296 - DNA, 8 bp, Unknown
  misc_feature (1)..( 8): Result.004 file - promoters60/5663154
acgtcgaa

SEQ ID NO: 146297 - DNA, 8 bp, Unknown
  misc_feature (1)..( 8): Result.004 file - promoters60/5663154
acgtggaa

SEQ ID NO: 146298 - DNA, 6 bp, Unknown
  misc_feature (1)..( 6): Result.004 file - promoters60/5663154
aaaaca

SEQ ID NO: 146299 - DNA, 6 bp, Unknown
  misc_feature (1)..( 6): Result.004 file - promoters60/5663154
aaaaca

SEQ ID NO: 146300 - DNA, 7 bp, Unknown
  misc_feature (1)..( 7): Result.004 file - promoters60/5663154
tttgctc

SEQ ID NO: 146301 - DNA, 7 bp, Unknown
  misc_feature (1)..( 7): Result.004 file - promoters60/5663154
tttactc

SEQ ID NO: 146302 - DNA, 6 bp, Unknown
  misc_feature (1)..( 6): Result.004 file - promoters60/5663154
ttttat

SEQ ID NO: 146303 - DNA, 6 bp, Unknown
  misc_feature (1)..( 6): Result.004 file - promoters60/5663154
ttttat

SEQ ID NO: 146304 - DNA, 7 bp, Unknown
  misc_feature (1)..( 7): Result.004 file - promoters60/5663154
actgatt

SEQ ID NO: 146305 - DNA, 7 bp, Unknown
  misc_feature (1)..( 7): Result.004 file - promoters60/5663154
actaatt

SEQ ID NO: 146306 - DNA, 9 bp, Unknown
  misc_feature (1)..( 9): Result.004 file - promoters60/5663154
ttgtttaaa

SEQ ID NO: 146307 - DNA, 9 bp, Unknown
  misc_feature (1)..( 9): Result.004 file - promoters60/5663154
ttgattaaa

SEQ ID NO: 146308 - DNA, 9 bp, Unknown
  misc_feature (1)..( 9): Result.004 file - promoters60/5663154
atgactaag

SEQ ID NO: 146309 - DNA, 6 bp, Unknown
  misc_feature (1)..( 6): Result.004 file - promoters60/5663154
tggata

SEQ ID NO: 146310 - DNA, 6 bp, Unknown
  misc_feature (1)..( 6): Result.004 file - promoters60/5663154
tggata

SEQ ID NO: 146311 - DNA, 7 bp, Unknown
  misc_feature (1)..( 7): Result.004 file - promoters60/5663154
ttggata

SEQ ID NO: 146312 - DNA, 7 bp, Unknown
  misc_feature (1)..( 7): Result.004 file - promoters60/5663154
ttggata

SEQ ID NO: 146313 - DNA, 7 bp, Unknown
  misc_feature (1)..( 7): Result.004 file - promoters60/5663154
taaaaaa

SEQ ID NO: 146314 - DNA, 7 bp, Unknown
  misc_feature (1)..( 7): Result.004 file - promoters60/5663154
taaaaaa

SEQ ID NO: 146315 - DNA, 7 bp, Unknown
  misc_feature (1)..( 7): Result.004 file - promoters60/5663154
acgcact

SEQ ID NO: 146316 - DNA, 7 bp, Unknown
  misc_feature (1)..( 7): Result.004 file - promoters60/5663154
acgaact

SEQ ID NO: 146317 - DNA, 7 bp, Unknown
  misc_feature (1)..( 7): Result.004 file - promoters60/5663154
tatctcg

SEQ ID NO: 146318 - DNA, 7 bp, Unknown
  misc_feature (1)..( 7): Result.004 file - promoters60/5663154
tatgtcg

SEQ ID NO: 146319 - DNA, 8 bp, Unknown
  misc_feature (1)..( 8): Result.004 file - promoters60/5663154
attttcac

SEQ ID NO: 146320 - DNA, 8 bp, Unknown
  misc_feature (1)..( 8): Result.004 file - promoters60/5663154
atttgcac

SEQ ID NO: 146321 - DNA, 7 bp, Unknown
  misc_feature (1)..( 7): Result.004 file - promoters60/5663154
ttaatat

SEQ ID NO: 146322 - DNA, 7 bp, Unknown
  misc_feature (1)..( 7): Result.004 file - promoters60/5663154
ttaatat

SEQ ID NO: 146323 - DNA, 6 bp, Unknown
  misc_feature (1)..( 6): Result.004 file - promoters60/5663154
aatata

SEQ ID NO: 146324 - DNA, 6 bp, Unknown
  misc_feature (1)..( 6): Result.004 file - promoters60/5663182
aatata

SEQ ID NO: 146325 - DNA, 6 bp, Unknown
  misc_feature (1)..( 6): Result.004 file - promoters60/5663182
aaataa

SEQ ID NO: 146326 - DNA, 6 bp, Unknown
  misc_feature (1)..( 6): Result.004 file - promoters60/5663182
aaataa

SEQ ID NO: 146327 - DNA, 7 bp, Unknown
  misc_feature (1)..( 7): Result.004 file - promoters60/5663182
aatctaa

SEQ ID NO: 146328 - DNA, 7 bp, Unknown
  misc_feature (1)..( 7): Result.004 file - promoters60/5663182
aatgtaa

SEQ ID NO: 146329 - DNA, 8 bp, Unknown
  misc_feature (1)..( 8): Result.004 file - promoters60/5663182
atatatac

SEQ ID NO: 146330 - DNA, 8 bp, Unknown
  misc_feature (1)..( 8): Result.004 file - promoters60/5663182
atatctac

SEQ ID NO: 146331 - DNA, 8 bp, Unknown
  misc_feature (1)..( 8): Result.004 file - promoters60/5663182
aatcagtg

SEQ ID NO: 146332 - DNA, 8 bp, Unknown
  misc_feature (1)..( 8): Result.004 file - promoters60/5663182
aatgagtg

SEQ ID NO: 146333 - DNA, 8 bp, Unknown
  misc_feature (1)..( 8): Result.004 file - promoters60/5663182
aaataaat

SEQ ID NO: 146334 - DNA, 8 bp, Unknown
  misc_feature (1)..( 8): Result.004 file - promoters60/5663182
aaaaaaaa

SEQ ID NO: 146335 - DNA, 8 bp, Unknown
  misc_feature (1)..( 8): Result.004 file - promoters60/5663182
tcataaat

SEQ ID NO: 146336 - DNA, 7 bp, Unknown
  misc_feature (1)..( 7): Result.004 file - promoters60/5663182
ataaaac

SEQ ID NO: 146337 - DNA, 7 bp, Unknown
  misc_feature (1)..( 7): Result.004 file - promoters60/5663182
ataaaac

SEQ ID NO: 146338 - DNA, 8 bp, Unknown
  misc_feature (1)..( 8): Result.004 file - promoters60/5663182
aacagaaa

SEQ ID NO: 146339 - DNA, 8 bp, Unknown
  misc_feature (1)..( 8): Result.004 file - promoters60/5663182
aacaaaaa

SEQ ID NO: 146340 - DNA, 6 bp, Unknown
  misc_feature (1)..( 6): Result.004 file - promoters60/5663182
aaaaga

SEQ ID NO: 146341 - DNA, 6 bp, Unknown
  misc_feature (1)..( 6): Result.004 file - promoters60/5663182
aaaaga

SEQ ID NO: 146342 - DNA, 7 bp, Unknown
  misc_feature (1)..( 7): Result.004 file - promoters60/5663182
atcatgt

SEQ ID NO: 146343 - DNA, 7 bp, Unknown
  misc_feature (1)..( 7): Result.004 file - promoters60/5663182
atcatgt

SEQ ID NO: 146344 - DNA, 6 bp, Unknown
  misc_feature (1)..( 6): Result.004 file - promoters60/5663182
gagtcc

SEQ ID NO: 146345 - DNA, 6 bp, Unknown
  misc_feature (1)..( 6): Result.004 file - promoters60/5663182
gagtcc

SEQ ID NO: 146346 - DNA, 9 bp, Unknown
  misc_feature (1)..( 9): Result.004 file - promoters60/5663182
cgtcgattc

SEQ ID NO: 146347 - DNA, 9 bp, Unknown
  misc_feature (1)..( 9): Result.004 file - promoters60/5663182
tttcggttc

SEQ ID NO: 146348 - DNA, 9 bp, Unknown
  misc_feature (1)..( 9): Result.004 file - promoters60/5663182
ttttggttt

SEQ ID NO: 146349 - DNA, 6 bp, Unknown
  misc_feature (1)..( 6): Result.004 file - promoters60/5663182
tcttta

SEQ ID NO: 146350 - DNA, 6 bp, Unknown
  misc_feature (1)..( 6): Result.004 file - promoters60/5663182
tcttta

SEQ ID NO: 146351 - DNA, 6 bp, Unknown
  misc_feature (1)..( 6): Result.004 file - promoters60/5663182
tccctt

SEQ ID NO: 146352 - DNA, 6 bp, Unknown
  misc_feature (1)..( 6): Result.004 file - promoters60/5663221
tccctt

SEQ ID NO: 146353 - DNA, 11 bp, Unknown
  misc_feature (1)..( 11): Result.004 file - promoters60/5663221
ttttatggtcg

SEQ ID NO: 146354 - DNA, 11 bp, Unknown
  misc_feature (1)..( 11): Result.004 file - promoters60/5663221
ttttttggttt

SEQ ID NO: 146355 - DNA, 11 bp, Unknown
  misc_feature (1)..( 11): Result.004 file - promoters60/5663221
atttatgttgt

SEQ ID NO: 146356 - DNA, 11 bp, Unknown
  misc_feature (1)..( 11): Result.004 file - promoters60/5663221
gttgattttga

SEQ ID NO: 146357 - DNA, 11 bp, Unknown
  misc_feature (1)..( 11): Result.004 file - promoters60/5663221
gtttttgtttg

SEQ ID NO: 146358 - DNA, 11 bp, Unknown
  misc_feature (1)..( 11): Result.004 file - promoters60/5663221
gtttttctttc

SEQ ID NO: 146359 - DNA, 11 bp, Unknown
  misc_feature (1)..( 11): Result.004 file - promoters60/5663221
acttttctagc

SEQ ID NO: 146360 - DNA, 11 bp, Unknown
  misc_feature (1)..( 11): Result.004 file - promoters60/5663221
gtcttgtaaac

SEQ ID NO: 146361 - DNA, 11 bp, Unknown
  misc_feature (1)..( 11): Result.004 file - promoters60/5663221
aatttgaaaat

SEQ ID NO: 146362 - DNA, 11 bp, Unknown
  misc_feature (1)..( 11): Result.004 file - promoters60/5663221
cgtttgaattt

SEQ ID NO: 146363 - DNA, 11 bp, Unknown
  misc_feature (1)..( 11): Result.004 file - promoters60/5663221
aatatgaagaa

SEQ ID NO: 146364 - DNA, 11 bp, Unknown
  misc_feature (1)..( 11): Result.004 file - promoters60/5663221
ttttttaattt

SEQ ID NO: 146365 - DNA, 11 bp, Unknown
  misc_feature (1)..( 11): Result.004 file - promoters60/5663221
aatctgatgga

SEQ ID NO: 146366 - DNA, 15 bp, Unknown
  misc_feature (1)..( 15): Result.004 file - promoters60/5663221
taaattattgaagct

SEQ ID NO: 146367 - DNA, 15 bp, Unknown
  misc_feature (1)..( 15): Result.004 file - promoters60/5663221
agggatatagaacaa

SEQ ID NO: 146368 - DNA, 15 bp, Unknown
  misc_feature (1)..( 15): Result.004 file - promoters60/5663221
agggatttagattat

SEQ ID NO: 146369 - DNA, 15 bp, Unknown
  misc_feature (1)..( 15): Result.004 file - promoters60/5663221
caaaacattgagatt

SEQ ID NO: 146370 - DNA, 15 bp, Unknown
  misc_feature (1)..( 15): Result.004 file - promoters60/5663221
tgtgatttactaaga

SEQ ID NO: 146371 - DNA, 15 bp, Unknown
  misc_feature (1)..( 15): Result.004 file - promoters60/5663224
aattcttcggagatt

SEQ ID NO: 146372 - DNA, 10 bp, Unknown
  misc_feature (1)..( 10): Result.004 file - promoters60/5663224
cttttaaatt

SEQ ID NO: 146373 - DNA, 10 bp, Unknown
  misc_feature (1)..( 10): Result.004 file - promoters60/5663224
cttgtaatgt

SEQ ID NO: 146374 - DNA, 11 bp, Unknown
  misc_feature (1)..( 11): Result.004 file - promoters60/5663224
gttttgaatta

SEQ ID NO: 146375 - DNA, 7 bp, Unknown
  misc_feature (1)..( 7): Result.004 file - promoters60/5663224
gaattaa

SEQ ID NO: 146376 - DNA, 7 bp, Unknown
  misc_feature (1)..( 7): Result.004 file - promoters60/5663224
gaattat

SEQ ID NO: 146377 - DNA, 7 bp, Unknown
  misc_feature (1)..( 7): Result.004 file - promoters60/5663234
aaattat

SEQ ID NO: 146378 - DNA, 7 bp, Unknown
  misc_feature (1)..( 7): Result.004 file - promoters60/5663234
aaacttg

SEQ ID NO: 146379 - DNA, 7 bp, Unknown
  misc_feature (1)..( 7): Result.004 file - promoters60/5663234
aaacttt

SEQ ID NO: 146380 - DNA, 8 bp, Unknown
  misc_feature (1)..( 8): Result.004 file - promoters60/5663234
taacgttt

SEQ ID NO: 146381 - DNA, 10 bp, Unknown
  misc_feature (1)..( 10): Result.004 file - promoters60/5663234
catatatata

SEQ ID NO: 146382 - DNA, 10 bp, Unknown
  misc_feature (1)..( 10): Result.004 file - promoters60/5663234
catataaata

SEQ ID NO: 146383 - DNA, 10 bp, Unknown
  misc_feature (1)..( 10): Result.004 file - promoters60/5663234
cctatttatg

SEQ ID NO: 146384 - DNA, 8 bp, Unknown
  misc_feature (1)..( 8): Result.004 file - promoters60/5663234
cattttag

SEQ ID NO: 146385 - DNA, 8 bp, Unknown
  misc_feature (1)..( 8): Result.004 file - promoters60/5663234
cattttcg

SEQ ID NO: 146386 - DNA, 8 bp, Unknown
  misc_feature (1)..( 8): Result.004 file - promoters60/5663234
gattatcg

SEQ ID NO: 146387 - DNA, 10 bp, Unknown
  misc_feature (1)..( 10): Result.004 file - promoters60/5663234
ctttaaagat

SEQ ID NO: 146388 - DNA, 10 bp, Unknown
  misc_feature (1)..( 10): Result.004 file - promoters60/5663234
cataaaagat

SEQ ID NO: 146389 - DNA, 10 bp, Unknown
  misc_feature (1)..( 10): Result.004 file - promoters60/5663234
catacaagaa

SEQ ID NO: 146390 - DNA, 8 bp, Unknown
  misc_feature (1)..( 8): Result.004 file - promoters60/5663234
ataaaaaa

SEQ ID NO: 146391 - DNA, 8 bp, Unknown
  misc_feature (1)..( 8): Result.004 file - promoters60/5663234
ataaaaaa

SEQ ID NO: 146392 - DNA, 8 bp, Unknown
  misc_feature (1)..( 8): Result.004 file - promoters60/5663234
atataaag

SEQ ID NO: 146393 - DNA, 14 bp, Unknown
  misc_feature (1)..( 14): Result.004 file - promoters60/5663234
tgatggtcaagtaa

SEQ ID NO: 146394 - DNA, 14 bp, Unknown
  misc_feature (1)..( 14): Result.004 file - promoters60/5663234
tgatggtattgact

SEQ ID NO: 146395 - DNA, 14 bp, Unknown
  misc_feature (1)..( 14): Result.004 file - promoters60/5663234
atatgttattaact

SEQ ID NO: 146396 - DNA, 8 bp, Unknown
  misc_feature (1)..( 8): Result.004 file - promoters60/5663234
ttaaataa

SEQ ID NO: 146397 - DNA, 8 bp, Unknown
  misc_feature (1)..( 8): Result.004 file - promoters60/5663234
ttatatat

SEQ ID NO: 146398 - DNA, 8 bp, Unknown
  misc_feature (1)..( 8): Result.004 file - promoters60/5663234
ctatatat

SEQ ID NO: 146399 - DNA, 7 bp, Unknown
  misc_feature (1)..( 7): Result.004 file - promoters60/5663234
taaagta

SEQ ID NO: 146400 - DNA, 7 bp, Unknown
  misc_feature (1)..( 7): Result.004 file - promoters60/5663234
taaagtt

SEQ ID NO: 146401 - DNA, 7 bp, Unknown
  misc_feature (1)..( 7): Result.004 file - promoters60/5663234
taatgtt

SEQ ID NO: 146402 - DNA, 7 bp, Unknown
  misc_feature (1)..( 7): Result.004 file - promoters60/5663234
aaatttg

SEQ ID NO: 146403 - DNA, 7 bp, Unknown
  misc_feature (1)..( 7): Result.004 file - promoters60/5663234
aaagttg

SEQ ID NO: 146404 - DNA, 7 bp, Unknown
  misc_feature (1)..( 7): Result.004 file - promoters60/5663234
aaatttg

SEQ ID NO: 146405 - DNA, 7 bp, Unknown
  misc_feature (1)..( 7): Result.004 file - promoters60/5663234
ttttatt

SEQ ID NO: 146406 - DNA, 7 bp, Unknown
  misc_feature (1)..( 7): Result.004 file - promoters60/5663234
atttatt

SEQ ID NO: 146407 - DNA, 8 bp, Unknown
  misc_feature (1)..( 8): Result.004 file - promoters60/5663234
ttttgatt

SEQ ID NO: 146408 - DNA, 7 bp, Unknown
  misc_feature (1)..( 7): Result.004 file - promoters60/5663234
tatttaa

SEQ ID NO: 146409 - DNA, 7 bp, Unknown
  misc_feature (1)..( 7): Result.004 file - promoters60/5663234
tatttat

SEQ ID NO: 146410 - DNA, 7 bp, Unknown
  misc_feature (1)..( 7): Result.004 file - promoters60/5663281
gatttaa

SEQ ID NO: 146411 - DNA, 8 bp, Unknown
  misc_feature (1)..( 8): Result.004 file - promoters60/5663281
aactattt

SEQ ID NO: 146412 - DNA, 8 bp, Unknown
  misc_feature (1)..( 8): Result.004 file - promoters60/5663281
aaccattt

SEQ ID NO: 146413 - DNA, 8 bp, Unknown
  misc_feature (1)..( 8): Result.004 file - promoters60/5663281
aataaaat

SEQ ID NO: 146414 - DNA, 8 bp, Unknown
  misc_feature (1)..( 8): Result.004 file - promoters60/5663281
aataaaat

SEQ ID NO: 146415 - DNA, 12 bp, Unknown
  misc_feature (1)..( 12): Result.004 file - promoters60/5663281
aattaatatttt

SEQ ID NO: 146416 - DNA, 12 bp, Unknown
  misc_feature (1)..( 12): Result.004 file - promoters60/5663281
agttaatttttt

SEQ ID NO: 146417 - DNA, 12 bp, Unknown
  misc_feature (1)..( 12): Result.004 file - promoters60/5663281
aatgaatgaatt

SEQ ID NO: 146418 - DNA, 7 bp, Unknown
  misc_feature (1)..( 7): Result.004 file - promoters60/5663281
ttatttt

SEQ ID NO: 146419 - DNA, 7 bp, Unknown
  misc_feature (1)..( 7): Result.004 file - promoters60/5663281
ttatttt

SEQ ID NO: 146420 - DNA, 6 bp, Unknown
  misc_feature (1)..( 6): Result.004 file - promoters60/5663281
taacat

SEQ ID NO: 146421 - DNA, 6 bp, Unknown
  misc_feature (1)..( 6): Result.004 file - promoters60/5663281
taacat

SEQ ID NO: 146422 - DNA, 7 bp, Unknown
  misc_feature (1)..( 7): Result.004 file - promoters60/5663281
aatgtga

SEQ ID NO: 146423 - DNA, 7 bp, Unknown
  misc_feature (1)..( 7): Result.004 file - promoters60/5663281
aatttga

SEQ ID NO: 146424 - DNA, 8 bp, Unknown
  misc_feature (1)..( 8): Result.004 file - promoters60/5663281
aaaacaaa

SEQ ID NO: 146425 - DNA, 8 bp, Unknown
  misc_feature (1)..( 8): Result.004 file - promoters60/5663281
aaaaaaaa

SEQ ID NO: 146426 - DNA, 8 bp, Unknown
  misc_feature (1)..( 8): Result.004 file - promoters60/5663281
atttgatt

SEQ ID NO: 146427 - DNA, 8 bp, Unknown
  misc_feature (1)..( 8): Result.004 file - promoters60/5663281
atttgatt

SEQ ID NO: 146428 - DNA, 10 bp, Unknown
  misc_feature (1)..( 10): Result.004 file - promoters60/5663281
aaaaatactt

SEQ ID NO: 146429 - DNA, 10 bp, Unknown
  misc_feature (1)..( 10): Result.004 file - promoters60/5663281
aaaaaaactt

SEQ ID NO: 146430 - DNA, 6 bp, Unknown
  misc_feature (1)..( 6): Result.004 file - promoters60/5663281
tatatt

SEQ ID NO: 146431 - DNA, 6 bp, Unknown
  misc_feature (1)..( 6): Result.004 file - promoters60/5663281
tatatt

SEQ ID NO: 146432 - DNA, 8 bp, Unknown
  misc_feature (1)..( 8): Result.004 file - promoters60/5663281
acatgacg

SEQ ID NO: 146433 - DNA, 8 bp, Unknown
  misc_feature (1)..( 8): Result.004 file - promoters60/5663281
acataacg

SEQ ID NO: 146434 - DNA, 7 bp, Unknown
  misc_feature (1)..( 7): Result.004 file - promoters60/5663281
cattttt

SEQ ID NO: 146435 - DNA, 7 bp, Unknown
  misc_feature (1)..( 7): Result.004 file - promoters60/5663281
cattttt

SEQ ID NO: 146436 - DNA, 6 bp, Unknown
  misc_feature (1)..( 6): Result.004 file - promoters60/5663281
tagagt

SEQ ID NO: 146437 - DNA, 6 bp, Unknown
  misc_feature (1)..( 6): Result.004 file - promoters60/5663281
tagagt

SEQ ID NO: 146438 - DNA, 7 bp, Unknown
  misc_feature (1)..( 7): Result.004 file - promoters60/5663281
aaatcct

SEQ ID NO: 146439 - DNA, 7 bp, Unknown
  misc_feature (1)..( 7): Result.004 file - promoters60/5663281
aaaccct

SEQ ID NO: 146440 - DNA, 7 bp, Unknown
  misc_feature (1)..( 7): Result.004 file - promoters60/5663281
gtgttta

SEQ ID NO: 146441 - DNA, 7 bp, Unknown
  misc_feature (1)..( 7): Result.004 file - promoters60/5663281
gtgttta

SEQ ID NO: 146442 - DNA, 6 bp, Unknown
  misc_feature (1)..( 6): Result.004 file - promoters60/5663281
taaaca

SEQ ID NO: 146443 - DNA, 6 bp, Unknown
  misc_feature (1)..( 6): Result.004 file - promoters60/5663281
taaaca

SEQ ID NO: 146444 - DNA, 6 bp, Unknown
  misc_feature (1)..( 6): Result.004 file - promoters60/5663281
aagata

SEQ ID NO: 146445 - DNA, 6 bp, Unknown
  misc_feature (1)..( 6): Result.004 file - promoters60/5663327
aagata

SEQ ID NO: 146446 - DNA, 8 bp, Unknown
  misc_feature (1)..( 8): Result.004 file - promoters60/5663327
cagttttc

SEQ ID NO: 146447 - DNA, 8 bp, Unknown
  misc_feature (1)..( 8): Result.004 file - promoters60/5663327
cagatttc

SEQ ID NO: 146448 - DNA, 9 bp, Unknown
  misc_feature (1)..( 9): Result.004 file - promoters60/5663327
tttttgaat

SEQ ID NO: 146449 - DNA, 9 bp, Unknown
  misc_feature (1)..( 9): Result.004 file - promoters60/5663327
tgtttgaaa

SEQ ID NO: 146450 - DNA, 9 bp, Unknown
  misc_feature (1)..( 9): Result.004 file - promoters60/5663327
tgtatgaaa

SEQ ID NO: 146451 - DNA, 6 bp, Unknown
  misc_feature (1)..( 6): Result.004 file - promoters60/5663327
gaataa

SEQ ID NO: 146452 - DNA, 6 bp, Unknown
  misc_feature (1)..( 6): Result.004 file - promoters60/5663327
gaataa

SEQ ID NO: 146453 - DNA, 10 bp, Unknown
  misc_feature (1)..( 10): Result.004 file - promoters60/5663327
atattttttt

SEQ ID NO: 146454 - DNA, 10 bp, Unknown
  misc_feature (1)..( 10): Result.004 file - promoters60/5663327
acattttttt

SEQ ID NO: 146455 - DNA, 10 bp, Unknown
  misc_feature (1)..( 10): Result.004 file - promoters60/5663327
acattttatc

SEQ ID NO: 146456 - DNA, 7 bp, Unknown
  misc_feature (1)..( 7): Result.004 file - promoters60/5663327
taatatt

SEQ ID NO: 146457 - DNA, 7 bp, Unknown
  misc_feature (1)..( 7): Result.004 file - promoters60/5663327
aaatatt

SEQ ID NO: 146458 - DNA, 7 bp, Unknown
  misc_feature (1)..( 7): Result.004 file - promoters60/5663327
aaaaatt

SEQ ID NO: 146459 - DNA, 9 bp, Unknown
  misc_feature (1)..( 9): Result.004 file - promoters60/5663327
catatcaaa

SEQ ID NO: 146460 - DNA, 9 bp, Unknown
  misc_feature (1)..( 9): Result.004 file - promoters60/5663327
tgtatgaaa

SEQ ID NO: 146461 - DNA, 9 bp, Unknown
  misc_feature (1)..( 9): Result.004 file - promoters60/5663327
tgtttgaaa

SEQ ID NO: 146462 - DNA, 6 bp, Unknown
  misc_feature (1)..( 6): Result.004 file - promoters60/5663327
aatata

SEQ ID NO: 146463 - DNA, 6 bp, Unknown
  misc_feature (1)..( 6): Result.004 file - promoters60/5663327
aatata

SEQ ID NO: 146464 - DNA, 7 bp, Unknown
  misc_feature (1)..( 7): Result.004 file - promoters60/5663327
attttaa

SEQ ID NO: 146465 - DNA, 7 bp, Unknown
  misc_feature (1)..( 7): Result.004 file - promoters60/5663327
attttaa

SEQ ID NO: 146466 - DNA, 8 bp, Unknown
  misc_feature (1)..( 8): Result.004 file - promoters60/5663327
aattgatc

SEQ ID NO: 146467 - DNA, 8 bp, Unknown
  misc_feature (1)..( 8): Result.004 file - promoters60/5663327
aatcgatc

SEQ ID NO: 146468 - DNA, 6 bp, Unknown
  misc_feature (1)..( 6): Result.004 file - promoters60/5663327
aaaaat

SEQ ID NO: 146469 - DNA, 6 bp, Unknown
  misc_feature (1)..( 6): Result.004 file - promoters60/5663327
aaaaat

SEQ ID NO: 146470 - DNA, 10 bp, Unknown
  misc_feature (1)..( 10): Result.004 file - promoters60/5663327
ctcttcaatt

SEQ ID NO: 146471 - DNA, 10 bp, Unknown
  misc_feature (1)..( 10): Result.004 file - promoters60/5663327
ctctgcaatt

SEQ ID NO: 146472 - DNA, 8 bp, Unknown
  misc_feature (1)..( 8): Result.004 file - promoters60/5663327
taaaccga

SEQ ID NO: 146473 - DNA, 8 bp, Unknown
  misc_feature (1)..( 8): Result.004 file - promoters60/5663327
taaaacga

SEQ ID NO: 146474 - DNA, 6 bp, Unknown
  misc_feature (1)..( 6): Result.004 file - promoters60/5663327
ttaatc

SEQ ID NO: 146475 - DNA, 6 bp, Unknown
  misc_feature (1)..( 6): Result.004 file - promoters60/5663327
ttaatc

SEQ ID NO: 146476 - DNA, 12 bp, Unknown
  misc_feature (1)..( 12): Result.004 file - promoters60/5663327
ttaaaatcacat

SEQ ID NO: 146477 - DNA, 12 bp, Unknown
  misc_feature (1)..( 12): Result.004 file - promoters60/5663327
ttataattacat

SEQ ID NO: 146478 - DNA, 14 bp, Unknown
  misc_feature (1)..( 14): Result.004 file - promoters60/5663327
tataagtttgatat

SEQ ID NO: 146479 - DNA, 14 bp, Unknown
  misc_feature (1)..( 14): Result.004 file - promoters60/5663327
tataattttggtat

SEQ ID NO: 146480 - DNA, 10 bp, Unknown
  misc_feature (1)..( 10): Result.004 file - promoters60/5663327
aaactaattt

SEQ ID NO: 146481 - DNA, 10 bp, Unknown
  misc_feature (1)..( 10): Result.004 file - promoters60/5663327
aaattaattt

SEQ ID NO: 146482 - DNA, 9 bp, Unknown
  misc_feature (1)..( 9): Result.004 file - promoters60/5663327
tttcttttc

SEQ ID NO: 146483 - DNA, 9 bp, Unknown
  misc_feature (1)..( 9): Result.004 file - promoters60/5663327
tttcttttc

SEQ ID NO: 146484 - DNA, 10 bp, Unknown
  misc_feature (1)..( 10): Result.004 file - promoters60/5663327
tttatatttt

SEQ ID NO: 146485 - DNA, 10 bp, Unknown
  misc_feature (1)..( 10): Result.004 file - promoters60/5663327
tttaaatttt

SEQ ID NO: 146486 - DNA, 6 bp, Unknown
  misc_feature (1)..( 6): Result.004 file - promoters60/5663327
caaaat

SEQ ID NO: 146487 - DNA, 6 bp, Unknown
  misc_feature (1)..( 6): Result.004 file - promoters60/5663327
caaaat

SEQ ID NO: 146488 - DNA, 13 bp, Unknown
  misc_feature (1)..( 13): Result.004 file - promoters60/5663327
tttaaaaataaat

SEQ ID NO: 146489 - DNA, 13 bp, Unknown
  misc_feature (1)..( 13): Result.004 file - promoters60/5663327
tttagaaattaat

SEQ ID NO: 146490 - DNA, 7 bp, Unknown
  misc_feature (1)..( 7): Result.004 file - promoters60/5663327
aattaaa

SEQ ID NO: 146491 - DNA, 7 bp, Unknown
  misc_feature (1)..( 7): Result.004 file - promoters60/5663333
aatcaaa

SEQ ID NO: 146492 - DNA, 8 bp, Unknown
  misc_feature (1)..( 8): Result.004 file - promoters60/5663333
catgaaga

SEQ ID NO: 146493 - DNA, 8 bp, Unknown
  misc_feature (1)..( 8): Result.004 file - promoters60/5663333
catgaata

SEQ ID NO: 146494 - DNA, 8 bp, Unknown
  misc_feature (1)..( 8): Result.004 file - promoters60/5663333
catggata

SEQ ID NO: 146495 - DNA, 7 bp, Unknown
  misc_feature (1)..( 7): Result.004 file - promoters60/5663333
cgatcat

SEQ ID NO: 146496 - DNA, 7 bp, Unknown
  misc_feature (1)..( 7): Result.004 file - promoters60/5663333
tgatcat

SEQ ID NO: 146497 - DNA, 7 bp, Unknown
  misc_feature (1)..( 7): Result.004 file - promoters60/5663333
cgaccat

SEQ ID NO: 146498 - DNA, 7 bp, Unknown
  misc_feature (1)..( 7): Result.004 file - promoters60/5663333
agaaatt

SEQ ID NO: 146499 - DNA, 7 bp, Unknown
  misc_feature (1)..( 7): Result.004 file - promoters60/5663333
agaaatc

SEQ ID NO: 146500 - DNA, 7 bp, Unknown
  misc_feature (1)..( 7): Result.004 file - promoters60/5663333
agacatt

SEQ ID NO: 146501 - DNA, 7 bp, Unknown
  misc_feature (1)..( 7): Result.004 file - promoters60/5663333
taaactt

SEQ ID NO: 146502 - DNA, 7 bp, Unknown
  misc_feature (1)..( 7): Result.004 file - promoters60/5663333
taatctt

SEQ ID NO: 146503 - DNA, 7 bp, Unknown
  misc_feature (1)..( 7): Result.004 file - promoters60/5663358
taaactt

SEQ ID NO: 146504 - DNA, 13 bp, Unknown
  misc_feature (1)..( 13): Result.004 file - promoters60/5663358
ataaattattttc

SEQ ID NO: 146505 - DNA, 13 bp, Unknown
  misc_feature (1)..( 13): Result.004 file - promoters60/5663358
gtaatttattttc

SEQ ID NO: 146506 - DNA, 13 bp, Unknown
  misc_feature (1)..( 13): Result.004 file - promoters60/5663358
ataaattatacaa

SEQ ID NO: 146507 - DNA, 13 bp, Unknown
  misc_feature (1)..( 13): Result.004 file - promoters60/5663358
atttaatattttt

SEQ ID NO: 146508 - DNA, 13 bp, Unknown
  misc_feature (1)..( 13): Result.004 file - promoters60/5663358
agaatttagtcac

SEQ ID NO: 146509 - DNA, 13 bp, Unknown
  misc_feature (1)..( 13): Result.004 file - promoters60/5663358
tgaacttagtctg

SEQ ID NO: 146510 - DNA, 14 bp, Unknown
  misc_feature (1)..( 14): Result.004 file - promoters60/5663358
gtcagtgaaagcaa

SEQ ID NO: 146511 - DNA, 14 bp, Unknown
  misc_feature (1)..( 14): Result.004 file - promoters60/5663358
aactttgaaagcaa

SEQ ID NO: 146512 - DNA, 14 bp, Unknown
  misc_feature (1)..( 14): Result.004 file - promoters60/5663358
agaagtgaaactga

SEQ ID NO: 146513 - DNA, 14 bp, Unknown
  misc_feature (1)..( 14): Result.004 file - promoters60/5663358
aaactttaaaaact

SEQ ID NO: 146514 - DNA, 14 bp, Unknown
  misc_feature (1)..( 14): Result.004 file - promoters60/5663358
agaaatgaaatcat

SEQ ID NO: 146515 - DNA, 14 bp, Unknown
  misc_feature (1)..( 14): Result.004 file - promoters60/5663358
ccaaaagaaacgaa

SEQ ID NO: 146516 - DNA, 9 bp, Unknown
  misc_feature (1)..( 9): Result.004 file - promoters60/5663358
gatagtatt

SEQ ID NO: 146517 - DNA, 9 bp, Unknown
  misc_feature (1)..( 9): Result.004 file - promoters60/5663358
tataatata

SEQ ID NO: 146518 - DNA, 9 bp, Unknown
  misc_feature (1)..( 9): Result.004 file - promoters60/5663358
attaagata

SEQ ID NO: 146519 - DNA, 9 bp, Unknown
  misc_feature (1)..( 9): Result.004 file - promoters60/5663358
tctaaaata

SEQ ID NO: 146520 - DNA, 9 bp, Unknown
  misc_feature (1)..( 9): Result.004 file - promoters60/5663358
tttaaaatt

SEQ ID NO: 146521 - DNA, 9 bp, Unknown
  misc_feature (1)..( 9): Result.004 file - promoters60/5663370
aaaaaaatt

SEQ ID NO: 146522 - DNA, 8 bp, Unknown
  misc_feature (1)..( 8): Result.004 file - promoters60/5663370
acacacaa

SEQ ID NO: 146523 - DNA, 8 bp, Unknown
  misc_feature (1)..( 8): Result.004 file - promoters60/5663370
acactcaa

SEQ ID NO: 146524 - DNA, 8 bp, Unknown
  misc_feature (1)..( 8): Result.004 file - promoters60/5663370
caagacaa

SEQ ID NO: 146525 - DNA, 8 bp, Unknown
  misc_feature (1)..( 8): Result.004 file - promoters60/5663370
caaaacaa

SEQ ID NO: 146526 - DNA, 8 bp, Unknown
  misc_feature (1)..( 8): Result.004 file - promoters60/5663370
aaataatt

SEQ ID NO: 146527 - DNA, 8 bp, Unknown
  misc_feature (1)..( 8): Result.004 file - promoters60/5663370
aaattatt

SEQ ID NO: 146528 - DNA, 6 bp, Unknown
  misc_feature (1)..( 6): Result.004 file - promoters60/5663370
aaaacg

SEQ ID NO: 146529 - DNA, 6 bp, Unknown
  misc_feature (1)..( 6): Result.004 file - promoters60/5663370
aaaacg

SEQ ID NO: 146530 - DNA, 9 bp, Unknown
  misc_feature (1)..( 9): Result.004 file - promoters60/5663370
aattttggt

SEQ ID NO: 146531 - DNA, 9 bp, Unknown
  misc_feature (1)..( 9): Result.004 file - promoters60/5663370
aatattggt

SEQ ID NO: 146532 - DNA, 7 bp, Unknown
  misc_feature (1)..( 7): Result.004 file - promoters60/5663370
attgcaa

SEQ ID NO: 146533 - DNA, 7 bp, Unknown
  misc_feature (1)..( 7): Result.004 file - promoters60/5663370
atttcaa

SEQ ID NO: 146534 - DNA, 8 bp, Unknown
  misc_feature (1)..( 8): Result.004 file - promoters60/5663370
tggcgtta

SEQ ID NO: 146535 - DNA, 8 bp, Unknown
  misc_feature (1)..( 8): Result.004 file - promoters60/5663370
tggagtta

SEQ ID NO: 146536 - DNA, 10 bp, Unknown
  misc_feature (1)..( 10): Result.004 file - promoters60/5663370
tggtcattat

SEQ ID NO: 146537 - DNA, 10 bp, Unknown
  misc_feature (1)..( 10): Result.004 file - promoters60/5663370
tggttattca

SEQ ID NO: 146538 - DNA, 10 bp, Unknown
  misc_feature (1)..( 10): Result.004 file - promoters60/5663370
atgttattca

SEQ ID NO: 146539 - DNA, 7 bp, Unknown
  misc_feature (1)..( 7): Result.004 file - promoters60/5663370
gagtgga

SEQ ID NO: 146540 - DNA, 7 bp, Unknown
  misc_feature (1)..( 7): Result.004 file - promoters60/5663370
gagagga

SEQ ID NO: 146541 - DNA, 7 bp, Unknown
  misc_feature (1)..( 7): Result.004 file - promoters60/5663370
acaagaa

SEQ ID NO: 146542 - DNA, 7 bp, Unknown
  misc_feature (1)..( 7): Result.004 file - promoters60/5663370
acaagaa

SEQ ID NO: 146543 - DNA, 6 bp, Unknown
  misc_feature (1)..( 6): Result.004 file - promoters60/5663370
ctaaaa

SEQ ID NO: 146544 - DNA, 6 bp, Unknown
  misc_feature (1)..( 6): Result.004 file - promoters60/5663370
ctaaaa

SEQ ID NO: 146545 - DNA, 10 bp, Unknown
  misc_feature (1)..( 10): Result.004 file - promoters60/5663370
aaatcaacca

SEQ ID NO: 146546 - DNA, 10 bp, Unknown
  misc_feature (1)..( 10): Result.004 file - promoters60/5663370
aaaacaacca

SEQ ID NO: 146547 - DNA, 6 bp, Unknown
  misc_feature (1)..( 6): Result.004 file - promoters60/5663370
aaaaat

SEQ ID NO: 146548 - DNA, 6 bp, Unknown
  misc_feature (1)..( 6): Result.004 file - promoters60/5663370
aaaaat

SEQ ID NO: 146549 - DNA, 8 bp, Unknown
  misc_feature (1)..( 8): Result.004 file - promoters60/5663370
tctgtata

SEQ ID NO: 146550 - DNA, 8 bp, Unknown
  misc_feature (1)..( 8): Result.004 file - promoters60/5663370
tctgtata

SEQ ID NO: 146551 - DNA, 9 bp, Unknown
  misc_feature (1)..( 9): Result.004 file - promoters60/5663370
ataaatttc

SEQ ID NO: 146552 - DNA, 9 bp, Unknown
  misc_feature (1)..( 9): Result.004 file - promoters60/5663370
ataagtttc

SEQ ID NO: 146553 - DNA, 9 bp, Unknown
  misc_feature (1)..( 9): Result.004 file - promoters60/5663370
ttctacatg

SEQ ID NO: 146554 - DNA, 9 bp, Unknown
  misc_feature (1)..( 9): Result.004 file - promoters60/5663370
ttcaacatc

SEQ ID NO: 146555 - DNA, 9 bp, Unknown
  misc_feature (1)..( 9): Result.004 file - promoters60/5663370
gttaacatc

SEQ ID NO: 146556 - DNA, 7 bp, Unknown
  misc_feature (1)..( 7): Result.004 file - promoters60/5663370
catttct

SEQ ID NO: 146557 - DNA, 7 bp, Unknown
  misc_feature (1)..( 7): Result.004 file - promoters60/5663370
catctct

SEQ ID NO: 146558 - DNA, 6 bp, Unknown
  misc_feature (1)..( 6): Result.004 file - promoters60/5663370
atgagc

SEQ ID NO: 146559 - DNA, 6 bp, Unknown
  misc_feature (1)..( 6): Result.004 file - promoters60/5663370
atgagc

SEQ ID NO: 146560 - DNA, 6 bp, Unknown
  misc_feature (1)..( 6): Result.004 file - promoters60/5663370
taaaac

SEQ ID NO: 146561 - DNA, 6 bp, Unknown
  misc_feature (1)..( 6): Result.004 file - promoters60/5663370
taaaac

SEQ ID NO: 146562 - DNA, 10 bp, Unknown
  misc_feature (1)..( 10): Result.004 file - promoters60/5663370
ttcaattttt

SEQ ID NO: 146563 - DNA, 10 bp, Unknown
  misc_feature (1)..( 10): Result.004 file - promoters60/5663370
ttctattttt

SEQ ID NO: 146564 - DNA, 6 bp, Unknown
  misc_feature (1)..( 6): Result.004 file - promoters60/5663370
atgaga

SEQ ID NO: 146565 - DNA, 6 bp, Unknown
  misc_feature (1)..( 6): Result.004 file - promoters60/5663370
atgaga

SEQ ID NO: 146566 - DNA, 6 bp, Unknown
  misc_feature (1)..( 6): Result.004 file - promoters60/5663370
gaggaa

SEQ ID NO: 146567 - DNA, 6 bp, Unknown
  misc_feature (1)..( 6): Result.004 file - promoters60/5663370
gaggaa

SEQ ID NO: 146568 - DNA, 8 bp, Unknown
  misc_feature (1)..( 8): Result.004 file - promoters60/5663370
acttttca

SEQ ID NO: 146569 - DNA, 8 bp, Unknown
  misc_feature (1)..( 8): Result.004 file - promoters60/5663370
actcttca

SEQ ID NO: 146570 - DNA, 7 bp, Unknown
  misc_feature (1)..( 7): Result.004 file - promoters60/5663370
caaaata

SEQ ID NO: 146571 - DNA, 7 bp, Unknown
  misc_feature (1)..( 7): Result.004 file - promoters60/5663374
caagata

SEQ ID NO: 146572 - DNA, 8 bp, Unknown
  misc_feature (1)..( 8): Result.004 file - promoters60/5663374
agagattt

SEQ ID NO: 146573 - DNA, 8 bp, Unknown
  misc_feature (1)..( 8): Result.004 file - promoters60/5663374
agacattt

SEQ ID NO: 146574 - DNA, 13 bp, Unknown
  misc_feature (1)..( 13): Result.004 file - promoters60/5663374
caataaattaaat

SEQ ID NO: 146575 - DNA, 13 bp, Unknown
  misc_feature (1)..( 13): Result.004 file - promoters60/5663374
aaataaaataaat

SEQ ID NO: 146576 - DNA, 13 bp, Unknown
  misc_feature (1)..( 13): Result.004 file - promoters60/5663374
aaatgaaatatct

SEQ ID NO: 146577 - DNA, 9 bp, Unknown
  misc_feature (1)..( 9): Result.004 file - promoters60/5663374
ttctcacat

SEQ ID NO: 146578 - DNA, 9 bp, Unknown
  misc_feature (1)..( 9): Result.004 file - promoters60/5663374
ttcccacta

SEQ ID NO: 146579 - DNA, 9 bp, Unknown
  misc_feature (1)..( 9): Result.004 file - promoters60/5663374
aacccacta

SEQ ID NO: 146580 - DNA, 9 bp, Unknown
  misc_feature (1)..( 9): Result.004 file - promoters60/5663374
aaaccagaa

SEQ ID NO: 146581 - DNA, 9 bp, Unknown
  misc_feature (1)..( 9): Result.004 file - promoters60/5663374
aaaccggaa

SEQ ID NO: 146582 - DNA, 6 bp, Unknown
  misc_feature (1)..( 6): Result.004 file - promoters60/5663374
atttcc

SEQ ID NO: 146583 - DNA, 6 bp, Unknown
  misc_feature (1)..( 6): Result.004 file - promoters60/5663374
atttcc

SEQ ID NO: 146584 - DNA, 6 bp, Unknown
  misc_feature (1)..( 6): Result.004 file - promoters60/5663374
atatgg

SEQ ID NO: 146585 - DNA, 6 bp, Unknown
  misc_feature (1)..( 6): Result.004 file - promoters60/5663374
atatgg

SEQ ID NO: 146586 - DNA, 6 bp, Unknown
  misc_feature (1)..( 6): Result.004 file - promoters60/5663374
aagata

SEQ ID NO: 146587 - DNA, 6 bp, Unknown
  misc_feature (1)..( 6): Result.004 file - promoters60/5663374
aagata

SEQ ID NO: 146588 - DNA, 7 bp, Unknown
  misc_feature (1)..( 7): Result.004 file - promoters60/5663374
attttta

SEQ ID NO: 146589 - DNA, 7 bp, Unknown
  misc_feature (1)..( 7): Result.004 file - promoters60/5663374
attgtta

SEQ ID NO: 146590 - DNA, 7 bp, Unknown
  misc_feature (1)..( 7): Result.004 file - promoters60/5663374
aactaaa

SEQ ID NO: 146591 - DNA, 7 bp, Unknown
  misc_feature (1)..( 7): Result.004 file - promoters60/5663374
aactaaa

SEQ ID NO: 146592 - DNA, 6 bp, Unknown
  misc_feature (1)..( 6): Result.004 file - promoters60/5663374
atctat

SEQ ID NO: 146593 - DNA, 6 bp, Unknown
  misc_feature (1)..( 6): Result.004 file - promoters60/5663374
atctat

SEQ ID NO: 146594 - DNA, 6 bp, Unknown
  misc_feature (1)..( 6): Result.004 file - promoters60/5663374
aataaa

SEQ ID NO: 146595 - DNA, 6 bp, Unknown
  misc_feature (1)..( 6): Result.004 file - promoters60/5663374
aataaa

SEQ ID NO: 146596 - DNA, 6 bp, Unknown
  misc_feature (1)..( 6): Result.004 file - promoters60/5663374
agtaaa

SEQ ID NO: 146597 - DNA, 6 bp, Unknown
  misc_feature (1)..( 6): Result.004 file - promoters60/5663374
agtaaa

SEQ ID NO: 146598 - DNA, 7 bp, Unknown
  misc_feature (1)..( 7): Result.004 file - promoters60/5663374
aatcggg

SEQ ID NO: 146599 - DNA, 7 bp, Unknown
  misc_feature (1)..( 7): Result.004 file - promoters60/5663374
aattggg

SEQ ID NO: 146600 - DNA, 8 bp, Unknown
  misc_feature (1)..( 8): Result.004 file - promoters60/5663374
gaaagaaa

SEQ ID NO: 146601 - DNA, 8 bp, Unknown
  misc_feature (1)..( 8): Result.004 file - promoters60/5663374
gaaacaaa

SEQ ID NO: 146602 - DNA, 9 bp, Unknown
  misc_feature (1)..( 9): Result.004 file - promoters60/5663374
aaagaaaag

SEQ ID NO: 146603 - DNA, 9 bp, Unknown
  misc_feature (1)..( 9): Result.004 file - promoters60/5663374
aaagtaaag

SEQ ID NO: 146604 - DNA, 7 bp, Unknown
  misc_feature (1)..( 7): Result.004 file - promoters60/5663374
gtatata

SEQ ID NO: 146605 - DNA, 7 bp, Unknown
  misc_feature (1)..( 7): Result.004 file - promoters60/5663418
gtatata

SEQ ID NO: 146606 - DNA, 7 bp, Unknown
  misc_feature (1)..( 7): Result.004 file - promoters60/5663418
aatcaca

SEQ ID NO: 146607 - DNA, 7 bp, Unknown
  misc_feature (1)..( 7): Result.004 file - promoters60/5663418
aattaca

SEQ ID NO: 146608 - DNA, 7 bp, Unknown
  misc_feature (1)..( 7): Result.004 file - promoters60/5663418
tctttat

SEQ ID NO: 146609 - DNA, 7 bp, Unknown
  misc_feature (1)..( 7): Result.004 file - promoters60/5663418
tctgtat

SEQ ID NO: 146610 - DNA, 7 bp, Unknown
  misc_feature (1)..( 7): Result.004 file - promoters60/5663418
actttat

SEQ ID NO: 146611 - DNA, 7 bp, Unknown
  misc_feature (1)..( 7): Result.004 file - promoters60/5663418
gaaaaaa

SEQ ID NO: 146612 - DNA, 7 bp, Unknown
  misc_feature (1)..( 7): Result.004 file - promoters60/5663418
gaaaaag

SEQ ID NO: 146613 - DNA, 7 bp, Unknown
  misc_feature (1)..( 7): Result.004 file - promoters60/5663418
caaaaaa

SEQ ID NO: 146614 - DNA, 6 bp, Unknown
  misc_feature (1)..( 6): Result.004 file - promoters60/5663418
aaagaa

SEQ ID NO: 146615 - DNA, 6 bp, Unknown
  misc_feature (1)..( 6): Result.004 file - promoters60/5663418
aaagaa

SEQ ID NO: 146616 - DNA, 6 bp, Unknown
  misc_feature (1)..( 6): Result.004 file - promoters60/5663418
ttgctc

SEQ ID NO: 146617 - DNA, 6 bp, Unknown
  misc_feature (1)..( 6): Result.004 file - promoters60/5663418
ttgctc

SEQ ID NO: 146618 - DNA, 7 bp, Unknown
  misc_feature (1)..( 7): Result.004 file - promoters60/5663418
acttgga

SEQ ID NO: 146619 - DNA, 7 bp, Unknown
  misc_feature (1)..( 7): Result.004 file - promoters60/5663418
acttgga

SEQ ID NO: 146620 - DNA, 14 bp, Unknown
  misc_feature (1)..( 14): Result.004 file - promoters60/5663418
ggtttatttttaat

SEQ ID NO: 146621 - DNA, 14 bp, Unknown
  misc_feature (1)..( 14): Result.004 file - promoters60/5663418
ggtctattctaaat

SEQ ID NO: 146622 - DNA, 14 bp, Unknown
  misc_feature (1)..( 14): Result.004 file - promoters60/5663418
catctattctcaat

SEQ ID NO: 146623 - DNA, 7 bp, Unknown
  misc_feature (1)..( 7): Result.004 file - promoters60/5663418
tttaatt

SEQ ID NO: 146624 - DNA, 7 bp, Unknown
  misc_feature (1)..( 7): Result.004 file - promoters60/5663418
tttaatt

SEQ ID NO: 146625 - DNA, 8 bp, Unknown
  misc_feature (1)..( 8): Result.004 file - promoters60/5663418
tctgattt

SEQ ID NO: 146626 - DNA, 8 bp, Unknown
  misc_feature (1)..( 8): Result.004 file - promoters60/5663418
tctgtttt

SEQ ID NO: 146627 - DNA, 6 bp, Unknown
  misc_feature (1)..( 6): Result.004 file - promoters60/5663418
ttttct

SEQ ID NO: 146628 - DNA, 6 bp, Unknown
  misc_feature (1)..( 6): Result.004 file - promoters60/5663418
ttttct

SEQ ID NO: 146629 - DNA, 9 bp, Unknown
  misc_feature (1)..( 9): Result.004 file - promoters60/5663418
tgatttgat

SEQ ID NO: 146630 - DNA, 9 bp, Unknown
  misc_feature (1)..( 9): Result.004 file - promoters60/5663418
tgagttgat

SEQ ID NO: 146631 - DNA, 6 bp, Unknown
  misc_feature (1)..( 6): Result.004 file - promoters60/5663418
cttttt

SEQ ID NO: 146632 - DNA, 6 bp, Unknown
  misc_feature (1)..( 6): Result.004 file - promoters60/5663418
cttttt

SEQ ID NO: 146633 - DNA, 8 bp, Unknown
  misc_feature (1)..( 8): Result.004 file - promoters60/5663418
ttgaattt

SEQ ID NO: 146634 - DNA, 8 bp, Unknown
  misc_feature (1)..( 8): Result.004 file - promoters60/5663418
ttgaattt

SEQ ID NO: 146635 - DNA, 8 bp, Unknown
  misc_feature (1)..( 8): Result.004 file - promoters60/5663418
tcaataca

SEQ ID NO: 146636 - DNA, 8 bp, Unknown
  misc_feature (1)..( 8): Result.004 file - promoters60/5663418
tcattaca

SEQ ID NO: 146637 - DNA, 6 bp, Unknown
  misc_feature (1)..( 6): Result.004 file - promoters60/5663418
acaaat

SEQ ID NO: 146638 - DNA, 6 bp, Unknown
  misc_feature (1)..( 6): Result.004 file - promoters60/5663418
acaaat

SEQ ID NO: 146639 - DNA, 11 bp, Unknown
  misc_feature (1)..( 11): Result.004 file - promoters60/5663418
accaattattg

SEQ ID NO: 146640 - DNA, 11 bp, Unknown
  misc_feature (1)..( 11): Result.004 file - promoters60/5663418
accaaatattg

SEQ ID NO: 146641 - DNA, 7 bp, Unknown
  misc_feature (1)..( 7): Result.004 file - promoters60/5663418
tttatgt

SEQ ID NO: 146642 - DNA, 7 bp, Unknown
  misc_feature (1)..( 7): Result.004 file - promoters60/5663418
tttatgt

SEQ ID NO: 146643 - DNA, 6 bp, Unknown
  misc_feature (1)..( 6): Result.004 file - promoters60/5663418
agactt

SEQ ID NO: 146644 - DNA, 6 bp, Unknown
  misc_feature (1)..( 6): Result.004 file - promoters60/5663418
agactt

SEQ ID NO: 146645 - DNA, 7 bp, Unknown
  misc_feature (1)..( 7): Result.004 file - promoters60/5663418
agaagct

SEQ ID NO: 146646 - DNA, 7 bp, Unknown
  misc_feature (1)..( 7): Result.004 file - promoters60/5663418
agaggct

SEQ ID NO: 146647 - DNA, 7 bp, Unknown
  misc_feature (1)..( 7): Result.004 file - promoters60/5663418
tataaaa

SEQ ID NO: 146648 - DNA, 7 bp, Unknown
  misc_feature (1)..( 7): Result.004 file - promoters60/5663433
tataaaa

SEQ ID NO: 146649 - DNA, 10 bp, Unknown
  misc_feature (1)..( 10): Result.004 file - promoters60/5663433
tttttagatt

SEQ ID NO: 146650 - DNA, 10 bp, Unknown
  misc_feature (1)..( 10): Result.004 file - promoters60/5663433
ggcttagatt

SEQ ID NO: 146651 - DNA, 10 bp, Unknown
  misc_feature (1)..( 10): Result.004 file - promoters60/5663433
ggctttgatg

SEQ ID NO: 146652 - DNA, 6 bp, Unknown
  misc_feature (1)..( 6): Result.004 file - promoters60/5663433
tttttt

SEQ ID NO: 146653 - DNA, 6 bp, Unknown
  misc_feature (1)..( 6): Result.004 file - promoters60/5663433
tttttt

SEQ ID NO: 146654 - DNA, 6 bp, Unknown
  misc_feature (1)..( 6): Result.004 file - promoters60/5663433
aaatat

SEQ ID NO: 146655 - DNA, 6 bp, Unknown
  misc_feature (1)..( 6): Result.004 file - promoters60/5663433
aaatat

SEQ ID NO: 146656 - DNA, 8 bp, Unknown
  misc_feature (1)..( 8): Result.004 file - promoters60/5663433
aaatctca

SEQ ID NO: 146657 - DNA, 8 bp, Unknown
  misc_feature (1)..( 8): Result.004 file - promoters60/5663433
aaatatca

SEQ ID NO: 146658 - DNA, 6 bp, Unknown
  misc_feature (1)..( 6): Result.004 file - promoters60/5663433
acacat

SEQ ID NO: 146659 - DNA, 6 bp, Unknown
  misc_feature (1)..( 6): Result.004 file - promoters60/5663433
acacat

SEQ ID NO: 146660 - DNA, 7 bp, Unknown
  misc_feature (1)..( 7): Result.004 file - promoters60/5663433
atgatta

SEQ ID NO: 146661 - DNA, 7 bp, Unknown
  misc_feature (1)..( 7): Result.004 file - promoters60/5663433
atgatta

SEQ ID NO: 146662 - DNA, 8 bp, Unknown
  misc_feature (1)..( 8): Result.004 file - promoters60/5663433
aatgggcc

SEQ ID NO: 146663 - DNA, 8 bp, Unknown
  misc_feature (1)..( 8): Result.004 file - promoters60/5663433
aatgggcc

SEQ ID NO: 146664 - DNA, 7 bp, Unknown
  misc_feature (1)..( 7): Result.004 file - promoters60/5663433
atgatat

SEQ ID NO: 146665 - DNA, 7 bp, Unknown
  misc_feature (1)..( 7): Result.004 file - promoters60/5663433
atgatat

SEQ ID NO: 146666 - DNA, 6 bp, Unknown
  misc_feature (1)..( 6): Result.004 file - promoters60/5663433
ttttaa

SEQ ID NO: 146667 - DNA, 6 bp, Unknown
  misc_feature (1)..( 6): Result.004 file - promoters60/5663433
ttttaa

SEQ ID NO: 146668 - DNA, 7 bp, Unknown
  misc_feature (1)..( 7): Result.004 file - promoters60/5663433
ttttaga

SEQ ID NO: 146669 - DNA, 7 bp, Unknown
  misc_feature (1)..( 7): Result.004 file - promoters60/5663433
tttgaga

SEQ ID NO: 146670 - DNA, 7 bp, Unknown
  misc_feature (1)..( 7): Result.004 file - promoters60/5663433
gtaaaat

SEQ ID NO: 146671 - DNA, 7 bp, Unknown
  misc_feature (1)..( 7): Result.004 file - promoters60/5663440
gtaaaat

SEQ ID NO: 146672 - DNA, 7 bp, Unknown
  misc_feature (1)..( 7): Result.004 file - promoters60/5663440
gaaggaa

SEQ ID NO: 146673 - DNA, 7 bp, Unknown
  misc_feature (1)..( 7): Result.004 file - promoters60/5663440
aaaggaa

SEQ ID NO: 146674 - DNA, 7 bp, Unknown
  misc_feature (1)..( 7): Result.004 file - promoters60/5663440
aaaagaa

SEQ ID NO: 146675 - DNA, 7 bp, Unknown
  misc_feature (1)..( 7): Result.004 file - promoters60/5663440
aaaagaa

SEQ ID NO: 146676 - DNA, 16 bp, Unknown
  misc_feature (1)..( 16): Result.004 file - promoters60/5663440
tctcttcttcattgaa

SEQ ID NO: 146677 - DNA, 16 bp, Unknown
  misc_feature (1)..( 16): Result.004 file - promoters60/5663440
tcttttctctctataa

SEQ ID NO: 146678 - DNA, 16 bp, Unknown
  misc_feature (1)..( 16): Result.004 file - promoters60/5663440
acttttgtctatataa

SEQ ID NO: 146679 - DNA, 16 bp, Unknown
  misc_feature (1)..( 16): Result.004 file - promoters60/5663440
atgtttctcttcttct

SEQ ID NO: 146680 - DNA, 7 bp, Unknown
  misc_feature (1)..( 7): Result.004 file - promoters60/5663440
aagcaag

SEQ ID NO: 146681 - DNA, 7 bp, Unknown
  misc_feature (1)..( 7): Result.004 file - promoters60/5663440
aagcaaa

SEQ ID NO: 146682 - DNA, 7 bp, Unknown
  misc_feature (1)..( 7): Result.004 file - promoters60/5663440
aagtaaa

SEQ ID NO: 146683 - DNA, 7 bp, Unknown
  misc_feature (1)..( 7): Result.004 file - promoters60/5663440
aagtaac

SEQ ID NO: 146684 - DNA, 9 bp, Unknown
  misc_feature (1)..( 9): Result.004 file - promoters60/5663440
ttacattaa

SEQ ID NO: 146685 - DNA, 9 bp, Unknown
  misc_feature (1)..( 9): Result.004 file - promoters60/5663440
ttatattta

SEQ ID NO: 146686 - DNA, 9 bp, Unknown
  misc_feature (1)..( 9): Result.004 file - promoters60/5663440
acatatttg

SEQ ID NO: 146687 - DNA, 9 bp, Unknown
  misc_feature (1)..( 9): Result.004 file - promoters60/5663474
taataatta

SEQ ID NO: 146688 - DNA, 9 bp, Unknown
  misc_feature (1)..( 9): Result.004 file - promoters60/5663474
taaagatgt

SEQ ID NO: 146689 - DNA, 9 bp, Unknown
  misc_feature (1)..( 9): Result.004 file - promoters60/5663474
taaagctgt

SEQ ID NO: 146690 - DNA, 8 bp, Unknown
  misc_feature (1)..( 8): Result.004 file - promoters60/5663474
ttgtgtta

SEQ ID NO: 146691 - DNA, 8 bp, Unknown
  misc_feature (1)..( 8): Result.004 file - promoters60/5663474
ttgtttta

SEQ ID NO: 146692 - DNA, 8 bp, Unknown
  misc_feature (1)..( 8): Result.004 file - promoters60/5663474
ttgtgttg

SEQ ID NO: 146693 - DNA, 6 bp, Unknown
  misc_feature (1)..( 6): Result.004 file - promoters60/5663474
gttttt

SEQ ID NO: 146694 - DNA, 6 bp, Unknown
  misc_feature (1)..( 6): Result.004 file - promoters60/5663474
gttttt

SEQ ID NO: 146695 - DNA, 7 bp, Unknown
  misc_feature (1)..( 7): Result.004 file - promoters60/5663474
aatacaa

SEQ ID NO: 146696 - DNA, 7 bp, Unknown
  misc_feature (1)..( 7): Result.004 file - promoters60/5663474
aatacaa

SEQ ID NO: 146697 - DNA, 7 bp, Unknown
  misc_feature (1)..( 7): Result.004 file - promoters60/5663474
aagaaag

SEQ ID NO: 146698 - DNA, 7 bp, Unknown
  misc_feature (1)..( 7): Result.004 file - promoters60/5663474
aaggaag

SEQ ID NO: 146699 - DNA, 9 bp, Unknown
  misc_feature (1)..( 9): Result.004 file - promoters60/5663474
tctaatgaa

SEQ ID NO: 146700 - DNA, 9 bp, Unknown
  misc_feature (1)..( 9): Result.004 file - promoters60/5663474
tctattgaa

SEQ ID NO: 146701 - DNA, 7 bp, Unknown
  misc_feature (1)..( 7): Result.004 file - promoters60/5663474
tgaagaa

SEQ ID NO: 146702 - DNA, 7 bp, Unknown
  misc_feature (1)..( 7): Result.004 file - promoters60/5663474
tgatgaa

SEQ ID NO: 146703 - DNA, 9 bp, Unknown
  misc_feature (1)..( 9): Result.004 file - promoters60/5663474
tcacaaaga

SEQ ID NO: 146704 - DNA, 9 bp, Unknown
  misc_feature (1)..( 9): Result.004 file - promoters60/5663474
tcaaaaaga

SEQ ID NO: 146705 - DNA, 7 bp, Unknown
  misc_feature (1)..( 7): Result.004 file - promoters60/5663474
tgtgttg

SEQ ID NO: 146706 - DNA, 7 bp, Unknown
  misc_feature (1)..( 7): Result.004 file - promoters60/5663474
tgtgttg

SEQ ID NO: 146707 - DNA, 6 bp, Unknown
  misc_feature (1)..( 6): Result.004 file - promoters60/5663474
atctcc

SEQ ID NO: 146708 - DNA, 6 bp, Unknown
  misc_feature (1)..( 6): Result.004 file - promoters60/5663474
atctcc

SEQ ID NO: 146709 - DNA, 7 bp, Unknown
  misc_feature (1)..( 7): Result.004 file - promoters60/5663474
gttggat

SEQ ID NO: 146710 - DNA, 7 bp, Unknown
  misc_feature (1)..( 7): Result.004 file - promoters60/5663474
gtttgat

SEQ ID NO: 146711 - DNA, 7 bp, Unknown
  misc_feature (1)..( 7): Result.004 file - promoters60/5663474
catgtaa

SEQ ID NO: 146712 - DNA, 7 bp, Unknown
  misc_feature (1)..( 7): Result.004 file - promoters60/5663474
catataa

SEQ ID NO: 146713 - DNA, 9 bp, Unknown
  misc_feature (1)..( 9): Result.004 file - promoters60/5663474
tcttataat

SEQ ID NO: 146714 - DNA, 9 bp, Unknown
  misc_feature (1)..( 9): Result.004 file - promoters60/5663478
tcttgtaat

SEQ ID NO: 146715 - DNA, 8 bp, Unknown
  misc_feature (1)..( 8): Result.004 file - promoters60/5663478
acagcttt

SEQ ID NO: 146716 - DNA, 8 bp, Unknown
  misc_feature (1)..( 8): Result.004 file - promoters60/5663478
caagcttt

SEQ ID NO: 146717 - DNA, 8 bp, Unknown
  misc_feature (1)..( 8): Result.004 file - promoters60/5663478
caagtttt

SEQ ID NO: 146718 - DNA, 11 bp, Unknown
  misc_feature (1)..( 11): Result.004 file - promoters60/5663478
aaaatcataat

SEQ ID NO: 146719 - DNA, 11 bp, Unknown
  misc_feature (1)..( 11): Result.004 file - promoters60/5663478
aaactcaaaat

SEQ ID NO: 146720 - DNA, 11 bp, Unknown
  misc_feature (1)..( 11): Result.004 file - promoters60/5663478
ccaatcattag

SEQ ID NO: 146721 - DNA, 10 bp, Unknown
  misc_feature (1)..( 10): Result.004 file - promoters60/5663478
tgattagcaa

SEQ ID NO: 146722 - DNA, 10 bp, Unknown
  misc_feature (1)..( 10): Result.004 file - promoters60/5663478
tgattagtta

SEQ ID NO: 146723 - DNA, 10 bp, Unknown
  misc_feature (1)..( 10): Result.004 file - promoters60/5663478
cgatgagtac

SEQ ID NO: 146724 - DNA, 10 bp, Unknown
  misc_feature (1)..( 10): Result.004 file - promoters60/5663478
tcattagtta

SEQ ID NO: 146725 - DNA, 8 bp, Unknown
  misc_feature (1)..( 8): Result.004 file - promoters60/5663478
tttattaa

SEQ ID NO: 146726 - DNA, 8 bp, Unknown
  misc_feature (1)..( 8): Result.004 file - promoters60/5663478
tttcttaa

SEQ ID NO: 146727 - DNA, 8 bp, Unknown
  misc_feature (1)..( 8): Result.004 file - promoters60/5663478
tttcataa

SEQ ID NO: 146728 - DNA, 10 bp, Unknown
  misc_feature (1)..( 10): Result.004 file - promoters60/5663478
tgcaatcttt

SEQ ID NO: 146729 - DNA, 10 bp, Unknown
  misc_feature (1)..( 10): Result.004 file - promoters60/5663478
ctcaaacttg

SEQ ID NO: 146730 - DNA, 10 bp, Unknown
  misc_feature (1)..( 10): Result.004 file - promoters60/5663502
ctcaaaattg

SEQ ID NO: 146731 - DNA, 6 bp, Unknown
  misc_feature (1)..( 6): Result.004 file - promoters60/5663502
aaaaaa

SEQ ID NO: 146732 - DNA, 6 bp, Unknown
  misc_feature (1)..( 6): Result.004 file - promoters60/5663502
aaaaaa

SEQ ID NO: 146733 - DNA, 11 bp, Unknown
  misc_feature (1)..( 11): Result.004 file - promoters60/5663502
attgatcaaaa

SEQ ID NO: 146734 - DNA, 11 bp, Unknown
  misc_feature (1)..( 11): Result.004 file - promoters60/5663502
atttatcgaat

SEQ ID NO: 146735 - DNA, 11 bp, Unknown
  misc_feature (1)..( 11): Result.004 file - promoters60/5663502
ctttttcgaat

SEQ ID NO: 146736 - DNA, 7 bp, Unknown
  misc_feature (1)..( 7): Result.004 file - promoters60/5663502
cacggaa

SEQ ID NO: 146737 - DNA, 7 bp, Unknown
  misc_feature (1)..( 7): Result.004 file - promoters60/5663502
caccgaa

SEQ ID NO: 146738 - DNA, 6 bp, Unknown
  misc_feature (1)..( 6): Result.004 file - promoters60/5663502
actttt

SEQ ID NO: 146739 - DNA, 6 bp, Unknown
  misc_feature (1)..( 6): Result.004 file - promoters60/5663502
actttt

SEQ ID NO: 146740 - DNA, 6 bp, Unknown
  misc_feature (1)..( 6): Result.004 file - promoters60/5663502
ttttac

SEQ ID NO: 146741 - DNA, 6 bp, Unknown
  misc_feature (1)..( 6): Result.004 file - promoters60/5663502
ttttac

SEQ ID NO: 146742 - DNA, 6 bp, Unknown
  misc_feature (1)..( 6): Result.004 file - promoters60/5663502
tcttgt

SEQ ID NO: 146743 - DNA, 6 bp, Unknown
  misc_feature (1)..( 6): Result.004 file - promoters60/5663502
tcttgt

SEQ ID NO: 146744 - DNA, 7 bp, Unknown
  misc_feature (1)..( 7): Result.004 file - promoters60/5663502
attcttc

SEQ ID NO: 146745 - DNA, 7 bp, Unknown
  misc_feature (1)..( 7): Result.004 file - promoters60/5663502
atttttc

SEQ ID NO: 146746 - DNA, 14 bp, Unknown
  misc_feature (1)..( 14): Result.004 file - promoters60/5663502
tcatttttttttgt

SEQ ID NO: 146747 - DNA, 14 bp, Unknown
  misc_feature (1)..( 14): Result.004 file - promoters60/5663502
actagtttttgtgt

SEQ ID NO: 146748 - DNA, 14 bp, Unknown
  misc_feature (1)..( 14): Result.004 file - promoters60/5663502
tcatatttttttca

SEQ ID NO: 146749 - DNA, 10 bp, Unknown
  misc_feature (1)..( 10): Result.004 file - promoters60/5663502
aatttttttt

SEQ ID NO: 146750 - DNA, 10 bp, Unknown
  misc_feature (1)..( 10): Result.004 file - promoters60/5663502
aatttttttt

SEQ ID NO: 146751 - DNA, 10 bp, Unknown
  misc_feature (1)..( 10): Result.004 file - promoters60/5663502
aaacacatct

SEQ ID NO: 146752 - DNA, 10 bp, Unknown
  misc_feature (1)..( 10): Result.004 file - promoters60/5663502
aaatacattt

SEQ ID NO: 146753 - DNA, 10 bp, Unknown
  misc_feature (1)..( 10): Result.004 file - promoters60/5663502
tcacacgtct

SEQ ID NO: 146754 - DNA, 9 bp, Unknown
  misc_feature (1)..( 9): Result.004 file - promoters60/5663502
tattacttt

SEQ ID NO: 146755 - DNA, 9 bp, Unknown
  misc_feature (1)..( 9): Result.004 file - promoters60/5663502
catttcttt

SEQ ID NO: 146756 - DNA, 9 bp, Unknown
  misc_feature (1)..( 9): Result.004 file - promoters60/5663502
catttgttt

SEQ ID NO: 146757 - DNA, 8 bp, Unknown
  misc_feature (1)..( 8): Result.004 file - promoters60/5663502
aattatat

SEQ ID NO: 146758 - DNA, 8 bp, Unknown
  misc_feature (1)..( 8): Result.004 file - promoters60/5663502
aattttat

SEQ ID NO: 146759 - DNA, 6 bp, Unknown
  misc_feature (1)..( 6): Result.004 file - promoters60/5663502
attctt

SEQ ID NO: 146760 - DNA, 6 bp, Unknown
  misc_feature (1)..( 6): Result.004 file - promoters60/5663502
attctt

SEQ ID NO: 146761 - DNA, 6 bp, Unknown
  misc_feature (1)..( 6): Result.004 file - promoters60/5663502
aaatca

SEQ ID NO: 146762 - DNA, 6 bp, Unknown
  misc_feature (1)..( 6): Result.004 file - promoters60/5663502
aaatca

SEQ ID NO: 146763 - DNA, 7 bp, Unknown
  misc_feature (1)..( 7): Result.004 file - promoters60/5663502
ttacctt

SEQ ID NO: 146764 - DNA, 7 bp, Unknown
  misc_feature (1)..( 7): Result.004 file - promoters60/5663502
ttaactt

SEQ ID NO: 146765 - DNA, 6 bp, Unknown
  misc_feature (1)..( 6): Result.004 file - promoters60/5663502
ttcaaa

SEQ ID NO: 146766 - DNA, 6 bp, Unknown
  misc_feature (1)..( 6): Result.004 file - promoters60/5663502
ttcaaa

SEQ ID NO: 146767 - DNA, 6 bp, Unknown
  misc_feature (1)..( 6): Result.004 file - promoters60/5663502
gtttct

SEQ ID NO: 146768 - DNA, 6 bp, Unknown
  misc_feature (1)..( 6): Result.004 file - promoters60/5663502
gtttct

SEQ ID NO: 146769 - DNA, 7 bp, Unknown
  misc_feature (1)..( 7): Result.004 file - promoters60/5663502
ttagatt

SEQ ID NO: 146770 - DNA, 7 bp, Unknown
  misc_feature (1)..( 7): Result.004 file - promoters60/5663502
ttaaatt

SEQ ID NO: 146771 - DNA, 7 bp, Unknown
  misc_feature (1)..( 7): Result.004 file - promoters60/5663502
atatctt

SEQ ID NO: 146772 - DNA, 7 bp, Unknown
  misc_feature (1)..( 7): Result.004 file - promoters60/5663502
atatctt

SEQ ID NO: 146773 - DNA, 10 bp, Unknown
  misc_feature (1)..( 10): Result.004 file - promoters60/5663502
ttttaatctc

SEQ ID NO: 146774 - DNA, 10 bp, Unknown
  misc_feature (1)..( 10): Result.004 file - promoters60/5663577
ttttaacctc

SEQ ID NO: 146775 - DNA, 8 bp, Unknown
  misc_feature (1)..( 8): Result.004 file - promoters60/5663577
gtaagaat

SEQ ID NO: 146776 - DNA, 8 bp, Unknown
  misc_feature (1)..( 8): Result.004 file - promoters60/5663577
gtacgaat

SEQ ID NO: 146777 - DNA, 8 bp, Unknown
  misc_feature (1)..( 8): Result.004 file - promoters60/5663577
aaacgaat

SEQ ID NO: 146778 - DNA, 8 bp, Unknown
  misc_feature (1)..( 8): Result.004 file - promoters60/5663577
atttcatt

SEQ ID NO: 146779 - DNA, 8 bp, Unknown
  misc_feature (1)..( 8): Result.004 file - promoters60/5663577
gtttcata

SEQ ID NO: 146780 - DNA, 8 bp, Unknown
  misc_feature (1)..( 8): Result.004 file - promoters60/5663585
atttcatt

SEQ ID NO: 146781 - DNA, 6 bp, Unknown
  misc_feature (1)..( 6): Result.004 file - promoters60/5663585
atcaaa

SEQ ID NO: 146782 - DNA, 6 bp, Unknown
  misc_feature (1)..( 6): Result.004 file - promoters60/5663585
atcaaa

SEQ ID NO: 146783 - DNA, 13 bp, Unknown
  misc_feature (1)..( 13): Result.004 file - promoters60/5663585
attattaatgtcg

SEQ ID NO: 146784 - DNA, 13 bp, Unknown
  misc_feature (1)..( 13): Result.004 file - promoters60/5663585
attcttaactttt

SEQ ID NO: 146785 - DNA, 13 bp, Unknown
  misc_feature (1)..( 13): Result.004 file - promoters60/5663585
ttccttaagtttt

SEQ ID NO: 146786 - DNA, 6 bp, Unknown
  misc_feature (1)..( 6): Result.004 file - promoters60/5663585
ccaaat

SEQ ID NO: 146787 - DNA, 6 bp, Unknown
  misc_feature (1)..( 6): Result.004 file - promoters60/5663585
ccaaat

SEQ ID NO: 146788 - DNA, 6 bp, Unknown
  misc_feature (1)..( 6): Result.004 file - promoters60/5663585
attatt

SEQ ID NO: 146789 - DNA, 6 bp, Unknown
  misc_feature (1)..( 6): Result.004 file - promoters60/5663585
attatt

SEQ ID NO: 146790 - DNA, 9 bp, Unknown
  misc_feature (1)..( 9): Result.004 file - promoters60/5663585
tattcaaac

SEQ ID NO: 146791 - DNA, 9 bp, Unknown
  misc_feature (1)..( 9): Result.004 file - promoters60/5663585
tatgcaaaa

SEQ ID NO: 146792 - DNA, 9 bp, Unknown
  misc_feature (1)..( 9): Result.004 file - promoters60/5663585
gaatcaaac

SEQ ID NO: 146793 - DNA, 6 bp, Unknown
  misc_feature (1)..( 6): Result.004 file - promoters60/5663585
atttgg

SEQ ID NO: 146794 - DNA, 6 bp, Unknown
  misc_feature (1)..( 6): Result.004 file - promoters60/5663585
atttgg

SEQ ID NO: 146795 - DNA, 8 bp, Unknown
  misc_feature (1)..( 8): Result.004 file - promoters60/5663585
taacaagc

SEQ ID NO: 146796 - DNA, 8 bp, Unknown
  misc_feature (1)..( 8): Result.004 file - promoters60/5663585
taagaagc

SEQ ID NO: 146797 - DNA, 8 bp, Unknown
  misc_feature (1)..( 8): Result.004 file - promoters60/5663585
cttaatac

SEQ ID NO: 146798 - DNA, 8 bp, Unknown
  misc_feature (1)..( 8): Result.004 file - promoters60/5663585
ctttataa

SEQ ID NO: 146799 - DNA, 8 bp, Unknown
  misc_feature (1)..( 8): Result.004 file - promoters60/5663585
ttttataa

SEQ ID NO: 146800 - DNA, 7 bp, Unknown
  misc_feature (1)..( 7): Result.004 file - promoters60/5663585
gtgtaaa

SEQ ID NO: 146801 - DNA, 7 bp, Unknown
  misc_feature (1)..( 7): Result.004 file - promoters60/5663585
gtgaaaa

SEQ ID NO: 146802 - DNA, 6 bp, Unknown
  misc_feature (1)..( 6): Result.004 file - promoters60/5663585
agacaa

SEQ ID NO: 146803 - DNA, 6 bp, Unknown
  misc_feature (1)..( 6): Result.004 file - promoters60/5663585
agacaa

SEQ ID NO: 146804 - DNA, 6 bp, Unknown
  misc_feature (1)..( 6): Result.004 file - promoters60/5663585
ttctta

SEQ ID NO: 146805 - DNA, 6 bp, Unknown
  misc_feature (1)..( 6): Result.004 file - promoters60/5663585
ttctta

SEQ ID NO: 146806 - DNA, 8 bp, Unknown
  misc_feature (1)..( 8): Result.004 file - promoters60/5663585
ataaacaa

SEQ ID NO: 146807 - DNA, 8 bp, Unknown
  misc_feature (1)..( 8): Result.004 file - promoters60/5663585
atatacaa

SEQ ID NO: 146808 - DNA, 7 bp, Unknown
  misc_feature (1)..( 7): Result.004 file - promoters60/5663585
aaatcca

SEQ ID NO: 146809 - DNA, 7 bp, Unknown
  misc_feature (1)..( 7): Result.004 file - promoters60/5663585
aaatcca

SEQ ID NO: 146810 - DNA, 7 bp, Unknown
  misc_feature (1)..( 7): Result.004 file - promoters60/5663585
attattc

SEQ ID NO: 146811 - DNA, 7 bp, Unknown
  misc_feature (1)..( 7): Result.004 file - promoters60/5663585
atttttc

SEQ ID NO: 146812 - DNA, 7 bp, Unknown
  misc_feature (1)..( 7): Result.004 file - promoters60/5663585
atgatat

SEQ ID NO: 146813 - DNA, 7 bp, Unknown
  misc_feature (1)..( 7): Result.004 file - promoters60/5663585
atggtat

SEQ ID NO: 146814 - DNA, 7 bp, Unknown
  misc_feature (1)..( 7): Result.004 file - promoters60/5663585
aatattt

SEQ ID NO: 146815 - DNA, 7 bp, Unknown
  misc_feature (1)..( 7): Result.004 file - promoters60/5663585
aatattt

SEQ ID NO: 146816 - DNA, 8 bp, Unknown
  misc_feature (1)..( 8): Result.004 file - promoters60/5663585
aaatcttt

SEQ ID NO: 146817 - DNA, 8 bp, Unknown
  misc_feature (1)..( 8): Result.004 file - promoters60/5663585
aaagcttt

SEQ ID NO: 146818 - DNA, 7 bp, Unknown
  misc_feature (1)..( 7): Result.004 file - promoters60/5663585
acatatt

SEQ ID NO: 146819 - DNA, 7 bp, Unknown
  misc_feature (1)..( 7): Result.004 file - promoters60/5663585
acaaatt

SEQ ID NO: 146820 - DNA, 6 bp, Unknown
  misc_feature (1)..( 6): Result.004 file - promoters60/5663585
cacata

SEQ ID NO: 146821 - DNA, 6 bp, Unknown
  misc_feature (1)..( 6): Result.004 file - promoters60/5663585
cacata

SEQ ID NO: 146822 - DNA, 6 bp, Unknown
  misc_feature (1)..( 6): Result.004 file - promoters60/5663585
aagttt

SEQ ID NO: 146823 - DNA, 6 bp, Unknown
  misc_feature (1)..( 6): Result.004 file - promoters60/5663585
aagttt

SEQ ID NO: 146824 - DNA, 6 bp, Unknown
  misc_feature (1)..( 6): Result.004 file - promoters60/5663585
ataaat

SEQ ID NO: 146825 - DNA, 6 bp, Unknown
  misc_feature (1)..( 6): Result.004 file - promoters60/5663585
ataaat

SEQ ID NO: 146826 - DNA, 8 bp, Unknown
  misc_feature (1)..( 8): Result.004 file - promoters60/5663585
attgtaat

SEQ ID NO: 146827 - DNA, 8 bp, Unknown
  misc_feature (1)..( 8): Result.004 file - promoters60/5663585
attgtaat

SEQ ID NO: 146828 - DNA, 8 bp, Unknown
  misc_feature (1)..( 8): Result.004 file - promoters60/5663585
aattatac

SEQ ID NO: 146829 - DNA, 8 bp, Unknown
  misc_feature (1)..( 8): Result.004 file - promoters60/5663585
aattatac

SEQ ID NO: 146830 - DNA, 6 bp, Unknown
  misc_feature (1)..( 6): Result.004 file - promoters60/5663585
gtaaaa

SEQ ID NO: 146831 - DNA, 6 bp, Unknown
  misc_feature (1)..( 6): Result.004 file - promoters60/5663585
gtaaaa

SEQ ID NO: 146832 - DNA, 7 bp, Unknown
  misc_feature (1)..( 7): Result.004 file - promoters60/5663585
tttctat

SEQ ID NO: 146833 - DNA, 7 bp, Unknown
  misc_feature (1)..( 7): Result.004 file - promoters60/5663585
tttttat

SEQ ID NO: 146834 - DNA, 10 bp, Unknown
  misc_feature (1)..( 10): Result.004 file - promoters60/5663585
tataaaagtt

SEQ ID NO: 146835 - DNA, 10 bp, Unknown
  misc_feature (1)..( 10): Result.004 file - promoters60/5663595
tattaaagtt

SEQ ID NO: 146836 - DNA, 9 bp, Unknown
  misc_feature (1)..( 9): Result.004 file - promoters60/5663595
gacaaaata

SEQ ID NO: 146837 - DNA, 9 bp, Unknown
  misc_feature (1)..( 9): Result.004 file - promoters60/5663595
gacataata

SEQ ID NO: 146838 - DNA, 6 bp, Unknown
  misc_feature (1)..( 6): Result.004 file - promoters60/5663595
aatact

SEQ ID NO: 146839 - DNA, 6 bp, Unknown
  misc_feature (1)..( 6): Result.004 file - promoters60/5663595
aatact

SEQ ID NO: 146840 - DNA, 8 bp, Unknown
  misc_feature (1)..( 8): Result.004 file - promoters60/5663595
ttttattt

SEQ ID NO: 146841 - DNA, 8 bp, Unknown
  misc_feature (1)..( 8): Result.004 file - promoters60/5663595
ttttgttt

SEQ ID NO: 146842 - DNA, 8 bp, Unknown
  misc_feature (1)..( 8): Result.004 file - promoters60/5663595
gtttattt

SEQ ID NO: 146843 - DNA, 7 bp, Unknown
  misc_feature (1)..( 7): Result.004 file - promoters60/5663595
tttttct

SEQ ID NO: 146844 - DNA, 7 bp, Unknown
  misc_feature (1)..( 7): Result.004 file - promoters60/5663595
tttgtct

SEQ ID NO: 146845 - DNA, 7 bp, Unknown
  misc_feature (1)..( 7): Result.004 file - promoters60/5663595
tttagtt

SEQ ID NO: 146846 - DNA, 7 bp, Unknown
  misc_feature (1)..( 7): Result.004 file - promoters60/5663595
tttcgtt

SEQ ID NO: 146847 - DNA, 8 bp, Unknown
  misc_feature (1)..( 8): Result.004 file - promoters60/5663595
ttttcttg

SEQ ID NO: 146848 - DNA, 8 bp, Unknown
  misc_feature (1)..( 8): Result.004 file - promoters60/5663595
tttacttg

SEQ ID NO: 146849 - DNA, 7 bp, Unknown
  misc_feature (1)..( 7): Result.004 file - promoters60/5663595
tttcttt

SEQ ID NO: 146850 - DNA, 7 bp, Unknown
  misc_feature (1)..( 7): Result.004 file - promoters60/5663595
ttttttt

SEQ ID NO: 146851 - DNA, 8 bp, Unknown
  misc_feature (1)..( 8): Result.004 file - promoters60/5663595
tcagttta

SEQ ID NO: 146852 - DNA, 8 bp, Unknown
  misc_feature (1)..( 8): Result.004 file - promoters60/5663595
tcatttta

SEQ ID NO: 146853 - DNA, 6 bp, Unknown
  misc_feature (1)..( 6): Result.004 file - promoters60/5663595
ttttca

SEQ ID NO: 146854 - DNA, 6 bp, Unknown
  misc_feature (1)..( 6): Result.004 file - promoters60/5663595
ttttca

SEQ ID NO: 146855 - DNA, 7 bp, Unknown
  misc_feature (1)..( 7): Result.004 file - promoters60/5663595
atttggt

SEQ ID NO: 146856 - DNA, 7 bp, Unknown
  misc_feature (1)..( 7): Result.004 file - promoters60/5663595
atttggt

SEQ ID NO: 146857 - DNA, 7 bp, Unknown
  misc_feature (1)..( 7): Result.004 file - promoters60/5663595
aaactct

SEQ ID NO: 146858 - DNA, 7 bp, Unknown
  misc_feature (1)..( 7): Result.004 file - promoters60/5663595
aaaatct

SEQ ID NO: 146859 - DNA, 15 bp, Unknown
  misc_feature (1)..( 15): Result.004 file - promoters60/5663595
actaaaatccaaaat

SEQ ID NO: 146860 - DNA, 15 bp, Unknown
  misc_feature (1)..( 15): Result.004 file - promoters60/5663595
actagaattcaaaat

SEQ ID NO: 146861 - DNA, 6 bp, Unknown
  misc_feature (1)..( 6): Result.004 file - promoters60/5663595
ttttct

SEQ ID NO: 146862 - DNA, 6 bp, Unknown
  misc_feature (1)..( 6): Result.004 file - promoters60/5663595
ttttct

SEQ ID NO: 146863 - DNA, 9 bp, Unknown
  misc_feature (1)..( 9): Result.004 file - promoters60/5663595
aaaatgaat

SEQ ID NO: 146864 - DNA, 9 bp, Unknown
  misc_feature (1)..( 9): Result.004 file - promoters60/5663595
aaaattaat

SEQ ID NO: 146865 - DNA, 6 bp, Unknown
  misc_feature (1)..( 6): Result.004 file - promoters60/5663595
tctttt

SEQ ID NO: 146866 - DNA, 6 bp, Unknown
  misc_feature (1)..( 6): Result.004 file - promoters60/5663595
tctttt

SEQ ID NO: 146867 - DNA, 10 bp, Unknown
  misc_feature (1)..( 10): Result.004 file - promoters60/5663595
tttccttttt

SEQ ID NO: 146868 - DNA, 10 bp, Unknown
  misc_feature (1)..( 10): Result.004 file - promoters60/5663595
tttcattttt

SEQ ID NO: 146869 - DNA, 6 bp, Unknown
  misc_feature (1)..( 6): Result.004 file - promoters60/5663595
tttaac

SEQ ID NO: 146870 - DNA, 6 bp, Unknown
  misc_feature (1)..( 6): Result.004 file - promoters60/5663595
tttaac

SEQ ID NO: 146871 - DNA, 7 bp, Unknown
  misc_feature (1)..( 7): Result.004 file - promoters60/5663595
gacataa

SEQ ID NO: 146872 - DNA, 7 bp, Unknown
  misc_feature (1)..( 7): Result.004 file - promoters60/5663595
gacgtaa

SEQ ID NO: 146873 - DNA, 8 bp, Unknown
  misc_feature (1)..( 8): Result.004 file - promoters60/5663595
ttcgaaaa

SEQ ID NO: 146874 - DNA, 8 bp, Unknown
  misc_feature (1)..( 8): Result.004 file - promoters60/5663595
ttccaaaa

SEQ ID NO: 146875 - DNA, 6 bp, Unknown
  misc_feature (1)..( 6): Result.004 file - promoters60/5663595
aaaatt

SEQ ID NO: 146876 - DNA, 6 bp, Unknown
  misc_feature (1)..( 6): Result.004 file - promoters60/5663595
aaaatt

SEQ ID NO: 146877 - DNA, 6 bp, Unknown
  misc_feature (1)..( 6): Result.004 file - promoters60/5663595
aattaa

SEQ ID NO: 146878 - DNA, 6 bp, Unknown
  misc_feature (1)..( 6): Result.004 file - promoters60/5663595
aattaa

SEQ ID NO: 146879 - DNA, 8 bp, Unknown
  misc_feature (1)..( 8): Result.004 file - promoters60/5663595
aaaaaatt

SEQ ID NO: 146880 - DNA, 8 bp, Unknown
  misc_feature (1)..( 8): Result.004 file - promoters60/5663614
aaaacatt

SEQ ID NO: 146881 - DNA, 6 bp, Unknown
  misc_feature (1)..( 6): Result.004 file - promoters60/5663614
aatttg

SEQ ID NO: 146882 - DNA, 6 bp, Unknown
  misc_feature (1)..( 6): Result.004 file - promoters60/5663614
aatttg

SEQ ID NO: 146883 - DNA, 7 bp, Unknown
  misc_feature (1)..( 7): Result.004 file - promoters60/5663614
cttgtaa

SEQ ID NO: 146884 - DNA, 7 bp, Unknown
  misc_feature (1)..( 7): Result.004 file - promoters60/5663614
cttataa

SEQ ID NO: 146885 - DNA, 6 bp, Unknown
  misc_feature (1)..( 6): Result.004 file - promoters60/5663614
aataat

SEQ ID NO: 146886 - DNA, 6 bp, Unknown
  misc_feature (1)..( 6): Result.004 file - promoters60/5663614
aataat

SEQ ID NO: 146887 - DNA, 9 bp, Unknown
  misc_feature (1)..( 9): Result.004 file - promoters60/5663614
aaaacaatt

SEQ ID NO: 146888 - DNA, 9 bp, Unknown
  misc_feature (1)..( 9): Result.004 file - promoters60/5663614
aaaacaatt

SEQ ID NO: 146889 - DNA, 6 bp, Unknown
  misc_feature (1)..( 6): Result.004 file - promoters60/5663614
agcaaa

SEQ ID NO: 146890 - DNA, 6 bp, Unknown
  misc_feature (1)..( 6): Result.004 file - promoters60/5663614
agcaaa

SEQ ID NO: 146891 - DNA, 7 bp, Unknown
  misc_feature (1)..( 7): Result.004 file - promoters60/5663614
aaccaaa

SEQ ID NO: 146892 - DNA, 7 bp, Unknown
  misc_feature (1)..( 7): Result.004 file - promoters60/5663614
aactaaa

SEQ ID NO: 146893 - DNA, 12 bp, Unknown
  misc_feature (1)..( 12): Result.004 file - promoters60/5663614
aaaacaaaccaa

SEQ ID NO: 146894 - DNA, 12 bp, Unknown
  misc_feature (1)..( 12): Result.004 file - promoters60/5663614
aaaataaatcaa

SEQ ID NO: 146895 - DNA, 12 bp, Unknown
  misc_feature (1)..( 12): Result.004 file - promoters60/5663614
cccattaatcaa

SEQ ID NO: 146896 - DNA, 6 bp, Unknown
  misc_feature (1)..( 6): Result.004 file - promoters60/5663614
ttcatt

SEQ ID NO: 146897 - DNA, 6 bp, Unknown
  misc_feature (1)..( 6): Result.004 file - promoters60/5663614
ttcatt

SEQ ID NO: 146898 - DNA, 9 bp, Unknown
  misc_feature (1)..( 9): Result.004 file - promoters60/5663614
atataattc

SEQ ID NO: 146899 - DNA, 9 bp, Unknown
  misc_feature (1)..( 9): Result.004 file - promoters60/5663614
atacaattt

SEQ ID NO: 146900 - DNA, 9 bp, Unknown
  misc_feature (1)..( 9): Result.004 file - promoters60/5663614
ttacacttt

SEQ ID NO: 146901 - DNA, 8 bp, Unknown
  misc_feature (1)..( 8): Result.004 file - promoters60/5663614
caactttt

SEQ ID NO: 146902 - DNA, 8 bp, Unknown
  misc_feature (1)..( 8): Result.004 file - promoters60/5663614
aaacttta

SEQ ID NO: 146903 - DNA, 8 bp, Unknown
  misc_feature (1)..( 8): Result.004 file - promoters60/5663614
aaaattta

SEQ ID NO: 146904 - DNA, 13 bp, Unknown
  misc_feature (1)..( 13): Result.004 file - promoters60/5663614
cttttcttagttt

SEQ ID NO: 146905 - DNA, 13 bp, Unknown
  misc_feature (1)..( 13): Result.004 file - promoters60/5663614
atcttcttatttt

SEQ ID NO: 146906 - DNA, 13 bp, Unknown
  misc_feature (1)..( 13): Result.004 file - promoters60/5663614
atcttcttccacg

SEQ ID NO: 146907 - DNA, 6 bp, Unknown
  misc_feature (1)..( 6): Result.004 file - promoters60/5663614
aaaata

SEQ ID NO: 146908 - DNA, 6 bp, Unknown
  misc_feature (1)..( 6): Result.004 file - promoters60/5663614
aaaata

SEQ ID NO: 146909 - DNA, 6 bp, Unknown
  misc_feature (1)..( 6): Result.004 file - promoters60/5663614
tggtct

SEQ ID NO: 146910 - DNA, 6 bp, Unknown
  misc_feature (1)..( 6): Result.004 file - promoters60/5663614
tggtct

SEQ ID NO: 146911 - DNA, 6 bp, Unknown
  misc_feature (1)..( 6): Result.004 file - promoters60/5663614
cccaaa

SEQ ID NO: 146912 - DNA, 6 bp, Unknown
  misc_feature (1)..( 6): Result.004 file - promoters60/5663614
cccaaa

SEQ ID NO: 146913 - DNA, 11 bp, Unknown
  misc_feature (1)..( 11): Result.004 file - promoters60/5663614
caaacggacca

SEQ ID NO: 146914 - DNA, 11 bp, Unknown
  misc_feature (1)..( 11): Result.004 file - promoters60/5663614
caaaaggacca

SEQ ID NO: 146915 - DNA, 6 bp, Unknown
  misc_feature (1)..( 6): Result.004 file - promoters60/5663614
tcagat

SEQ ID NO: 146916 - DNA, 6 bp, Unknown
  misc_feature (1)..( 6): Result.004 file - promoters60/5663614
tcagat

SEQ ID NO: 146917 - DNA, 7 bp, Unknown
  misc_feature (1)..( 7): Result.004 file - promoters60/5663614
tttgttt

SEQ ID NO: 146918 - DNA, 7 bp, Unknown
  misc_feature (1)..( 7): Result.004 file - promoters60/5663614
ttttttt

SEQ ID NO: 146919 - DNA, 6 bp, Unknown
  misc_feature (1)..( 6): Result.004 file - promoters60/5663614
ttctta

SEQ ID NO: 146920 - DNA, 6 bp, Unknown
  misc_feature (1)..( 6): Result.004 file - promoters60/5663614
ttctta

SEQ ID NO: 146921 - DNA, 7 bp, Unknown
  misc_feature (1)..( 7): Result.004 file - promoters60/5663614
aaactaa

SEQ ID NO: 146922 - DNA, 7 bp, Unknown
  misc_feature (1)..( 7): Result.004 file - promoters60/5663614
aaaataa

SEQ ID NO: 146923 - DNA, 6 bp, Unknown
  misc_feature (1)..( 6): Result.004 file - promoters60/5663614
caatat

SEQ ID NO: 146924 - DNA, 6 bp, Unknown
  misc_feature (1)..( 6): Result.004 file - promoters60/5663614
caatat

SEQ ID NO: 146925 - DNA, 8 bp, Unknown
  misc_feature (1)..( 8): Result.004 file - promoters60/5663614
tatttata

SEQ ID NO: 146926 - DNA, 8 bp, Unknown
  misc_feature (1)..( 8): Result.004 file - promoters60/5663614
tattaata

SEQ ID NO: 146927 - DNA, 8 bp, Unknown
  misc_feature (1)..( 8): Result.004 file - promoters60/5663614
ttttgccc

SEQ ID NO: 146928 - DNA, 8 bp, Unknown
  misc_feature (1)..( 8): Result.004 file - promoters60/5663614
tttggccc

SEQ ID NO: 146929 - DNA, 7 bp, Unknown
  misc_feature (1)..( 7): Result.004 file - promoters60/5663614
caaaatt

SEQ ID NO: 146930 - DNA, 7 bp, Unknown
  misc_feature (1)..( 7): Result.004 file - promoters60/5663614
caaaatt

SEQ ID NO: 146931 - DNA, 7 bp, Unknown
  misc_feature (1)..( 7): Result.004 file - promoters60/5663614
aatattt

SEQ ID NO: 146932 - DNA, 7 bp, Unknown
  misc_feature (1)..( 7): Result.004 file - promoters60/5663625
aattttt

SEQ ID NO: 146933 - DNA, 11 bp, Unknown
  misc_feature (1)..( 11): Result.004 file - promoters60/5663625
tctttgcttac

SEQ ID NO: 146934 - DNA, 11 bp, Unknown
  misc_feature (1)..( 11): Result.004 file - promoters60/5663625
gtttttctttt

SEQ ID NO: 146935 - DNA, 11 bp, Unknown
  misc_feature (1)..( 11): Result.004 file - promoters60/5663625
aagttgtttat

SEQ ID NO: 146936 - DNA, 11 bp, Unknown
  misc_feature (1)..( 11): Result.004 file - promoters60/5663625
aattttattta

SEQ ID NO: 146937 - DNA, 11 bp, Unknown
  misc_feature (1)..( 11): Result.004 file - promoters60/5663625
ctttttatttt

SEQ ID NO: 146938 - DNA, 11 bp, Unknown
  misc_feature (1)..( 11): Result.004 file - promoters60/5663625
ttgaatcttaa

SEQ ID NO: 146939 - DNA, 11 bp, Unknown
  misc_feature (1)..( 11): Result.004 file - promoters60/5663625
ttcatgtttaa

SEQ ID NO: 146940 - DNA, 11 bp, Unknown
  misc_feature (1)..( 11): Result.004 file - promoters60/5663625
attatgttttt

SEQ ID NO: 146941 - DNA, 14 bp, Unknown
  misc_feature (1)..( 14): Result.004 file - promoters60/5663625
cttacaatttcact

SEQ ID NO: 146942 - DNA, 14 bp, Unknown
  misc_feature (1)..( 14): Result.004 file - promoters60/5663625
ctttttttttcact

SEQ ID NO: 146943 - DNA, 14 bp, Unknown
  misc_feature (1)..( 14): Result.004 file - promoters60/5663625
tttttcttttcata

SEQ ID NO: 146944 - DNA, 14 bp, Unknown
  misc_feature (1)..( 14): Result.004 file - promoters60/5663625
tttttattttgttg

SEQ ID NO: 146945 - DNA, 14 bp, Unknown
  misc_feature (1)..( 14): Result.004 file - promoters60/5663625
tttacctttttacc

SEQ ID NO: 146946 - DNA, 14 bp, Unknown
  misc_feature (1)..( 14): Result.004 file - promoters60/5663625
cgattatgttttta

SEQ ID NO: 146947 - DNA, 8 bp, Unknown
  misc_feature (1)..( 8): Result.004 file - promoters60/5663625
tattttga

SEQ ID NO: 146948 - DNA, 8 bp, Unknown
  misc_feature (1)..( 8): Result.004 file - promoters60/5663625
tattttat

SEQ ID NO: 146949 - DNA, 8 bp, Unknown
  misc_feature (1)..( 8): Result.004 file - promoters60/5663625
tattatat

SEQ ID NO: 146950 - DNA, 9 bp, Unknown
  misc_feature (1)..( 9): Result.004 file - promoters60/5663625
tatatatga

SEQ ID NO: 146951 - DNA, 9 bp, Unknown
  misc_feature (1)..( 9): Result.004 file - promoters60/5663625
tatatttta

SEQ ID NO: 146952 - DNA, 9 bp, Unknown
  misc_feature (1)..( 9): Result.004 file - promoters60/5663625
ttcatatga

SEQ ID NO: 146953 - DNA, 13 bp, Unknown
  misc_feature (1)..( 13): Result.004 file - promoters60/5663625
caacaatgtacaa

SEQ ID NO: 146954 - DNA, 13 bp, Unknown
  misc_feature (1)..( 13): Result.004 file - promoters60/5663625
caataatttacat

SEQ ID NO: 146955 - DNA, 13 bp, Unknown
  misc_feature (1)..( 13): Result.004 file - promoters60/5663625
gaataataaaatg

SEQ ID NO: 146956 - DNA, 13 bp, Unknown
  misc_feature (1)..( 13): Result.004 file - promoters60/5663625
atttaatttaata

SEQ ID NO: 146957 - DNA, 13 bp, Unknown
  misc_feature (1)..( 13): Result.004 file - promoters60/5663625
acctgattttatt

SEQ ID NO: 146958 - DNA, 13 bp, Unknown
  misc_feature (1)..( 13): Result.004 file - promoters60/5663625
gtataatttaatg

SEQ ID NO: 146959 - DNA, 13 bp, Unknown
  misc_feature (1)..( 13): Result.004 file - promoters60/5663625
tgaaaatttatac

SEQ ID NO: 146960 - DNA, 14 bp, Unknown
  misc_feature (1)..( 14): Result.004 file - promoters60/5663625
gattttttatttta

SEQ ID NO: 146961 - DNA, 14 bp, Unknown
  misc_feature (1)..( 14): Result.004 file - promoters60/5663625
tattttatattagt

SEQ ID NO: 146962 - DNA, 14 bp, Unknown
  misc_feature (1)..( 14): Result.004 file - promoters60/5663625
gattttgactatgc

SEQ ID NO: 146963 - DNA, 14 bp, Unknown
  misc_feature (1)..( 14): Result.004 file - promoters60/5663625
aattttttgttgtt

SEQ ID NO: 146964 - DNA, 14 bp, Unknown
  misc_feature (1)..( 14): Result.004 file - promoters60/5663625
atgattatatgtac

SEQ ID NO: 146965 - DNA, 14 bp, Unknown
  misc_feature (1)..( 14): Result.004 file - promoters60/5663625
cacttcatatgagt

SEQ ID NO: 146966 - DNA, 13 bp, Unknown
  misc_feature (1)..( 13): Result.004 file - promoters60/5663625
atttataaaaatt

SEQ ID NO: 146967 - DNA, 13 bp, Unknown
  misc_feature (1)..( 13): Result.004 file - promoters60/5663625
ttttttaattgat

SEQ ID NO: 146968 - DNA, 13 bp, Unknown
  misc_feature (1)..( 13): Result.004 file - promoters60/5663625
attaatacaattg

SEQ ID NO: 146969 - DNA, 13 bp, Unknown
  misc_feature (1)..( 13): Result.004 file - promoters60/5663625
tatttgaatttag

SEQ ID NO: 146970 - DNA, 13 bp, Unknown
  misc_feature (1)..( 13): Result.004 file - promoters60/5663625
atttataacaaat

SEQ ID NO: 146971 - DNA, 13 bp, Unknown
  misc_feature (1)..( 13): Result.004 file - promoters60/5663698
aataatagaattg

SEQ ID NO: 146972 - DNA, 7 bp, Unknown
  misc_feature (1)..( 7): Result.004 file - promoters60/5663698
tgcttaa

SEQ ID NO: 146973 - DNA, 7 bp, Unknown
  misc_feature (1)..( 7): Result.004 file - promoters60/5663698
tgcataa

SEQ ID NO: 146974 - DNA, 9 bp, Unknown
  misc_feature (1)..( 9): Result.004 file - promoters60/5663698
tcaaaaact

SEQ ID NO: 146975 - DNA, 9 bp, Unknown
  misc_feature (1)..( 9): Result.004 file - promoters60/5663698
tcataaact

SEQ ID NO: 146976 - DNA, 7 bp, Unknown
  misc_feature (1)..( 7): Result.004 file - promoters60/5663698
aacaaag

SEQ ID NO: 146977 - DNA, 7 bp, Unknown
  misc_feature (1)..( 7): Result.004 file - promoters60/5663698
aacaaat

SEQ ID NO: 146978 - DNA, 7 bp, Unknown
  misc_feature (1)..( 7): Result.004 file - promoters60/5663698
tacaaat

SEQ ID NO: 146979 - DNA, 6 bp, Unknown
  misc_feature (1)..( 6): Result.004 file - promoters60/5663698
ttttaa

SEQ ID NO: 146980 - DNA, 6 bp, Unknown
  misc_feature (1)..( 6): Result.004 file - promoters60/5663698
ttttaa

SEQ ID NO: 146981 - DNA, 6 bp, Unknown
  misc_feature (1)..( 6): Result.004 file - promoters60/5663698
ccaatt

SEQ ID NO: 146982 - DNA, 6 bp, Unknown
  misc_feature (1)..( 6): Result.004 file - promoters60/5663698
ccaatt

SEQ ID NO: 146983 - DNA, 9 bp, Unknown
  misc_feature (1)..( 9): Result.004 file - promoters60/5663698
tataatgaa

SEQ ID NO: 146984 - DNA, 9 bp, Unknown
  misc_feature (1)..( 9): Result.004 file - promoters60/5663698
tataatgaa

SEQ ID NO: 146985 - DNA, 8 bp, Unknown
  misc_feature (1)..( 8): Result.004 file - promoters60/5663698
agtgatca

SEQ ID NO: 146986 - DNA, 8 bp, Unknown
  misc_feature (1)..( 8): Result.004 file - promoters60/5663698
tgtgatca

SEQ ID NO: 146987 - DNA, 8 bp, Unknown
  misc_feature (1)..( 8): Result.004 file - promoters60/5663698
agtgattt

SEQ ID NO: 146988 - DNA, 10 bp, Unknown
  misc_feature (1)..( 10): Result.004 file - promoters60/5663698
cttacaattt

SEQ ID NO: 146989 - DNA, 10 bp, Unknown
  misc_feature (1)..( 10): Result.004 file - promoters60/5663698
cttgcaattt

SEQ ID NO: 146990 - DNA, 6 bp, Unknown
  misc_feature (1)..( 6): Result.004 file - promoters60/5663698
tttgta

SEQ ID NO: 146991 - DNA, 6 bp, Unknown
  misc_feature (1)..( 6): Result.004 file - promoters60/5663698
tttgta

SEQ ID NO: 146992 - DNA, 6 bp, Unknown
  misc_feature (1)..( 6): Result.004 file - promoters60/5663698
aatata

SEQ ID NO: 146993 - DNA, 6 bp, Unknown
  misc_feature (1)..( 6): Result.004 file - promoters60/5663698
aatata

SEQ ID NO: 146994 - DNA, 6 bp, Unknown
  misc_feature (1)..( 6): Result.004 file - promoters60/5663698
aatggt

SEQ ID NO: 146995 - DNA, 6 bp, Unknown
  misc_feature (1)..( 6): Result.004 file - promoters60/5663698
aatggt

SEQ ID NO: 146996 - DNA, 8 bp, Unknown
  misc_feature (1)..( 8): Result.004 file - promoters60/5663698
tcagattt

SEQ ID NO: 146997 - DNA, 8 bp, Unknown
  misc_feature (1)..( 8): Result.004 file - promoters60/5663698
tcaaattt

SEQ ID NO: 146998 - DNA, 7 bp, Unknown
  misc_feature (1)..( 7): Result.004 file - promoters60/5663698
aagaaca

SEQ ID NO: 146999 - DNA, 7 bp, Unknown
  misc_feature (1)..( 7): Result.004 file - promoters60/5663698
aagaaca

SEQ ID NO: 147000 - DNA, 7 bp, Unknown
  misc_feature (1)..( 7): Result.004 file - promoters60/5663698
gttagtg

SEQ ID NO: 147001 - DNA, 7 bp, Unknown
  misc_feature (1)..( 7): Result.004 file - promoters60/5663698
gttggtg

SEQ ID NO: 147002 - DNA, 6 bp, Unknown
  misc_feature (1)..( 6): Result.004 file - promoters60/5663698
ttttgc

SEQ ID NO: 147003 - DNA, 6 bp, Unknown
  misc_feature (1)..( 6): Result.004 file - promoters60/5663698
ttttgc

SEQ ID NO: 147004 - DNA, 9 bp, Unknown
  misc_feature (1)..( 9): Result.004 file - promoters60/5663698
tgagaattt

SEQ ID NO: 147005 - DNA, 9 bp, Unknown
  misc_feature (1)..( 9): Result.004 file - promoters60/5663698
tgagaattt

SEQ ID NO: 147006 - DNA, 9 bp, Unknown
  misc_feature (1)..( 9): Result.004 file - promoters60/5663698
gatgttgta

SEQ ID NO: 147007 - DNA, 9 bp, Unknown
  misc_feature (1)..( 9): Result.004 file - promoters60/5663698
gattttgta

SEQ ID NO: 147008 - DNA, 8 bp, Unknown
  misc_feature (1)..( 8): Result.004 file - promoters60/5663698
tctgtctg

SEQ ID NO: 147009 - DNA, 8 bp, Unknown
  misc_feature (1)..( 8): Result.004 file - promoters60/5663706
tctatctg

SEQ ID NO: 147010 - DNA, 10 bp, Unknown
  misc_feature (1)..( 10): Result.004 file - promoters60/5663706
aaaattctaa

SEQ ID NO: 147011 - DNA, 10 bp, Unknown
  misc_feature (1)..( 10): Result.004 file - promoters60/5663706
aaaattttaa

SEQ ID NO: 147012 - DNA, 11 bp, Unknown
  misc_feature (1)..( 11): Result.004 file - promoters60/5663706
aaacattgtat

SEQ ID NO: 147013 - DNA, 7 bp, Unknown
  misc_feature (1)..( 7): Result.004 file - promoters60/5663706
aatattt

SEQ ID NO: 147014 - DNA, 7 bp, Unknown
  misc_feature (1)..( 7): Result.004 file - promoters60/5663706
aatattc

SEQ ID NO: 147015 - DNA, 8 bp, Unknown
  misc_feature (1)..( 8): Result.004 file - promoters60/5663706
aataattc

SEQ ID NO: 147016 - DNA, 8 bp, Unknown
  misc_feature (1)..( 8): Result.004 file - promoters60/5663706
aaatatcc

SEQ ID NO: 147017 - DNA, 8 bp, Unknown
  misc_feature (1)..( 8): Result.004 file - promoters60/5663706
gtaggtag

SEQ ID NO: 147018 - DNA, 8 bp, Unknown
  misc_feature (1)..( 8): Result.004 file - promoters60/5663706
gtaggtgg

SEQ ID NO: 147019 - DNA, 8 bp, Unknown
  misc_feature (1)..( 8): Result.004 file - promoters60/5663706
atagttag

SEQ ID NO: 147020 - DNA, 13 bp, Unknown
  misc_feature (1)..( 13): Result.004 file - promoters60/5663706
gttttattttata

SEQ ID NO: 147021 - DNA, 13 bp, Unknown
  misc_feature (1)..( 13): Result.004 file - promoters60/5663706
gttatataggctc

SEQ ID NO: 147022 - DNA, 13 bp, Unknown
  misc_feature (1)..( 13): Result.004 file - promoters60/5663706
actttatttaata

SEQ ID NO: 147023 - DNA, 7 bp, Unknown
  misc_feature (1)..( 7): Result.004 file - promoters60/5663706
gtaaaaa

SEQ ID NO: 147024 - DNA, 7 bp, Unknown
  misc_feature (1)..( 7): Result.004 file - promoters60/5663706
gtataaa

SEQ ID NO: 147025 - DNA, 7 bp, Unknown
  misc_feature (1)..( 7): Result.004 file - promoters60/5663706
gtagaaa

SEQ ID NO: 147026 - DNA, 10 bp, Unknown
  misc_feature (1)..( 10): Result.004 file - promoters60/5663706
aaatattctt

SEQ ID NO: 147027 - DNA, 10 bp, Unknown
  misc_feature (1)..( 10): Result.004 file - promoters60/5663706
ttatattctt

SEQ ID NO: 147028 - DNA, 10 bp, Unknown
  misc_feature (1)..( 10): Result.004 file - promoters60/5663706
ttaaattacg

SEQ ID NO: 147029 - DNA, 7 bp, Unknown
  misc_feature (1)..( 7): Result.004 file - promoters60/5663706
caattaa

SEQ ID NO: 147030 - DNA, 7 bp, Unknown
  misc_feature (1)..( 7): Result.004 file - promoters60/5663706
aaattaa

SEQ ID NO: 147031 - DNA, 7 bp, Unknown
  misc_feature (1)..( 7): Result.004 file - promoters60/5663706
aaattac

SEQ ID NO: 147032 - DNA, 11 bp, Unknown
  misc_feature (1)..( 11): Result.004 file - promoters60/5663706
ttgaatatttc

SEQ ID NO: 147033 - DNA, 11 bp, Unknown
  misc_feature (1)..( 11): Result.004 file - promoters60/5663706
gtgaatagtga

SEQ ID NO: 147034 - DNA, 11 bp, Unknown
  misc_feature (1)..( 11): Result.004 file - promoters60/5663706
ttgaatgtttc

SEQ ID NO: 147035 - DNA, 7 bp, Unknown
  misc_feature (1)..( 7): Result.004 file - promoters60/5663706
acactta

SEQ ID NO: 147036 - DNA, 7 bp, Unknown
  misc_feature (1)..( 7): Result.004 file - promoters60/5663706
acacttt

SEQ ID NO: 147037 - DNA, 7 bp, Unknown
  misc_feature (1)..( 7): Result.004 file - promoters60/5663706
acattta

SEQ ID NO: 147038 - DNA, 10 bp, Unknown
  misc_feature (1)..( 10): Result.004 file - promoters60/5663706
taattaattt

SEQ ID NO: 147039 - DNA, 10 bp, Unknown
  misc_feature (1)..( 10): Result.004 file - promoters60/5663706
taattagttt

SEQ ID NO: 147040 - DNA, 10 bp, Unknown
  misc_feature (1)..( 10): Result.004 file - promoters60/5663710
ttatttattc

SEQ ID NO: 147041 - DNA, 8 bp, Unknown
  misc_feature (1)..( 8): Result.004 file - promoters60/5663710
catgaaga

SEQ ID NO: 147042 - DNA, 8 bp, Unknown
  misc_feature (1)..( 8): Result.004 file - promoters60/5663710
catgaata

SEQ ID NO: 147043 - DNA, 8 bp, Unknown
  misc_feature (1)..( 8): Result.004 file - promoters60/5663710
catggata

SEQ ID NO: 147044 - DNA, 8 bp, Unknown
  misc_feature (1)..( 8): Result.004 file - promoters60/5663710
tatgaatc

SEQ ID NO: 147045 - DNA, 8 bp, Unknown
  misc_feature (1)..( 8): Result.004 file - promoters60/5663710
tatggatt

SEQ ID NO: 147046 - DNA, 10 bp, Unknown
  misc_feature (1)..( 10): Result.004 file - promoters60/5663710
tgttaaactt

SEQ ID NO: 147047 - DNA, 10 bp, Unknown
  misc_feature (1)..( 10): Result.004 file - promoters60/5663710
gcataatctt

SEQ ID NO: 147048 - DNA, 10 bp, Unknown
  misc_feature (1)..( 10): Result.004 file - promoters60/5663710
tggtaaactt

SEQ ID NO: 147049 - DNA, 10 bp, Unknown
  misc_feature (1)..( 10): Result.004 file - promoters60/5663710
agataatctc

SEQ ID NO: 147050 - DNA, 10 bp, Unknown
  misc_feature (1)..( 10): Result.004 file - promoters60/5663710
agatcatctt

SEQ ID NO: 147051 - DNA, 11 bp, Unknown
  misc_feature (1)..( 11): Result.004 file - promoters60/5663710
gtaatattgtg

SEQ ID NO: 147052 - DNA, 11 bp, Unknown
  misc_feature (1)..( 11): Result.004 file - promoters60/5663710
ataaaattgaa

SEQ ID NO: 147053 - DNA, 11 bp, Unknown
  misc_feature (1)..( 11): Result.004 file - promoters60/5663710
ttaaacttgag

SEQ ID NO: 147054 - DNA, 11 bp, Unknown
  misc_feature (1)..( 11): Result.004 file - promoters60/5663710
ataaaagtcta

SEQ ID NO: 147055 - DNA, 11 bp, Unknown
  misc_feature (1)..( 11): Result.004 file - promoters60/5663744
agaaaacaaaa

SEQ ID NO: 147056 - DNA, 9 bp, Unknown
  misc_feature (1)..( 9): Result.004 file - promoters60/5663744
gtttttctt

SEQ ID NO: 147057 - DNA, 9 bp, Unknown
  misc_feature (1)..( 9): Result.004 file - promoters60/5663744
gttttactt

SEQ ID NO: 147058 - DNA, 8 bp, Unknown
  misc_feature (1)..( 8): Result.004 file - promoters60/5663744
ctagtgat

SEQ ID NO: 147059 - DNA, 8 bp, Unknown
  misc_feature (1)..( 8): Result.004 file - promoters60/5663744
ctattgat

SEQ ID NO: 147060 - DNA, 8 bp, Unknown
  misc_feature (1)..( 8): Result.004 file - promoters60/5663744
aaagatgg

SEQ ID NO: 147061 - DNA, 8 bp, Unknown
  misc_feature (1)..( 8): Result.004 file - promoters60/5663744
aaacatgg

SEQ ID NO: 147062 - DNA, 9 bp, Unknown
  misc_feature (1)..( 9): Result.004 file - promoters60/5663744
gtatagatt

SEQ ID NO: 147063 - DNA, 9 bp, Unknown
  misc_feature (1)..( 9): Result.004 file - promoters60/5663744
gtatcgatt

SEQ ID NO: 147064 - DNA, 8 bp, Unknown
  misc_feature (1)..( 8): Result.004 file - promoters60/5663744
gatatgtg

SEQ ID NO: 147065 - DNA, 8 bp, Unknown
  misc_feature (1)..( 8): Result.004 file - promoters60/5663744
gatacgtg

SEQ ID NO: 147066 - DNA, 10 bp, Unknown
  misc_feature (1)..( 10): Result.004 file - promoters60/5663744
gaactagaag

SEQ ID NO: 147067 - DNA, 10 bp, Unknown
  misc_feature (1)..( 10): Result.004 file - promoters60/5663744
gaactagata

SEQ ID NO: 147068 - DNA, 10 bp, Unknown
  misc_feature (1)..( 10): Result.004 file - promoters60/5663744
gttctacata

SEQ ID NO: 147069 - DNA, 6 bp, Unknown
  misc_feature (1)..( 6): Result.004 file - promoters60/5663744
ttgatt

SEQ ID NO: 147070 - DNA, 6 bp, Unknown
  misc_feature (1)..( 6): Result.004 file - promoters60/5663744
ttgatt

SEQ ID NO: 147071 - DNA, 9 bp, Unknown
  misc_feature (1)..( 9): Result.004 file - promoters60/5663744
taacatttg

SEQ ID NO: 147072 - DNA, 9 bp, Unknown
  misc_feature (1)..( 9): Result.004 file - promoters60/5663744
taacttttt

SEQ ID NO: 147073 - DNA, 9 bp, Unknown
  misc_feature (1)..( 9): Result.004 file - promoters60/5663744
aggcttttt

SEQ ID NO: 147074 - DNA, 7 bp, Unknown
  misc_feature (1)..( 7): Result.004 file - promoters60/5663744
ataaaga

SEQ ID NO: 147075 - DNA, 7 bp, Unknown
  misc_feature (1)..( 7): Result.004 file - promoters60/5663744
ataaaga

SEQ ID NO: 147076 - DNA, 7 bp, Unknown
  misc_feature (1)..( 7): Result.004 file - promoters60/5663744
tcccgaa

SEQ ID NO: 147077 - DNA, 7 bp, Unknown
  misc_feature (1)..( 7): Result.004 file - promoters60/5663744
tccagaa

SEQ ID NO: 147078 - DNA, 8 bp, Unknown
  misc_feature (1)..( 8): Result.004 file - promoters60/5663744
aatcaaag

SEQ ID NO: 147079 - DNA, 8 bp, Unknown
  misc_feature (1)..( 8): Result.004 file - promoters60/5663744
aatgaaag

SEQ ID NO: 147080 - DNA, 7 bp, Unknown
  misc_feature (1)..( 7): Result.004 file - promoters60/5663744
aaacaca

SEQ ID NO: 147081 - DNA, 7 bp, Unknown
  misc_feature (1)..( 7): Result.004 file - promoters60/5663744
aaacaca

SEQ ID NO: 147082 - DNA, 7 bp, Unknown
  misc_feature (1)..( 7): Result.004 file - promoters60/5663744
aaagatc

SEQ ID NO: 147083 - DNA, 7 bp, Unknown
  misc_feature (1)..( 7): Result.004 file - promoters60/5663744
aaatatc

SEQ ID NO: 147084 - DNA, 7 bp, Unknown
  misc_feature (1)..( 7): Result.004 file - promoters60/5663744
aaacaaa

SEQ ID NO: 147085 - DNA, 7 bp, Unknown
  misc_feature (1)..( 7): Result.004 file - promoters60/5663748
aaagaaa

SEQ ID NO: 147086 - DNA, 7 bp, Unknown
  misc_feature (1)..( 7): Result.004 file - promoters60/5663748
tttttaa

SEQ ID NO: 147087 - DNA, 7 bp, Unknown
  misc_feature (1)..( 7): Result.004 file - promoters60/5663748
tttttat

SEQ ID NO: 147088 - DNA, 7 bp, Unknown
  misc_feature (1)..( 7): Result.004 file - promoters60/5663748
cttttat

SEQ ID NO: 147089 - DNA, 6 bp, Unknown
  misc_feature (1)..( 6): Result.004 file - promoters60/5663748
agaaat

SEQ ID NO: 147090 - DNA, 6 bp, Unknown
  misc_feature (1)..( 6): Result.004 file - promoters60/5663748
agaaat

SEQ ID NO: 147091 - DNA, 6 bp, Unknown
  misc_feature (1)..( 6): Result.004 file - promoters60/5663748
agaaat

SEQ ID NO: 147092 - DNA, 7 bp, Unknown
  misc_feature (1)..( 7): Result.004 file - promoters60/5663748
tttatct

SEQ ID NO: 147093 - DNA, 7 bp, Unknown
  misc_feature (1)..( 7): Result.004 file - promoters60/5663748
tttatca

SEQ ID NO: 147094 - DNA, 7 bp, Unknown
  misc_feature (1)..( 7): Result.004 file - promoters60/5663748
gttatct

SEQ ID NO: 147095 - DNA, 8 bp, Unknown
  misc_feature (1)..( 8): Result.004 file - promoters60/5663748
cttttctt

SEQ ID NO: 147096 - DNA, 8 bp, Unknown
  misc_feature (1)..( 8): Result.004 file - promoters60/5663748
ctttactt

SEQ ID NO: 147097 - DNA, 8 bp, Unknown
  misc_feature (1)..( 8): Result.004 file - promoters60/5663748
gtttactc

SEQ ID NO: 147098 - DNA, 8 bp, Unknown
  misc_feature (1)..( 8): Result.004 file - promoters60/5663748
aaatatat

SEQ ID NO: 147099 - DNA, 8 bp, Unknown
  misc_feature (1)..( 8): Result.004 file - promoters60/5663748
aaaaataa

SEQ ID NO: 147100 - DNA, 8 bp, Unknown
  misc_feature (1)..( 8): Result.004 file - promoters60/5663748
aaaaaaaa

SEQ ID NO: 147101 - DNA, 11 bp, Unknown
  misc_feature (1)..( 11): Result.004 file - promoters60/5663748
tctgaaacaga

SEQ ID NO: 147102 - DNA, 11 bp, Unknown
  misc_feature (1)..( 11): Result.004 file - promoters60/5663748
aaacaaaaaga

SEQ ID NO: 147103 - DNA, 11 bp, Unknown
  misc_feature (1)..( 11): Result.004 file - promoters60/5663748
aaccaaaatta

SEQ ID NO: 147104 - DNA, 10 bp, Unknown
  misc_feature (1)..( 10): Result.004 file - promoters60/5663748
agagaaaatg

SEQ ID NO: 147105 - DNA, 10 bp, Unknown
  misc_feature (1)..( 10): Result.004 file - promoters60/5663748
agagaaacat

SEQ ID NO: 147106 - DNA, 10 bp, Unknown
  misc_feature (1)..( 10): Result.004 file - promoters60/5663748
caagaaaatt

SEQ ID NO: 147107 - DNA, 10 bp, Unknown
  misc_feature (1)..( 10): Result.004 file - promoters60/5663748
aaaaaaataa

SEQ ID NO: 147108 - DNA, 7 bp, Unknown
  misc_feature (1)..( 7): Result.004 file - promoters60/5663748
aaatttt

SEQ ID NO: 147109 - DNA, 7 bp, Unknown
  misc_feature (1)..( 7): Result.004 file - promoters60/5663748
aaattta

SEQ ID NO: 147110 - DNA, 7 bp, Unknown
  misc_feature (1)..( 7): Result.004 file - promoters60/5663758
gaatttt

SEQ ID NO: 147111 - DNA, 8 bp, Unknown
  misc_feature (1)..( 8): Result.004 file - promoters60/5663758
catatttg

SEQ ID NO: 147112 - DNA, 8 bp, Unknown
  misc_feature (1)..( 8): Result.004 file - promoters60/5663758
catttttt

SEQ ID NO: 147113 - DNA, 8 bp, Unknown
  misc_feature (1)..( 8): Result.004 file - promoters60/5663758
cattttcg

SEQ ID NO: 147114 - DNA, 9 bp, Unknown
  misc_feature (1)..( 9): Result.004 file - promoters60/5663758
aatttattt

SEQ ID NO: 147115 - DNA, 10 bp, Unknown
  misc_feature (1)..( 10): Result.004 file - promoters60/5663758
gtaaaatttt

SEQ ID NO: 147116 - DNA, 10 bp, Unknown
  misc_feature (1)..( 10): Result.004 file - promoters60/5663758
aaaaaattag

SEQ ID NO: 147117 - DNA, 10 bp, Unknown
  misc_feature (1)..( 10): Result.004 file - promoters60/5663758
ctaaaatctt

SEQ ID NO: 147118 - DNA, 10 bp, Unknown
  misc_feature (1)..( 10): Result.004 file - promoters60/5663758
ctaaaataat

SEQ ID NO: 147119 - DNA, 10 bp, Unknown
  misc_feature (1)..( 10): Result.004 file - promoters60/5663758
gtaaaagaat

SEQ ID NO: 147120 - DNA, 10 bp, Unknown
  misc_feature (1)..( 10): Result.004 file - promoters60/5663758
ctacaatttt

SEQ ID NO: 147121 - DNA, 13 bp, Unknown
  misc_feature (1)..( 13): Result.004 file - promoters60/5663758
tttttttttgttc

SEQ ID NO: 147122 - DNA, 13 bp, Unknown
  misc_feature (1)..( 13): Result.004 file - promoters60/5663758
gtattttgtgttc

SEQ ID NO: 147123 - DNA, 13 bp, Unknown
  misc_feature (1)..( 13): Result.004 file - promoters60/5663758
ttttttttttttc

SEQ ID NO: 147124 - DNA, 13 bp, Unknown
  misc_feature (1)..( 13): Result.004 file - promoters60/5663758
atcaaatttgtta

SEQ ID NO: 147125 - DNA, 9 bp, Unknown
  misc_feature (1)..( 9): Result.004 file - promoters60/5663758
tcaaaatta

SEQ ID NO: 147126 - DNA, 9 bp, Unknown
  misc_feature (1)..( 9): Result.004 file - promoters60/5663758
tcaaaatta

SEQ ID NO: 147127 - DNA, 9 bp, Unknown
  misc_feature (1)..( 9): Result.004 file - promoters60/5663758
acaatattt

SEQ ID NO: 147128 - DNA, 9 bp, Unknown
  misc_feature (1)..( 9): Result.004 file - promoters60/5663758
tcaatatgt

SEQ ID NO: 147129 - DNA, 8 bp, Unknown
  misc_feature (1)..( 8): Result.004 file - promoters60/5663758
ttgtgtaa

SEQ ID NO: 147130 - DNA, 8 bp, Unknown
  misc_feature (1)..( 8): Result.004 file - promoters60/5663758
ttgtgttt

SEQ ID NO: 147131 - DNA, 8 bp, Unknown
  misc_feature (1)..( 8): Result.004 file - promoters60/5663758
ttgtattt

SEQ ID NO: 147132 - DNA, 8 bp, Unknown
  misc_feature (1)..( 8): Result.004 file - promoters60/5663758
ttgggttt

SEQ ID NO: 147133 - DNA, 10 bp, Unknown
  misc_feature (1)..( 10): Result.004 file - promoters60/5663758
gtaaaatttt

SEQ ID NO: 147134 - DNA, 10 bp, Unknown
  misc_feature (1)..( 10): Result.004 file - promoters60/5663758
gtaaaagaat

SEQ ID NO: 147135 - DNA, 10 bp, Unknown
  misc_feature (1)..( 10): Result.004 file - promoters60/5663758
ctaaaatctt

SEQ ID NO: 147136 - DNA, 10 bp, Unknown
  misc_feature (1)..( 10): Result.004 file - promoters60/5663758
ctaaaataat

SEQ ID NO: 147137 - DNA, 10 bp, Unknown
  misc_feature (1)..( 10): Result.004 file - promoters60/5663758
ttaaaaaaat

SEQ ID NO: 147138 - DNA, 10 bp, Unknown
  misc_feature (1)..( 10): Result.004 file - promoters60/5663758
ctacaatttt

SEQ ID NO: 147139 - DNA, 9 bp, Unknown
  misc_feature (1)..( 9): Result.004 file - promoters60/5663758
atctaaaat

SEQ ID NO: 147140 - DNA, 9 bp, Unknown
  misc_feature (1)..( 9): Result.004 file - promoters60/5663758
atctaacaa

SEQ ID NO: 147141 - DNA, 9 bp, Unknown
  misc_feature (1)..( 9): Result.004 file - promoters60/5663758
ttctaaaat

SEQ ID NO: 147142 - DNA, 9 bp, Unknown
  misc_feature (1)..( 9): Result.004 file - promoters60/5663785
gcctacaat

SEQ ID NO: 147143 - DNA, 8 bp, Unknown
  misc_feature (1)..( 8): Result.004 file - promoters60/5663785
caaataaa

SEQ ID NO: 147144 - DNA, 8 bp, Unknown
  misc_feature (1)..( 8): Result.004 file - promoters60/5663785
aaaataaa

SEQ ID NO: 147145 - DNA, 8 bp, Unknown
  misc_feature (1)..( 8): Result.004 file - promoters60/5663785
taaaaaaa

SEQ ID NO: 147146 - DNA, 8 bp, Unknown
  misc_feature (1)..( 8): Result.004 file - promoters60/5663785
aaaataaa

SEQ ID NO: 147147 - DNA, 8 bp, Unknown
  misc_feature (1)..( 8): Result.004 file - promoters60/5663785
aaaataat

SEQ ID NO: 147148 - DNA, 10 bp, Unknown
  misc_feature (1)..( 10): Result.004 file - promoters60/5663785
taaaattttt

SEQ ID NO: 147149 - DNA, 10 bp, Unknown
  misc_feature (1)..( 10): Result.004 file - promoters60/5663785
taaaataact

SEQ ID NO: 147150 - DNA, 10 bp, Unknown
  misc_feature (1)..( 10): Result.004 file - promoters60/5663785
gaaactttat

SEQ ID NO: 147151 - DNA, 10 bp, Unknown
  misc_feature (1)..( 10): Result.004 file - promoters60/5663785
aaaaagaaaa

SEQ ID NO: 147152 - DNA, 10 bp, Unknown
  misc_feature (1)..( 10): Result.004 file - promoters60/5663785
aaaaataata

SEQ ID NO: 147153 - DNA, 9 bp, Unknown
  misc_feature (1)..( 9): Result.004 file - promoters60/5663785
ttgttattt

SEQ ID NO: 147154 - DNA, 9 bp, Unknown
  misc_feature (1)..( 9): Result.004 file - promoters60/5663785
ctgtttttt

SEQ ID NO: 147155 - DNA, 9 bp, Unknown
  misc_feature (1)..( 9): Result.004 file - promoters60/5663785
ctgttatgt

SEQ ID NO: 147156 - DNA, 9 bp, Unknown
  misc_feature (1)..( 9): Result.004 file - promoters60/5663785
ttgctatac

SEQ ID NO: 147157 - DNA, 9 bp, Unknown
  misc_feature (1)..( 9): Result.004 file - promoters60/5663785
aaaattaaa

SEQ ID NO: 147158 - DNA, 9 bp, Unknown
  misc_feature (1)..( 9): Result.004 file - promoters60/5663785
aaacttaat

SEQ ID NO: 147159 - DNA, 9 bp, Unknown
  misc_feature (1)..( 9): Result.004 file - promoters60/5663785
gtatttaat

SEQ ID NO: 147160 - DNA, 9 bp, Unknown
  misc_feature (1)..( 9): Result.004 file - promoters60/5663785
tagattaaa

SEQ ID NO: 147161 - DNA, 10 bp, Unknown
  misc_feature (1)..( 10): Result.004 file - promoters60/5663785
tatatagaac

SEQ ID NO: 147162 - DNA, 10 bp, Unknown
  misc_feature (1)..( 10): Result.004 file - promoters60/5663785
aaaatagaaa

SEQ ID NO: 147163 - DNA, 10 bp, Unknown
  misc_feature (1)..( 10): Result.004 file - promoters60/5663785
ttaatggaaa

SEQ ID NO: 147164 - DNA, 10 bp, Unknown
  misc_feature (1)..( 10): Result.004 file - promoters60/5663785
ttattggatt

SEQ ID NO: 147165 - DNA, 9 bp, Unknown
  misc_feature (1)..( 9): Result.004 file - promoters60/5663785
aaaagacaa

SEQ ID NO: 147166 - DNA, 9 bp, Unknown
  misc_feature (1)..( 9): Result.004 file - promoters60/5663785
aaaagaaaa

SEQ ID NO: 147167 - DNA, 9 bp, Unknown
  misc_feature (1)..( 9): Result.004 file - promoters60/5663785
aaaataaaa

SEQ ID NO: 147168 - DNA, 9 bp, Unknown
  misc_feature (1)..( 9): Result.004 file - promoters60/5663785
aaaataata

SEQ ID NO: 147169 - DNA, 9 bp, Unknown
  misc_feature (1)..( 9): Result.004 file - promoters60/5663785
aaactaaac

SEQ ID NO: 147170 - DNA, 11 bp, Unknown
  misc_feature (1)..( 11): Result.004 file - promoters60/5663785
tttaaccaaaa

SEQ ID NO: 147171 - DNA, 11 bp, Unknown
  misc_feature (1)..( 11): Result.004 file - promoters60/5663785
tttcaccaagg

SEQ ID NO: 147172 - DNA, 11 bp, Unknown
  misc_feature (1)..( 11): Result.004 file - promoters60/5663785
tataaccaaaa

SEQ ID NO: 147173 - DNA, 11 bp, Unknown
  misc_feature (1)..( 11): Result.004 file - promoters60/5663805
ataaactaaac

SEQ ID NO: 147174 - DNA, 8 bp, Unknown
  misc_feature (1)..( 8): Result.004 file - promoters60/5663805
tttgtata

SEQ ID NO: 147175 - DNA, 8 bp, Unknown
  misc_feature (1)..( 8): Result.004 file - promoters60/5663805
ggtgtata

SEQ ID NO: 147176 - DNA, 8 bp, Unknown
  misc_feature (1)..( 8): Result.004 file - promoters60/5663805
tttctatc

SEQ ID NO: 147177 - DNA, 8 bp, Unknown
  misc_feature (1)..( 8): Result.004 file - promoters60/5663805
tttttatc

SEQ ID NO: 147178 - DNA, 8 bp, Unknown
  misc_feature (1)..( 8): Result.004 file - promoters60/5663805
tttttaat

SEQ ID NO: 147179 - DNA, 13 bp, Unknown
  misc_feature (1)..( 13): Result.004 file - promoters60/5663805
ttacaataaatat

SEQ ID NO: 147180 - DNA, 13 bp, Unknown
  misc_feature (1)..( 13): Result.004 file - promoters60/5663805
acataataaatat

SEQ ID NO: 147181 - DNA, 13 bp, Unknown
  misc_feature (1)..( 13): Result.004 file - promoters60/5663805
ttataataaaact

SEQ ID NO: 147182 - DNA, 13 bp, Unknown
  misc_feature (1)..( 13): Result.004 file - promoters60/5663805
acaaaataaaata

SEQ ID NO: 147183 - DNA, 13 bp, Unknown
  misc_feature (1)..( 13): Result.004 file - promoters60/5663805
taacaataaagaa

SEQ ID NO: 147184 - DNA, 14 bp, Unknown
  misc_feature (1)..( 14): Result.004 file - promoters60/5663805
tctcataagtttga

SEQ ID NO: 147185 - DNA, 14 bp, Unknown
  misc_feature (1)..( 14): Result.004 file - promoters60/5663805
actcataataaata

SEQ ID NO: 147186 - DNA, 14 bp, Unknown
  misc_feature (1)..( 14): Result.004 file - promoters60/5663805
acttataatgaatt

SEQ ID NO: 147187 - DNA, 14 bp, Unknown
  misc_feature (1)..( 14): Result.004 file - promoters60/5663805
tcatataatagtaa

SEQ ID NO: 147188 - DNA, 14 bp, Unknown
  misc_feature (1)..( 14): Result.004 file - promoters60/5663805
atttataatataat

SEQ ID NO: 147189 - DNA, 14 bp, Unknown
  misc_feature (1)..( 14): Result.004 file - promoters60/5663805
taaaataaggaatt

SEQ ID NO: 147190 - DNA, 10 bp, Unknown
  misc_feature (1)..( 10): Result.004 file - promoters60/5663805
tgtttttgtg

SEQ ID NO: 147191 - DNA, 10 bp, Unknown
  misc_feature (1)..( 10): Result.004 file - promoters60/5663805
gatttttgta

SEQ ID NO: 147192 - DNA, 10 bp, Unknown
  misc_feature (1)..( 10): Result.004 file - promoters60/5663805
ggtttttata

SEQ ID NO: 147193 - DNA, 10 bp, Unknown
  misc_feature (1)..( 10): Result.004 file - promoters60/5663805
tgtttttgtg

SEQ ID NO: 147194 - DNA, 10 bp, Unknown
  misc_feature (1)..( 10): Result.004 file - promoters60/5663805
gattttttct

SEQ ID NO: 147195 - DNA, 14 bp, Unknown
  misc_feature (1)..( 14): Result.004 file - promoters60/5663805
ccccaaaagaaaaa

SEQ ID NO: 147196 - DNA, 14 bp, Unknown
  misc_feature (1)..( 14): Result.004 file - promoters60/5663805
ataaaaaataaata

SEQ ID NO: 147197 - DNA, 14 bp, Unknown
  misc_feature (1)..( 14): Result.004 file - promoters60/5663805
aatcagaataaaaa

SEQ ID NO: 147198 - DNA, 14 bp, Unknown
  misc_feature (1)..( 14): Result.004 file - promoters60/5663805
atatataataaata

SEQ ID NO: 147199 - DNA, 14 bp, Unknown
  misc_feature (1)..( 14): Result.004 file - promoters60/5663805
aattattatacttc

SEQ ID NO: 147200 - DNA, 14 bp, Unknown
  misc_feature (1)..( 14): Result.004 file - promoters60/5663805
tcatataattatct

SEQ ID NO: 147201 - DNA, 14 bp, Unknown
  misc_feature (1)..( 14): Result.004 file - promoters60/5663805
tcatataacaattt

SEQ ID NO: 147202 - DNA, 13 bp, Unknown
  misc_feature (1)..( 13): Result.004 file - promoters60/5663805
aaaagaaaaaaaa

SEQ ID NO: 147203 - DNA, 13 bp, Unknown
  misc_feature (1)..( 13): Result.004 file - promoters60/5663805
agcataaaaaata

SEQ ID NO: 147204 - DNA, 13 bp, Unknown
  misc_feature (1)..( 13): Result.004 file - promoters60/5663805
agaataaaaattg

SEQ ID NO: 147205 - DNA, 13 bp, Unknown
  misc_feature (1)..( 13): Result.004 file - promoters60/5663805
tatataataaata

SEQ ID NO: 147206 - DNA, 13 bp, Unknown
  misc_feature (1)..( 13): Result.004 file - promoters60/5663805
taattattatact

SEQ ID NO: 147207 - DNA, 13 bp, Unknown
  misc_feature (1)..( 13): Result.004 file - promoters60/5663805
atcatataattat

SEQ ID NO: 147208 - DNA, 13 bp, Unknown
  misc_feature (1)..( 13): Result.004 file - promoters60/5663805
gtcatataacaat

SEQ ID NO: 147209 - DNA, 10 bp, Unknown
  misc_feature (1)..( 10): Result.004 file - promoters60/5663805
aaataatgaa

SEQ ID NO: 147210 - DNA, 10 bp, Unknown
  misc_feature (1)..( 10): Result.004 file - promoters60/5663805
gaatactgaa

SEQ ID NO: 147211 - DNA, 10 bp, Unknown
  misc_feature (1)..( 10): Result.004 file - promoters60/5663805
aaataataaa

SEQ ID NO: 147212 - DNA, 10 bp, Unknown
  misc_feature (1)..( 10): Result.004 file - promoters60/5663805
acttaatgac

SEQ ID NO: 147213 - DNA, 10 bp, Unknown
  misc_feature (1)..( 10): Result.004 file - promoters60/5663805
aaatcatatt

SEQ ID NO: 147214 - DNA, 14 bp, Unknown
  misc_feature (1)..( 14): Result.004 file - promoters60/5663805
actcataataaata

SEQ ID NO: 147215 - DNA, 14 bp, Unknown
  misc_feature (1)..( 14): Result.004 file - promoters60/5663805
tcatataatagtaa

SEQ ID NO: 147216 - DNA, 14 bp, Unknown
  misc_feature (1)..( 14): Result.004 file - promoters60/5663805
atttataatataat

SEQ ID NO: 147217 - DNA, 14 bp, Unknown
  misc_feature (1)..( 14): Result.004 file - promoters60/5663805
acttataatgaatt

SEQ ID NO: 147218 - DNA, 14 bp, Unknown
  misc_feature (1)..( 14): Result.004 file - promoters60/5663805
taaaataaggaatt

SEQ ID NO: 147219 - DNA, 13 bp, Unknown
  misc_feature (1)..( 13): Result.004 file - promoters60/5663805
tttgttatataag

SEQ ID NO: 147220 - DNA, 13 bp, Unknown
  misc_feature (1)..( 13): Result.004 file - promoters60/5663805
tcctttatatatt

SEQ ID NO: 147221 - DNA, 13 bp, Unknown
  misc_feature (1)..( 13): Result.004 file - promoters60/5663805
cttattatataga

SEQ ID NO: 147222 - DNA, 13 bp, Unknown
  misc_feature (1)..( 13): Result.004 file - promoters60/5663805
cgtcccataaaga

SEQ ID NO: 147223 - DNA, 13 bp, Unknown
  misc_feature (1)..( 13): Result.004 file - promoters60/5663820
cgtcctataaata

SEQ ID NO: 147224 - DNA, 6 bp, Unknown
  misc_feature (1)..( 6): Result.004 file - promoters60/5663820
ttatca

SEQ ID NO: 147225 - DNA, 6 bp, Unknown
  misc_feature (1)..( 6): Result.004 file - promoters60/5663820
ttatca

SEQ ID NO: 147226 - DNA, 8 bp, Unknown
  misc_feature (1)..( 8): Result.004 file - promoters60/5663820
ttttattt

SEQ ID NO: 147227 - DNA, 8 bp, Unknown
  misc_feature (1)..( 8): Result.004 file - promoters60/5663820
tttttttt

SEQ ID NO: 147228 - DNA, 8 bp, Unknown
  misc_feature (1)..( 8): Result.004 file - promoters60/5663820
cctacttt

SEQ ID NO: 147229 - DNA, 8 bp, Unknown
  misc_feature (1)..( 8): Result.004 file - promoters60/5663820
cctatttt

SEQ ID NO: 147230 - DNA, 7 bp, Unknown
  misc_feature (1)..( 7): Result.004 file - promoters60/5663820
tttggtt

SEQ ID NO: 147231 - DNA, 7 bp, Unknown
  misc_feature (1)..( 7): Result.004 file - promoters60/5663820
ttttgtt

SEQ ID NO: 147232 - DNA, 7 bp, Unknown
  misc_feature (1)..( 7): Result.004 file - promoters60/5663820
tttctct

SEQ ID NO: 147233 - DNA, 7 bp, Unknown
  misc_feature (1)..( 7): Result.004 file - promoters60/5663820
tttttct

SEQ ID NO: 147234 - DNA, 6 bp, Unknown
  misc_feature (1)..( 6): Result.004 file - promoters60/5663820
cactta

SEQ ID NO: 147235 - DNA, 6 bp, Unknown
  misc_feature (1)..( 6): Result.004 file - promoters60/5663820
cactta

SEQ ID NO: 147236 - DNA, 6 bp, Unknown
  misc_feature (1)..( 6): Result.004 file - promoters60/5663820
gaaagt

SEQ ID NO: 147237 - DNA, 6 bp, Unknown
  misc_feature (1)..( 6): Result.004 file - promoters60/5663820
gaaagt

SEQ ID NO: 147238 - DNA, 9 bp, Unknown
  misc_feature (1)..( 9): Result.004 file - promoters60/5663820
ttgtgatcc

SEQ ID NO: 147239 - DNA, 9 bp, Unknown
  misc_feature (1)..( 9): Result.004 file - promoters60/5663820
ttgggatcc

SEQ ID NO: 147240 - DNA, 8 bp, Unknown
  misc_feature (1)..( 8): Result.004 file - promoters60/5663820
tatgtgtg

SEQ ID NO: 147241 - DNA, 8 bp, Unknown
  misc_feature (1)..( 8): Result.004 file - promoters60/5663820
tatgtgtg

SEQ ID NO: 147242 - DNA, 6 bp, Unknown
  misc_feature (1)..( 6): Result.004 file - promoters60/5663820
ttttca

SEQ ID NO: 147243 - DNA, 6 bp, Unknown
  misc_feature (1)..( 6): Result.004 file - promoters60/5663820
ttttca

SEQ ID NO: 147244 - DNA, 7 bp, Unknown
  misc_feature (1)..( 7): Result.004 file - promoters60/5663820
gttcaaa

SEQ ID NO: 147245 - DNA, 7 bp, Unknown
  misc_feature (1)..( 7): Result.004 file - promoters60/5663820
gttgaaa

SEQ ID NO: 147246 - DNA, 7 bp, Unknown
  misc_feature (1)..( 7): Result.004 file - promoters60/5663820
gcaatga

SEQ ID NO: 147247 - DNA, 7 bp, Unknown
  misc_feature (1)..( 7): Result.004 file - promoters60/5663820
gcaatga

SEQ ID NO: 147248 - DNA, 6 bp, Unknown
  misc_feature (1)..( 6): Result.004 file - promoters60/5663820
tgtttt

SEQ ID NO: 147249 - DNA, 6 bp, Unknown
  misc_feature (1)..( 6): Result.004 file - promoters60/5663820
tgtttt

SEQ ID NO: 147250 - DNA, 6 bp, Unknown
  misc_feature (1)..( 6): Result.004 file - promoters60/5663820
accttc

SEQ ID NO: 147251 - DNA, 6 bp, Unknown
  misc_feature (1)..( 6): Result.004 file - promoters60/5663820
accttc

SEQ ID NO: 147252 - DNA, 6 bp, Unknown
  misc_feature (1)..( 6): Result.004 file - promoters60/5663820
tctttt

SEQ ID NO: 147253 - DNA, 6 bp, Unknown
  misc_feature (1)..( 6): Result.004 file - promoters60/5663820
tctttt

SEQ ID NO: 147254 - DNA, 7 bp, Unknown
  misc_feature (1)..( 7): Result.004 file - promoters60/5663820
ctttatt

SEQ ID NO: 147255 - DNA, 7 bp, Unknown
  misc_feature (1)..( 7): Result.004 file - promoters60/5663820
cttgatt

SEQ ID NO: 147256 - DNA, 7 bp, Unknown
  misc_feature (1)..( 7): Result.004 file - promoters60/5663820
aatataa

SEQ ID NO: 147257 - DNA, 7 bp, Unknown
  misc_feature (1)..( 7): Result.004 file - promoters60/5663820
aatctaa

SEQ ID NO: 147258 - DNA, 7 bp, Unknown
  misc_feature (1)..( 7): Result.004 file - promoters60/5663820
tatcttt

SEQ ID NO: 147259 - DNA, 7 bp, Unknown
  misc_feature (1)..( 7): Result.004 file - promoters60/5663820
tattttt

SEQ ID NO: 147260 - DNA, 7 bp, Unknown
  misc_feature (1)..( 7): Result.004 file - promoters60/5663820
ttttttt

SEQ ID NO: 147261 - DNA, 7 bp, Unknown
  misc_feature (1)..( 7): Result.004 file - promoters60/5663820
tttcttt

SEQ ID NO: 147262 - DNA, 7 bp, Unknown
  misc_feature (1)..( 7): Result.004 file - promoters60/5663820
aattaac

SEQ ID NO: 147263 - DNA, 7 bp, Unknown
  misc_feature (1)..( 7): Result.004 file - promoters60/5663820
aataaac

SEQ ID NO: 147264 - DNA, 8 bp, Unknown
  misc_feature (1)..( 8): Result.004 file - promoters60/5663820
ccgtttta

SEQ ID NO: 147265 - DNA, 8 bp, Unknown
  misc_feature (1)..( 8): Result.004 file - promoters60/5663862
ccgtgtta

SEQ ID NO: 147266 - DNA, 13 bp, Unknown
  misc_feature (1)..( 13): Result.004 file - promoters60/5663862
acacagacaatcc

SEQ ID NO: 147267 - DNA, 13 bp, Unknown
  misc_feature (1)..( 13): Result.004 file - promoters60/5663862
cataagaaaattg

SEQ ID NO: 147268 - DNA, 13 bp, Unknown
  misc_feature (1)..( 13): Result.004 file - promoters60/5663862
taaaagaaaccaa

SEQ ID NO: 147269 - DNA, 13 bp, Unknown
  misc_feature (1)..( 13): Result.004 file - promoters60/5663862
cataacaaaaaat

SEQ ID NO: 147270 - DNA, 13 bp, Unknown
  misc_feature (1)..( 13): Result.004 file - promoters60/5663862
ccaaagaaaggtc

SEQ ID NO: 147271 - DNA, 13 bp, Unknown
  misc_feature (1)..( 13): Result.004 file - promoters60/5663862
gattataaaattg

SEQ ID NO: 147272 - DNA, 13 bp, Unknown
  misc_feature (1)..( 13): Result.004 file - promoters60/5663862
tcaaacaaatcaa

SEQ ID NO: 147273 - DNA, 8 bp, Unknown
  misc_feature (1)..( 8): Result.004 file - promoters60/5663862
tacgaaaa

SEQ ID NO: 147274 - DNA, 8 bp, Unknown
  misc_feature (1)..( 8): Result.004 file - promoters60/5663862
aacgaaat

SEQ ID NO: 147275 - DNA, 8 bp, Unknown
  misc_feature (1)..( 8): Result.004 file - promoters60/5663862
tactaaaa

SEQ ID NO: 147276 - DNA, 8 bp, Unknown
  misc_feature (1)..( 8): Result.004 file - promoters60/5663862
cacgaaat

SEQ ID NO: 147277 - DNA, 9 bp, Unknown
  misc_feature (1)..( 9): Result.004 file - promoters60/5663862
gacttaaaa

SEQ ID NO: 147278 - DNA, 10 bp, Unknown
  misc_feature (1)..( 10): Result.004 file - promoters60/5663862
ttgttacaat

SEQ ID NO: 147279 - DNA, 13 bp, Unknown
  misc_feature (1)..( 13): Result.004 file - promoters60/5663862
caagacctaaact

SEQ ID NO: 147280 - DNA, 13 bp, Unknown
  misc_feature (1)..( 13): Result.004 file - promoters60/5663862
tcagacctaaaca

SEQ ID NO: 147281 - DNA, 13 bp, Unknown
  misc_feature (1)..( 13): Result.004 file - promoters60/5663862
gaatggcaaaacc

SEQ ID NO: 147282 - DNA, 13 bp, Unknown
  misc_feature (1)..( 13): Result.004 file - promoters60/5663862
acaaatcaaatcg

SEQ ID NO: 147283 - DNA, 13 bp, Unknown
  misc_feature (1)..( 13): Result.004 file - promoters60/5663862
agaaaccaatttc

SEQ ID NO: 147284 - DNA, 13 bp, Unknown
  misc_feature (1)..( 13): Result.004 file - promoters60/5663934
gcataacaaaaaa

SEQ ID NO: 147285 - DNA, 9 bp, Unknown
  misc_feature (1)..( 9): Result.004 file - promoters60/5663934
catataaag

SEQ ID NO: 147286 - DNA, 9 bp, Unknown
  misc_feature (1)..( 9): Result.004 file - promoters60/5663934
catatatac

SEQ ID NO: 147287 - DNA, 9 bp, Unknown
  misc_feature (1)..( 9): Result.004 file - promoters60/5663934
aataaaaag

SEQ ID NO: 147288 - DNA, 9 bp, Unknown
  misc_feature (1)..( 9): Result.004 file - promoters60/5663934
tatatatat

SEQ ID NO: 147289 - DNA, 9 bp, Unknown
  misc_feature (1)..( 9): Result.004 file - promoters60/5663934
tatagataa

SEQ ID NO: 147290 - DNA, 9 bp, Unknown
  misc_feature (1)..( 9): Result.004 file - promoters60/5663934
tataaaacc

SEQ ID NO: 147291 - DNA, 11 bp, Unknown
  misc_feature (1)..( 11): Result.004 file - promoters60/5663934
cttgtttatat

SEQ ID NO: 147292 - DNA, 11 bp, Unknown
  misc_feature (1)..( 11): Result.004 file - promoters60/5663934
tttggttacaa

SEQ ID NO: 147293 - DNA, 11 bp, Unknown
  misc_feature (1)..( 11): Result.004 file - promoters60/5663934
cgagtttattt

SEQ ID NO: 147294 - DNA, 11 bp, Unknown
  misc_feature (1)..( 11): Result.004 file - promoters60/5663934
cttgtttactg

SEQ ID NO: 147295 - DNA, 11 bp, Unknown
  misc_feature (1)..( 11): Result.004 file - promoters60/5663934
acggtttgctg

SEQ ID NO: 147296 - DNA, 11 bp, Unknown
  misc_feature (1)..( 11): Result.004 file - promoters60/5663942
attttttttat

SEQ ID NO: 147297 - DNA, 10 bp, Unknown
  misc_feature (1)..( 10): Result.004 file - promoters60/5663942
gagagatttt

SEQ ID NO: 147298 - DNA, 10 bp, Unknown
  misc_feature (1)..( 10): Result.004 file - promoters60/5663942
gtgagctttt

SEQ ID NO: 147299 - DNA, 10 bp, Unknown
  misc_feature (1)..( 10): Result.004 file - promoters60/5663942
gagagatcgt

SEQ ID NO: 147300 - DNA, 7 bp, Unknown
  misc_feature (1)..( 7): Result.004 file - promoters60/5663942
attaggg

SEQ ID NO: 147301 - DNA, 7 bp, Unknown
  misc_feature (1)..( 7): Result.004 file - promoters60/5663942
atttggg

SEQ ID NO: 147302 - DNA, 7 bp, Unknown
  misc_feature (1)..( 7): Result.004 file - promoters60/5663942
tttagat

SEQ ID NO: 147303 - DNA, 7 bp, Unknown
  misc_feature (1)..( 7): Result.004 file - promoters60/5663942
tttagat

SEQ ID NO: 147304 - DNA, 9 bp, Unknown
  misc_feature (1)..( 9): Result.004 file - promoters60/5663942
gagaagaaa

SEQ ID NO: 147305 - DNA, 9 bp, Unknown
  misc_feature (1)..( 9): Result.004 file - promoters60/5663942
tagaaaaaa

SEQ ID NO: 147306 - DNA, 9 bp, Unknown
  misc_feature (1)..( 9): Result.004 file - promoters60/5663942
gaggagagc

SEQ ID NO: 147307 - DNA, 6 bp, Unknown
  misc_feature (1)..( 6): Result.004 file - promoters60/5663942
agtgag

SEQ ID NO: 147308 - DNA, 6 bp, Unknown
  misc_feature (1)..( 6): Result.004 file - promoters60/5663942
agtgag

SEQ ID NO: 147309 - DNA, 6 bp, Unknown
  misc_feature (1)..( 6): Result.004 file - promoters60/5663942
gagaga

SEQ ID NO: 147310 - DNA, 6 bp, Unknown
  misc_feature (1)..( 6): Result.004 file - promoters60/5663942
gagaga

SEQ ID NO: 147311 - DNA, 7 bp, Unknown
  misc_feature (1)..( 7): Result.004 file - promoters60/5663942
taaataa

SEQ ID NO: 147312 - DNA, 7 bp, Unknown
  misc_feature (1)..( 7): Result.004 file - promoters60/5663942
taaataa

SEQ ID NO: 147313 - DNA, 6 bp, Unknown
  misc_feature (1)..( 6): Result.004 file - promoters60/5663942
tcaccg

SEQ ID NO: 147314 - DNA, 6 bp, Unknown
  misc_feature (1)..( 6): Result.004 file - promoters60/5663942
tcaccg

SEQ ID NO: 147315 - DNA, 6 bp, Unknown
  misc_feature (1)..( 6): Result.004 file - promoters60/5663942
aggaga

SEQ ID NO: 147316 - DNA, 6 bp, Unknown
  misc_feature (1)..( 6): Result.004 file - promoters60/5663942
aggaga

SEQ ID NO: 147317 - DNA, 7 bp, Unknown
  misc_feature (1)..( 7): Result.004 file - promoters60/5663942
acgacca

SEQ ID NO: 147318 - DNA, 7 bp, Unknown
  misc_feature (1)..( 7): Result.004 file - promoters60/5663942
acggcca

SEQ ID NO: 147319 - DNA, 6 bp, Unknown
  misc_feature (1)..( 6): Result.004 file - promoters60/5663942
agagaa

SEQ ID NO: 147320 - DNA, 6 bp, Unknown
  misc_feature (1)..( 6): Result.004 file - promoters60/5663942
agagaa

SEQ ID NO: 147321 - DNA, 6 bp, Unknown
  misc_feature (1)..( 6): Result.004 file - promoters60/5663942
tgcaaa

SEQ ID NO: 147322 - DNA, 6 bp, Unknown
  misc_feature (1)..( 6): Result.004 file - promoters60/5663942
tgcaaa

SEQ ID NO: 147323 - DNA, 7 bp, Unknown
  misc_feature (1)..( 7): Result.004 file - promoters60/5663942
caattaa

SEQ ID NO: 147324 - DNA, 7 bp, Unknown
  misc_feature (1)..( 7): Result.004 file - promoters60/5663942
caattaa

SEQ ID NO: 147325 - DNA, 9 bp, Unknown
  misc_feature (1)..( 9): Result.004 file - promoters60/5663942
caatcgacg

SEQ ID NO: 147326 - DNA, 9 bp, Unknown
  misc_feature (1)..( 9): Result.004 file - promoters60/5663942
caatccacg

SEQ ID NO: 147327 - DNA, 7 bp, Unknown
  misc_feature (1)..( 7): Result.004 file - promoters60/5663942
agtattg

SEQ ID NO: 147328 - DNA, 7 bp, Unknown
  misc_feature (1)..( 7): Result.004 file - promoters60/5663942
agtattg

SEQ ID NO: 147329 - DNA, 7 bp, Unknown
  misc_feature (1)..( 7): Result.004 file - promoters60/5663942
tattaaa

SEQ ID NO: 147330 - DNA, 7 bp, Unknown
  misc_feature (1)..( 7): Result.004 file - promoters60/5663942
tatgaaa

SEQ ID NO: 147331 - DNA, 8 bp, Unknown
  misc_feature (1)..( 8): Result.004 file - promoters60/5663942
ttatatat

SEQ ID NO: 147332 - DNA, 8 bp, Unknown
  misc_feature (1)..( 8): Result.004 file - promoters60/5663942
ttatatat

SEQ ID NO: 147333 - DNA, 6 bp, Unknown
  misc_feature (1)..( 6): Result.004 file - promoters60/5663942
actcac

SEQ ID NO: 147334 - DNA, 6 bp, Unknown
  misc_feature (1)..( 6): Result.004 file - promoters60/5663942
actcac

SEQ ID NO: 147335 - DNA, 6 bp, Unknown
  misc_feature (1)..( 6): Result.004 file - promoters60/5663942
gagaat

SEQ ID NO: 147336 - DNA, 6 bp, Unknown
  misc_feature (1)..( 6): Result.004 file - promoters60/5663942
gagaat

SEQ ID NO: 147337 - DNA, 9 bp, Unknown
  misc_feature (1)..( 9): Result.004 file - promoters60/5663942
cagatttca

SEQ ID NO: 147338 - DNA, 9 bp, Unknown
  misc_feature (1)..( 9): Result.004 file - promoters60/5663942
caggtttca

SEQ ID NO: 147339 - DNA, 7 bp, Unknown
  misc_feature (1)..( 7): Result.004 file - promoters60/5663942
aaaatat

SEQ ID NO: 147340 - DNA, 7 bp, Unknown
  misc_feature (1)..( 7): Result.004 file - promoters60/5663942
aaattat

SEQ ID NO: 147341 - DNA, 6 bp, Unknown
  misc_feature (1)..( 6): Result.004 file - promoters60/5663942
ataaaa

SEQ ID NO: 147342 - DNA, 6 bp, Unknown
  misc_feature (1)..( 6): Result.004 file - promoters60/5663942
ataaaa

SEQ ID NO: 147343 - DNA, 7 bp, Unknown
  misc_feature (1)..( 7): Result.004 file - promoters60/5663942
gttgata

SEQ ID NO: 147344 - DNA, 7 bp, Unknown
  misc_feature (1)..( 7): Result.004 file - promoters60/5663946
gttgata

SEQ ID NO: 147345 - DNA, 8 bp, Unknown
  misc_feature (1)..( 8): Result.004 file - promoters60/5663946
gaaataaa

SEQ ID NO: 147346 - DNA, 8 bp, Unknown
  misc_feature (1)..( 8): Result.004 file - promoters60/5663946
aaaataac

SEQ ID NO: 147347 - DNA, 8 bp, Unknown
  misc_feature (1)..( 8): Result.004 file - promoters60/5663946
taaagaaa

SEQ ID NO: 147348 - DNA, 8 bp, Unknown
  misc_feature (1)..( 8): Result.004 file - promoters60/5663946
taaagagc

SEQ ID NO: 147349 - DNA, 8 bp, Unknown
  misc_feature (1)..( 8): Result.004 file - promoters60/5663946
ttttctta

SEQ ID NO: 147350 - DNA, 8 bp, Unknown
  misc_feature (1)..( 8): Result.004 file - promoters60/5663946
tttccttt

SEQ ID NO: 147351 - DNA, 8 bp, Unknown
  misc_feature (1)..( 8): Result.004 file - promoters60/5663946
atttcttc

SEQ ID NO: 147352 - DNA, 8 bp, Unknown
  misc_feature (1)..( 8): Result.004 file - promoters60/5663950
gtttcttc

SEQ ID NO: 147353 - DNA, 11 bp, Unknown
  misc_feature (1)..( 11): Result.004 file - promoters60/5663950
tgagaagattt

SEQ ID NO: 147354 - DNA, 11 bp, Unknown
  misc_feature (1)..( 11): Result.004 file - promoters60/5663950
aagaaagattc

SEQ ID NO: 147355 - DNA, 11 bp, Unknown
  misc_feature (1)..( 11): Result.004 file - promoters60/5663950
tcggaaaattt

SEQ ID NO: 147356 - DNA, 11 bp, Unknown
  misc_feature (1)..( 11): Result.004 file - promoters60/5663950
aagaaaaatta

SEQ ID NO: 147357 - DNA, 11 bp, Unknown
  misc_feature (1)..( 11): Result.004 file - promoters60/5663950
tatcgaaatta

SEQ ID NO: 147358 - DNA, 11 bp, Unknown
  misc_feature (1)..( 11): Result.004 file - promoters60/5663950
ttggatgaatt

SEQ ID NO: 147359 - DNA, 11 bp, Unknown
  misc_feature (1)..( 11): Result.004 file - promoters60/5663950
accgtttagat

SEQ ID NO: 147360 - DNA, 11 bp, Unknown
  misc_feature (1)..( 11): Result.004 file - promoters60/5663950
acctttttaaa

SEQ ID NO: 147361 - DNA, 11 bp, Unknown
  misc_feature (1)..( 11): Result.004 file - promoters60/5663950
atctttttaaa

SEQ ID NO: 147362 - DNA, 11 bp, Unknown
  misc_feature (1)..( 11): Result.004 file - promoters60/5663950
ttttttataac

SEQ ID NO: 147363 - DNA, 11 bp, Unknown
  misc_feature (1)..( 11): Result.004 file - promoters60/5663950
ccctttcatag

SEQ ID NO: 147364 - DNA, 11 bp, Unknown
  misc_feature (1)..( 11): Result.004 file - promoters60/5663950
tcctttttgta

SEQ ID NO: 147365 - DNA, 12 bp, Unknown
  misc_feature (1)..( 12): Result.004 file - promoters60/5663950
attttcttcaca

SEQ ID NO: 147366 - DNA, 12 bp, Unknown
  misc_feature (1)..( 12): Result.004 file - promoters60/5663950
gtttgcttcttt

SEQ ID NO: 147367 - DNA, 10 bp, Unknown
  misc_feature (1)..( 10): Result.004 file - promoters60/5663950
aatcttcaat

SEQ ID NO: 147368 - DNA, 12 bp, Unknown
  misc_feature (1)..( 12): Result.004 file - promoters60/5663950
ttttttttcggg

SEQ ID NO: 147369 - DNA, 12 bp, Unknown
  misc_feature (1)..( 12): Result.004 file - promoters60/5663950
aggatctgcaat

SEQ ID NO: 147370 - DNA, 12 bp, Unknown
  misc_feature (1)..( 12): Result.004 file - promoters60/5663954
tttattttccaa

SEQ ID NO: 147371 - DNA, 11 bp, Unknown
  misc_feature (1)..( 11): Result.004 file - promoters60/5663954
gtttcctagct

SEQ ID NO: 147372 - DNA, 11 bp, Unknown
  misc_feature (1)..( 11): Result.004 file - promoters60/5663954
aattcttagaa

SEQ ID NO: 147373 - DNA, 11 bp, Unknown
  misc_feature (1)..( 11): Result.004 file - promoters60/5663954
aatacttacaa

SEQ ID NO: 147374 - DNA, 11 bp, Unknown
  misc_feature (1)..( 11): Result.004 file - promoters60/5663954
ttgtctgagaa

SEQ ID NO: 147375 - DNA, 11 bp, Unknown
  misc_feature (1)..( 11): Result.004 file - promoters60/5663962
gaaattgagaa

SEQ ID NO: 147376 - DNA, 6 bp, Unknown
  misc_feature (1)..( 6): Result.004 file - promoters60/5663962
gcagta

SEQ ID NO: 147377 - DNA, 6 bp, Unknown
  misc_feature (1)..( 6): Result.004 file - promoters60/5663962
gcagta

SEQ ID NO: 147378 - DNA, 7 bp, Unknown
  misc_feature (1)..( 7): Result.004 file - promoters60/5663962
accagca

SEQ ID NO: 147379 - DNA, 7 bp, Unknown
  misc_feature (1)..( 7): Result.004 file - promoters60/5663962
acccgca

SEQ ID NO: 147380 - DNA, 6 bp, Unknown
  misc_feature (1)..( 6): Result.004 file - promoters60/5663962
aaccga

SEQ ID NO: 147381 - DNA, 6 bp, Unknown
  misc_feature (1)..( 6): Result.004 file - promoters60/5663962
aaccga

SEQ ID NO: 147382 - DNA, 6 bp, Unknown
  misc_feature (1)..( 6): Result.004 file - promoters60/5663962
aaccgg

SEQ ID NO: 147383 - DNA, 6 bp, Unknown
  misc_feature (1)..( 6): Result.004 file - promoters60/5663962
aaccgg

SEQ ID NO: 147384 - DNA, 7 bp, Unknown
  misc_feature (1)..( 7): Result.004 file - promoters60/5663962
gattcca

SEQ ID NO: 147385 - DNA, 7 bp, Unknown
  misc_feature (1)..( 7): Result.004 file - promoters60/5663962
gatacca

SEQ ID NO: 147386 - DNA, 9 bp, Unknown
  misc_feature (1)..( 9): Result.004 file - promoters60/5663962
ctccgccga

SEQ ID NO: 147387 - DNA, 9 bp, Unknown
  misc_feature (1)..( 9): Result.004 file - promoters60/5663962
ctccggcga

SEQ ID NO: 147388 - DNA, 7 bp, Unknown
  misc_feature (1)..( 7): Result.004 file - promoters60/5663962
tcataat

SEQ ID NO: 147389 - DNA, 7 bp, Unknown
  misc_feature (1)..( 7): Result.004 file - promoters60/5663962
tcataat

SEQ ID NO: 147390 - DNA, 6 bp, Unknown
  misc_feature (1)..( 6): Result.004 file - promoters60/5663962
attgtt

SEQ ID NO: 147391 - DNA, 6 bp, Unknown
  misc_feature (1)..( 6): Result.004 file - promoters60/5663970
attgtt

SEQ ID NO: 147392 - DNA, 9 bp, Unknown
  misc_feature (1)..( 9): Result.004 file - promoters60/5663970
aaagtttca

SEQ ID NO: 147393 - DNA, 9 bp, Unknown
  misc_feature (1)..( 9): Result.004 file - promoters60/5663970
aaaatttga

SEQ ID NO: 147394 - DNA, 9 bp, Unknown
  misc_feature (1)..( 9): Result.004 file - promoters60/5663970
ttagtttcc

SEQ ID NO: 147395 - DNA, 9 bp, Unknown
  misc_feature (1)..( 9): Result.004 file - promoters60/5663970
gaaatttgt

SEQ ID NO: 147396 - DNA, 9 bp, Unknown
  misc_feature (1)..( 9): Result.004 file - promoters60/5663970
caaatttgt

SEQ ID NO: 147397 - DNA, 9 bp, Unknown
  misc_feature (1)..( 9): Result.004 file - promoters60/5663970
ttattttcc

SEQ ID NO: 147398 - DNA, 11 bp, Unknown
  misc_feature (1)..( 11): Result.004 file - promoters60/5663970
tctgaatttta

SEQ ID NO: 147399 - DNA, 11 bp, Unknown
  misc_feature (1)..( 11): Result.004 file - promoters60/5663970
tccgaaatttg

SEQ ID NO: 147400 - DNA, 11 bp, Unknown
  misc_feature (1)..( 11): Result.004 file - promoters60/5663970
tctcaatttct

SEQ ID NO: 147401 - DNA, 11 bp, Unknown
  misc_feature (1)..( 11): Result.004 file - promoters60/5663970
ttcaaaatttg

SEQ ID NO: 147402 - DNA, 11 bp, Unknown
  misc_feature (1)..( 11): Result.004 file - promoters60/5663970
gattaatgtct

SEQ ID NO: 147403 - DNA, 11 bp, Unknown
  misc_feature (1)..( 11): Result.004 file - promoters60/5663970
gattaatttct

SEQ ID NO: 147404 - DNA, 13 bp, Unknown
  misc_feature (1)..( 13): Result.004 file - promoters60/5663970
tggttaattctcg

SEQ ID NO: 147405 - DNA, 13 bp, Unknown
  misc_feature (1)..( 13): Result.004 file - promoters60/5663970
tggataattgaag

SEQ ID NO: 147406 - DNA, 13 bp, Unknown
  misc_feature (1)..( 13): Result.004 file - promoters60/5663970
cggttgattttga

SEQ ID NO: 147407 - DNA, 13 bp, Unknown
  misc_feature (1)..( 13): Result.004 file - promoters60/5663970
agaatatttgata

SEQ ID NO: 147408 - DNA, 13 bp, Unknown
  misc_feature (1)..( 13): Result.004 file - promoters60/5663970
acactatttgata

SEQ ID NO: 147409 - DNA, 13 bp, Unknown
  misc_feature (1)..( 13): Result.004 file - promoters60/5663985
ttgttaacgatgt

SEQ ID NO: 147410 - DNA, 7 bp, Unknown
  misc_feature (1)..( 7): Result.004 file - promoters60/5663985
tgtttaa

SEQ ID NO: 147411 - DNA, 7 bp, Unknown
  misc_feature (1)..( 7): Result.004 file - promoters60/5663985
tgtttaa

SEQ ID NO: 147412 - DNA, 8 bp, Unknown
  misc_feature (1)..( 8): Result.004 file - promoters60/5663985
gttaactt

SEQ ID NO: 147413 - DNA, 8 bp, Unknown
  misc_feature (1)..( 8): Result.004 file - promoters60/5663985
gttatctt

SEQ ID NO: 147414 - DNA, 8 bp, Unknown
  misc_feature (1)..( 8): Result.004 file - promoters60/5663985
tattttga

SEQ ID NO: 147415 - DNA, 8 bp, Unknown
  misc_feature (1)..( 8): Result.004 file - promoters60/5663985
tattttga

SEQ ID NO: 147416 - DNA, 8 bp, Unknown
  misc_feature (1)..( 8): Result.004 file - promoters60/5663985
tatcttgc

SEQ ID NO: 147417 - DNA, 8 bp, Unknown
  misc_feature (1)..( 8): Result.004 file - promoters60/5663985
ttagtgtt

SEQ ID NO: 147418 - DNA, 8 bp, Unknown
  misc_feature (1)..( 8): Result.004 file - promoters60/5663985
ttagtgtt

SEQ ID NO: 147419 - DNA, 15 bp, Unknown
  misc_feature (1)..( 15): Result.004 file - promoters60/5663985
aatcaaggagcaatt

SEQ ID NO: 147420 - DNA, 15 bp, Unknown
  misc_feature (1)..( 15): Result.004 file - promoters60/5663985
aatcaaggagcaatt

SEQ ID NO: 147421 - DNA, 7 bp, Unknown
  misc_feature (1)..( 7): Result.004 file - promoters60/5663985
gattcag

SEQ ID NO: 147422 - DNA, 7 bp, Unknown
  misc_feature (1)..( 7): Result.004 file - promoters60/5663985
gatacag

SEQ ID NO: 147423 - DNA, 6 bp, Unknown
  misc_feature (1)..( 6): Result.004 file - promoters60/5663985
ttcagc

SEQ ID NO: 147424 - DNA, 6 bp, Unknown
  misc_feature (1)..( 6): Result.004 file - promoters60/5663985
ttcagc

SEQ ID NO: 147425 - DNA, 6 bp, Unknown
  misc_feature (1)..( 6): Result.004 file - promoters60/5663985
tcttgt

SEQ ID NO: 147426 - DNA, 6 bp, Unknown
  misc_feature (1)..( 6): Result.004 file - promoters60/5663985
tcttgt

SEQ ID NO: 147427 - DNA, 6 bp, Unknown
  misc_feature (1)..( 6): Result.004 file - promoters60/5663985
cttctt

SEQ ID NO: 147428 - DNA, 6 bp, Unknown
  misc_feature (1)..( 6): Result.004 file - promoters60/5663985
cttctt

SEQ ID NO: 147429 - DNA, 6 bp, Unknown
  misc_feature (1)..( 6): Result.004 file - promoters60/5663985
caaaaa

SEQ ID NO: 147430 - DNA, 6 bp, Unknown
  misc_feature (1)..( 6): Result.004 file - promoters60/5663985
caaaaa

SEQ ID NO: 147431 - DNA, 7 bp, Unknown
  misc_feature (1)..( 7): Result.004 file - promoters60/5663985
tatgggc

SEQ ID NO: 147432 - DNA, 7 bp, Unknown
  misc_feature (1)..( 7): Result.004 file - promoters60/5663985
tatgggc

SEQ ID NO: 147433 - DNA, 6 bp, Unknown
  misc_feature (1)..( 6): Result.004 file - promoters60/5663985
gggctt

SEQ ID NO: 147434 - DNA, 6 bp, Unknown
  misc_feature (1)..( 6): Result.004 file - promoters60/5663985
gggctt

SEQ ID NO: 147435 - DNA, 9 bp, Unknown
  misc_feature (1)..( 9): Result.004 file - promoters60/5663985
tttttgtta

SEQ ID NO: 147436 - DNA, 9 bp, Unknown
  misc_feature (1)..( 9): Result.004 file - promoters60/5663985
ttttggtta

SEQ ID NO: 147437 - DNA, 6 bp, Unknown
  misc_feature (1)..( 6): Result.004 file - promoters60/5663985
tttttg

SEQ ID NO: 147438 - DNA, 6 bp, Unknown
  misc_feature (1)..( 6): Result.004 file - promoters60/5663985
tttttg

SEQ ID NO: 147439 - DNA, 9 bp, Unknown
  misc_feature (1)..( 9): Result.004 file - promoters60/5663985
tttcaaaag

SEQ ID NO: 147440 - DNA, 9 bp, Unknown
  misc_feature (1)..( 9): Result.004 file - promoters60/5663985
ttttaaaag

SEQ ID NO: 147441 - DNA, 7 bp, Unknown
  misc_feature (1)..( 7): Result.004 file - promoters60/5663985
aagagaa

SEQ ID NO: 147442 - DNA, 7 bp, Unknown
  misc_feature (1)..( 7): Result.004 file - promoters60/5663996
aagtgaa

SEQ ID NO: 147443 - DNA, 12 bp, Unknown
  misc_feature (1)..( 12): Result.004 file - promoters60/5663996
ggtgaaacttac

SEQ ID NO: 147444 - DNA, 12 bp, Unknown
  misc_feature (1)..( 12): Result.004 file - promoters60/5663996
ttccgtacttac

SEQ ID NO: 147445 - DNA, 12 bp, Unknown
  misc_feature (1)..( 12): Result.004 file - promoters60/5663996
cccaaaaattat

SEQ ID NO: 147446 - DNA, 12 bp, Unknown
  misc_feature (1)..( 12): Result.004 file - promoters60/5663996
gtactaacttgt

SEQ ID NO: 147447 - DNA, 12 bp, Unknown
  misc_feature (1)..( 12): Result.004 file - promoters60/5663996
tcaacaaattaa

SEQ ID NO: 147448 - DNA, 12 bp, Unknown
  misc_feature (1)..( 12): Result.004 file - promoters60/5663996
attcaaaattct

SEQ ID NO: 147449 - DNA, 11 bp, Unknown
  misc_feature (1)..( 11): Result.004 file - promoters60/5663996
taagaacattg

SEQ ID NO: 147450 - DNA, 11 bp, Unknown
  misc_feature (1)..( 11): Result.004 file - promoters60/5663996
taataacattg

SEQ ID NO: 147451 - DNA, 11 bp, Unknown
  misc_feature (1)..( 11): Result.004 file - promoters60/5663996
cacgaacatgg

SEQ ID NO: 147452 - DNA, 11 bp, Unknown
  misc_feature (1)..( 11): Result.004 file - promoters60/5663996
tctctacattg

SEQ ID NO: 147453 - DNA, 11 bp, Unknown
  misc_feature (1)..( 11): Result.004 file - promoters60/5663996
aagtaaaattt

SEQ ID NO: 147454 - DNA, 11 bp, Unknown
  misc_feature (1)..( 11): Result.004 file - promoters60/5664022
gaataacaaaa

SEQ ID NO: 147455 - DNA, 7 bp, Unknown
  misc_feature (1)..( 7): Result.004 file - promoters60/5664022
aacttaa

SEQ ID NO: 147456 - DNA, 7 bp, Unknown
  misc_feature (1)..( 7): Result.004 file - promoters60/5664022
aacttaa

SEQ ID NO: 147457 - DNA, 6 bp, Unknown
  misc_feature (1)..( 6): Result.004 file - promoters60/5664022
caaaac

SEQ ID NO: 147458 - DNA, 6 bp, Unknown
  misc_feature (1)..( 6): Result.004 file - promoters60/5664022
caaaac

SEQ ID NO: 147459 - DNA, 6 bp, Unknown
  misc_feature (1)..( 6): Result.004 file - promoters60/5664022
ttcaaa

SEQ ID NO: 147460 - DNA, 6 bp, Unknown
  misc_feature (1)..( 6): Result.004 file - promoters60/5664022
ttcaaa

SEQ ID NO: 147461 - DNA, 8 bp, Unknown
  misc_feature (1)..( 8): Result.004 file - promoters60/5664022
ttgtgaca

SEQ ID NO: 147462 - DNA, 8 bp, Unknown
  misc_feature (1)..( 8): Result.004 file - promoters60/5664022
ttgtaaca

SEQ ID NO: 147463 - DNA, 6 bp, Unknown
  misc_feature (1)..( 6): Result.004 file - promoters60/5664022
cttttc

SEQ ID NO: 147464 - DNA, 6 bp, Unknown
  misc_feature (1)..( 6): Result.004 file - promoters60/5664022
cttttc

SEQ ID NO: 147465 - DNA, 8 bp, Unknown
  misc_feature (1)..( 8): Result.004 file - promoters60/5664022
aataaaaa

SEQ ID NO: 147466 - DNA, 8 bp, Unknown
  misc_feature (1)..( 8): Result.004 file - promoters60/5664022
aatagaaa

SEQ ID NO: 147467 - DNA, 9 bp, Unknown
  misc_feature (1)..( 9): Result.004 file - promoters60/5664022
acccaaaaa

SEQ ID NO: 147468 - DNA, 9 bp, Unknown
  misc_feature (1)..( 9): Result.004 file - promoters60/5664022
ggccaaaaa

SEQ ID NO: 147469 - DNA, 9 bp, Unknown
  misc_feature (1)..( 9): Result.004 file - promoters60/5664022
acccaaatt

SEQ ID NO: 147470 - DNA, 7 bp, Unknown
  misc_feature (1)..( 7): Result.004 file - promoters60/5664022
ctagcaa

SEQ ID NO: 147471 - DNA, 7 bp, Unknown
  misc_feature (1)..( 7): Result.004 file - promoters60/5664022
ctatcaa

SEQ ID NO: 147472 - DNA, 7 bp, Unknown
  misc_feature (1)..( 7): Result.004 file - promoters60/5664022
taaaccc

SEQ ID NO: 147473 - DNA, 7 bp, Unknown
  misc_feature (1)..( 7): Result.004 file - promoters60/5664022
taatccc

SEQ ID NO: 147474 - DNA, 7 bp, Unknown
  misc_feature (1)..( 7): Result.004 file - promoters60/5664022
atatctt

SEQ ID NO: 147475 - DNA, 7 bp, Unknown
  misc_feature (1)..( 7): Result.004 file - promoters60/5664022
ataactt

SEQ ID NO: 147476 - DNA, 7 bp, Unknown
  misc_feature (1)..( 7): Result.004 file - promoters60/5664022
attggaa

SEQ ID NO: 147477 - DNA, 7 bp, Unknown
  misc_feature (1)..( 7): Result.004 file - promoters60/5664022
atttgaa

SEQ ID NO: 147478 - DNA, 7 bp, Unknown
  misc_feature (1)..( 7): Result.004 file - promoters60/5664022
tactaaa

SEQ ID NO: 147479 - DNA, 7 bp, Unknown
  misc_feature (1)..( 7): Result.004 file - promoters60/5664060
tactaaa

SEQ ID NO: 147480 - DNA, 9 bp, Unknown
  misc_feature (1)..( 9): Result.004 file - promoters60/5664060
tcaaataat

SEQ ID NO: 147481 - DNA, 9 bp, Unknown
  misc_feature (1)..( 9): Result.004 file - promoters60/5664060
gaaaacaat

SEQ ID NO: 147482 - DNA, 9 bp, Unknown
  misc_feature (1)..( 9): Result.004 file - promoters60/5664060
acaaattta

SEQ ID NO: 147483 - DNA, 9 bp, Unknown
  misc_feature (1)..( 9): Result.004 file - promoters60/5664060
attagatta

SEQ ID NO: 147484 - DNA, 9 bp, Unknown
  misc_feature (1)..( 9): Result.004 file - promoters60/5664060
attggatta

SEQ ID NO: 147485 - DNA, 9 bp, Unknown
  misc_feature (1)..( 9): Result.004 file - promoters60/5664060
catagttta

SEQ ID NO: 147486 - DNA, 9 bp, Unknown
  misc_feature (1)..( 9): Result.004 file - promoters60/5664060
atttgtctt

SEQ ID NO: 147487 - DNA, 9 bp, Unknown
  misc_feature (1)..( 9): Result.004 file - promoters60/5664060
atttatcta

SEQ ID NO: 147488 - DNA, 9 bp, Unknown
  misc_feature (1)..( 9): Result.004 file - promoters60/5664060
ttttgttta

SEQ ID NO: 147489 - DNA, 8 bp, Unknown
  misc_feature (1)..( 8): Result.004 file - promoters60/5664060
agatgtca

SEQ ID NO: 147490 - DNA, 8 bp, Unknown
  misc_feature (1)..( 8): Result.004 file - promoters60/5664060
aaatgtca

SEQ ID NO: 147491 - DNA, 8 bp, Unknown
  misc_feature (1)..( 8): Result.004 file - promoters60/5664060
aaatatca

SEQ ID NO: 147492 - DNA, 7 bp, Unknown
  misc_feature (1)..( 7): Result.004 file - promoters60/5664060
tgagaac

SEQ ID NO: 147493 - DNA, 7 bp, Unknown
  misc_feature (1)..( 7): Result.004 file - promoters60/5664060
tgaaaac

SEQ ID NO: 147494 - DNA, 7 bp, Unknown
  misc_feature (1)..( 7): Result.004 file - promoters60/5664072
agaaaac

SEQ ID NO: 147495 - DNA, 6 bp, Unknown
  misc_feature (1)..( 6): Result.004 file - promoters60/5664072
tagaaa

SEQ ID NO: 147496 - DNA, 6 bp, Unknown
  misc_feature (1)..( 6): Result.004 file - promoters60/5664072
tagaaa

SEQ ID NO: 147497 - DNA, 7 bp, Unknown
  misc_feature (1)..( 7): Result.004 file - promoters60/5664072
ataatga

SEQ ID NO: 147498 - DNA, 7 bp, Unknown
  misc_feature (1)..( 7): Result.004 file - promoters60/5664072
atactga

SEQ ID NO: 147499 - DNA, 7 bp, Unknown
  misc_feature (1)..( 7): Result.004 file - promoters60/5664072
taaaaat

SEQ ID NO: 147500 - DNA, 7 bp, Unknown
  misc_feature (1)..( 7): Result.004 file - promoters60/5664072
taacaat

SEQ ID NO: 147501 - DNA, 6 bp, Unknown
  misc_feature (1)..( 6): Result.004 file - promoters60/5664072
aaacag

SEQ ID NO: 147502 - DNA, 6 bp, Unknown
  misc_feature (1)..( 6): Result.004 file - promoters60/5664072
aaacag

SEQ ID NO: 147503 - DNA, 8 bp, Unknown
  misc_feature (1)..( 8): Result.004 file - promoters60/5664072
atcttttt

SEQ ID NO: 147504 - DNA, 8 bp, Unknown
  misc_feature (1)..( 8): Result.004 file - promoters60/5664072
ctctattt

SEQ ID NO: 147505 - DNA, 8 bp, Unknown
  misc_feature (1)..( 8): Result.004 file - promoters60/5664072
ctccattg

SEQ ID NO: 147506 - DNA, 7 bp, Unknown
  misc_feature (1)..( 7): Result.004 file - promoters60/5664072
attcttt

SEQ ID NO: 147507 - DNA, 7 bp, Unknown
  misc_feature (1)..( 7): Result.004 file - promoters60/5664072
attcttt

SEQ ID NO: 147508 - DNA, 10 bp, Unknown
  misc_feature (1)..( 10): Result.004 file - promoters60/5664072
taggatttat

SEQ ID NO: 147509 - DNA, 10 bp, Unknown
  misc_feature (1)..( 10): Result.004 file - promoters60/5664072
tagcatttat

SEQ ID NO: 147510 - DNA, 6 bp, Unknown
  misc_feature (1)..( 6): Result.004 file - promoters60/5664072
aaagaa

SEQ ID NO: 147511 - DNA, 6 bp, Unknown
  misc_feature (1)..( 6): Result.004 file - promoters60/5664072
aaagaa

SEQ ID NO: 147512 - DNA, 7 bp, Unknown
  misc_feature (1)..( 7): Result.004 file - promoters60/5664072
tagagaa

SEQ ID NO: 147513 - DNA, 7 bp, Unknown
  misc_feature (1)..( 7): Result.004 file - promoters60/5664072
tagagaa

SEQ ID NO: 147514 - DNA, 7 bp, Unknown
  misc_feature (1)..( 7): Result.004 file - promoters60/5664072
aaggaga

SEQ ID NO: 147515 - DNA, 7 bp, Unknown
  misc_feature (1)..( 7): Result.004 file - promoters60/5664072
aagtaga

SEQ ID NO: 147516 - DNA, 7 bp, Unknown
  misc_feature (1)..( 7): Result.004 file - promoters60/5664072
aaagaag

SEQ ID NO: 147517 - DNA, 7 bp, Unknown
  misc_feature (1)..( 7): Result.004 file - promoters60/5664072
aaagaag

SEQ ID NO: 147518 - DNA, 6 bp, Unknown
  misc_feature (1)..( 6): Result.004 file - promoters60/5664072
caaaag

SEQ ID NO: 147519 - DNA, 6 bp, Unknown
  misc_feature (1)..( 6): Result.004 file - promoters60/5664072
caaaag

SEQ ID NO: 147520 - DNA, 6 bp, Unknown
  misc_feature (1)..( 6): Result.004 file - promoters60/5664072
caacac

SEQ ID NO: 147521 - DNA, 6 bp, Unknown
  misc_feature (1)..( 6): Result.004 file - promoters60/5664072
caacac

SEQ ID NO: 147522 - DNA, 6 bp, Unknown
  misc_feature (1)..( 6): Result.004 file - promoters60/5664072
ttgaag

SEQ ID NO: 147523 - DNA, 6 bp, Unknown
  misc_feature (1)..( 6): Result.004 file - promoters60/5664080
ttgaag

SEQ ID NO: 147524 - DNA, 12 bp, Unknown
  misc_feature (1)..( 12): Result.004 file - promoters60/5664080
attgtctcgtag

SEQ ID NO: 147525 - DNA, 12 bp, Unknown
  misc_feature (1)..( 12): Result.004 file - promoters60/5664080
attgtctcgagc

SEQ ID NO: 147526 - DNA, 12 bp, Unknown
  misc_feature (1)..( 12): Result.004 file - promoters60/5664080
ttcttctcttag

SEQ ID NO: 147527 - DNA, 8 bp, Unknown
  misc_feature (1)..( 8): Result.004 file - promoters60/5664080
acttaaaa

SEQ ID NO: 147528 - DNA, 8 bp, Unknown
  misc_feature (1)..( 8): Result.004 file - promoters60/5664080
acttgaaa

SEQ ID NO: 147529 - DNA, 8 bp, Unknown
  misc_feature (1)..( 8): Result.004 file - promoters60/5664080
aaatttac

SEQ ID NO: 147530 - DNA, 8 bp, Unknown
  misc_feature (1)..( 8): Result.004 file - promoters60/5664080
caatttac

SEQ ID NO: 147531 - DNA, 8 bp, Unknown
  misc_feature (1)..( 8): Result.004 file - promoters60/5664080
caaattaa

SEQ ID NO: 147532 - DNA, 7 bp, Unknown
  misc_feature (1)..( 7): Result.004 file - promoters60/5664080
tgaagaa

SEQ ID NO: 147533 - DNA, 7 bp, Unknown
  misc_feature (1)..( 7): Result.004 file - promoters60/5664080
tgatgaa

SEQ ID NO: 147534 - DNA, 8 bp, Unknown
  misc_feature (1)..( 8): Result.004 file - promoters60/5664080
gaaacttt

SEQ ID NO: 147535 - DNA, 8 bp, Unknown
  misc_feature (1)..( 8): Result.004 file - promoters60/5664080
gaatcttt

SEQ ID NO: 147536 - DNA, 12 bp, Unknown
  misc_feature (1)..( 12): Result.004 file - promoters60/5664080
ttttcagcatgc

SEQ ID NO: 147537 - DNA, 12 bp, Unknown
  misc_feature (1)..( 12): Result.004 file - promoters60/5664080
tttacagtatgc

SEQ ID NO: 147538 - DNA, 6 bp, Unknown
  misc_feature (1)..( 6): Result.004 file - promoters60/5664080
tgcttc

SEQ ID NO: 147539 - DNA, 6 bp, Unknown
  misc_feature (1)..( 6): Result.004 file - promoters60/5664080
tgcttc

SEQ ID NO: 147540 - DNA, 6 bp, Unknown
  misc_feature (1)..( 6): Result.004 file - promoters60/5664080
tcagtt

SEQ ID NO: 147541 - DNA, 6 bp, Unknown
  misc_feature (1)..( 6): Result.004 file - promoters60/5664080
tcagtt

SEQ ID NO: 147542 - DNA, 10 bp, Unknown
  misc_feature (1)..( 10): Result.004 file - promoters60/5664080
aaagtgtgtg

SEQ ID NO: 147543 - DNA, 10 bp, Unknown
  misc_feature (1)..( 10): Result.004 file - promoters60/5664080
aaagtgagtg

SEQ ID NO: 147544 - DNA, 10 bp, Unknown
  misc_feature (1)..( 10): Result.004 file - promoters60/5664080
aggataaagt

SEQ ID NO: 147545 - DNA, 10 bp, Unknown
  misc_feature (1)..( 10): Result.004 file - promoters60/5664080
agggtaaagt

SEQ ID NO: 147546 - DNA, 7 bp, Unknown
  misc_feature (1)..( 7): Result.004 file - promoters60/5664080
gaatggt

SEQ ID NO: 147547 - DNA, 7 bp, Unknown
  misc_feature (1)..( 7): Result.004 file - promoters60/5664080
gaatggt

SEQ ID NO: 147548 - DNA, 7 bp, Unknown
  misc_feature (1)..( 7): Result.004 file - promoters60/5664080
gaaaccc

SEQ ID NO: 147549 - DNA, 7 bp, Unknown
  misc_feature (1)..( 7): Result.004 file - promoters60/5664084
gaaaccc

SEQ ID NO: 147550 - DNA, 12 bp, Unknown
  misc_feature (1)..( 12): Result.004 file - promoters60/5664084
gaaaagcaaaac

SEQ ID NO: 147551 - DNA, 12 bp, Unknown
  misc_feature (1)..( 12): Result.004 file - promoters60/5664084
gaagagcaaaac

SEQ ID NO: 147552 - DNA, 8 bp, Unknown
  misc_feature (1)..( 8): Result.004 file - promoters60/5664084
aaagttaa

SEQ ID NO: 147553 - DNA, 8 bp, Unknown
  misc_feature (1)..( 8): Result.004 file - promoters60/5664084
aaaattaa

SEQ ID NO: 147554 - DNA, 8 bp, Unknown
  misc_feature (1)..( 8): Result.004 file - promoters60/5664084
taagttaa

SEQ ID NO: 147555 - DNA, 9 bp, Unknown
  misc_feature (1)..( 9): Result.004 file - promoters60/5664084
ttaaatttt

SEQ ID NO: 147556 - DNA, 9 bp, Unknown
  misc_feature (1)..( 9): Result.004 file - promoters60/5664084
ttaattttt

SEQ ID NO: 147557 - DNA, 7 bp, Unknown
  misc_feature (1)..( 7): Result.004 file - promoters60/5664084
cttcttg

SEQ ID NO: 147558 - DNA, 7 bp, Unknown
  misc_feature (1)..( 7): Result.004 file - promoters60/5664084
cttattg

SEQ ID NO: 147559 - DNA, 7 bp, Unknown
  misc_feature (1)..( 7): Result.004 file - promoters60/5664084
aaaaatc

SEQ ID NO: 147560 - DNA, 7 bp, Unknown
  misc_feature (1)..( 7): Result.004 file - promoters60/5664084
aaatatc

SEQ ID NO: 147561 - DNA, 6 bp, Unknown
  misc_feature (1)..( 6): Result.004 file - promoters60/5664084
aacaca

SEQ ID NO: 147562 - DNA, 6 bp, Unknown
  misc_feature (1)..( 6): Result.004 file - promoters60/5664084
aacaca

SEQ ID NO: 147563 - DNA, 10 bp, Unknown
  misc_feature (1)..( 10): Result.004 file - promoters60/5664084
agaaaccgaa

SEQ ID NO: 147564 - DNA, 10 bp, Unknown
  misc_feature (1)..( 10): Result.004 file - promoters60/5664084
agaaaacgaa

SEQ ID NO: 147565 - DNA, 6 bp, Unknown
  misc_feature (1)..( 6): Result.004 file - promoters60/5664084
ccaacc

SEQ ID NO: 147566 - DNA, 6 bp, Unknown
  misc_feature (1)..( 6): Result.004 file - promoters60/5664084
ccaacc

SEQ ID NO: 147567 - DNA, 7 bp, Unknown
  misc_feature (1)..( 7): Result.004 file - promoters60/5664084
aaatatt

SEQ ID NO: 147568 - DNA, 7 bp, Unknown
  misc_feature (1)..( 7): Result.004 file - promoters60/5664084
aaaaatt

SEQ ID NO: 147569 - DNA, 6 bp, Unknown
  misc_feature (1)..( 6): Result.004 file - promoters60/5664084
atataa

SEQ ID NO: 147570 - DNA, 6 bp, Unknown
  misc_feature (1)..( 6): Result.004 file - promoters60/5664084
atataa

SEQ ID NO: 147571 - DNA, 7 bp, Unknown
  misc_feature (1)..( 7): Result.004 file - promoters60/5664084
ccagaaa

SEQ ID NO: 147572 - DNA, 7 bp, Unknown
  misc_feature (1)..( 7): Result.004 file - promoters60/5664084
ccataaa

SEQ ID NO: 147573 - DNA, 7 bp, Unknown
  misc_feature (1)..( 7): Result.004 file - promoters60/5664084
tcgcttt

SEQ ID NO: 147574 - DNA, 7 bp, Unknown
  misc_feature (1)..( 7): Result.004 file - promoters60/5664084
tcgattt

SEQ ID NO: 147575 - DNA, 7 bp, Unknown
  misc_feature (1)..( 7): Result.004 file - promoters60/5664084
attataa

SEQ ID NO: 147576 - DNA, 7 bp, Unknown
  misc_feature (1)..( 7): Result.004 file - promoters60/5664126
attttaa

SEQ ID NO: 147577 - DNA, 8 bp, Unknown
  misc_feature (1)..( 8): Result.004 file - promoters60/5664126
attataca

SEQ ID NO: 147578 - DNA, 8 bp, Unknown
  misc_feature (1)..( 8): Result.004 file - promoters60/5664126
aatataca

SEQ ID NO: 147579 - DNA, 8 bp, Unknown
  misc_feature (1)..( 8): Result.004 file - promoters60/5664126
attctacc

SEQ ID NO: 147580 - DNA, 8 bp, Unknown
  misc_feature (1)..( 8): Result.004 file - promoters60/5664126
aaatatat

SEQ ID NO: 147581 - DNA, 8 bp, Unknown
  misc_feature (1)..( 8): Result.004 file - promoters60/5664126
aaatatat

SEQ ID NO: 147582 - DNA, 7 bp, Unknown
  misc_feature (1)..( 7): Result.004 file - promoters60/5664126
aacgtaa

SEQ ID NO: 147583 - DNA, 7 bp, Unknown
  misc_feature (1)..( 7): Result.004 file - promoters60/5664126
aacttaa

SEQ ID NO: 147584 - DNA, 7 bp, Unknown
  misc_feature (1)..( 7): Result.004 file - promoters60/5664126
atttgaa

SEQ ID NO: 147585 - DNA, 7 bp, Unknown
  misc_feature (1)..( 7): Result.004 file - promoters60/5664126
attggaa

SEQ ID NO: 147586 - DNA, 6 bp, Unknown
  misc_feature (1)..( 6): Result.004 file - promoters60/5664126
attttt

SEQ ID NO: 147587 - DNA, 6 bp, Unknown
  misc_feature (1)..( 6): Result.004 file - promoters60/5664126
attttt

SEQ ID NO: 147588 - DNA, 8 bp, Unknown
  misc_feature (1)..( 8): Result.004 file - promoters60/5664126
acagacac

SEQ ID NO: 147589 - DNA, 8 bp, Unknown
  misc_feature (1)..( 8): Result.004 file - promoters60/5664126
acacacac

SEQ ID NO: 147590 - DNA, 6 bp, Unknown
  misc_feature (1)..( 6): Result.004 file - promoters60/5664126
tcaaaa

SEQ ID NO: 147591 - DNA, 6 bp, Unknown
  misc_feature (1)..( 6): Result.004 file - promoters60/5664126
tcaaaa

SEQ ID NO: 147592 - DNA, 6 bp, Unknown
  misc_feature (1)..( 6): Result.004 file - promoters60/5664126
acataa

SEQ ID NO: 147593 - DNA, 6 bp, Unknown
  misc_feature (1)..( 6): Result.004 file - promoters60/5664126
acataa

SEQ ID NO: 147594 - DNA, 6 bp, Unknown
  misc_feature (1)..( 6): Result.004 file - promoters60/5664126
aattga

SEQ ID NO: 147595 - DNA, 6 bp, Unknown
  misc_feature (1)..( 6): Result.004 file - promoters60/5664126
aattga

SEQ ID NO: 147596 - DNA, 9 bp, Unknown
  misc_feature (1)..( 9): Result.004 file - promoters60/5664126
aacaaaaat

SEQ ID NO: 147597 - DNA, 9 bp, Unknown
  misc_feature (1)..( 9): Result.004 file - promoters60/5664126
aaccaaaat

SEQ ID NO: 147598 - DNA, 9 bp, Unknown
  misc_feature (1)..( 9): Result.004 file - promoters60/5664126
aaacccttt

SEQ ID NO: 147599 - DNA, 9 bp, Unknown
  misc_feature (1)..( 9): Result.004 file - promoters60/5664126
aaacccttt

SEQ ID NO: 147600 - DNA, 6 bp, Unknown
  misc_feature (1)..( 6): Result.004 file - promoters60/5664126
gaaaat

SEQ ID NO: 147601 - DNA, 6 bp, Unknown
  misc_feature (1)..( 6): Result.004 file - promoters60/5664126
gaaaat

SEQ ID NO: 147602 - DNA, 7 bp, Unknown
  misc_feature (1)..( 7): Result.004 file - promoters60/5664126
ttttttc

SEQ ID NO: 147603 - DNA, 7 bp, Unknown
  misc_feature (1)..( 7): Result.004 file - promoters60/5664126
tttgttc

SEQ ID NO: 147604 - DNA, 8 bp, Unknown
  misc_feature (1)..( 8): Result.004 file - promoters60/5664126
tttaggtc

SEQ ID NO: 147605 - DNA, 8 bp, Unknown
  misc_feature (1)..( 8): Result.004 file - promoters60/5664126
tttatgtc

SEQ ID NO: 147606 - DNA, 7 bp, Unknown
  misc_feature (1)..( 7): Result.004 file - promoters60/5664126
agataat

SEQ ID NO: 147607 - DNA, 7 bp, Unknown
  misc_feature (1)..( 7): Result.004 file - promoters60/5664126
agaaaat

SEQ ID NO: 147608 - DNA, 14 bp, Unknown
  misc_feature (1)..( 14): Result.004 file - promoters60/5664126
ggagtcagaaaaat

SEQ ID NO: 147609 - DNA, 14 bp, Unknown
  misc_feature (1)..( 14): Result.004 file - promoters60/5664126
taattcagaaaaat

SEQ ID NO: 147610 - DNA, 14 bp, Unknown
  misc_feature (1)..( 14): Result.004 file - promoters60/5664126
taattgagaatccg

SEQ ID NO: 147611 - DNA, 6 bp, Unknown
  misc_feature (1)..( 6): Result.004 file - promoters60/5664126
aatata

SEQ ID NO: 147612 - DNA, 6 bp, Unknown
  misc_feature (1)..( 6): Result.004 file - promoters60/5664126
aatata

SEQ ID NO: 147613 - DNA, 6 bp, Unknown
  misc_feature (1)..( 6): Result.004 file - promoters60/5664126
aaaatt

SEQ ID NO: 147614 - DNA, 6 bp, Unknown
  misc_feature (1)..( 6): Result.004 file - promoters60/5664126
aaaatt

SEQ ID NO: 147615 - DNA, 7 bp, Unknown
  misc_feature (1)..( 7): Result.004 file - promoters60/5664126
aactgaa

SEQ ID NO: 147616 - DNA, 7 bp, Unknown
  misc_feature (1)..( 7): Result.004 file - promoters60/5664126
aacagaa

SEQ ID NO: 147617 - DNA, 6 bp, Unknown
  misc_feature (1)..( 6): Result.004 file - promoters60/5664126
tgtaat

SEQ ID NO: 147618 - DNA, 6 bp, Unknown
  misc_feature (1)..( 6): Result.004 file - promoters60/5664126
tgtaat

SEQ ID NO: 147619 - DNA, 7 bp, Unknown
  misc_feature (1)..( 7): Result.004 file - promoters60/5664126
tttattt

SEQ ID NO: 147620 - DNA, 7 bp, Unknown
  misc_feature (1)..( 7): Result.004 file - promoters60/5664126
tttattt

SEQ ID NO: 147621 - DNA, 12 bp, Unknown
  misc_feature (1)..( 12): Result.004 file - promoters60/5664126
aaaagaaaaaac

SEQ ID NO: 147622 - DNA, 12 bp, Unknown
  misc_feature (1)..( 12): Result.004 file - promoters60/5664126
aaatgaaaaaac

SEQ ID NO: 147623 - DNA, 8 bp, Unknown
  misc_feature (1)..( 8): Result.004 file - promoters60/5664126
aatgttct

SEQ ID NO: 147624 - DNA, 8 bp, Unknown
  misc_feature (1)..( 8): Result.004 file - promoters60/5664126
aatgttct

SEQ ID NO: 147625 - DNA, 8 bp, Unknown
  misc_feature (1)..( 8): Result.004 file - promoters60/5664126
taatttgt

SEQ ID NO: 147626 - DNA, 8 bp, Unknown
  misc_feature (1)..( 8): Result.004 file - promoters60/5664126
taatttgt

SEQ ID NO: 147627 - DNA, 6 bp, Unknown
  misc_feature (1)..( 6): Result.004 file - promoters60/5664126
atgggc

SEQ ID NO: 147628 - DNA, 6 bp, Unknown
  misc_feature (1)..( 6): Result.004 file - promoters60/5664126
atgggc

SEQ ID NO: 147629 - DNA, 6 bp, Unknown
  misc_feature (1)..( 6): Result.004 file - promoters60/5664126
ggccca

SEQ ID NO: 147630 - DNA, 6 bp, Unknown
  misc_feature (1)..( 6): Result.004 file - promoters60/5664133
ggccca

SEQ ID NO: 147631 - DNA, 7 bp, Unknown
  misc_feature (1)..( 7): Result.004 file - promoters60/5664133
tcacaag

SEQ ID NO: 147632 - DNA, 7 bp, Unknown
  misc_feature (1)..( 7): Result.004 file - promoters60/5664133
tcacaaa

SEQ ID NO: 147633 - DNA, 7 bp, Unknown
  misc_feature (1)..( 7): Result.004 file - promoters60/5664133
ccacaaa

SEQ ID NO: 147634 - DNA, 9 bp, Unknown
  misc_feature (1)..( 9): Result.004 file - promoters60/5664133
aattaaaaa

SEQ ID NO: 147635 - DNA, 9 bp, Unknown
  misc_feature (1)..( 9): Result.004 file - promoters60/5664133
aattaagtt

SEQ ID NO: 147636 - DNA, 9 bp, Unknown
  misc_feature (1)..( 9): Result.004 file - promoters60/5664133
cattaagtt

SEQ ID NO: 147637 - DNA, 8 bp, Unknown
  misc_feature (1)..( 8): Result.004 file - promoters60/5664133
aacaaaac

SEQ ID NO: 147638 - DNA, 8 bp, Unknown
  misc_feature (1)..( 8): Result.004 file - promoters60/5664133
cacaaaac

SEQ ID NO: 147639 - DNA, 8 bp, Unknown
  misc_feature (1)..( 8): Result.004 file - promoters60/5664133
cacaaaca

SEQ ID NO: 147640 - DNA, 8 bp, Unknown
  misc_feature (1)..( 8): Result.004 file - promoters60/5664133
gaaaaaaa

SEQ ID NO: 147641 - DNA, 8 bp, Unknown
  misc_feature (1)..( 8): Result.004 file - promoters60/5664133
caaacaaa

SEQ ID NO: 147642 - DNA, 8 bp, Unknown
  misc_feature (1)..( 8): Result.004 file - promoters60/5664133
caaacata

SEQ ID NO: 147643 - DNA, 8 bp, Unknown
  misc_feature (1)..( 8): Result.004 file - promoters60/5664133
caaacata

SEQ ID NO: 147644 - DNA, 8 bp, Unknown
  misc_feature (1)..( 8): Result.004 file - promoters60/5664133
aaaacata

SEQ ID NO: 147645 - DNA, 8 bp, Unknown
  misc_feature (1)..( 8): Result.004 file - promoters60/5664133
caaacaaa

SEQ ID NO: 147646 - DNA, 9 bp, Unknown
  misc_feature (1)..( 9): Result.004 file - promoters60/5664133
taacaaaaa

SEQ ID NO: 147647 - DNA, 9 bp, Unknown
  misc_feature (1)..( 9): Result.004 file - promoters60/5664133
tcacaaaac

SEQ ID NO: 147648 - DNA, 9 bp, Unknown
  misc_feature (1)..( 9): Result.004 file - promoters60/5664133
tcacagaac

SEQ ID NO: 147649 - DNA, 9 bp, Unknown
  misc_feature (1)..( 9): Result.004 file - promoters60/5664133
ataaaaatg

SEQ ID NO: 147650 - DNA, 9 bp, Unknown
  misc_feature (1)..( 9): Result.004 file - promoters60/5664133
ataaacatg

SEQ ID NO: 147651 - DNA, 9 bp, Unknown
  misc_feature (1)..( 9): Result.004 file - promoters60/5664141
gtaaacaca

SEQ ID NO: 147652 - DNA, 11 bp, Unknown
  misc_feature (1)..( 11): Result.004 file - promoters60/5664141
ataaaaacact

SEQ ID NO: 147653 - DNA, 11 bp, Unknown
  misc_feature (1)..( 11): Result.004 file - promoters60/5664141
ctaaaaagaaa

SEQ ID NO: 147654 - DNA, 11 bp, Unknown
  misc_feature (1)..( 11): Result.004 file - promoters60/5664141
atataaatata

SEQ ID NO: 147655 - DNA, 11 bp, Unknown
  misc_feature (1)..( 11): Result.004 file - promoters60/5664141
ttaaaaatata

SEQ ID NO: 147656 - DNA, 11 bp, Unknown
  misc_feature (1)..( 11): Result.004 file - promoters60/5664141
ctataaacaaa

SEQ ID NO: 147657 - DNA, 10 bp, Unknown
  misc_feature (1)..( 10): Result.004 file - promoters60/5664141
tatttgtttt

SEQ ID NO: 147658 - DNA, 10 bp, Unknown
  misc_feature (1)..( 10): Result.004 file - promoters60/5664141
gatttgtttg

SEQ ID NO: 147659 - DNA, 10 bp, Unknown
  misc_feature (1)..( 10): Result.004 file - promoters60/5664141
gatttttttt

SEQ ID NO: 147660 - DNA, 10 bp, Unknown
  misc_feature (1)..( 10): Result.004 file - promoters60/5664141
gatttgagtt

SEQ ID NO: 147661 - DNA, 10 bp, Unknown
  misc_feature (1)..( 10): Result.004 file - promoters60/5664141
tattatttac

SEQ ID NO: 147662 - DNA, 11 bp, Unknown
  misc_feature (1)..( 11): Result.004 file - promoters60/5664141
aacgattaaat

SEQ ID NO: 147663 - DNA, 11 bp, Unknown
  misc_feature (1)..( 11): Result.004 file - promoters60/5664141
tctgataaaaa

SEQ ID NO: 147664 - DNA, 11 bp, Unknown
  misc_feature (1)..( 11): Result.004 file - promoters60/5664141
aacaattatgt

SEQ ID NO: 147665 - DNA, 11 bp, Unknown
  misc_feature (1)..( 11): Result.004 file - promoters60/5664141
tggaataaaaa

SEQ ID NO: 147666 - DNA, 11 bp, Unknown
  misc_feature (1)..( 11): Result.004 file - promoters60/5664141
gctcttaaaaa

SEQ ID NO: 147667 - DNA, 12 bp, Unknown
  misc_feature (1)..( 12): Result.004 file - promoters60/5664141
tagaattttctg

SEQ ID NO: 147668 - DNA, 12 bp, Unknown
  misc_feature (1)..( 12): Result.004 file - promoters60/5664141
atgaatttaaaa

SEQ ID NO: 147669 - DNA, 12 bp, Unknown
  misc_feature (1)..( 12): Result.004 file - promoters60/5664141
ttgagtttttat

SEQ ID NO: 147670 - DNA, 12 bp, Unknown
  misc_feature (1)..( 12): Result.004 file - promoters60/5664141
atgaaattatta

SEQ ID NO: 147671 - DNA, 12 bp, Unknown
  misc_feature (1)..( 12): Result.004 file - promoters60/5664141
taatttttaagt

SEQ ID NO: 147672 - DNA, 13 bp, Unknown
  misc_feature (1)..( 13): Result.004 file - promoters60/5664141
atgtataaaaaca

SEQ ID NO: 147673 - DNA, 13 bp, Unknown
  misc_feature (1)..( 13): Result.004 file - promoters60/5664141
cactataaacaaa

SEQ ID NO: 147674 - DNA, 13 bp, Unknown
  misc_feature (1)..( 13): Result.004 file - promoters60/5664141
tcatataaatata

SEQ ID NO: 147675 - DNA, 13 bp, Unknown
  misc_feature (1)..( 13): Result.004 file - promoters60/5664141
atgtttaattaaa

SEQ ID NO: 147676 - DNA, 13 bp, Unknown
  misc_feature (1)..( 13): Result.004 file - promoters60/5664153
ttctaaaaagaaa

SEQ ID NO: 147677 - DNA, 11 bp, Unknown
  misc_feature (1)..( 11): Result.004 file - promoters60/5664153
aagttatataa

SEQ ID NO: 147678 - DNA, 11 bp, Unknown
  misc_feature (1)..( 11): Result.004 file - promoters60/5664153
aagttatataa

SEQ ID NO: 147679 - DNA, 12 bp, Unknown
  misc_feature (1)..( 12): Result.004 file - promoters60/5664153
tttttatgatct

SEQ ID NO: 147680 - DNA, 7 bp, Unknown
  misc_feature (1)..( 7): Result.004 file - promoters60/5664153
tttaaaa

SEQ ID NO: 147681 - DNA, 7 bp, Unknown
  misc_feature (1)..( 7): Result.004 file - promoters60/5664153
tttcaaa

SEQ ID NO: 147682 - DNA, 7 bp, Unknown
  misc_feature (1)..( 7): Result.004 file - promoters60/5664153
tttcaaa

SEQ ID NO: 147683 - DNA, 6 bp, Unknown
  misc_feature (1)..( 6): Result.004 file - promoters60/5664153
ttagtt

SEQ ID NO: 147684 - DNA, 6 bp, Unknown
  misc_feature (1)..( 6): Result.004 file - promoters60/5664153
ttagtt

SEQ ID NO: 147685 - DNA, 10 bp, Unknown
  misc_feature (1)..( 10): Result.004 file - promoters60/5664153
gaactaaagt

SEQ ID NO: 147686 - DNA, 10 bp, Unknown
  misc_feature (1)..( 10): Result.004 file - promoters60/5664153
gaaccaaagt

SEQ ID NO: 147687 - DNA, 7 bp, Unknown
  misc_feature (1)..( 7): Result.004 file - promoters60/5664153
aacacac

SEQ ID NO: 147688 - DNA, 7 bp, Unknown
  misc_feature (1)..( 7): Result.004 file - promoters60/5664153
aacacac

SEQ ID NO: 147689 - DNA, 6 bp, Unknown
  misc_feature (1)..( 6): Result.004 file - promoters60/5664153
aacatt

SEQ ID NO: 147690 - DNA, 6 bp, Unknown
  misc_feature (1)..( 6): Result.004 file - promoters60/5664153
aacatt

SEQ ID NO: 147691 - DNA, 8 bp, Unknown
  misc_feature (1)..( 8): Result.004 file - promoters60/5664153
gtgagttc

SEQ ID NO: 147692 - DNA, 8 bp, Unknown
  misc_feature (1)..( 8): Result.004 file - promoters60/5664153
gtgagttc

SEQ ID NO: 147693 - DNA, 7 bp, Unknown
  misc_feature (1)..( 7): Result.004 file - promoters60/5664153
ttaattt

SEQ ID NO: 147694 - DNA, 7 bp, Unknown
  misc_feature (1)..( 7): Result.004 file - promoters60/5664153
ttagttt

SEQ ID NO: 147695 - DNA, 7 bp, Unknown
  misc_feature (1)..( 7): Result.004 file - promoters60/5664153
tgactct

SEQ ID NO: 147696 - DNA, 7 bp, Unknown
  misc_feature (1)..( 7): Result.004 file - promoters60/5664153
tgattct

SEQ ID NO: 147697 - DNA, 8 bp, Unknown
  misc_feature (1)..( 8): Result.004 file - promoters60/5664153
ataccaaa

SEQ ID NO: 147698 - DNA, 8 bp, Unknown
  misc_feature (1)..( 8): Result.004 file - promoters60/5664153
gtactaaa

SEQ ID NO: 147699 - DNA, 8 bp, Unknown
  misc_feature (1)..( 8): Result.004 file - promoters60/5664153
gtaataac

SEQ ID NO: 147700 - DNA, 7 bp, Unknown
  misc_feature (1)..( 7): Result.004 file - promoters60/5664153
ttcgtat

SEQ ID NO: 147701 - DNA, 7 bp, Unknown
  misc_feature (1)..( 7): Result.004 file - promoters60/5664153
ttcgtat

SEQ ID NO: 147702 - DNA, 6 bp, Unknown
  misc_feature (1)..( 6): Result.004 file - promoters60/5664153
cagaag

SEQ ID NO: 147703 - DNA, 6 bp, Unknown
  misc_feature (1)..( 6): Result.004 file - promoters60/5664153
cagaag

SEQ ID NO: 147704 - DNA, 7 bp, Unknown
  misc_feature (1)..( 7): Result.004 file - promoters60/5664153
aagtaat

SEQ ID NO: 147705 - DNA, 7 bp, Unknown
  misc_feature (1)..( 7): Result.004 file - promoters60/5664153
aagaaat

SEQ ID NO: 147706 - DNA, 7 bp, Unknown
  misc_feature (1)..( 7): Result.004 file - promoters60/5664153
ccaaaaa

SEQ ID NO: 147707 - DNA, 7 bp, Unknown
  misc_feature (1)..( 7): Result.004 file - promoters60/5664170
ccaaaaa

SEQ ID NO: 147708 - DNA, 7 bp, Unknown
  misc_feature (1)..( 7): Result.004 file - promoters60/5664170
cataatt

SEQ ID NO: 147709 - DNA, 7 bp, Unknown
  misc_feature (1)..( 7): Result.004 file - promoters60/5664170
cataatc

SEQ ID NO: 147710 - DNA, 7 bp, Unknown
  misc_feature (1)..( 7): Result.004 file - promoters60/5664170
cataatt

SEQ ID NO: 147711 - DNA, 7 bp, Unknown
  misc_feature (1)..( 7): Result.004 file - promoters60/5664170
atttttg

SEQ ID NO: 147712 - DNA, 7 bp, Unknown
  misc_feature (1)..( 7): Result.004 file - promoters60/5664170
gtttttg

SEQ ID NO: 147713 - DNA, 7 bp, Unknown
  misc_feature (1)..( 7): Result.004 file - promoters60/5664182
attttta

SEQ ID NO: 147714 - DNA, 11 bp, Unknown
  misc_feature (1)..( 11): Result.004 file - promoters60/5664182
cctcttcaaag

SEQ ID NO: 147715 - DNA, 11 bp, Unknown
  misc_feature (1)..( 11): Result.004 file - promoters60/5664182
catcttcagat

SEQ ID NO: 147716 - DNA, 11 bp, Unknown
  misc_feature (1)..( 11): Result.004 file - promoters60/5664182
cattttctcca

SEQ ID NO: 147717 - DNA, 11 bp, Unknown
  misc_feature (1)..( 11): Result.004 file - promoters60/5664182
cattttccaat

SEQ ID NO: 147718 - DNA, 11 bp, Unknown
  misc_feature (1)..( 11): Result.004 file - promoters60/5664182
ttttttcttga

SEQ ID NO: 147719 - DNA, 11 bp, Unknown
  misc_feature (1)..( 11): Result.004 file - promoters60/5664182
aatttttactt

SEQ ID NO: 147720 - DNA, 11 bp, Unknown
  misc_feature (1)..( 11): Result.004 file - promoters60/5664182
cattttttcct

SEQ ID NO: 147721 - DNA, 16 bp, Unknown
  misc_feature (1)..( 16): Result.004 file - promoters60/5664182
tggttctttttgtgtg

SEQ ID NO: 147722 - DNA, 16 bp, Unknown
  misc_feature (1)..( 16): Result.004 file - promoters60/5664182
ttgggctttttaagcc

SEQ ID NO: 147723 - DNA, 16 bp, Unknown
  misc_feature (1)..( 16): Result.004 file - promoters60/5664182
ttcatctctttattat

SEQ ID NO: 147724 - DNA, 16 bp, Unknown
  misc_feature (1)..( 16): Result.004 file - promoters60/5664182
ttgggcttcttatatc

SEQ ID NO: 147725 - DNA, 16 bp, Unknown
  misc_feature (1)..( 16): Result.004 file - promoters60/5664182
tattaaagtttgggcc

SEQ ID NO: 147726 - DNA, 16 bp, Unknown
  misc_feature (1)..( 16): Result.004 file - promoters60/5664216
cttaagtaaatgggcc

SEQ ID NO: 147727 - DNA, 8 bp, Unknown
  misc_feature (1)..( 8): Result.004 file - promoters60/5664216
taaaacca

SEQ ID NO: 147728 - DNA, 8 bp, Unknown
  misc_feature (1)..( 8): Result.004 file - promoters60/5664216
taaaacag

SEQ ID NO: 147729 - DNA, 8 bp, Unknown
  misc_feature (1)..( 8): Result.004 file - promoters60/5664216
taaagcca

SEQ ID NO: 147730 - DNA, 8 bp, Unknown
  misc_feature (1)..( 8): Result.004 file - promoters60/5664216
taacacat

SEQ ID NO: 147731 - DNA, 8 bp, Unknown
  misc_feature (1)..( 8): Result.004 file - promoters60/5664216
gttaaata

SEQ ID NO: 147732 - DNA, 8 bp, Unknown
  misc_feature (1)..( 8): Result.004 file - promoters60/5664216
tataaata

SEQ ID NO: 147733 - DNA, 8 bp, Unknown
  misc_feature (1)..( 8): Result.004 file - promoters60/5664216
tataaata

SEQ ID NO: 147734 - DNA, 8 bp, Unknown
  misc_feature (1)..( 8): Result.004 file - promoters60/5664222
tataaatc

SEQ ID NO: 147735 - DNA, 9 bp, Unknown
  misc_feature (1)..( 9): Result.004 file - promoters60/5664222
ttggtcaaa

SEQ ID NO: 147736 - DNA, 9 bp, Unknown
  misc_feature (1)..( 9): Result.004 file - promoters60/5664222
ttgttcaaa

SEQ ID NO: 147737 - DNA, 7 bp, Unknown
  misc_feature (1)..( 7): Result.004 file - promoters60/5664222
aaagcaa

SEQ ID NO: 147738 - DNA, 7 bp, Unknown
  misc_feature (1)..( 7): Result.004 file - promoters60/5664222
aaaccaa

SEQ ID NO: 147739 - DNA, 9 bp, Unknown
  misc_feature (1)..( 9): Result.004 file - promoters60/5664222
agaaccaaa

SEQ ID NO: 147740 - DNA, 9 bp, Unknown
  misc_feature (1)..( 9): Result.004 file - promoters60/5664222
agaaccaaa

SEQ ID NO: 147741 - DNA, 7 bp, Unknown
  misc_feature (1)..( 7): Result.004 file - promoters60/5664222
caaacac

SEQ ID NO: 147742 - DNA, 7 bp, Unknown
  misc_feature (1)..( 7): Result.004 file - promoters60/5664222
caaccac

SEQ ID NO: 147743 - DNA, 6 bp, Unknown
  misc_feature (1)..( 6): Result.004 file - promoters60/5664222
tatcta

SEQ ID NO: 147744 - DNA, 6 bp, Unknown
  misc_feature (1)..( 6): Result.004 file - promoters60/5664222
tatcta

SEQ ID NO: 147745 - DNA, 8 bp, Unknown
  misc_feature (1)..( 8): Result.004 file - promoters60/5664222
gaaactca

SEQ ID NO: 147746 - DNA, 8 bp, Unknown
  misc_feature (1)..( 8): Result.004 file - promoters60/5664222
gaatctca

SEQ ID NO: 147747 - DNA, 9 bp, Unknown
  misc_feature (1)..( 9): Result.004 file - promoters60/5664222
attcatttt

SEQ ID NO: 147748 - DNA, 9 bp, Unknown
  misc_feature (1)..( 9): Result.004 file - promoters60/5664222
attcacttt

SEQ ID NO: 147749 - DNA, 8 bp, Unknown
  misc_feature (1)..( 8): Result.004 file - promoters60/5664222
accggttt

SEQ ID NO: 147750 - DNA, 8 bp, Unknown
  misc_feature (1)..( 8): Result.004 file - promoters60/5664222
acccgttt

SEQ ID NO: 147751 - DNA, 7 bp, Unknown
  misc_feature (1)..( 7): Result.004 file - promoters60/5664222
tcataat

SEQ ID NO: 147752 - DNA, 7 bp, Unknown
  misc_feature (1)..( 7): Result.004 file - promoters60/5664222
tcataat

SEQ ID NO: 147753 - DNA, 6 bp, Unknown
  misc_feature (1)..( 6): Result.004 file - promoters60/5664222
attgtt

SEQ ID NO: 147754 - DNA, 6 bp, Unknown
  misc_feature (1)..( 6): Result.004 file - promoters60/5664263
attgtt

SEQ ID NO: 147755 - DNA, 9 bp, Unknown
  misc_feature (1)..( 9): Result.004 file - promoters60/5664263
ccaataatt

SEQ ID NO: 147756 - DNA, 9 bp, Unknown
  misc_feature (1)..( 9): Result.004 file - promoters60/5664263
ggaatgatt

SEQ ID NO: 147757 - DNA, 9 bp, Unknown
  misc_feature (1)..( 9): Result.004 file - promoters60/5664263
tctatgatt

SEQ ID NO: 147758 - DNA, 9 bp, Unknown
  misc_feature (1)..( 9): Result.004 file - promoters60/5664263
ttaatgata

SEQ ID NO: 147759 - DNA, 9 bp, Unknown
  misc_feature (1)..( 9): Result.004 file - promoters60/5664263
tgtattatt

SEQ ID NO: 147760 - DNA, 9 bp, Unknown
  misc_feature (1)..( 9): Result.004 file - promoters60/5664268
tgtattaca

SEQ ID NO: 147761 - DNA, 7 bp, Unknown
  misc_feature (1)..( 7): Result.004 file - promoters60/5664268
gagacga

SEQ ID NO: 147762 - DNA, 7 bp, Unknown
  misc_feature (1)..( 7): Result.004 file - promoters60/5664268
gaggcga

SEQ ID NO: 147763 - DNA, 7 bp, Unknown
  misc_feature (1)..( 7): Result.004 file - promoters60/5664268
gtaacat

SEQ ID NO: 147764 - DNA, 7 bp, Unknown
  misc_feature (1)..( 7): Result.004 file - promoters60/5664268
gtatcat

SEQ ID NO: 147765 - DNA, 7 bp, Unknown
  misc_feature (1)..( 7): Result.004 file - promoters60/5664268
aactatg

SEQ ID NO: 147766 - DNA, 7 bp, Unknown
  misc_feature (1)..( 7): Result.004 file - promoters60/5664268
aacgatg

SEQ ID NO: 147767 - DNA, 8 bp, Unknown
  misc_feature (1)..( 8): Result.004 file - promoters60/5664268
gtgtgaac

SEQ ID NO: 147768 - DNA, 8 bp, Unknown
  misc_feature (1)..( 8): Result.004 file - promoters60/5664268
gtgttaac

SEQ ID NO: 147769 - DNA, 7 bp, Unknown
  misc_feature (1)..( 7): Result.004 file - promoters60/5664268
ctatatt

SEQ ID NO: 147770 - DNA, 7 bp, Unknown
  misc_feature (1)..( 7): Result.004 file - promoters60/5664268
ctatatt

SEQ ID NO: 147771 - DNA, 9 bp, Unknown
  misc_feature (1)..( 9): Result.004 file - promoters60/5664268
atacaccaa

SEQ ID NO: 147772 - DNA, 9 bp, Unknown
  misc_feature (1)..( 9): Result.004 file - promoters60/5664268
ataaaccaa

SEQ ID NO: 147773 - DNA, 6 bp, Unknown
  misc_feature (1)..( 6): Result.004 file - promoters60/5664268
atttaa

SEQ ID NO: 147774 - DNA, 6 bp, Unknown
  misc_feature (1)..( 6): Result.004 file - promoters60/5664268
atttaa

SEQ ID NO: 147775 - DNA, 6 bp, Unknown
  misc_feature (1)..( 6): Result.004 file - promoters60/5664268
gatttg

SEQ ID NO: 147776 - DNA, 6 bp, Unknown
  misc_feature (1)..( 6): Result.004 file - promoters60/5664268
gatttg

SEQ ID NO: 147777 - DNA, 7 bp, Unknown
  misc_feature (1)..( 7): Result.004 file - promoters60/5664268
caaatcg

SEQ ID NO: 147778 - DNA, 7 bp, Unknown
  misc_feature (1)..( 7): Result.004 file - promoters60/5664268
caattcg

SEQ ID NO: 147779 - DNA, 9 bp, Unknown
  misc_feature (1)..( 9): Result.004 file - promoters60/5664268
gatagcaac

SEQ ID NO: 147780 - DNA, 9 bp, Unknown
  misc_feature (1)..( 9): Result.004 file - promoters60/5664268
gataccaac

SEQ ID NO: 147781 - DNA, 6 bp, Unknown
  misc_feature (1)..( 6): Result.004 file - promoters60/5664268
gaacta

SEQ ID NO: 147782 - DNA, 6 bp, Unknown
  misc_feature (1)..( 6): Result.004 file - promoters60/5664268
gaacta

SEQ ID NO: 147783 - DNA, 7 bp, Unknown
  misc_feature (1)..( 7): Result.004 file - promoters60/5664268
tcataat

SEQ ID NO: 147784 - DNA, 7 bp, Unknown
  misc_feature (1)..( 7): Result.004 file - promoters60/5664268
tcataat

SEQ ID NO: 147785 - DNA, 6 bp, Unknown
  misc_feature (1)..( 6): Result.004 file - promoters60/5664268
attgtt

SEQ ID NO: 147786 - DNA, 6 bp, Unknown
  misc_feature (1)..( 6): Result.004 file - promoters60/5664290
attgtt

SEQ ID NO: 147787 - DNA, 6 bp, Unknown
  misc_feature (1)..( 6): Result.004 file - promoters60/5664290
aatttt

SEQ ID NO: 147788 - DNA, 6 bp, Unknown
  misc_feature (1)..( 6): Result.004 file - promoters60/5664290
aatttt

SEQ ID NO: 147789 - DNA, 6 bp, Unknown
  misc_feature (1)..( 6): Result.004 file - promoters60/5664290
aacgaa

SEQ ID NO: 147790 - DNA, 6 bp, Unknown
  misc_feature (1)..( 6): Result.004 file - promoters60/5664290
aacgaa

SEQ ID NO: 147791 - DNA, 8 bp, Unknown
  misc_feature (1)..( 8): Result.004 file - promoters60/5664290
tatgtttt

SEQ ID NO: 147792 - DNA, 8 bp, Unknown
  misc_feature (1)..( 8): Result.004 file - promoters60/5664290
tatgcttt

SEQ ID NO: 147793 - DNA, 8 bp, Unknown
  misc_feature (1)..( 8): Result.004 file - promoters60/5664290
ttaccaaa

SEQ ID NO: 147794 - DNA, 8 bp, Unknown
  misc_feature (1)..( 8): Result.004 file - promoters60/5664290
ttaccaaa

SEQ ID NO: 147795 - DNA, 7 bp, Unknown
  misc_feature (1)..( 7): Result.004 file - promoters60/5664290
attttca

SEQ ID NO: 147796 - DNA, 7 bp, Unknown
  misc_feature (1)..( 7): Result.004 file - promoters60/5664290
attctca

SEQ ID NO: 147797 - DNA, 8 bp, Unknown
  misc_feature (1)..( 8): Result.004 file - promoters60/5664290
tggaatcc

SEQ ID NO: 147798 - DNA, 8 bp, Unknown
  misc_feature (1)..( 8): Result.004 file - promoters60/5664290
tggtatcc

SEQ ID NO: 147799 - DNA, 7 bp, Unknown
  misc_feature (1)..( 7): Result.004 file - promoters60/5664290
atcatgc

SEQ ID NO: 147800 - DNA, 7 bp, Unknown
  misc_feature (1)..( 7): Result.004 file - promoters60/5664294
atcctgc

SEQ ID NO: 147801 - DNA, 8 bp, Unknown
  misc_feature (1)..( 8): Result.004 file - promoters60/5664294
caaaccga

SEQ ID NO: 147802 - DNA, 8 bp, Unknown
  misc_feature (1)..( 8): Result.004 file - promoters60/5664294
aaaatcga

SEQ ID NO: 147803 - DNA, 8 bp, Unknown
  misc_feature (1)..( 8): Result.004 file - promoters60/5664294
aaaatctg

SEQ ID NO: 147804 - DNA, 8 bp, Unknown
  misc_feature (1)..( 8): Result.004 file - promoters60/5664294
gataaaaa

SEQ ID NO: 147805 - DNA, 8 bp, Unknown
  misc_feature (1)..( 8): Result.004 file - promoters60/5664294
tatataaa

SEQ ID NO: 147806 - DNA, 8 bp, Unknown
  misc_feature (1)..( 8): Result.004 file - promoters60/5664294
gataaatg

SEQ ID NO: 147807 - DNA, 9 bp, Unknown
  misc_feature (1)..( 9): Result.004 file - promoters60/5664294
ctttataat

SEQ ID NO: 147808 - DNA, 9 bp, Unknown
  misc_feature (1)..( 9): Result.004 file - promoters60/5664294
cattaaaat

SEQ ID NO: 147809 - DNA, 10 bp, Unknown
  misc_feature (1)..( 10): Result.004 file - promoters60/5664298
acttcataga

SEQ ID NO: 147810 - DNA, 10 bp, Unknown
  misc_feature (1)..( 10): Result.004 file - promoters60/5664298
cacaaaaata

SEQ ID NO: 147811 - DNA, 10 bp, Unknown
  misc_feature (1)..( 10): Result.004 file - promoters60/5664298
cacaagaatt

SEQ ID NO: 147812 - DNA, 10 bp, Unknown
  misc_feature (1)..( 10): Result.004 file - promoters60/5664298
tataaatata

SEQ ID NO: 147813 - DNA, 10 bp, Unknown
  misc_feature (1)..( 10): Result.004 file - promoters60/5664298
tacaaaaaag

SEQ ID NO: 147814 - DNA, 10 bp, Unknown
  misc_feature (1)..( 10): Result.004 file - promoters60/5664298
tttaagaata

SEQ ID NO: 147815 - DNA, 9 bp, Unknown
  misc_feature (1)..( 9): Result.004 file - promoters60/5664302
ttaagaatg

SEQ ID NO: 147816 - DNA, 7 bp, Unknown
  misc_feature (1)..( 7): Result.004 file - promoters60/5664302
tggttat

SEQ ID NO: 147817 - DNA, 7 bp, Unknown
  misc_feature (1)..( 7): Result.004 file - promoters60/5664302
tggttat

SEQ ID NO: 147818 - DNA, 8 bp, Unknown
  misc_feature (1)..( 8): Result.004 file - promoters60/5664302
caaaagga

SEQ ID NO: 147819 - DNA, 8 bp, Unknown
  misc_feature (1)..( 8): Result.004 file - promoters60/5664302
caaacgga

SEQ ID NO: 147820 - DNA, 10 bp, Unknown
  misc_feature (1)..( 10): Result.004 file - promoters60/5664302
agcaggaaga

SEQ ID NO: 147821 - DNA, 10 bp, Unknown
  misc_feature (1)..( 10): Result.004 file - promoters60/5664302
agcaggaaga

SEQ ID NO: 147822 - DNA, 7 bp, Unknown
  misc_feature (1)..( 7): Result.004 file - promoters60/5664302
tataaat

SEQ ID NO: 147823 - DNA, 7 bp, Unknown
  misc_feature (1)..( 7): Result.004 file - promoters60/5664302
tattaat

SEQ ID NO: 147824 - DNA, 7 bp, Unknown
  misc_feature (1)..( 7): Result.004 file - promoters60/5664302
ttggaaa

SEQ ID NO: 147825 - DNA, 7 bp, Unknown
  misc_feature (1)..( 7): Result.004 file - promoters60/5664302
ttgtaaa

SEQ ID NO: 147826 - DNA, 6 bp, Unknown
  misc_feature (1)..( 6): Result.004 file - promoters60/5664302
aaataa

SEQ ID NO: 147827 - DNA, 6 bp, Unknown
  misc_feature (1)..( 6): Result.004 file - promoters60/5664302
aaataa

SEQ ID NO: 147828 - DNA, 6 bp, Unknown
  misc_feature (1)..( 6): Result.004 file - promoters60/5664302
ttaaaa

SEQ ID NO: 147829 - DNA, 6 bp, Unknown
  misc_feature (1)..( 6): Result.004 file - promoters60/5664302
ttaaaa

SEQ ID NO: 147830 - DNA, 10 bp, Unknown
  misc_feature (1)..( 10): Result.004 file - promoters60/5664302
accttaaaaa

SEQ ID NO: 147831 - DNA, 10 bp, Unknown
  misc_feature (1)..( 10): Result.004 file - promoters60/5664302
accttaaaaa

SEQ ID NO: 147832 - DNA, 7 bp, Unknown
  misc_feature (1)..( 7): Result.004 file - promoters60/5664302
aaagcct

SEQ ID NO: 147833 - DNA, 7 bp, Unknown
  misc_feature (1)..( 7): Result.004 file - promoters60/5664302
aaaacct

SEQ ID NO: 147834 - DNA, 6 bp, Unknown
  misc_feature (1)..( 6): Result.004 file - promoters60/5664302
ttaaaa

SEQ ID NO: 147835 - DNA, 6 bp, Unknown
  misc_feature (1)..( 6): Result.004 file - promoters60/5664302
ttaaaa

SEQ ID NO: 147836 - DNA, 8 bp, Unknown
  misc_feature (1)..( 8): Result.004 file - promoters60/5664302
aaaataaa

SEQ ID NO: 147837 - DNA, 8 bp, Unknown
  misc_feature (1)..( 8): Result.004 file - promoters60/5664302
aaattaaa

SEQ ID NO: 147838 - DNA, 7 bp, Unknown
  misc_feature (1)..( 7): Result.004 file - promoters60/5664302
aaaccta

SEQ ID NO: 147839 - DNA, 7 bp, Unknown
  misc_feature (1)..( 7): Result.004 file - promoters60/5664302
aaatcta

SEQ ID NO: 147840 - DNA, 11 bp, Unknown
  misc_feature (1)..( 11): Result.004 file - promoters60/5664302
ataaaccaaaa

SEQ ID NO: 147841 - DNA, 11 bp, Unknown
  misc_feature (1)..( 11): Result.004 file - promoters60/5664302
ataaacctaaa

SEQ ID NO: 147842 - DNA, 6 bp, Unknown
  misc_feature (1)..( 6): Result.004 file - promoters60/5664302
aaaata

SEQ ID NO: 147843 - DNA, 6 bp, Unknown
  misc_feature (1)..( 6): Result.004 file - promoters60/5664302
aaaata

SEQ ID NO: 147844 - DNA, 6 bp, Unknown
  misc_feature (1)..( 6): Result.004 file - promoters60/5664302
ccaaaa

SEQ ID NO: 147845 - DNA, 6 bp, Unknown
  misc_feature (1)..( 6): Result.004 file - promoters60/5664302
ccaaaa

SEQ ID NO: 147846 - DNA, 6 bp, Unknown
  misc_feature (1)..( 6): Result.004 file - promoters60/5664302
ccaaaa

SEQ ID NO: 147847 - DNA, 6 bp, Unknown
  misc_feature (1)..( 6): Result.004 file - promoters60/5664302
ccaaaa

SEQ ID NO: 147848 - DNA, 7 bp, Unknown
  misc_feature (1)..( 7): Result.004 file - promoters60/5664302
aaattca

SEQ ID NO: 147849 - DNA, 7 bp, Unknown
  misc_feature (1)..( 7): Result.004 file - promoters60/5664302
aaaatca

SEQ ID NO: 147850 - DNA, 7 bp, Unknown
  misc_feature (1)..( 7): Result.004 file - promoters60/5664302
tcataaa

SEQ ID NO: 147851 - DNA, 7 bp, Unknown
  misc_feature (1)..( 7): Result.004 file - promoters60/5664302
tcataaa

SEQ ID NO: 147852 - DNA, 10 bp, Unknown
  misc_feature (1)..( 10): Result.004 file - promoters60/5664302
caataattca

SEQ ID NO: 147853 - DNA, 10 bp, Unknown
  misc_feature (1)..( 10): Result.004 file - promoters60/5664302
caaaaattca

SEQ ID NO: 147854 - DNA, 8 bp, Unknown
  misc_feature (1)..( 8): Result.004 file - promoters60/5664302
tgtattat

SEQ ID NO: 147855 - DNA, 8 bp, Unknown
  misc_feature (1)..( 8): Result.004 file - promoters60/5664302
tgtaatat

SEQ ID NO: 147856 - DNA, 7 bp, Unknown
  misc_feature (1)..( 7): Result.004 file - promoters60/5664302
aattggt

SEQ ID NO: 147857 - DNA, 7 bp, Unknown
  misc_feature (1)..( 7): Result.004 file - promoters60/5664302
aattggt

SEQ ID NO: 147858 - DNA, 6 bp, Unknown
  misc_feature (1)..( 6): Result.004 file - promoters60/5664302
ggttat

SEQ ID NO: 147859 - DNA, 6 bp, Unknown
  misc_feature (1)..( 6): Result.004 file - promoters60/5664302
ggttat

SEQ ID NO: 147860 - DNA, 7 bp, Unknown
  misc_feature (1)..( 7): Result.004 file - promoters60/5664302
ggaagat

SEQ ID NO: 147861 - DNA, 7 bp, Unknown
  misc_feature (1)..( 7): Result.004 file - promoters60/5664311
ggaagat

SEQ ID NO: 147862 - DNA, 10 bp, Unknown
  misc_feature (1)..( 10): Result.004 file - promoters60/5664311
taaaagtggc

SEQ ID NO: 147863 - DNA, 10 bp, Unknown
  misc_feature (1)..( 10): Result.004 file - promoters60/5664311
aaaaagttat

SEQ ID NO: 147864 - DNA, 10 bp, Unknown
  misc_feature (1)..( 10): Result.004 file - promoters60/5664311
aaaaagtttc

SEQ ID NO: 147865 - DNA, 10 bp, Unknown
  misc_feature (1)..( 10): Result.004 file - promoters60/5664311
ccaaagaaag

SEQ ID NO: 147866 - DNA, 10 bp, Unknown
  misc_feature (1)..( 10): Result.004 file - promoters60/5664311
caaaatttga

SEQ ID NO: 147867 - DNA, 10 bp, Unknown
  misc_feature (1)..( 10): Result.004 file - promoters60/5664311
caaacaaatc

SEQ ID NO: 147868 - DNA, 10 bp, Unknown
  misc_feature (1)..( 10): Result.004 file - promoters60/5664311
caaaacacat

SEQ ID NO: 147869 - DNA, 10 bp, Unknown
  misc_feature (1)..( 10): Result.004 file - promoters60/5664311
caaaacatcc

SEQ ID NO: 147870 - DNA, 10 bp, Unknown
  misc_feature (1)..( 10): Result.004 file - promoters60/5664311
taaaacaaaa

SEQ ID NO: 147871 - DNA, 10 bp, Unknown
  misc_feature (1)..( 10): Result.004 file - promoters60/5664311
caaaagacac

SEQ ID NO: 147872 - DNA, 10 bp, Unknown
  misc_feature (1)..( 10): Result.004 file - promoters60/5664311
gcaaataaat

SEQ ID NO: 147873 - DNA, 10 bp, Unknown
  misc_feature (1)..( 10): Result.004 file - promoters60/5664311
ctaaacaaaa

SEQ ID NO: 147874 - DNA, 14 bp, Unknown
  misc_feature (1)..( 14): Result.004 file - promoters60/5664311
tctctcaaagattt

SEQ ID NO: 147875 - DNA, 14 bp, Unknown
  misc_feature (1)..( 14): Result.004 file - promoters60/5664311
agtttcaaagaaag

SEQ ID NO: 147876 - DNA, 14 bp, Unknown
  misc_feature (1)..( 14): Result.004 file - promoters60/5664311
tctttcaaaatttg

SEQ ID NO: 147877 - DNA, 14 bp, Unknown
  misc_feature (1)..( 14): Result.004 file - promoters60/5664311
aaaaccaaagaaag

SEQ ID NO: 147878 - DNA, 14 bp, Unknown
  misc_feature (1)..( 14): Result.004 file - promoters60/5664311
gtggagaaaaaaag

SEQ ID NO: 147879 - DNA, 14 bp, Unknown
  misc_feature (1)..( 14): Result.004 file - promoters60/5664329
cctatcaaacaaat

SEQ ID NO: 147880 - DNA, 8 bp, Unknown
  misc_feature (1)..( 8): Result.004 file - promoters60/5664329
aaataaaa

SEQ ID NO: 147881 - DNA, 8 bp, Unknown
  misc_feature (1)..( 8): Result.004 file - promoters60/5664329
aaataatt

SEQ ID NO: 147882 - DNA, 8 bp, Unknown
  misc_feature (1)..( 8): Result.004 file - promoters60/5664329
taataaaa

SEQ ID NO: 147883 - DNA, 9 bp, Unknown
  misc_feature (1)..( 9): Result.004 file - promoters60/5664329
gtctttttc

SEQ ID NO: 147884 - DNA, 9 bp, Unknown
  misc_feature (1)..( 9): Result.004 file - promoters60/5664329
gtctctttc

SEQ ID NO: 147885 - DNA, 7 bp, Unknown
  misc_feature (1)..( 7): Result.004 file - promoters60/5664329
tttttgt

SEQ ID NO: 147886 - DNA, 7 bp, Unknown
  misc_feature (1)..( 7): Result.004 file - promoters60/5664329
tttttgt

SEQ ID NO: 147887 - DNA, 6 bp, Unknown
  misc_feature (1)..( 6): Result.004 file - promoters60/5664329
aaaaaa

SEQ ID NO: 147888 - DNA, 6 bp, Unknown
  misc_feature (1)..( 6): Result.004 file - promoters60/5664329
aaaaaa

SEQ ID NO: 147889 - DNA, 6 bp, Unknown
  misc_feature (1)..( 6): Result.004 file - promoters60/5664329
taaaaa

SEQ ID NO: 147890 - DNA, 6 bp, Unknown
  misc_feature (1)..( 6): Result.004 file - promoters60/5664329
taaaaa

SEQ ID NO: 147891 - DNA, 9 bp, Unknown
  misc_feature (1)..( 9): Result.004 file - promoters60/5664329
acaaatttt

SEQ ID NO: 147892 - DNA, 9 bp, Unknown
  misc_feature (1)..( 9): Result.004 file - promoters60/5664329
acatatttt

SEQ ID NO: 147893 - DNA, 10 bp, Unknown
  misc_feature (1)..( 10): Result.004 file - promoters60/5664329
aaaaataaat

SEQ ID NO: 147894 - DNA, 10 bp, Unknown
  misc_feature (1)..( 10): Result.004 file - promoters60/5664329
aaaaagaaat

SEQ ID NO: 147895 - DNA, 8 bp, Unknown
  misc_feature (1)..( 8): Result.004 file - promoters60/5664329
attacaag

SEQ ID NO: 147896 - DNA, 8 bp, Unknown
  misc_feature (1)..( 8): Result.004 file - promoters60/5664329
attataag

SEQ ID NO: 147897 - DNA, 7 bp, Unknown
  misc_feature (1)..( 7): Result.004 file - promoters60/5664329
aaacaaa

SEQ ID NO: 147898 - DNA, 7 bp, Unknown
  misc_feature (1)..( 7): Result.004 file - promoters60/5664329
aaataaa

SEQ ID NO: 147899 - DNA, 6 bp, Unknown
  misc_feature (1)..( 6): Result.004 file - promoters60/5664329
tgtaca

SEQ ID NO: 147900 - DNA, 6 bp, Unknown
  misc_feature (1)..( 6): Result.004 file - promoters60/5664329
tgtaca

SEQ ID NO: 147901 - DNA, 6 bp, Unknown
  misc_feature (1)..( 6): Result.004 file - promoters60/5664329
ataaaa

SEQ ID NO: 147902 - DNA, 6 bp, Unknown
  misc_feature (1)..( 6): Result.004 file - promoters60/5664329
ataaaa

SEQ ID NO: 147903 - DNA, 8 bp, Unknown
  misc_feature (1)..( 8): Result.004 file - promoters60/5664329
agatgtct

SEQ ID NO: 147904 - DNA, 8 bp, Unknown
  misc_feature (1)..( 8): Result.004 file - promoters60/5664329
agatatct

SEQ ID NO: 147905 - DNA, 8 bp, Unknown
  misc_feature (1)..( 8): Result.004 file - promoters60/5664329
tttactag

SEQ ID NO: 147906 - DNA, 8 bp, Unknown
  misc_feature (1)..( 8): Result.004 file - promoters60/5664329
tttaatag

SEQ ID NO: 147907 - DNA, 9 bp, Unknown
  misc_feature (1)..( 9): Result.004 file - promoters60/5664329
atataataa

SEQ ID NO: 147908 - DNA, 9 bp, Unknown
  misc_feature (1)..( 9): Result.004 file - promoters60/5664329
atatagtaa

SEQ ID NO: 147909 - DNA, 6 bp, Unknown
  misc_feature (1)..( 6): Result.004 file - promoters60/5664329
ttttaa

SEQ ID NO: 147910 - DNA, 6 bp, Unknown
  misc_feature (1)..( 6): Result.004 file - promoters60/5664329
ttttaa

SEQ ID NO: 147911 - DNA, 6 bp, Unknown
  misc_feature (1)..( 6): Result.004 file - promoters60/5664329
cttcca

SEQ ID NO: 147912 - DNA, 6 bp, Unknown
  misc_feature (1)..( 6): Result.004 file - promoters60/5664329
cttcca

SEQ ID NO: 147913 - DNA, 6 bp, Unknown
  misc_feature (1)..( 6): Result.004 file - promoters60/5664329
aaaaat

SEQ ID NO: 147914 - DNA, 6 bp, Unknown
  misc_feature (1)..( 6): Result.004 file - promoters60/5664341
aaaaat

SEQ ID NO: 147915 - DNA, 7 bp, Unknown
  misc_feature (1)..( 7): Result.004 file - promoters60/5664341
ttccctt

SEQ ID NO: 147916 - DNA, 7 bp, Unknown
  misc_feature (1)..( 7): Result.004 file - promoters60/5664341
ttcgctt

SEQ ID NO: 147917 - DNA, 6 bp, Unknown
  misc_feature (1)..( 6): Result.004 file - promoters60/5664341
ctttct

SEQ ID NO: 147918 - DNA, 6 bp, Unknown
  misc_feature (1)..( 6): Result.004 file - promoters60/5664341
ctttct

SEQ ID NO: 147919 - DNA, 6 bp, Unknown
  misc_feature (1)..( 6): Result.004 file - promoters60/5664341
ttctct

SEQ ID NO: 147920 - DNA, 6 bp, Unknown
  misc_feature (1)..( 6): Result.004 file - promoters60/5664341
ttctct

SEQ ID NO: 147921 - DNA, 6 bp, Unknown
  misc_feature (1)..( 6): Result.004 file - promoters60/5664341
ttctat

SEQ ID NO: 147922 - DNA, 6 bp, Unknown
  misc_feature (1)..( 6): Result.004 file - promoters60/5664341
ttctat

SEQ ID NO: 147923 - DNA, 7 bp, Unknown
  misc_feature (1)..( 7): Result.004 file - promoters60/5664341
tatctat

SEQ ID NO: 147924 - DNA, 7 bp, Unknown
  misc_feature (1)..( 7): Result.004 file - promoters60/5664341
tatctat

SEQ ID NO: 147925 - DNA, 7 bp, Unknown
  misc_feature (1)..( 7): Result.004 file - promoters60/5664341
atagtgt

SEQ ID NO: 147926 - DNA, 7 bp, Unknown
  misc_feature (1)..( 7): Result.004 file - promoters60/5664341
atattgt

SEQ ID NO: 147927 - DNA, 6 bp, Unknown
  misc_feature (1)..( 6): Result.004 file - promoters60/5664341
aacttg

SEQ ID NO: 147928 - DNA, 6 bp, Unknown
  misc_feature (1)..( 6): Result.004 file - promoters60/5664341
aacttg

SEQ ID NO: 147929 - DNA, 6 bp, Unknown
  misc_feature (1)..( 6): Result.004 file - promoters60/5664341
tcatat

SEQ ID NO: 147930 - DNA, 6 bp, Unknown
  misc_feature (1)..( 6): Result.004 file - promoters60/5664341
tcatat

SEQ ID NO: 147931 - DNA, 7 bp, Unknown
  misc_feature (1)..( 7): Result.004 file - promoters60/5664341
ttatgta

SEQ ID NO: 147932 - DNA, 7 bp, Unknown
  misc_feature (1)..( 7): Result.004 file - promoters60/5664341
ttacgta

SEQ ID NO: 147933 - DNA, 7 bp, Unknown
  misc_feature (1)..( 7): Result.004 file - promoters60/5664341
ctggtta

SEQ ID NO: 147934 - DNA, 7 bp, Unknown
  misc_feature (1)..( 7): Result.004 file - promoters60/5664341
ctgatta

SEQ ID NO: 147935 - DNA, 6 bp, Unknown
  misc_feature (1)..( 6): Result.004 file - promoters60/5664341
atcatt

SEQ ID NO: 147936 - DNA, 6 bp, Unknown
  misc_feature (1)..( 6): Result.004 file - promoters60/5664341
atcatt

SEQ ID NO: 147937 - DNA, 11 bp, Unknown
  misc_feature (1)..( 11): Result.004 file - promoters60/5664341
ttactgaagtt

SEQ ID NO: 147938 - DNA, 11 bp, Unknown
  misc_feature (1)..( 11): Result.004 file - promoters60/5664341
ttagtgatgtt

SEQ ID NO: 147939 - DNA, 7 bp, Unknown
  misc_feature (1)..( 7): Result.004 file - promoters60/5664341
ttttcat

SEQ ID NO: 147940 - DNA, 7 bp, Unknown
  misc_feature (1)..( 7): Result.004 file - promoters60/5664341
tttccat

SEQ ID NO: 147941 - DNA, 8 bp, Unknown
  misc_feature (1)..( 8): Result.004 file - promoters60/5664341
atcttgtg

SEQ ID NO: 147942 - DNA, 8 bp, Unknown
  misc_feature (1)..( 8): Result.004 file - promoters60/5664362
atctcgtg

SEQ ID NO: 147943 - DNA, 10 bp, Unknown
  misc_feature (1)..( 10): Result.004 file - promoters60/5664362
caatccaaag

SEQ ID NO: 147944 - DNA, 10 bp, Unknown
  misc_feature (1)..( 10): Result.004 file - promoters60/5664362
gaattcaaga

SEQ ID NO: 147945 - DNA, 10 bp, Unknown
  misc_feature (1)..( 10): Result.004 file - promoters60/5664362
aaatcgaaat

SEQ ID NO: 147946 - DNA, 10 bp, Unknown
  misc_feature (1)..( 10): Result.004 file - promoters60/5664362
ctatccgaag

SEQ ID NO: 147947 - DNA, 10 bp, Unknown
  misc_feature (1)..( 10): Result.004 file - promoters60/5664362
gaattctttc

SEQ ID NO: 147948 - DNA, 10 bp, Unknown
  misc_feature (1)..( 10): Result.004 file - promoters60/5664362
aaatcgttag

SEQ ID NO: 147949 - DNA, 10 bp, Unknown
  misc_feature (1)..( 10): Result.004 file - promoters60/5664402
gaatccgaaa

SEQ ID NO: 147950 - DNA, 8 bp, Unknown
  misc_feature (1)..( 8): Result.004 file - promoters60/5664402
aatttttt

SEQ ID NO: 147951 - DNA, 8 bp, Unknown
  misc_feature (1)..( 8): Result.004 file - promoters60/5664402
aatttttt

SEQ ID NO: 147952 - DNA, 7 bp, Unknown
  misc_feature (1)..( 7): Result.004 file - promoters60/5664402
tattttt

SEQ ID NO: 147953 - DNA, 7 bp, Unknown
  misc_feature (1)..( 7): Result.004 file - promoters60/5664402
tattttt

SEQ ID NO: 147954 - DNA, 7 bp, Unknown
  misc_feature (1)..( 7): Result.004 file - promoters60/5664402
ccaaatt

SEQ ID NO: 147955 - DNA, 7 bp, Unknown
  misc_feature (1)..( 7): Result.004 file - promoters60/5664402
ccagatt

SEQ ID NO: 147956 - DNA, 6 bp, Unknown
  misc_feature (1)..( 6): Result.004 file - promoters60/5664402
gaaaca

SEQ ID NO: 147957 - DNA, 6 bp, Unknown
  misc_feature (1)..( 6): Result.004 file - promoters60/5664402
gaaaca

SEQ ID NO: 147958 - DNA, 6 bp, Unknown
  misc_feature (1)..( 6): Result.004 file - promoters60/5664402
acaaac

SEQ ID NO: 147959 - DNA, 6 bp, Unknown
  misc_feature (1)..( 6): Result.004 file - promoters60/5664402
acaaac

SEQ ID NO: 147960 - DNA, 8 bp, Unknown
  misc_feature (1)..( 8): Result.004 file - promoters60/5664402
aaaacaaa

SEQ ID NO: 147961 - DNA, 8 bp, Unknown
  misc_feature (1)..( 8): Result.004 file - promoters60/5664402
aaaaaaaa

SEQ ID NO: 147962 - DNA, 12 bp, Unknown
  misc_feature (1)..( 12): Result.004 file - promoters60/5664402
aaaattaaattt

SEQ ID NO: 147963 - DNA, 12 bp, Unknown
  misc_feature (1)..( 12): Result.004 file - promoters60/5664402
aaaattgaattt

SEQ ID NO: 147964 - DNA, 6 bp, Unknown
  misc_feature (1)..( 6): Result.004 file - promoters60/5664402
tgaaaa

SEQ ID NO: 147965 - DNA, 6 bp, Unknown
  misc_feature (1)..( 6): Result.004 file - promoters60/5664402
tgaaaa

SEQ ID NO: 147966 - DNA, 8 bp, Unknown
  misc_feature (1)..( 8): Result.004 file - promoters60/5664402
acgtttct

SEQ ID NO: 147967 - DNA, 8 bp, Unknown
  misc_feature (1)..( 8): Result.004 file - promoters60/5664402
acgtctct

SEQ ID NO: 147968 - DNA, 7 bp, Unknown
  misc_feature (1)..( 7): Result.004 file - promoters60/5664402
tcatgtt

SEQ ID NO: 147969 - DNA, 7 bp, Unknown
  misc_feature (1)..( 7): Result.004 file - promoters60/5664402
tcatgtt

SEQ ID NO: 147970 - DNA, 7 bp, Unknown
  misc_feature (1)..( 7): Result.004 file - promoters60/5664402
aaaactt

SEQ ID NO: 147971 - DNA, 7 bp, Unknown
  misc_feature (1)..( 7): Result.004 file - promoters60/5664402
aaagctt

SEQ ID NO: 147972 - DNA, 7 bp, Unknown
  misc_feature (1)..( 7): Result.004 file - promoters60/5664402
ccattat

SEQ ID NO: 147973 - DNA, 7 bp, Unknown
  misc_feature (1)..( 7): Result.004 file - promoters60/5664402
ccactat

SEQ ID NO: 147974 - DNA, 6 bp, Unknown
  misc_feature (1)..( 6): Result.004 file - promoters60/5664402
aaattg

SEQ ID NO: 147975 - DNA, 6 bp, Unknown
  misc_feature (1)..( 6): Result.004 file - promoters60/5664402
aaattg

SEQ ID NO: 147976 - DNA, 7 bp, Unknown
  misc_feature (1)..( 7): Result.004 file - promoters60/5664402
agaagaa

SEQ ID NO: 147977 - DNA, 7 bp, Unknown
  misc_feature (1)..( 7): Result.004 file - promoters60/5664402
agaggaa

SEQ ID NO: 147978 - DNA, 8 bp, Unknown
  misc_feature (1)..( 8): Result.004 file - promoters60/5664402
tttctttt

SEQ ID NO: 147979 - DNA, 8 bp, Unknown
  misc_feature (1)..( 8): Result.004 file - promoters60/5664402
tttctttt

SEQ ID NO: 147980 - DNA, 6 bp, Unknown
  misc_feature (1)..( 6): Result.004 file - promoters60/5664402
tcacca

SEQ ID NO: 147981 - DNA, 6 bp, Unknown
  misc_feature (1)..( 6): Result.004 file - promoters60/5664402
tcacca

SEQ ID NO: 147982 - DNA, 7 bp, Unknown
  misc_feature (1)..( 7): Result.004 file - promoters60/5664402
tttgagc

SEQ ID NO: 147983 - DNA, 7 bp, Unknown
  misc_feature (1)..( 7): Result.004 file - promoters60/5664402
ttttagc

SEQ ID NO: 147984 - DNA, 8 bp, Unknown
  misc_feature (1)..( 8): Result.004 file - promoters60/5664402
atatacta

SEQ ID NO: 147985 - DNA, 8 bp, Unknown
  misc_feature (1)..( 8): Result.004 file - promoters60/5664402
atattcta

SEQ ID NO: 147986 - DNA, 7 bp, Unknown
  misc_feature (1)..( 7): Result.004 file - promoters60/5664402
ggtgtga

SEQ ID NO: 147987 - DNA, 7 bp, Unknown
  misc_feature (1)..( 7): Result.004 file - promoters60/5664465
ggtctga

SEQ ID NO: 147988 - DNA, 8 bp, Unknown
  misc_feature (1)..( 8): Result.004 file - promoters60/5664465
aataattc

SEQ ID NO: 147989 - DNA, 8 bp, Unknown
  misc_feature (1)..( 8): Result.004 file - promoters60/5664465
tttaattc

SEQ ID NO: 147990 - DNA, 8 bp, Unknown
  misc_feature (1)..( 8): Result.004 file - promoters60/5664465
tttgatta

SEQ ID NO: 147991 - DNA, 8 bp, Unknown
  misc_feature (1)..( 8): Result.004 file - promoters60/5664465
attaattg

SEQ ID NO: 147992 - DNA, 9 bp, Unknown
  misc_feature (1)..( 9): Result.004 file - promoters60/5664465
ataaaaaag

SEQ ID NO: 147993 - DNA, 9 bp, Unknown
  misc_feature (1)..( 9): Result.004 file - promoters60/5664465
atacaaaat

SEQ ID NO: 147994 - DNA, 9 bp, Unknown
  misc_feature (1)..( 9): Result.004 file - promoters60/5664465
atacaaaac

SEQ ID NO: 147995 - DNA, 9 bp, Unknown
  misc_feature (1)..( 9): Result.004 file - promoters60/5664465
agaaaaaaa

SEQ ID NO: 147996 - DNA, 10 bp, Unknown
  misc_feature (1)..( 10): Result.004 file - promoters60/5664465
ctaaaataat

SEQ ID NO: 147997 - DNA, 10 bp, Unknown
  misc_feature (1)..( 10): Result.004 file - promoters60/5664465
attcattgta

SEQ ID NO: 147998 - DNA, 10 bp, Unknown
  misc_feature (1)..( 10): Result.004 file - promoters60/5664465
attcatcttc

SEQ ID NO: 147999 - DNA, 10 bp, Unknown
  misc_feature (1)..( 10): Result.004 file - promoters60/5664465
attaattgta

SEQ ID NO: 148000 - DNA, 10 bp, Unknown
  misc_feature (1)..( 10): Result.004 file - promoters60/5664465
tttaattctc

SEQ ID NO: 148001 - DNA, 11 bp, Unknown
  misc_feature (1)..( 11): Result.004 file - promoters60/5664465
cagcgacttca

SEQ ID NO: 148002 - DNA, 11 bp, Unknown
  misc_feature (1)..( 11): Result.004 file - promoters60/5664465
cagagacatca

SEQ ID NO: 148003 - DNA, 11 bp, Unknown
  misc_feature (1)..( 11): Result.004 file - promoters60/5664465
tagatacagtg

SEQ ID NO: 148004 - DNA, 11 bp, Unknown
  misc_feature (1)..( 11): Result.004 file - promoters60/5664465
ccgatccagaa

SEQ ID NO: 148005 - DNA, 10 bp, Unknown
  misc_feature (1)..( 10): Result.004 file - promoters60/5664465
caaacttatc

SEQ ID NO: 148006 - DNA, 10 bp, Unknown
  misc_feature (1)..( 10): Result.004 file - promoters60/5664465
caaaattata

SEQ ID NO: 148007 - DNA, 10 bp, Unknown
  misc_feature (1)..( 10): Result.004 file - promoters60/5664465
caatatttgt

SEQ ID NO: 148008 - DNA, 10 bp, Unknown
  misc_feature (1)..( 10): Result.004 file - promoters60/5664465
tgatattata

SEQ ID NO: 148009 - DNA, 10 bp, Unknown
  misc_feature (1)..( 10): Result.004 file - promoters60/5664480
caatatgtgc

SEQ ID NO: 148010 - DNA, 8 bp, Unknown
  misc_feature (1)..( 8): Result.004 file - promoters60/5664480
taatatat

SEQ ID NO: 148011 - DNA, 8 bp, Unknown
  misc_feature (1)..( 8): Result.004 file - promoters60/5664480
taaaatat

SEQ ID NO: 148012 - DNA, 9 bp, Unknown
  misc_feature (1)..( 9): Result.004 file - promoters60/5664480
ttatttgga

SEQ ID NO: 148013 - DNA, 9 bp, Unknown
  misc_feature (1)..( 9): Result.004 file - promoters60/5664480
atatttgtt

SEQ ID NO: 148014 - DNA, 9 bp, Unknown
  misc_feature (1)..( 9): Result.004 file - promoters60/5664480
ttatgtgga

SEQ ID NO: 148015 - DNA, 8 bp, Unknown
  misc_feature (1)..( 8): Result.004 file - promoters60/5664480
atctagtt

SEQ ID NO: 148016 - DNA, 8 bp, Unknown
  misc_feature (1)..( 8): Result.004 file - promoters60/5664480
atctagtt

SEQ ID NO: 148017 - DNA, 7 bp, Unknown
  misc_feature (1)..( 7): Result.004 file - promoters60/5664480
tataaat

SEQ ID NO: 148018 - DNA, 7 bp, Unknown
  misc_feature (1)..( 7): Result.004 file - promoters60/5664480
tataaat

SEQ ID NO: 148019 - DNA, 7 bp, Unknown
  misc_feature (1)..( 7): Result.004 file - promoters60/5664480
tataaaa

SEQ ID NO: 148020 - DNA, 11 bp, Unknown
  misc_feature (1)..( 11): Result.004 file - promoters60/5664480
cgatacttgtc

SEQ ID NO: 148021 - DNA, 11 bp, Unknown
  misc_feature (1)..( 11): Result.004 file - promoters60/5664480
cgaaactggtc

SEQ ID NO: 148022 - DNA, 8 bp, Unknown
  misc_feature (1)..( 8): Result.004 file - promoters60/5664480
gaactcat

SEQ ID NO: 148023 - DNA, 8 bp, Unknown
  misc_feature (1)..( 8): Result.004 file - promoters60/5664480
gaagtcat

SEQ ID NO: 148024 - DNA, 9 bp, Unknown
  misc_feature (1)..( 9): Result.004 file - promoters60/5664480
ttaaatgaa

SEQ ID NO: 148025 - DNA, 9 bp, Unknown
  misc_feature (1)..( 9): Result.004 file - promoters60/5664480
ttacatgaa

SEQ ID NO: 148026 - DNA, 7 bp, Unknown
  misc_feature (1)..( 7): Result.004 file - promoters60/5664480
agaagaa

SEQ ID NO: 148027 - DNA, 7 bp, Unknown
  misc_feature (1)..( 7): Result.004 file - promoters60/5664480
agaagaa

SEQ ID NO: 148028 - DNA, 6 bp, Unknown
  misc_feature (1)..( 6): Result.004 file - promoters60/5664480
gtgtaa

SEQ ID NO: 148029 - DNA, 6 bp, Unknown
  misc_feature (1)..( 6): Result.004 file - promoters60/5664480
gtgtaa

SEQ ID NO: 148030 - DNA, 9 bp, Unknown
  misc_feature (1)..( 9): Result.004 file - promoters60/5664480
aaacaaaaa

SEQ ID NO: 148031 - DNA, 9 bp, Unknown
  misc_feature (1)..( 9): Result.004 file - promoters60/5664480
aaagaaaaa

SEQ ID NO: 148032 - DNA, 7 bp, Unknown
  misc_feature (1)..( 7): Result.004 file - promoters60/5664480
ctaatct

SEQ ID NO: 148033 - DNA, 7 bp, Unknown
  misc_feature (1)..( 7): Result.004 file - promoters60/5664480
ctattct

SEQ ID NO: 148034 - DNA, 6 bp, Unknown
  misc_feature (1)..( 6): Result.004 file - promoters60/5664480
aacaga

SEQ ID NO: 148035 - DNA, 6 bp, Unknown
  misc_feature (1)..( 6): Result.004 file - promoters60/5664480
aacaga

SEQ ID NO: 148036 - DNA, 6 bp, Unknown
  misc_feature (1)..( 6): Result.004 file - promoters60/5664480
agcaat

SEQ ID NO: 148037 - DNA, 6 bp, Unknown
  misc_feature (1)..( 6): Result.004 file - promoters60/5664488
agcaat

SEQ ID NO: 148038 - DNA, 9 bp, Unknown
  misc_feature (1)..( 9): Result.004 file - promoters60/5664488
ttacgaaag

SEQ ID NO: 148039 - DNA, 9 bp, Unknown
  misc_feature (1)..( 9): Result.004 file - promoters60/5664488
ttacggaag

SEQ ID NO: 148040 - DNA, 7 bp, Unknown
  misc_feature (1)..( 7): Result.004 file - promoters60/5664488
acaaaga

SEQ ID NO: 148041 - DNA, 7 bp, Unknown
  misc_feature (1)..( 7): Result.004 file - promoters60/5664488
acagaga

SEQ ID NO: 148042 - DNA, 7 bp, Unknown
  misc_feature (1)..( 7): Result.004 file - promoters60/5664488
tatatat

SEQ ID NO: 148043 - DNA, 7 bp, Unknown
  misc_feature (1)..( 7): Result.004 file - promoters60/5664488
tatatat

SEQ ID NO: 148044 - DNA, 6 bp, Unknown
  misc_feature (1)..( 6): Result.004 file - promoters60/5664488
tcataa

SEQ ID NO: 148045 - DNA, 6 bp, Unknown
  misc_feature (1)..( 6): Result.004 file - promoters60/5664488
tcataa

SEQ ID NO: 148046 - DNA, 6 bp, Unknown
  misc_feature (1)..( 6): Result.004 file - promoters60/5664488
catttc

SEQ ID NO: 148047 - DNA, 6 bp, Unknown
  misc_feature (1)..( 6): Result.004 file - promoters60/5664488
catttc

SEQ ID NO: 148048 - DNA, 7 bp, Unknown
  misc_feature (1)..( 7): Result.004 file - promoters60/5664488
catatgt

SEQ ID NO: 148049 - DNA, 7 bp, Unknown
  misc_feature (1)..( 7): Result.004 file - promoters60/5664488
catatgt

SEQ ID NO: 148050 - DNA, 6 bp, Unknown
  misc_feature (1)..( 6): Result.004 file - promoters60/5664488
caagtc

SEQ ID NO: 148051 - DNA, 6 bp, Unknown
  misc_feature (1)..( 6): Result.004 file - promoters60/5664488
caagtc

SEQ ID NO: 148052 - DNA, 9 bp, Unknown
  misc_feature (1)..( 9): Result.004 file - promoters60/5664488
attaaatat

SEQ ID NO: 148053 - DNA, 9 bp, Unknown
  misc_feature (1)..( 9): Result.004 file - promoters60/5664488
attatatat

SEQ ID NO: 148054 - DNA, 7 bp, Unknown
  misc_feature (1)..( 7): Result.004 file - promoters60/5664488
gattcat

SEQ ID NO: 148055 - DNA, 7 bp, Unknown
  misc_feature (1)..( 7): Result.004 file - promoters60/5664488
gatacat

SEQ ID NO: 148056 - DNA, 8 bp, Unknown
  misc_feature (1)..( 8): Result.004 file - promoters60/5664488
gtcgctct

SEQ ID NO: 148057 - DNA, 8 bp, Unknown
  misc_feature (1)..( 8): Result.004 file - promoters60/5664488
gtcgatct

SEQ ID NO: 148058 - DNA, 6 bp, Unknown
  misc_feature (1)..( 6): Result.004 file - promoters60/5664488
taaact

SEQ ID NO: 148059 - DNA, 6 bp, Unknown
  misc_feature (1)..( 6): Result.004 file - promoters60/5664488
taaact

SEQ ID NO: 148060 - DNA, 8 bp, Unknown
  misc_feature (1)..( 8): Result.004 file - promoters60/5664488
aatggtgt

SEQ ID NO: 148061 - DNA, 8 bp, Unknown
  misc_feature (1)..( 8): Result.004 file - promoters60/5664488
aatgttgt

SEQ ID NO: 148062 - DNA, 6 bp, Unknown
  misc_feature (1)..( 6): Result.004 file - promoters60/5664488
aatgtt

SEQ ID NO: 148063 - DNA, 6 bp, Unknown
  misc_feature (1)..( 6): Result.004 file - promoters60/5664488
aatgtt

SEQ ID NO: 148064 - DNA, 7 bp, Unknown
  misc_feature (1)..( 7): Result.004 file - promoters60/5664488
tgttcat

SEQ ID NO: 148065 - DNA, 7 bp, Unknown
  misc_feature (1)..( 7): Result.004 file - promoters60/5664488
tgtacat

SEQ ID NO: 148066 - DNA, 6 bp, Unknown
  misc_feature (1)..( 6): Result.004 file - promoters60/5664488
tatgag

SEQ ID NO: 148067 - DNA, 6 bp, Unknown
  misc_feature (1)..( 6): Result.004 file - promoters60/5664488
tatgag

SEQ ID NO: 148068 - DNA, 8 bp, Unknown
  misc_feature (1)..( 8): Result.004 file - promoters60/5664488
gatgtttc

SEQ ID NO: 148069 - DNA, 8 bp, Unknown
  misc_feature (1)..( 8): Result.004 file - promoters60/5664517
gatgtttc

SEQ ID NO: 148070 - DNA, 9 bp, Unknown
  misc_feature (1)..( 9): Result.004 file - promoters60/5664517
tttatgaat

SEQ ID NO: 148071 - DNA, 9 bp, Unknown
  misc_feature (1)..( 9): Result.004 file - promoters60/5664517
tatatgaaa

SEQ ID NO: 148072 - DNA, 9 bp, Unknown
  misc_feature (1)..( 9): Result.004 file - promoters60/5664517
tttattaaa

SEQ ID NO: 148073 - DNA, 9 bp, Unknown
  misc_feature (1)..( 9): Result.004 file - promoters60/5664517
ttttttact

SEQ ID NO: 148074 - DNA, 10 bp, Unknown
  misc_feature (1)..( 10): Result.004 file - promoters60/5664517
gaaaatctaa

SEQ ID NO: 148075 - DNA, 10 bp, Unknown
  misc_feature (1)..( 10): Result.004 file - promoters60/5664517
taaaatttaa

SEQ ID NO: 148076 - DNA, 10 bp, Unknown
  misc_feature (1)..( 10): Result.004 file - promoters60/5664517
caaaattaga

SEQ ID NO: 148077 - DNA, 10 bp, Unknown
  misc_feature (1)..( 10): Result.004 file - promoters60/5664633
taatattact

SEQ ID NO: 148078 - DNA, 6 bp, Unknown
  misc_feature (1)..( 6): Result.004 file - promoters60/5664633
atttta

SEQ ID NO: 148079 - DNA, 6 bp, Unknown
  misc_feature (1)..( 6): Result.004 file - promoters60/5664633
atttta

SEQ ID NO: 148080 - DNA, 10 bp, Unknown
  misc_feature (1)..( 10): Result.004 file - promoters60/5664633
aaaaggaaaa

SEQ ID NO: 148081 - DNA, 10 bp, Unknown
  misc_feature (1)..( 10): Result.004 file - promoters60/5664633
aaaagtaaaa

SEQ ID NO: 148082 - DNA, 8 bp, Unknown
  misc_feature (1)..( 8): Result.004 file - promoters60/5664633
gcaaaaat

SEQ ID NO: 148083 - DNA, 8 bp, Unknown
  misc_feature (1)..( 8): Result.004 file - promoters60/5664633
gcaataat

SEQ ID NO: 148084 - DNA, 6 bp, Unknown
  misc_feature (1)..( 6): Result.004 file - promoters60/5664633
tatttt

SEQ ID NO: 148085 - DNA, 6 bp, Unknown
  misc_feature (1)..( 6): Result.004 file - promoters60/5664633
tatttt

SEQ ID NO: 148086 - DNA, 6 bp, Unknown
  misc_feature (1)..( 6): Result.004 file - promoters60/5664633
ttttca

SEQ ID NO: 148087 - DNA, 6 bp, Unknown
  misc_feature (1)..( 6): Result.004 file - promoters60/5664633
ttttca

SEQ ID NO: 148088 - DNA, 6 bp, Unknown
  misc_feature (1)..( 6): Result.004 file - promoters60/5664633
tttttt

SEQ ID NO: 148089 - DNA, 6 bp, Unknown
  misc_feature (1)..( 6): Result.004 file - promoters60/5664633
tttttt

SEQ ID NO: 148090 - DNA, 8 bp, Unknown
  misc_feature (1)..( 8): Result.004 file - promoters60/5664633
attaatta

SEQ ID NO: 148091 - DNA, 8 bp, Unknown
  misc_feature (1)..( 8): Result.004 file - promoters60/5664633
attattta

SEQ ID NO: 148092 - DNA, 6 bp, Unknown
  misc_feature (1)..( 6): Result.004 file - promoters60/5664633
tttttc

SEQ ID NO: 148093 - DNA, 6 bp, Unknown
  misc_feature (1)..( 6): Result.004 file - promoters60/5664633
tttttc

SEQ ID NO: 148094 - DNA, 9 bp, Unknown
  misc_feature (1)..( 9): Result.004 file - promoters60/5664633
aatcattat

SEQ ID NO: 148095 - DNA, 9 bp, Unknown
  misc_feature (1)..( 9): Result.004 file - promoters60/5664633
aatcactat

SEQ ID NO: 148096 - DNA, 8 bp, Unknown
  misc_feature (1)..( 8): Result.004 file - promoters60/5664633
tatgtgtt

SEQ ID NO: 148097 - DNA, 8 bp, Unknown
  misc_feature (1)..( 8): Result.004 file - promoters60/5664633
tatatgtt

SEQ ID NO: 148098 - DNA, 8 bp, Unknown
  misc_feature (1)..( 8): Result.004 file - promoters60/5664633
tttccttt

SEQ ID NO: 148099 - DNA, 8 bp, Unknown
  misc_feature (1)..( 8): Result.004 file - promoters60/5664633
tttcattt

SEQ ID NO: 148100 - DNA, 8 bp, Unknown
  misc_feature (1)..( 8): Result.004 file - promoters60/5664633
tttctcca

SEQ ID NO: 148101 - DNA, 8 bp, Unknown
  misc_feature (1)..( 8): Result.004 file - promoters60/5664633
aaaattaa

SEQ ID NO: 148102 - DNA, 8 bp, Unknown
  misc_feature (1)..( 8): Result.004 file - promoters60/5664633
aaaattaa

SEQ ID NO: 148103 - DNA, 8 bp, Unknown
  misc_feature (1)..( 8): Result.004 file - promoters60/5664633
caaactaa

SEQ ID NO: 148104 - DNA, 8 bp, Unknown
  misc_feature (1)..( 8): Result.004 file - promoters60/5664633
tactaaaa

SEQ ID NO: 148105 - DNA, 8 bp, Unknown
  misc_feature (1)..( 8): Result.004 file - promoters60/5664633
tacgaaaa

SEQ ID NO: 148106 - DNA, 6 bp, Unknown
  misc_feature (1)..( 6): Result.004 file - promoters60/5664633
atttta

SEQ ID NO: 148107 - DNA, 6 bp, Unknown
  misc_feature (1)..( 6): Result.004 file - promoters60/5664633
atttta

SEQ ID NO: 148108 - DNA, 7 bp, Unknown
  misc_feature (1)..( 7): Result.004 file - promoters60/5664633
agagtaa

SEQ ID NO: 148109 - DNA, 7 bp, Unknown
  misc_feature (1)..( 7): Result.004 file - promoters60/5664633
agaataa

SEQ ID NO: 148110 - DNA, 6 bp, Unknown
  misc_feature (1)..( 6): Result.004 file - promoters60/5664633
aagttg

SEQ ID NO: 148111 - DNA, 6 bp, Unknown
  misc_feature (1)..( 6): Result.004 file - promoters60/5664633
aagttg

SEQ ID NO: 148112 - DNA, 7 bp, Unknown
  misc_feature (1)..( 7): Result.004 file - promoters60/5664633
ttttaaa

SEQ ID NO: 148113 - DNA, 7 bp, Unknown
  misc_feature (1)..( 7): Result.004 file - promoters60/5664633
tttgaaa

SEQ ID NO: 148114 - DNA, 7 bp, Unknown
  misc_feature (1)..( 7): Result.004 file - promoters60/5664633
taataaa

SEQ ID NO: 148115 - DNA, 7 bp, Unknown
  misc_feature (1)..( 7): Result.004 file - promoters60/5664633
taagaaa

SEQ ID NO: 148116 - DNA, 7 bp, Unknown
  misc_feature (1)..( 7): Result.004 file - promoters60/5664633
ttgtgaa

SEQ ID NO: 148117 - DNA, 7 bp, Unknown
  misc_feature (1)..( 7): Result.004 file - promoters60/5664633
ttgggaa

SEQ ID NO: 148118 - DNA, 13 bp, Unknown
  misc_feature (1)..( 13): Result.004 file - promoters60/5664633
gttgatttttttc

SEQ ID NO: 148119 - DNA, 13 bp, Unknown
  misc_feature (1)..( 13): Result.004 file - promoters60/5664633
tccgatttctttt

SEQ ID NO: 148120 - DNA, 14 bp, Unknown
  misc_feature (1)..( 14): Result.004 file - promoters60/5664633
tccgatttcatttt

SEQ ID NO: 148121 - DNA, 6 bp, Unknown
  misc_feature (1)..( 6): Result.004 file - promoters60/5664633
agtttt

SEQ ID NO: 148122 - DNA, 6 bp, Unknown
  misc_feature (1)..( 6): Result.004 file - promoters60/5664633
agtttt

SEQ ID NO: 148123 - DNA, 7 bp, Unknown
  misc_feature (1)..( 7): Result.004 file - promoters60/5664633
gaagaaa

SEQ ID NO: 148124 - DNA, 7 bp, Unknown
  misc_feature (1)..( 7): Result.004 file - promoters60/5664633
gaagaaa

SEQ ID NO: 148125 - DNA, 6 bp, Unknown
  misc_feature (1)..( 6): Result.004 file - promoters60/5664633
ttgaat

SEQ ID NO: 148126 - DNA, 6 bp, Unknown
  misc_feature (1)..( 6): Result.004 file - promoters60/5664633
ttgaat

SEQ ID NO: 148127 - DNA, 7 bp, Unknown
  misc_feature (1)..( 7): Result.004 file - promoters60/5664633
aaaatta

SEQ ID NO: 148128 - DNA, 7 bp, Unknown
  misc_feature (1)..( 7): Result.004 file - promoters60/5664633
aaaatta

SEQ ID NO: 148129 - DNA, 7 bp, Unknown
  misc_feature (1)..( 7): Result.004 file - promoters60/5664633
ttttcgc

SEQ ID NO: 148130 - DNA, 7 bp, Unknown
  misc_feature (1)..( 7): Result.004 file - promoters60/5664633
tttccgc

SEQ ID NO: 148131 - DNA, 9 bp, Unknown
  misc_feature (1)..( 9): Result.004 file - promoters60/5664633
aaaaaaaaa

SEQ ID NO: 148132 - DNA, 9 bp, Unknown
  misc_feature (1)..( 9): Result.004 file - promoters60/5664633
aaacaaaaa

SEQ ID NO: 148133 - DNA, 6 bp, Unknown
  misc_feature (1)..( 6): Result.004 file - promoters60/5664633
aaatca

SEQ ID NO: 148134 - DNA, 6 bp, Unknown
  misc_feature (1)..( 6): Result.004 file - promoters60/5664657
aaatca

SEQ ID NO: 148135 - DNA, 9 bp, Unknown
  misc_feature (1)..( 9): Result.004 file - promoters60/5664657
aaaattgac

SEQ ID NO: 148136 - DNA, 9 bp, Unknown
  misc_feature (1)..( 9): Result.004 file - promoters60/5664657
aaaattgga

SEQ ID NO: 148137 - DNA, 9 bp, Unknown
  misc_feature (1)..( 9): Result.004 file - promoters60/5664657
aaaataaat

SEQ ID NO: 148138 - DNA, 8 bp, Unknown
  misc_feature (1)..( 8): Result.004 file - promoters60/5664657
atttaaat

SEQ ID NO: 148139 - DNA, 8 bp, Unknown
  misc_feature (1)..( 8): Result.004 file - promoters60/5664657
ctttaaaa

SEQ ID NO: 148140 - DNA, 8 bp, Unknown
  misc_feature (1)..( 8): Result.004 file - promoters60/5664657
cttgaaaa

SEQ ID NO: 148141 - DNA, 8 bp, Unknown
  misc_feature (1)..( 8): Result.004 file - promoters60/5664657
aaactact

SEQ ID NO: 148142 - DNA, 8 bp, Unknown
  misc_feature (1)..( 8): Result.004 file - promoters60/5664657
aaattaca

SEQ ID NO: 148143 - DNA, 8 bp, Unknown
  misc_feature (1)..( 8): Result.004 file - promoters60/5664657
gaatgaca

SEQ ID NO: 148144 - DNA, 11 bp, Unknown
  misc_feature (1)..( 11): Result.004 file - promoters60/5664657
atttttttgtt

SEQ ID NO: 148145 - DNA, 11 bp, Unknown
  misc_feature (1)..( 11): Result.004 file - promoters60/5664657
atttgtttgaa

SEQ ID NO: 148146 - DNA, 11 bp, Unknown
  misc_feature (1)..( 11): Result.004 file - promoters60/5664703
tggggtttgaa

SEQ ID NO: 148147 - DNA, 12 bp, Unknown
  misc_feature (1)..( 12): Result.004 file - promoters60/5664703
ctttttgtttat

SEQ ID NO: 148148 - DNA, 12 bp, Unknown
  misc_feature (1)..( 12): Result.004 file - promoters60/5664703
tgatttgtatat

SEQ ID NO: 148149 - DNA, 12 bp, Unknown
  misc_feature (1)..( 12): Result.004 file - promoters60/5664703
cttattgtataa

SEQ ID NO: 148150 - DNA, 6 bp, Unknown
  misc_feature (1)..( 6): Result.004 file - promoters60/5664703
attgaa

SEQ ID NO: 148151 - DNA, 6 bp, Unknown
  misc_feature (1)..( 6): Result.004 file - promoters60/5664703
attgaa

SEQ ID NO: 148152 - DNA, 6 bp, Unknown
  misc_feature (1)..( 6): Result.004 file - promoters60/5664703
tgaaca

SEQ ID NO: 148153 - DNA, 6 bp, Unknown
  misc_feature (1)..( 6): Result.004 file - promoters60/5664703
tgaaca

SEQ ID NO: 148154 - DNA, 7 bp, Unknown
  misc_feature (1)..( 7): Result.004 file - promoters60/5664703
tctacga

SEQ ID NO: 148155 - DNA, 7 bp, Unknown
  misc_feature (1)..( 7): Result.004 file - promoters60/5664703
tcttcga

SEQ ID NO: 148156 - DNA, 7 bp, Unknown
  misc_feature (1)..( 7): Result.004 file - promoters60/5664703
agggttt

SEQ ID NO: 148157 - DNA, 7 bp, Unknown
  misc_feature (1)..( 7): Result.004 file - promoters60/5664703
aggattt

SEQ ID NO: 148158 - DNA, 10 bp, Unknown
  misc_feature (1)..( 10): Result.004 file - promoters60/5664703
gcaggagatg

SEQ ID NO: 148159 - DNA, 10 bp, Unknown
  misc_feature (1)..( 10): Result.004 file - promoters60/5664703
gcaggagatg

SEQ ID NO: 148160 - DNA, 8 bp, Unknown
  misc_feature (1)..( 8): Result.004 file - promoters60/5664703
gctggatt

SEQ ID NO: 148161 - DNA, 8 bp, Unknown
  misc_feature (1)..( 8): Result.004 file - promoters60/5664703
tctgaatt

SEQ ID NO: 148162 - DNA, 8 bp, Unknown
  misc_feature (1)..( 8): Result.004 file - promoters60/5664703
tctgaaca

SEQ ID NO: 148163 - DNA, 6 bp, Unknown
  misc_feature (1)..( 6): Result.004 file - promoters60/5664703
aatcta

SEQ ID NO: 148164 - DNA, 6 bp, Unknown
  misc_feature (1)..( 6): Result.004 file - promoters60/5664703
aatcta

SEQ ID NO: 148165 - DNA, 6 bp, Unknown
  misc_feature (1)..( 6): Result.004 file - promoters60/5664703
catcaa

SEQ ID NO: 148166 - DNA, 6 bp, Unknown
  misc_feature (1)..( 6): Result.004 file - promoters60/5664703
catcaa

SEQ ID NO: 148167 - DNA, 8 bp, Unknown
  misc_feature (1)..( 8): Result.004 file - promoters60/5664703
gattggtg

SEQ ID NO: 148168 - DNA, 8 bp, Unknown
  misc_feature (1)..( 8): Result.004 file - promoters60/5664703
gattcgtg

SEQ ID NO: 148169 - DNA, 7 bp, Unknown
  misc_feature (1)..( 7): Result.004 file - promoters60/5664703
cactgtc

SEQ ID NO: 148170 - DNA, 7 bp, Unknown
  misc_feature (1)..( 7): Result.004 file - promoters60/5664703
cacggtc

SEQ ID NO: 148171 - DNA, 6 bp, Unknown
  misc_feature (1)..( 6): Result.004 file - promoters60/5664703
ggttta

SEQ ID NO: 148172 - DNA, 6 bp, Unknown
  misc_feature (1)..( 6): Result.004 file - promoters60/5664703
ggttta

SEQ ID NO: 148173 - DNA, 6 bp, Unknown
  misc_feature (1)..( 6): Result.004 file - promoters60/5664703
ttgact

SEQ ID NO: 148174 - DNA, 6 bp, Unknown
  misc_feature (1)..( 6): Result.004 file - promoters60/5664703
ttgact

SEQ ID NO: 148175 - DNA, 6 bp, Unknown
  misc_feature (1)..( 6): Result.004 file - promoters60/5664703
ggctgt

SEQ ID NO: 148176 - DNA, 6 bp, Unknown
  misc_feature (1)..( 6): Result.004 file - promoters60/5664734
ggctgt

SEQ ID NO: 148177 - DNA, 8 bp, Unknown
  misc_feature (1)..( 8): Result.004 file - promoters60/5664734
aaataagt

SEQ ID NO: 148178 - DNA, 8 bp, Unknown
  misc_feature (1)..( 8): Result.004 file - promoters60/5664734
aaattagt

SEQ ID NO: 148179 - DNA, 8 bp, Unknown
  misc_feature (1)..( 8): Result.004 file - promoters60/5664734
aaattaat

SEQ ID NO: 148180 - DNA, 6 bp, Unknown
  misc_feature (1)..( 6): Result.004 file - promoters60/5664734
atctta

SEQ ID NO: 148181 - DNA, 6 bp, Unknown
  misc_feature (1)..( 6): Result.004 file - promoters60/5664734
atctta

SEQ ID NO: 148182 - DNA, 6 bp, Unknown
  misc_feature (1)..( 6): Result.004 file - promoters60/5664734
tgatgt

SEQ ID NO: 148183 - DNA, 6 bp, Unknown
  misc_feature (1)..( 6): Result.004 file - promoters60/5664734
tgatgt

SEQ ID NO: 148184 - DNA, 9 bp, Unknown
  misc_feature (1)..( 9): Result.004 file - promoters60/5664734
gtgagcgga

SEQ ID NO: 148185 - DNA, 9 bp, Unknown
  misc_feature (1)..( 9): Result.004 file - promoters60/5664734
gtgagagga

SEQ ID NO: 148186 - DNA, 6 bp, Unknown
  misc_feature (1)..( 6): Result.004 file - promoters60/5664734
cggtga

SEQ ID NO: 148187 - DNA, 6 bp, Unknown
  misc_feature (1)..( 6): Result.004 file - promoters60/5664734
cggtga

SEQ ID NO: 148188 - DNA, 6 bp, Unknown
  misc_feature (1)..( 6): Result.004 file - promoters60/5664734
cggtgg

SEQ ID NO: 148189 - DNA, 6 bp, Unknown
  misc_feature (1)..( 6): Result.004 file - promoters60/5664734
cggtgg

SEQ ID NO: 148190 - DNA, 6 bp, Unknown
  misc_feature (1)..( 6): Result.004 file - promoters60/5664734
gagaaa

SEQ ID NO: 148191 - DNA, 6 bp, Unknown
  misc_feature (1)..( 6): Result.004 file - promoters60/5664734
gagaaa

SEQ ID NO: 148192 - DNA, 6 bp, Unknown
  misc_feature (1)..( 6): Result.004 file - promoters60/5664734
aaacta

SEQ ID NO: 148193 - DNA, 6 bp, Unknown
  misc_feature (1)..( 6): Result.004 file - promoters60/5664734
aaacta

SEQ ID NO: 148194 - DNA, 6 bp, Unknown
  misc_feature (1)..( 6): Result.004 file - promoters60/5664734
atgatc

SEQ ID NO: 148195 - DNA, 6 bp, Unknown
  misc_feature (1)..( 6): Result.004 file - promoters60/5664734
atgatc

SEQ ID NO: 148196 - DNA, 7 bp, Unknown
  misc_feature (1)..( 7): Result.004 file - promoters60/5664734
caaatta

SEQ ID NO: 148197 - DNA, 7 bp, Unknown
  misc_feature (1)..( 7): Result.004 file - promoters60/5664734
caattta

SEQ ID NO: 148198 - DNA, 6 bp, Unknown
  misc_feature (1)..( 6): Result.004 file - promoters60/5664734
gacgtg

SEQ ID NO: 148199 - DNA, 6 bp, Unknown
  misc_feature (1)..( 6): Result.004 file - promoters60/5664806
gacgtg

SEQ ID NO: 148200 - DNA, 6 bp, Unknown
  misc_feature (1)..( 6): Result.004 file - promoters60/5664806
atgaaa

SEQ ID NO: 148201 - DNA, 6 bp, Unknown
  misc_feature (1)..( 6): Result.004 file - promoters60/5664806
atgaaa

SEQ ID NO: 148202 - DNA, 10 bp, Unknown
  misc_feature (1)..( 10): Result.004 file - promoters60/5664806
aaggaaataa

SEQ ID NO: 148203 - DNA, 10 bp, Unknown
  misc_feature (1)..( 10): Result.004 file - promoters60/5664806
aagcaaaact

SEQ ID NO: 148204 - DNA, 10 bp, Unknown
  misc_feature (1)..( 10): Result.004 file - promoters60/5664806
aaagaaagga

SEQ ID NO: 148205 - DNA, 7 bp, Unknown
  misc_feature (1)..( 7): Result.004 file - promoters60/5664806
aacatga

SEQ ID NO: 148206 - DNA, 7 bp, Unknown
  misc_feature (1)..( 7): Result.004 file - promoters60/5664806
aacctga

SEQ ID NO: 148207 - DNA, 11 bp, Unknown
  misc_feature (1)..( 11): Result.004 file - promoters60/5664806
accaataaaag

SEQ ID NO: 148208 - DNA, 11 bp, Unknown
  misc_feature (1)..( 11): Result.004 file - promoters60/5664806
accaagaaaac

SEQ ID NO: 148209 - DNA, 11 bp, Unknown
  misc_feature (1)..( 11): Result.004 file - promoters60/5664806
atctggaaaac

SEQ ID NO: 148210 - DNA, 6 bp, Unknown
  misc_feature (1)..( 6): Result.004 file - promoters60/5664806
ttttca

SEQ ID NO: 148211 - DNA, 6 bp, Unknown
  misc_feature (1)..( 6): Result.004 file - promoters60/5664806
ttttca

SEQ ID NO: 148212 - DNA, 10 bp, Unknown
  misc_feature (1)..( 10): Result.004 file - promoters60/5664806
taatagtaat

SEQ ID NO: 148213 - DNA, 10 bp, Unknown
  misc_feature (1)..( 10): Result.004 file - promoters60/5664806
taatagcaat

SEQ ID NO: 148214 - DNA, 8 bp, Unknown
  misc_feature (1)..( 8): Result.004 file - promoters60/5664806
attattat

SEQ ID NO: 148215 - DNA, 8 bp, Unknown
  misc_feature (1)..( 8): Result.004 file - promoters60/5664806
atttttat

SEQ ID NO: 148216 - DNA, 7 bp, Unknown
  misc_feature (1)..( 7): Result.004 file - promoters60/5664806
ttgtgga

SEQ ID NO: 148217 - DNA, 7 bp, Unknown
  misc_feature (1)..( 7): Result.004 file - promoters60/5664806
ttgtgga

SEQ ID NO: 148218 - DNA, 11 bp, Unknown
  misc_feature (1)..( 11): Result.004 file - promoters60/5664806
tcttctttttt

SEQ ID NO: 148219 - DNA, 11 bp, Unknown
  misc_feature (1)..( 11): Result.004 file - promoters60/5664806
tcttatttttt

SEQ ID NO: 148220 - DNA, 7 bp, Unknown
  misc_feature (1)..( 7): Result.004 file - promoters60/5664806
atgtatt

SEQ ID NO: 148221 - DNA, 7 bp, Unknown
  misc_feature (1)..( 7): Result.004 file - promoters60/5664806
atgcatt

SEQ ID NO: 148222 - DNA, 7 bp, Unknown
  misc_feature (1)..( 7): Result.004 file - promoters60/5664806
aattaac

SEQ ID NO: 148223 - DNA, 7 bp, Unknown
  misc_feature (1)..( 7): Result.004 file - promoters60/5664806
aatgaac

SEQ ID NO: 148224 - DNA, 7 bp, Unknown
  misc_feature (1)..( 7): Result.004 file - promoters60/5664806
aaaggaa

SEQ ID NO: 148225 - DNA, 7 bp, Unknown
  misc_feature (1)..( 7): Result.004 file - promoters60/5664806
aaaagaa

SEQ ID NO: 148226 - DNA, 7 bp, Unknown
  misc_feature (1)..( 7): Result.004 file - promoters60/5664806
ttttatt

SEQ ID NO: 148227 - DNA, 7 bp, Unknown
  misc_feature (1)..( 7): Result.004 file - promoters60/5664806
tttaatt

SEQ ID NO: 148228 - DNA, 7 bp, Unknown
  misc_feature (1)..( 7): Result.004 file - promoters60/5664806
ttgtcta

SEQ ID NO: 148229 - DNA, 7 bp, Unknown
  misc_feature (1)..( 7): Result.004 file - promoters60/5664806
ttggcta

SEQ ID NO: 148230 - DNA, 7 bp, Unknown
  misc_feature (1)..( 7): Result.004 file - promoters60/5664806
atatata

SEQ ID NO: 148231 - DNA, 7 bp, Unknown
  misc_feature (1)..( 7): Result.004 file - promoters60/5664806
ataaata

SEQ ID NO: 148232 - DNA, 7 bp, Unknown
  misc_feature (1)..( 7): Result.004 file - promoters60/5664806
taatatt

SEQ ID NO: 148233 - DNA, 7 bp, Unknown
  misc_feature (1)..( 7): Result.004 file - promoters60/5664806
taatatt

SEQ ID NO: 148234 - DNA, 7 bp, Unknown
  misc_feature (1)..( 7): Result.004 file - promoters60/5664806
acaatat

SEQ ID NO: 148235 - DNA, 7 bp, Unknown
  misc_feature (1)..( 7): Result.004 file - promoters60/5664806
acaatat

SEQ ID NO: 148236 - DNA, 7 bp, Unknown
  misc_feature (1)..( 7): Result.004 file - promoters60/5664806
tggtttt

SEQ ID NO: 148237 - DNA, 7 bp, Unknown
  misc_feature (1)..( 7): Result.004 file - promoters60/5664806
tgggttt

SEQ ID NO: 148238 - DNA, 8 bp, Unknown
  misc_feature (1)..( 8): Result.004 file - promoters60/5664806
acaactga

SEQ ID NO: 148239 - DNA, 8 bp, Unknown
  misc_feature (1)..( 8): Result.004 file - promoters60/5664806
acaattga

SEQ ID NO: 148240 - DNA, 6 bp, Unknown
  misc_feature (1)..( 6): Result.004 file - promoters60/5664806
tgtttt

SEQ ID NO: 148241 - DNA, 6 bp, Unknown
  misc_feature (1)..( 6): Result.004 file - promoters60/5664806
tgtttt

SEQ ID NO: 148242 - DNA, 7 bp, Unknown
  misc_feature (1)..( 7): Result.004 file - promoters60/5664806
atgggag

SEQ ID NO: 148243 - DNA, 7 bp, Unknown
  misc_feature (1)..( 7): Result.004 file - promoters60/5664806
atgtgag

SEQ ID NO: 148244 - DNA, 6 bp, Unknown
  misc_feature (1)..( 6): Result.004 file - promoters60/5664806
ctatct

SEQ ID NO: 148245 - DNA, 6 bp, Unknown
  misc_feature (1)..( 6): Result.004 file - promoters60/5664814
ctatct

SEQ ID NO: 148246 - DNA, 7 bp, Unknown
  misc_feature (1)..( 7): Result.004 file - promoters60/5664814
aaataaa

SEQ ID NO: 148247 - DNA, 7 bp, Unknown
  misc_feature (1)..( 7): Result.004 file - promoters60/5664814
aaaaaaa

SEQ ID NO: 148248 - DNA, 7 bp, Unknown
  misc_feature (1)..( 7): Result.004 file - promoters60/5664814
taataaa

SEQ ID NO: 148249 - DNA, 7 bp, Unknown
  misc_feature (1)..( 7): Result.004 file - promoters60/5664814
taaaaaa

SEQ ID NO: 148250 - DNA, 11 bp, Unknown
  misc_feature (1)..( 11): Result.004 file - promoters60/5664814
attttcttaat

SEQ ID NO: 148251 - DNA, 11 bp, Unknown
  misc_feature (1)..( 11): Result.004 file - promoters60/5664814
tttttcataat

SEQ ID NO: 148252 - DNA, 11 bp, Unknown
  misc_feature (1)..( 11): Result.004 file - promoters60/5664814
attttcttgca

SEQ ID NO: 148253 - DNA, 11 bp, Unknown
  misc_feature (1)..( 11): Result.004 file - promoters60/5664814
actttcattca

SEQ ID NO: 148254 - DNA, 10 bp, Unknown
  misc_feature (1)..( 10): Result.004 file - promoters60/5664814
agttaataaa

SEQ ID NO: 148255 - DNA, 10 bp, Unknown
  misc_feature (1)..( 10): Result.004 file - promoters60/5664814
agttaatatt

SEQ ID NO: 148256 - DNA, 10 bp, Unknown
  misc_feature (1)..( 10): Result.004 file - promoters60/5664814
ttgtaacaaa

SEQ ID NO: 148257 - DNA, 10 bp, Unknown
  misc_feature (1)..( 10): Result.004 file - promoters60/5664814
aactaaaaaa

SEQ ID NO: 148258 - DNA, 8 bp, Unknown
  misc_feature (1)..( 8): Result.004 file - promoters60/5664814
tacattct

SEQ ID NO: 148259 - DNA, 8 bp, Unknown
  misc_feature (1)..( 8): Result.004 file - promoters60/5664814
tacatttg

SEQ ID NO: 148260 - DNA, 9 bp, Unknown
  misc_feature (1)..( 9): Result.004 file - promoters60/5664814
aacaattga

SEQ ID NO: 148261 - DNA, 9 bp, Unknown
  misc_feature (1)..( 9): Result.004 file - promoters60/5664814
aaccattac

SEQ ID NO: 148262 - DNA, 7 bp, Unknown
  misc_feature (1)..( 7): Result.004 file - promoters60/5664814
aaaaaaa

SEQ ID NO: 148263 - DNA, 7 bp, Unknown
  misc_feature (1)..( 7): Result.004 file - promoters60/5664814
aaaaaag

SEQ ID NO: 148264 - DNA, 7 bp, Unknown
  misc_feature (1)..( 7): Result.004 file - promoters60/5664814
aaacaga

SEQ ID NO: 148265 - DNA, 7 bp, Unknown
  misc_feature (1)..( 7): Result.004 file - promoters60/5664814
taacaga

SEQ ID NO: 148266 - DNA, 12 bp, Unknown
  misc_feature (1)..( 12): Result.004 file - promoters60/5664814
tctcaaaatcaa

SEQ ID NO: 148267 - DNA, 12 bp, Unknown
  misc_feature (1)..( 12): Result.004 file - promoters60/5664814
attcaagatcaa

SEQ ID NO: 148268 - DNA, 12 bp, Unknown
  misc_feature (1)..( 12): Result.004 file - promoters60/5664814
tctgaaaatgga

SEQ ID NO: 148269 - DNA, 12 bp, Unknown
  misc_feature (1)..( 12): Result.004 file - promoters60/5664873
cttcaaggcttc

SEQ ID NO: 148270 - DNA, 15 bp, Unknown
  misc_feature (1)..( 15): Result.004 file - promoters60/5664873
gtctcctataataaa

SEQ ID NO: 148271 - DNA, 15 bp, Unknown
  misc_feature (1)..( 15): Result.004 file - promoters60/5664873
gtagcctttaaaaaa

SEQ ID NO: 148272 - DNA, 15 bp, Unknown
  misc_feature (1)..( 15): Result.004 file - promoters60/5664873
ttcttctatatatat

SEQ ID NO: 148273 - DNA, 15 bp, Unknown
  misc_feature (1)..( 15): Result.004 file - promoters60/5664873
ttgtcctataaatat

SEQ ID NO: 148274 - DNA, 15 bp, Unknown
  misc_feature (1)..( 15): Result.004 file - promoters60/5664873
gtctcttatatattc

SEQ ID NO: 148275 - DNA, 15 bp, Unknown
  misc_feature (1)..( 15): Result.004 file - promoters60/5664873
ctcttcttcattgaa

SEQ ID NO: 148276 - DNA, 15 bp, Unknown
  misc_feature (1)..( 15): Result.004 file - promoters60/5664873
aaaatcgtaaaattc

SEQ ID NO: 148277 - DNA, 15 bp, Unknown
  misc_feature (1)..( 15): Result.004 file - promoters60/5664873
tataacccaaaattg

SEQ ID NO: 148278 - DNA, 15 bp, Unknown
  misc_feature (1)..( 15): Result.004 file - promoters60/5664873
taaatcgtaaaattt

SEQ ID NO: 148279 - DNA, 15 bp, Unknown
  misc_feature (1)..( 15): Result.004 file - promoters60/5664873
accaaaataaaataa

SEQ ID NO: 148280 - DNA, 15 bp, Unknown
  misc_feature (1)..( 15): Result.004 file - promoters60/5664873
tataaccaaaaataa

SEQ ID NO: 148281 - DNA, 15 bp, Unknown
  misc_feature (1)..( 15): Result.004 file - promoters60/5664942
aacactggaaacttt

SEQ ID NO: 148282 - DNA, 8 bp, Unknown
  misc_feature (1)..( 8): Result.004 file - promoters60/5664942
cataccag

SEQ ID NO: 148283 - DNA, 8 bp, Unknown
  misc_feature (1)..( 8): Result.004 file - promoters60/5664942
cataacag

SEQ ID NO: 148284 - DNA, 6 bp, Unknown
  misc_feature (1)..( 6): Result.004 file - promoters60/5664942
aactta

SEQ ID NO: 148285 - DNA, 6 bp, Unknown
  misc_feature (1)..( 6): Result.004 file - promoters60/5664942
aactta

SEQ ID NO: 148286 - DNA, 6 bp, Unknown
  misc_feature (1)..( 6): Result.004 file - promoters60/5664942
ctttct

SEQ ID NO: 148287 - DNA, 6 bp, Unknown
  misc_feature (1)..( 6): Result.004 file - promoters60/5664942
ctttct

SEQ ID NO: 148288 - DNA, 6 bp, Unknown
  misc_feature (1)..( 6): Result.004 file - promoters60/5664942
aaaatc

SEQ ID NO: 148289 - DNA, 6 bp, Unknown
  misc_feature (1)..( 6): Result.004 file - promoters60/5664942
aaaatc

SEQ ID NO: 148290 - DNA, 6 bp, Unknown
  misc_feature (1)..( 6): Result.004 file - promoters60/5664942
aaaatc

SEQ ID NO: 148291 - DNA, 6 bp, Unknown
  misc_feature (1)..( 6): Result.004 file - promoters60/5664942
aataat

SEQ ID NO: 148292 - DNA, 6 bp, Unknown
  misc_feature (1)..( 6): Result.004 file - promoters60/5664942
aataat

SEQ ID NO: 148293 - DNA, 6 bp, Unknown
  misc_feature (1)..( 6): Result.004 file - promoters60/5664942
acatct

SEQ ID NO: 148294 - DNA, 6 bp, Unknown
  misc_feature (1)..( 6): Result.004 file - promoters60/5664942
acatct

SEQ ID NO: 148295 - DNA, 6 bp, Unknown
  misc_feature (1)..( 6): Result.004 file - promoters60/5664942
tataag

SEQ ID NO: 148296 - DNA, 6 bp, Unknown
  misc_feature (1)..( 6): Result.004 file - promoters60/5664942
tataag

SEQ ID NO: 148297 - DNA, 8 bp, Unknown
  misc_feature (1)..( 8): Result.004 file - promoters60/5664942
tacctttc

SEQ ID NO: 148298 - DNA, 8 bp, Unknown
  misc_feature (1)..( 8): Result.004 file - promoters60/5664942
tacatttc

SEQ ID NO: 148299 - DNA, 7 bp, Unknown
  misc_feature (1)..( 7): Result.004 file - promoters60/5664942
atatata

SEQ ID NO: 148300 - DNA, 7 bp, Unknown
  misc_feature (1)..( 7): Result.004 file - promoters60/5664942
atacata

SEQ ID NO: 148301 - DNA, 6 bp, Unknown
  misc_feature (1)..( 6): Result.004 file - promoters60/5664942
cttcat

SEQ ID NO: 148302 - DNA, 6 bp, Unknown
  misc_feature (1)..( 6): Result.004 file - promoters60/5664942
cttcat

SEQ ID NO: 148303 - DNA, 7 bp, Unknown
  misc_feature (1)..( 7): Result.004 file - promoters60/5664942
tttctat

SEQ ID NO: 148304 - DNA, 7 bp, Unknown
  misc_feature (1)..( 7): Result.004 file - promoters60/5665083
tttttat

SEQ ID NO: 148305 - DNA, 7 bp, Unknown
  misc_feature (1)..( 7): Result.004 file - promoters60/5665083
tcgacaa

SEQ ID NO: 148306 - DNA, 7 bp, Unknown
  misc_feature (1)..( 7): Result.004 file - promoters60/5665083
tcgtcaa

SEQ ID NO: 148307 - DNA, 7 bp, Unknown
  misc_feature (1)..( 7): Result.004 file - promoters60/5665083
gttttta

SEQ ID NO: 148308 - DNA, 7 bp, Unknown
  misc_feature (1)..( 7): Result.004 file - promoters60/5665083
gttttta

SEQ ID NO: 148309 - DNA, 7 bp, Unknown
  misc_feature (1)..( 7): Result.004 file - promoters60/5665083
tttttta

SEQ ID NO: 148310 - DNA, 7 bp, Unknown
  misc_feature (1)..( 7): Result.004 file - promoters60/5665083
gaatcac

SEQ ID NO: 148311 - DNA, 7 bp, Unknown
  misc_feature (1)..( 7): Result.004 file - promoters60/5665083
gaaacac

SEQ ID NO: 148312 - DNA, 8 bp, Unknown
  misc_feature (1)..( 8): Result.004 file - promoters60/5665083
tctctatt

SEQ ID NO: 148313 - DNA, 8 bp, Unknown
  misc_feature (1)..( 8): Result.004 file - promoters60/5665083
tctttatt

SEQ ID NO: 148314 - DNA, 6 bp, Unknown
  misc_feature (1)..( 6): Result.004 file - promoters60/5665083
taaaaa

SEQ ID NO: 148315 - DNA, 6 bp, Unknown
  misc_feature (1)..( 6): Result.004 file - promoters60/5665083
taaaaa

SEQ ID NO: 148316 - DNA, 8 bp, Unknown
  misc_feature (1)..( 8): Result.004 file - promoters60/5665083
tggagtgt

SEQ ID NO: 148317 - DNA, 8 bp, Unknown
  misc_feature (1)..( 8): Result.004 file - promoters60/5665083
tggactgt

SEQ ID NO: 148318 - DNA, 7 bp, Unknown
  misc_feature (1)..( 7): Result.004 file - promoters60/5665083
atcttat

SEQ ID NO: 148319 - DNA, 7 bp, Unknown
  misc_feature (1)..( 7): Result.004 file - promoters60/5665083
atcctat

SEQ ID NO: 148320 - DNA, 6 bp, Unknown
  misc_feature (1)..( 6): Result.004 file - promoters60/5665083
tgaacc

SEQ ID NO: 148321 - DNA, 6 bp, Unknown
  misc_feature (1)..( 6): Result.004 file - promoters60/5665083
tgaacc

SEQ ID NO: 148322 - DNA, 6 bp, Unknown
  misc_feature (1)..( 6): Result.004 file - promoters60/5665083
ttacat

SEQ ID NO: 148323 - DNA, 6 bp, Unknown
  misc_feature (1)..( 6): Result.004 file - promoters60/5665083
ttacat

SEQ ID NO: 148324 - DNA, 7 bp, Unknown
  misc_feature (1)..( 7): Result.004 file - promoters60/5665083
gtgtttt

SEQ ID NO: 148325 - DNA, 7 bp, Unknown
  misc_feature (1)..( 7): Result.004 file - promoters60/5665083
gtgattt

SEQ ID NO: 148326 - DNA, 10 bp, Unknown
  misc_feature (1)..( 10): Result.004 file - promoters60/5665083
ttttgaatct

SEQ ID NO: 148327 - DNA, 10 bp, Unknown
  misc_feature (1)..( 10): Result.004 file - promoters60/5665083
tttttaatct

SEQ ID NO: 148328 - DNA, 7 bp, Unknown
  misc_feature (1)..( 7): Result.004 file - promoters60/5665083
tataatc

SEQ ID NO: 148329 - DNA, 7 bp, Unknown
  misc_feature (1)..( 7): Result.004 file - promoters60/5665083
tatgatc

SEQ ID NO: 148330 - DNA, 6 bp, Unknown
  misc_feature (1)..( 6): Result.004 file - promoters60/5665083
atattg

SEQ ID NO: 148331 - DNA, 6 bp, Unknown
  misc_feature (1)..( 6): Result.004 file - promoters60/5665083
atattg

SEQ ID NO: 148332 - DNA, 7 bp, Unknown
  misc_feature (1)..( 7): Result.004 file - promoters60/5665083
tattgtt

SEQ ID NO: 148333 - DNA, 7 bp, Unknown
  misc_feature (1)..( 7): Result.004 file - promoters60/5665083
tatagtt

SEQ ID NO: 148334 - DNA, 11 bp, Unknown
  misc_feature (1)..( 11): Result.004 file - promoters60/5665083
aaacttcatct

SEQ ID NO: 148335 - DNA, 11 bp, Unknown
  misc_feature (1)..( 11): Result.004 file - promoters60/5665083
aaagttcatct

SEQ ID NO: 148336 - DNA, 7 bp, Unknown
  misc_feature (1)..( 7): Result.004 file - promoters60/5665083
tatatgt

SEQ ID NO: 148337 - DNA, 7 bp, Unknown
  misc_feature (1)..( 7): Result.004 file - promoters60/5665083
tatgtgt

SEQ ID NO: 148338 - DNA, 7 bp, Unknown
  misc_feature (1)..( 7): Result.004 file - promoters60/5665083
taagatt

SEQ ID NO: 148339 - DNA, 7 bp, Unknown
  misc_feature (1)..( 7): Result.004 file - promoters60/5665083
taagatt

SEQ ID NO: 148340 - DNA, 7 bp, Unknown
  misc_feature (1)..( 7): Result.004 file - promoters60/5665083
tggttat

SEQ ID NO: 148341 - DNA, 7 bp, Unknown
  misc_feature (1)..( 7): Result.004 file - promoters60/5665140
tggatat

SEQ ID NO: 148342 - DNA, 16 bp, Unknown
  misc_feature (1)..( 16): Result.004 file - promoters60/5665140
gttgatttaatcataa

SEQ ID NO: 148343 - DNA, 16 bp, Unknown
  misc_feature (1)..( 16): Result.004 file - promoters60/5665140
ctccatttaatttttt

SEQ ID NO: 148344 - DNA, 16 bp, Unknown
  misc_feature (1)..( 16): Result.004 file - promoters60/5665140
gaaactttaatgaatg

SEQ ID NO: 148345 - DNA, 16 bp, Unknown
  misc_feature (1)..( 16): Result.004 file - promoters60/5665140
gtgatttgaattaaac

SEQ ID NO: 148346 - DNA, 16 bp, Unknown
  misc_feature (1)..( 16): Result.004 file - promoters60/5665140
gaaagtttaaaaaggc

SEQ ID NO: 148347 - DNA, 16 bp, Unknown
  misc_feature (1)..( 16): Result.004 file - promoters60/5665140
ccacagatcatgaaag

SEQ ID NO: 148348 - DNA, 11 bp, Unknown
  misc_feature (1)..( 11): Result.004 file - promoters60/5665140
tttaaaataaa

SEQ ID NO: 148349 - DNA, 11 bp, Unknown
  misc_feature (1)..( 11): Result.004 file - promoters60/5665140
gataacataga

SEQ ID NO: 148350 - DNA, 11 bp, Unknown
  misc_feature (1)..( 11): Result.004 file - promoters60/5665140
tttaaaacatg

SEQ ID NO: 148351 - DNA, 11 bp, Unknown
  misc_feature (1)..( 11): Result.004 file - promoters60/5665140
agtaacttagg

SEQ ID NO: 148352 - DNA, 11 bp, Unknown
  misc_feature (1)..( 11): Result.004 file - promoters60/5665140
ttggacataga

SEQ ID NO: 148353 - DNA, 11 bp, Unknown
  misc_feature (1)..( 11): Result.004 file - promoters60/5665140
gtttaatgtta

SEQ ID NO: 148354 - DNA, 11 bp, Unknown
  misc_feature (1)..( 11): Result.004 file - promoters60/5665140
gttaaatgtat

SEQ ID NO: 148355 - DNA, 11 bp, Unknown
  misc_feature (1)..( 11): Result.004 file - promoters60/5665140
atttattgttt

SEQ ID NO: 148356 - DNA, 11 bp, Unknown
  misc_feature (1)..( 11): Result.004 file - promoters60/5665140
accaaatctta

SEQ ID NO: 148357 - DNA, 11 bp, Unknown
  misc_feature (1)..( 11): Result.004 file - promoters60/5665140
aataaagctta

SEQ ID NO: 148358 - DNA, 11 bp, Unknown
  misc_feature (1)..( 11): Result.004 file - promoters60/5665140
agacattgttg

SEQ ID NO: 148359 - DNA, 10 bp, Unknown
  misc_feature (1)..( 10): Result.004 file - promoters60/5665140
tttaatgtta

SEQ ID NO: 148360 - DNA, 10 bp, Unknown
  misc_feature (1)..( 10): Result.004 file - promoters60/5665140
tagtatgtta

SEQ ID NO: 148361 - DNA, 10 bp, Unknown
  misc_feature (1)..( 10): Result.004 file - promoters60/5665140
tttattgttt

SEQ ID NO: 148362 - DNA, 10 bp, Unknown
  misc_feature (1)..( 10): Result.004 file - promoters60/5665140
ccaaatctta

SEQ ID NO: 148363 - DNA, 10 bp, Unknown
  misc_feature (1)..( 10): Result.004 file - promoters60/5665140
ataaagctta

SEQ ID NO: 148364 - DNA, 10 bp, Unknown
  misc_feature (1)..( 10): Result.004 file - promoters60/5665140
gacattgttg

SEQ ID NO: 148365 - DNA, 9 bp, Unknown
  misc_feature (1)..( 9): Result.004 file - promoters60/5665140
acaataaaa

SEQ ID NO: 148366 - DNA, 9 bp, Unknown
  misc_feature (1)..( 9): Result.004 file - promoters60/5665140
gcaaaaaaa

SEQ ID NO: 148367 - DNA, 9 bp, Unknown
  misc_feature (1)..( 9): Result.004 file - promoters60/5665140
acattaaca

SEQ ID NO: 148368 - DNA, 9 bp, Unknown
  misc_feature (1)..( 9): Result.004 file - promoters60/5665140
gtcataaaa

SEQ ID NO: 148369 - DNA, 9 bp, Unknown
  misc_feature (1)..( 9): Result.004 file - promoters60/5665140
gcaagattc

SEQ ID NO: 148370 - DNA, 8 bp, Unknown
  misc_feature (1)..( 8): Result.004 file - promoters60/5665140
aaatcaaa

SEQ ID NO: 148371 - DNA, 8 bp, Unknown
  misc_feature (1)..( 8): Result.004 file - promoters60/5665140
aaaacaat

SEQ ID NO: 148372 - DNA, 8 bp, Unknown
  misc_feature (1)..( 8): Result.004 file - promoters60/5665140
aaatcaaa

SEQ ID NO: 148373 - DNA, 8 bp, Unknown
  misc_feature (1)..( 8): Result.004 file - promoters60/5665140
aaaacatg

SEQ ID NO: 148374 - DNA, 8 bp, Unknown
  misc_feature (1)..( 8): Result.004 file - promoters60/5665140
tataaata

SEQ ID NO: 148375 - DNA, 8 bp, Unknown
  misc_feature (1)..( 8): Result.004 file - promoters60/5665140
aataaata

SEQ ID NO: 148376 - DNA, 8 bp, Unknown
  misc_feature (1)..( 8): Result.004 file - promoters60/5665140
aataaata

SEQ ID NO: 148377 - DNA, 8 bp, Unknown
  misc_feature (1)..( 8): Result.004 file - promoters60/5665140
tataaata

SEQ ID NO: 148378 - DNA, 8 bp, Unknown
  misc_feature (1)..( 8): Result.004 file - promoters60/5665140
aaacatag

SEQ ID NO: 148379 - DNA, 8 bp, Unknown
  misc_feature (1)..( 8): Result.004 file - promoters60/5665140
taacttag

SEQ ID NO: 148380 - DNA, 8 bp, Unknown
  misc_feature (1)..( 8): Result.004 file - promoters60/5665140
aaacatgt

SEQ ID NO: 148381 - DNA, 8 bp, Unknown
  misc_feature (1)..( 8): Result.004 file - promoters60/5665140
ggacatag

SEQ ID NO: 148382 - DNA, 8 bp, Unknown
  misc_feature (1)..( 8): Result.004 file - promoters60/5665140
taacatag

SEQ ID NO: 148383 - DNA, 13 bp, Unknown
  misc_feature (1)..( 13): Result.004 file - promoters60/5665140
aaaacaatagatt

SEQ ID NO: 148384 - DNA, 13 bp, Unknown
  misc_feature (1)..( 13): Result.004 file - promoters60/5665140
ttaacaatatatt

SEQ ID NO: 148385 - DNA, 13 bp, Unknown
  misc_feature (1)..( 13): Result.004 file - promoters60/5665140
aaaacaatgaatt

SEQ ID NO: 148386 - DNA, 13 bp, Unknown
  misc_feature (1)..( 13): Result.004 file - promoters60/5665140
tgaataatgaaaa

SEQ ID NO: 148387 - DNA, 10 bp, Unknown
  misc_feature (1)..( 10): Result.004 file - promoters60/5665140
tgtaattacg

SEQ ID NO: 148388 - DNA, 10 bp, Unknown
  misc_feature (1)..( 10): Result.004 file - promoters60/5665140
tctaattatt

SEQ ID NO: 148389 - DNA, 10 bp, Unknown
  misc_feature (1)..( 10): Result.004 file - promoters60/5665140
caaaattacg

SEQ ID NO: 148390 - DNA, 10 bp, Unknown
  misc_feature (1)..( 10): Result.004 file - promoters60/5665140
aataatttag

SEQ ID NO: 148391 - DNA, 11 bp, Unknown
  misc_feature (1)..( 11): Result.004 file - promoters60/5665140
ttaccaaatca

SEQ ID NO: 148392 - DNA, 11 bp, Unknown
  misc_feature (1)..( 11): Result.004 file - promoters60/5665140
cacacaattca

SEQ ID NO: 148393 - DNA, 11 bp, Unknown
  misc_feature (1)..( 11): Result.004 file - promoters60/5665140
catacaattca

SEQ ID NO: 148394 - DNA, 11 bp, Unknown
  misc_feature (1)..( 11): Result.004 file - promoters60/5665140
catgcaattcc

SEQ ID NO: 148395 - DNA, 9 bp, Unknown
  misc_feature (1)..( 9): Result.004 file - promoters60/5665140
tgtatcatg

SEQ ID NO: 148396 - DNA, 9 bp, Unknown
  misc_feature (1)..( 9): Result.004 file - promoters60/5665140
aatataatg

SEQ ID NO: 148397 - DNA, 9 bp, Unknown
  misc_feature (1)..( 9): Result.004 file - promoters60/5665140
aatttaaat

SEQ ID NO: 148398 - DNA, 10 bp, Unknown
  misc_feature (1)..( 10): Result.004 file - promoters60/5665140
gatttgaatt

SEQ ID NO: 148399 - DNA, 17 bp, Unknown
  misc_feature (1)..( 17): Result.004 file - promoters60/5665140
taatttaactgataaaa

SEQ ID NO: 148400 - DNA, 17 bp, Unknown
  misc_feature (1)..( 17): Result.004 file - promoters60/5665140
ctagtcatgtcataaaa

SEQ ID NO: 148401 - DNA, 17 bp, Unknown
  misc_feature (1)..( 17): Result.004 file - promoters60/5665140
taatctaattgataaac

SEQ ID NO: 148402 - DNA, 17 bp, Unknown
  misc_feature (1)..( 17): Result.004 file - promoters60/5665140
acattaacatcatcaaa

SEQ ID NO: 148403 - DNA, 10 bp, Unknown
  misc_feature (1)..( 10): Result.004 file - promoters60/5665140
aaaaaacaat

SEQ ID NO: 148404 - DNA, 10 bp, Unknown
  misc_feature (1)..( 10): Result.004 file - promoters60/5665140
aaaaaactgt

SEQ ID NO: 148405 - DNA, 10 bp, Unknown
  misc_feature (1)..( 10): Result.004 file - promoters60/5665140
ttaaaacaat

SEQ ID NO: 148406 - DNA, 10 bp, Unknown
  misc_feature (1)..( 10): Result.004 file - promoters60/5665234
aaaaaaagat

SEQ ID NO: 148407 - DNA, 9 bp, Unknown
  misc_feature (1)..( 9): Result.004 file - promoters60/5665234
gaaaaaaag

SEQ ID NO: 148408 - DNA, 9 bp, Unknown
  misc_feature (1)..( 9): Result.004 file - promoters60/5665234
caaacaaat

SEQ ID NO: 148409 - DNA, 9 bp, Unknown
  misc_feature (1)..( 9): Result.004 file - promoters60/5665234
caaagaaag

SEQ ID NO: 148410 - DNA, 9 bp, Unknown
  misc_feature (1)..( 9): Result.004 file - promoters60/5665234
caaaaaaaa

SEQ ID NO: 148411 - DNA, 9 bp, Unknown
  misc_feature (1)..( 9): Result.004 file - promoters60/5665234
caaacacaa

SEQ ID NO: 148412 - DNA, 9 bp, Unknown
  misc_feature (1)..( 9): Result.004 file - promoters60/5665283
caaggaaag

SEQ ID NO: 148413 - DNA, 10 bp, Unknown
  misc_feature (1)..( 10): Result.004 file - promoters60/5665283
ttttaagaga

SEQ ID NO: 148414 - DNA, 10 bp, Unknown
  misc_feature (1)..( 10): Result.004 file - promoters60/5665283
ttttaaaaga

SEQ ID NO: 148415 - DNA, 10 bp, Unknown
  misc_feature (1)..( 10): Result.004 file - promoters60/5665283
tttcaaattg

SEQ ID NO: 148416 - DNA, 7 bp, Unknown
  misc_feature (1)..( 7): Result.004 file - promoters60/5665283
caataat

SEQ ID NO: 148417 - DNA, 7 bp, Unknown
  misc_feature (1)..( 7): Result.004 file - promoters60/5665283
caataat

SEQ ID NO: 148418 - DNA, 7 bp, Unknown
  misc_feature (1)..( 7): Result.004 file - promoters60/5665283
attattg

SEQ ID NO: 148419 - DNA, 7 bp, Unknown
  misc_feature (1)..( 7): Result.004 file - promoters60/5665283
attattg

SEQ ID NO: 148420 - DNA, 7 bp, Unknown
  misc_feature (1)..( 7): Result.004 file - promoters60/5665283
caccaag

SEQ ID NO: 148421 - DNA, 7 bp, Unknown
  misc_feature (1)..( 7): Result.004 file - promoters60/5665283
cacaaag

SEQ ID NO: 148422 - DNA, 6 bp, Unknown
  misc_feature (1)..( 6): Result.004 file - promoters60/5665283
taccct

SEQ ID NO: 148423 - DNA, 6 bp, Unknown
  misc_feature (1)..( 6): Result.004 file - promoters60/5665283
taccct

SEQ ID NO: 148424 - DNA, 10 bp, Unknown
  misc_feature (1)..( 10): Result.004 file - promoters60/5665283
attatttttt

SEQ ID NO: 148425 - DNA, 10 bp, Unknown
  misc_feature (1)..( 10): Result.004 file - promoters60/5665283
attacttttt

SEQ ID NO: 148426 - DNA, 7 bp, Unknown
  misc_feature (1)..( 7): Result.004 file - promoters60/5665283
gatttat

SEQ ID NO: 148427 - DNA, 7 bp, Unknown
  misc_feature (1)..( 7): Result.004 file - promoters60/5665283
gatatat

SEQ ID NO: 148428 - DNA, 6 bp, Unknown
  misc_feature (1)..( 6): Result.004 file - promoters60/5665283
caaaag

SEQ ID NO: 148429 - DNA, 6 bp, Unknown
  misc_feature (1)..( 6): Result.004 file - promoters60/5665283
caaaag

SEQ ID NO: 148430 - DNA, 7 bp, Unknown
  misc_feature (1)..( 7): Result.004 file - promoters60/5665283
ttgggtt

SEQ ID NO: 148431 - DNA, 7 bp, Unknown
  misc_feature (1)..( 7): Result.004 file - promoters60/5665283
ttgagtt

SEQ ID NO: 148432 - DNA, 7 bp, Unknown
  misc_feature (1)..( 7): Result.004 file - promoters60/5665283
atatcta

SEQ ID NO: 148433 - DNA, 7 bp, Unknown
  misc_feature (1)..( 7): Result.004 file - promoters60/5665283
atagcta

SEQ ID NO: 148434 - DNA, 10 bp, Unknown
  misc_feature (1)..( 10): Result.004 file - promoters60/5665283
actatatata

SEQ ID NO: 148435 - DNA, 10 bp, Unknown
  misc_feature (1)..( 10): Result.004 file - promoters60/5665283
actctatata

SEQ ID NO: 148436 - DNA, 8 bp, Unknown
  misc_feature (1)..( 8): Result.004 file - promoters60/5665283
acatagga

SEQ ID NO: 148437 - DNA, 8 bp, Unknown
  misc_feature (1)..( 8): Result.004 file - promoters60/5665283
acattgga

SEQ ID NO: 148438 - DNA, 6 bp, Unknown
  misc_feature (1)..( 6): Result.004 file - promoters60/5665283
tatttt

SEQ ID NO: 148439 - DNA, 6 bp, Unknown
  misc_feature (1)..( 6): Result.004 file - promoters60/5665283
tatttt

SEQ ID NO: 148440 - DNA, 13 bp, Unknown
  misc_feature (1)..( 13): Result.004 file - promoters60/5665283
attggatagatat

SEQ ID NO: 148441 - DNA, 13 bp, Unknown
  misc_feature (1)..( 13): Result.004 file - promoters60/5665283
attgtatacatat

SEQ ID NO: 148442 - DNA, 6 bp, Unknown
  misc_feature (1)..( 6): Result.004 file - promoters60/5665283
gaacat

SEQ ID NO: 148443 - DNA, 6 bp, Unknown
  misc_feature (1)..( 6): Result.004 file - promoters60/5665283
gaacat

SEQ ID NO: 148444 - DNA, 6 bp, Unknown
  misc_feature (1)..( 6): Result.004 file - promoters60/5665283
tttata

SEQ ID NO: 148445 - DNA, 6 bp, Unknown
  misc_feature (1)..( 6): Result.004 file - promoters60/5665283
tttata

SEQ ID NO: 148446 - DNA, 8 bp, Unknown
  misc_feature (1)..( 8): Result.004 file - promoters60/5665283
aatcttta

SEQ ID NO: 148447 - DNA, 8 bp, Unknown
  misc_feature (1)..( 8): Result.004 file - promoters60/5665283
aatgttta

SEQ ID NO: 148448 - DNA, 6 bp, Unknown
  misc_feature (1)..( 6): Result.004 file - promoters60/5665283
ttaata

SEQ ID NO: 148449 - DNA, 6 bp, Unknown
  misc_feature (1)..( 6): Result.004 file - promoters60/5665283
ttaata

SEQ ID NO: 148450 - DNA, 7 bp, Unknown
  misc_feature (1)..( 7): Result.004 file - promoters60/5665283
taacgct

SEQ ID NO: 148451 - DNA, 7 bp, Unknown
  misc_feature (1)..( 7): Result.004 file - promoters60/5665283
taatgct

SEQ ID NO: 148452 - DNA, 6 bp, Unknown
  misc_feature (1)..( 6): Result.004 file - promoters60/5665283
aacaac

SEQ ID NO: 148453 - DNA, 6 bp, Unknown
  misc_feature (1)..( 6): Result.004 file - promoters60/5665283
aacaac

SEQ ID NO: 148454 - DNA, 8 bp, Unknown
  misc_feature (1)..( 8): Result.004 file - promoters60/5665283
gtaataat

SEQ ID NO: 148455 - DNA, 8 bp, Unknown
  misc_feature (1)..( 8): Result.004 file - promoters60/5665314
gtattaat

SEQ ID NO: 148456 - DNA, 7 bp, Unknown
  misc_feature (1)..( 7): Result.004 file - promoters60/5665314
aaataaa

SEQ ID NO: 148457 - DNA, 7 bp, Unknown
  misc_feature (1)..( 7): Result.004 file - promoters60/5665314
aaacaaa

SEQ ID NO: 148458 - DNA, 7 bp, Unknown
  misc_feature (1)..( 7): Result.004 file - promoters60/5665314
aaatgaa

SEQ ID NO: 148459 - DNA, 7 bp, Unknown
  misc_feature (1)..( 7): Result.004 file - promoters60/5665314
aaaagaa

SEQ ID NO: 148460 - DNA, 6 bp, Unknown
  misc_feature (1)..( 6): Result.004 file - promoters60/5665314
gacaaa

SEQ ID NO: 148461 - DNA, 6 bp, Unknown
  misc_feature (1)..( 6): Result.004 file - promoters60/5665314
gacaaa

SEQ ID NO: 148462 - DNA, 8 bp, Unknown
  misc_feature (1)..( 8): Result.004 file - promoters60/5665314
ttttttat

SEQ ID NO: 148463 - DNA, 8 bp, Unknown
  misc_feature (1)..( 8): Result.004 file - promoters60/5665314
tttattat

SEQ ID NO: 148464 - DNA, 7 bp, Unknown
  misc_feature (1)..( 7): Result.004 file - promoters60/5665314
aactgaa

SEQ ID NO: 148465 - DNA, 7 bp, Unknown
  misc_feature (1)..( 7): Result.004 file - promoters60/5665314
aacagaa

SEQ ID NO: 148466 - DNA, 8 bp, Unknown
  misc_feature (1)..( 8): Result.004 file - promoters60/5665314
ttttgata

SEQ ID NO: 148467 - DNA, 8 bp, Unknown
  misc_feature (1)..( 8): Result.004 file - promoters60/5665314
ttttgagt

SEQ ID NO: 148468 - DNA, 8 bp, Unknown
  misc_feature (1)..( 8): Result.004 file - promoters60/5665314
gtttgagt

SEQ ID NO: 148469 - DNA, 7 bp, Unknown
  misc_feature (1)..( 7): Result.004 file - promoters60/5665314
tgtctct

SEQ ID NO: 148470 - DNA, 7 bp, Unknown
  misc_feature (1)..( 7): Result.004 file - promoters60/5665314
tgtatct

SEQ ID NO: 148471 - DNA, 6 bp, Unknown
  misc_feature (1)..( 6): Result.004 file - promoters60/5665314
taataa

SEQ ID NO: 148472 - DNA, 6 bp, Unknown
  misc_feature (1)..( 6): Result.004 file - promoters60/5665314
taataa

SEQ ID NO: 148473 - DNA, 8 bp, Unknown
  misc_feature (1)..( 8): Result.004 file - promoters60/5665314
taaaggat

SEQ ID NO: 148474 - DNA, 8 bp, Unknown
  misc_feature (1)..( 8): Result.004 file - promoters60/5665314
taaaggag

SEQ ID NO: 148475 - DNA, 8 bp, Unknown
  misc_feature (1)..( 8): Result.004 file - promoters60/5665314
agaaggag

SEQ ID NO: 148476 - DNA, 6 bp, Unknown
  misc_feature (1)..( 6): Result.004 file - promoters60/5665314
ttcctg

SEQ ID NO: 148477 - DNA, 6 bp, Unknown
  misc_feature (1)..( 6): Result.004 file - promoters60/5665314
ttcctg

SEQ ID NO: 148478 - DNA, 10 bp, Unknown
  misc_feature (1)..( 10): Result.004 file - promoters60/5665314
gggtttatga

SEQ ID NO: 148479 - DNA, 10 bp, Unknown
  misc_feature (1)..( 10): Result.004 file - promoters60/5665314
gggtttgtga

SEQ ID NO: 148480 - DNA, 8 bp, Unknown
  misc_feature (1)..( 8): Result.004 file - promoters60/5665314
tggaggaa

SEQ ID NO: 148481 - DNA, 8 bp, Unknown
  misc_feature (1)..( 8): Result.004 file - promoters60/5665314
tggaagaa

SEQ ID NO: 148482 - DNA, 6 bp, Unknown
  misc_feature (1)..( 6): Result.004 file - promoters60/5665314
acctgt

SEQ ID NO: 148483 - DNA, 6 bp, Unknown
  misc_feature (1)..( 6): Result.004 file - promoters60/5665314
acctgt

SEQ ID NO: 148484 - DNA, 6 bp, Unknown
  misc_feature (1)..( 6): Result.004 file - promoters60/5665314
cacaag

SEQ ID NO: 148485 - DNA, 6 bp, Unknown
  misc_feature (1)..( 6): Result.004 file - promoters60/5665314
cacaag

SEQ ID NO: 148486 - DNA, 7 bp, Unknown
  misc_feature (1)..( 7): Result.004 file - promoters60/5665314
gaagctt

SEQ ID NO: 148487 - DNA, 7 bp, Unknown
  misc_feature (1)..( 7): Result.004 file - promoters60/5665326
gaatctt

SEQ ID NO: 148488 - DNA, 13 bp, Unknown
  misc_feature (1)..( 13): Result.004 file - promoters60/5665326
aatgaatattaga

SEQ ID NO: 148489 - DNA, 13 bp, Unknown
  misc_feature (1)..( 13): Result.004 file - promoters60/5665326
aattaatgacgat

SEQ ID NO: 148490 - DNA, 13 bp, Unknown
  misc_feature (1)..( 13): Result.004 file - promoters60/5665326
gatgaattccggt

SEQ ID NO: 148491 - DNA, 13 bp, Unknown
  misc_feature (1)..( 13): Result.004 file - promoters60/5665326
tctgaatattaga

SEQ ID NO: 148492 - DNA, 13 bp, Unknown
  misc_feature (1)..( 13): Result.004 file - promoters60/5665326
atataataaatag

SEQ ID NO: 148493 - DNA, 13 bp, Unknown
  misc_feature (1)..( 13): Result.004 file - promoters60/5665326
gcataaaaaataa

SEQ ID NO: 148494 - DNA, 13 bp, Unknown
  misc_feature (1)..( 13): Result.004 file - promoters60/5665326
ttattatacttct

SEQ ID NO: 148495 - DNA, 13 bp, Unknown
  misc_feature (1)..( 13): Result.004 file - promoters60/5665326
tcacaatgaatgg

SEQ ID NO: 148496 - DNA, 13 bp, Unknown
  misc_feature (1)..( 13): Result.004 file - promoters60/5665326
atataattatctc

SEQ ID NO: 148497 - DNA, 13 bp, Unknown
  misc_feature (1)..( 13): Result.004 file - promoters60/5665326
ttgaaatcattat

SEQ ID NO: 148498 - DNA, 10 bp, Unknown
  misc_feature (1)..( 10): Result.004 file - promoters60/5665326
gtatatatat

SEQ ID NO: 148499 - DNA, 10 bp, Unknown
  misc_feature (1)..( 10): Result.004 file - promoters60/5665326
aaataaatag

SEQ ID NO: 148500 - DNA, 10 bp, Unknown
  misc_feature (1)..( 10): Result.004 file - promoters60/5665326
caatgaatgg

SEQ ID NO: 148501 - DNA, 10 bp, Unknown
  misc_feature (1)..( 10): Result.004 file - promoters60/5665326
aaatatataa

SEQ ID NO: 148502 - DNA, 10 bp, Unknown
  misc_feature (1)..( 10): Result.004 file - promoters60/5665326
gaaaaaataa

SEQ ID NO: 148503 - DNA, 9 bp, Unknown
  misc_feature (1)..( 9): Result.004 file - promoters60/5665326
aaattaata

SEQ ID NO: 148504 - DNA, 9 bp, Unknown
  misc_feature (1)..( 9): Result.004 file - promoters60/5665326
taattaagt

SEQ ID NO: 148505 - DNA, 9 bp, Unknown
  misc_feature (1)..( 9): Result.004 file - promoters60/5665326
aaatcaata

SEQ ID NO: 148506 - DNA, 9 bp, Unknown
  misc_feature (1)..( 9): Result.004 file - promoters60/5665326
aaaataaaa

SEQ ID NO: 148507 - DNA, 9 bp, Unknown
  misc_feature (1)..( 9): Result.004 file - promoters60/5665326
taattatta

SEQ ID NO: 148508 - DNA, 9 bp, Unknown
  misc_feature (1)..( 9): Result.004 file - promoters60/5665326
tgttatata

SEQ ID NO: 148509 - DNA, 9 bp, Unknown
  misc_feature (1)..( 9): Result.004 file - promoters60/5665326
ctttatata

SEQ ID NO: 148510 - DNA, 9 bp, Unknown
  misc_feature (1)..( 9): Result.004 file - promoters60/5665326
tattatata

SEQ ID NO: 148511 - DNA, 9 bp, Unknown
  misc_feature (1)..( 9): Result.004 file - promoters60/5665326
ctttataca

SEQ ID NO: 148512 - DNA, 9 bp, Unknown
  misc_feature (1)..( 9): Result.004 file - promoters60/5665326
aaactatac

SEQ ID NO: 148513 - DNA, 9 bp, Unknown
  misc_feature (1)..( 9): Result.004 file - promoters60/5665326
ttactttac

SEQ ID NO: 148514 - DNA, 9 bp, Unknown
  misc_feature (1)..( 9): Result.004 file - promoters60/5665326
atacttttt

SEQ ID NO: 148515 - DNA, 9 bp, Unknown
  misc_feature (1)..( 9): Result.004 file - promoters60/5665326
atacttttt

SEQ ID NO: 148516 - DNA, 9 bp, Unknown
  misc_feature (1)..( 9): Result.004 file - promoters60/5665326
tttgttggt

SEQ ID NO: 148517 - DNA, 9 bp, Unknown
  misc_feature (1)..( 9): Result.004 file - promoters60/5665326
tttgttggt

SEQ ID NO: 148518 - DNA, 9 bp, Unknown
  misc_feature (1)..( 9): Result.004 file - promoters60/5665326
tttattgat

SEQ ID NO: 148519 - DNA, 9 bp, Unknown
  misc_feature (1)..( 9): Result.004 file - promoters60/5665326
gttactgat

SEQ ID NO: 148520 - DNA, 9 bp, Unknown
  misc_feature (1)..( 9): Result.004 file - promoters60/5665326
aatatatat

SEQ ID NO: 148521 - DNA, 9 bp, Unknown
  misc_feature (1)..( 9): Result.004 file - promoters60/5665326
aatttattt

SEQ ID NO: 148522 - DNA, 9 bp, Unknown
  misc_feature (1)..( 9): Result.004 file - promoters60/5665326
gctttgttt

SEQ ID NO: 148523 - DNA, 9 bp, Unknown
  misc_feature (1)..( 9): Result.004 file - promoters60/5665326
catttgttt

SEQ ID NO: 148524 - DNA, 10 bp, Unknown
  misc_feature (1)..( 10): Result.004 file - promoters60/5665326
catttttaag

SEQ ID NO: 148525 - DNA, 10 bp, Unknown
  misc_feature (1)..( 10): Result.004 file - promoters60/5665326
tatttttttt

SEQ ID NO: 148526 - DNA, 10 bp, Unknown
  misc_feature (1)..( 10): Result.004 file - promoters60/5665326
catctttgcc

SEQ ID NO: 148527 - DNA, 10 bp, Unknown
  misc_feature (1)..( 10): Result.004 file - promoters60/5665343
actttttttt

SEQ ID NO: 148528 - DNA, 8 bp, Unknown
  misc_feature (1)..( 8): Result.004 file - promoters60/5665343
ttttttta

SEQ ID NO: 148529 - DNA, 8 bp, Unknown
  misc_feature (1)..( 8): Result.004 file - promoters60/5665343
tttttttt

SEQ ID NO: 148530 - DNA, 8 bp, Unknown
  misc_feature (1)..( 8): Result.004 file - promoters60/5665343
ttttttta

SEQ ID NO: 148531 - DNA, 8 bp, Unknown
  misc_feature (1)..( 8): Result.004 file - promoters60/5665343
tttaagtt

SEQ ID NO: 148532 - DNA, 8 bp, Unknown
  misc_feature (1)..( 8): Result.004 file - promoters60/5665343
cctaagtt

SEQ ID NO: 148533 - DNA, 8 bp, Unknown
  misc_feature (1)..( 8): Result.004 file - promoters60/5665343
ttttagtg

SEQ ID NO: 148534 - DNA, 8 bp, Unknown
  misc_feature (1)..( 8): Result.004 file - promoters60/5665343
acttcttt

SEQ ID NO: 148535 - DNA, 8 bp, Unknown
  misc_feature (1)..( 8): Result.004 file - promoters60/5665343
actactta

SEQ ID NO: 148536 - DNA, 8 bp, Unknown
  misc_feature (1)..( 8): Result.004 file - promoters60/5665343
acttattt

SEQ ID NO: 148537 - DNA, 7 bp, Unknown
  misc_feature (1)..( 7): Result.004 file - promoters60/5665343
ttgattc

SEQ ID NO: 148538 - DNA, 7 bp, Unknown
  misc_feature (1)..( 7): Result.004 file - promoters60/5665343
ttgtttc

SEQ ID NO: 148539 - DNA, 7 bp, Unknown
  misc_feature (1)..( 7): Result.004 file - promoters60/5665343
ttgttta

SEQ ID NO: 148540 - DNA, 13 bp, Unknown
  misc_feature (1)..( 13): Result.004 file - promoters60/5665343
ctaaaaactatga

SEQ ID NO: 148541 - DNA, 13 bp, Unknown
  misc_feature (1)..( 13): Result.004 file - promoters60/5665343
aaaaaaactagtt

SEQ ID NO: 148542 - DNA, 13 bp, Unknown
  misc_feature (1)..( 13): Result.004 file - promoters60/5665343
ctaaatactttga

SEQ ID NO: 148543 - DNA, 7 bp, Unknown
  misc_feature (1)..( 7): Result.004 file - promoters60/5665343
gaagaaa

SEQ ID NO: 148544 - DNA, 7 bp, Unknown
  misc_feature (1)..( 7): Result.004 file - promoters60/5665343
gaaaaaa

SEQ ID NO: 148545 - DNA, 7 bp, Unknown
  misc_feature (1)..( 7): Result.004 file - promoters60/5665343
gaggaaa

SEQ ID NO: 148546 - DNA, 8 bp, Unknown
  misc_feature (1)..( 8): Result.004 file - promoters60/5665343
ttatttta

SEQ ID NO: 148547 - DNA, 8 bp, Unknown
  misc_feature (1)..( 8): Result.004 file - promoters60/5665343
ttattttt

SEQ ID NO: 148548 - DNA, 8 bp, Unknown
  misc_feature (1)..( 8): Result.004 file - promoters60/5665351
acatttta

SEQ ID NO: 148549 - DNA, 7 bp, Unknown
  misc_feature (1)..( 7): Result.004 file - promoters60/5665351
ccatttc

SEQ ID NO: 148550 - DNA, 7 bp, Unknown
  misc_feature (1)..( 7): Result.004 file - promoters60/5665351
gcatttc

SEQ ID NO: 148551 - DNA, 7 bp, Unknown
  misc_feature (1)..( 7): Result.004 file - promoters60/5665351
gcatttg

SEQ ID NO: 148552 - DNA, 8 bp, Unknown
  misc_feature (1)..( 8): Result.004 file - promoters60/5665351
caaatgaa

SEQ ID NO: 148553 - DNA, 8 bp, Unknown
  misc_feature (1)..( 8): Result.004 file - promoters60/5665351
caaatggt

SEQ ID NO: 148554 - DNA, 8 bp, Unknown
  misc_feature (1)..( 8): Result.004 file - promoters60/5665351
aaaaggaa

SEQ ID NO: 148555 - DNA, 6 bp, Unknown
  misc_feature (1)..( 6): Result.004 file - promoters60/5665351
accatt

SEQ ID NO: 148556 - DNA, 6 bp, Unknown
  misc_feature (1)..( 6): Result.004 file - promoters60/5665351
accatt

SEQ ID NO: 148557 - DNA, 6 bp, Unknown
  misc_feature (1)..( 6): Result.004 file - promoters60/5665351
atcttt

SEQ ID NO: 148558 - DNA, 6 bp, Unknown
  misc_feature (1)..( 6): Result.004 file - promoters60/5665351
atcttt

SEQ ID NO: 148559 - DNA, 7 bp, Unknown
  misc_feature (1)..( 7): Result.004 file - promoters60/5665351
tgaaatt

SEQ ID NO: 148560 - DNA, 7 bp, Unknown
  misc_feature (1)..( 7): Result.004 file - promoters60/5665351
tgatatt

SEQ ID NO: 148561 - DNA, 9 bp, Unknown
  misc_feature (1)..( 9): Result.004 file - promoters60/5665351
cttcttctc

SEQ ID NO: 148562 - DNA, 9 bp, Unknown
  misc_feature (1)..( 9): Result.004 file - promoters60/5665351
tttcttctt

SEQ ID NO: 148563 - DNA, 9 bp, Unknown
  misc_feature (1)..( 9): Result.004 file - promoters60/5665351
cttattctc

SEQ ID NO: 148564 - DNA, 6 bp, Unknown
  misc_feature (1)..( 6): Result.004 file - promoters60/5665351
tattat

SEQ ID NO: 148565 - DNA, 6 bp, Unknown
  misc_feature (1)..( 6): Result.004 file - promoters60/5665351
tattat

SEQ ID NO: 148566 - DNA, 7 bp, Unknown
  misc_feature (1)..( 7): Result.004 file - promoters60/5665351
tatttga

SEQ ID NO: 148567 - DNA, 7 bp, Unknown
  misc_feature (1)..( 7): Result.004 file - promoters60/5665351
tatatga

SEQ ID NO: 148568 - DNA, 6 bp, Unknown
  misc_feature (1)..( 6): Result.004 file - promoters60/5665351
atcaac

SEQ ID NO: 148569 - DNA, 6 bp, Unknown
  misc_feature (1)..( 6): Result.004 file - promoters60/5665351
atcaac

SEQ ID NO: 148570 - DNA, 8 bp, Unknown
  misc_feature (1)..( 8): Result.004 file - promoters60/5665351
cgaatcca

SEQ ID NO: 148571 - DNA, 8 bp, Unknown
  misc_feature (1)..( 8): Result.004 file - promoters60/5665351
cgaaacca

SEQ ID NO: 148572 - DNA, 7 bp, Unknown
  misc_feature (1)..( 7): Result.004 file - promoters60/5665351
agggatc

SEQ ID NO: 148573 - DNA, 7 bp, Unknown
  misc_feature (1)..( 7): Result.004 file - promoters60/5665351
aggaatc

SEQ ID NO: 148574 - DNA, 6 bp, Unknown
  misc_feature (1)..( 6): Result.004 file - promoters60/5665351
cttctt

SEQ ID NO: 148575 - DNA, 6 bp, Unknown
  misc_feature (1)..( 6): Result.004 file - promoters60/5665351
cttctt

SEQ ID NO: 148576 - DNA, 9 bp, Unknown
  misc_feature (1)..( 9): Result.004 file - promoters60/5665351
aaggttgtt

SEQ ID NO: 148577 - DNA, 9 bp, Unknown
  misc_feature (1)..( 9): Result.004 file - promoters60/5665351
aagattgtt

SEQ ID NO: 148578 - DNA, 6 bp, Unknown
  misc_feature (1)..( 6): Result.004 file - promoters60/5665351
tgatct

SEQ ID NO: 148579 - DNA, 6 bp, Unknown
  misc_feature (1)..( 6): Result.004 file - promoters60/5665351
tgatct

SEQ ID NO: 148580 - DNA, 7 bp, Unknown
  misc_feature (1)..( 7): Result.004 file - promoters60/5665351
tggtaat

SEQ ID NO: 148581 - DNA, 7 bp, Unknown
  misc_feature (1)..( 7): Result.004 file - promoters60/5665359
tggtaat

SEQ ID NO: 148582 - DNA, 6 bp, Unknown
  misc_feature (1)..( 6): Result.004 file - promoters60/5665359
aattct

SEQ ID NO: 148583 - DNA, 6 bp, Unknown
  misc_feature (1)..( 6): Result.004 file - promoters60/5665359
aattct

SEQ ID NO: 148584 - DNA, 7 bp, Unknown
  misc_feature (1)..( 7): Result.004 file - promoters60/5665359
aaaaatt

SEQ ID NO: 148585 - DNA, 7 bp, Unknown
  misc_feature (1)..( 7): Result.004 file - promoters60/5665359
caaaatt

SEQ ID NO: 148586 - DNA, 7 bp, Unknown
  misc_feature (1)..( 7): Result.004 file - promoters60/5665359
aaaaata

SEQ ID NO: 148587 - DNA, 7 bp, Unknown
  misc_feature (1)..( 7): Result.004 file - promoters60/5665359
tttgaga

SEQ ID NO: 148588 - DNA, 7 bp, Unknown
  misc_feature (1)..( 7): Result.004 file - promoters60/5665359
tttgaga

SEQ ID NO: 148589 - DNA, 6 bp, Unknown
  misc_feature (1)..( 6): Result.004 file - promoters60/5665359
gaactt

SEQ ID NO: 148590 - DNA, 6 bp, Unknown
  misc_feature (1)..( 6): Result.004 file - promoters60/5665359
gaactt

SEQ ID NO: 148591 - DNA, 7 bp, Unknown
  misc_feature (1)..( 7): Result.004 file - promoters60/5665359
gagaaaa

SEQ ID NO: 148592 - DNA, 7 bp, Unknown
  misc_feature (1)..( 7): Result.004 file - promoters60/5665359
gagaaaa

SEQ ID NO: 148593 - DNA, 7 bp, Unknown
  misc_feature (1)..( 7): Result.004 file - promoters60/5665359
gttattt

SEQ ID NO: 148594 - DNA, 7 bp, Unknown
  misc_feature (1)..( 7): Result.004 file - promoters60/5665359
gttgttt

SEQ ID NO: 148595 - DNA, 8 bp, Unknown
  misc_feature (1)..( 8): Result.004 file - promoters60/5665359
tttaattt

SEQ ID NO: 148596 - DNA, 6 bp, Unknown
  misc_feature (1)..( 6): Result.004 file - promoters60/5665359
tattgt

SEQ ID NO: 148597 - DNA, 6 bp, Unknown
  misc_feature (1)..( 6): Result.004 file - promoters60/5665359
tattgt

SEQ ID NO: 148598 - DNA, 6 bp, Unknown
  misc_feature (1)..( 6): Result.004 file - promoters60/5665359
tattgt

SEQ ID NO: 148599 - DNA, 9 bp, Unknown
  misc_feature (1)..( 9): Result.004 file - promoters60/5665359
attgttttg

SEQ ID NO: 148600 - DNA, 9 bp, Unknown
  misc_feature (1)..( 9): Result.004 file - promoters60/5665359
aaagttttg

SEQ ID NO: 148601 - DNA, 9 bp, Unknown
  misc_feature (1)..( 9): Result.004 file - promoters60/5665359
ttggtttat

SEQ ID NO: 148602 - DNA, 8 bp, Unknown
  misc_feature (1)..( 8): Result.004 file - promoters60/5665359
aaaatata

SEQ ID NO: 148603 - DNA, 8 bp, Unknown
  misc_feature (1)..( 8): Result.004 file - promoters60/5665359
aaaatata

SEQ ID NO: 148604 - DNA, 6 bp, Unknown
  misc_feature (1)..( 6): Result.004 file - promoters60/5665359
ttaatt

SEQ ID NO: 148605 - DNA, 6 bp, Unknown
  misc_feature (1)..( 6): Result.004 file - promoters60/5665359
ttaatt

SEQ ID NO: 148606 - DNA, 6 bp, Unknown
  misc_feature (1)..( 6): Result.004 file - promoters60/5665359
cagaag

SEQ ID NO: 148607 - DNA, 6 bp, Unknown
  misc_feature (1)..( 6): Result.004 file - promoters60/5665359
cagaag

SEQ ID NO: 148608 - DNA, 7 bp, Unknown
  misc_feature (1)..( 7): Result.004 file - promoters60/5665359
aatctct

SEQ ID NO: 148609 - DNA, 7 bp, Unknown
  misc_feature (1)..( 7): Result.004 file - promoters60/5665359
aatctct

SEQ ID NO: 148610 - DNA, 10 bp, Unknown
  misc_feature (1)..( 10): Result.004 file - promoters60/5665359
aaagatttct

SEQ ID NO: 148611 - DNA, 10 bp, Unknown
  misc_feature (1)..( 10): Result.004 file - promoters60/5665359
aaaggtttct

SEQ ID NO: 148612 - DNA, 6 bp, Unknown
  misc_feature (1)..( 6): Result.004 file - promoters60/5665359
actttg

SEQ ID NO: 148613 - DNA, 6 bp, Unknown
  misc_feature (1)..( 6): Result.004 file - promoters60/5665359
actttg

SEQ ID NO: 148614 - DNA, 6 bp, Unknown
  misc_feature (1)..( 6): Result.004 file - promoters60/5665359
tttatt

SEQ ID NO: 148615 - DNA, 6 bp, Unknown
  misc_feature (1)..( 6): Result.004 file - promoters60/5665359
tttatt

SEQ ID NO: 148616 - DNA, 8 bp, Unknown
  misc_feature (1)..( 8): Result.004 file - promoters60/5665359
taaagttt

SEQ ID NO: 148617 - DNA, 8 bp, Unknown
  misc_feature (1)..( 8): Result.004 file - promoters60/5665359
taaaattt

SEQ ID NO: 148618 - DNA, 6 bp, Unknown
  misc_feature (1)..( 6): Result.004 file - promoters60/5665359
gtatca

SEQ ID NO: 148619 - DNA, 6 bp, Unknown
  misc_feature (1)..( 6): Result.004 file - promoters60/5665367
gtatca

SEQ ID NO: 148620 - DNA, 8 bp, Unknown
  misc_feature (1)..( 8): Result.004 file - promoters60/5665367
tcgctgaa

SEQ ID NO: 148621 - DNA, 8 bp, Unknown
  misc_feature (1)..( 8): Result.004 file - promoters60/5665367
tcggtgaa

SEQ ID NO: 148622 - DNA, 7 bp, Unknown
  misc_feature (1)..( 7): Result.004 file - promoters60/5665367
aaataaa

SEQ ID NO: 148623 - DNA, 7 bp, Unknown
  misc_feature (1)..( 7): Result.004 file - promoters60/5665367
aaataaa

SEQ ID NO: 148624 - DNA, 8 bp, Unknown
  misc_feature (1)..( 8): Result.004 file - promoters60/5665367
tatgactt

SEQ ID NO: 148625 - DNA, 8 bp, Unknown
  misc_feature (1)..( 8): Result.004 file - promoters60/5665367
tatggctt

SEQ ID NO: 148626 - DNA, 7 bp, Unknown
  misc_feature (1)..( 7): Result.004 file - promoters60/5665367
ggaaaaa

SEQ ID NO: 148627 - DNA, 7 bp, Unknown
  misc_feature (1)..( 7): Result.004 file - promoters60/5665367
ggacaaa

SEQ ID NO: 148628 - DNA, 8 bp, Unknown
  misc_feature (1)..( 8): Result.004 file - promoters60/5665367
tatatata

SEQ ID NO: 148629 - DNA, 8 bp, Unknown
  misc_feature (1)..( 8): Result.004 file - promoters60/5665367
tatatata

SEQ ID NO: 148630 - DNA, 8 bp, Unknown
  misc_feature (1)..( 8): Result.004 file - promoters60/5665367
tatataaa

SEQ ID NO: 148631 - DNA, 9 bp, Unknown
  misc_feature (1)..( 9): Result.004 file - promoters60/5665367
taatagttt

SEQ ID NO: 148632 - DNA, 9 bp, Unknown
  misc_feature (1)..( 9): Result.004 file - promoters60/5665367
taagagttt

SEQ ID NO: 148633 - DNA, 8 bp, Unknown
  misc_feature (1)..( 8): Result.004 file - promoters60/5665367
aggaattc

SEQ ID NO: 148634 - DNA, 8 bp, Unknown
  misc_feature (1)..( 8): Result.004 file - promoters60/5665367
agggattc

SEQ ID NO: 148635 - DNA, 7 bp, Unknown
  misc_feature (1)..( 7): Result.004 file - promoters60/5665367
actttcg

SEQ ID NO: 148636 - DNA, 7 bp, Unknown
  misc_feature (1)..( 7): Result.004 file - promoters60/5665367
actatcg

SEQ ID NO: 148637 - DNA, 7 bp, Unknown
  misc_feature (1)..( 7): Result.004 file - promoters60/5665367
taaaatg

SEQ ID NO: 148638 - DNA, 7 bp, Unknown
  misc_feature (1)..( 7): Result.004 file - promoters60/5665367
taacatg

SEQ ID NO: 148639 - DNA, 7 bp, Unknown
  misc_feature (1)..( 7): Result.004 file - promoters60/5665367
aaaatag

SEQ ID NO: 148640 - DNA, 7 bp, Unknown
  misc_feature (1)..( 7): Result.004 file - promoters60/5665367
aaattag

SEQ ID NO: 148641 - DNA, 9 bp, Unknown
  misc_feature (1)..( 9): Result.004 file - promoters60/5665367
attctattt

SEQ ID NO: 148642 - DNA, 9 bp, Unknown
  misc_feature (1)..( 9): Result.004 file - promoters60/5665367
attctcttt

SEQ ID NO: 148643 - DNA, 7 bp, Unknown
  misc_feature (1)..( 7): Result.004 file - promoters60/5665367
ctagata

SEQ ID NO: 148644 - DNA, 7 bp, Unknown
  misc_feature (1)..( 7): Result.004 file - promoters60/5665367
ttagata

SEQ ID NO: 148645 - DNA, 7 bp, Unknown
  misc_feature (1)..( 7): Result.004 file - promoters60/5665367
ttaaata

SEQ ID NO: 148646 - DNA, 7 bp, Unknown
  misc_feature (1)..( 7): Result.004 file - promoters60/5665367
ttatttc

SEQ ID NO: 148647 - DNA, 7 bp, Unknown
  misc_feature (1)..( 7): Result.004 file - promoters60/5665367
ttagttc

SEQ ID NO: 148648 - DNA, 7 bp, Unknown
  misc_feature (1)..( 7): Result.004 file - promoters60/5665367
acaaaat

SEQ ID NO: 148649 - DNA, 7 bp, Unknown
  misc_feature (1)..( 7): Result.004 file - promoters60/5665367
acaaaat

SEQ ID NO: 148650 - DNA, 6 bp, Unknown
  misc_feature (1)..( 6): Result.004 file - promoters60/5665367
aaaata

SEQ ID NO: 148651 - DNA, 6 bp, Unknown
  misc_feature (1)..( 6): Result.004 file - promoters60/5665367
aaaata

SEQ ID NO: 148652 - DNA, 7 bp, Unknown
  misc_feature (1)..( 7): Result.004 file - promoters60/5665367
aaacgaa

SEQ ID NO: 148653 - DNA, 7 bp, Unknown
  misc_feature (1)..( 7): Result.004 file - promoters60/5665367
aaatgaa

SEQ ID NO: 148654 - DNA, 6 bp, Unknown
  misc_feature (1)..( 6): Result.004 file - promoters60/5665367
taaaaa

SEQ ID NO: 148655 - DNA, 6 bp, Unknown
  misc_feature (1)..( 6): Result.004 file - promoters60/5665367
taaaaa

SEQ ID NO: 148656 - DNA, 7 bp, Unknown
  misc_feature (1)..( 7): Result.004 file - promoters60/5665367
ggttaga

SEQ ID NO: 148657 - DNA, 7 bp, Unknown
  misc_feature (1)..( 7): Result.004 file - promoters60/5665367
ggtgaga

SEQ ID NO: 148658 - DNA, 6 bp, Unknown
  misc_feature (1)..( 6): Result.004 file - promoters60/5665367
gagaaa

SEQ ID NO: 148659 - DNA, 6 bp, Unknown
  misc_feature (1)..( 6): Result.004 file - promoters60/5665374
gagaaa

SEQ ID NO: 148660 - DNA, 7 bp, Unknown
  misc_feature (1)..( 7): Result.004 file - promoters60/5665374
taaaaca

SEQ ID NO: 148661 - DNA, 7 bp, Unknown
  misc_feature (1)..( 7): Result.004 file - promoters60/5665374
taataca

SEQ ID NO: 148662 - DNA, 8 bp, Unknown
  misc_feature (1)..( 8): Result.004 file - promoters60/5665374
agatcaaa

SEQ ID NO: 148663 - DNA, 8 bp, Unknown
  misc_feature (1)..( 8): Result.004 file - promoters60/5665374
ttatcaaa

SEQ ID NO: 148664 - DNA, 8 bp, Unknown
  misc_feature (1)..( 8): Result.004 file - promoters60/5665374
ttaccaat

SEQ ID NO: 148665 - DNA, 7 bp, Unknown
  misc_feature (1)..( 7): Result.004 file - promoters60/5665374
tacagct

SEQ ID NO: 148666 - DNA, 7 bp, Unknown
  misc_feature (1)..( 7): Result.004 file - promoters60/5665374
tactgct

SEQ ID NO: 148667 - DNA, 6 bp, Unknown
  misc_feature (1)..( 6): Result.004 file - promoters60/5665374
ccacta

SEQ ID NO: 148668 - DNA, 6 bp, Unknown
  misc_feature (1)..( 6): Result.004 file - promoters60/5665374
ccacta

SEQ ID NO: 148669 - DNA, 10 bp, Unknown
  misc_feature (1)..( 10): Result.004 file - promoters60/5665374
gctatctaaa

SEQ ID NO: 148670 - DNA, 10 bp, Unknown
  misc_feature (1)..( 10): Result.004 file - promoters60/5665374
actatctaaa

SEQ ID NO: 148671 - DNA, 10 bp, Unknown
  misc_feature (1)..( 10): Result.004 file - promoters60/5665374
actttctctg

SEQ ID NO: 148672 - DNA, 7 bp, Unknown
  misc_feature (1)..( 7): Result.004 file - promoters60/5665374
aaaatta

SEQ ID NO: 148673 - DNA, 7 bp, Unknown
  misc_feature (1)..( 7): Result.004 file - promoters60/5665374
aaaatta

SEQ ID NO: 148674 - DNA, 7 bp, Unknown
  misc_feature (1)..( 7): Result.004 file - promoters60/5665374
aattgac

SEQ ID NO: 148675 - DNA, 7 bp, Unknown
  misc_feature (1)..( 7): Result.004 file - promoters60/5665374
aatggac

SEQ ID NO: 148676 - DNA, 7 bp, Unknown
  misc_feature (1)..( 7): Result.004 file - promoters60/5665374
aataaat

SEQ ID NO: 148677 - DNA, 7 bp, Unknown
  misc_feature (1)..( 7): Result.004 file - promoters60/5665374
aataaat

SEQ ID NO: 148678 - DNA, 7 bp, Unknown
  misc_feature (1)..( 7): Result.004 file - promoters60/5665374
tatgtga

SEQ ID NO: 148679 - DNA, 7 bp, Unknown
  misc_feature (1)..( 7): Result.004 file - promoters60/5665374
tatatga

SEQ ID NO: 148680 - DNA, 7 bp, Unknown
  misc_feature (1)..( 7): Result.004 file - promoters60/5665374
aaatcaa

SEQ ID NO: 148681 - DNA, 7 bp, Unknown
  misc_feature (1)..( 7): Result.004 file - promoters60/5665374
aaaccaa

SEQ ID NO: 148682 - DNA, 6 bp, Unknown
  misc_feature (1)..( 6): Result.004 file - promoters60/5665374
tttttg

SEQ ID NO: 148683 - DNA, 6 bp, Unknown
  misc_feature (1)..( 6): Result.004 file - promoters60/5665374
tttttg

SEQ ID NO: 148684 - DNA, 8 bp, Unknown
  misc_feature (1)..( 8): Result.004 file - promoters60/5665374
aattacca

SEQ ID NO: 148685 - DNA, 8 bp, Unknown
  misc_feature (1)..( 8): Result.004 file - promoters60/5665374
aataacca

SEQ ID NO: 148686 - DNA, 6 bp, Unknown
  misc_feature (1)..( 6): Result.004 file - promoters60/5665374
aaatca

SEQ ID NO: 148687 - DNA, 6 bp, Unknown
  misc_feature (1)..( 6): Result.004 file - promoters60/5665374
aaatca

SEQ ID NO: 148688 - DNA, 6 bp, Unknown
  misc_feature (1)..( 6): Result.004 file - promoters60/5665374
ccaaaa

SEQ ID NO: 148689 - DNA, 6 bp, Unknown
  misc_feature (1)..( 6): Result.004 file - promoters60/5665374
ccaaaa

SEQ ID NO: 148690 - DNA, 8 bp, Unknown
  misc_feature (1)..( 8): Result.004 file - promoters60/5665374
tattgaac

SEQ ID NO: 148691 - DNA, 8 bp, Unknown
  misc_feature (1)..( 8): Result.004 file - promoters60/5665374
tatttaac

SEQ ID NO: 148692 - DNA, 6 bp, Unknown
  misc_feature (1)..( 6): Result.004 file - promoters60/5665374
ttattg

SEQ ID NO: 148693 - DNA, 6 bp, Unknown
  misc_feature (1)..( 6): Result.004 file - promoters60/5665374
ttattg

SEQ ID NO: 148694 - DNA, 8 bp, Unknown
  misc_feature (1)..( 8): Result.004 file - promoters60/5665374
attttcaa

SEQ ID NO: 148695 - DNA, 8 bp, Unknown
  misc_feature (1)..( 8): Result.004 file - promoters60/5665374
attgtcaa

SEQ ID NO: 148696 - DNA, 9 bp, Unknown
  misc_feature (1)..( 9): Result.004 file - promoters60/5665374
gaaaatatg

SEQ ID NO: 148697 - DNA, 9 bp, Unknown
  misc_feature (1)..( 9): Result.004 file - promoters60/5665374
gaaaaaatg

SEQ ID NO: 148698 - DNA, 6 bp, Unknown
  misc_feature (1)..( 6): Result.004 file - promoters60/5665374
taaaag

SEQ ID NO: 148699 - DNA, 6 bp, Unknown
  misc_feature (1)..( 6): Result.004 file - promoters60/5665374
taaaag

SEQ ID NO: 148700 - DNA, 8 bp, Unknown
  misc_feature (1)..( 8): Result.004 file - promoters60/5665374
agcttcac

SEQ ID NO: 148701 - DNA, 8 bp, Unknown
  misc_feature (1)..( 8): Result.004 file - promoters60/5665404
agcctcac

SEQ ID NO: 148702 - DNA, 7 bp, Unknown
  misc_feature (1)..( 7): Result.004 file - promoters60/5665404
agatgtg

SEQ ID NO: 148703 - DNA, 7 bp, Unknown
  misc_feature (1)..( 7): Result.004 file - promoters60/5665404
agatgtg

SEQ ID NO: 148704 - DNA, 9 bp, Unknown
  misc_feature (1)..( 9): Result.004 file - promoters60/5665404
ttcgtcctt

SEQ ID NO: 148705 - DNA, 9 bp, Unknown
  misc_feature (1)..( 9): Result.004 file - promoters60/5665404
aacgttctt

SEQ ID NO: 148706 - DNA, 9 bp, Unknown
  misc_feature (1)..( 9): Result.004 file - promoters60/5665404
ttcgtccaa

SEQ ID NO: 148707 - DNA, 7 bp, Unknown
  misc_feature (1)..( 7): Result.004 file - promoters60/5665404
ttgcttt

SEQ ID NO: 148708 - DNA, 7 bp, Unknown
  misc_feature (1)..( 7): Result.004 file - promoters60/5665404
atgcttt

SEQ ID NO: 148709 - DNA, 7 bp, Unknown
  misc_feature (1)..( 7): Result.004 file - promoters60/5665404
ttgtttt

SEQ ID NO: 148710 - DNA, 10 bp, Unknown
  misc_feature (1)..( 10): Result.004 file - promoters60/5665404
ttttaaaatt

SEQ ID NO: 148711 - DNA, 10 bp, Unknown
  misc_feature (1)..( 10): Result.004 file - promoters60/5665404
aaataaaata

SEQ ID NO: 148712 - DNA, 10 bp, Unknown
  misc_feature (1)..( 10): Result.004 file - promoters60/5665404
aaatgaaata

SEQ ID NO: 148713 - DNA, 10 bp, Unknown
  misc_feature (1)..( 10): Result.004 file - promoters60/5665404
agttaaaaca

SEQ ID NO: 148714 - DNA, 10 bp, Unknown
  misc_feature (1)..( 10): Result.004 file - promoters60/5665404
agttaagaca

SEQ ID NO: 148715 - DNA, 10 bp, Unknown
  misc_feature (1)..( 10): Result.004 file - promoters60/5665404
aacgctaaag

SEQ ID NO: 148716 - DNA, 10 bp, Unknown
  misc_feature (1)..( 10): Result.004 file - promoters60/5665404
aaccctaaag

SEQ ID NO: 148717 - DNA, 6 bp, Unknown
  misc_feature (1)..( 6): Result.004 file - promoters60/5665404
aaaaat

SEQ ID NO: 148718 - DNA, 6 bp, Unknown
  misc_feature (1)..( 6): Result.004 file - promoters60/5665404
aaaaat

SEQ ID NO: 148719 - DNA, 6 bp, Unknown
  misc_feature (1)..( 6): Result.004 file - promoters60/5665404
gcctac

SEQ ID NO: 148720 - DNA, 6 bp, Unknown
  misc_feature (1)..( 6): Result.004 file - promoters60/5665404
gcctac

SEQ ID NO: 148721 - DNA, 9 bp, Unknown
  misc_feature (1)..( 9): Result.004 file - promoters60/5665404
aaatattgt

SEQ ID NO: 148722 - DNA, 9 bp, Unknown
  misc_feature (1)..( 9): Result.004 file - promoters60/5665404
aaacattgt

SEQ ID NO: 148723 - DNA, 6 bp, Unknown
  misc_feature (1)..( 6): Result.004 file - promoters60/5665404
ctattg

SEQ ID NO: 148724 - DNA, 6 bp, Unknown
  misc_feature (1)..( 6): Result.004 file - promoters60/5665404
ctattg

SEQ ID NO: 148725 - DNA, 7 bp, Unknown
  misc_feature (1)..( 7): Result.004 file - promoters60/5665404
aaacaaa

SEQ ID NO: 148726 - DNA, 7 bp, Unknown
  misc_feature (1)..( 7): Result.004 file - promoters60/5665404
aaagaaa

SEQ ID NO: 148727 - DNA, 7 bp, Unknown
  misc_feature (1)..( 7): Result.004 file - promoters60/5665404
aaacttt

SEQ ID NO: 148728 - DNA, 7 bp, Unknown
  misc_feature (1)..( 7): Result.004 file - promoters60/5665404
aaacttt

SEQ ID NO: 148729 - DNA, 6 bp, Unknown
  misc_feature (1)..( 6): Result.004 file - promoters60/5665404
agtaaa

SEQ ID NO: 148730 - DNA, 6 bp, Unknown
  misc_feature (1)..( 6): Result.004 file - promoters60/5665404
agtaaa

SEQ ID NO: 148731 - DNA, 7 bp, Unknown
  misc_feature (1)..( 7): Result.004 file - promoters60/5665404
aatcggg

SEQ ID NO: 148732 - DNA, 7 bp, Unknown
  misc_feature (1)..( 7): Result.004 file - promoters60/5665404
aattggg

SEQ ID NO: 148733 - DNA, 8 bp, Unknown
  misc_feature (1)..( 8): Result.004 file - promoters60/5665404
gaaagaaa

SEQ ID NO: 148734 - DNA, 8 bp, Unknown
  misc_feature (1)..( 8): Result.004 file - promoters60/5665404
gaaacaaa

SEQ ID NO: 148735 - DNA, 10 bp, Unknown
  misc_feature (1)..( 10): Result.004 file - promoters60/5665404
ggaaaagaaa

SEQ ID NO: 148736 - DNA, 10 bp, Unknown
  misc_feature (1)..( 10): Result.004 file - promoters60/5665404
ggaaatgaaa

SEQ ID NO: 148737 - DNA, 7 bp, Unknown
  misc_feature (1)..( 7): Result.004 file - promoters60/5665404
cccacta

SEQ ID NO: 148738 - DNA, 7 bp, Unknown
  misc_feature (1)..( 7): Result.004 file - promoters60/5665404
cccacta

SEQ ID NO: 148739 - DNA, 9 bp, Unknown
  misc_feature (1)..( 9): Result.004 file - promoters60/5665404
aaagaaaag

SEQ ID NO: 148740 - DNA, 9 bp, Unknown
  misc_feature (1)..( 9): Result.004 file - promoters60/5665404
aaagtaaag

SEQ ID NO: 148741 - DNA, 7 bp, Unknown
  misc_feature (1)..( 7): Result.004 file - promoters60/5665404
gtatata

SEQ ID NO: 148742 - DNA, 7 bp, Unknown
  misc_feature (1)..( 7): Result.004 file - promoters60/5665420
gtatata

SEQ ID NO: 148743 - DNA, 7 bp, Unknown
  misc_feature (1)..( 7): Result.004 file - promoters60/5665420
aaaatat

SEQ ID NO: 148744 - DNA, 7 bp, Unknown
  misc_feature (1)..( 7): Result.004 file - promoters60/5665420
aaattat

SEQ ID NO: 148745 - DNA, 7 bp, Unknown
  misc_feature (1)..( 7): Result.004 file - promoters60/5665420
aaaattt

SEQ ID NO: 148746 - DNA, 8 bp, Unknown
  misc_feature (1)..( 8): Result.004 file - promoters60/5665420
caactaaa

SEQ ID NO: 148747 - DNA, 8 bp, Unknown
  misc_feature (1)..( 8): Result.004 file - promoters60/5665420
caacgaaa

SEQ ID NO: 148748 - DNA, 7 bp, Unknown
  misc_feature (1)..( 7): Result.004 file - promoters60/5665420
tatcata

SEQ ID NO: 148749 - DNA, 7 bp, Unknown
  misc_feature (1)..( 7): Result.004 file - promoters60/5665420
tattata

SEQ ID NO: 148750 - DNA, 6 bp, Unknown
  misc_feature (1)..( 6): Result.004 file - promoters60/5665420
atttta

SEQ ID NO: 148751 - DNA, 6 bp, Unknown
  misc_feature (1)..( 6): Result.004 file - promoters60/5665420
atttta

SEQ ID NO: 148752 - DNA, 6 bp, Unknown
  misc_feature (1)..( 6): Result.004 file - promoters60/5665420
gacggt

SEQ ID NO: 148753 - DNA, 6 bp, Unknown
  misc_feature (1)..( 6): Result.004 file - promoters60/5665420
gacggt

SEQ ID NO: 148754 - DNA, 9 bp, Unknown
  misc_feature (1)..( 9): Result.004 file - promoters60/5665420
aaattaaaa

SEQ ID NO: 148755 - DNA, 9 bp, Unknown
  misc_feature (1)..( 9): Result.004 file - promoters60/5665420
aaatgaaaa

SEQ ID NO: 148756 - DNA, 10 bp, Unknown
  misc_feature (1)..( 10): Result.004 file - promoters60/5665420
tgttaattaa

SEQ ID NO: 148757 - DNA, 10 bp, Unknown
  misc_feature (1)..( 10): Result.004 file - promoters60/5665420
tgtgaattaa

SEQ ID NO: 148758 - DNA, 8 bp, Unknown
  misc_feature (1)..( 8): Result.004 file - promoters60/5665420
taataaag

SEQ ID NO: 148759 - DNA, 8 bp, Unknown
  misc_feature (1)..( 8): Result.004 file - promoters60/5665420
taatcaag

SEQ ID NO: 148760 - DNA, 7 bp, Unknown
  misc_feature (1)..( 7): Result.004 file - promoters60/5665420
tctcttt

SEQ ID NO: 148761 - DNA, 7 bp, Unknown
  misc_feature (1)..( 7): Result.004 file - promoters60/5665420
tctgttt

SEQ ID NO: 148762 - DNA, 7 bp, Unknown
  misc_feature (1)..( 7): Result.004 file - promoters60/5665420
tttgagt

SEQ ID NO: 148763 - DNA, 7 bp, Unknown
  misc_feature (1)..( 7): Result.004 file - promoters60/5665420
ttttagt

SEQ ID NO: 148764 - DNA, 9 bp, Unknown
  misc_feature (1)..( 9): Result.004 file - promoters60/5665420
ttaaaatag

SEQ ID NO: 148765 - DNA, 9 bp, Unknown
  misc_feature (1)..( 9): Result.004 file - promoters60/5665420
ttaaagtag

SEQ ID NO: 148766 - DNA, 9 bp, Unknown
  misc_feature (1)..( 9): Result.004 file - promoters60/5665420
ataaattaa

SEQ ID NO: 148767 - DNA, 9 bp, Unknown
  misc_feature (1)..( 9): Result.004 file - promoters60/5665420
atagattaa

SEQ ID NO: 148768 - DNA, 6 bp, Unknown
  misc_feature (1)..( 6): Result.004 file - promoters60/5665420
atatat

SEQ ID NO: 148769 - DNA, 6 bp, Unknown
  misc_feature (1)..( 6): Result.004 file - promoters60/5665420
atatat

SEQ ID NO: 148770 - DNA, 8 bp, Unknown
  misc_feature (1)..( 8): Result.004 file - promoters60/5665420
aactgaaa

SEQ ID NO: 148771 - DNA, 8 bp, Unknown
  misc_feature (1)..( 8): Result.004 file - promoters60/5665420
aacggaaa

SEQ ID NO: 148772 - DNA, 6 bp, Unknown
  misc_feature (1)..( 6): Result.004 file - promoters60/5665420
tcataa

SEQ ID NO: 148773 - DNA, 6 bp, Unknown
  misc_feature (1)..( 6): Result.004 file - promoters60/5665420
tcataa

SEQ ID NO: 148774 - DNA, 7 bp, Unknown
  misc_feature (1)..( 7): Result.004 file - promoters60/5665420
ttatttc

SEQ ID NO: 148775 - DNA, 7 bp, Unknown
  misc_feature (1)..( 7): Result.004 file - promoters60/5665420
ttatttc

SEQ ID NO: 148776 - DNA, 7 bp, Unknown
  misc_feature (1)..( 7): Result.004 file - promoters60/5665420
taaaaca

SEQ ID NO: 148777 - DNA, 7 bp, Unknown
  misc_feature (1)..( 7): Result.004 file - promoters60/5665420
taaaaca

SEQ ID NO: 148778 - DNA, 7 bp, Unknown
  misc_feature (1)..( 7): Result.004 file - promoters60/5665420
aaaacac

SEQ ID NO: 148779 - DNA, 7 bp, Unknown
  misc_feature (1)..( 7): Result.004 file - promoters60/5665420
aaaacaa

SEQ ID NO: 148780 - DNA, 8 bp, Unknown
  misc_feature (1)..( 8): Result.004 file - promoters60/5665420
aaaatcaa

SEQ ID NO: 148781 - DNA, 7 bp, Unknown
  misc_feature (1)..( 7): Result.004 file - promoters60/5665420
tgtatat

SEQ ID NO: 148782 - DNA, 7 bp, Unknown
  misc_feature (1)..( 7): Result.004 file - promoters60/5665420
tgtgtat

SEQ ID NO: 148783 - DNA, 6 bp, Unknown
  misc_feature (1)..( 6): Result.004 file - promoters60/5665420
ttatca

SEQ ID NO: 148784 - DNA, 6 bp, Unknown
  misc_feature (1)..( 6): Result.004 file - promoters60/5665420
ttatca

SEQ ID NO: 148785 - DNA, 6 bp, Unknown
  misc_feature (1)..( 6): Result.004 file - promoters60/5665420
atttat

SEQ ID NO: 148786 - DNA, 6 bp, Unknown
  misc_feature (1)..( 6): Result.004 file - promoters60/5665420
atttat

SEQ ID NO: 148787 - DNA, 8 bp, Unknown
  misc_feature (1)..( 8): Result.004 file - promoters60/5665420
gtgataaa

SEQ ID NO: 148788 - DNA, 8 bp, Unknown
  misc_feature (1)..( 8): Result.004 file - promoters60/5665420
gtgttaaa

SEQ ID NO: 148789 - DNA, 7 bp, Unknown
  misc_feature (1)..( 7): Result.004 file - promoters60/5665420
gaaaata

SEQ ID NO: 148790 - DNA, 7 bp, Unknown
  misc_feature (1)..( 7): Result.004 file - promoters60/5665420
gaatata

SEQ ID NO: 148791 - DNA, 6 bp, Unknown
  misc_feature (1)..( 6): Result.004 file - promoters60/5665420
cagaaa

SEQ ID NO: 148792 - DNA, 6 bp, Unknown
  misc_feature (1)..( 6): Result.004 file - promoters60/5665420
cagaaa

SEQ ID NO: 148793 - DNA, 10 bp, Unknown
  misc_feature (1)..( 10): Result.004 file - promoters60/5665420
ttaaccagta

SEQ ID NO: 148794 - DNA, 10 bp, Unknown
  misc_feature (1)..( 10): Result.004 file - promoters60/5665420
ttaacaagta

SEQ ID NO: 148795 - DNA, 6 bp, Unknown
  misc_feature (1)..( 6): Result.004 file - promoters60/5665420
aagcaa

SEQ ID NO: 148796 - DNA, 6 bp, Unknown
  misc_feature (1)..( 6): Result.004 file - promoters60/5665436
aagcaa

SEQ ID NO: 148797 - DNA, 17 bp, Unknown
  misc_feature (1)..( 17): Result.004 file - promoters60/5665436
agtgattctatttttat

SEQ ID NO: 148798 - DNA, 17 bp, Unknown
  misc_feature (1)..( 17): Result.004 file - promoters60/5665436
aacaattctaattttct

SEQ ID NO: 148799 - DNA, 17 bp, Unknown
  misc_feature (1)..( 17): Result.004 file - promoters60/5665436
caatgatggattattaa

SEQ ID NO: 148800 - DNA, 17 bp, Unknown
  misc_feature (1)..( 17): Result.004 file - promoters60/5665436
aacaagtctctatgaca

SEQ ID NO: 148801 - DNA, 17 bp, Unknown
  misc_feature (1)..( 17): Result.004 file - promoters60/5665436
ttagttaatattaagcc

SEQ ID NO: 148802 - DNA, 17 bp, Unknown
  misc_feature (1)..( 17): Result.004 file - promoters60/5665436
tatataaggcttaataa

SEQ ID NO: 148803 - DNA, 14 bp, Unknown
  misc_feature (1)..( 14): Result.004 file - promoters60/5665436
cttgttctttatgt

SEQ ID NO: 148804 - DNA, 14 bp, Unknown
  misc_feature (1)..( 14): Result.004 file - promoters60/5665436
aatgttcttgataa

SEQ ID NO: 148805 - DNA, 14 bp, Unknown
  misc_feature (1)..( 14): Result.004 file - promoters60/5665436
gtgtttctttttgt

SEQ ID NO: 148806 - DNA, 14 bp, Unknown
  misc_feature (1)..( 14): Result.004 file - promoters60/5665436
aattttctcattgc

SEQ ID NO: 148807 - DNA, 14 bp, Unknown
  misc_feature (1)..( 14): Result.004 file - promoters60/5665436
aattttcttactat

SEQ ID NO: 148808 - DNA, 14 bp, Unknown
  misc_feature (1)..( 14): Result.004 file - promoters60/5665436
catttttttttttc

SEQ ID NO: 148809 - DNA, 12 bp, Unknown
  misc_feature (1)..( 12): Result.004 file - promoters60/5665436
agtattacaatt

SEQ ID NO: 148810 - DNA, 12 bp, Unknown
  misc_feature (1)..( 12): Result.004 file - promoters60/5665436
gtaattacagta

SEQ ID NO: 148811 - DNA, 12 bp, Unknown
  misc_feature (1)..( 12): Result.004 file - promoters60/5665436
tattttaaaatt

SEQ ID NO: 148812 - DNA, 12 bp, Unknown
  misc_feature (1)..( 12): Result.004 file - promoters60/5665436
aatattactaaa

SEQ ID NO: 148813 - DNA, 12 bp, Unknown
  misc_feature (1)..( 12): Result.004 file - promoters60/5665436
cattttaaaaaa

SEQ ID NO: 148814 - DNA, 12 bp, Unknown
  misc_feature (1)..( 12): Result.004 file - promoters60/5665436
taaattacgatg

SEQ ID NO: 148815 - DNA, 12 bp, Unknown
  misc_feature (1)..( 12): Result.004 file - promoters60/5665507
aaaaataataat

SEQ ID NO: 148816 - DNA, 12 bp, Unknown
  misc_feature (1)..( 12): Result.004 file - promoters60/5665507
cgagaatacata

SEQ ID NO: 148817 - DNA, 12 bp, Unknown
  misc_feature (1)..( 12): Result.004 file - promoters60/5665507
ccaaaatccatc

SEQ ID NO: 148818 - DNA, 12 bp, Unknown
  misc_feature (1)..( 12): Result.004 file - promoters60/5665507
gaagaaaacaat

SEQ ID NO: 148819 - DNA, 12 bp, Unknown
  misc_feature (1)..( 12): Result.004 file - promoters60/5665507
ctataaagcaaa

SEQ ID NO: 148820 - DNA, 12 bp, Unknown
  misc_feature (1)..( 12): Result.004 file - promoters60/5665507
ctagaaaatggt

SEQ ID NO: 148821 - DNA, 12 bp, Unknown
  misc_feature (1)..( 12): Result.004 file - promoters60/5665796
gaagaaatcgaa

SEQ ID NO: 148822 - DNA, 12 bp, Unknown
  misc_feature (1)..( 12): Result.004 file - promoters60/5665796
tgattattgttc

SEQ ID NO: 148823 - DNA, 12 bp, Unknown
  misc_feature (1)..( 12): Result.004 file - promoters60/5665796
atattaatgttt

SEQ ID NO: 148824 - DNA, 12 bp, Unknown
  misc_feature (1)..( 12): Result.004 file - promoters60/5665796
tgatttttggca

SEQ ID NO: 148825 - DNA, 12 bp, Unknown
  misc_feature (1)..( 12): Result.004 file - promoters60/5665796
catgtaatgtgt

SEQ ID NO: 148826 - DNA, 12 bp, Unknown
  misc_feature (1)..( 12): Result.004 file - promoters60/5665796
tctccaatgttt

SEQ ID NO: 148827 - DNA, 12 bp, Unknown
  misc_feature (1)..( 12): Result.004 file - promoters60/5665796
tccaaaatgtta

SEQ ID NO: 148828 - DNA, 11 bp, Unknown
  misc_feature (1)..( 11): Result.004 file - promoters60/5665796
attcataattt

SEQ ID NO: 148829 - DNA, 11 bp, Unknown
  misc_feature (1)..( 11): Result.004 file - promoters60/5665796
aaagctaattt

SEQ ID NO: 148830 - DNA, 11 bp, Unknown
  misc_feature (1)..( 11): Result.004 file - promoters60/5665796
ttatatatttt

SEQ ID NO: 148831 - DNA, 11 bp, Unknown
  misc_feature (1)..( 11): Result.004 file - promoters60/5665796
attgatattta

SEQ ID NO: 148832 - DNA, 11 bp, Unknown
  misc_feature (1)..( 11): Result.004 file - promoters60/5665796
attgatttttt

SEQ ID NO: 148833 - DNA, 11 bp, Unknown
  misc_feature (1)..( 11): Result.004 file - promoters60/5665796
tacagtaattt

SEQ ID NO: 148834 - DNA, 12 bp, Unknown
  misc_feature (1)..( 12): Result.004 file - promoters60/5665796
taataaattcat

SEQ ID NO: 148835 - DNA, 12 bp, Unknown
  misc_feature (1)..( 12): Result.004 file - promoters60/5665796
ttatatattttt

SEQ ID NO: 148836 - DNA, 12 bp, Unknown
  misc_feature (1)..( 12): Result.004 file - promoters60/5665796
taacaaatacca

SEQ ID NO: 148837 - DNA, 12 bp, Unknown
  misc_feature (1)..( 12): Result.004 file - promoters60/5665796
atatttatgtgt

SEQ ID NO: 148838 - DNA, 12 bp, Unknown
  misc_feature (1)..( 12): Result.004 file - promoters60/5665796
tgattcatgcta

SEQ ID NO: 148839 - DNA, 12 bp, Unknown
  misc_feature (1)..( 12): Result.004 file - promoters60/5666614
cgattgattttt

SEQ ID NO: 148840 - DNA, 6 bp, Unknown
  misc_feature (1)..( 6): Result.004 file - promoters60/5666614
gaataa

SEQ ID NO: 148841 - DNA, 6 bp, Unknown
  misc_feature (1)..( 6): Result.004 file - promoters60/5666614
gaataa

SEQ ID NO: 148842 - DNA, 7 bp, Unknown
  misc_feature (1)..( 7): Result.004 file - promoters60/5666614
atggaat

SEQ ID NO: 148843 - DNA, 7 bp, Unknown
  misc_feature (1)..( 7): Result.004 file - promoters60/5666614
atggaat

SEQ ID NO: 148844 - DNA, 7 bp, Unknown
  misc_feature (1)..( 7): Result.004 file - promoters60/5666614
ttataaa

SEQ ID NO: 148845 - DNA, 7 bp, Unknown
  misc_feature (1)..( 7): Result.004 file - promoters60/5666614
ttaaaaa

SEQ ID NO: 148846 - DNA, 6 bp, Unknown
  misc_feature (1)..( 6): Result.004 file - promoters60/5666614
caaggg

SEQ ID NO: 148847 - DNA, 6 bp, Unknown
  misc_feature (1)..( 6): Result.004 file - promoters60/5666614
caaggg

SEQ ID NO: 148848 - DNA, 7 bp, Unknown
  misc_feature (1)..( 7): Result.004 file - promoters60/5666614
gttaaac

SEQ ID NO: 148849 - DNA, 7 bp, Unknown
  misc_feature (1)..( 7): Result.004 file - promoters60/5666614
gtttaac

SEQ ID NO: 148850 - DNA, 7 bp, Unknown
  misc_feature (1)..( 7): Result.004 file - promoters60/5666614
ttttaac

SEQ ID NO: 148851 - DNA, 8 bp, Unknown
  misc_feature (1)..( 8): Result.004 file - promoters60/5666614
aaatctcg

SEQ ID NO: 148852 - DNA, 8 bp, Unknown
  misc_feature (1)..( 8): Result.004 file - promoters60/5666614
taatttcg

SEQ ID NO: 148853 - DNA, 8 bp, Unknown
  misc_feature (1)..( 8): Result.004 file - promoters60/5666614
taacttcc

SEQ ID NO: 148854 - DNA, 6 bp, Unknown
  misc_feature (1)..( 6): Result.004 file - promoters60/5666614
caacaa

SEQ ID NO: 148855 - DNA, 6 bp, Unknown
  misc_feature (1)..( 6): Result.004 file - promoters60/5666614
caacaa

SEQ ID NO: 148856 - DNA, 6 bp, Unknown
  misc_feature (1)..( 6): Result.004 file - promoters60/5666614
ccacaa

SEQ ID NO: 148857 - DNA, 6 bp, Unknown
  misc_feature (1)..( 6): Result.004 file - promoters60/5666614
ccacaa

SEQ ID NO: 148858 - DNA, 9 bp, Unknown
  misc_feature (1)..( 9): Result.004 file - promoters60/5666614
agaagtagc

SEQ ID NO: 148859 - DNA, 9 bp, Unknown
  misc_feature (1)..( 9): Result.004 file - promoters60/5666614
agatgtagc

SEQ ID NO: 148860 - DNA, 8 bp, Unknown
  misc_feature (1)..( 8): Result.004 file - promoters60/5666614
acaccaga

SEQ ID NO: 148861 - DNA, 8 bp, Unknown
  misc_feature (1)..( 8): Result.004 file - promoters60/5666614
acaacaga

SEQ ID NO: 148862 - DNA, 8 bp, Unknown
  misc_feature (1)..( 8): Result.004 file - promoters60/5666614
ttgtttac

SEQ ID NO: 148863 - DNA, 8 bp, Unknown
  misc_feature (1)..( 8): Result.004 file - promoters60/5666614
ttgcttac

SEQ ID NO: 148864 - DNA, 7 bp, Unknown
  misc_feature (1)..( 7): Result.004 file - promoters60/5666614
tttttct

SEQ ID NO: 148865 - DNA, 7 bp, Unknown
  misc_feature (1)..( 7): Result.004 file - promoters60/5666614
tttctct

SEQ ID NO: 148866 - DNA, 6 bp, Unknown
  misc_feature (1)..( 6): Result.004 file - promoters60/5666614
tatttt

SEQ ID NO: 148867 - DNA, 6 bp, Unknown
  misc_feature (1)..( 6): Result.004 file - promoters60/5666614
tatttt

SEQ ID NO: 148868 - DNA, 9 bp, Unknown
  misc_feature (1)..( 9): Result.004 file - promoters60/5666614
gacaaatac

SEQ ID NO: 148869 - DNA, 9 bp, Unknown
  misc_feature (1)..( 9): Result.004 file - promoters60/5666614
gacaattac

SEQ ID NO: 148870 - DNA, 6 bp, Unknown
  misc_feature (1)..( 6): Result.004 file - promoters60/5666614
caattt

SEQ ID NO: 148871 - DNA, 6 bp, Unknown
  misc_feature (1)..( 6): Result.004 file - promoters60/5667152
caattt

SEQ ID NO: 148872 - DNA, 8 bp, Unknown
  misc_feature (1)..( 8): Result.004 file - promoters60/5667152
cggtataa

SEQ ID NO: 148873 - DNA, 8 bp, Unknown
  misc_feature (1)..( 8): Result.004 file - promoters60/5667152
cggtctaa

SEQ ID NO: 148874 - DNA, 8 bp, Unknown
  misc_feature (1)..( 8): Result.004 file - promoters60/5667152
aaaaaatc

SEQ ID NO: 148875 - DNA, 8 bp, Unknown
  misc_feature (1)..( 8): Result.004 file - promoters60/5667152
aaaacatc

SEQ ID NO: 148876 - DNA, 8 bp, Unknown
  misc_feature (1)..( 8): Result.004 file - promoters60/5667152
acaaaatt

SEQ ID NO: 148877 - DNA, 8 bp, Unknown
  misc_feature (1)..( 8): Result.004 file - promoters60/5667152
acaacatt

SEQ ID NO: 148878 - DNA, 7 bp, Unknown
  misc_feature (1)..( 7): Result.004 file - promoters60/5667152
agaaatg

SEQ ID NO: 148879 - DNA, 7 bp, Unknown
  misc_feature (1)..( 7): Result.004 file - promoters60/5667152
agacatg

SEQ ID NO: 148880 - DNA, 7 bp, Unknown
  misc_feature (1)..( 7): Result.004 file - promoters60/5667152
agttaag

SEQ ID NO: 148881 - DNA, 7 bp, Unknown
  misc_feature (1)..( 7): Result.004 file - promoters60/5667152
agtgaag

SEQ ID NO: 148882 - DNA, 8 bp, Unknown
  misc_feature (1)..( 8): Result.004 file - promoters60/5667152
tggtttgt

SEQ ID NO: 148883 - DNA, 8 bp, Unknown
  misc_feature (1)..( 8): Result.004 file - promoters60/5667152
tggtctgt

SEQ ID NO: 148884 - DNA, 7 bp, Unknown
  misc_feature (1)..( 7): Result.004 file - promoters60/5667152
ttattcg

SEQ ID NO: 148885 - DNA, 7 bp, Unknown
  misc_feature (1)..( 7): Result.004 file - promoters60/5667152
ttattcg

SEQ ID NO: 148886 - DNA, 7 bp, Unknown
  misc_feature (1)..( 7): Result.004 file - promoters60/5667152
ttgaatc

SEQ ID NO: 148887 - DNA, 7 bp, Unknown
  misc_feature (1)..( 7): Result.004 file - promoters60/5667152
ttggatc

SEQ ID NO: 148888 - DNA, 9 bp, Unknown
  misc_feature (1)..( 9): Result.004 file - promoters60/5667152
atcatattt

SEQ ID NO: 148889 - DNA, 9 bp, Unknown
  misc_feature (1)..( 9): Result.004 file - promoters60/5667152
atcaaattt

SEQ ID NO: 148890 - DNA, 7 bp, Unknown
  misc_feature (1)..( 7): Result.004 file - promoters60/5667152
tttcttc

SEQ ID NO: 148891 - DNA, 7 bp, Unknown
  misc_feature (1)..( 7): Result.004 file - promoters60/5667152
tttcttc

SEQ ID NO: 148892 - DNA, 6 bp, Unknown
  misc_feature (1)..( 6): Result.004 file - promoters60/5667152
gttgta

SEQ ID NO: 148893 - DNA, 6 bp, Unknown
  misc_feature (1)..( 6): Result.004 file - promoters60/5667152
gttgta

SEQ ID NO: 148894 - DNA, 7 bp, Unknown
  misc_feature (1)..( 7): Result.004 file - promoters60/5667152
gaccaga

SEQ ID NO: 148895 - DNA, 7 bp, Unknown
  misc_feature (1)..( 7): Result.004 file - promoters60/5667570
gaccaga

SEQ ID NO: 148896 - DNA, 7 bp, Unknown
  misc_feature (1)..( 7): Result.004 file - promoters60/5667570
aatgaat

SEQ ID NO: 148897 - DNA, 7 bp, Unknown
  misc_feature (1)..( 7): Result.004 file - promoters60/5667570
aattaat

SEQ ID NO: 148898 - DNA, 7 bp, Unknown
  misc_feature (1)..( 7): Result.004 file - promoters60/5667570
atattta

SEQ ID NO: 148899 - DNA, 7 bp, Unknown
  misc_feature (1)..( 7): Result.004 file - promoters60/5667570
ataatta

SEQ ID NO: 148900 - DNA, 7 bp, Unknown
  misc_feature (1)..( 7): Result.004 file - promoters60/5667570
ttacaga

SEQ ID NO: 148901 - DNA, 7 bp, Unknown
  misc_feature (1)..( 7): Result.004 file - promoters60/5667570
ttaaaga

SEQ ID NO: 148902 - DNA, 7 bp, Unknown
  misc_feature (1)..( 7): Result.004 file - promoters60/5667570
aaaatta

SEQ ID NO: 148903 - DNA, 7 bp, Unknown
  misc_feature (1)..( 7): Result.004 file - promoters60/5667570
aaaatta

SEQ ID NO: 148904 - DNA, 8 bp, Unknown
  misc_feature (1)..( 8): Result.004 file - promoters60/5667570
tatttaat

SEQ ID NO: 148905 - DNA, 8 bp, Unknown
  misc_feature (1)..( 8): Result.004 file - promoters60/5667570
tatttaat

SEQ ID NO: 148906 - DNA, 9 bp, Unknown
  misc_feature (1)..( 9): Result.004 file - promoters60/5667570
tttaaaata

SEQ ID NO: 148907 - DNA, 9 bp, Unknown
  misc_feature (1)..( 9): Result.004 file - promoters60/5667570
ttttaaata

SEQ ID NO: 148908 - DNA, 6 bp, Unknown
  misc_feature (1)..( 6): Result.004 file - promoters60/5667570
taataa

SEQ ID NO: 148909 - DNA, 6 bp, Unknown
  misc_feature (1)..( 6): Result.004 file - promoters60/5667570
taataa

SEQ ID NO: 148910 - DNA, 7 bp, Unknown
  misc_feature (1)..( 7): Result.004 file - promoters60/5667570
aaataag

SEQ ID NO: 148911 - DNA, 7 bp, Unknown
  misc_feature (1)..( 7): Result.004 file - promoters60/5667570
aaaaaag

SEQ ID NO: 148912 - DNA, 8 bp, Unknown
  misc_feature (1)..( 8): Result.004 file - promoters60/5667570
aaacaaat

SEQ ID NO: 148913 - DNA, 8 bp, Unknown
  misc_feature (1)..( 8): Result.004 file - promoters60/5667570
aaagaaat

SEQ ID NO: 148914 - DNA, 8 bp, Unknown
  misc_feature (1)..( 8): Result.004 file - promoters60/5667570
ataagaaa

SEQ ID NO: 148915 - DNA, 8 bp, Unknown
  misc_feature (1)..( 8): Result.004 file - promoters60/5667570
ataagaaa

SEQ ID NO: 148916 - DNA, 11 bp, Unknown
  misc_feature (1)..( 11): Result.004 file - promoters60/5667570
caaaataagaa

SEQ ID NO: 148917 - DNA, 11 bp, Unknown
  misc_feature (1)..( 11): Result.004 file - promoters60/5667570
caaaattcttt

SEQ ID NO: 148918 - DNA, 11 bp, Unknown
  misc_feature (1)..( 11): Result.004 file - promoters60/5667570
caaaaaaaaaa

SEQ ID NO: 148919 - DNA, 9 bp, Unknown
  misc_feature (1)..( 9): Result.004 file - promoters60/5667570
acttgtttt

SEQ ID NO: 148920 - DNA, 9 bp, Unknown
  misc_feature (1)..( 9): Result.004 file - promoters60/5667570
tggtgtttt

SEQ ID NO: 148921 - DNA, 9 bp, Unknown
  misc_feature (1)..( 9): Result.004 file - promoters60/5667570
tggggtttt

SEQ ID NO: 148922 - DNA, 11 bp, Unknown
  misc_feature (1)..( 11): Result.004 file - promoters60/5667570
tatatataaac

SEQ ID NO: 148923 - DNA, 11 bp, Unknown
  misc_feature (1)..( 11): Result.004 file - promoters60/5667570
tatatataaac

SEQ ID NO: 148924 - DNA, 7 bp, Unknown
  misc_feature (1)..( 7): Result.004 file - promoters60/5667570
ttcccaa

SEQ ID NO: 148925 - DNA, 7 bp, Unknown
  misc_feature (1)..( 7): Result.004 file - promoters60/5667570
ttcccaa

SEQ ID NO: 148926 - DNA, 6 bp, Unknown
  misc_feature (1)..( 6): Result.004 file - promoters60/5667570
ctgttg

SEQ ID NO: 148927 - DNA, 6 bp, Unknown
  misc_feature (1)..( 6): Result.004 file - promoters60/5667570
ctgttg

SEQ ID NO: 148928 - DNA, 7 bp, Unknown
  misc_feature (1)..( 7): Result.004 file - promoters60/5667570
ttgaaat

SEQ ID NO: 148929 - DNA, 7 bp, Unknown
  misc_feature (1)..( 7): Result.004 file - promoters60/5667570
ttgtaat

SEQ ID NO: 148930 - DNA, 6 bp, Unknown
  misc_feature (1)..( 6): Result.004 file - promoters60/5667570
aaatta

SEQ ID NO: 148931 - DNA, 6 bp, Unknown
  misc_feature (1)..( 6): Result.004 file - promoters60/5667570
aaatta

SEQ ID NO: 148932 - DNA, 7 bp, Unknown
  misc_feature (1)..( 7): Result.004 file - promoters60/5667570
cttattt

SEQ ID NO: 148933 - DNA, 7 bp, Unknown
  misc_feature (1)..( 7): Result.004 file - promoters60/5667570
ctttttt

SEQ ID NO: 148934 - DNA, 8 bp, Unknown
  misc_feature (1)..( 8): Result.004 file - promoters60/5667570
tttcaaaa

SEQ ID NO: 148935 - DNA, 8 bp, Unknown
  misc_feature (1)..( 8): Result.004 file - promoters60/5667570
ttttaaaa

SEQ ID NO: 148936 - DNA, 7 bp, Unknown
  misc_feature (1)..( 7): Result.004 file - promoters60/5667570
aaattta

SEQ ID NO: 148937 - DNA, 7 bp, Unknown
  misc_feature (1)..( 7): Result.004 file - promoters60/5667570
aaattta

SEQ ID NO: 148938 - DNA, 7 bp, Unknown
  misc_feature (1)..( 7): Result.004 file - promoters60/5667570
acctaaa

SEQ ID NO: 148939 - DNA, 7 bp, Unknown
  misc_feature (1)..( 7): Result.004 file - promoters60/5667570
acccaaa

SEQ ID NO: 148940 - DNA, 6 bp, Unknown
  misc_feature (1)..( 6): Result.004 file - promoters60/5667570
tctcat

SEQ ID NO: 148941 - DNA, 6 bp, Unknown
  misc_feature (1)..( 6): Result.004 file - promoters60/5667570
tctcat

SEQ ID NO: 148942 - DNA, 7 bp, Unknown
  misc_feature (1)..( 7): Result.004 file - promoters60/5667570
ttgccaa

SEQ ID NO: 148943 - DNA, 7 bp, Unknown
  misc_feature (1)..( 7): Result.004 file - promoters60/5667570
ttgtcaa

SEQ ID NO: 148944 - DNA, 6 bp, Unknown
  misc_feature (1)..( 6): Result.004 file - promoters60/5667570
tttatt

SEQ ID NO: 148945 - DNA, 6 bp, Unknown
  misc_feature (1)..( 6): Result.004 file - promoters60/5667570
tttatt

SEQ ID NO: 148946 - DNA, 6 bp, Unknown
  misc_feature (1)..( 6): Result.004 file - promoters60/5667570
taattt

SEQ ID NO: 148947 - DNA, 6 bp, Unknown
  misc_feature (1)..( 6): Result.004 file - promoters60/5667570
taattt

SEQ ID NO: 148948 - DNA, 7 bp, Unknown
  misc_feature (1)..( 7): Result.004 file - promoters60/5667570
aaagagg

SEQ ID NO: 148949 - DNA, 7 bp, Unknown
  misc_feature (1)..( 7): Result.004 file - promoters60/5667570
aaaaagg

SEQ ID NO: 148950 - DNA, 7 bp, Unknown
  misc_feature (1)..( 7): Result.004 file - promoters60/5667570
gctaaaa

SEQ ID NO: 148951 - DNA, 7 bp, Unknown
  misc_feature (1)..( 7): Result.004 file - promoters60/5667588
gctcaaa

SEQ ID NO: 148952 - DNA, 8 bp, Unknown
  misc_feature (1)..( 8): Result.004 file - promoters60/5667588
caataatt

SEQ ID NO: 148953 - DNA, 8 bp, Unknown
  misc_feature (1)..( 8): Result.004 file - promoters60/5667588
caatcatt

SEQ ID NO: 148954 - DNA, 9 bp, Unknown
  misc_feature (1)..( 9): Result.004 file - promoters60/5667588
attattatt

SEQ ID NO: 148955 - DNA, 9 bp, Unknown
  misc_feature (1)..( 9): Result.004 file - promoters60/5667588
atttttatt

SEQ ID NO: 148956 - DNA, 10 bp, Unknown
  misc_feature (1)..( 10): Result.004 file - promoters60/5667588
tatctaagtg

SEQ ID NO: 148957 - DNA, 10 bp, Unknown
  misc_feature (1)..( 10): Result.004 file - promoters60/5667588
gttctacgtg

SEQ ID NO: 148958 - DNA, 10 bp, Unknown
  misc_feature (1)..( 10): Result.004 file - promoters60/5667588
tatataaaca

SEQ ID NO: 148959 - DNA, 6 bp, Unknown
  misc_feature (1)..( 6): Result.004 file - promoters60/5667588
ttaaca

SEQ ID NO: 148960 - DNA, 6 bp, Unknown
  misc_feature (1)..( 6): Result.004 file - promoters60/5667588
ttaaca

SEQ ID NO: 148961 - DNA, 8 bp, Unknown
  misc_feature (1)..( 8): Result.004 file - promoters60/5667588
ccttccac

SEQ ID NO: 148962 - DNA, 8 bp, Unknown
  misc_feature (1)..( 8): Result.004 file - promoters60/5667588
cctaccac

SEQ ID NO: 148963 - DNA, 8 bp, Unknown
  misc_feature (1)..( 8): Result.004 file - promoters60/5667588
actatata

SEQ ID NO: 148964 - DNA, 8 bp, Unknown
  misc_feature (1)..( 8): Result.004 file - promoters60/5667588
actctata

SEQ ID NO: 148965 - DNA, 8 bp, Unknown
  misc_feature (1)..( 8): Result.004 file - promoters60/5667588
gttatata

SEQ ID NO: 148966 - DNA, 8 bp, Unknown
  misc_feature (1)..( 8): Result.004 file - promoters60/5667588
ttattttt

SEQ ID NO: 148967 - DNA, 8 bp, Unknown
  misc_feature (1)..( 8): Result.004 file - promoters60/5667588
ttattttt

SEQ ID NO: 148968 - DNA, 6 bp, Unknown
  misc_feature (1)..( 6): Result.004 file - promoters60/5667588
aattat

SEQ ID NO: 148969 - DNA, 6 bp, Unknown
  misc_feature (1)..( 6): Result.004 file - promoters60/5667588
aattat

SEQ ID NO: 148970 - DNA, 6 bp, Unknown
  misc_feature (1)..( 6): Result.004 file - promoters60/5667588
gagttt

SEQ ID NO: 148971 - DNA, 6 bp, Unknown
  misc_feature (1)..( 6): Result.004 file - promoters60/5667588
gagttt

SEQ ID NO: 148972 - DNA, 6 bp, Unknown
  misc_feature (1)..( 6): Result.004 file - promoters60/5667588
attttt

SEQ ID NO: 148973 - DNA, 6 bp, Unknown
  misc_feature (1)..( 6): Result.004 file - promoters60/5667588
attttt

SEQ ID NO: 148974 - DNA, 7 bp, Unknown
  misc_feature (1)..( 7): Result.004 file - promoters60/5667588
tttttat

SEQ ID NO: 148975 - DNA, 7 bp, Unknown
  misc_feature (1)..( 7): Result.004 file - promoters60/5667588
tttttat

SEQ ID NO: 148976 - DNA, 9 bp, Unknown
  misc_feature (1)..( 9): Result.004 file - promoters60/5667588
aaaaatatc

SEQ ID NO: 148977 - DNA, 9 bp, Unknown
  misc_feature (1)..( 9): Result.004 file - promoters60/5667588
aaacatatc

SEQ ID NO: 148978 - DNA, 6 bp, Unknown
  misc_feature (1)..( 6): Result.004 file - promoters60/5667588
acacca

SEQ ID NO: 148979 - DNA, 6 bp, Unknown
  misc_feature (1)..( 6): Result.004 file - promoters60/5667588
acacca

SEQ ID NO: 148980 - DNA, 6 bp, Unknown
  misc_feature (1)..( 6): Result.004 file - promoters60/5667588
tcaaga

SEQ ID NO: 148981 - DNA, 6 bp, Unknown
  misc_feature (1)..( 6): Result.004 file - promoters60/5667588
tcaaga

SEQ ID NO: 148982 - DNA, 6 bp, Unknown
  misc_feature (1)..( 6): Result.004 file - promoters60/5667588
atagcc

SEQ ID NO: 148983 - DNA, 6 bp, Unknown
  misc_feature (1)..( 6): Result.004 file - promoters60/5667588
atagcc

SEQ ID NO: 148984 - DNA, 6 bp, Unknown
  misc_feature (1)..( 6): Result.004 file - promoters60/5667588
aaaaat

SEQ ID NO: 148985 - DNA, 6 bp, Unknown
  misc_feature (1)..( 6): Result.004 file - promoters60/5667588
aaaaat

SEQ ID NO: 148986 - DNA, 7 bp, Unknown
  misc_feature (1)..( 7): Result.004 file - promoters60/5667588
aattgta

SEQ ID NO: 148987 - DNA, 7 bp, Unknown
  misc_feature (1)..( 7): Result.004 file - promoters60/5667588
aatagta

SEQ ID NO: 148988 - DNA, 6 bp, Unknown
  misc_feature (1)..( 6): Result.004 file - promoters60/5667588
taaagg

SEQ ID NO: 148989 - DNA, 6 bp, Unknown
  misc_feature (1)..( 6): Result.004 file - promoters60/5667588
taaagg

SEQ ID NO: 148990 - DNA, 9 bp, Unknown
  misc_feature (1)..( 9): Result.004 file - promoters60/5667588
aaaaatgaa

SEQ ID NO: 148991 - DNA, 9 bp, Unknown
  misc_feature (1)..( 9): Result.004 file - promoters60/5667588
aaaactgaa

SEQ ID NO: 148992 - DNA, 9 bp, Unknown
  misc_feature (1)..( 9): Result.004 file - promoters60/5667588
aaaacattt

SEQ ID NO: 148993 - DNA, 9 bp, Unknown
  misc_feature (1)..( 9): Result.004 file - promoters60/5667588
aaaacattt

SEQ ID NO: 148994 - DNA, 9 bp, Unknown
  misc_feature (1)..( 9): Result.004 file - promoters60/5667588
tcacgaaaa

SEQ ID NO: 148995 - DNA, 9 bp, Unknown
  misc_feature (1)..( 9): Result.004 file - promoters60/5667588
tcacgaaaa

SEQ ID NO: 148996 - DNA, 7 bp, Unknown
  misc_feature (1)..( 7): Result.004 file - promoters60/5667588
ttccgaa

SEQ ID NO: 148997 - DNA, 7 bp, Unknown
  misc_feature (1)..( 7): Result.004 file - promoters60/5667685
ttccgaa

SEQ ID NO: 148998 - DNA, 7 bp, Unknown
  misc_feature (1)..( 7): Result.004 file - promoters60/5667685
attgatt

SEQ ID NO: 148999 - DNA, 7 bp, Unknown
  misc_feature (1)..( 7): Result.004 file - promoters60/5667685
attgatt

SEQ ID NO: 149000 - DNA, 10 bp, Unknown
  misc_feature (1)..( 10): Result.004 file - promoters60/5667685
ttgtaaccaa

SEQ ID NO: 149001 - DNA, 10 bp, Unknown
  misc_feature (1)..( 10): Result.004 file - promoters60/5667685
ttggaactgc

SEQ ID NO: 149002 - DNA, 10 bp, Unknown
  misc_feature (1)..( 10): Result.004 file - promoters60/5667685
aagtaaacaa

SEQ ID NO: 149003 - DNA, 8 bp, Unknown
  misc_feature (1)..( 8): Result.004 file - promoters60/5667685
ctataatt

SEQ ID NO: 149004 - DNA, 8 bp, Unknown
  misc_feature (1)..( 8): Result.004 file - promoters60/5667685
ctagaatt

SEQ ID NO: 149005 - DNA, 6 bp, Unknown
  misc_feature (1)..( 6): Result.004 file - promoters60/5667685
atcttc

SEQ ID NO: 149006 - DNA, 6 bp, Unknown
  misc_feature (1)..( 6): Result.004 file - promoters60/5667685
atcttc

SEQ ID NO: 149007 - DNA, 8 bp, Unknown
  misc_feature (1)..( 8): Result.004 file - promoters60/5667685
tttcgaaa

SEQ ID NO: 149008 - DNA, 8 bp, Unknown
  misc_feature (1)..( 8): Result.004 file - promoters60/5667685
tttggaaa

SEQ ID NO: 149009 - DNA, 6 bp, Unknown
  misc_feature (1)..( 6): Result.004 file - promoters60/5667685
tcactt

SEQ ID NO: 149010 - DNA, 6 bp, Unknown
  misc_feature (1)..( 6): Result.004 file - promoters60/5667685
tcactt

SEQ ID NO: 149011 - DNA, 6 bp, Unknown
  misc_feature (1)..( 6): Result.004 file - promoters60/5667685
aaaaat

SEQ ID NO: 149012 - DNA, 6 bp, Unknown
  misc_feature (1)..( 6): Result.004 file - promoters60/5667685
aaaaat

SEQ ID NO: 149013 - DNA, 8 bp, Unknown
  misc_feature (1)..( 8): Result.004 file - promoters60/5667685
ccttttca

SEQ ID NO: 149014 - DNA, 8 bp, Unknown
  misc_feature (1)..( 8): Result.004 file - promoters60/5667685
ttttttca

SEQ ID NO: 149015 - DNA, 8 bp, Unknown
  misc_feature (1)..( 8): Result.004 file - promoters60/5667685
ttttttcc

SEQ ID NO: 149016 - DNA, 6 bp, Unknown
  misc_feature (1)..( 6): Result.004 file - promoters60/5667685
tttaat

SEQ ID NO: 149017 - DNA, 6 bp, Unknown
  misc_feature (1)..( 6): Result.004 file - promoters60/5667685
tttaat

SEQ ID NO: 149018 - DNA, 10 bp, Unknown
  misc_feature (1)..( 10): Result.004 file - promoters60/5667685
accaataatg

SEQ ID NO: 149019 - DNA, 10 bp, Unknown
  misc_feature (1)..( 10): Result.004 file - promoters60/5667685
accaaaaatg

SEQ ID NO: 149020 - DNA, 6 bp, Unknown
  misc_feature (1)..( 6): Result.004 file - promoters60/5667685
acaaaa

SEQ ID NO: 149021 - DNA, 6 bp, Unknown
  misc_feature (1)..( 6): Result.004 file - promoters60/5667685
acaaaa

SEQ ID NO: 149022 - DNA, 6 bp, Unknown
  misc_feature (1)..( 6): Result.004 file - promoters60/5667685
aataaa

SEQ ID NO: 149023 - DNA, 6 bp, Unknown
  misc_feature (1)..( 6): Result.004 file - promoters60/5667685
aataaa

SEQ ID NO: 149024 - DNA, 7 bp, Unknown
  misc_feature (1)..( 7): Result.004 file - promoters60/5667685
taagaat

SEQ ID NO: 149025 - DNA, 7 bp, Unknown
  misc_feature (1)..( 7): Result.004 file - promoters60/5667685
taaaaat

SEQ ID NO: 149026 - DNA, 6 bp, Unknown
  misc_feature (1)..( 6): Result.004 file - promoters60/5667685
actaac

SEQ ID NO: 149027 - DNA, 6 bp, Unknown
  misc_feature (1)..( 6): Result.004 file - promoters60/5667685
actaac

SEQ ID NO: 149028 - DNA, 8 bp, Unknown
  misc_feature (1)..( 8): Result.004 file - promoters60/5667685
tgatacta

SEQ ID NO: 149029 - DNA, 8 bp, Unknown
  misc_feature (1)..( 8): Result.004 file - promoters60/5667685
tgaaacta

SEQ ID NO: 149030 - DNA, 6 bp, Unknown
  misc_feature (1)..( 6): Result.004 file - promoters60/5667685
aaatct

SEQ ID NO: 149031 - DNA, 6 bp, Unknown
  misc_feature (1)..( 6): Result.004 file - promoters60/5667685
aaatct

SEQ ID NO: 149032 - DNA, 7 bp, Unknown
  misc_feature (1)..( 7): Result.004 file - promoters60/5667685
cttcaat

SEQ ID NO: 149033 - DNA, 7 bp, Unknown
  misc_feature (1)..( 7): Result.004 file - promoters60/5667685
cttaaat

SEQ ID NO: 149034 - DNA, 9 bp, Unknown
  misc_feature (1)..( 9): Result.004 file - promoters60/5667685
aactttttt

SEQ ID NO: 149035 - DNA, 9 bp, Unknown
  misc_feature (1)..( 9): Result.004 file - promoters60/5667685
aactttttt

SEQ ID NO: 149036 - DNA, 7 bp, Unknown
  misc_feature (1)..( 7): Result.004 file - promoters60/5667685
atataat

SEQ ID NO: 149037 - DNA, 7 bp, Unknown
  misc_feature (1)..( 7): Result.004 file - promoters60/5667685
ataaaat

SEQ ID NO: 149038 - DNA, 6 bp, Unknown
  misc_feature (1)..( 6): Result.004 file - promoters60/5667685
cttttt

SEQ ID NO: 149039 - DNA, 6 bp, Unknown
  misc_feature (1)..( 6): Result.004 file - promoters60/5667685
cttttt

SEQ ID NO: 149040 - DNA, 7 bp, Unknown
  misc_feature (1)..( 7): Result.004 file - promoters60/5667685
taagcca

SEQ ID NO: 149041 - DNA, 7 bp, Unknown
  misc_feature (1)..( 7): Result.004 file - promoters60/5667685
taaacca

SEQ ID NO: 149042 - DNA, 7 bp, Unknown
  misc_feature (1)..( 7): Result.004 file - promoters60/5667685
aagttaa

SEQ ID NO: 149043 - DNA, 7 bp, Unknown
  misc_feature (1)..( 7): Result.004 file - promoters60/5667685
aagttaa

SEQ ID NO: 149044 - DNA, 6 bp, Unknown
  misc_feature (1)..( 6): Result.004 file - promoters60/5667685
tgaaaa

SEQ ID NO: 149045 - DNA, 6 bp, Unknown
  misc_feature (1)..( 6): Result.004 file - promoters60/5667685
tgaaaa

SEQ ID NO: 149046 - DNA, 8 bp, Unknown
  misc_feature (1)..( 8): Result.004 file - promoters60/5667685
gatgcaag

SEQ ID NO: 149047 - DNA, 8 bp, Unknown
  misc_feature (1)..( 8): Result.004 file - promoters60/5667720
gatggaag

SEQ ID NO: 149048 - DNA, 10 bp, Unknown
  misc_feature (1)..( 10): Result.004 file - promoters60/5667720
taatttgttt

SEQ ID NO: 149049 - DNA, 10 bp, Unknown
  misc_feature (1)..( 10): Result.004 file - promoters60/5667720
aaatttgctc

SEQ ID NO: 149050 - DNA, 10 bp, Unknown
  misc_feature (1)..( 10): Result.004 file - promoters60/5667720
taatttacag

SEQ ID NO: 149051 - DNA, 10 bp, Unknown
  misc_feature (1)..( 10): Result.004 file - promoters60/5667720
ttattttttt

SEQ ID NO: 149052 - DNA, 10 bp, Unknown
  misc_feature (1)..( 10): Result.004 file - promoters60/5667720
aaatttctga

SEQ ID NO: 149053 - DNA, 10 bp, Unknown
  misc_feature (1)..( 10): Result.004 file - promoters60/5667720
ctgttttttt

SEQ ID NO: 149054 - DNA, 10 bp, Unknown
  misc_feature (1)..( 10): Result.004 file - promoters60/5667720
tgctttttct

SEQ ID NO: 149055 - DNA, 12 bp, Unknown
  misc_feature (1)..( 12): Result.004 file - promoters60/5667720
gaacattataca

SEQ ID NO: 149056 - DNA, 12 bp, Unknown
  misc_feature (1)..( 12): Result.004 file - promoters60/5667720
taacatttcgtt

SEQ ID NO: 149057 - DNA, 12 bp, Unknown
  misc_feature (1)..( 12): Result.004 file - promoters60/5667720
gaaaatttacct

SEQ ID NO: 149058 - DNA, 12 bp, Unknown
  misc_feature (1)..( 12): Result.004 file - promoters60/5667720
ctacaatataag

SEQ ID NO: 149059 - DNA, 12 bp, Unknown
  misc_feature (1)..( 12): Result.004 file - promoters60/5667720
aaaactttctta

SEQ ID NO: 149060 - DNA, 12 bp, Unknown
  misc_feature (1)..( 12): Result.004 file - promoters60/5667720
ctaaattttata

SEQ ID NO: 149061 - DNA, 12 bp, Unknown
  misc_feature (1)..( 12): Result.004 file - promoters60/5667720
atcacttcctta

SEQ ID NO: 149062 - DNA, 8 bp, Unknown
  misc_feature (1)..( 8): Result.004 file - promoters60/5667720
atttgttt

SEQ ID NO: 149063 - DNA, 8 bp, Unknown
  misc_feature (1)..( 8): Result.004 file - promoters60/5667720
gttttttt

SEQ ID NO: 149064 - DNA, 8 bp, Unknown
  misc_feature (1)..( 8): Result.004 file - promoters60/5667720
cttttttt

SEQ ID NO: 149065 - DNA, 8 bp, Unknown
  misc_feature (1)..( 8): Result.004 file - promoters60/5667720
attttttt

SEQ ID NO: 149066 - DNA, 8 bp, Unknown
  misc_feature (1)..( 8): Result.004 file - promoters60/5667720
ctttttat

SEQ ID NO: 149067 - DNA, 8 bp, Unknown
  misc_feature (1)..( 8): Result.004 file - promoters60/5667720
gtttttct

SEQ ID NO: 149068 - DNA, 10 bp, Unknown
  misc_feature (1)..( 10): Result.004 file - promoters60/5667720
gtataaattg

SEQ ID NO: 149069 - DNA, 10 bp, Unknown
  misc_feature (1)..( 10): Result.004 file - promoters60/5667720
gtataaataa

SEQ ID NO: 149070 - DNA, 10 bp, Unknown
  misc_feature (1)..( 10): Result.004 file - promoters60/5667720
ctataaattg

SEQ ID NO: 149071 - DNA, 10 bp, Unknown
  misc_feature (1)..( 10): Result.004 file - promoters60/5667720
atataaatat

SEQ ID NO: 149072 - DNA, 10 bp, Unknown
  misc_feature (1)..( 10): Result.004 file - promoters60/5667720
ctatatatat

SEQ ID NO: 149073 - DNA, 10 bp, Unknown
  misc_feature (1)..( 10): Result.004 file - promoters60/5667737
ctataaatat

SEQ ID NO: 149074 - DNA, 8 bp, Unknown
  misc_feature (1)..( 8): Result.004 file - promoters60/5667737
ctacaaca

SEQ ID NO: 149075 - DNA, 8 bp, Unknown
  misc_feature (1)..( 8): Result.004 file - promoters60/5667737
ctacaaag

SEQ ID NO: 149076 - DNA, 8 bp, Unknown
  misc_feature (1)..( 8): Result.004 file - promoters60/5667737
ctagaaat

SEQ ID NO: 149077 - DNA, 8 bp, Unknown
  misc_feature (1)..( 8): Result.004 file - promoters60/5667737
ctaaaaag

SEQ ID NO: 149078 - DNA, 14 bp, Unknown
  misc_feature (1)..( 14): Result.004 file - promoters60/5667737
caacaaaaaccaaa

SEQ ID NO: 149079 - DNA, 14 bp, Unknown
  misc_feature (1)..( 14): Result.004 file - promoters60/5667737
ctacaaagaccaaa

SEQ ID NO: 149080 - DNA, 14 bp, Unknown
  misc_feature (1)..( 14): Result.004 file - promoters60/5667737
ctagaaattctatt

SEQ ID NO: 149081 - DNA, 14 bp, Unknown
  misc_feature (1)..( 14): Result.004 file - promoters60/5667741
ctaaaaagtatttt

SEQ ID NO: 149082 - DNA, 6 bp, Unknown
  misc_feature (1)..( 6): Result.004 file - promoters60/5667741
gtttct

SEQ ID NO: 149083 - DNA, 6 bp, Unknown
  misc_feature (1)..( 6): Result.004 file - promoters60/5667741
gtttct

SEQ ID NO: 149084 - DNA, 6 bp, Unknown
  misc_feature (1)..( 6): Result.004 file - promoters60/5667741
tctgtt

SEQ ID NO: 149085 - DNA, 6 bp, Unknown
  misc_feature (1)..( 6): Result.004 file - promoters60/5667741
tctgtt

SEQ ID NO: 149086 - DNA, 7 bp, Unknown
  misc_feature (1)..( 7): Result.004 file - promoters60/5667741
ttcttca

SEQ ID NO: 149087 - DNA, 7 bp, Unknown
  misc_feature (1)..( 7): Result.004 file - promoters60/5667741
ttcttca

SEQ ID NO: 149088 - DNA, 9 bp, Unknown
  misc_feature (1)..( 9): Result.004 file - promoters60/5667741
ctggtatat

SEQ ID NO: 149089 - DNA, 9 bp, Unknown
  misc_feature (1)..( 9): Result.004 file - promoters60/5667741
ctgctatat

SEQ ID NO: 149090 - DNA, 7 bp, Unknown
  misc_feature (1)..( 7): Result.004 file - promoters60/5667741
ttcattt

SEQ ID NO: 149091 - DNA, 7 bp, Unknown
  misc_feature (1)..( 7): Result.004 file - promoters60/5667741
ttctttt

SEQ ID NO: 149092 - DNA, 9 bp, Unknown
  misc_feature (1)..( 9): Result.004 file - promoters60/5667741
gtttttctt

SEQ ID NO: 149093 - DNA, 9 bp, Unknown
  misc_feature (1)..( 9): Result.004 file - promoters60/5667741
gttcttctt

SEQ ID NO: 149094 - DNA, 7 bp, Unknown
  misc_feature (1)..( 7): Result.004 file - promoters60/5667741
gaaaaaa

SEQ ID NO: 149095 - DNA, 7 bp, Unknown
  misc_feature (1)..( 7): Result.004 file - promoters60/5667741
gaagaaa

SEQ ID NO: 149096 - DNA, 7 bp, Unknown
  misc_feature (1)..( 7): Result.004 file - promoters60/5667741
gctgctg

SEQ ID NO: 149097 - DNA, 7 bp, Unknown
  misc_feature (1)..( 7): Result.004 file - promoters60/5667741
gctgctg

SEQ ID NO: 149098 - DNA, 6 bp, Unknown
  misc_feature (1)..( 6): Result.004 file - promoters60/5667741
tgttct

SEQ ID NO: 149099 - DNA, 6 bp, Unknown
  misc_feature (1)..( 6): Result.004 file - promoters60/5667741
tgttct

SEQ ID NO: 149100 - DNA, 9 bp, Unknown
  misc_feature (1)..( 9): Result.004 file - promoters60/5667741
tttaagtct

SEQ ID NO: 149101 - DNA, 9 bp, Unknown
  misc_feature (1)..( 9): Result.004 file - promoters60/5667741
tttaactct

SEQ ID NO: 149102 - DNA, 8 bp, Unknown
  misc_feature (1)..( 8): Result.004 file - promoters60/5667741
gtctacga

SEQ ID NO: 149103 - DNA, 8 bp, Unknown
  misc_feature (1)..( 8): Result.004 file - promoters60/5667741
gtcttcga

SEQ ID NO: 149104 - DNA, 8 bp, Unknown
  misc_feature (1)..( 8): Result.004 file - promoters60/5667741
aatcaagt

SEQ ID NO: 149105 - DNA, 8 bp, Unknown
  misc_feature (1)..( 8): Result.004 file - promoters60/5667741
aattaagt

SEQ ID NO: 149106 - DNA, 9 bp, Unknown
  misc_feature (1)..( 9): Result.004 file - promoters60/5667741
tgggcccat

SEQ ID NO: 149107 - DNA, 9 bp, Unknown
  misc_feature (1)..( 9): Result.004 file - promoters60/5667741
tgggcccat

SEQ ID NO: 149108 - DNA, 6 bp, Unknown
  misc_feature (1)..( 6): Result.004 file - promoters60/5667741
cgtcct

SEQ ID NO: 149109 - DNA, 6 bp, Unknown
  misc_feature (1)..( 6): Result.004 file - promoters60/5667741
cgtcct

SEQ ID NO: 149110 - DNA, 9 bp, Unknown
  misc_feature (1)..( 9): Result.004 file - promoters60/5667741
ttttgtgtt

SEQ ID NO: 149111 - DNA, 9 bp, Unknown
  misc_feature (1)..( 9): Result.004 file - promoters60/5667741
ttttgtgtt

SEQ ID NO: 149112 - DNA, 7 bp, Unknown
  misc_feature (1)..( 7): Result.004 file - promoters60/5667741
ttttgag

SEQ ID NO: 149113 - DNA, 7 bp, Unknown
  misc_feature (1)..( 7): Result.004 file - promoters60/5667766
ttttgag

SEQ ID NO: 149114 - DNA, 6 bp, Unknown
  misc_feature (1)..( 6): Result.004 file - promoters60/5667766
ttacta

SEQ ID NO: 149115 - DNA, 6 bp, Unknown
  misc_feature (1)..( 6): Result.004 file - promoters60/5667766
ttacta

SEQ ID NO: 149116 - DNA, 9 bp, Unknown
  misc_feature (1)..( 9): Result.004 file - promoters60/5667766
tttttaaaa

SEQ ID NO: 149117 - DNA, 9 bp, Unknown
  misc_feature (1)..( 9): Result.004 file - promoters60/5667766
tttgtaaaa

SEQ ID NO: 149118 - DNA, 8 bp, Unknown
  misc_feature (1)..( 8): Result.004 file - promoters60/5667766
aaatccat

SEQ ID NO: 149119 - DNA, 8 bp, Unknown
  misc_feature (1)..( 8): Result.004 file - promoters60/5667766
aaaaccat

SEQ ID NO: 149120 - DNA, 6 bp, Unknown
  misc_feature (1)..( 6): Result.004 file - promoters60/5667766
atctct

SEQ ID NO: 149121 - DNA, 6 bp, Unknown
  misc_feature (1)..( 6): Result.004 file - promoters60/5667766
atctct

SEQ ID NO: 149122 - DNA, 8 bp, Unknown
  misc_feature (1)..( 8): Result.004 file - promoters60/5667766
gatattaa

SEQ ID NO: 149123 - DNA, 8 bp, Unknown
  misc_feature (1)..( 8): Result.004 file - promoters60/5667766
gatgttaa

SEQ ID NO: 149124 - DNA, 6 bp, Unknown
  misc_feature (1)..( 6): Result.004 file - promoters60/5667766
atattc

SEQ ID NO: 149125 - DNA, 6 bp, Unknown
  misc_feature (1)..( 6): Result.004 file - promoters60/5667766
atattc

SEQ ID NO: 149126 - DNA, 8 bp, Unknown
  misc_feature (1)..( 8): Result.004 file - promoters60/5667766
cattcgga

SEQ ID NO: 149127 - DNA, 8 bp, Unknown
  misc_feature (1)..( 8): Result.004 file - promoters60/5667766
catttgga

SEQ ID NO: 149128 - DNA, 7 bp, Unknown
  misc_feature (1)..( 7): Result.004 file - promoters60/5667766
accttaa

SEQ ID NO: 149129 - DNA, 7 bp, Unknown
  misc_feature (1)..( 7): Result.004 file - promoters60/5667766
accataa

SEQ ID NO: 149130 - DNA, 7 bp, Unknown
  misc_feature (1)..( 7): Result.004 file - promoters60/5667766
caataaa

SEQ ID NO: 149131 - DNA, 7 bp, Unknown
  misc_feature (1)..( 7): Result.004 file - promoters60/5667766
caacaaa

SEQ ID NO: 149132 - DNA, 6 bp, Unknown
  misc_feature (1)..( 6): Result.004 file - promoters60/5667766
gaatgg

SEQ ID NO: 149133 - DNA, 6 bp, Unknown
  misc_feature (1)..( 6): Result.004 file - promoters60/5667766
gaatgg

SEQ ID NO: 149134 - DNA, 9 bp, Unknown
  misc_feature (1)..( 9): Result.004 file - promoters60/5667766
atttttgtt

SEQ ID NO: 149135 - DNA, 9 bp, Unknown
  misc_feature (1)..( 9): Result.004 file - promoters60/5667766
attgttgtt

SEQ ID NO: 149136 - DNA, 6 bp, Unknown
  misc_feature (1)..( 6): Result.004 file - promoters60/5667766
cgaaac

SEQ ID NO: 149137 - DNA, 6 bp, Unknown
  misc_feature (1)..( 6): Result.004 file - promoters60/5667766
cgaaac

SEQ ID NO: 149138 - DNA, 7 bp, Unknown
  misc_feature (1)..( 7): Result.004 file - promoters60/5667766
aaaactt

SEQ ID NO: 149139 - DNA, 7 bp, Unknown
  misc_feature (1)..( 7): Result.004 file - promoters60/5667785
aaacctt

SEQ ID NO: 149140 - DNA, 7 bp, Unknown
  misc_feature (1)..( 7): Result.004 file - promoters60/5667785
actaatt

SEQ ID NO: 149141 - DNA, 7 bp, Unknown
  misc_feature (1)..( 7): Result.004 file - promoters60/5667785
actgatt

SEQ ID NO: 149142 - DNA, 6 bp, Unknown
  misc_feature (1)..( 6): Result.004 file - promoters60/5667785
caaaaa

SEQ ID NO: 149143 - DNA, 6 bp, Unknown
  misc_feature (1)..( 6): Result.004 file - promoters60/5667785
caaaaa

SEQ ID NO: 149144 - DNA, 8 bp, Unknown
  misc_feature (1)..( 8): Result.004 file - promoters60/5667785
aaaagtat

SEQ ID NO: 149145 - DNA, 8 bp, Unknown
  misc_feature (1)..( 8): Result.004 file - promoters60/5667785
aaaaatat

SEQ ID NO: 149146 - DNA, 7 bp, Unknown
  misc_feature (1)..( 7): Result.004 file - promoters60/5667785
aaacata

SEQ ID NO: 149147 - DNA, 7 bp, Unknown
  misc_feature (1)..( 7): Result.004 file - promoters60/5667785
aaagata

SEQ ID NO: 149148 - DNA, 7 bp, Unknown
  misc_feature (1)..( 7): Result.004 file - promoters60/5667785
attaatg

SEQ ID NO: 149149 - DNA, 7 bp, Unknown
  misc_feature (1)..( 7): Result.004 file - promoters60/5667785
attaatg

SEQ ID NO: 149150 - DNA, 7 bp, Unknown
  misc_feature (1)..( 7): Result.004 file - promoters60/5667785
ttctaaa

SEQ ID NO: 149151 - DNA, 7 bp, Unknown
  misc_feature (1)..( 7): Result.004 file - promoters60/5667785
ttccaaa

SEQ ID NO: 149152 - DNA, 6 bp, Unknown
  misc_feature (1)..( 6): Result.004 file - promoters60/5667785
ccaaac

SEQ ID NO: 149153 - DNA, 6 bp, Unknown
  misc_feature (1)..( 6): Result.004 file - promoters60/5667785
ccaaac

SEQ ID NO: 149154 - DNA, 6 bp, Unknown
  misc_feature (1)..( 6): Result.004 file - promoters60/5667785
ggtttt

SEQ ID NO: 149155 - DNA, 6 bp, Unknown
  misc_feature (1)..( 6): Result.004 file - promoters60/5667785
ggtttt

SEQ ID NO: 149156 - DNA, 6 bp, Unknown
  misc_feature (1)..( 6): Result.004 file - promoters60/5667785
ttaatt

SEQ ID NO: 149157 - DNA, 6 bp, Unknown
  misc_feature (1)..( 6): Result.004 file - promoters60/5667785
ttaatt

SEQ ID NO: 149158 - DNA, 8 bp, Unknown
  misc_feature (1)..( 8): Result.004 file - promoters60/5667785
gttagtat

SEQ ID NO: 149159 - DNA, 8 bp, Unknown
  misc_feature (1)..( 8): Result.004 file - promoters60/5667785
gttcgtat

SEQ ID NO: 149160 - DNA, 6 bp, Unknown
  misc_feature (1)..( 6): Result.004 file - promoters60/5667785
ttggcg

SEQ ID NO: 149161 - DNA, 6 bp, Unknown
  misc_feature (1)..( 6): Result.004 file - promoters60/5667785
ttggcg

SEQ ID NO: 149162 - DNA, 7 bp, Unknown
  misc_feature (1)..( 7): Result.004 file - promoters60/5667785
atattta
